United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 29

SEQ ID NO: 1272037 - RNA, 19 nt, Human
agcuacagagaaaccagcu

SEQ ID NO: 1272038 - RNA, 20 nt, Human
agcuacagagaaaccagcuu

SEQ ID NO: 1272039 - RNA, 21 nt, Human
agcuacagagaaaccagcuuc

SEQ ID NO: 1272040 - RNA, 22 nt, Human
agcuacagagaaaccagcuucc

SEQ ID NO: 1272041 - RNA, 23 nt, Human
agcuacagagaaaccagcuuccu

SEQ ID NO: 1272042 - RNA, 16 nt, Human
agcuagucuuuugcuu

SEQ ID NO: 1272043 - RNA, 15 nt, Human
agcuacauaauuuag

SEQ ID NO: 1272044 - RNA, 20 nt, Human
agcuacccuuuuucuccagc

SEQ ID NO: 1272045 - RNA, 16 nt, Human
ugccccauucaacauc

SEQ ID NO: 1272046 - RNA, 21 nt, Human
ugcccccaaccauuuccucag

SEQ ID NO: 1272047 - RNA, 16 nt, Human
ugcccccaaccauuuc

SEQ ID NO: 1272048 - RNA, 12 nt, Human
ugcccccacccc

SEQ ID NO: 1272049 - RNA, 21 nt, Human
ugcccccuaauccccuucucc

SEQ ID NO: 1272050 - RNA, 23 nt, Human
ugcccccuaauccccuucucccc

SEQ ID NO: 1272051 - RNA, 14 nt, Human
ugcccccucugccc

SEQ ID NO: 1272052 - RNA, 15 nt, Human
ugcccccucugcccu

SEQ ID NO: 1272053 - RNA, 16 nt, Human
ugcccccucugcccug

SEQ ID NO: 1272054 - RNA, 17 nt, Human
ugcccccucugcccugc

SEQ ID NO: 1272055 - RNA, 18 nt, Human
ugcccccucugcccugcg

SEQ ID NO: 1272056 - RNA, 12 nt, Human
ugcccccugcag

SEQ ID NO: 1272057 - RNA, 13 nt, Human
ugcccccugcaga

SEQ ID NO: 1272058 - RNA, 14 nt, Human
ugcccccugcagaa

SEQ ID NO: 1272059 - RNA, 22 nt, Human
ugcccccugcagaaccggagag

SEQ ID NO: 1272060 - RNA, 13 nt, Human
ugcccccugcagg

SEQ ID NO: 1272061 - RNA, 23 nt, Human
ugccauuuguacugaccccauca

SEQ ID NO: 1272062 - RNA, 23 nt, Human
ugcccaaagcagcacuuauaaau

SEQ ID NO: 1272063 - RNA, 20 nt, Human
ugcccaaauccuuagaucug

SEQ ID NO: 1272064 - RNA, 19 nt, Human
ugcccaacccuucccucac

SEQ ID NO: 1272065 - RNA, 11 nt, Human
ugcccaggaga

SEQ ID NO: 1272066 - RNA, 12 nt, Human
ugcccaggagaa

SEQ ID NO: 1272067 - RNA, 23 nt, Human
agccucagcucucaguugcagcc

SEQ ID NO: 1272068 - RNA, 13 nt, Human
agccucaggacug

SEQ ID NO: 1272069 - RNA, 16 nt, Human
agccucaggacuggga

SEQ ID NO: 1272070 - RNA, 17 nt, Human
agccucaggacugggag

SEQ ID NO: 1272071 - RNA, 18 nt, Human
agccucaggacugggagc

SEQ ID NO: 1272072 - RNA, 19 nt, Human
agccucaggacugggagcc

SEQ ID NO: 1272073 - RNA, 21 nt, Human
agccucaggacugggagcccc

SEQ ID NO: 1272074 - RNA, 23 nt, Human
agccucaggacugggagccccca

SEQ ID NO: 1272075 - RNA, 23 nt, Human
agccucaggggucugagcuccag

SEQ ID NO: 1272076 - RNA, 20 nt, Human
agccucaggggucugagcuc

SEQ ID NO: 1272077 - RNA, 23 nt, Human
agccucacuuuuaaugaacaaau

SEQ ID NO: 1272078 - RNA, 22 nt, Human
agccucacuuuuaaugaacaaa

SEQ ID NO: 1272079 - RNA, 20 nt, Human
agccucagagacaucagccc

SEQ ID NO: 1272080 - RNA, 23 nt, Human
agccucagagacaucagcccuug

SEQ ID NO: 1272081 - RNA, 14 nt, Human
agccucagauuccu

SEQ ID NO: 1272082 - RNA, 16 nt, Human
agccucagauuccuuc

SEQ ID NO: 1272083 - RNA, 17 nt, Human
agccucagauuccuucc

SEQ ID NO: 1272084 - RNA, 23 nt, Human
agccucagauuccuucccaugga

SEQ ID NO: 1272085 - RNA, 18 nt, Human
agccucagauuccuuccc

SEQ ID NO: 1272086 - RNA, 13 nt, Human
agccucagucucc

SEQ ID NO: 1272087 - RNA, 16 nt, Human
agccucagucucccuc

SEQ ID NO: 1272088 - RNA, 19 nt, Human
agccucagucucccucccu

SEQ ID NO: 1272089 - RNA, 20 nt, Human
agccucagucucccucccuu

SEQ ID NO: 1272090 - RNA, 22 nt, Human
agccucagucucccucccuugg

SEQ ID NO: 1272091 - RNA, 20 nt, Human
agccucagugacccuggcuc

SEQ ID NO: 1272092 - RNA, 21 nt, Human
agccucagugacccuggcucc

SEQ ID NO: 1272093 - RNA, 14 nt, Human
agcccuuuugucuc

SEQ ID NO: 1272094 - RNA, 15 nt, Human
agcccuuuugucucu

SEQ ID NO: 1272095 - RNA, 21 nt, Human
agccucaagguuuuagguucu

SEQ ID NO: 1272096 - RNA, 22 nt, Human
agccucaagguuuuagguucua

SEQ ID NO: 1272097 - RNA, 23 nt, Human
agccucaagguuuuagguucuaa

SEQ ID NO: 1272098 - RNA, 15 nt, Human
agccucaauuucuga

SEQ ID NO: 1272099 - RNA, 22 nt, Human
agccucugcagcggaaucuguu

SEQ ID NO: 1272100 - RNA, 18 nt, Human
agccucugcccaggcacu

SEQ ID NO: 1272101 - RNA, 22 nt, Human
agccucugcccaggcacugcua

SEQ ID NO: 1272102 - RNA, 21 nt, Human
agccuccaagcuccaucucca

SEQ ID NO: 1272103 - RNA, 14 nt, Human
agccuccaauuuuu

SEQ ID NO: 1272104 - RNA, 17 nt, Human
agccuccaugcugccuc

SEQ ID NO: 1272105 - RNA, 22 nt, Human
agccuccaccccacaacccaaa

SEQ ID NO: 1272106 - RNA, 22 nt, Human
agccucuggcauuagaauuauu

SEQ ID NO: 1272107 - RNA, 23 nt, Human
agccucuggcauuagaauuauuu

SEQ ID NO: 1272108 - RNA, 13 nt, Human
agccucugggggg

SEQ ID NO: 1272109 - RNA, 20 nt, Human
agccucugggggguggccag

SEQ ID NO: 1272110 - RNA, 21 nt, Human
agccucugggggguggccagg

SEQ ID NO: 1272111 - RNA, 22 nt, Human
agccucugggggguggccaggc

SEQ ID NO: 1272112 - RNA, 15 nt, Human
ugcagaagacaguau

SEQ ID NO: 1272113 - RNA, 14 nt, Human
ugcagaagacagua

SEQ ID NO: 1272114 - RNA, 22 nt, Human
ugcagaagacaguauggcagcu

SEQ ID NO: 1272115 - RNA, 16 nt, Human
ugcagaagaaggcauc

SEQ ID NO: 1272116 - RNA, 17 nt, Human
ugcagaagaaggcaucg

SEQ ID NO: 1272117 - RNA, 23 nt, Human
ugcagaccacgcccguccugccu

SEQ ID NO: 1272118 - RNA, 15 nt, Human
ugcagacccugcccu

SEQ ID NO: 1272119 - RNA, 19 nt, Human
ugcagacccugcccuuguu

SEQ ID NO: 1272120 - RNA, 14 nt, Human
ugcagacucacugu

SEQ ID NO: 1272121 - RNA, 14 nt, Human
agcccuguccuggu

SEQ ID NO: 1272122 - RNA, 16 nt, Human
agcccuguccuggugg

SEQ ID NO: 1272123 - RNA, 17 nt, Human
agcccuguccugguggu

SEQ ID NO: 1272124 - RNA, 23 nt, Human
agcccuguccuggugguauuuuc

SEQ ID NO: 1272125 - RNA, 21 nt, Human
agcccuguccuggugguauuu

SEQ ID NO: 1272126 - RNA, 14 nt, Human
agcccuuggggguc

SEQ ID NO: 1272127 - RNA, 21 nt, Human
agcccuuggggguccuccucc

SEQ ID NO: 1272128 - RNA, 22 nt, Human
agcccuuggggguccuccucca

SEQ ID NO: 1272129 - RNA, 23 nt, Human
agcccuuggggguccuccuccag

SEQ ID NO: 1272130 - RNA, 21 nt, Human
agcccuugugaaucaaggguc

SEQ ID NO: 1272131 - RNA, 15 nt, Human
agcccuuuccaagcu

SEQ ID NO: 1272132 - RNA, 23 nt, Human
agcccauucauuccauucuggaa

SEQ ID NO: 1272133 - RNA, 22 nt, Human
agcccauucauuccauucugga

SEQ ID NO: 1272134 - RNA, 17 nt, Human
agcccauucauuccauu

SEQ ID NO: 1272135 - RNA, 14 nt, Human
agcccauucauucc

SEQ ID NO: 1272136 - RNA, 16 nt, Human
agcccagggaggccga

SEQ ID NO: 1272137 - RNA, 14 nt, Human
agcccagggcuccu

SEQ ID NO: 1272138 - RNA, 15 nt, Human
agcccagggcuccug

SEQ ID NO: 1272139 - RNA, 16 nt, Human
agcccagggcuccugc

SEQ ID NO: 1272140 - RNA, 17 nt, Human
agcccagggcuccugca

SEQ ID NO: 1272141 - RNA, 23 nt, Human
agcccagggcuccugcacuuacu

SEQ ID NO: 1272142 - RNA, 19 nt, Human
agcccaggauacuggcaca

SEQ ID NO: 1272143 - RNA, 23 nt, Human
agcccaggauacuggcacagagg

SEQ ID NO: 1272144 - RNA, 21 nt, Human
agcccaggauacuggcacaga

SEQ ID NO: 1272145 - RNA, 13 nt, Human
agcccaggccagg

SEQ ID NO: 1272146 - RNA, 14 nt, Human
agcccaggccagga

SEQ ID NO: 1272147 - RNA, 15 nt, Human
agcccaggccaggac

SEQ ID NO: 1272148 - RNA, 16 nt, Human
agcccaggccaggacu

SEQ ID NO: 1272149 - RNA, 22 nt, Human
agcccaggccaggacucugcag

SEQ ID NO: 1272150 - RNA, 19 nt, Human
agcccaggccaggacucug

SEQ ID NO: 1272151 - RNA, 20 nt, Human
agcccaggccaggacucugc

SEQ ID NO: 1272152 - RNA, 21 nt, Human
agcccaggccaggacucugca

SEQ ID NO: 1272153 - RNA, 20 nt, Human
agcccaggcucggccugccc

SEQ ID NO: 1272154 - RNA, 16 nt, Human
agcccauuguggccua

SEQ ID NO: 1272155 - RNA, 22 nt, Human
agcccauuguggccuaagaggc

SEQ ID NO: 1272156 - RNA, 19 nt, Human
agcccauuguggccuaaga

SEQ ID NO: 1272157 - RNA, 15 nt, Human
ugauuuguacugaaa

SEQ ID NO: 1272158 - RNA, 18 nt, Human
ugauuuguacugaaaaau

SEQ ID NO: 1272159 - RNA, 17 nt, Human
ugauuuguaacccacug

SEQ ID NO: 1272160 - RNA, 22 nt, Human
ugcaaaccugaccccugcucag

SEQ ID NO: 1272161 - RNA, 23 nt, Human
ugcaaaccugaccccugcucagu

SEQ ID NO: 1272162 - RNA, 20 nt, Human
ugcaaacucuuuggucguuu

SEQ ID NO: 1272163 - RNA, 11 nt, Human
ugcaaacuggg

SEQ ID NO: 1272164 - RNA, 13 nt, Human
ugcaaacugggaa

SEQ ID NO: 1272165 - RNA, 23 nt, Human
ugcaaacugggaaccccuuuccc

SEQ ID NO: 1272166 - RNA, 22 nt, Human
ugcaaacugggaaccccuuucc

SEQ ID NO: 1272167 - RNA, 23 nt, Human
ugcaagucaguccaggaugcuaa

SEQ ID NO: 1272168 - RNA, 23 nt, Human
ugcaauacaaguuucauccagaa

SEQ ID NO: 1272169 - RNA, 18 nt, Human
ugcaauacaaguuucauc

SEQ ID NO: 1272170 - RNA, 14 nt, Human
ugcaauacauacca

SEQ ID NO: 1272171 - RNA, 16 nt, Human
ugcaauagaaggugau

SEQ ID NO: 1272172 - RNA, 15 nt, Human
ugcaauauacuggaa

SEQ ID NO: 1272173 - RNA, 20 nt, Human
ugcaauauacuggaaagcuu

SEQ ID NO: 1272174 - RNA, 16 nt, Human
ugcaauauacuggaaa

SEQ ID NO: 1272175 - RNA, 12 nt, Human
agcccaggagcu

SEQ ID NO: 1272176 - RNA, 14 nt, Human
agcccaggagcucc

SEQ ID NO: 1272177 - RNA, 18 nt, Human
agcccaggagcuccccuc

SEQ ID NO: 1272178 - RNA, 19 nt, Human
agcccaggagcuccccucc

SEQ ID NO: 1272179 - RNA, 23 nt, Human
agcccaggagcuccccuccccaa

SEQ ID NO: 1272180 - RNA, 17 nt, Human
ugcaauacaaguuucau

SEQ ID NO: 1272181 - RNA, 16 nt, Human
ugcaauacaaguuuca

SEQ ID NO: 1272182 - RNA, 21 nt, Human
ugcaauaaaucugacccagug

SEQ ID NO: 1272183 - RNA, 23 nt, Human
ugcaauaaaucugacccagugcc

SEQ ID NO: 1272184 - RNA, 20 nt, Human
ugcaauaaaucugacccagu

SEQ ID NO: 1272185 - RNA, 17 nt, Human
agcccugggaggcucug

SEQ ID NO: 1272186 - RNA, 20 nt, Human
agcccugggaccgcuacacc

SEQ ID NO: 1272187 - RNA, 11 nt, Human
agcccugggac

SEQ ID NO: 1272188 - RNA, 13 nt, Human
agcccugggaccg

SEQ ID NO: 1272189 - RNA, 14 nt, Human
agcccugggaccgc

SEQ ID NO: 1272190 - RNA, 15 nt, Human
agcccugggaccgcu

SEQ ID NO: 1272191 - RNA, 19 nt, Human
agcccugcugcugccugcc

SEQ ID NO: 1272192 - RNA, 18 nt, Human
agcccugcugcugccugc

SEQ ID NO: 1272193 - RNA, 22 nt, Human
agcccugccuggaggaccugag

SEQ ID NO: 1272194 - RNA, 20 nt, Human
agcccugcugcugccugccu

SEQ ID NO: 1272195 - RNA, 17 nt, Human
agcccugcuuugggcug

SEQ ID NO: 1272196 - RNA, 15 nt, Human
agcccggcuccuggu

SEQ ID NO: 1272197 - RNA, 16 nt, Human
agcccggcuccugguc

SEQ ID NO: 1272198 - RNA, 20 nt, Human
agcccugccuggaggaccug

SEQ ID NO: 1272199 - RNA, 21 nt, Human
agcccugccuggaggaccuga

SEQ ID NO: 1272200 - RNA, 23 nt, Human
agcccugccuggaggaccugagc

SEQ ID NO: 1272201 - RNA, 12 nt, Human
agcccggcuccu

SEQ ID NO: 1272202 - RNA, 13 nt, Human
agcccggcuccug

SEQ ID NO: 1272203 - RNA, 14 nt, Human
agcccggcuccugg

SEQ ID NO: 1272204 - RNA, 19 nt, Human
agcccugcuuugggcugcc

SEQ ID NO: 1272205 - RNA, 20 nt, Human
agcccugcuuugggcugccc

SEQ ID NO: 1272206 - RNA, 22 nt, Human
agcccuggcaugucaacagcgu

SEQ ID NO: 1272207 - RNA, 19 nt, Human
agcccccuaagagagcacc

SEQ ID NO: 1272208 - RNA, 11 nt, Human
agcccccucac

SEQ ID NO: 1272209 - RNA, 14 nt, Human
agcccccucacagu

SEQ ID NO: 1272210 - RNA, 22 nt, Human
agcccccucacaguauugcuca

SEQ ID NO: 1272211 - RNA, 23 nt, Human
agcccccucacaguauugcucac

SEQ ID NO: 1272212 - RNA, 13 nt, Human
agcccccuccugg

SEQ ID NO: 1272213 - RNA, 20 nt, Human
agcccccuccuggugccacc

SEQ ID NO: 1272214 - RNA, 21 nt, Human
agcccccuccuggugccaccu

SEQ ID NO: 1272215 - RNA, 12 nt, Human
agcccccugacc

SEQ ID NO: 1272216 - RNA, 19 nt, Human
agcccccugaccacucaga

SEQ ID NO: 1272217 - RNA, 20 nt, Human
agcccccugaccacucagag

SEQ ID NO: 1272218 - RNA, 21 nt, Human
agcccccugaccacucagaga

SEQ ID NO: 1272219 - RNA, 21 nt, Human
agccccucuggucgcuccugc

SEQ ID NO: 1272220 - RNA, 22 nt, Human
agccccucuggucgcuccugcc

SEQ ID NO: 1272221 - RNA, 22 nt, Human
agcccccugaccacucagagac

SEQ ID NO: 1272222 - RNA, 15 nt, Human
agccccucuuggaga

SEQ ID NO: 1272223 - RNA, 17 nt, Human
agccccucuuggagaag

SEQ ID NO: 1272224 - RNA, 18 nt, Human
agccccucuuggagaagu

SEQ ID NO: 1272225 - RNA, 20 nt, Human
agccccucuuggagaagucu

SEQ ID NO: 1272226 - RNA, 23 nt, Human
agccccucuuggagaagucucag

SEQ ID NO: 1272227 - RNA, 16 nt, Human
agccccugaaagccau

SEQ ID NO: 1272228 - RNA, 14 nt, Human
agccccugccauug

SEQ ID NO: 1272229 - RNA, 14 nt, Human
agccccugaaagcc

SEQ ID NO: 1272230 - RNA, 14 nt, Human
agccccuuucccuu

SEQ ID NO: 1272231 - RNA, 21 nt, Human
agccccuuucccuuguagcuc

SEQ ID NO: 1272232 - RNA, 23 nt, Human
agccccuuucccuuguagcuccu

SEQ ID NO: 1272233 - RNA, 14 nt, Human
agcccgaggaggug

SEQ ID NO: 1272234 - RNA, 15 nt, Human
agcccgcacaccugc

SEQ ID NO: 1272235 - RNA, 16 nt, Human
agcccacuguacuugc

SEQ ID NO: 1272236 - RNA, 20 nt, Human
agccauggagauucucauaa

SEQ ID NO: 1272237 - RNA, 14 nt, Human
agcccacuguccug

SEQ ID NO: 1272238 - RNA, 14 nt, Human
agcccacuguacuu

SEQ ID NO: 1272239 - RNA, 18 nt, Human
agccaugcuggaaaauaa

SEQ ID NO: 1272240 - RNA, 19 nt, Human
agccauggagauucucaua

SEQ ID NO: 1272241 - RNA, 22 nt, Human
agccauggagauucucauaacu

SEQ ID NO: 1272242 - RNA, 18 nt, Human
agccaucccgucuucucc

SEQ ID NO: 1272243 - RNA, 21 nt, Human
agccaugagaugauacaucca

SEQ ID NO: 1272244 - RNA, 23 nt, Human
agccaugaguuccagaaaguaaa

SEQ ID NO: 1272245 - RNA, 16 nt, Human
agccaugcgcccccuc

SEQ ID NO: 1272246 - RNA, 23 nt, Human
agccaugcgcccccuccgcccug

SEQ ID NO: 1272247 - RNA, 15 nt, Human
agcccacuguccugg

SEQ ID NO: 1272248 - RNA, 17 nt, Human
agcccacuguccugggc

SEQ ID NO: 1272249 - RNA, 18 nt, Human
agcccacuguccugggcc

SEQ ID NO: 1272250 - RNA, 19 nt, Human
agcccacuguccugggccu

SEQ ID NO: 1272251 - RNA, 20 nt, Human
agcccacuguccugggccug

SEQ ID NO: 1272252 - RNA, 22 nt, Human
agcccacuguccugggccugca

SEQ ID NO: 1272253 - RNA, 23 nt, Human
agcccacuguccugggccugcag

SEQ ID NO: 1272254 - RNA, 15 nt, Human
agcccagagggucug

SEQ ID NO: 1272255 - RNA, 17 nt, Human
agcccagagggucuggg

SEQ ID NO: 1272256 - RNA, 20 nt, Human
agcccagagggucugggggc

SEQ ID NO: 1272257 - RNA, 21 nt, Human
agcccagagggucugggggca

SEQ ID NO: 1272258 - RNA, 15 nt, Human
agcccagcacugcuu

SEQ ID NO: 1272259 - RNA, 12 nt, Human
agccaggucccu

SEQ ID NO: 1272260 - RNA, 18 nt, Human
agccagguuccacagagg

SEQ ID NO: 1272261 - RNA, 13 nt, Human
agccagggcucaa

SEQ ID NO: 1272262 - RNA, 15 nt, Human
agccaggucccucuc

SEQ ID NO: 1272263 - RNA, 18 nt, Human
agccaucaaaaugcuuuu

SEQ ID NO: 1272264 - RNA, 17 nt, Human
agccaucaagagacuga

SEQ ID NO: 1272265 - RNA, 15 nt, Human
agccaucaccucaga

SEQ ID NO: 1272266 - RNA, 16 nt, Human
agccaucaccucagau

SEQ ID NO: 1272267 - RNA, 18 nt, Human
agccaucaccucagaugg

SEQ ID NO: 1272268 - RNA, 19 nt, Human
agccaucaccucagauggc

SEQ ID NO: 1272269 - RNA, 21 nt, Human
agccaucaccucagauggcag

SEQ ID NO: 1272270 - RNA, 22 nt, Human
agccaucaccucagauggcagc

SEQ ID NO: 1272271 - RNA, 14 nt, Human
agccaucaccuuag

SEQ ID NO: 1272272 - RNA, 18 nt, Human
agccaucaccuuagacca

SEQ ID NO: 1272273 - RNA, 16 nt, Human
agccagcguccuccuc

SEQ ID NO: 1272274 - RNA, 17 nt, Human
agccagcguccuccucu

SEQ ID NO: 1272275 - RNA, 18 nt, Human
agccagcguccuccucug

SEQ ID NO: 1272276 - RNA, 19 nt, Human
agccagcguccuccucugu

SEQ ID NO: 1272277 - RNA, 21 nt, Human
agccagcguccuccucuguga

SEQ ID NO: 1272278 - RNA, 23 nt, Human
agccagcguccuccucugugacc

SEQ ID NO: 1272279 - RNA, 20 nt, Human
agccagcgucggucugugcc

SEQ ID NO: 1272280 - RNA, 23 nt, Human
agccagcuaagggguggggcugc

SEQ ID NO: 1272281 - RNA, 22 nt, Human
agccagcgucggucugugcccc

SEQ ID NO: 1272282 - RNA, 15 nt, Human
agccagggagagccc

SEQ ID NO: 1272283 - RNA, 16 nt, Human
agccagggagagccca

SEQ ID NO: 1272284 - RNA, 17 nt, Human
agccagggagagcccag

SEQ ID NO: 1272285 - RNA, 18 nt, Human
agccagggagagcccagg

SEQ ID NO: 1272286 - RNA, 19 nt, Human
agccagggagagcccagga

SEQ ID NO: 1272287 - RNA, 20 nt, Human
agccagggagagcccaggag

SEQ ID NO: 1272288 - RNA, 21 nt, Human
agccagggagagcccaggagc

SEQ ID NO: 1272289 - RNA, 22 nt, Human
agccagggagagcccaggagcu

SEQ ID NO: 1272290 - RNA, 13 nt, Human
ugauuuccuugaa

SEQ ID NO: 1272291 - RNA, 14 nt, Human
ugauuuccuugaau

SEQ ID NO: 1272292 - RNA, 15 nt, Human
ugauuuccuugaaug

SEQ ID NO: 1272293 - RNA, 16 nt, Human
ugauuuccuugaaugu

SEQ ID NO: 1272294 - RNA, 17 nt, Human
ugauuuccuugaaugug

SEQ ID NO: 1272295 - RNA, 19 nt, Human
ugauuuccuugaauguggc

SEQ ID NO: 1272296 - RNA, 23 nt, Human
ugauuuccuugaauguggcuuga

SEQ ID NO: 1272297 - RNA, 11 nt, Human
ugauuucuagg

SEQ ID NO: 1272298 - RNA, 17 nt, Human
ugauuugaagaacaugu

SEQ ID NO: 1272299 - RNA, 19 nt, Human
ugauuugaagaacauguga

SEQ ID NO: 1272300 - RNA, 20 nt, Human
ugauuuguaacccacugaga

SEQ ID NO: 1272301 - RNA, 13 nt, Human
ugauuucauucaa

SEQ ID NO: 1272302 - RNA, 15 nt, Human
ugauuucauuaauac

SEQ ID NO: 1272303 - RNA, 18 nt, Human
ugauuucauguacugcau

SEQ ID NO: 1272304 - RNA, 17 nt, Human
ugauuucauguacugca

SEQ ID NO: 1272305 - RNA, 16 nt, Human
ugauuucauguacugc

SEQ ID NO: 1272306 - RNA, 15 nt, Human
ugauuucauguacug

SEQ ID NO: 1272307 - RNA, 13 nt, Human
ugauuucauguac

SEQ ID NO: 1272308 - RNA, 21 nt, Human
ugauuucaguucuaggaaaau

SEQ ID NO: 1272309 - RNA, 19 nt, Human
ugauuucaguucuaggaaa

SEQ ID NO: 1272310 - RNA, 20 nt, Human
ugauuucaguucuaggaaaa

SEQ ID NO: 1272311 - RNA, 22 nt, Human
ugauuucaguagcacaaguuau

SEQ ID NO: 1272312 - RNA, 15 nt, Human
ugauuucaguucuag

SEQ ID NO: 1272313 - RNA, 18 nt, Human
ugauuucaguucuaggaa

SEQ ID NO: 1272314 - RNA, 17 nt, Human
ugauuucagcucacugc

SEQ ID NO: 1272315 - RNA, 21 nt, Human
ugauuuaggagaagccaggaa

SEQ ID NO: 1272316 - RNA, 22 nt, Human
ugauuuaggagaagccaggaau

SEQ ID NO: 1272317 - RNA, 16 nt, Human
ugauuuacgcucauug

SEQ ID NO: 1272318 - RNA, 16 nt, Human
ugauuuaggagaagcc

SEQ ID NO: 1272319 - RNA, 20 nt, Human
ugauuuaggagaagccagga

SEQ ID NO: 1272320 - RNA, 23 nt, Human
agcccagcuugaaaccuucacuu

SEQ ID NO: 1272321 - RNA, 21 nt, Human
agcccagcugggucaggcagg

SEQ ID NO: 1272322 - RNA, 21 nt, Human
agcccagcacugcuugaggaa

SEQ ID NO: 1272323 - RNA, 11 nt, Human
agcccagccag

SEQ ID NO: 1272324 - RNA, 12 nt, Human
agcccagccagc

SEQ ID NO: 1272325 - RNA, 19 nt, Human
agcccagcugggucaggca

SEQ ID NO: 1272326 - RNA, 20 nt, Human
agcccagcugggucaggcag

SEQ ID NO: 1272327 - RNA, 16 nt, Human
ugauucauaguaacuu

SEQ ID NO: 1272328 - RNA, 18 nt, Human
ugauucauaguaacuucu

SEQ ID NO: 1272329 - RNA, 16 nt, Human
ugauucucaugccuca

SEQ ID NO: 1272330 - RNA, 13 nt, Human
ugauucucaugcc

SEQ ID NO: 1272331 - RNA, 14 nt, Human
ugauucucaugccu

SEQ ID NO: 1272332 - RNA, 15 nt, Human
ugauucucaugccuc

SEQ ID NO: 1272333 - RNA, 19 nt, Human
ugauucauaguaacuucuu

SEQ ID NO: 1272334 - RNA, 19 nt, Human
ugauucaugccaauuagca

SEQ ID NO: 1272335 - RNA, 17 nt, Human
ugauucauuuuaacauc

SEQ ID NO: 1272336 - RNA, 17 nt, Human
ugauggagaaggaaggc

SEQ ID NO: 1272337 - RNA, 14 nt, Human
ugauggagugcugu

SEQ ID NO: 1272338 - RNA, 21 nt, Human
ugaugggaaguccggccccag

SEQ ID NO: 1272339 - RNA, 14 nt, Human
ugaugggauuuggu

SEQ ID NO: 1272340 - RNA, 16 nt, Human
ugaugggauucuggac

SEQ ID NO: 1272341 - RNA, 17 nt, Human
ugaugggauucuggaca

SEQ ID NO: 1272342 - RNA, 16 nt, Human
ugauggagugcuguuu

SEQ ID NO: 1272343 - RNA, 16 nt, Human
ugauggagaaggaagg

SEQ ID NO: 1272344 - RNA, 15 nt, Human
ugauggagaaggaag

SEQ ID NO: 1272345 - RNA, 14 nt, Human
ugauggagaaggaa

SEQ ID NO: 1272346 - RNA, 13 nt, Human
ugauggagaagga

SEQ ID NO: 1272347 - RNA, 16 nt, Human
ugauggcaacagaucu

SEQ ID NO: 1272348 - RNA, 12 nt, Human
ugauggagaagg

SEQ ID NO: 1272349 - RNA, 15 nt, Human
ugauggaacacagaa

SEQ ID NO: 1272350 - RNA, 11 nt, Human
ugaugaagaag

SEQ ID NO: 1272351 - RNA, 12 nt, Human
ugaugaagaagu

SEQ ID NO: 1272352 - RNA, 16 nt, Human
ugauccuggaggccca

SEQ ID NO: 1272353 - RNA, 17 nt, Human
ugauccuggaggcccag

SEQ ID NO: 1272354 - RNA, 18 nt, Human
ugauccuggaggcccagu

SEQ ID NO: 1272355 - RNA, 20 nt, Human
ugauccuggaggcccaguuc

SEQ ID NO: 1272356 - RNA, 18 nt, Human
ugaugaacucuuaaucaa

SEQ ID NO: 1272357 - RNA, 14 nt, Human
ugaugaccaaaguc

SEQ ID NO: 1272358 - RNA, 15 nt, Human
ugaugacccuuuuca

SEQ ID NO: 1272359 - RNA, 16 nt, Human
ugaugacccuuuucau

SEQ ID NO: 1272360 - RNA, 21 nt, Human
ugaugacuuaguacaaaguuu

SEQ ID NO: 1272361 - RNA, 23 nt, Human
ugaugacuuucuuuuuguagcug

SEQ ID NO: 1272362 - RNA, 18 nt, Human
agcaccugcccuaccugc

SEQ ID NO: 1272363 - RNA, 22 nt, Human
agcaccugcccuaccugcccca

SEQ ID NO: 1272364 - RNA, 14 nt, Human
ugauccuggaggcc

SEQ ID NO: 1272365 - RNA, 15 nt, Human
ugauccuggaggccc

SEQ ID NO: 1272366 - RNA, 23 nt, Human
ugauuaaguaaugauaacuggaa

SEQ ID NO: 1272367 - RNA, 17 nt, Human
ugauuaauggaaauguu

SEQ ID NO: 1272368 - RNA, 19 nt, Human
agccacuaaccuugccugg

SEQ ID NO: 1272369 - RNA, 20 nt, Human
agccacuaaccuugccuggu

SEQ ID NO: 1272370 - RNA, 22 nt, Human
agccacuaaccuugccugguac

SEQ ID NO: 1272371 - RNA, 12 nt, Human
agccacuccucu

SEQ ID NO: 1272372 - RNA, 18 nt, Human
ugauuaaguaaugauaac

SEQ ID NO: 1272373 - RNA, 17 nt, Human
ugauggugaugaaaugu

SEQ ID NO: 1272374 - RNA, 24 nt, Human
ugaugggauucuggacaggaugug

SEQ ID NO: 1272375 - RNA, 15 nt, Human
ugauggugaugaaau

SEQ ID NO: 1272376 - RNA, 16 nt, Human
ugauggugaugaaaug

SEQ ID NO: 1272377 - RNA, 13 nt, Human
agccacuccucug

SEQ ID NO: 1272378 - RNA, 14 nt, Human
agccagcaucggaa

SEQ ID NO: 1272379 - RNA, 12 nt, Human
agccagcaucug

SEQ ID NO: 1272380 - RNA, 17 nt, Human
agccagcaucugggccu

SEQ ID NO: 1272381 - RNA, 16 nt, Human
agccagcaucugggcc

SEQ ID NO: 1272382 - RNA, 13 nt, Human
agccagcccugcc

SEQ ID NO: 1272383 - RNA, 14 nt, Human
agccagcccugccu

SEQ ID NO: 1272384 - RNA, 15 nt, Human
agccagcccugccug

SEQ ID NO: 1272385 - RNA, 16 nt, Human
agccagcccugccugg

SEQ ID NO: 1272386 - RNA, 17 nt, Human
agccagcccugccugga

SEQ ID NO: 1272387 - RNA, 18 nt, Human
agccagcccugccuggag

SEQ ID NO: 1272388 - RNA, 19 nt, Human
agccagcccugccuggagg

SEQ ID NO: 1272389 - RNA, 20 nt, Human
agccagcccugccuggagga

SEQ ID NO: 1272390 - RNA, 21 nt, Human
agccagcccugccuggaggac

SEQ ID NO: 1272391 - RNA, 23 nt, Human
agccagcccugccuggaggaccu

SEQ ID NO: 1272392 - RNA, 24 nt, Human
agccagcccugccuggaggaccug

SEQ ID NO: 1272393 - RNA, 19 nt, Human
agccagccgagcaggaggc

SEQ ID NO: 1272394 - RNA, 21 nt, Human
agccagccgagcaggaggccu

SEQ ID NO: 1272395 - RNA, 16 nt, Human
agccagccggggcgag

SEQ ID NO: 1272396 - RNA, 19 nt, Human
agccagccggggcgagugg

SEQ ID NO: 1272397 - RNA, 10 nt, Human
agccagccuc

SEQ ID NO: 1272398 - RNA, 18 nt, Human
agccagccucgcccaucc

SEQ ID NO: 1272399 - RNA, 12 nt, Human
uggcugcaugcg

SEQ ID NO: 1272400 - RNA, 14 nt, Human
uggcugauaauuuu

SEQ ID NO: 1272401 - RNA, 19 nt, Human
uggcugauaauuuuaaauu

SEQ ID NO: 1272402 - RNA, 19 nt, Human
uggcugcauaaauguggua

SEQ ID NO: 1272403 - RNA, 15 nt, Human
uggcugagggcaguu

SEQ ID NO: 1272404 - RNA, 22 nt, Human
uggcugagggcaguucgcagcc

SEQ ID NO: 1272405 - RNA, 23 nt, Human
uggcugagggcaguucgcagcca

SEQ ID NO: 1272406 - RNA, 13 nt, Human
uggcugagggcag

SEQ ID NO: 1272407 - RNA, 17 nt, Human
uggcugaggccacccag

SEQ ID NO: 1272408 - RNA, 14 nt, Human
uggcugagggcagu

SEQ ID NO: 1272409 - RNA, 22 nt, Human
aggcugggaauggaggggcaga

SEQ ID NO: 1272410 - RNA, 19 nt, Human
aggcuggcuccagaugcag

SEQ ID NO: 1272411 - RNA, 23 nt, Human
uggcuagauuaaccuucucuguc

SEQ ID NO: 1272412 - RNA, 18 nt, Human
aggcugggaacucaucug

SEQ ID NO: 1272413 - RNA, 15 nt, Human
uggcuaguccuuguu

SEQ ID NO: 1272414 - RNA, 13 nt, Human
uggcuauguuuuu

SEQ ID NO: 1272415 - RNA, 17 nt, Human
uggcuauguuuuuaaug

SEQ ID NO: 1272416 - RNA, 15 nt, Human
uggcuauuuaaaacu

SEQ ID NO: 1272417 - RNA, 18 nt, Human
uggcuauguuuuuaaugu

SEQ ID NO: 1272418 - RNA, 12 nt, Human
uggcuauuuuau

SEQ ID NO: 1272419 - RNA, 20 nt, Human
ugggaaagccccugccccuc

SEQ ID NO: 1272420 - RNA, 22 nt, Human
ugggaaagccccugccccuccu

SEQ ID NO: 1272421 - RNA, 18 nt, Human
ugggaaccccuuucccac

SEQ ID NO: 1272422 - RNA, 15 nt, Human
uggcuucccgcucag

SEQ ID NO: 1272423 - RNA, 16 nt, Human
uggcuucccgcucagc

SEQ ID NO: 1272424 - RNA, 14 nt, Human
uggcuucccauccc

SEQ ID NO: 1272425 - RNA, 15 nt, Human
uggcuucccaucccc

SEQ ID NO: 1272426 - RNA, 18 nt, Human
uggcuucccauccccagc

SEQ ID NO: 1272427 - RNA, 19 nt, Human
uggcuucccauccccagcg

SEQ ID NO: 1272428 - RNA, 20 nt, Human
uggcuucccauccccagcga

SEQ ID NO: 1272429 - RNA, 18 nt, Human
uggcuucccgcucagccc

SEQ ID NO: 1272430 - RNA, 17 nt, Human
uggcuucccgcucagcc

SEQ ID NO: 1272431 - RNA, 21 nt, Human
uggcuucccauccccagcgau

SEQ ID NO: 1272432 - RNA, 13 nt, Human
ugggaacuagacu

SEQ ID NO: 1272433 - RNA, 20 nt, Human
ugggaagacuccuagcuguc

SEQ ID NO: 1272434 - RNA, 23 nt, Human
ugggaagacuccuagcuguccuu

SEQ ID NO: 1272435 - RNA, 22 nt, Human
ugggaagacuccuagcuguccu

SEQ ID NO: 1272436 - RNA, 19 nt, Human
ugggaagcccauccugacc

SEQ ID NO: 1272437 - RNA, 22 nt, Human
ugggaagcccauccugaccagc

SEQ ID NO: 1272438 - RNA, 23 nt, Human
ugggaaggcuacuucggggcugg

SEQ ID NO: 1272439 - RNA, 17 nt, Human
ugggaaggcuugggauu

SEQ ID NO: 1272440 - RNA, 18 nt, Human
ugggaaggcuugggauuu

SEQ ID NO: 1272441 - RNA, 18 nt, Human
ugggaaguccggccccag

SEQ ID NO: 1272442 - RNA, 23 nt, Human
ugggaagucguccuuacuccugu

SEQ ID NO: 1272443 - RNA, 15 nt, Human
ugggaagugaagacu

SEQ ID NO: 1272444 - RNA, 19 nt, Human
uggcuuauaauucuuucaa

SEQ ID NO: 1272445 - RNA, 13 nt, Human
uggcuuaccuggc

SEQ ID NO: 1272446 - RNA, 14 nt, Human
uggcuuaccuggcc

SEQ ID NO: 1272447 - RNA, 17 nt, Human
uggcuuaccuggcccau

SEQ ID NO: 1272448 - RNA, 15 nt, Human
uggcuuaccuggccc

SEQ ID NO: 1272449 - RNA, 18 nt, Human
uggcuuauaauucuuuca

SEQ ID NO: 1272450 - RNA, 19 nt, Human
aggcucuggagcccacugu

SEQ ID NO: 1272451 - RNA, 18 nt, Human
aggcucuggagcccacug

SEQ ID NO: 1272452 - RNA, 24 nt, Human
aggcugccugagucgugaccugcu

SEQ ID NO: 1272453 - RNA, 15 nt, Human
aggcucuggagccca

SEQ ID NO: 1272454 - RNA, 14 nt, Human
aggcucuggagccc

SEQ ID NO: 1272455 - RNA, 13 nt, Human
aggcucuggagcc

SEQ ID NO: 1272456 - RNA, 18 nt, Human
aggcuggaagauagcugu

SEQ ID NO: 1272457 - RNA, 18 nt, Human
aggcuggaagcugggagg

SEQ ID NO: 1272458 - RNA, 22 nt, Human
aggcugcuguacugaaguaaaa

SEQ ID NO: 1272459 - RNA, 23 nt, Human
aggcugcucuugaacuccugacc

SEQ ID NO: 1272460 - RNA, 17 nt, Human
aggcugcucggggugca

SEQ ID NO: 1272461 - RNA, 20 nt, Human
aggcugcucggggugcacag

SEQ ID NO: 1272462 - RNA, 21 nt, Human
aggcugcucggggugcacagg

SEQ ID NO: 1272463 - RNA, 22 nt, Human
aggcugcucggggugcacagga

SEQ ID NO: 1272464 - RNA, 23 nt, Human
aggcugcucggggugcacaggag

SEQ ID NO: 1272465 - RNA, 19 nt, Human
aggcuggcccugcccuggu

SEQ ID NO: 1272466 - RNA, 21 nt, Human
aggcuggccuauguggucuaa

SEQ ID NO: 1272467 - RNA, 12 nt, Human
aggcuggcccug

SEQ ID NO: 1272468 - RNA, 14 nt, Human
aggcuggcccugcc

SEQ ID NO: 1272469 - RNA, 17 nt, Human
aggcuggccaguccagg

SEQ ID NO: 1272470 - RNA, 18 nt, Human
aggcuggccaguccaggc

SEQ ID NO: 1272471 - RNA, 19 nt, Human
aggcuggccaguccaggcu

SEQ ID NO: 1272472 - RNA, 21 nt, Human
aggcuggccaguccaggcugc

SEQ ID NO: 1272473 - RNA, 15 nt, Human
aggcuggcccugccc

SEQ ID NO: 1272474 - RNA, 16 nt, Human
aggcuggcccugcccu

SEQ ID NO: 1272475 - RNA, 17 nt, Human
aggcuggcccugcccug

SEQ ID NO: 1272476 - RNA, 18 nt, Human
aggcuggcccugcccugg

SEQ ID NO: 1272477 - RNA, 22 nt, Human
aggcuggaagauagcugugacu

SEQ ID NO: 1272478 - RNA, 14 nt, Human
aggcuggcacagga

SEQ ID NO: 1272479 - RNA, 16 nt, Human
aggcuggcacaggaca

SEQ ID NO: 1272480 - RNA, 17 nt, Human
aggcuggcacaggacau

SEQ ID NO: 1272481 - RNA, 18 nt, Human
aggcuggcacaggacaug

SEQ ID NO: 1272482 - RNA, 15 nt, Human
aggcuggccagucca

SEQ ID NO: 1272483 - RNA, 17 nt, Human
aggccugguguuucuug

SEQ ID NO: 1272484 - RNA, 14 nt, Human
aggcuccugccacc

SEQ ID NO: 1272485 - RNA, 20 nt, Human
aggccuguguagcugugacc

SEQ ID NO: 1272486 - RNA, 13 nt, Human
aggccugggcagu

SEQ ID NO: 1272487 - RNA, 14 nt, Human
aggccugggcagug

SEQ ID NO: 1272488 - RNA, 15 nt, Human
aggccugggcagugg

SEQ ID NO: 1272489 - RNA, 19 nt, Human
aggccugggccgcugccac

SEQ ID NO: 1272490 - RNA, 11 nt, Human
aggccuggggu

SEQ ID NO: 1272491 - RNA, 18 nt, Human
aggccuggggugacccgg

SEQ ID NO: 1272492 - RNA, 21 nt, Human
aggccuggggugacccggcac

SEQ ID NO: 1272493 - RNA, 20 nt, Human
aggccuggggugacccggca

SEQ ID NO: 1272494 - RNA, 20 nt, Human
aggcuccugccaccacgccc

SEQ ID NO: 1272495 - RNA, 21 nt, Human
aggccuguguagcugugaccu

SEQ ID NO: 1272496 - RNA, 16 nt, Human
aggcuccuguuuugca

SEQ ID NO: 1272497 - RNA, 22 nt, Human
aggcuccuguuuugcacagcca

SEQ ID NO: 1272498 - RNA, 17 nt, Human
aggcucggccugccccc

SEQ ID NO: 1272499 - RNA, 18 nt, Human
aggcucguggacugagug

SEQ ID NO: 1272500 - RNA, 17 nt, Human
aggcucuagaucauaag

SEQ ID NO: 1272501 - RNA, 19 nt, Human
aggcucuaugagucuagau

SEQ ID NO: 1272502 - RNA, 20 nt, Human
aggcucuaugagucuagaug

SEQ ID NO: 1272503 - RNA, 21 nt, Human
aggcucuaugagucuagaugu

SEQ ID NO: 1272504 - RNA, 18 nt, Human
aggcucucuuugcccagu

SEQ ID NO: 1272505 - RNA, 13 nt, Human
aggcucugagagu

SEQ ID NO: 1272506 - RNA, 16 nt, Human
aggcucugagagucua

SEQ ID NO: 1272507 - RNA, 19 nt, Human
aggcucugagagucuagau

SEQ ID NO: 1272508 - RNA, 20 nt, Human
aggcucugagagucuagauu

SEQ ID NO: 1272509 - RNA, 21 nt, Human
aggcucugagagucuagauuc

SEQ ID NO: 1272510 - RNA, 22 nt, Human
aggcucugagagucuagauucu

SEQ ID NO: 1272511 - RNA, 23 nt, Human
aggcucugagagucuagauucuc

SEQ ID NO: 1272512 - RNA, 18 nt, Human
uggacgagaaaacaauaa

SEQ ID NO: 1272513 - RNA, 24 nt, Human
uggacgacacggucggggcaucug

SEQ ID NO: 1272514 - RNA, 22 nt, Human
uggaccucugacagcagcaucu

SEQ ID NO: 1272515 - RNA, 20 nt, Human
aggcauuuguugguuuauca

SEQ ID NO: 1272516 - RNA, 15 nt, Human
aggcauuuuuaccau

SEQ ID NO: 1272517 - RNA, 21 nt, Human
aggccaaagagucuccaguuu

SEQ ID NO: 1272518 - RNA, 22 nt, Human
aggccaaaggggaccuggaagg

SEQ ID NO: 1272519 - RNA, 14 nt, Human
aggccaagaaacgu

SEQ ID NO: 1272520 - RNA, 17 nt, Human
aggccaagaaacgucuu

SEQ ID NO: 1272521 - RNA, 21 nt, Human
aggccaagaaacgucuucuaa

SEQ ID NO: 1272522 - RNA, 21 nt, Human
aggccaaaggggaccuggaag

SEQ ID NO: 1272523 - RNA, 14 nt, Human
aggccaaggugucc

SEQ ID NO: 1272524 - RNA, 19 nt, Human
aggccaagguguccuacag

SEQ ID NO: 1272525 - RNA, 20 nt, Human
aggccaagguguccuacaga

SEQ ID NO: 1272526 - RNA, 21 nt, Human
aggccaagguguccuacagaa

SEQ ID NO: 1272527 - RNA, 18 nt, Human
aggccaagucaggcccuu

SEQ ID NO: 1272528 - RNA, 19 nt, Human
uggagucagacagaugugg

SEQ ID NO: 1272529 - RNA, 16 nt, Human
uggagucaaaaagaac

SEQ ID NO: 1272530 - RNA, 14 nt, Human
uggaguccccucac

SEQ ID NO: 1272531 - RNA, 15 nt, Human
uggaguccccucacc

SEQ ID NO: 1272532 - RNA, 19 nt, Human
uggaguccccucaccuccu

SEQ ID NO: 1272533 - RNA, 20 nt, Human
uggaguccccucaccuccuc

SEQ ID NO: 1272534 - RNA, 21 nt, Human
uggaguccccucaccuccucu

SEQ ID NO: 1272535 - RNA, 15 nt, Human
uggagucugccaccc

SEQ ID NO: 1272536 - RNA, 23 nt, Human
uggaugggggaacucagauccag

SEQ ID NO: 1272537 - RNA, 18 nt, Human
aggccagaccauggacac

SEQ ID NO: 1272538 - RNA, 17 nt, Human
aggccagaccauggaca

SEQ ID NO: 1272539 - RNA, 16 nt, Human
aggccagaccauggac

SEQ ID NO: 1272540 - RNA, 20 nt, Human
aggccacuguguuccuuccg

SEQ ID NO: 1272541 - RNA, 19 nt, Human
aggccacuguuuggaaaua

SEQ ID NO: 1272542 - RNA, 21 nt, Human
aggccaccuggcucucaccuc

SEQ ID NO: 1272543 - RNA, 14 nt, Human
aggccacuggagac

SEQ ID NO: 1272544 - RNA, 20 nt, Human
aggccacuggagacgcauau

SEQ ID NO: 1272545 - RNA, 14 nt, Human
aggccacuguguuc

SEQ ID NO: 1272546 - RNA, 19 nt, Human
aggccacuguguuccuucc

SEQ ID NO: 1272547 - RNA, 17 nt, Human
aggccacacucagcaca

SEQ ID NO: 1272548 - RNA, 18 nt, Human
aggccacacucagcacaa

SEQ ID NO: 1272549 - RNA, 21 nt, Human
aggccacacuucaaacuacuu

SEQ ID NO: 1272550 - RNA, 11 nt, Human
uggcagccuug

SEQ ID NO: 1272551 - RNA, 15 nt, Human
uggcagccucuucaa

SEQ ID NO: 1272552 - RNA, 16 nt, Human
uggcagccucuucaaa

SEQ ID NO: 1272553 - RNA, 23 nt, Human
uggcagccgugccuucagcucua

SEQ ID NO: 1272554 - RNA, 19 nt, Human
uggcagccucccauccagg

SEQ ID NO: 1272555 - RNA, 20 nt, Human
uggcagccucccauccaggg

SEQ ID NO: 1272556 - RNA, 21 nt, Human
uggcagccucccauccagggc

SEQ ID NO: 1272557 - RNA, 22 nt, Human
uggcagccucccauccagggcc

SEQ ID NO: 1272558 - RNA, 19 nt, Human
uggcagccacacuucucag

SEQ ID NO: 1272559 - RNA, 12 nt, Human
uggcagcccagc

SEQ ID NO: 1272560 - RNA, 13 nt, Human
uggcagcccagcc

SEQ ID NO: 1272561 - RNA, 14 nt, Human
uggcagcccagcca

SEQ ID NO: 1272562 - RNA, 15 nt, Human
uggcagcccagccag

SEQ ID NO: 1272563 - RNA, 16 nt, Human
uggcagcccagccagc

SEQ ID NO: 1272564 - RNA, 17 nt, Human
uggcagcccagccagcg

SEQ ID NO: 1272565 - RNA, 16 nt, Human
uggcagccgugccuuc

SEQ ID NO: 1272566 - RNA, 18 nt, Human
uggcagcccagccagcgu

SEQ ID NO: 1272567 - RNA, 14 nt, Human
uggauguccccagc

SEQ ID NO: 1272568 - RNA, 15 nt, Human
uggauguccccagca

SEQ ID NO: 1272569 - RNA, 16 nt, Human
uggauguccccagcag

SEQ ID NO: 1272570 - RNA, 11 nt, Human
uggcagccaca

SEQ ID NO: 1272571 - RNA, 18 nt, Human
uggcagccacacuucuca

SEQ ID NO: 1272572 - RNA, 21 nt, Human
uggcagccacacuucucagga

SEQ ID NO: 1272573 - RNA, 20 nt, Human
uggccagucuggucucgaac

SEQ ID NO: 1272574 - RNA, 23 nt, Human
uggccaguccaggcugccguggg

SEQ ID NO: 1272575 - RNA, 14 nt, Human
uggccagugcccug

SEQ ID NO: 1272576 - RNA, 18 nt, Human
uggccagugcccugaucc

SEQ ID NO: 1272577 - RNA, 21 nt, Human
uggccagugcccugaucccag

SEQ ID NO: 1272578 - RNA, 17 nt, Human
uggccaguccaggcugc

SEQ ID NO: 1272579 - RNA, 21 nt, Human
uggccaguccaggcugccgug

SEQ ID NO: 1272580 - RNA, 20 nt, Human
uggccaggcuugucucgaac

SEQ ID NO: 1272581 - RNA, 14 nt, Human
uggccaaguuccuc

SEQ ID NO: 1272582 - RNA, 20 nt, Human
uggccagggccacgcuccag

SEQ ID NO: 1272583 - RNA, 22 nt, Human
uggccagggccacgcuccagcu

SEQ ID NO: 1272584 - RNA, 20 nt, Human
uggccaggcuggucucgaac

SEQ ID NO: 1272585 - RNA, 16 nt, Human
uggccaaguuccucua

SEQ ID NO: 1272586 - RNA, 22 nt, Human
uggccaaugcaccuaaagaaaa

SEQ ID NO: 1272587 - RNA, 14 nt, Human
uggccaagagaaac

SEQ ID NO: 1272588 - RNA, 18 nt, Human
uggccaagagaaacuucc

SEQ ID NO: 1272589 - RNA, 20 nt, Human
uggccaagagaaacuuccua

SEQ ID NO: 1272590 - RNA, 22 nt, Human
uggccaagaagcaguggccuua

SEQ ID NO: 1272591 - RNA, 13 nt, Human
uggccaagcugag

SEQ ID NO: 1272592 - RNA, 14 nt, Human
uggccaagcugagg

SEQ ID NO: 1272593 - RNA, 17 nt, Human
uggccaagcugaggugc

SEQ ID NO: 1272594 - RNA, 19 nt, Human
uggccaagcugaggugccc

SEQ ID NO: 1272595 - RNA, 21 nt, Human
uggccaagcugaggugcccag

SEQ ID NO: 1272596 - RNA, 22 nt, Human
uggccaagcugaggugcccagg

SEQ ID NO: 1272597 - RNA, 23 nt, Human
uggccaagcugaggugcccagga

SEQ ID NO: 1272598 - RNA, 16 nt, Human
uggccaaggaaaggca

SEQ ID NO: 1272599 - RNA, 21 nt, Human
uggcauggaaauuuaaagcag

SEQ ID NO: 1272600 - RNA, 23 nt, Human
uggcauggaaauuuaaagcaggu

SEQ ID NO: 1272601 - RNA, 13 nt, Human
uggccaagaagca

SEQ ID NO: 1272602 - RNA, 16 nt, Human
uggccaagaagcagug

SEQ ID NO: 1272603 - RNA, 21 nt, Human
uggccaagaagcaguggccuu

SEQ ID NO: 1272604 - RNA, 13 nt, Human
aggccugccuguu

SEQ ID NO: 1272605 - RNA, 19 nt, Human
aggccugagguuacuggaa

SEQ ID NO: 1272606 - RNA, 17 nt, Human
aggccuggacuuuccug

SEQ ID NO: 1272607 - RNA, 19 nt, Human
uggcauggaaauuuaaagc

SEQ ID NO: 1272608 - RNA, 20 nt, Human
uggcauggaaauuuaaagca

SEQ ID NO: 1272609 - RNA, 17 nt, Human
aggccauucuuucccaa

SEQ ID NO: 1272610 - RNA, 18 nt, Human
aggccauucuuucccaac

SEQ ID NO: 1272611 - RNA, 19 nt, Human
aggccauucuuucccaaca

SEQ ID NO: 1272612 - RNA, 17 nt, Human
aggcccucgcugccagc

SEQ ID NO: 1272613 - RNA, 22 nt, Human
aggcccucgcugccagcucugu

SEQ ID NO: 1272614 - RNA, 14 nt, Human
aggccuccuggcug

SEQ ID NO: 1272615 - RNA, 23 nt, Human
aggccuccuggcugucugaggcu

SEQ ID NO: 1272616 - RNA, 13 nt, Human
aggccucagggcu

SEQ ID NO: 1272617 - RNA, 18 nt, Human
aggccucagggcuccuug

SEQ ID NO: 1272618 - RNA, 18 nt, Human
aggccuccaucuucucau

SEQ ID NO: 1272619 - RNA, 12 nt, Human
uggccuggagca

SEQ ID NO: 1272620 - RNA, 23 nt, Human
uggccuggagcacaaagacccug

SEQ ID NO: 1272621 - RNA, 13 nt, Human
uggccuggccagu

SEQ ID NO: 1272622 - RNA, 14 nt, Human
uggccuggccagug

SEQ ID NO: 1272623 - RNA, 17 nt, Human
uggccuggccagugccc

SEQ ID NO: 1272624 - RNA, 20 nt, Human
uggccuggccagugcccuga

SEQ ID NO: 1272625 - RNA, 14 nt, Human
uggcccgacagccu

SEQ ID NO: 1272626 - RNA, 15 nt, Human
uggcccgacagccug

SEQ ID NO: 1272627 - RNA, 16 nt, Human
uggcccgacagccugg

SEQ ID NO: 1272628 - RNA, 17 nt, Human
uggcccgacagccuggc

SEQ ID NO: 1272629 - RNA, 18 nt, Human
uggcccgacagccuggca

SEQ ID NO: 1272630 - RNA, 19 nt, Human
uggcccgacagccuggcac

SEQ ID NO: 1272631 - RNA, 17 nt, Human
uggccgcugaguggcag

SEQ ID NO: 1272632 - RNA, 19 nt, Human
uggccgcugaguggcaggg

SEQ ID NO: 1272633 - RNA, 15 nt, Human
uggccgggagccuga

SEQ ID NO: 1272634 - RNA, 17 nt, Human
uggccgaguccaagcug

SEQ ID NO: 1272635 - RNA, 19 nt, Human
uggccgaguccaagcuggg

SEQ ID NO: 1272636 - RNA, 13 nt, Human
uggccgcccccug

SEQ ID NO: 1272637 - RNA, 15 nt, Human
uggccgcccccugcc

SEQ ID NO: 1272638 - RNA, 17 nt, Human
uggccgcccccugcccc

SEQ ID NO: 1272639 - RNA, 21 nt, Human
uggccgcccccugccccccag

SEQ ID NO: 1272640 - RNA, 23 nt, Human
uggccgcccccugccccccagcc

SEQ ID NO: 1272641 - RNA, 15 nt, Human
uggccgccugggucc

SEQ ID NO: 1272642 - RNA, 18 nt, Human
uggaauuggagcucgugg

SEQ ID NO: 1272643 - RNA, 17 nt, Human
uggaauugggagcuugg

SEQ ID NO: 1272644 - RNA, 17 nt, Human
aggcaaaauccuugcuu

SEQ ID NO: 1272645 - RNA, 19 nt, Human
aggcaaaauccuugcuuau

SEQ ID NO: 1272646 - RNA, 13 nt, Human
aggcaaaauugca

SEQ ID NO: 1272647 - RNA, 17 nt, Human
aggcaaaauugcaaauc

SEQ ID NO: 1272648 - RNA, 15 nt, Human
aggcaaauuugcauu

SEQ ID NO: 1272649 - RNA, 22 nt, Human
aggcaaauuugcauuaaauuac

SEQ ID NO: 1272650 - RNA, 19 nt, Human
aggcaacaguuugacauuu

SEQ ID NO: 1272651 - RNA, 16 nt, Human
aggcaacauccaaaau

SEQ ID NO: 1272652 - RNA, 17 nt, Human
aggaugccccguccccc

SEQ ID NO: 1272653 - RNA, 16 nt, Human
aggaugcuaacaucua

SEQ ID NO: 1272654 - RNA, 17 nt, Human
aggaugcuaacaucuaa

SEQ ID NO: 1272655 - RNA, 19 nt, Human
aggaugcuaacaucuaaaa

SEQ ID NO: 1272656 - RNA, 21 nt, Human
aggauuuuuuuuaauguuuaa

SEQ ID NO: 1272657 - RNA, 15 nt, Human
aggcaaaaauguaaa

SEQ ID NO: 1272658 - RNA, 22 nt, Human
aggaugagggaaaagaaaaaga

SEQ ID NO: 1272659 - RNA, 13 nt, Human
uggacccugacca

SEQ ID NO: 1272660 - RNA, 15 nt, Human
uggacccugaccagc

SEQ ID NO: 1272661 - RNA, 18 nt, Human
uggacccugaccagcucc

SEQ ID NO: 1272662 - RNA, 19 nt, Human
uggacccugaccagcuccc

SEQ ID NO: 1272663 - RNA, 20 nt, Human
uggacccugaccagcucccc

SEQ ID NO: 1272664 - RNA, 13 nt, Human
uggacccuuccau

SEQ ID NO: 1272665 - RNA, 23 nt, Human
uggacccugaccagcucccccuc

SEQ ID NO: 1272666 - RNA, 15 nt, Human
uggaccggagagugg

SEQ ID NO: 1272667 - RNA, 18 nt, Human
uggaccggagaguggggg

SEQ ID NO: 1272668 - RNA, 22 nt, Human
uggaccggagaguggggguggg

SEQ ID NO: 1272669 - RNA, 17 nt, Human
uggaccuaaauggccuc

SEQ ID NO: 1272670 - RNA, 18 nt, Human
uggaccuaaauggccuca

SEQ ID NO: 1272671 - RNA, 21 nt, Human
uggaccuaaauggccucaugu

SEQ ID NO: 1272672 - RNA, 14 nt, Human
uggaccuaauccaa

SEQ ID NO: 1272673 - RNA, 22 nt, Human
uggaccuaauccaagcaucccu

SEQ ID NO: 1272674 - RNA, 15 nt, Human
uggaccucaccaagc

SEQ ID NO: 1272675 - RNA, 13 nt, Human
uggaccucugaca

SEQ ID NO: 1272676 - RNA, 14 nt, Human
uggaccucugacag

SEQ ID NO: 1272677 - RNA, 15 nt, Human
uggaccucugacagc

SEQ ID NO: 1272678 - RNA, 16 nt, Human
uggaccucugacagca

SEQ ID NO: 1272679 - RNA, 17 nt, Human
uggaccucugacagcag

SEQ ID NO: 1272680 - RNA, 18 nt, Human
uggaccucugacagcagc

SEQ ID NO: 1272681 - RNA, 19 nt, Human
uggaccucugacagcagca

SEQ ID NO: 1272682 - RNA, 16 nt, Human
uggaccagccucucca

SEQ ID NO: 1272683 - RNA, 22 nt, Human
uggaccagccucuccacucaug

SEQ ID NO: 1272684 - RNA, 20 nt, Human
uggaccauggaguggcagcc

SEQ ID NO: 1272685 - RNA, 19 nt, Human
uggaccauggaguggcagc

SEQ ID NO: 1272686 - RNA, 17 nt, Human
uggacccagccaggccc

SEQ ID NO: 1272687 - RNA, 21 nt, Human
uggacccagccaggcccagcc

SEQ ID NO: 1272688 - RNA, 18 nt, Human
uggacccagccaggccca

SEQ ID NO: 1272689 - RNA, 14 nt, Human
aggaggcagagaag

SEQ ID NO: 1272690 - RNA, 14 nt, Human
aggaggcaggaccu

SEQ ID NO: 1272691 - RNA, 18 nt, Human
aggaggcaccuacacuca

SEQ ID NO: 1272692 - RNA, 14 nt, Human
aggagggacaaagg

SEQ ID NO: 1272693 - RNA, 18 nt, Human
aggagggacaaaggagcc

SEQ ID NO: 1272694 - RNA, 19 nt, Human
aggagggacaaaggagccu

SEQ ID NO: 1272695 - RNA, 20 nt, Human
aggagggacaaaggagccug

SEQ ID NO: 1272696 - RNA, 21 nt, Human
aggagggacaaaggagccugu

SEQ ID NO: 1272697 - RNA, 23 nt, Human
aggagggacaaaggagccuguga

SEQ ID NO: 1272698 - RNA, 22 nt, Human
aggagggacaaaggagccugug

SEQ ID NO: 1272699 - RNA, 19 nt, Human
aggagggacugucgcugcu

SEQ ID NO: 1272700 - RNA, 16 nt, Human
aggagggagacacugg

SEQ ID NO: 1272701 - RNA, 23 nt, Human
aggagggagacacuggccccuca

SEQ ID NO: 1272702 - RNA, 22 nt, Human
aggaggagccuguccugccugu

SEQ ID NO: 1272703 - RNA, 23 nt, Human
aggaggagggucggugccuucaa

SEQ ID NO: 1272704 - RNA, 18 nt, Human
uggaaauucccuucaucu

SEQ ID NO: 1272705 - RNA, 16 nt, Human
uggaaauugacgaggg

SEQ ID NO: 1272706 - RNA, 17 nt, Human
uggaaauugauuuugaa

SEQ ID NO: 1272707 - RNA, 22 nt, Human
uggaaauucccuucaucuggaa

SEQ ID NO: 1272708 - RNA, 17 nt, Human
uggaaauucccuucauc

SEQ ID NO: 1272709 - RNA, 12 nt, Human
aggagcugccug

SEQ ID NO: 1272710 - RNA, 14 nt, Human
aggagcugccugga

SEQ ID NO: 1272711 - RNA, 15 nt, Human
aggagcugccuggac

SEQ ID NO: 1272712 - RNA, 16 nt, Human
aggagcugccuggacc

SEQ ID NO: 1272713 - RNA, 18 nt, Human
aggagcugccuggacccg

SEQ ID NO: 1272714 - RNA, 17 nt, Human
aggagcugccuggaccc

SEQ ID NO: 1272715 - RNA, 14 nt, Human
uggaaauauauauu

SEQ ID NO: 1272716 - RNA, 17 nt, Human
uggaaauauauauuaua

SEQ ID NO: 1272717 - RNA, 19 nt, Human
uggaaauauauauuauacu

SEQ ID NO: 1272718 - RNA, 15 nt, Human
aggaguuuugcaaag

SEQ ID NO: 1272719 - RNA, 12 nt, Human
aggauaaaauaa

SEQ ID NO: 1272720 - RNA, 21 nt, Human
aggagggagcaucagugcccu

SEQ ID NO: 1272721 - RNA, 14 nt, Human
aggagggaggggga

SEQ ID NO: 1272722 - RNA, 21 nt, Human
aggacuuccuguccagcucca

SEQ ID NO: 1272723 - RNA, 13 nt, Human
aggacuugugucu

SEQ ID NO: 1272724 - RNA, 16 nt, Human
aggacuugugucucug

SEQ ID NO: 1272725 - RNA, 15 nt, Human
aggacuguuucaaac

SEQ ID NO: 1272726 - RNA, 19 nt, Human
aggacuguuucaaacaugc

SEQ ID NO: 1272727 - RNA, 19 nt, Human
aggacuuauuuaaacucug

SEQ ID NO: 1272728 - RNA, 15 nt, Human
aggacuucccugugu

SEQ ID NO: 1272729 - RNA, 20 nt, Human
aggacuuccuguccagcucc

SEQ ID NO: 1272730 - RNA, 14 nt, Human
aggacauuucucua

SEQ ID NO: 1272731 - RNA, 15 nt, Human
aggacugaugucucc

SEQ ID NO: 1272732 - RNA, 19 nt, Human
aggacugaauuaugaaacu

SEQ ID NO: 1272733 - RNA, 20 nt, Human
aggacugaauuaugaaacuu

SEQ ID NO: 1272734 - RNA, 18 nt, Human
aggagcccugggaggcuc

SEQ ID NO: 1272735 - RNA, 20 nt, Human
aggagcccacgacacugcag

SEQ ID NO: 1272736 - RNA, 14 nt, Human
aggagccaccaguu

SEQ ID NO: 1272737 - RNA, 15 nt, Human
aggagccaccaguuc

SEQ ID NO: 1272738 - RNA, 17 nt, Human
aggagccaccaguucuc

SEQ ID NO: 1272739 - RNA, 13 nt, Human
aggagcaaagccu

SEQ ID NO: 1272740 - RNA, 14 nt, Human
aggagcaaagccug

SEQ ID NO: 1272741 - RNA, 16 nt, Human
aggagcaaagccuguu

SEQ ID NO: 1272742 - RNA, 15 nt, Human
aggagcaaagccugu

SEQ ID NO: 1272743 - RNA, 20 nt, Human
aggacuuuauagaucagcca

SEQ ID NO: 1272744 - RNA, 21 nt, Human
aggacuuuauagaucagccag

SEQ ID NO: 1272745 - RNA, 15 nt, Human
aggacuuuguacauu

SEQ ID NO: 1272746 - RNA, 11 nt, Human
aggagaaacug

SEQ ID NO: 1272747 - RNA, 11 nt, Human
aggacuuugca

SEQ ID NO: 1272748 - RNA, 13 nt, Human
aggacuuuguaca

SEQ ID NO: 1272749 - RNA, 21 nt, Human
aggagauucugccuuugccag

SEQ ID NO: 1272750 - RNA, 17 nt, Human
aggagaaacuggaacuc

SEQ ID NO: 1272751 - RNA, 17 nt, Human
aggagauggggacaggg

SEQ ID NO: 1272752 - RNA, 16 nt, Human
aggagauucugccuuu

SEQ ID NO: 1272753 - RNA, 20 nt, Human
aggagauucugccuuugcca

SEQ ID NO: 1272754 - RNA, 22 nt, Human
aggagauucugccuuugccagg

SEQ ID NO: 1272755 - RNA, 23 nt, Human
aggagcccugggaggcucuggag

SEQ ID NO: 1272756 - RNA, 19 nt, Human
aggagcccugggaggcucu

SEQ ID NO: 1272757 - RNA, 11 nt, Human
aggagccuggc

SEQ ID NO: 1272758 - RNA, 12 nt, Human
aggagccugucc

SEQ ID NO: 1272759 - RNA, 16 nt, Human
aggagccuguccugcc

SEQ ID NO: 1272760 - RNA, 17 nt, Human
aggagccuguccugccu

SEQ ID NO: 1272761 - RNA, 19 nt, Human
aggagccuguccugccugu

SEQ ID NO: 1272762 - RNA, 21 nt, Human
aggagccuguccugccugugg

SEQ ID NO: 1272763 - RNA, 11 nt, Human
aggagccugug

SEQ ID NO: 1272764 - RNA, 12 nt, Human
aggagccuguga

SEQ ID NO: 1272765 - RNA, 13 nt, Human
aggagccugugaa

SEQ ID NO: 1272766 - RNA, 17 nt, Human
aggagccugugaaccca

SEQ ID NO: 1272767 - RNA, 18 nt, Human
aggagccugugaacccag

SEQ ID NO: 1272768 - RNA, 19 nt, Human
aggagccugugaacccagg

SEQ ID NO: 1272769 - RNA, 20 nt, Human
aggagccugugaacccagga

SEQ ID NO: 1272770 - RNA, 21 nt, Human
aggagccugugaacccaggac

SEQ ID NO: 1272771 - RNA, 22 nt, Human
aggagccugugaacccaggaca

SEQ ID NO: 1272772 - RNA, 13 nt, Human
aggagccugugac

SEQ ID NO: 1272773 - RNA, 14 nt, Human
aggagccugugaca

SEQ ID NO: 1272774 - RNA, 14 nt, Human
aggagcgagcaugu

SEQ ID NO: 1272775 - RNA, 15 nt, Human
aggagcgagcauguc

SEQ ID NO: 1272776 - RNA, 12 nt, Human
aggagcuaaggc

SEQ ID NO: 1272777 - RNA, 13 nt, Human
aggagcuaaggcu

SEQ ID NO: 1272778 - RNA, 14 nt, Human
aggagcuaaggcuc

SEQ ID NO: 1272779 - RNA, 15 nt, Human
aggagcuaaggcucu

SEQ ID NO: 1272780 - RNA, 21 nt, Human
ugcuugccaaggcagaggccu

SEQ ID NO: 1272781 - RNA, 22 nt, Human
ugcuugccaaggcagaggccug

SEQ ID NO: 1272782 - RNA, 23 nt, Human
ugcuugccaaggcagaggccugg

SEQ ID NO: 1272783 - RNA, 18 nt, Human
ugcuugcccuaagcagaa

SEQ ID NO: 1272784 - RNA, 21 nt, Human
ugcuugcccuaagcagaaagu

SEQ ID NO: 1272785 - RNA, 20 nt, Human
ugcuugcccuaagcagaaag

SEQ ID NO: 1272786 - RNA, 13 nt, Human
uggaaaggcagcu

SEQ ID NO: 1272787 - RNA, 14 nt, Human
uggaaauacacagu

SEQ ID NO: 1272788 - RNA, 15 nt, Human
uggaaauacacagug

SEQ ID NO: 1272789 - RNA, 13 nt, Human
uggaaauauauau

SEQ ID NO: 1272790 - RNA, 14 nt, Human
ugcuuuucagcuga

SEQ ID NO: 1272791 - RNA, 16 nt, Human
ugcuuuucaugcaaac

SEQ ID NO: 1272792 - RNA, 20 nt, Human
ugcuuuucaugcaaacucuu

SEQ ID NO: 1272793 - RNA, 17 nt, Human
ugcuuuucaugcaaacu

SEQ ID NO: 1272794 - RNA, 17 nt, Human
ugcuuuucccuuuguga

SEQ ID NO: 1272795 - RNA, 21 nt, Human
ugcuuuucccuuugugaguca

SEQ ID NO: 1272796 - RNA, 18 nt, Human
ugcuuuucccuuugugag

SEQ ID NO: 1272797 - RNA, 14 nt, Human
ugcuuuucauccuu

SEQ ID NO: 1272798 - RNA, 24 nt, Human
ugcuuuuaguauuuuagugaacuu

SEQ ID NO: 1272799 - RNA, 12 nt, Human
ugcuuuguauug

SEQ ID NO: 1272800 - RNA, 23 nt, Human
ugcuuuguaagugaaaaacauga

SEQ ID NO: 1272801 - RNA, 17 nt, Human
ugcuuugggcuugggcc

SEQ ID NO: 1272802 - RNA, 21 nt, Human
ugcuuggggggugaugagggc

SEQ ID NO: 1272803 - RNA, 20 nt, Human
ugcuuggggggugaugaggg

SEQ ID NO: 1272804 - RNA, 18 nt, Human
ugcuuugggcugcccugg

SEQ ID NO: 1272805 - RNA, 19 nt, Human
ugcuuugggcugcccuggu

SEQ ID NO: 1272806 - RNA, 20 nt, Human
ugcuuugggcugcccuggug

SEQ ID NO: 1272807 - RNA, 21 nt, Human
ugcuuugggcugcccuggugc

SEQ ID NO: 1272808 - RNA, 20 nt, Human
aggaauuuuauuuuuuucug

SEQ ID NO: 1272809 - RNA, 14 nt, Human
ugcuggagcucugc

SEQ ID NO: 1272810 - RNA, 13 nt, Human
ugcuggagcucug

SEQ ID NO: 1272811 - RNA, 15 nt, Human
aggaauuucuuaacu

SEQ ID NO: 1272812 - RNA, 19 nt, Human
aggaauuucuuaacuucuu

SEQ ID NO: 1272813 - RNA, 23 nt, Human
aggaauuucuuaacuucuugcuu

SEQ ID NO: 1272814 - RNA, 15 nt, Human
ugcuggcugccuuag

SEQ ID NO: 1272815 - RNA, 14 nt, Human
ugcuggcugccuua

SEQ ID NO: 1272816 - RNA, 21 nt, Human
ugcuggcugccuuagaaccuu

SEQ ID NO: 1272817 - RNA, 12 nt, Human
ugcuggcccagg

SEQ ID NO: 1272818 - RNA, 13 nt, Human
ugcuggcccaggg

SEQ ID NO: 1272819 - RNA, 14 nt, Human
ugcuggcccagggc

SEQ ID NO: 1272820 - RNA, 16 nt, Human
ugcuggcccagggccc

SEQ ID NO: 1272821 - RNA, 17 nt, Human
ugcuggcccagggccca

SEQ ID NO: 1272822 - RNA, 18 nt, Human
ugcuggcccagggcccag

SEQ ID NO: 1272823 - RNA, 19 nt, Human
ugcuggcccagggcccaga

SEQ ID NO: 1272824 - RNA, 20 nt, Human
ugcuggcccagggcccagag

SEQ ID NO: 1272825 - RNA, 21 nt, Human
ugcuggcccagggcccagagc

SEQ ID NO: 1272826 - RNA, 22 nt, Human
ugcuggcccagggcccagagcc

SEQ ID NO: 1272827 - RNA, 23 nt, Human
ugcuggcccagggcccagagccc

SEQ ID NO: 1272828 - RNA, 18 nt, Human
ugcuguccgguggagauc

SEQ ID NO: 1272829 - RNA, 21 nt, Human
ugcuguacugaaguaaaacaa

SEQ ID NO: 1272830 - RNA, 17 nt, Human
ugcugucaccuugcuca

SEQ ID NO: 1272831 - RNA, 12 nt, Human
ugcugucccucc

SEQ ID NO: 1272832 - RNA, 13 nt, Human
ugcugucccuccc

SEQ ID NO: 1272833 - RNA, 16 nt, Human
ugcugucccucccccu

SEQ ID NO: 1272834 - RNA, 17 nt, Human
ugcugucccucccccuu

SEQ ID NO: 1272835 - RNA, 15 nt, Human
ugcuguacaucuauu

SEQ ID NO: 1272836 - RNA, 16 nt, Human
ugcuguacaucuauuu

SEQ ID NO: 1272837 - RNA, 17 nt, Human
ugcuguacaucuauuuu

SEQ ID NO: 1272838 - RNA, 21 nt, Human
ugcuguacaucuauuuuggau

SEQ ID NO: 1272839 - RNA, 16 nt, Human
ugcugggagaggcagc

SEQ ID NO: 1272840 - RNA, 15 nt, Human
ugcugggagcuccac

SEQ ID NO: 1272841 - RNA, 16 nt, Human
ugcugggagcuccacu

SEQ ID NO: 1272842 - RNA, 17 nt, Human
ugcugggagcuccacuc

SEQ ID NO: 1272843 - RNA, 18 nt, Human
ugcugggagcuccacucu

SEQ ID NO: 1272844 - RNA, 20 nt, Human
ugcugggagcuccacucugc

SEQ ID NO: 1272845 - RNA, 21 nt, Human
ugcugggagcuccacucugcu

SEQ ID NO: 1272846 - RNA, 22 nt, Human
ugcugggagcuccacucugcuu

SEQ ID NO: 1272847 - RNA, 23 nt, Human
ugcugggagcuccacucugcuuc

SEQ ID NO: 1272848 - RNA, 17 nt, Human
ugcugggagaggcagcc

SEQ ID NO: 1272849 - RNA, 14 nt, Human
ugcuucaucccuuu

SEQ ID NO: 1272850 - RNA, 14 nt, Human
aggacacugauaug

SEQ ID NO: 1272851 - RNA, 22 nt, Human
aggacaucagcaaacaggauca

SEQ ID NO: 1272852 - RNA, 16 nt, Human
aggacaucagcaaaca

SEQ ID NO: 1272853 - RNA, 15 nt, Human
aggacaucagcaaac

SEQ ID NO: 1272854 - RNA, 14 nt, Human
aggacaucagcaaa

SEQ ID NO: 1272855 - RNA, 13 nt, Human
aggacaucagcaa

SEQ ID NO: 1272856 - RNA, 12 nt, Human
aggacaucagca

SEQ ID NO: 1272857 - RNA, 20 nt, Human
aggacaugcgguagccagca

SEQ ID NO: 1272858 - RNA, 22 nt, Human
aggacaugcgguagccagcaca

SEQ ID NO: 1272859 - RNA, 17 nt, Human
aggacacugauaugggu

SEQ ID NO: 1272860 - RNA, 16 nt, Human
aggacagccgccugga

SEQ ID NO: 1272861 - RNA, 20 nt, Human
aggacaggauccaggccggc

SEQ ID NO: 1272862 - RNA, 14 nt, Human
aggacaggauccag

SEQ ID NO: 1272863 - RNA, 16 nt, Human
ugcuuauauuguucac

SEQ ID NO: 1272864 - RNA, 21 nt, Human
ugcuuaugacaucacuuguac

SEQ ID NO: 1272865 - RNA, 16 nt, Human
ugcugugaggcugucc

SEQ ID NO: 1272866 - RNA, 17 nt, Human
ugcugugaggcuguccu

SEQ ID NO: 1272867 - RNA, 18 nt, Human
ugcugugaggcuguccug

SEQ ID NO: 1272868 - RNA, 19 nt, Human
ugcugugaggcuguccugu

SEQ ID NO: 1272869 - RNA, 23 nt, Human
ugcugugagucuuugguucuaag

SEQ ID NO: 1272870 - RNA, 20 nt, Human
ugcuuaguguacuuggagua

SEQ ID NO: 1272871 - RNA, 15 nt, Human
ugcugucugggugcu

SEQ ID NO: 1272872 - RNA, 18 nt, Human
ugcugucuggguggcuca

SEQ ID NO: 1272873 - RNA, 19 nt, Human
ugcugucuggguggcucac

SEQ ID NO: 1272874 - RNA, 13 nt, Human
ugcugucuuaaac

SEQ ID NO: 1272875 - RNA, 21 nt, Human
ugcugucuuaaacuaaaugug

SEQ ID NO: 1272876 - RNA, 14 nt, Human
ugcugucuuaaacu

SEQ ID NO: 1272877 - RNA, 13 nt, Human
ugcugugaggcug

SEQ ID NO: 1272878 - RNA, 14 nt, Human
ugcugugaggcugu

SEQ ID NO: 1272879 - RNA, 18 nt, Human
ugcuuaugcucuuaauug

SEQ ID NO: 1272880 - RNA, 21 nt, Human
ugcuuaugguaccagaugcag

SEQ ID NO: 1272881 - RNA, 14 nt, Human
ugcuuaugguacca

SEQ ID NO: 1272882 - RNA, 19 nt, Human
ugcuuauuccaugacugcu

SEQ ID NO: 1272883 - RNA, 21 nt, Human
ugcuuauuccaugacugcuug

SEQ ID NO: 1272884 - RNA, 22 nt, Human
ugcuuauuccaugacugcuugc

SEQ ID NO: 1272885 - RNA, 14 nt, Human
ugcuucacaauguu

SEQ ID NO: 1272886 - RNA, 23 nt, Human
agcuggaggcaggggcuuccugg

SEQ ID NO: 1272887 - RNA, 19 nt, Human
agcuggagugcaguggcau

SEQ ID NO: 1272888 - RNA, 15 nt, Human
agcuggagugcagug

SEQ ID NO: 1272889 - RNA, 13 nt, Human
ugcuccagacagg

SEQ ID NO: 1272890 - RNA, 17 nt, Human
ugcuccagacagggaau

SEQ ID NO: 1272891 - RNA, 12 nt, Human
ugcuccagaccu

SEQ ID NO: 1272892 - RNA, 14 nt, Human
ugcuccagaccuga

SEQ ID NO: 1272893 - RNA, 21 nt, Human
ugcuccagaccugauccugga

SEQ ID NO: 1272894 - RNA, 14 nt, Human
ugcugacuguacuc

SEQ ID NO: 1272895 - RNA, 22 nt, Human
ugcugacggccagggagaagcu

SEQ ID NO: 1272896 - RNA, 14 nt, Human
ugcugaccugugca

SEQ ID NO: 1272897 - RNA, 20 nt, Human
ugcugacgggacccacaugc

SEQ ID NO: 1272898 - RNA, 14 nt, Human
ugcugacggccagg

SEQ ID NO: 1272899 - RNA, 15 nt, Human
ugcugacggccaggg

SEQ ID NO: 1272900 - RNA, 17 nt, Human
ugcugacggccagggag

SEQ ID NO: 1272901 - RNA, 20 nt, Human
ugcugacggccagggagaag

SEQ ID NO: 1272902 - RNA, 18 nt, Human
ugcuccgccuggccuggc

SEQ ID NO: 1272903 - RNA, 17 nt, Human
ugcugacccuccccaaa

SEQ ID NO: 1272904 - RNA, 13 nt, Human
ugcugacccuccc

SEQ ID NO: 1272905 - RNA, 13 nt, Human
ugcugaccugcug

SEQ ID NO: 1272906 - RNA, 14 nt, Human
ugcugaccugcuga

SEQ ID NO: 1272907 - RNA, 23 nt, Human
ugcugaccugcugaccugugcac

SEQ ID NO: 1272908 - RNA, 18 nt, Human
ugcuccgaggacccagga

SEQ ID NO: 1272909 - RNA, 20 nt, Human
ugcuccgaggacccaggaaa

SEQ ID NO: 1272910 - RNA, 14 nt, Human
ugcuccgccuggcc

SEQ ID NO: 1272911 - RNA, 16 nt, Human
ugcuccgccuggccug

SEQ ID NO: 1272912 - RNA, 13 nt, Human
ugcuccccacguc

SEQ ID NO: 1272913 - RNA, 18 nt, Human
ugcucccauccugugugu

SEQ ID NO: 1272914 - RNA, 20 nt, Human
aggaaggaggacccaggaca

SEQ ID NO: 1272915 - RNA, 19 nt, Human
aggaaggaggacccaggac

SEQ ID NO: 1272916 - RNA, 18 nt, Human
aggaauuucaccuguaaa

SEQ ID NO: 1272917 - RNA, 23 nt, Human
aggaauuguguuuauaauuuuaa

SEQ ID NO: 1272918 - RNA, 22 nt, Human
aggaauuucaccuguaaaccug

SEQ ID NO: 1272919 - RNA, 15 nt, Human
aggaauuucccagga

SEQ ID NO: 1272920 - RNA, 17 nt, Human
aggaauuucccaggacc

SEQ ID NO: 1272921 - RNA, 18 nt, Human
aggaauuucccaggaccc

SEQ ID NO: 1272922 - RNA, 19 nt, Human
aggaauuucccaggacccu

SEQ ID NO: 1272923 - RNA, 20 nt, Human
aggaauuucccaggacccug

SEQ ID NO: 1272924 - RNA, 21 nt, Human
aggaauuucccaggacccuga

SEQ ID NO: 1272925 - RNA, 13 nt, Human
aggaauuucuuaa

SEQ ID NO: 1272926 - RNA, 21 nt, Human
aggaaggaggacccaggacag

SEQ ID NO: 1272927 - RNA, 18 nt, Human
aggaaggaggacccagga

SEQ ID NO: 1272928 - RNA, 21 nt, Human
aggaaggagcugccuggaccc

SEQ ID NO: 1272929 - RNA, 22 nt, Human
aggaaggagcugccuggacccg

SEQ ID NO: 1272930 - RNA, 17 nt, Human
aggaaggagcugccugg

SEQ ID NO: 1272931 - RNA, 18 nt, Human
aggaaggagcugccugga

SEQ ID NO: 1272932 - RNA, 19 nt, Human
aggaaggagcugccuggac

SEQ ID NO: 1272933 - RNA, 20 nt, Human
aggaaggagcugccuggacc

SEQ ID NO: 1272934 - RNA, 11 nt, Human
aggaauuuaaa

SEQ ID NO: 1272935 - RNA, 22 nt, Human
aggaagcuuuggugagaaccug

SEQ ID NO: 1272936 - RNA, 23 nt, Human
aggaagcuuuggugagaaccugg

SEQ ID NO: 1272937 - RNA, 12 nt, Human
aggaaggagcug

SEQ ID NO: 1272938 - RNA, 13 nt, Human
aggaaggagcugc

SEQ ID NO: 1272939 - RNA, 14 nt, Human
aggaaggagcugcc

SEQ ID NO: 1272940 - RNA, 15 nt, Human
aggaaggagcugccu

SEQ ID NO: 1272941 - RNA, 16 nt, Human
aggaaggagcugccug

SEQ ID NO: 1272942 - RNA, 18 nt, Human
ugcugacuggcuucagca

SEQ ID NO: 1272943 - RNA, 21 nt, Human
ugagagacacacugaagaagc

SEQ ID NO: 1272944 - RNA, 22 nt, Human
ugagagacacacugaagaagca

SEQ ID NO: 1272945 - RNA, 19 nt, Human
ugagagacauuaacucauu

SEQ ID NO: 1272946 - RNA, 18 nt, Human
ugagagacauuaacucau

SEQ ID NO: 1272947 - RNA, 13 nt, Human
ugagagaggccau

SEQ ID NO: 1272948 - RNA, 15 nt, Human
ugagagaguggcugg

SEQ ID NO: 1272949 - RNA, 22 nt, Human
ugagagaguggcuggggcaugg

SEQ ID NO: 1272950 - RNA, 21 nt, Human
ugagagaugcagaaauauuug

SEQ ID NO: 1272951 - RNA, 21 nt, Human
ugagagcaucaggccuagagg

SEQ ID NO: 1272952 - RNA, 20 nt, Human
ugagagcaucaggccuagag

SEQ ID NO: 1272953 - RNA, 20 nt, Human
ugagagcccugaggccuaga

SEQ ID NO: 1272954 - RNA, 14 nt, Human
ugagauguguucac

SEQ ID NO: 1272955 - RNA, 16 nt, Human
ugagauuacaggcaug

SEQ ID NO: 1272956 - RNA, 15 nt, Human
ugagauucucaaagg

SEQ ID NO: 1272957 - RNA, 22 nt, Human
ugagauucucaaaggagcgagc

SEQ ID NO: 1272958 - RNA, 18 nt, Human
ugagauugcaccacugca

SEQ ID NO: 1272959 - RNA, 17 nt, Human
ugagauugaauuucacu

SEQ ID NO: 1272960 - RNA, 16 nt, Human
ugagauuuauuaaaga

SEQ ID NO: 1272961 - RNA, 17 nt, Human
ugagauuuauuaaagaa

SEQ ID NO: 1272962 - RNA, 21 nt, Human
ugagauuuauuaaagaaaaaa

SEQ ID NO: 1272963 - RNA, 22 nt, Human
ugagaugggcuucccaagggcu

SEQ ID NO: 1272964 - RNA, 23 nt, Human
ugagauguagccccucuccugga

SEQ ID NO: 1272965 - RNA, 17 nt, Human
ugagaugcuggcuuggg

SEQ ID NO: 1272966 - RNA, 12 nt, Human
ugagaugcuggc

SEQ ID NO: 1272967 - RNA, 15 nt, Human
ugagaugcuggcuug

SEQ ID NO: 1272968 - RNA, 18 nt, Human
ugagauggagucuugcuc

SEQ ID NO: 1272969 - RNA, 17 nt, Human
ugagauggagucuugcu

SEQ ID NO: 1272970 - RNA, 16 nt, Human
ugagauggcucccagg

SEQ ID NO: 1272971 - RNA, 19 nt, Human
ugagacagaaucucagucu

SEQ ID NO: 1272972 - RNA, 13 nt, Human
ugagagaaaauaa

SEQ ID NO: 1272973 - RNA, 16 nt, Human
ugagagacacacugaa

SEQ ID NO: 1272974 - RNA, 17 nt, Human
ugagagacacacugaag

SEQ ID NO: 1272975 - RNA, 19 nt, Human
ugagagacacacugaagaa

SEQ ID NO: 1272976 - RNA, 20 nt, Human
ugagagacacacugaagaag

SEQ ID NO: 1272977 - RNA, 12 nt, Human
ugagacagcucu

SEQ ID NO: 1272978 - RNA, 20 nt, Human
ugagacucugucucagucca

SEQ ID NO: 1272979 - RNA, 15 nt, Human
agauuuuccugaaaa

SEQ ID NO: 1272980 - RNA, 13 nt, Human
agauuuuacauga

SEQ ID NO: 1272981 - RNA, 16 nt, Human
agauuuuacaugaagu

SEQ ID NO: 1272982 - RNA, 20 nt, Human
agauuuuacaugaaguauuu

SEQ ID NO: 1272983 - RNA, 16 nt, Human
agauuuuccugaaaac

SEQ ID NO: 1272984 - RNA, 19 nt, Human
agauuuuacaugaaguauu

SEQ ID NO: 1272985 - RNA, 16 nt, Human
agauuuucugcuacuu

SEQ ID NO: 1272986 - RNA, 21 nt, Human
ugagaagcugcucaacuugca

SEQ ID NO: 1272987 - RNA, 14 nt, Human
ugagaaucauuuag

SEQ ID NO: 1272988 - RNA, 19 nt, Human
ugagaaucauuuagcaugu

SEQ ID NO: 1272989 - RNA, 17 nt, Human
ugagaagcugcucaacu

SEQ ID NO: 1272990 - RNA, 16 nt, Human
ugagaagcugcucaac

SEQ ID NO: 1272991 - RNA, 14 nt, Human
ugagaagcugcuca

SEQ ID NO: 1272992 - RNA, 12 nt, Human
ugagaagcucug

SEQ ID NO: 1272993 - RNA, 13 nt, Human
ugagaagcugcuc

SEQ ID NO: 1272994 - RNA, 20 nt, Human
ugagacagaaucucgcucug

SEQ ID NO: 1272995 - RNA, 16 nt, Human
ugagaauguaucccca

SEQ ID NO: 1272996 - RNA, 13 nt, Human
ugagaaucccaaa

SEQ ID NO: 1272997 - RNA, 20 nt, Human
ugagaaucccaaauuugauu

SEQ ID NO: 1272998 - RNA, 21 nt, Human
ugagaaucccaaauuugauug

SEQ ID NO: 1272999 - RNA, 22 nt, Human
ugagaaucccaaauuugauuga

SEQ ID NO: 1273000 - RNA, 12 nt, Human
ugagaaucuacc

SEQ ID NO: 1273001 - RNA, 21 nt, Human
ugagaaucuacccccagaucc

SEQ ID NO: 1273002 - RNA, 18 nt, Human
ugagaaucuauauuuaac

SEQ ID NO: 1273003 - RNA, 23 nt, Human
ugagaaucuauauuuaacaagau

SEQ ID NO: 1273004 - RNA, 14 nt, Human
agcacagcuugacc

SEQ ID NO: 1273005 - RNA, 12 nt, Human
agcaauaugcau

SEQ ID NO: 1273006 - RNA, 18 nt, Human
agcacagcuugaccugag

SEQ ID NO: 1273007 - RNA, 20 nt, Human
agcacagcuugaccugaggc

SEQ ID NO: 1273008 - RNA, 12 nt, Human
agcacaggcuaa

SEQ ID NO: 1273009 - RNA, 17 nt, Human
agcacaggcuaauuuuu

SEQ ID NO: 1273010 - RNA, 16 nt, Human
agcacaggcuaauuuu

SEQ ID NO: 1273011 - RNA, 14 nt, Human
agcaccuccucagc

SEQ ID NO: 1273012 - RNA, 15 nt, Human
agcaccuccucagcc

SEQ ID NO: 1273013 - RNA, 16 nt, Human
agcaccuccucagccu

SEQ ID NO: 1273014 - RNA, 18 nt, Human
agcaccuccucagccuga

SEQ ID NO: 1273015 - RNA, 17 nt, Human
agcaccuagccucgcuc

SEQ ID NO: 1273016 - RNA, 19 nt, Human
agcaccggaccagccuggc

SEQ ID NO: 1273017 - RNA, 18 nt, Human
agcaccguucugugcaca

SEQ ID NO: 1273018 - RNA, 15 nt, Human
agcaccuacuuacau

SEQ ID NO: 1273019 - RNA, 16 nt, Human
agcacaugugcugccc

SEQ ID NO: 1273020 - RNA, 16 nt, Human
agcaccggaccagccu

SEQ ID NO: 1273021 - RNA, 17 nt, Human
agcaccggaccagccug

SEQ ID NO: 1273022 - RNA, 18 nt, Human
agcaccggaccagccugg

SEQ ID NO: 1273023 - RNA, 23 nt, Human
agcaccggaccagccuggcccac

SEQ ID NO: 1273024 - RNA, 15 nt, Human
agcaccguucugugc

SEQ ID NO: 1273025 - RNA, 16 nt, Human
agcaccguucugugca

SEQ ID NO: 1273026 - RNA, 17 nt, Human
agcaccguucugugcac

SEQ ID NO: 1273027 - RNA, 15 nt, Human
agcaagucagaauag

SEQ ID NO: 1273028 - RNA, 13 nt, Human
agcaaguaaaaag

SEQ ID NO: 1273029 - RNA, 18 nt, Human
agcaaguaaaaaggcuaa

SEQ ID NO: 1273030 - RNA, 17 nt, Human
agcaagcuuaauggcug

SEQ ID NO: 1273031 - RNA, 12 nt, Human
agcaaggcccga

SEQ ID NO: 1273032 - RNA, 14 nt, Human
agcaaggcccgagc

SEQ ID NO: 1273033 - RNA, 17 nt, Human
agcaaggcccgagcagc

SEQ ID NO: 1273034 - RNA, 18 nt, Human
agcaaggcccgagcagcu

SEQ ID NO: 1273035 - RNA, 19 nt, Human
agcaaggcccgagcagcug

SEQ ID NO: 1273036 - RNA, 22 nt, Human
agcaaggcccgagcagcugagc

SEQ ID NO: 1273037 - RNA, 20 nt, Human
agcaaggcccgagcagcuga

SEQ ID NO: 1273038 - RNA, 21 nt, Human
agcaaggcccgagcagcugag

SEQ ID NO: 1273039 - RNA, 14 nt, Human
ugagcauuagauuu

SEQ ID NO: 1273040 - RNA, 16 nt, Human
ugagcauguuacugac

SEQ ID NO: 1273041 - RNA, 14 nt, Human
ugagcauguuuaga

SEQ ID NO: 1273042 - RNA, 15 nt, Human
ugagcauguuuagac

SEQ ID NO: 1273043 - RNA, 23 nt, Human
ugagcauguuuagacuuuaacau

SEQ ID NO: 1273044 - RNA, 16 nt, Human
ugagcauuagauuucu

SEQ ID NO: 1273045 - RNA, 24 nt, Human
ugagcauguuuagacuuuaacaua

SEQ ID NO: 1273046 - RNA, 15 nt, Human
ugagcaaauguggcu

SEQ ID NO: 1273047 - RNA, 18 nt, Human
ugagcaucugucccccuu

SEQ ID NO: 1273048 - RNA, 16 nt, Human
ugagcaaaucaccaca

SEQ ID NO: 1273049 - RNA, 19 nt, Human
ugagcauggaacacuucga

SEQ ID NO: 1273050 - RNA, 15 nt, Human
ugagcauguuacuga

SEQ ID NO: 1273051 - RNA, 18 nt, Human
ugagauuuauuaaagaaa

SEQ ID NO: 1273052 - RNA, 11 nt, Human
ugagccacugc

SEQ ID NO: 1273053 - RNA, 15 nt, Human
agcaagcaagaggcc

SEQ ID NO: 1273054 - RNA, 15 nt, Human
agcaagcauucagaa

SEQ ID NO: 1273055 - RNA, 18 nt, Human
agcaagcauucagaagaa

SEQ ID NO: 1273056 - RNA, 21 nt, Human
agcaagcauucagaagaaaaa

SEQ ID NO: 1273057 - RNA, 22 nt, Human
agcaagcauucagaagaaaaag

SEQ ID NO: 1273058 - RNA, 17 nt, Human
agcaagcugauuaaaug

SEQ ID NO: 1273059 - RNA, 21 nt, Human
agaugcaguucugaagaagau

SEQ ID NO: 1273060 - RNA, 20 nt, Human
agaugcaccaccaagccaag

SEQ ID NO: 1273061 - RNA, 18 nt, Human
agaugcauuuggguccag

SEQ ID NO: 1273062 - RNA, 19 nt, Human
agaugcauuuggguccagg

SEQ ID NO: 1273063 - RNA, 19 nt, Human
agaugcuagaacucccuuu

SEQ ID NO: 1273064 - RNA, 20 nt, Human
agaugcauuuggguccagga

SEQ ID NO: 1273065 - RNA, 21 nt, Human
agaugcauuuggguccaggag

SEQ ID NO: 1273066 - RNA, 23 nt, Human
agaugcauuuggguccaggagga

SEQ ID NO: 1273067 - RNA, 22 nt, Human
agaugcauuuggguccaggagg

SEQ ID NO: 1273068 - RNA, 18 nt, Human
agaugcaccaccaagcca

SEQ ID NO: 1273069 - RNA, 21 nt, Human
agaugcaccaccaagccaagg

SEQ ID NO: 1273070 - RNA, 22 nt, Human
agauguagccccucuccuggaa

SEQ ID NO: 1273071 - RNA, 13 nt, Human
agauguaggaggg

SEQ ID NO: 1273072 - RNA, 14 nt, Human
agauguaggaggga

SEQ ID NO: 1273073 - RNA, 15 nt, Human
agauguaggagggac

SEQ ID NO: 1273074 - RNA, 14 nt, Human
agauguaguauuuu

SEQ ID NO: 1273075 - RNA, 14 nt, Human
agaugcuggcccag

SEQ ID NO: 1273076 - RNA, 15 nt, Human
agaugcuggcccagg

SEQ ID NO: 1273077 - RNA, 16 nt, Human
agaugcuggcccaggg

SEQ ID NO: 1273078 - RNA, 17 nt, Human
agaugcuggcccagggc

SEQ ID NO: 1273079 - RNA, 18 nt, Human
agaugcuggcccagggcc

SEQ ID NO: 1273080 - RNA, 19 nt, Human
agaugcuggcccagggccc

SEQ ID NO: 1273081 - RNA, 22 nt, Human
agaugcuagaacucccuuucaa

SEQ ID NO: 1273082 - RNA, 21 nt, Human
agaugcuagaacucccuuuca

SEQ ID NO: 1273083 - RNA, 15 nt, Human
agaucccccagaaaa

SEQ ID NO: 1273084 - RNA, 19 nt, Human
agaucccccagaaaagaaa

SEQ ID NO: 1273085 - RNA, 13 nt, Human
agaucccccagaa

SEQ ID NO: 1273086 - RNA, 18 nt, Human
agauccccaagccuggca

SEQ ID NO: 1273087 - RNA, 14 nt, Human
agauccuaaggguc

SEQ ID NO: 1273088 - RNA, 21 nt, Human
agauccuaagggucgaaagcu

SEQ ID NO: 1273089 - RNA, 23 nt, Human
agauccuaagggucgaaagcucu

SEQ ID NO: 1273090 - RNA, 16 nt, Human
agauccuagauccuaa

SEQ ID NO: 1273091 - RNA, 18 nt, Human
agauccuagauccuaagg

SEQ ID NO: 1273092 - RNA, 22 nt, Human
ugaccaaccuuuucccaaccau

SEQ ID NO: 1273093 - RNA, 15 nt, Human
ugaccaagauacuua

SEQ ID NO: 1273094 - RNA, 13 nt, Human
agauccuggaaau

SEQ ID NO: 1273095 - RNA, 12 nt, Human
agauccuccuca

SEQ ID NO: 1273096 - RNA, 13 nt, Human
agauccuccucau

SEQ ID NO: 1273097 - RNA, 12 nt, Human
agauccuccugc

SEQ ID NO: 1273098 - RNA, 17 nt, Human
agauccugcgggugggg

SEQ ID NO: 1273099 - RNA, 14 nt, Human
agauccuggaaauc

SEQ ID NO: 1273100 - RNA, 18 nt, Human
agauccugcggguggggc

SEQ ID NO: 1273101 - RNA, 15 nt, Human
agauccuccucauuc

SEQ ID NO: 1273102 - RNA, 11 nt, Human
agaucuaaaua

SEQ ID NO: 1273103 - RNA, 19 nt, Human
agaucuaaauaaaaugcua

SEQ ID NO: 1273104 - RNA, 18 nt, Human
agaucuaaauaaaaugcu

SEQ ID NO: 1273105 - RNA, 23 nt, Human
ugacacccuucucccacucuccu

SEQ ID NO: 1273106 - RNA, 21 nt, Human
ugacacccuucucccacucuc

SEQ ID NO: 1273107 - RNA, 15 nt, Human
ugacaccuaacucuu

SEQ ID NO: 1273108 - RNA, 18 nt, Human
ugacaccuaacucuucuu

SEQ ID NO: 1273109 - RNA, 17 nt, Human
ugacaccucuuuuuucg

SEQ ID NO: 1273110 - RNA, 15 nt, Human
ugacaccugcugaga

SEQ ID NO: 1273111 - RNA, 21 nt, Human
ugaaugcuuaaagaauucaaa

SEQ ID NO: 1273112 - RNA, 22 nt, Human
ugaaugcuuaaagaauucaaau

SEQ ID NO: 1273113 - RNA, 15 nt, Human
ugacacccuucuccc

SEQ ID NO: 1273114 - RNA, 16 nt, Human
ugacacccuucuccca

SEQ ID NO: 1273115 - RNA, 19 nt, Human
ugacacccuucucccacuc

SEQ ID NO: 1273116 - RNA, 20 nt, Human
ugacacccuucucccacucu

SEQ ID NO: 1273117 - RNA, 17 nt, Human
ugaaugcuuaaagaauu

SEQ ID NO: 1273118 - RNA, 19 nt, Human
ugaaugccuaugguggauc

SEQ ID NO: 1273119 - RNA, 19 nt, Human
ugaaugcugggacucagcc

SEQ ID NO: 1273120 - RNA, 14 nt, Human
ugaaugcugggacu

SEQ ID NO: 1273121 - RNA, 15 nt, Human
ugaaugcugggacuc

SEQ ID NO: 1273122 - RNA, 13 nt, Human
ugaaucaauaaua

SEQ ID NO: 1273123 - RNA, 15 nt, Human
ugaaucaauaauaua

SEQ ID NO: 1273124 - RNA, 16 nt, Human
ugaaucaauaauauau

SEQ ID NO: 1273125 - RNA, 17 nt, Human
ugaaucaauaauauauu

SEQ ID NO: 1273126 - RNA, 19 nt, Human
ugaaucaauaauauauuuu

SEQ ID NO: 1273127 - RNA, 20 nt, Human
ugaaucaauaauauauuuuc

SEQ ID NO: 1273128 - RNA, 22 nt, Human
ugaaucaauaauauauuuucug

SEQ ID NO: 1273129 - RNA, 14 nt, Human
ugaaugccguggau

SEQ ID NO: 1273130 - RNA, 11 nt, Human
ugaaugcuggg

SEQ ID NO: 1273131 - RNA, 12 nt, Human
ugaaugcuggga

SEQ ID NO: 1273132 - RNA, 13 nt, Human
ugaaugcugggac

SEQ ID NO: 1273133 - RNA, 17 nt, Human
ugacacugcaauuggca

SEQ ID NO: 1273134 - RNA, 13 nt, Human
ugacacugcucua

SEQ ID NO: 1273135 - RNA, 15 nt, Human
ugacacugcucuaac

SEQ ID NO: 1273136 - RNA, 16 nt, Human
ugacacugcucuaaca

SEQ ID NO: 1273137 - RNA, 19 nt, Human
ugacacugcucuaacagcc

SEQ ID NO: 1273138 - RNA, 21 nt, Human
ugacacugcucuaacagcccu

SEQ ID NO: 1273139 - RNA, 22 nt, Human
ugacacugcucuaacagcccuc

SEQ ID NO: 1273140 - RNA, 20 nt, Human
ugacacugcuggagaggccc

SEQ ID NO: 1273141 - RNA, 16 nt, Human
ugacacuuaaaaaugg

SEQ ID NO: 1273142 - RNA, 15 nt, Human
ugacacuuaaaaaug

SEQ ID NO: 1273143 - RNA, 12 nt, Human
ugacagcagcau

SEQ ID NO: 1273144 - RNA, 16 nt, Human
ugacagcagcaucucu

SEQ ID NO: 1273145 - RNA, 14 nt, Human
ugacagcagcaucu

SEQ ID NO: 1273146 - RNA, 18 nt, Human
ugacagccucagugaccc

SEQ ID NO: 1273147 - RNA, 15 nt, Human
ugacagccucaguga

SEQ ID NO: 1273148 - RNA, 15 nt, Human
ugacagguaaacuau

SEQ ID NO: 1273149 - RNA, 15 nt, Human
ugacauuccuugcug

SEQ ID NO: 1273150 - RNA, 15 nt, Human
ugacauucugaaugc

SEQ ID NO: 1273151 - RNA, 16 nt, Human
ugacauucugaaugcu

SEQ ID NO: 1273152 - RNA, 15 nt, Human
ugacauucaccugcc

SEQ ID NO: 1273153 - RNA, 18 nt, Human
ugacauucaccugcccca

SEQ ID NO: 1273154 - RNA, 21 nt, Human
ugacagggcggggguggcggc

SEQ ID NO: 1273155 - RNA, 20 nt, Human
ugacauuaugugguuuuaga

SEQ ID NO: 1273156 - RNA, 12 nt, Human
ugacauucaccu

SEQ ID NO: 1273157 - RNA, 18 nt, Human
ugacauucugaaugcuuc

SEQ ID NO: 1273158 - RNA, 20 nt, Human
ugacauuuauauauugaauu

SEQ ID NO: 1273159 - RNA, 18 nt, Human
ugacauuuauuuuucauu

SEQ ID NO: 1273160 - RNA, 21 nt, Human
ugacauuuauuuuucauuuag

SEQ ID NO: 1273161 - RNA, 21 nt, Human
ugacauuuggaguguuccccu

SEQ ID NO: 1273162 - RNA, 21 nt, Human
ugacauuugggagacauguga

SEQ ID NO: 1273163 - RNA, 22 nt, Human
ugacauuugggagacaugugac

SEQ ID NO: 1273164 - RNA, 23 nt, Human
ugacauuugggagacaugugaca

SEQ ID NO: 1273165 - RNA, 24 nt, Human
ugacauuugggagacaugugacau

SEQ ID NO: 1273166 - RNA, 20 nt, Human
agauuacaaaucagaaguca

SEQ ID NO: 1273167 - RNA, 14 nt, Human
agauuaccuccuga

SEQ ID NO: 1273168 - RNA, 19 nt, Human
ugacuuauaguacaugaua

SEQ ID NO: 1273169 - RNA, 17 nt, Human
ugacuuauaguacauga

SEQ ID NO: 1273170 - RNA, 15 nt, Human
ugacuuauaguacau

SEQ ID NO: 1273171 - RNA, 14 nt, Human
agauuaagaaauag

SEQ ID NO: 1273172 - RNA, 15 nt, Human
agauuaagaaauaga

SEQ ID NO: 1273173 - RNA, 14 nt, Human
ugacuuauaguaca

SEQ ID NO: 1273174 - RNA, 13 nt, Human
ugacuuauaguac

SEQ ID NO: 1273175 - RNA, 14 nt, Human
ugacuuaguacaaa

SEQ ID NO: 1273176 - RNA, 16 nt, Human
ugacuuaguacaaagu

SEQ ID NO: 1273177 - RNA, 19 nt, Human
ugacuuaguacaaaguuuc

SEQ ID NO: 1273178 - RNA, 21 nt, Human
agauuagagccuguaaacuuu

SEQ ID NO: 1273179 - RNA, 13 nt, Human
agauucagcuagu

SEQ ID NO: 1273180 - RNA, 16 nt, Human
agauucagguaauaca

SEQ ID NO: 1273181 - RNA, 18 nt, Human
agauucagguaauacaaa

SEQ ID NO: 1273182 - RNA, 20 nt, Human
agauucagguaauacaaacu

SEQ ID NO: 1273183 - RNA, 14 nt, Human
agauuauagauucu

SEQ ID NO: 1273184 - RNA, 15 nt, Human
agauuauagauucua

SEQ ID NO: 1273185 - RNA, 16 nt, Human
agauuauagauucuaa

SEQ ID NO: 1273186 - RNA, 17 nt, Human
agauuauagauucuaaa

SEQ ID NO: 1273187 - RNA, 18 nt, Human
agauuauagauucuaaag

SEQ ID NO: 1273188 - RNA, 19 nt, Human
agauuauagauucuaaaga

SEQ ID NO: 1273189 - RNA, 20 nt, Human
agauuauagauucuaaagau

SEQ ID NO: 1273190 - RNA, 21 nt, Human
agauuauagauucuaaagauu

SEQ ID NO: 1273191 - RNA, 21 nt, Human
agauuccagagaguggcuccu

SEQ ID NO: 1273192 - RNA, 22 nt, Human
agauuccagagaguggcuccuc

SEQ ID NO: 1273193 - RNA, 19 nt, Human
agauuccauugguccaaga

SEQ ID NO: 1273194 - RNA, 20 nt, Human
agauuccauugguccaagau

SEQ ID NO: 1273195 - RNA, 21 nt, Human
agauuccauugguccaagauu

SEQ ID NO: 1273196 - RNA, 22 nt, Human
agauuccauugguccaagauuc

SEQ ID NO: 1273197 - RNA, 23 nt, Human
agauuccauugguccaagauucc

SEQ ID NO: 1273198 - RNA, 13 nt, Human
agauucccagagc

SEQ ID NO: 1273199 - RNA, 16 nt, Human
agauucccagagcaaa

SEQ ID NO: 1273200 - RNA, 12 nt, Human
agauuguuugca

SEQ ID NO: 1273201 - RNA, 12 nt, Human
agauuucauagu

SEQ ID NO: 1273202 - RNA, 18 nt, Human
agauuucauaguucagaa

SEQ ID NO: 1273203 - RNA, 19 nt, Human
agauuucauaguucagaau

SEQ ID NO: 1273204 - RNA, 20 nt, Human
agauuucauaguucagaauu

SEQ ID NO: 1273205 - RNA, 19 nt, Human
agauuugugugcaucaggc

SEQ ID NO: 1273206 - RNA, 15 nt, Human
agauuuguuuuuaaa

SEQ ID NO: 1273207 - RNA, 17 nt, Human
agauuuguuuuuaaacu

SEQ ID NO: 1273208 - RNA, 19 nt, Human
agauuuguuuuuaaacugu

SEQ ID NO: 1273209 - RNA, 20 nt, Human
agauuuguuuuuaaacugua

SEQ ID NO: 1273210 - RNA, 21 nt, Human
agauuuguuuuuaaacuguac

SEQ ID NO: 1273211 - RNA, 22 nt, Human
agauuuguuuuuaaacuguaca

SEQ ID NO: 1273212 - RNA, 23 nt, Human
agauuuguuuuuaaacuguacag

SEQ ID NO: 1273213 - RNA, 15 nt, Human
agauuuuaaucaaau

SEQ ID NO: 1273214 - RNA, 16 nt, Human
agauuuuaaucaaauu

SEQ ID NO: 1273215 - RNA, 18 nt, Human
agauuuuaaucaaauuug

SEQ ID NO: 1273216 - RNA, 16 nt, Human
ugaccugccucccuuc

SEQ ID NO: 1273217 - RNA, 22 nt, Human
agauguauguacuucaugcugu

SEQ ID NO: 1273218 - RNA, 16 nt, Human
agauguaggagggacu

SEQ ID NO: 1273219 - RNA, 13 nt, Human
agaugucuuggaa

SEQ ID NO: 1273220 - RNA, 14 nt, Human
agaugucuuggaac

SEQ ID NO: 1273221 - RNA, 18 nt, Human
agaugucuuggaacauug

SEQ ID NO: 1273222 - RNA, 18 nt, Human
agaugucuuuucccauuu

SEQ ID NO: 1273223 - RNA, 22 nt, Human
agaugucuuuucccauuuaucu

SEQ ID NO: 1273224 - RNA, 21 nt, Human
ugaccugccucccuucaugca

SEQ ID NO: 1273225 - RNA, 16 nt, Human
ugaccugcuaggccag

SEQ ID NO: 1273226 - RNA, 18 nt, Human
ugaccugcuaggccagag

SEQ ID NO: 1273227 - RNA, 22 nt, Human
ugaccugcuaggccagagccca

SEQ ID NO: 1273228 - RNA, 23 nt, Human
ugaccugccucccuucaugcaug

SEQ ID NO: 1273229 - RNA, 19 nt, Human
ugaccugccucccuucaug

SEQ ID NO: 1273230 - RNA, 17 nt, Human
ugaccugccucccuuca

SEQ ID NO: 1273231 - RNA, 19 nt, Human
ugaccugcuaggccagagc

SEQ ID NO: 1273232 - RNA, 11 nt, Human
ugaccugcuga

SEQ ID NO: 1273233 - RNA, 13 nt, Human
ugaccugcugacc

SEQ ID NO: 1273234 - RNA, 15 nt, Human
ugaccugcugaccug

SEQ ID NO: 1273235 - RNA, 18 nt, Human
ugaccugcugaccugugc

SEQ ID NO: 1273236 - RNA, 12 nt, Human
ugaccugcugag

SEQ ID NO: 1273237 - RNA, 13 nt, Human
ugaccugcugagc

SEQ ID NO: 1273238 - RNA, 14 nt, Human
ugaccugcugagcu

SEQ ID NO: 1273239 - RNA, 15 nt, Human
ugaccugcugagcuc

SEQ ID NO: 1273240 - RNA, 16 nt, Human
ugaccugcugagcucu

SEQ ID NO: 1273241 - RNA, 17 nt, Human
ugaccugcugagcucug

SEQ ID NO: 1273242 - RNA, 18 nt, Human
ugaccugcugagcucuga

SEQ ID NO: 1273243 - RNA, 19 nt, Human
ugaccugcugagcucugag

SEQ ID NO: 1273244 - RNA, 20 nt, Human
ugaccugcugagcucugaga

SEQ ID NO: 1273245 - RNA, 22 nt, Human
ugaccugcugagcucugagagg

SEQ ID NO: 1273246 - RNA, 21 nt, Human
ugaccugcugagcucugagag

SEQ ID NO: 1273247 - RNA, 16 nt, Human
ugaccuggauggggca

SEQ ID NO: 1273248 - RNA, 22 nt, Human
ugaccuggauggggcaggccac

SEQ ID NO: 1273249 - RNA, 12 nt, Human
ugaccuggcccc

SEQ ID NO: 1273250 - RNA, 15 nt, Human
ugaccuggcccccuc

SEQ ID NO: 1273251 - RNA, 12 nt, Human
ugacuauguaaa

SEQ ID NO: 1273252 - RNA, 17 nt, Human
ugacuauucuugaugua

SEQ ID NO: 1273253 - RNA, 19 nt, Human
ugacuauucuugauguaaa

SEQ ID NO: 1273254 - RNA, 20 nt, Human
ugacuauucuugauguaaaa

SEQ ID NO: 1273255 - RNA, 22 nt, Human
ugacuauucuugauguaaaauc

SEQ ID NO: 1273256 - RNA, 13 nt, Human
ugacuauguaaac

SEQ ID NO: 1273257 - RNA, 21 nt, Human
ugacucguauaugucucaggu

SEQ ID NO: 1273258 - RNA, 18 nt, Human
ugacucgguuucuccaaa

SEQ ID NO: 1273259 - RNA, 24 nt, Human
ugacucuaagguuaucuacuuuua

SEQ ID NO: 1273260 - RNA, 21 nt, Human
ugacuauucuugauguaaaau

SEQ ID NO: 1273261 - RNA, 14 nt, Human
ugacucgguuucuc

SEQ ID NO: 1273262 - RNA, 15 nt, Human
ugacucgguuucucc

SEQ ID NO: 1273263 - RNA, 16 nt, Human
ugacucgguuucucca

SEQ ID NO: 1273264 - RNA, 19 nt, Human
ugacuguuuuucggacagu

SEQ ID NO: 1273265 - RNA, 20 nt, Human
ugacuguuuuucggacaguu

SEQ ID NO: 1273266 - RNA, 17 nt, Human
ucuuuuuucaaaagaaa

SEQ ID NO: 1273267 - RNA, 13 nt, Human
ucuuuuuucguuu

SEQ ID NO: 1273268 - RNA, 22 nt, Human
ucuuuuuuggccaucugcuccu

SEQ ID NO: 1273269 - RNA, 21 nt, Human
ucuuuuuuggccaucugcucc

SEQ ID NO: 1273270 - RNA, 15 nt, Human
ucuuuuuuucuugaa

SEQ ID NO: 1273271 - RNA, 15 nt, Human
ucuuuuuuuguauag

SEQ ID NO: 1273272 - RNA, 17 nt, Human
ucuuuuuuuguauaguu

SEQ ID NO: 1273273 - RNA, 22 nt, Human
ucuuuuuucuaaaguaaaaaca

SEQ ID NO: 1273274 - RNA, 21 nt, Human
ucuuuuuucuaaaguaaaaac

SEQ ID NO: 1273275 - RNA, 15 nt, Human
agagacacugguggg

SEQ ID NO: 1273276 - RNA, 15 nt, Human
ucuuugucagggagu

SEQ ID NO: 1273277 - RNA, 21 nt, Human
ucuuugucagggaguguuccc

SEQ ID NO: 1273278 - RNA, 16 nt, Human
agagacacacugaaga

SEQ ID NO: 1273279 - RNA, 15 nt, Human
agagacagaaagcag

SEQ ID NO: 1273280 - RNA, 14 nt, Human
agagacagaaagca

SEQ ID NO: 1273281 - RNA, 16 nt, Human
agagacacuggugggg

SEQ ID NO: 1273282 - RNA, 15 nt, Human
agacuuuuaugauac

SEQ ID NO: 1273283 - RNA, 12 nt, Human
agacuuuuauga

SEQ ID NO: 1273284 - RNA, 19 nt, Human
agacugggaaggcuuggga

SEQ ID NO: 1273285 - RNA, 21 nt, Human
agacugggaaggcuugggauu

SEQ ID NO: 1273286 - RNA, 22 nt, Human
agacugggaaggcuugggauuu

SEQ ID NO: 1273287 - RNA, 23 nt, Human
agacugggaaggcuugggauuug

SEQ ID NO: 1273288 - RNA, 12 nt, Human
agacugggcuga

SEQ ID NO: 1273289 - RNA, 14 nt, Human
agacugggcugagg

SEQ ID NO: 1273290 - RNA, 15 nt, Human
agacugggcugaggg

SEQ ID NO: 1273291 - RNA, 16 nt, Human
agacugggcugaggga

SEQ ID NO: 1273292 - RNA, 20 nt, Human
agacugggcugagggagccu

SEQ ID NO: 1273293 - RNA, 19 nt, Human
agacucuacccauauuaca

SEQ ID NO: 1273294 - RNA, 16 nt, Human
agacucuagaguccaa

SEQ ID NO: 1273295 - RNA, 17 nt, Human
agacucuagaguccaag

SEQ ID NO: 1273296 - RNA, 19 nt, Human
agacucuagaguccaaggu

SEQ ID NO: 1273297 - RNA, 20 nt, Human
agacucuagaguccaagguu

SEQ ID NO: 1273298 - RNA, 21 nt, Human
agacuccagcuggguuggaaa

SEQ ID NO: 1273299 - RNA, 14 nt, Human
agacuccagaccug

SEQ ID NO: 1273300 - RNA, 18 nt, Human
agacuccagaccugaggc

SEQ ID NO: 1273301 - RNA, 16 nt, Human
agacucccaagcugga

SEQ ID NO: 1273302 - RNA, 17 nt, Human
agacucccauuccugaa

SEQ ID NO: 1273303 - RNA, 19 nt, Human
agacucccauuccugaaga

SEQ ID NO: 1273304 - RNA, 23 nt, Human
agacucccauuccugaagaacca

SEQ ID NO: 1273305 - RNA, 17 nt, Human
agacuccuagcuguccu

SEQ ID NO: 1273306 - RNA, 22 nt, Human
agacuccuagcuguccuuuuuc

SEQ ID NO: 1273307 - RNA, 21 nt, Human
agacucuagaguccaagguuu

SEQ ID NO: 1273308 - RNA, 17 nt, Human
agacucugucuaccugg

SEQ ID NO: 1273309 - RNA, 11 nt, Human
agacuggcuuu

SEQ ID NO: 1273310 - RNA, 18 nt, Human
agacuggcuuuuauuaau

SEQ ID NO: 1273311 - RNA, 22 nt, Human
agacuggcuuuuauuaaugcac

SEQ ID NO: 1273312 - RNA, 23 nt, Human
agacuggcuuuuauuaaugcacu

SEQ ID NO: 1273313 - RNA, 17 nt, Human
ucuuuaaugcaauauac

SEQ ID NO: 1273314 - RNA, 12 nt, Human
ucuuucccuccu

SEQ ID NO: 1273315 - RNA, 13 nt, Human
ucuuucccuccuu

SEQ ID NO: 1273316 - RNA, 16 nt, Human
ucuuucccuccuuggu

SEQ ID NO: 1273317 - RNA, 14 nt, Human
ucuuucccuggucc

SEQ ID NO: 1273318 - RNA, 14 nt, Human
ucuuucccuccuug

SEQ ID NO: 1273319 - RNA, 17 nt, Human
ucuuucucacuaaaucu

SEQ ID NO: 1273320 - RNA, 18 nt, Human
ucuuucucacuaaaucuu

SEQ ID NO: 1273321 - RNA, 14 nt, Human
ugaaaauuaacaug

SEQ ID NO: 1273322 - RNA, 20 nt, Human
ugaaaaugugcuauacugca

SEQ ID NO: 1273323 - RNA, 21 nt, Human
ugaaaaugugcuauacugcau

SEQ ID NO: 1273324 - RNA, 22 nt, Human
ugaaaaugugcuauacugcaua

SEQ ID NO: 1273325 - RNA, 13 nt, Human
ugaaagaaaauaa

SEQ ID NO: 1273326 - RNA, 12 nt, Human
ugaaaaugcugg

SEQ ID NO: 1273327 - RNA, 16 nt, Human
ugaaaaugggcucaac

SEQ ID NO: 1273328 - RNA, 13 nt, Human
ugaaaaugcuggc

SEQ ID NO: 1273329 - RNA, 16 nt, Human
ugaaaaugucuugugu

SEQ ID NO: 1273330 - RNA, 17 nt, Human
ugaaaaugugcuauacu

SEQ ID NO: 1273331 - RNA, 19 nt, Human
ugaaaaugugcuauacugc

SEQ ID NO: 1273332 - RNA, 14 nt, Human
ugaaaacacauuug

SEQ ID NO: 1273333 - RNA, 17 nt, Human
ugaaaacacauuugcuu

SEQ ID NO: 1273334 - RNA, 14 nt, Human
ucuuuuuuugugau

SEQ ID NO: 1273335 - RNA, 16 nt, Human
ucuuuuuuugugaugu

SEQ ID NO: 1273336 - RNA, 18 nt, Human
ucuuuuuuuguauaguua

SEQ ID NO: 1273337 - RNA, 23 nt, Human
ucuuuuuuuguauaguuaacaca

SEQ ID NO: 1273338 - RNA, 20 nt, Human
ucuuuuuuuucuauuucacu

SEQ ID NO: 1273339 - RNA, 23 nt, Human
ucuuuuuuuuuuuuuaauaaauu

SEQ ID NO: 1273340 - RNA, 22 nt, Human
ucuuuuuuuuuuuuuaauaaau

SEQ ID NO: 1273341 - RNA, 19 nt, Human
ugaaaacacauuugcuuuu

SEQ ID NO: 1273342 - RNA, 20 nt, Human
ugaaaauaaaaagaucacuu

SEQ ID NO: 1273343 - RNA, 21 nt, Human
ugaaaauaaaaagaucacuuu

SEQ ID NO: 1273344 - RNA, 13 nt, Human
ugaaaauaaagaa

SEQ ID NO: 1273345 - RNA, 14 nt, Human
ugaaaauaaagaau

SEQ ID NO: 1273346 - RNA, 15 nt, Human
ugaaaauaaagaaug

SEQ ID NO: 1273347 - RNA, 16 nt, Human
ugaaaauaaagaaugg

SEQ ID NO: 1273348 - RNA, 17 nt, Human
ugaaaauaaaguguaua

SEQ ID NO: 1273349 - RNA, 16 nt, Human
ugaaaauaagaauaga

SEQ ID NO: 1273350 - RNA, 17 nt, Human
ugaaaauaaagaaugga

SEQ ID NO: 1273351 - RNA, 17 nt, Human
agagaguggcuggggca

SEQ ID NO: 1273352 - RNA, 15 nt, Human
agagaguugaaccua

SEQ ID NO: 1273353 - RNA, 13 nt, Human
agagauacagagg

SEQ ID NO: 1273354 - RNA, 13 nt, Human
agagaguggcugg

SEQ ID NO: 1273355 - RNA, 14 nt, Human
agagaguggcuggg

SEQ ID NO: 1273356 - RNA, 16 nt, Human
agagaguggcuggggc

SEQ ID NO: 1273357 - RNA, 17 nt, Human
agagaguggcuccuccc

SEQ ID NO: 1273358 - RNA, 21 nt, Human
agagaucccaaguagaaucuc

SEQ ID NO: 1273359 - RNA, 13 nt, Human
agagaugcagaaa

SEQ ID NO: 1273360 - RNA, 17 nt, Human
agagaugcagaaauauu

SEQ ID NO: 1273361 - RNA, 16 nt, Human
agagaugcagaaauau

SEQ ID NO: 1273362 - RNA, 13 nt, Human
agagaugccuccc

SEQ ID NO: 1273363 - RNA, 14 nt, Human
agagaugccucccu

SEQ ID NO: 1273364 - RNA, 18 nt, Human
agagaugccucccugagc

SEQ ID NO: 1273365 - RNA, 22 nt, Human
agagacugaauagauaugaaag

SEQ ID NO: 1273366 - RNA, 15 nt, Human
agagacuugggaaug

SEQ ID NO: 1273367 - RNA, 12 nt, Human
agagacuuguuu

SEQ ID NO: 1273368 - RNA, 18 nt, Human
agagacuuguuuuggaug

SEQ ID NO: 1273369 - RNA, 16 nt, Human
agagacuuguuuugga

SEQ ID NO: 1273370 - RNA, 17 nt, Human
ugaaagaggaaugaagu

SEQ ID NO: 1273371 - RNA, 18 nt, Human
ugaaagaggaaugaagua

SEQ ID NO: 1273372 - RNA, 14 nt, Human
ugaaagagaaacac

SEQ ID NO: 1273373 - RNA, 22 nt, Human
ugaaauugaaccuuugugcccu

SEQ ID NO: 1273374 - RNA, 12 nt, Human
ugaaauuucaga

SEQ ID NO: 1273375 - RNA, 13 nt, Human
ugaaauugaaccu

SEQ ID NO: 1273376 - RNA, 17 nt, Human
ugaaauugaaccuuugu

SEQ ID NO: 1273377 - RNA, 19 nt, Human
ugaaauugaaccuuugugc

SEQ ID NO: 1273378 - RNA, 23 nt, Human
ugaaauagacccacaagaggcag

SEQ ID NO: 1273379 - RNA, 15 nt, Human
ugaaauuuccuggga

SEQ ID NO: 1273380 - RNA, 22 nt, Human
ugaaauuucagauucccagagc

SEQ ID NO: 1273381 - RNA, 21 nt, Human
ugaaauuuccugggagcuuuu

SEQ ID NO: 1273382 - RNA, 23 nt, Human
ugaaauuuccugggagcuuuugu

SEQ ID NO: 1273383 - RNA, 13 nt, Human
ugaaauuuuucuu

SEQ ID NO: 1273384 - RNA, 15 nt, Human
ugaaauuuuucuucu

SEQ ID NO: 1273385 - RNA, 14 nt, Human
ugaacaaagcagcc

SEQ ID NO: 1273386 - RNA, 15 nt, Human
ugaacaaagcagcca

SEQ ID NO: 1273387 - RNA, 16 nt, Human
ugaacaaagcagccac

SEQ ID NO: 1273388 - RNA, 17 nt, Human
ugaacaaagcagccacg

SEQ ID NO: 1273389 - RNA, 23 nt, Human
ugaacaaaguuuaccagaaagca

SEQ ID NO: 1273390 - RNA, 15 nt, Human
ugaacaaauggccuu

SEQ ID NO: 1273391 - RNA, 13 nt, Human
ugaaauaaacguc

SEQ ID NO: 1273392 - RNA, 18 nt, Human
ugaaauaaacgucuuaaa

SEQ ID NO: 1273393 - RNA, 22 nt, Human
ugaaauaaacgucuuaaauauu

SEQ ID NO: 1273394 - RNA, 23 nt, Human
ugaaauaaacgucuuaaauauuc

SEQ ID NO: 1273395 - RNA, 14 nt, Human
ugaaauaagccaga

SEQ ID NO: 1273396 - RNA, 15 nt, Human
ugaaauaagaauuca

SEQ ID NO: 1273397 - RNA, 21 nt, Human
ugaaauaccaaccugaagaca

SEQ ID NO: 1273398 - RNA, 20 nt, Human
ugaaauaagaauucagacau

SEQ ID NO: 1273399 - RNA, 20 nt, Human
agagauuaccuccugagaaa

SEQ ID NO: 1273400 - RNA, 23 nt, Human
agagauucugaacuaaagugcug

SEQ ID NO: 1273401 - RNA, 15 nt, Human
agagaugccucccug

SEQ ID NO: 1273402 - RNA, 21 nt, Human
agagauguguguugauacugu

SEQ ID NO: 1273403 - RNA, 22 nt, Human
agagauguguguugauacuguu

SEQ ID NO: 1273404 - RNA, 23 nt, Human
agagauguguguugauacuguug

SEQ ID NO: 1273405 - RNA, 24 nt, Human
agagauguguguugauacuguugc

SEQ ID NO: 1273406 - RNA, 16 nt, Human
agagauuaccuccuga

SEQ ID NO: 1273407 - RNA, 19 nt, Human
agagauuaccuccugagaa

SEQ ID NO: 1273408 - RNA, 23 nt, Human
agagauuggguuuuuggacuucu

SEQ ID NO: 1273409 - RNA, 23 nt, Human
ugaacuagaguuuagcuggaaaa

SEQ ID NO: 1273410 - RNA, 21 nt, Human
ugaacuaaagugcugcacuca

SEQ ID NO: 1273411 - RNA, 19 nt, Human
ugaacuaaagugcugcacu

SEQ ID NO: 1273412 - RNA, 23 nt, Human
ugaacguuuucuaauugcuuauu

SEQ ID NO: 1273413 - RNA, 19 nt, Human
ugaacguuuucuaauugcu

SEQ ID NO: 1273414 - RNA, 15 nt, Human
ugaacuaaagugcug

SEQ ID NO: 1273415 - RNA, 15 nt, Human
ugaacguuuucuaau

SEQ ID NO: 1273416 - RNA, 16 nt, Human
ugaacguuuucuaauu

SEQ ID NO: 1273417 - RNA, 17 nt, Human
ugaacguuuucuaauug

SEQ ID NO: 1273418 - RNA, 18 nt, Human
ugaacccgggaggcagag

SEQ ID NO: 1273419 - RNA, 22 nt, Human
ugaacccauauuuguacaccaa

SEQ ID NO: 1273420 - RNA, 12 nt, Human
ugaaccaccgcg

SEQ ID NO: 1273421 - RNA, 18 nt, Human
ugaacaaauuuacagaga

SEQ ID NO: 1273422 - RNA, 13 nt, Human
ugaacaaauuuac

SEQ ID NO: 1273423 - RNA, 17 nt, Human
ugaaccauuaaccagau

SEQ ID NO: 1273424 - RNA, 12 nt, Human
ugaacccaggac

SEQ ID NO: 1273425 - RNA, 22 nt, Human
ugaacccaggacaagcaugguc

SEQ ID NO: 1273426 - RNA, 13 nt, Human
ugaacccaggaca

SEQ ID NO: 1273427 - RNA, 15 nt, Human
ugaacuccugaccuc

SEQ ID NO: 1273428 - RNA, 20 nt, Human
ugaacuaccuugguuccccc

SEQ ID NO: 1273429 - RNA, 20 nt, Human
ugaacucacuuuccuccuga

SEQ ID NO: 1273430 - RNA, 13 nt, Human
ugaagaacaugug

SEQ ID NO: 1273431 - RNA, 14 nt, Human
ugaagaacauguga

SEQ ID NO: 1273432 - RNA, 19 nt, Human
ugaagaaccagucccccca

SEQ ID NO: 1273433 - RNA, 20 nt, Human
ugaagaaccaguccccccac

SEQ ID NO: 1273434 - RNA, 13 nt, Human
ugaagaacugagg

SEQ ID NO: 1273435 - RNA, 19 nt, Human
ugaagaacugaggaggaaa

SEQ ID NO: 1273436 - RNA, 14 nt, Human
ugaagaacugcagg

SEQ ID NO: 1273437 - RNA, 15 nt, Human
ugaagaacugcaggc

SEQ ID NO: 1273438 - RNA, 16 nt, Human
ugaagaacugcaggcc

SEQ ID NO: 1273439 - RNA, 17 nt, Human
ugaagaacugcaggccc

SEQ ID NO: 1273440 - RNA, 20 nt, Human
ugaagaacugcaggcccugg

SEQ ID NO: 1273441 - RNA, 14 nt, Human
ugaagacagaacca

SEQ ID NO: 1273442 - RNA, 19 nt, Human
ugaagacagaaccacaggg

SEQ ID NO: 1273443 - RNA, 13 nt, Human
ugaagacagaagu

SEQ ID NO: 1273444 - RNA, 12 nt, Human
agagcuggugcg

SEQ ID NO: 1273445 - RNA, 18 nt, Human
ugaagaacugcaggcccu

SEQ ID NO: 1273446 - RNA, 14 nt, Human
ugaacuccugccau

SEQ ID NO: 1273447 - RNA, 15 nt, Human
ugaagaaggugaaua

SEQ ID NO: 1273448 - RNA, 22 nt, Human
ugaagaagcuaaauccuuuacu

SEQ ID NO: 1273449 - RNA, 16 nt, Human
ugaagaauacuucuca

SEQ ID NO: 1273450 - RNA, 19 nt, Human
ugaagaauacuucucauuu

SEQ ID NO: 1273451 - RNA, 21 nt, Human
ugaagaauacuucucauuuuu

SEQ ID NO: 1273452 - RNA, 20 nt, Human
ugaagaauacuucucauuuu

SEQ ID NO: 1273453 - RNA, 22 nt, Human
ugaagaaugcacaagaauggau

SEQ ID NO: 1273454 - RNA, 13 nt, Human
ugaagaauguuaa

SEQ ID NO: 1273455 - RNA, 21 nt, Human
ugaagaauuauuuuuuuucuu

SEQ ID NO: 1273456 - RNA, 20 nt, Human
ugaagaauuauuuuuuuucu

SEQ ID NO: 1273457 - RNA, 22 nt, Human
agaguaauccaagcaaauguga

SEQ ID NO: 1273458 - RNA, 20 nt, Human
agaguaauccaagcaaaugu

SEQ ID NO: 1273459 - RNA, 18 nt, Human
agaguaauccaagcaaau

SEQ ID NO: 1273460 - RNA, 20 nt, Human
agaggcugccccucucacca

SEQ ID NO: 1273461 - RNA, 15 nt, Human
agaggcugcccuccu

SEQ ID NO: 1273462 - RNA, 14 nt, Human
agaggcugccccuc

SEQ ID NO: 1273463 - RNA, 16 nt, Human
agaggcugccccucuc

SEQ ID NO: 1273464 - RNA, 18 nt, Human
agaggcugccccucucac

SEQ ID NO: 1273465 - RNA, 19 nt, Human
agaggcugccccucucacc

SEQ ID NO: 1273466 - RNA, 12 nt, Human
agaggcugcccc

SEQ ID NO: 1273467 - RNA, 20 nt, Human
agaggccuguuuggccucuc

SEQ ID NO: 1273468 - RNA, 19 nt, Human
agaggcugaggcuggcaca

SEQ ID NO: 1273469 - RNA, 21 nt, Human
agaggcugaggcuggcacagg

SEQ ID NO: 1273470 - RNA, 18 nt, Human
agaggccuguuuggccuc

SEQ ID NO: 1273471 - RNA, 23 nt, Human
agaggccaggcaggagcccuucu

SEQ ID NO: 1273472 - RNA, 13 nt, Human
agaggcaguaccu

SEQ ID NO: 1273473 - RNA, 13 nt, Human
agaggccagaggc

SEQ ID NO: 1273474 - RNA, 12 nt, Human
agaggcccugga

SEQ ID NO: 1273475 - RNA, 13 nt, Human
agaggcccuggau

SEQ ID NO: 1273476 - RNA, 15 nt, Human
agaggcccuggauca

SEQ ID NO: 1273477 - RNA, 17 nt, Human
agaggcccuggaucagc

SEQ ID NO: 1273478 - RNA, 20 nt, Human
agaggcccuggaucagcgug

SEQ ID NO: 1273479 - RNA, 21 nt, Human
agaggcccuggaucagcgugg

SEQ ID NO: 1273480 - RNA, 22 nt, Human
agaggcccuggaucagcguggc

SEQ ID NO: 1273481 - RNA, 24 nt, Human
agaggcccuggaucagcguggccu

SEQ ID NO: 1273482 - RNA, 23 nt, Human
agaggcccuggaucagcguggcc

SEQ ID NO: 1273483 - RNA, 14 nt, Human
agaggccguggcug

SEQ ID NO: 1273484 - RNA, 15 nt, Human
agaggccguggcugc

SEQ ID NO: 1273485 - RNA, 22 nt, Human
agaggccguggcugcuguggga

SEQ ID NO: 1273486 - RNA, 17 nt, Human
agaggccguggcugcug

SEQ ID NO: 1273487 - RNA, 14 nt, Human
agaggccugggcug

SEQ ID NO: 1273488 - RNA, 18 nt, Human
agaggccugggcugggaa

SEQ ID NO: 1273489 - RNA, 19 nt, Human
agaggccugggcugggaaa

SEQ ID NO: 1273490 - RNA, 15 nt, Human
agagcuggugcggcu

SEQ ID NO: 1273491 - RNA, 17 nt, Human
agagcuggugcggcugg

SEQ ID NO: 1273492 - RNA, 18 nt, Human
agagcuggugcggcuggc

SEQ ID NO: 1273493 - RNA, 19 nt, Human
agagcuggugcggcuggcc

SEQ ID NO: 1273494 - RNA, 22 nt, Human
agagcuggugcggcuggccaug

SEQ ID NO: 1273495 - RNA, 21 nt, Human
agagcuggugcggcuggccau

SEQ ID NO: 1273496 - RNA, 17 nt, Human
agagcuguauuaagcca

SEQ ID NO: 1273497 - RNA, 19 nt, Human
agagcuguauuaagccacu

SEQ ID NO: 1273498 - RNA, 15 nt, Human
ugaauacauuuccaa

SEQ ID NO: 1273499 - RNA, 16 nt, Human
ugaauaccacucugua

SEQ ID NO: 1273500 - RNA, 20 nt, Human
ugaagucaauuacucuauaa

SEQ ID NO: 1273501 - RNA, 21 nt, Human
ugaauauuuguuauguagaua

SEQ ID NO: 1273502 - RNA, 18 nt, Human
ugaaucaagggucaggcc

SEQ ID NO: 1273503 - RNA, 20 nt, Human
ugaaucaagggucaggccuu

SEQ ID NO: 1273504 - RNA, 23 nt, Human
ugaauaauguaagacaaauaugu

SEQ ID NO: 1273505 - RNA, 20 nt, Human
ugaaguauuuugcuggaaua

SEQ ID NO: 1273506 - RNA, 17 nt, Human
ugaaguauuuuuucagu

SEQ ID NO: 1273507 - RNA, 21 nt, Human
ugaaguauuuuuucaguauua

SEQ ID NO: 1273508 - RNA, 17 nt, Human
ugaaguacucauacaug

SEQ ID NO: 1273509 - RNA, 15 nt, Human
ugaaguaagcaaaga

SEQ ID NO: 1273510 - RNA, 18 nt, Human
ugaaguacccguucacau

SEQ ID NO: 1273511 - RNA, 23 nt, Human
ugaaguacccguucacauuuuug

SEQ ID NO: 1273512 - RNA, 17 nt, Human
ugaagauuuaccacuug

SEQ ID NO: 1273513 - RNA, 20 nt, Human
ugaagauuuaccacuugugu

SEQ ID NO: 1273514 - RNA, 19 nt, Human
ugaagauuuaauauuacag

SEQ ID NO: 1273515 - RNA, 15 nt, Human
ugaagggaagagaca

SEQ ID NO: 1273516 - RNA, 15 nt, Human
ugaagggcaggugcu

SEQ ID NO: 1273517 - RNA, 19 nt, Human
ugaagggcaggugcuucag

SEQ ID NO: 1273518 - RNA, 12 nt, Human
ugaagggccaga

SEQ ID NO: 1273519 - RNA, 14 nt, Human
ugaagggccagagc

SEQ ID NO: 1273520 - RNA, 15 nt, Human
ugaagggccagagcc

SEQ ID NO: 1273521 - RNA, 16 nt, Human
ugaagggccagagcca

SEQ ID NO: 1273522 - RNA, 17 nt, Human
ugaagggccagagccag

SEQ ID NO: 1273523 - RNA, 18 nt, Human
ugaagggccagagccagg

SEQ ID NO: 1273524 - RNA, 13 nt, Human
ugaaguaagcaaa

SEQ ID NO: 1273525 - RNA, 14 nt, Human
ugaaguaagcaaag

SEQ ID NO: 1273526 - RNA, 22 nt, Human
ugaaguaaaacaaacaauaccu

SEQ ID NO: 1273527 - RNA, 13 nt, Human
ugaaguaaaacaa

SEQ ID NO: 1273528 - RNA, 14 nt, Human
ugaaguaaacuuuu

SEQ ID NO: 1273529 - RNA, 16 nt, Human
ugaaguaaacuuuuug

SEQ ID NO: 1273530 - RNA, 22 nt, Human
ugaaguaaacuuuuuguucugg

SEQ ID NO: 1273531 - RNA, 23 nt, Human
ugaaguaaaacaaacaauaccug

SEQ ID NO: 1273532 - RNA, 19 nt, Human
agaauguaaaugucucacu

SEQ ID NO: 1273533 - RNA, 17 nt, Human
agaauguaaaugucuca

SEQ ID NO: 1273534 - RNA, 14 nt, Human
agaauguaaauguc

SEQ ID NO: 1273535 - RNA, 13 nt, Human
agaauguaaaugu

SEQ ID NO: 1273536 - RNA, 13 nt, Human
agaauguaaagcu

SEQ ID NO: 1273537 - RNA, 16 nt, Human
agaauguaaagcuugu

SEQ ID NO: 1273538 - RNA, 17 nt, Human
agaauguaaagcuuguc

SEQ ID NO: 1273539 - RNA, 23 nt, Human
agaauggugugggagagggauga

SEQ ID NO: 1273540 - RNA, 12 nt, Human
agaauguaaagc

SEQ ID NO: 1273541 - RNA, 20 nt, Human
agaauccagcaccggcccca

SEQ ID NO: 1273542 - RNA, 15 nt, Human
agaaucccaaauuug

SEQ ID NO: 1273543 - RNA, 18 nt, Human
agaauccacauuucuaaa

SEQ ID NO: 1273544 - RNA, 19 nt, Human
agaauccacauuucuaaaa

SEQ ID NO: 1273545 - RNA, 20 nt, Human
agaauccacauuucuaaaau

SEQ ID NO: 1273546 - RNA, 22 nt, Human
agaauccacauuucuaaaaucu

SEQ ID NO: 1273547 - RNA, 17 nt, Human
agaaucccaaauuugau

SEQ ID NO: 1273548 - RNA, 18 nt, Human
agaaucccaaauuugauu

SEQ ID NO: 1273549 - RNA, 19 nt, Human
agaaucccaaauuugauug

SEQ ID NO: 1273550 - RNA, 21 nt, Human
agaaucccagcccccugacca

SEQ ID NO: 1273551 - RNA, 20 nt, Human
agaaucccuuaacaguugua

SEQ ID NO: 1273552 - RNA, 18 nt, Human
agaauauuaucuucauaa

SEQ ID NO: 1273553 - RNA, 15 nt, Human
agaaucauuuagcau

SEQ ID NO: 1273554 - RNA, 16 nt, Human
agaauccacauuucua

SEQ ID NO: 1273555 - RNA, 17 nt, Human
agaauccacauuucuaa

SEQ ID NO: 1273556 - RNA, 22 nt, Human
agaauguaaaugucucacugag

SEQ ID NO: 1273557 - RNA, 23 nt, Human
agaauguauauuaagguguggcu

SEQ ID NO: 1273558 - RNA, 21 nt, Human
agaauguauccccaaaagcgu

SEQ ID NO: 1273559 - RNA, 14 nt, Human
agaauguaucccca

SEQ ID NO: 1273560 - RNA, 23 nt, Human
agaauuaacacaugauccugcaa

SEQ ID NO: 1273561 - RNA, 14 nt, Human
agaauuaucuaauu

SEQ ID NO: 1273562 - RNA, 15 nt, Human
agaauuaucuaauuu

SEQ ID NO: 1273563 - RNA, 17 nt, Human
agaauuaucuaauuuau

SEQ ID NO: 1273564 - RNA, 15 nt, Human
agaauuaacacauga

SEQ ID NO: 1273565 - RNA, 14 nt, Human
agaauuaaacuuuu

SEQ ID NO: 1273566 - RNA, 15 nt, Human
agaauuaaacuuuua

SEQ ID NO: 1273567 - RNA, 18 nt, Human
agaauuaaacuuuuaauu

SEQ ID NO: 1273568 - RNA, 20 nt, Human
agaauuaaacuuuuaauuca

SEQ ID NO: 1273569 - RNA, 21 nt, Human
agaauuaaacuuuuaauucau

SEQ ID NO: 1273570 - RNA, 22 nt, Human
agaauuaaacuuuuaauucauu

SEQ ID NO: 1273571 - RNA, 12 nt, Human
agaauucaaauu

SEQ ID NO: 1273572 - RNA, 13 nt, Human
agaauucagacau

SEQ ID NO: 1273573 - RNA, 17 nt, Human
agaauucaaauuuuauc

SEQ ID NO: 1273574 - RNA, 15 nt, Human
agaauuauuuuguga

SEQ ID NO: 1273575 - RNA, 13 nt, Human
agaauuauuuugu

SEQ ID NO: 1273576 - RNA, 18 nt, Human
agaauuaucuaauuuaua

SEQ ID NO: 1273577 - RNA, 20 nt, Human
agaauuaucuaauuuauaaa

SEQ ID NO: 1273578 - RNA, 21 nt, Human
agaauuaucuaauuuauaaaa

SEQ ID NO: 1273579 - RNA, 11 nt, Human
agaauuauuua

SEQ ID NO: 1273580 - RNA, 13 nt, Human
ucugggagggcag

SEQ ID NO: 1273581 - RNA, 19 nt, Human
ucugggagggcagcagggc

SEQ ID NO: 1273582 - RNA, 21 nt, Human
ucugggagggcagcagggcua

SEQ ID NO: 1273583 - RNA, 15 nt, Human
ucugggagucacaca

SEQ ID NO: 1273584 - RNA, 16 nt, Human
ucugggagucacacag

SEQ ID NO: 1273585 - RNA, 18 nt, Human
ucugggagucacacagug

SEQ ID NO: 1273586 - RNA, 17 nt, Human
ucugggagucacacagu

SEQ ID NO: 1273587 - RNA, 18 nt, Human
ucugggauaaguaaguuu

SEQ ID NO: 1273588 - RNA, 17 nt, Human
agaauaaaauuuuuaau

SEQ ID NO: 1273589 - RNA, 13 nt, Human
agaauaaacauuu

SEQ ID NO: 1273590 - RNA, 14 nt, Human
agaauaaacauuug

SEQ ID NO: 1273591 - RNA, 16 nt, Human
agaauaaacauuuguu

SEQ ID NO: 1273592 - RNA, 17 nt, Human
agaauaaacauuuguua

SEQ ID NO: 1273593 - RNA, 14 nt, Human
agaauaaaauuuuu

SEQ ID NO: 1273594 - RNA, 12 nt, Human
agaauaaaauuu

SEQ ID NO: 1273595 - RNA, 12 nt, Human
agaauaaguuau

SEQ ID NO: 1273596 - RNA, 13 nt, Human
agaauaaguuauu

SEQ ID NO: 1273597 - RNA, 14 nt, Human
agaauaaguuauug

SEQ ID NO: 1273598 - RNA, 16 nt, Human
agaauaaguuauugca

SEQ ID NO: 1273599 - RNA, 17 nt, Human
agaauaaguuauugcag

SEQ ID NO: 1273600 - RNA, 19 nt, Human
agaauaaguuauugcaguu

SEQ ID NO: 1273601 - RNA, 20 nt, Human
agaauaaguuauugcaguuu

SEQ ID NO: 1273602 - RNA, 21 nt, Human
agaauaaguuauugcaguuua

SEQ ID NO: 1273603 - RNA, 12 nt, Human
agaauaugccuu

SEQ ID NO: 1273604 - RNA, 13 nt, Human
agaauaugaaaca

SEQ ID NO: 1273605 - RNA, 14 nt, Human
agaauaugucagug

SEQ ID NO: 1273606 - RNA, 16 nt, Human
agaauagaugcugacu

SEQ ID NO: 1273607 - RNA, 17 nt, Human
agaauagccacauuugg

SEQ ID NO: 1273608 - RNA, 19 nt, Human
agaauagccacauuuggaa

SEQ ID NO: 1273609 - RNA, 17 nt, Human
agaauauccaugaccua

SEQ ID NO: 1273610 - RNA, 16 nt, Human
agaauaucacagaaaa

SEQ ID NO: 1273611 - RNA, 19 nt, Human
agaauacuucucauuuuuu

SEQ ID NO: 1273612 - RNA, 15 nt, Human
agaauacuucucauu

SEQ ID NO: 1273613 - RNA, 22 nt, Human
agaauagaaauaaaggauguga

SEQ ID NO: 1273614 - RNA, 17 nt, Human
agaauagaacacaguuu

SEQ ID NO: 1273615 - RNA, 20 nt, Human
agaaguggggacagagcaga

SEQ ID NO: 1273616 - RNA, 21 nt, Human
agaagugugccuucucucucc

SEQ ID NO: 1273617 - RNA, 22 nt, Human
agaaguguggggauuuucacug

SEQ ID NO: 1273618 - RNA, 15 nt, Human
agaaguuaguuugua

SEQ ID NO: 1273619 - RNA, 16 nt, Human
agaaguuaguuuguau

SEQ ID NO: 1273620 - RNA, 18 nt, Human
agaaguuaguuuguauau

SEQ ID NO: 1273621 - RNA, 19 nt, Human
agaaguuaguuuguauaua

SEQ ID NO: 1273622 - RNA, 19 nt, Human
agaaguucaauauaagcuu

SEQ ID NO: 1273623 - RNA, 18 nt, Human
agaaguuuagauuuuaau

SEQ ID NO: 1273624 - RNA, 19 nt, Human
agaaguuucaucauuuuuu

SEQ ID NO: 1273625 - RNA, 21 nt, Human
agaaguuucaucauuuuuuac

SEQ ID NO: 1273626 - RNA, 23 nt, Human
agaaguuucaucauuuuuuacuu

SEQ ID NO: 1273627 - RNA, 12 nt, Human
ucugcuuuccuc

SEQ ID NO: 1273628 - RNA, 13 nt, Human
ucugcuuuccucu

SEQ ID NO: 1273629 - RNA, 18 nt, Human
ucugcuuuccucuuccug

SEQ ID NO: 1273630 - RNA, 17 nt, Human
ucugcuuucuccuuuaa

SEQ ID NO: 1273631 - RNA, 19 nt, Human
agaaggcaaaaauaguuug

SEQ ID NO: 1273632 - RNA, 16 nt, Human
ucugcuuguauuccaa

SEQ ID NO: 1273633 - RNA, 19 nt, Human
ucugcuuguuauuagagau

SEQ ID NO: 1273634 - RNA, 20 nt, Human
ucugcuuuaaaaaugucuua

SEQ ID NO: 1273635 - RNA, 15 nt, Human
agaaggcaaaaaugu

SEQ ID NO: 1273636 - RNA, 18 nt, Human
agaaggcauuugcagggu

SEQ ID NO: 1273637 - RNA, 12 nt, Human
agaagggaaagc

SEQ ID NO: 1273638 - RNA, 15 nt, Human
agaagggaaagccca

SEQ ID NO: 1273639 - RNA, 14 nt, Human
ucugugagaugcua

SEQ ID NO: 1273640 - RNA, 23 nt, Human
ucugugagaugcuagaacucccu

SEQ ID NO: 1273641 - RNA, 17 nt, Human
ucugugagauucauuca

SEQ ID NO: 1273642 - RNA, 19 nt, Human
ucugugagauucauucaug

SEQ ID NO: 1273643 - RNA, 22 nt, Human
ucugugagaugcuagaacuccc

SEQ ID NO: 1273644 - RNA, 17 nt, Human
ucugugagaugcuagaa

SEQ ID NO: 1273645 - RNA, 14 nt, Human
ucugggccagaauu

SEQ ID NO: 1273646 - RNA, 15 nt, Human
ucugggccagaauuu

SEQ ID NO: 1273647 - RNA, 21 nt, Human
ucugggccauucuccacagca

SEQ ID NO: 1273648 - RNA, 12 nt, Human
ucugggccugac

SEQ ID NO: 1273649 - RNA, 14 nt, Human
ucugggccuuggcc

SEQ ID NO: 1273650 - RNA, 15 nt, Human
ucugggccuuggccu

SEQ ID NO: 1273651 - RNA, 18 nt, Human
ucugggccuuggccugga

SEQ ID NO: 1273652 - RNA, 19 nt, Human
ucugggccuuggccuggag

SEQ ID NO: 1273653 - RNA, 20 nt, Human
ucugggccuuggccuggagc

SEQ ID NO: 1273654 - RNA, 22 nt, Human
ucugggccuuggccuggagcac

SEQ ID NO: 1273655 - RNA, 23 nt, Human
ucuguauuugaaucagccuacag

SEQ ID NO: 1273656 - RNA, 21 nt, Human
ucugggccuuggccuggagca

SEQ ID NO: 1273657 - RNA, 13 nt, Human
ucugucacuuaau

SEQ ID NO: 1273658 - RNA, 16 nt, Human
ucuguuguauucauug

SEQ ID NO: 1273659 - RNA, 18 nt, Human
ucuguuggcaggcuggcc

SEQ ID NO: 1273660 - RNA, 20 nt, Human
ucuguuggcaggcuggccag

SEQ ID NO: 1273661 - RNA, 23 nt, Human
ucuguugucguaaagauuugggu

SEQ ID NO: 1273662 - RNA, 15 nt, Human
ucuguugcugccuca

SEQ ID NO: 1273663 - RNA, 15 nt, Human
ucuguuggcaggcug

SEQ ID NO: 1273664 - RNA, 21 nt, Human
ucugugagggugcugacuggc

SEQ ID NO: 1273665 - RNA, 20 nt, Human
ucugugaucugggucucuaa

SEQ ID NO: 1273666 - RNA, 16 nt, Human
ucuguugcaagugcaa

SEQ ID NO: 1273667 - RNA, 22 nt, Human
agaauuugauaugugaacaguu

SEQ ID NO: 1273668 - RNA, 17 nt, Human
agaauugaguaauggug

SEQ ID NO: 1273669 - RNA, 18 nt, Human
agaauugaguaauggugu

SEQ ID NO: 1273670 - RNA, 14 nt, Human
agaauugaguguuu

SEQ ID NO: 1273671 - RNA, 17 nt, Human
agaauugaguguuuaaa

SEQ ID NO: 1273672 - RNA, 12 nt, Human
agacacacauga

SEQ ID NO: 1273673 - RNA, 15 nt, Human
agacacacaugaagu

SEQ ID NO: 1273674 - RNA, 12 nt, Human
agacacagacug

SEQ ID NO: 1273675 - RNA, 12 nt, Human
agacacaggccc

SEQ ID NO: 1273676 - RNA, 16 nt, Human
agacacauacucauuu

SEQ ID NO: 1273677 - RNA, 12 nt, Human
agacacaugaag

SEQ ID NO: 1273678 - RNA, 13 nt, Human
agacacaugaagg

SEQ ID NO: 1273679 - RNA, 19 nt, Human
agacacaugaagguaaaua

SEQ ID NO: 1273680 - RNA, 20 nt, Human
agacacaugaagguaaauaa

SEQ ID NO: 1273681 - RNA, 23 nt, Human
agacacaugaagguaaauaaaaa

SEQ ID NO: 1273682 - RNA, 21 nt, Human
agacacaugaagguaaauaaa

SEQ ID NO: 1273683 - RNA, 18 nt, Human
agacacugaucuggcugc

SEQ ID NO: 1273684 - RNA, 16 nt, Human
agacagagccaggaga

SEQ ID NO: 1273685 - RNA, 19 nt, Human
agacagagccaggagaagc

SEQ ID NO: 1273686 - RNA, 20 nt, Human
agacagagccaggagaagcu

SEQ ID NO: 1273687 - RNA, 19 nt, Human
agacagagcccugugaggc

SEQ ID NO: 1273688 - RNA, 15 nt, Human
agacagagaggacug

SEQ ID NO: 1273689 - RNA, 20 nt, Human
agacagagaggacuguaggg

SEQ ID NO: 1273690 - RNA, 13 nt, Human
agacagagccagg

SEQ ID NO: 1273691 - RNA, 14 nt, Human
agacagagccagga

SEQ ID NO: 1273692 - RNA, 21 nt, Human
agacagagccaggagaagcuc

SEQ ID NO: 1273693 - RNA, 20 nt, Human
agacacugccacacaggguc

SEQ ID NO: 1273694 - RNA, 13 nt, Human
agacacuggcccc

SEQ ID NO: 1273695 - RNA, 15 nt, Human
agacacuggccccuc

SEQ ID NO: 1273696 - RNA, 16 nt, Human
agacacuggccccuca

SEQ ID NO: 1273697 - RNA, 12 nt, Human
agacacugguuu

SEQ ID NO: 1273698 - RNA, 12 nt, Human
agaagacaaaau

SEQ ID NO: 1273699 - RNA, 15 nt, Human
agaagacaaacuuug

SEQ ID NO: 1273700 - RNA, 18 nt, Human
agaagaugguaccaccag

SEQ ID NO: 1273701 - RNA, 22 nt, Human
agaagaaucucaucucagugaa

SEQ ID NO: 1273702 - RNA, 19 nt, Human
agaagaaugcuuaaucaga

SEQ ID NO: 1273703 - RNA, 13 nt, Human
agaagaacugaaa

SEQ ID NO: 1273704 - RNA, 16 nt, Human
agaagaaagaggugac

SEQ ID NO: 1273705 - RNA, 14 nt, Human
agaagaacugaaau

SEQ ID NO: 1273706 - RNA, 22 nt, Human
agaagaaguuucaucauuuuuu

SEQ ID NO: 1273707 - RNA, 18 nt, Human
agaaauucguguguuuuu

SEQ ID NO: 1273708 - RNA, 20 nt, Human
agaaauucguguguuuuuuu

SEQ ID NO: 1273709 - RNA, 23 nt, Human
agaaauucguguguuuuuuuaug

SEQ ID NO: 1273710 - RNA, 17 nt, Human
agaaauugcauuuccug

SEQ ID NO: 1273711 - RNA, 20 nt, Human
agaaauugcauuuccugaca

SEQ ID NO: 1273712 - RNA, 15 nt, Human
agaaauugaauacuu

SEQ ID NO: 1273713 - RNA, 16 nt, Human
agaaauugaauacuuu

SEQ ID NO: 1273714 - RNA, 17 nt, Human
agaaauugaauacuuug

SEQ ID NO: 1273715 - RNA, 18 nt, Human
agaaauugaauacuuuga

SEQ ID NO: 1273716 - RNA, 21 nt, Human
agaaauugaauacuuugaaug

SEQ ID NO: 1273717 - RNA, 22 nt, Human
agaaauugaauacuuugaaugu

SEQ ID NO: 1273718 - RNA, 21 nt, Human
agaacuggauuuucagaccug

SEQ ID NO: 1273719 - RNA, 14 nt, Human
agaacuucagaaag

SEQ ID NO: 1273720 - RNA, 15 nt, Human
agaacuucagaaaga

SEQ ID NO: 1273721 - RNA, 16 nt, Human
agaacuucagaaagac

SEQ ID NO: 1273722 - RNA, 17 nt, Human
agaacuucagaaagacu

SEQ ID NO: 1273723 - RNA, 18 nt, Human
agaacuucagaaagacuu

SEQ ID NO: 1273724 - RNA, 16 nt, Human
agaagacaaacuuugc

SEQ ID NO: 1273725 - RNA, 19 nt, Human
agaagcaacccaaauguuc

SEQ ID NO: 1273726 - RNA, 22 nt, Human
agaagcauucucauuggaaauu

SEQ ID NO: 1273727 - RNA, 19 nt, Human
agaagcauuuuguaaguug

SEQ ID NO: 1273728 - RNA, 18 nt, Human
agaagccaacuaugauua

SEQ ID NO: 1273729 - RNA, 23 nt, Human
agaagccaacuaugauuauuaac

SEQ ID NO: 1273730 - RNA, 10 nt, Human
ucugcccugc

SEQ ID NO: 1273731 - RNA, 14 nt, Human
ucugcccugcccac

SEQ ID NO: 1273732 - RNA, 11 nt, Human
ucugcccugcg

SEQ ID NO: 1273733 - RNA, 12 nt, Human
ucugcccugcgg

SEQ ID NO: 1273734 - RNA, 21 nt, Human
ucugcccucugcauccucugg

SEQ ID NO: 1273735 - RNA, 23 nt, Human
ucugccuggagacuuagggcacc

SEQ ID NO: 1273736 - RNA, 12 nt, Human
ucugccuggagu

SEQ ID NO: 1273737 - RNA, 13 nt, Human
ucugccuggagug

SEQ ID NO: 1273738 - RNA, 21 nt, Human
ucugccuggaguguaugacug

SEQ ID NO: 1273739 - RNA, 16 nt, Human
ucugcgugacaauaaa

SEQ ID NO: 1273740 - RNA, 15 nt, Human
ucugcgugucaccug

SEQ ID NO: 1273741 - RNA, 19 nt, Human
ucugcgugucaccugugcu

SEQ ID NO: 1273742 - RNA, 20 nt, Human
ucugcgugucaccugugcuu

SEQ ID NO: 1273743 - RNA, 22 nt, Human
ucugcucagacagaaccccuac

SEQ ID NO: 1273744 - RNA, 18 nt, Human
ucugcucagauagaauga

SEQ ID NO: 1273745 - RNA, 14 nt, Human
ucugcuccagacag

SEQ ID NO: 1273746 - RNA, 13 nt, Human
ucugcucccaagg

SEQ ID NO: 1273747 - RNA, 15 nt, Human
ucugcuccagacagg

SEQ ID NO: 1273748 - RNA, 11 nt, Human
ucugcucccaa

SEQ ID NO: 1273749 - RNA, 12 nt, Human
ucugcucccaag

SEQ ID NO: 1273750 - RNA, 14 nt, Human
ucugcaggucccua

SEQ ID NO: 1273751 - RNA, 19 nt, Human
ucugcagggggugugucug

SEQ ID NO: 1273752 - RNA, 13 nt, Human
ucugcaggucccu

SEQ ID NO: 1273753 - RNA, 12 nt, Human
ucugcagguccc

SEQ ID NO: 1273754 - RNA, 11 nt, Human
ucugcaggucc

SEQ ID NO: 1273755 - RNA, 21 nt, Human
ucugaugcaagcaagaaacac

SEQ ID NO: 1273756 - RNA, 18 nt, Human
ucugcagauaaacaguag

SEQ ID NO: 1273757 - RNA, 16 nt, Human
ucugagaagcucugaa

SEQ ID NO: 1273758 - RNA, 14 nt, Human
ucugacucugagcu

SEQ ID NO: 1273759 - RNA, 24 nt, Human
ucugagaagcucugaagaacucuc

SEQ ID NO: 1273760 - RNA, 22 nt, Human
ucugagaauuguugagauacuu

SEQ ID NO: 1273761 - RNA, 16 nt, Human
ucugaggugcacuggg

SEQ ID NO: 1273762 - RNA, 19 nt, Human
ucugaggugcacugggagg

SEQ ID NO: 1273763 - RNA, 21 nt, Human
ucugaggugccugucccaccc

SEQ ID NO: 1273764 - RNA, 23 nt, Human
ucugaggugcacugggaggcucc

SEQ ID NO: 1273765 - RNA, 15 nt, Human
ucugagguuuuauuu

SEQ ID NO: 1273766 - RNA, 13 nt, Human
ucugaguacagag

SEQ ID NO: 1273767 - RNA, 16 nt, Human
ucugagucaacuccuu

SEQ ID NO: 1273768 - RNA, 15 nt, Human
ucugagucagagcca

SEQ ID NO: 1273769 - RNA, 20 nt, Human
ucugagucagagccaugucu

SEQ ID NO: 1273770 - RNA, 21 nt, Human
ucugaucccucuacagagcuu

SEQ ID NO: 1273771 - RNA, 17 nt, Human
ucugaucagaacaaaug

SEQ ID NO: 1273772 - RNA, 16 nt, Human
ucugaugcaagcaaga

SEQ ID NO: 1273773 - RNA, 22 nt, Human
ucugaugaaaaauugcugacug

SEQ ID NO: 1273774 - RNA, 15 nt, Human
ucugaugaaaaauug

SEQ ID NO: 1273775 - RNA, 21 nt, Human
ucugaugaaaaauugcugacu

SEQ ID NO: 1273776 - RNA, 23 nt, Human
ucugaguguuuuaugagaaagcc

SEQ ID NO: 1273777 - RNA, 13 nt, Human
ucugaguccugga

SEQ ID NO: 1273778 - RNA, 15 nt, Human
ucugaauuauuuucu

SEQ ID NO: 1273779 - RNA, 13 nt, Human
ucugacucagggc

SEQ ID NO: 1273780 - RNA, 14 nt, Human
ucugacucagggcu

SEQ ID NO: 1273781 - RNA, 15 nt, Human
ucugacucagggcuc

SEQ ID NO: 1273782 - RNA, 20 nt, Human
ucugacucagggcuccuggg

SEQ ID NO: 1273783 - RNA, 16 nt, Human
ucugacucgguuucuc

SEQ ID NO: 1273784 - RNA, 18 nt, Human
ucugacucgguuucucca

SEQ ID NO: 1273785 - RNA, 19 nt, Human
ucugacucgguuucuccaa

SEQ ID NO: 1273786 - RNA, 20 nt, Human
ucugacucgguuucuccaaa

SEQ ID NO: 1273787 - RNA, 10 nt, Human
ucugaauuau

SEQ ID NO: 1273788 - RNA, 22 nt, Human
ucugaaugcuucuaaguaaaua

SEQ ID NO: 1273789 - RNA, 13 nt, Human
ucugaaugcuucu

SEQ ID NO: 1273790 - RNA, 17 nt, Human
ucugaaugcuucuaagu

SEQ ID NO: 1273791 - RNA, 19 nt, Human
ucugaaugcuucuaaguaa

SEQ ID NO: 1273792 - RNA, 22 nt, Human
agaaaugccaagcacuucuuuu

SEQ ID NO: 1273793 - RNA, 14 nt, Human
agaaaugccaagca

SEQ ID NO: 1273794 - RNA, 21 nt, Human
agaaaugccaagcacuucuuu

SEQ ID NO: 1273795 - RNA, 12 nt, Human
agaaaugcagaa

SEQ ID NO: 1273796 - RNA, 11 nt, Human
agaaaugccaa

SEQ ID NO: 1273797 - RNA, 18 nt, Human
ucugaagcccucccaggu

SEQ ID NO: 1273798 - RNA, 17 nt, Human
ucugaagcucaacucuc

SEQ ID NO: 1273799 - RNA, 21 nt, Human
ucugaagcucaacucucuuau

SEQ ID NO: 1273800 - RNA, 16 nt, Human
ucuccuuucacaaccu

SEQ ID NO: 1273801 - RNA, 18 nt, Human
ucuccuuguucugauaau

SEQ ID NO: 1273802 - RNA, 15 nt, Human
ucuccuuuaauugua

SEQ ID NO: 1273803 - RNA, 17 nt, Human
ucuccuuuaauuguaaa

SEQ ID NO: 1273804 - RNA, 13 nt, Human
ucuccuuguucug

SEQ ID NO: 1273805 - RNA, 14 nt, Human
ucuccuuguucuga

SEQ ID NO: 1273806 - RNA, 16 nt, Human
ucuccuuguucugaua

SEQ ID NO: 1273807 - RNA, 22 nt, Human
ucuccuuuaauuguaaaguaaa

SEQ ID NO: 1273808 - RNA, 17 nt, Human
ucuccuuuuccucucuc

SEQ ID NO: 1273809 - RNA, 19 nt, Human
ucuccuuuuccucucuccc

SEQ ID NO: 1273810 - RNA, 18 nt, Human
agaaagccccacccaggc

SEQ ID NO: 1273811 - RNA, 17 nt, Human
agaaagccccacccagg

SEQ ID NO: 1273812 - RNA, 11 nt, Human
agaaagccuga

SEQ ID NO: 1273813 - RNA, 18 nt, Human
agaaagccugggugacau

SEQ ID NO: 1273814 - RNA, 12 nt, Human
agaaagccugag

SEQ ID NO: 1273815 - RNA, 13 nt, Human
agaaauaucuuca

SEQ ID NO: 1273816 - RNA, 20 nt, Human
agaaauaucuucacuuguca

SEQ ID NO: 1273817 - RNA, 21 nt, Human
agaaauaugcacaauagcagu

SEQ ID NO: 1273818 - RNA, 14 nt, Human
agaaauauggacac

SEQ ID NO: 1273819 - RNA, 17 nt, Human
agaaauauggacacuua

SEQ ID NO: 1273820 - RNA, 20 nt, Human
agaaauauuugugacaaaaa

SEQ ID NO: 1273821 - RNA, 15 nt, Human
agaaauauuuuaaaa

SEQ ID NO: 1273822 - RNA, 17 nt, Human
agaaauauuuuaaaauc

SEQ ID NO: 1273823 - RNA, 21 nt, Human
agaaauauuuuaaaaucagcu

SEQ ID NO: 1273824 - RNA, 19 nt, Human
agaaauauuuuaaaaucag

SEQ ID NO: 1273825 - RNA, 17 nt, Human
ucuaggaaauauuuauu

SEQ ID NO: 1273826 - RNA, 14 nt, Human
ucuaggaaaucuag

SEQ ID NO: 1273827 - RNA, 16 nt, Human
ucuaggaaauauuuau

SEQ ID NO: 1273828 - RNA, 15 nt, Human
ucuaguucugccagg

SEQ ID NO: 1273829 - RNA, 16 nt, Human
ucuaguucugccagga

SEQ ID NO: 1273830 - RNA, 17 nt, Human
ucuaguucugccaggag

SEQ ID NO: 1273831 - RNA, 13 nt, Human
ucuaguucuuugu

SEQ ID NO: 1273832 - RNA, 19 nt, Human
ucuaguugaaaauaaagug

SEQ ID NO: 1273833 - RNA, 22 nt, Human
ucuaguuuaauuaaucuguaau

SEQ ID NO: 1273834 - RNA, 13 nt, Human
ucuaguuucucuu

SEQ ID NO: 1273835 - RNA, 19 nt, Human
ucuaguuucucuuagaaaa

SEQ ID NO: 1273836 - RNA, 14 nt, Human
ucuauaaacuauaa

SEQ ID NO: 1273837 - RNA, 21 nt, Human
ucuauaaacuauaaccucucc

SEQ ID NO: 1273838 - RNA, 12 nt, Human
ucuauaaagcau

SEQ ID NO: 1273839 - RNA, 14 nt, Human
ucuauaaagcauuu

SEQ ID NO: 1273840 - RNA, 15 nt, Human
ucuauaaagcauuua

SEQ ID NO: 1273841 - RNA, 16 nt, Human
ucuauaaagcauuuaa

SEQ ID NO: 1273842 - RNA, 17 nt, Human
ucuauaaagcauuuaac

SEQ ID NO: 1273843 - RNA, 20 nt, Human
ucuauaaagcauuuaacccc

SEQ ID NO: 1273844 - RNA, 19 nt, Human
ucuauaaagcauuuaaccc

SEQ ID NO: 1273845 - RNA, 20 nt, Human
ucuauaaccaaaugaaauau

SEQ ID NO: 1273846 - RNA, 13 nt, Human
ucuauaaggccau

SEQ ID NO: 1273847 - RNA, 14 nt, Human
ucuauaaggccaua

SEQ ID NO: 1273848 - RNA, 16 nt, Human
ucuauaaggccauaaa

SEQ ID NO: 1273849 - RNA, 22 nt, Human
ucuauaaggccauaaaacaggu

SEQ ID NO: 1273850 - RNA, 22 nt, Human
acuucaguuucacagaaaauaa

SEQ ID NO: 1273851 - RNA, 18 nt, Human
acuucauauaugaggacu

SEQ ID NO: 1273852 - RNA, 13 nt, Human
acuuccccuuccu

SEQ ID NO: 1273853 - RNA, 19 nt, Human
acuuccccuuccuaauucc

SEQ ID NO: 1273854 - RNA, 12 nt, Human
acuucccugugu

SEQ ID NO: 1273855 - RNA, 14 nt, Human
ucuagacacugcca

SEQ ID NO: 1273856 - RNA, 18 nt, Human
ucuagacauggagguucu

SEQ ID NO: 1273857 - RNA, 19 nt, Human
ucuagacauggagguucua

SEQ ID NO: 1273858 - RNA, 20 nt, Human
ucuagacauggagguucuaa

SEQ ID NO: 1273859 - RNA, 14 nt, Human
ucuagaccaauaaa

SEQ ID NO: 1273860 - RNA, 22 nt, Human
ucuagacauggagguucuaagg

SEQ ID NO: 1273861 - RNA, 14 nt, Human
ucuagagcacugcc

SEQ ID NO: 1273862 - RNA, 15 nt, Human
ucuagagcacugcca

SEQ ID NO: 1273863 - RNA, 15 nt, Human
ucuagagcagggauu

SEQ ID NO: 1273864 - RNA, 18 nt, Human
acuuagguaagaagauuc

SEQ ID NO: 1273865 - RNA, 16 nt, Human
ucuagaggcuuccuuc

SEQ ID NO: 1273866 - RNA, 21 nt, Human
ucuagaggcuuccuucauuuc

SEQ ID NO: 1273867 - RNA, 13 nt, Human
ucuagaguccaag

SEQ ID NO: 1273868 - RNA, 15 nt, Human
ucuagaguccaaggu

SEQ ID NO: 1273869 - RNA, 20 nt, Human
ucuagaguccaagguuuaaa

SEQ ID NO: 1273870 - RNA, 14 nt, Human
ucuagaguucagag

SEQ ID NO: 1273871 - RNA, 18 nt, Human
ucuagaguucagaguccu

SEQ ID NO: 1273872 - RNA, 16 nt, Human
ucuauacccacccaga

SEQ ID NO: 1273873 - RNA, 17 nt, Human
ucuauagaacugaauga

SEQ ID NO: 1273874 - RNA, 17 nt, Human
ucuauacccacccagaa

SEQ ID NO: 1273875 - RNA, 15 nt, Human
ucuauacccacccag

SEQ ID NO: 1273876 - RNA, 18 nt, Human
ucuauaccaauaaaguga

SEQ ID NO: 1273877 - RNA, 17 nt, Human
ucuauaccaauaaagug

SEQ ID NO: 1273878 - RNA, 16 nt, Human
ucuauaccaauaaagu

SEQ ID NO: 1273879 - RNA, 15 nt, Human
ucuauaccaauaaag

SEQ ID NO: 1273880 - RNA, 14 nt, Human
ucuauaccaauaaa

SEQ ID NO: 1273881 - RNA, 15 nt, Human
ucuauggguguuauc

SEQ ID NO: 1273882 - RNA, 13 nt, Human
ucuauguaucaaa

SEQ ID NO: 1273883 - RNA, 22 nt, Human
ucuauguaucaaauguaacuua

SEQ ID NO: 1273884 - RNA, 17 nt, Human
ucuaugugcuuguaaaa

SEQ ID NO: 1273885 - RNA, 11 nt, Human
ucuauuaaaag

SEQ ID NO: 1273886 - RNA, 12 nt, Human
ucuauuaaaaga

SEQ ID NO: 1273887 - RNA, 13 nt, Human
ucuauuaaaagac

SEQ ID NO: 1273888 - RNA, 14 nt, Human
ucuauuaaaagacu

SEQ ID NO: 1273889 - RNA, 15 nt, Human
ucuauuaaaagacuc

SEQ ID NO: 1273890 - RNA, 16 nt, Human
ucuauuaaaagacuca

SEQ ID NO: 1273891 - RNA, 17 nt, Human
ucuauuaaaagacucau

SEQ ID NO: 1273892 - RNA, 18 nt, Human
ucuauuaaaagacucauc

SEQ ID NO: 1273893 - RNA, 19 nt, Human
ucuauuaaaagacucaucc

SEQ ID NO: 1273894 - RNA, 20 nt, Human
ucuauuaaaagacucauccg

SEQ ID NO: 1273895 - RNA, 21 nt, Human
ucuauuaaaagacucauccgu

SEQ ID NO: 1273896 - RNA, 22 nt, Human
ucuauuaaaagacucauccguc

SEQ ID NO: 1273897 - RNA, 22 nt, Human
ucuauuaaagugcuaagguucu

SEQ ID NO: 1273898 - RNA, 23 nt, Human
ucuauuaaagugcuaagguucua

SEQ ID NO: 1273899 - RNA, 17 nt, Human
ucuauuacauuuucagu

SEQ ID NO: 1273900 - RNA, 12 nt, Human
ucuauucagcuu

SEQ ID NO: 1273901 - RNA, 15 nt, Human
ucuauuaugaaugug

SEQ ID NO: 1273902 - RNA, 22 nt, Human
ucuauuaugaaugugaagccuu

SEQ ID NO: 1273903 - RNA, 23 nt, Human
ucuauuaugaaugugaagccuuc

SEQ ID NO: 1273904 - RNA, 18 nt, Human
ucuauucgccacacagua

SEQ ID NO: 1273905 - RNA, 19 nt, Human
ucuauucgccacacaguau

SEQ ID NO: 1273906 - RNA, 22 nt, Human
ucuauucgccacacaguauuuu

SEQ ID NO: 1273907 - RNA, 13 nt, Human
ucuauucuuuaac

SEQ ID NO: 1273908 - RNA, 16 nt, Human
ucuauucuuuaacucc

SEQ ID NO: 1273909 - RNA, 12 nt, Human
ucuauugccucu

SEQ ID NO: 1273910 - RNA, 18 nt, Human
ucuauuuuggauuguaua

SEQ ID NO: 1273911 - RNA, 17 nt, Human
ucuauuuuguaaacuca

SEQ ID NO: 1273912 - RNA, 24 nt, Human
ucuauuuuguaacuuucucuauga

SEQ ID NO: 1273913 - RNA, 15 nt, Human
ucucaccauuuggau

SEQ ID NO: 1273914 - RNA, 16 nt, Human
ucucaccauuuggauc

SEQ ID NO: 1273915 - RNA, 18 nt, Human
ucucaccauuuggauccu

SEQ ID NO: 1273916 - RNA, 12 nt, Human
ucucacccugga

SEQ ID NO: 1273917 - RNA, 13 nt, Human
ucucacccuggag

SEQ ID NO: 1273918 - RNA, 14 nt, Human
ucucacccuggagg

SEQ ID NO: 1273919 - RNA, 16 nt, Human
ucucacccuggaggca

SEQ ID NO: 1273920 - RNA, 19 nt, Human
ucucacccuggaggcaccu

SEQ ID NO: 1273921 - RNA, 18 nt, Human
ucucacccuggaggcacc

SEQ ID NO: 1273922 - RNA, 14 nt, Human
ucucaccggcucuc

SEQ ID NO: 1273923 - RNA, 18 nt, Human
ucucaccggcucucaccu

SEQ ID NO: 1273924 - RNA, 21 nt, Human
ucucaccggcucucaccuggc

SEQ ID NO: 1273925 - RNA, 22 nt, Human
ucuauugccucugagagcauca

SEQ ID NO: 1273926 - RNA, 19 nt, Human
ucuauugccucugagagca

SEQ ID NO: 1273927 - RNA, 21 nt, Human
ucuauugccucugagagcauc

SEQ ID NO: 1273928 - RNA, 13 nt, Human
ucuauuuauaugu

SEQ ID NO: 1273929 - RNA, 18 nt, Human
ucuauuuauauguacaug

SEQ ID NO: 1273930 - RNA, 13 nt, Human
ucuauuuggggcu

SEQ ID NO: 1273931 - RNA, 18 nt, Human
ucuauuuggggcuugaug

SEQ ID NO: 1273932 - RNA, 14 nt, Human
ucuauuuuaaagac

SEQ ID NO: 1273933 - RNA, 20 nt, Human
ucuauuuuaauaaaaauaau

SEQ ID NO: 1273934 - RNA, 12 nt, Human
ucuauuuuaauu

SEQ ID NO: 1273935 - RNA, 20 nt, Human
ucuauuuuauuaugaagaag

SEQ ID NO: 1273936 - RNA, 16 nt, Human
ucuauuuuauuaugaa

SEQ ID NO: 1273937 - RNA, 18 nt, Human
ucuauuuuauuaugaaga

SEQ ID NO: 1273938 - RNA, 13 nt, Human
ucuauuuucucau

SEQ ID NO: 1273939 - RNA, 15 nt, Human
ucuauuuuggauugu

SEQ ID NO: 1273940 - RNA, 13 nt, Human
acuuaaauuuuag

SEQ ID NO: 1273941 - RNA, 18 nt, Human
acuuaaauguuauuaucu

SEQ ID NO: 1273942 - RNA, 15 nt, Human
acuuaaauguuauua

SEQ ID NO: 1273943 - RNA, 11 nt, Human
acuuaacaaac

SEQ ID NO: 1273944 - RNA, 17 nt, Human
acuuaacggaccaaagc

SEQ ID NO: 1273945 - RNA, 22 nt, Human
acuuaacuaucaucuuauucag

SEQ ID NO: 1273946 - RNA, 22 nt, Human
acuguugcacguguguuuuucu

SEQ ID NO: 1273947 - RNA, 16 nt, Human
acuuaaauaguauuuc

SEQ ID NO: 1273948 - RNA, 10 nt, Human
acuguugcac

SEQ ID NO: 1273949 - RNA, 11 nt, Human
acuguugcacg

SEQ ID NO: 1273950 - RNA, 12 nt, Human
acuguugcacgu

SEQ ID NO: 1273951 - RNA, 13 nt, Human
acuguugcacgug

SEQ ID NO: 1273952 - RNA, 14 nt, Human
acuguugcacgugu

SEQ ID NO: 1273953 - RNA, 15 nt, Human
acuguugcacgugug

SEQ ID NO: 1273954 - RNA, 16 nt, Human
acuguugcacgugugu

SEQ ID NO: 1273955 - RNA, 18 nt, Human
acuguugcacguguguuu

SEQ ID NO: 1273956 - RNA, 17 nt, Human
acuuaagcaucuggcuc

SEQ ID NO: 1273957 - RNA, 13 nt, Human
acuuaauguaugu

SEQ ID NO: 1273958 - RNA, 15 nt, Human
acuuaauguauguua

SEQ ID NO: 1273959 - RNA, 16 nt, Human
acuuaauguauguuac

SEQ ID NO: 1273960 - RNA, 14 nt, Human
acuuaauugcuaca

SEQ ID NO: 1273961 - RNA, 12 nt, Human
acuuacaugauu

SEQ ID NO: 1273962 - RNA, 14 nt, Human
acuuagcugggaga

SEQ ID NO: 1273963 - RNA, 13 nt, Human
acuuacuugcuua

SEQ ID NO: 1273964 - RNA, 14 nt, Human
acuuacuugcuuau

SEQ ID NO: 1273965 - RNA, 17 nt, Human
acuuacagcaaauccuu

SEQ ID NO: 1273966 - RNA, 15 nt, Human
acuuacaucaugugu

SEQ ID NO: 1273967 - RNA, 14 nt, Human
acuuacaugauuca

SEQ ID NO: 1273968 - RNA, 16 nt, Human
acuuagggcaccaggg

SEQ ID NO: 1273969 - RNA, 16 nt, Human
acuuaguacaaaguuu

SEQ ID NO: 1273970 - RNA, 20 nt, Human
acuuaguacaaaguuucaau

SEQ ID NO: 1273971 - RNA, 16 nt, Human
acuuaguauugcaaag

SEQ ID NO: 1273972 - RNA, 23 nt, Human
acuuagggcaccagggguuucuc

SEQ ID NO: 1273973 - RNA, 22 nt, Human
acuuaugaaaugugcacuuuau

SEQ ID NO: 1273974 - RNA, 14 nt, Human
acuuaugcugauuu

SEQ ID NO: 1273975 - RNA, 21 nt, Human
acuuauuaacaauuaggcaga

SEQ ID NO: 1273976 - RNA, 12 nt, Human
acuuauuaacaa

SEQ ID NO: 1273977 - RNA, 16 nt, Human
acuuauuaucuucagg

SEQ ID NO: 1273978 - RNA, 18 nt, Human
acuucagguauaccucac

SEQ ID NO: 1273979 - RNA, 20 nt, Human
acuucagguauaccucacuu

SEQ ID NO: 1273980 - RNA, 21 nt, Human
acuucaguuucacagaaaaua

SEQ ID NO: 1273981 - RNA, 23 nt, Human
ucuacagcuaaucagcauucuca

SEQ ID NO: 1273982 - RNA, 20 nt, Human
ucuacagcuaaucagcauuc

SEQ ID NO: 1273983 - RNA, 18 nt, Human
ucuacagaugagucacac

SEQ ID NO: 1273984 - RNA, 18 nt, Human
ucuaauaauuucuaaugu

SEQ ID NO: 1273985 - RNA, 16 nt, Human
ucuaauaauuucuaau

SEQ ID NO: 1273986 - RNA, 17 nt, Human
ucuaauaauuucuaaug

SEQ ID NO: 1273987 - RNA, 14 nt, Human
ucuaaguuucuaag

SEQ ID NO: 1273988 - RNA, 15 nt, Human
ucuaaguuucuaaga

SEQ ID NO: 1273989 - RNA, 16 nt, Human
ucuaaguuucuaagau

SEQ ID NO: 1273990 - RNA, 17 nt, Human
ucuaaguuucuaagauu

SEQ ID NO: 1273991 - RNA, 18 nt, Human
ucuaaguuucuaagauuc

SEQ ID NO: 1273992 - RNA, 20 nt, Human
ucuaaguuucuaagauucua

SEQ ID NO: 1273993 - RNA, 22 nt, Human
ucuaaguuucuaagauucuaaa

SEQ ID NO: 1273994 - RNA, 23 nt, Human
ucuaaguuucuaagauucuaaag

SEQ ID NO: 1273995 - RNA, 15 nt, Human
ucuaauaauuucuaa

SEQ ID NO: 1273996 - RNA, 21 nt, Human
uccuggcuucccauccccagc

SEQ ID NO: 1273997 - RNA, 13 nt, Human
ucuaaguuucuaa

SEQ ID NO: 1273998 - RNA, 12 nt, Human
ucuacccuggga

SEQ ID NO: 1273999 - RNA, 13 nt, Human
ucuacccugggau

SEQ ID NO: 1274000 - RNA, 16 nt, Human
ucuaccuagauuuaau

SEQ ID NO: 1274001 - RNA, 17 nt, Human
ucuaccuagauuuaaua

SEQ ID NO: 1274002 - RNA, 19 nt, Human
ucuaccuagauuuaauaua

SEQ ID NO: 1274003 - RNA, 21 nt, Human
ucuaccuagauuuaauauaaa

SEQ ID NO: 1274004 - RNA, 22 nt, Human
ucuaccuagauuuaauauaaag

SEQ ID NO: 1274005 - RNA, 15 nt, Human
ucuaccucaggcagc

SEQ ID NO: 1274006 - RNA, 15 nt, Human
acuguucccccugug

SEQ ID NO: 1274007 - RNA, 16 nt, Human
acuguucccccugugc

SEQ ID NO: 1274008 - RNA, 18 nt, Human
acuguucccccugugcag

SEQ ID NO: 1274009 - RNA, 13 nt, Human
acuguucuugaau

SEQ ID NO: 1274010 - RNA, 20 nt, Human
acuguucuuagcucaaugag

SEQ ID NO: 1274011 - RNA, 23 nt, Human
acuguucuuagcucaaugagcau

SEQ ID NO: 1274012 - RNA, 21 nt, Human
acuguucuuagcucaaugagc

SEQ ID NO: 1274013 - RNA, 22 nt, Human
acuuuuuauggcacuaguauuu

SEQ ID NO: 1274014 - RNA, 15 nt, Human
acuuuuuauauauau

SEQ ID NO: 1274015 - RNA, 18 nt, Human
acuuuuuaaauguaaaga

SEQ ID NO: 1274016 - RNA, 11 nt, Human
acuuuuuacaa

SEQ ID NO: 1274017 - RNA, 12 nt, Human
acuuuuuauaua

SEQ ID NO: 1274018 - RNA, 13 nt, Human
acuuuuuauauau

SEQ ID NO: 1274019 - RNA, 14 nt, Human
acuuuuuauauaua

SEQ ID NO: 1274020 - RNA, 13 nt, Human
agaaaaaauaaua

SEQ ID NO: 1274021 - RNA, 17 nt, Human
acuuuguacauuuggga

SEQ ID NO: 1274022 - RNA, 13 nt, Human
acuuuggcugcau

SEQ ID NO: 1274023 - RNA, 22 nt, Human
acuuugguaccagauaacuuuu

SEQ ID NO: 1274024 - RNA, 23 nt, Human
acuuuggaguccccucaccuccu

SEQ ID NO: 1274025 - RNA, 18 nt, Human
acuuuggaguccccucac

SEQ ID NO: 1274026 - RNA, 22 nt, Human
acuuuggaguccccucaccucc

SEQ ID NO: 1274027 - RNA, 14 nt, Human
acuuugacaguguu

SEQ ID NO: 1274028 - RNA, 18 nt, Human
acuuugacaguguuuuua

SEQ ID NO: 1274029 - RNA, 20 nt, Human
acuuugaccuaaauuauuua

SEQ ID NO: 1274030 - RNA, 22 nt, Human
acuuugaccuaaauuauuuacu

SEQ ID NO: 1274031 - RNA, 15 nt, Human
acuuuggaaccagac

SEQ ID NO: 1274032 - RNA, 16 nt, Human
acuuuggaaccagacu

SEQ ID NO: 1274033 - RNA, 17 nt, Human
acuuuggaaccagacuc

SEQ ID NO: 1274034 - RNA, 21 nt, Human
acuuuggaaccagacucuugc

SEQ ID NO: 1274035 - RNA, 22 nt, Human
acuuuggaaccagacucuugcc

SEQ ID NO: 1274036 - RNA, 23 nt, Human
acuuuggaaccagacucuugccu

SEQ ID NO: 1274037 - RNA, 21 nt, Human
ucucauuuuuccguaaaaaug

SEQ ID NO: 1274038 - RNA, 14 nt, Human
ucuccacagcaacc

SEQ ID NO: 1274039 - RNA, 19 nt, Human
ucuccacagcaaccccagg

SEQ ID NO: 1274040 - RNA, 23 nt, Human
ucuccaccaucgucuucuuggcc

SEQ ID NO: 1274041 - RNA, 19 nt, Human
ucuccccacgagggcuggc

SEQ ID NO: 1274042 - RNA, 20 nt, Human
ucuccccacgagggcuggcu

SEQ ID NO: 1274043 - RNA, 15 nt, Human
ucuccucacuguauc

SEQ ID NO: 1274044 - RNA, 14 nt, Human
ucuccccagcccag

SEQ ID NO: 1274045 - RNA, 15 nt, Human
ucuccccagcccaga

SEQ ID NO: 1274046 - RNA, 16 nt, Human
ucuccccagcccagag

SEQ ID NO: 1274047 - RNA, 17 nt, Human
ucuccccagcccagaga

SEQ ID NO: 1274048 - RNA, 18 nt, Human
ucuccccagcccagagac

SEQ ID NO: 1274049 - RNA, 19 nt, Human
ucuccccagcccagagaca

SEQ ID NO: 1274050 - RNA, 14 nt, Human
ucuccccagcuccc

SEQ ID NO: 1274051 - RNA, 18 nt, Human
ucuccccagcucccagga

SEQ ID NO: 1274052 - RNA, 15 nt, Human
ucuccccagguccag

SEQ ID NO: 1274053 - RNA, 15 nt, Human
ucuccccagcuccca

SEQ ID NO: 1274054 - RNA, 14 nt, Human
ucucccuugggcuc

SEQ ID NO: 1274055 - RNA, 15 nt, Human
ucucccuugggcucu

SEQ ID NO: 1274056 - RNA, 16 nt, Human
ucucccuugggcucug

SEQ ID NO: 1274057 - RNA, 17 nt, Human
ucucccuugggcucuga

SEQ ID NO: 1274058 - RNA, 18 nt, Human
ucucccuugggcucugau

SEQ ID NO: 1274059 - RNA, 22 nt, Human
ucucccuugggcucugaugaaa

SEQ ID NO: 1274060 - RNA, 15 nt, Human
ucucccuuuuccaug

SEQ ID NO: 1274061 - RNA, 20 nt, Human
ucucccuugggcucugauga

SEQ ID NO: 1274062 - RNA, 20 nt, Human
acuuuaauuaccaaccuguu

SEQ ID NO: 1274063 - RNA, 16 nt, Human
ucuccuccaugggaga

SEQ ID NO: 1274064 - RNA, 22 nt, Human
acuuuaauuaccaaccuguuac

SEQ ID NO: 1274065 - RNA, 20 nt, Human
acuuuacacaauagaauuau

SEQ ID NO: 1274066 - RNA, 13 nt, Human
acuuuacccauuu

SEQ ID NO: 1274067 - RNA, 18 nt, Human
acuuuacacaauagaauu

SEQ ID NO: 1274068 - RNA, 13 nt, Human
acuuucugccugg

SEQ ID NO: 1274069 - RNA, 14 nt, Human
acuuucugccugga

SEQ ID NO: 1274070 - RNA, 17 nt, Human
acuuugaaguuagcuuu

SEQ ID NO: 1274071 - RNA, 22 nt, Human
acuuugaauguguuucacaguu

SEQ ID NO: 1274072 - RNA, 12 nt, Human
acuuugaaugug

SEQ ID NO: 1274073 - RNA, 14 nt, Human
acuuugaauguguu

SEQ ID NO: 1274074 - RNA, 14 nt, Human
acuugcuuuuaaaa

SEQ ID NO: 1274075 - RNA, 19 nt, Human
acuugcuuaucaacuuccu

SEQ ID NO: 1274076 - RNA, 16 nt, Human
acuugcuuauuugaca

SEQ ID NO: 1274077 - RNA, 22 nt, Human
acuugcugcaguaugaaaauaa

SEQ ID NO: 1274078 - RNA, 19 nt, Human
acuuguauuauguguguuu

SEQ ID NO: 1274079 - RNA, 18 nt, Human
acuuguauuauguguguu

SEQ ID NO: 1274080 - RNA, 15 nt, Human
acuugucaauaaaau

SEQ ID NO: 1274081 - RNA, 21 nt, Human
acuugcuuaucaacuuccuaa

SEQ ID NO: 1274082 - RNA, 16 nt, Human
acuugucaauaaaauc

SEQ ID NO: 1274083 - RNA, 20 nt, Human
acuugcucuugaugccuggc

SEQ ID NO: 1274084 - RNA, 14 nt, Human
acuugcaucacuua

SEQ ID NO: 1274085 - RNA, 21 nt, Human
acuugcugcaguaugaaaaua

SEQ ID NO: 1274086 - RNA, 18 nt, Human
acuugcucuugaugccug

SEQ ID NO: 1274087 - RNA, 17 nt, Human
acuugcucuugaugccu

SEQ ID NO: 1274088 - RNA, 16 nt, Human
acuugcucuugaugcc

SEQ ID NO: 1274089 - RNA, 17 nt, Human
acuugcaaaaaggguca

SEQ ID NO: 1274090 - RNA, 23 nt, Human
acuugcaaaaagggucaguaugg

SEQ ID NO: 1274091 - RNA, 13 nt, Human
acuugcaaaauca

SEQ ID NO: 1274092 - RNA, 18 nt, Human
acuugcaaaaucaguuuu

SEQ ID NO: 1274093 - RNA, 17 nt, Human
acuugcaaaaucaguuu

SEQ ID NO: 1274094 - RNA, 16 nt, Human
acuugcaaaaucaguu

SEQ ID NO: 1274095 - RNA, 21 nt, Human
acuugcaaccgucuguuaugc

SEQ ID NO: 1274096 - RNA, 17 nt, Human
acuugauccauuucuaa

SEQ ID NO: 1274097 - RNA, 18 nt, Human
acuugauccauuucuaau

SEQ ID NO: 1274098 - RNA, 20 nt, Human
acuugauccauuucuaauua

SEQ ID NO: 1274099 - RNA, 19 nt, Human
acuugauccauuucuaauu

SEQ ID NO: 1274100 - RNA, 19 nt, Human
acuugauggcuaacuuaca

SEQ ID NO: 1274101 - RNA, 22 nt, Human
acuugauggcuaacuuacaaag

SEQ ID NO: 1274102 - RNA, 12 nt, Human
ucucagccccuu

SEQ ID NO: 1274103 - RNA, 17 nt, Human
ucucagccccuuucccu

SEQ ID NO: 1274104 - RNA, 12 nt, Human
ucucagcccuca

SEQ ID NO: 1274105 - RNA, 20 nt, Human
ucucagccccuuucccuugu

SEQ ID NO: 1274106 - RNA, 15 nt, Human
ucucaggacacaggc

SEQ ID NO: 1274107 - RNA, 16 nt, Human
ucucaggacacaggcc

SEQ ID NO: 1274108 - RNA, 17 nt, Human
ucucaggacacaggccu

SEQ ID NO: 1274109 - RNA, 18 nt, Human
ucucaggacacaggccug

SEQ ID NO: 1274110 - RNA, 19 nt, Human
ucucaggacacaggccugu

SEQ ID NO: 1274111 - RNA, 13 nt, Human
ucucaggauccaa

SEQ ID NO: 1274112 - RNA, 14 nt, Human
ucucaggauccaag

SEQ ID NO: 1274113 - RNA, 15 nt, Human
ucucaggauccaagc

SEQ ID NO: 1274114 - RNA, 16 nt, Human
ucucaggauccaagcu

SEQ ID NO: 1274115 - RNA, 20 nt, Human
ucucaggacacaggccugug

SEQ ID NO: 1274116 - RNA, 21 nt, Human
ucucaggacacaggccugugu

SEQ ID NO: 1274117 - RNA, 23 nt, Human
ucucaggaccaaagcuuucaugu

SEQ ID NO: 1274118 - RNA, 15 nt, Human
ucucauuuccaagca

SEQ ID NO: 1274119 - RNA, 18 nt, Human
ucucauuuagccuguccu

SEQ ID NO: 1274120 - RNA, 22 nt, Human
ucucauuuagccuguccuguca

SEQ ID NO: 1274121 - RNA, 19 nt, Human
ucucauuugccaauaauaa

SEQ ID NO: 1274122 - RNA, 17 nt, Human
ucucauuuuuccguaaa

SEQ ID NO: 1274123 - RNA, 20 nt, Human
ucucauuuuuuaaaaaagcu

SEQ ID NO: 1274124 - RNA, 17 nt, Human
ucucaggccagagccaa

SEQ ID NO: 1274125 - RNA, 21 nt, Human
ucucaugccucagccuccuga

SEQ ID NO: 1274126 - RNA, 17 nt, Human
ucucauggguggcacuc

SEQ ID NO: 1274127 - RNA, 22 nt, Human
ucucauguugaagccacugccu

SEQ ID NO: 1274128 - RNA, 23 nt, Human
uccuggaagugcuaauuuugaaa

SEQ ID NO: 1274129 - RNA, 22 nt, Human
uccuggaauaucuccgucaacu

SEQ ID NO: 1274130 - RNA, 17 nt, Human
uccuggacacucagacc

SEQ ID NO: 1274131 - RNA, 14 nt, Human
uccuggaagccagc

SEQ ID NO: 1274132 - RNA, 18 nt, Human
uccuggaagccagcuuuc

SEQ ID NO: 1274133 - RNA, 20 nt, Human
uccuggaagccagcuuuccc

SEQ ID NO: 1274134 - RNA, 22 nt, Human
uccuggaagcgcgagggccuca

SEQ ID NO: 1274135 - RNA, 16 nt, Human
uccuggaaaucagggu

SEQ ID NO: 1274136 - RNA, 22 nt, Human
uccuggaaauugacgaggggug

SEQ ID NO: 1274137 - RNA, 23 nt, Human
uccugcuugaugggauucuggac

SEQ ID NO: 1274138 - RNA, 12 nt, Human
uccugcuugcca

SEQ ID NO: 1274139 - RNA, 16 nt, Human
uccugcuugccaaggc

SEQ ID NO: 1274140 - RNA, 17 nt, Human
uccugcuugccaaggca

SEQ ID NO: 1274141 - RNA, 19 nt, Human
uccugcuugccaaggcaga

SEQ ID NO: 1274142 - RNA, 18 nt, Human
uccugcuuugggaagccg

SEQ ID NO: 1274143 - RNA, 15 nt, Human
uccugggagcuuuug

SEQ ID NO: 1274144 - RNA, 19 nt, Human
uccuggacacucagaccug

SEQ ID NO: 1274145 - RNA, 11 nt, Human
uccuggacagc

SEQ ID NO: 1274146 - RNA, 13 nt, Human
uccuggacagcug

SEQ ID NO: 1274147 - RNA, 14 nt, Human
uccuggacagcugu

SEQ ID NO: 1274148 - RNA, 15 nt, Human
uccuggacagcugug

SEQ ID NO: 1274149 - RNA, 16 nt, Human
uccuggacagcugugc

SEQ ID NO: 1274150 - RNA, 20 nt, Human
uccuggcgccuggcaguccg

SEQ ID NO: 1274151 - RNA, 23 nt, Human
uccuggcucuugauaccccccuc

SEQ ID NO: 1274152 - RNA, 14 nt, Human
uccuggcuucccau

SEQ ID NO: 1274153 - RNA, 20 nt, Human
uccuggcuucccauccccag

SEQ ID NO: 1274154 - RNA, 22 nt, Human
uccuggcuucccauccccagcg

SEQ ID NO: 1274155 - RNA, 14 nt, Human
uccugggaaauauu

SEQ ID NO: 1274156 - RNA, 16 nt, Human
uccugggaaauauucc

SEQ ID NO: 1274157 - RNA, 20 nt, Human
uccugggaaauauucccuag

SEQ ID NO: 1274158 - RNA, 21 nt, Human
uccugggaaauauucccuaga

SEQ ID NO: 1274159 - RNA, 15 nt, Human
uccugccucuacugg

SEQ ID NO: 1274160 - RNA, 16 nt, Human
uccugccucuacuggg

SEQ ID NO: 1274161 - RNA, 17 nt, Human
uccugccucuacuggga

SEQ ID NO: 1274162 - RNA, 21 nt, Human
uccugccucuacugggaaggc

SEQ ID NO: 1274163 - RNA, 22 nt, Human
uccugccucuacugggaaggcu

SEQ ID NO: 1274164 - RNA, 12 nt, Human
uccugccugugg

SEQ ID NO: 1274165 - RNA, 13 nt, Human
uccugccuguggc

SEQ ID NO: 1274166 - RNA, 20 nt, Human
uccugcugcugucugggugc

SEQ ID NO: 1274167 - RNA, 22 nt, Human
uccugcuugaugggauucugga

SEQ ID NO: 1274168 - RNA, 19 nt, Human
uccugcugcucccucagac

SEQ ID NO: 1274169 - RNA, 20 nt, Human
uccugcugcucccucagacu

SEQ ID NO: 1274170 - RNA, 13 nt, Human
uccugcugcuguc

SEQ ID NO: 1274171 - RNA, 14 nt, Human
uccugcugcugucu

SEQ ID NO: 1274172 - RNA, 15 nt, Human
uccugcugcugucug

SEQ ID NO: 1274173 - RNA, 17 nt, Human
uccugcugcugucuggg

SEQ ID NO: 1274174 - RNA, 18 nt, Human
uccugcugcugucugggu

SEQ ID NO: 1274175 - RNA, 19 nt, Human
uccugcugcugucugggug

SEQ ID NO: 1274176 - RNA, 14 nt, Human
uccugcugcucccu

SEQ ID NO: 1274177 - RNA, 15 nt, Human
uccugcugcucccuc

SEQ ID NO: 1274178 - RNA, 16 nt, Human
uccugcugcucccuca

SEQ ID NO: 1274179 - RNA, 17 nt, Human
uccugcugcucccucag

SEQ ID NO: 1274180 - RNA, 18 nt, Human
uccugcugcucccucaga

SEQ ID NO: 1274181 - RNA, 14 nt, Human
uccugccuguggcc

SEQ ID NO: 1274182 - RNA, 15 nt, Human
uccugccuguggcca

SEQ ID NO: 1274183 - RNA, 18 nt, Human
uccugccuguggccauga

SEQ ID NO: 1274184 - RNA, 14 nt, Human
uccugccuguggcg

SEQ ID NO: 1274185 - RNA, 14 nt, Human
uccugccuuccucc

SEQ ID NO: 1274186 - RNA, 16 nt, Human
uccugccuuccuccug

SEQ ID NO: 1274187 - RNA, 19 nt, Human
uccugccuuccuccugggc

SEQ ID NO: 1274188 - RNA, 22 nt, Human
uccugccuuccuccugggcccu

SEQ ID NO: 1274189 - RNA, 23 nt, Human
uccugccuuccuccugggcccuc

SEQ ID NO: 1274190 - RNA, 16 nt, Human
uccugccuugaaaaag

SEQ ID NO: 1274191 - RNA, 21 nt, Human
uccugccuuggccucccaagu

SEQ ID NO: 1274192 - RNA, 19 nt, Human
uccugccuuggccucccaa

SEQ ID NO: 1274193 - RNA, 17 nt, Human
acugagcacuguuuucu

SEQ ID NO: 1274194 - RNA, 23 nt, Human
acugagcacuguuuucuagugua

SEQ ID NO: 1274195 - RNA, 20 nt, Human
acugcaacuuguaaaugugg

SEQ ID NO: 1274196 - RNA, 17 nt, Human
acugauauauuuuacaa

SEQ ID NO: 1274197 - RNA, 14 nt, Human
acugagccuuguaa

SEQ ID NO: 1274198 - RNA, 22 nt, Human
acugauauaucaugagugaaua

SEQ ID NO: 1274199 - RNA, 16 nt, Human
acugauauauuuuaca

SEQ ID NO: 1274200 - RNA, 19 nt, Human
acugcaccaguugcugcuu

SEQ ID NO: 1274201 - RNA, 23 nt, Human
acugcacagugcaucucagccca

SEQ ID NO: 1274202 - RNA, 15 nt, Human
uccugaucagagccg

SEQ ID NO: 1274203 - RNA, 18 nt, Human
uccugcaccggggccugg

SEQ ID NO: 1274204 - RNA, 19 nt, Human
uccugcaccggggccuggg

SEQ ID NO: 1274205 - RNA, 22 nt, Human
uccugcacacgcuccuuccucu

SEQ ID NO: 1274206 - RNA, 14 nt, Human
uccugcacacgcuc

SEQ ID NO: 1274207 - RNA, 21 nt, Human
uccugcacacgcuccuuccuc

SEQ ID NO: 1274208 - RNA, 21 nt, Human
acugaacuuugcugagccugu

SEQ ID NO: 1274209 - RNA, 12 nt, Human
acugaagaagca

SEQ ID NO: 1274210 - RNA, 14 nt, Human
acugacgccagggu

SEQ ID NO: 1274211 - RNA, 13 nt, Human
acugacggacuca

SEQ ID NO: 1274212 - RNA, 16 nt, Human
acugacggacucauga

SEQ ID NO: 1274213 - RNA, 18 nt, Human
acugacuauucuugaugu

SEQ ID NO: 1274214 - RNA, 20 nt, Human
acugacuauucuugauguaa

SEQ ID NO: 1274215 - RNA, 13 nt, Human
acugacucuuaag

SEQ ID NO: 1274216 - RNA, 14 nt, Human
acugacucuuaaga

SEQ ID NO: 1274217 - RNA, 15 nt, Human
acugacucuuaagaa

SEQ ID NO: 1274218 - RNA, 16 nt, Human
acugacucuuaagaag

SEQ ID NO: 1274219 - RNA, 17 nt, Human
acugacucuuaagaaga

SEQ ID NO: 1274220 - RNA, 18 nt, Human
acugacucuuaagaagac

SEQ ID NO: 1274221 - RNA, 20 nt, Human
acugacucuuaagaagacug

SEQ ID NO: 1274222 - RNA, 22 nt, Human
acugacuauucuugauguaaaa

SEQ ID NO: 1274223 - RNA, 23 nt, Human
acugacuauucuugauguaaaau

SEQ ID NO: 1274224 - RNA, 24 nt, Human
acugacuauucuugauguaaaauc

SEQ ID NO: 1274225 - RNA, 21 nt, Human
acugagaaauuuauaaacuuu

SEQ ID NO: 1274226 - RNA, 17 nt, Human
acugagaaauuuauaaa

SEQ ID NO: 1274227 - RNA, 12 nt, Human
acugagaaauuu

SEQ ID NO: 1274228 - RNA, 13 nt, Human
acugacuuugcuu

SEQ ID NO: 1274229 - RNA, 15 nt, Human
acugacuuugcuugc

SEQ ID NO: 1274230 - RNA, 16 nt, Human
acugacuuugcuugcu

SEQ ID NO: 1274231 - RNA, 17 nt, Human
acugacuuugcuugcuu

SEQ ID NO: 1274232 - RNA, 23 nt, Human
acugacuuugcuugcuuugaagu

SEQ ID NO: 1274233 - RNA, 15 nt, Human
acugagaaaaccugu

SEQ ID NO: 1274234 - RNA, 18 nt, Human
acugagagugaacaaauu

SEQ ID NO: 1274235 - RNA, 16 nt, Human
acugagacaaugccuu

SEQ ID NO: 1274236 - RNA, 23 nt, Human
acugagaccaaggcuuucucuac

SEQ ID NO: 1274237 - RNA, 16 nt, Human
acugagaccaaggcuu

SEQ ID NO: 1274238 - RNA, 20 nt, Human
acugagagaugcagaaauau

SEQ ID NO: 1274239 - RNA, 16 nt, Human
acugagcacuguuuuc

SEQ ID NO: 1274240 - RNA, 15 nt, Human
acugagcacuguuuu

SEQ ID NO: 1274241 - RNA, 13 nt, Human
acugagcacuguu

SEQ ID NO: 1274242 - RNA, 20 nt, Human
acugagcaacgcuauuccag

SEQ ID NO: 1274243 - RNA, 21 nt, Human
acugagcaacgcuauuccagc

SEQ ID NO: 1274244 - RNA, 22 nt, Human
acugagcaacgcuauuccagcu

SEQ ID NO: 1274245 - RNA, 21 nt, Human
acugagaggacagagagaaau

SEQ ID NO: 1274246 - RNA, 18 nt, Human
acugagauaccagcgagg

SEQ ID NO: 1274247 - RNA, 19 nt, Human
acugagauaccagcgagga

SEQ ID NO: 1274248 - RNA, 19 nt, Human
acugaacuuugcugagccu

SEQ ID NO: 1274249 - RNA, 16 nt, Human
acugaacuuugcugag

SEQ ID NO: 1274250 - RNA, 20 nt, Human
acugaacucugacaacagac

SEQ ID NO: 1274251 - RNA, 18 nt, Human
acugaacucacuuuccuc

SEQ ID NO: 1274252 - RNA, 21 nt, Human
acucuuuugcuuuauuccaga

SEQ ID NO: 1274253 - RNA, 13 nt, Human
acugaaaaaauau

SEQ ID NO: 1274254 - RNA, 14 nt, Human
acugaaaaaauaua

SEQ ID NO: 1274255 - RNA, 16 nt, Human
acugaaaaaauauaug

SEQ ID NO: 1274256 - RNA, 20 nt, Human
acugaacaccauugaaggcu

SEQ ID NO: 1274257 - RNA, 21 nt, Human
acugaacaccauugaaggcuu

SEQ ID NO: 1274258 - RNA, 22 nt, Human
acugaacaccauugaaggcuua

SEQ ID NO: 1274259 - RNA, 15 nt, Human
acugaaaaaauauau

SEQ ID NO: 1274260 - RNA, 19 nt, Human
acugaacaucugaguccug

SEQ ID NO: 1274261 - RNA, 20 nt, Human
acugaacaucugaguccugg

SEQ ID NO: 1274262 - RNA, 23 nt, Human
acugaacaucugaguccuggaug

SEQ ID NO: 1274263 - RNA, 24 nt, Human
acugaacaucugaguccuggauga

SEQ ID NO: 1274264 - RNA, 15 nt, Human
acucuuguuuccuua

SEQ ID NO: 1274265 - RNA, 19 nt, Human
uccugacacccuucuccca

SEQ ID NO: 1274266 - RNA, 20 nt, Human
uccugacacccuucucccac

SEQ ID NO: 1274267 - RNA, 21 nt, Human
uccugacacccuucucccacu

SEQ ID NO: 1274268 - RNA, 22 nt, Human
uccugacacccuucucccacuc

SEQ ID NO: 1274269 - RNA, 13 nt, Human
uccugacacugca

SEQ ID NO: 1274270 - RNA, 15 nt, Human
uccugacacugcugg

SEQ ID NO: 1274271 - RNA, 17 nt, Human
uccugacacugcuggag

SEQ ID NO: 1274272 - RNA, 13 nt, Human
uccugacacuuua

SEQ ID NO: 1274273 - RNA, 11 nt, Human
acucuuucaaa

SEQ ID NO: 1274274 - RNA, 13 nt, Human
acucuuucaaaac

SEQ ID NO: 1274275 - RNA, 18 nt, Human
acucuuuaugaucuggcc

SEQ ID NO: 1274276 - RNA, 14 nt, Human
acucuuuaugcuug

SEQ ID NO: 1274277 - RNA, 15 nt, Human
acucuuuaugcuugc

SEQ ID NO: 1274278 - RNA, 17 nt, Human
acucuuuaugcuugcaa

SEQ ID NO: 1274279 - RNA, 18 nt, Human
acucuuuaugcuugcaaa

SEQ ID NO: 1274280 - RNA, 23 nt, Human
acucuuucgguagguggaagcua

SEQ ID NO: 1274281 - RNA, 13 nt, Human
acucuuuguaaga

SEQ ID NO: 1274282 - RNA, 14 nt, Human
acucuuuguaagag

SEQ ID NO: 1274283 - RNA, 18 nt, Human
acucuuuguuauuugaaa

SEQ ID NO: 1274284 - RNA, 18 nt, Human
acucuuuuccuucccuuu

SEQ ID NO: 1274285 - RNA, 12 nt, Human
acucuuuugcuu

SEQ ID NO: 1274286 - RNA, 14 nt, Human
acucuuuugcuuua

SEQ ID NO: 1274287 - RNA, 20 nt, Human
acucuuuugcuuuauuccag

SEQ ID NO: 1274288 - RNA, 21 nt, Human
uccugaaaagguuuaugaaaa

SEQ ID NO: 1274289 - RNA, 23 nt, Human
uccugaaaagguuuaugaaaaag

SEQ ID NO: 1274290 - RNA, 17 nt, Human
uccugaaacaacuugga

SEQ ID NO: 1274291 - RNA, 16 nt, Human
uccugaaagacaauau

SEQ ID NO: 1274292 - RNA, 21 nt, Human
uccugaauuuuauuuuuuggg

SEQ ID NO: 1274293 - RNA, 15 nt, Human
uccugaaauuucaga

SEQ ID NO: 1274294 - RNA, 14 nt, Human
uccugaaauuucag

SEQ ID NO: 1274295 - RNA, 18 nt, Human
uccucuuucagcuccuga

SEQ ID NO: 1274296 - RNA, 17 nt, Human
uccucccucccucuccg

SEQ ID NO: 1274297 - RNA, 13 nt, Human
ucccuuuuuuuaa

SEQ ID NO: 1274298 - RNA, 16 nt, Human
ucccuugggcucugau

SEQ ID NO: 1274299 - RNA, 17 nt, Human
ucccuugggcucugaug

SEQ ID NO: 1274300 - RNA, 21 nt, Human
ucccuugggcucugaugaaaa

SEQ ID NO: 1274301 - RNA, 12 nt, Human
ucccuugggcuc

SEQ ID NO: 1274302 - RNA, 14 nt, Human
ucccuugggcuccc

SEQ ID NO: 1274303 - RNA, 13 nt, Human
ucccuugggcucu

SEQ ID NO: 1274304 - RNA, 14 nt, Human
ucccuugggcucug

SEQ ID NO: 1274305 - RNA, 21 nt, Human
ucccuuuuuuuaaguaaggaa

SEQ ID NO: 1274306 - RNA, 16 nt, Human
ucccuuuuuuuaagua

SEQ ID NO: 1274307 - RNA, 18 nt, Human
uccgguguuuaagacauu

SEQ ID NO: 1274308 - RNA, 14 nt, Human
uccgguguucuaag

SEQ ID NO: 1274309 - RNA, 15 nt, Human
uccgguguucuaaga

SEQ ID NO: 1274310 - RNA, 16 nt, Human
uccgguguucuaagau

SEQ ID NO: 1274311 - RNA, 15 nt, Human
uccguaaaaaugauu

SEQ ID NO: 1274312 - RNA, 13 nt, Human
uccguaaaaauga

SEQ ID NO: 1274313 - RNA, 15 nt, Human
uccuagcuguccuuu

SEQ ID NO: 1274314 - RNA, 18 nt, Human
uccuagcuguccuuuuuc

SEQ ID NO: 1274315 - RNA, 14 nt, Human
uccuaggaaaauac

SEQ ID NO: 1274316 - RNA, 17 nt, Human
uccuagcugugugaaua

SEQ ID NO: 1274317 - RNA, 15 nt, Human
acuccagaccccugg

SEQ ID NO: 1274318 - RNA, 12 nt, Human
acucacacaggc

SEQ ID NO: 1274319 - RNA, 13 nt, Human
acucacacaggca

SEQ ID NO: 1274320 - RNA, 14 nt, Human
acucacacaggcau

SEQ ID NO: 1274321 - RNA, 19 nt, Human
acucacacaggcauuuccu

SEQ ID NO: 1274322 - RNA, 20 nt, Human
acucacacaggcauuuccug

SEQ ID NO: 1274323 - RNA, 22 nt, Human
acucacacaggcauuuccuggg

SEQ ID NO: 1274324 - RNA, 23 nt, Human
acucacacaggcauuuccugggu

SEQ ID NO: 1274325 - RNA, 17 nt, Human
acucacaccacuagccu

SEQ ID NO: 1274326 - RNA, 18 nt, Human
acucacaccacuagccuc

SEQ ID NO: 1274327 - RNA, 21 nt, Human
acucacaccugaacugaacac

SEQ ID NO: 1274328 - RNA, 18 nt, Human
acuccagaccccuggcuu

SEQ ID NO: 1274329 - RNA, 19 nt, Human
acuccagaccccuggcuuu

SEQ ID NO: 1274330 - RNA, 21 nt, Human
acuccagaccccuggcuuuuc

SEQ ID NO: 1274331 - RNA, 16 nt, Human
acucacagugcuuuua

SEQ ID NO: 1274332 - RNA, 19 nt, Human
acuccauagaccuuuucau

SEQ ID NO: 1274333 - RNA, 18 nt, Human
acuccaguuaaaaaaaau

SEQ ID NO: 1274334 - RNA, 20 nt, Human
acuccaguuaaaaaaaauuu

SEQ ID NO: 1274335 - RNA, 19 nt, Human
acuccaucugguagaaggg

SEQ ID NO: 1274336 - RNA, 18 nt, Human
acuccuaguucuagaaaa

SEQ ID NO: 1274337 - RNA, 20 nt, Human
acuccuaguucuagaaaaac

SEQ ID NO: 1274338 - RNA, 16 nt, Human
acuccuaugaucugag

SEQ ID NO: 1274339 - RNA, 19 nt, Human
acuccuaguucuagaaaaa

SEQ ID NO: 1274340 - RNA, 12 nt, Human
acuccucccagg

SEQ ID NO: 1274341 - RNA, 19 nt, Human
acuccucauuguaaacaaa

SEQ ID NO: 1274342 - RNA, 13 nt, Human
acuccucccaggg

SEQ ID NO: 1274343 - RNA, 15 nt, Human
acuccucccaggguu

SEQ ID NO: 1274344 - RNA, 22 nt, Human
acuccucccaggguuuuaacuu

SEQ ID NO: 1274345 - RNA, 19 nt, Human
acuccucccaggguuuuaa

SEQ ID NO: 1274346 - RNA, 21 nt, Human
acuccucccaggguuuuaacu

SEQ ID NO: 1274347 - RNA, 21 nt, Human
acucuuaagaagacugcauua

SEQ ID NO: 1274348 - RNA, 16 nt, Human
acucuggcagccacac

SEQ ID NO: 1274349 - RNA, 17 nt, Human
acucuggcagccacacu

SEQ ID NO: 1274350 - RNA, 13 nt, Human
acucuggcagcca

SEQ ID NO: 1274351 - RNA, 14 nt, Human
acucuggcagccac

SEQ ID NO: 1274352 - RNA, 15 nt, Human
acucuggcagccaca

SEQ ID NO: 1274353 - RNA, 14 nt, Human
acucuuaaucaaau

SEQ ID NO: 1274354 - RNA, 22 nt, Human
acucuuaccauauguuugguaa

SEQ ID NO: 1274355 - RNA, 16 nt, Human
acucuuauaucuauau

SEQ ID NO: 1274356 - RNA, 17 nt, Human
acucuuauaucuauauu

SEQ ID NO: 1274357 - RNA, 18 nt, Human
acucuuauaucuauauuu

SEQ ID NO: 1274358 - RNA, 22 nt, Human
acucuuauaucuauauuuuaca

SEQ ID NO: 1274359 - RNA, 19 nt, Human
acucuuauaucuauauuuu

SEQ ID NO: 1274360 - RNA, 16 nt, Human
acucuuauaaauuucu

SEQ ID NO: 1274361 - RNA, 16 nt, Human
acucuugauuauccau

SEQ ID NO: 1274362 - RNA, 22 nt, Human
acucuugcacagucacugcucu

SEQ ID NO: 1274363 - RNA, 14 nt, Human
acucuugccuguuu

SEQ ID NO: 1274364 - RNA, 18 nt, Human
acucuugccuguuuccca

SEQ ID NO: 1274365 - RNA, 13 nt, Human
uccucccaggcgc

SEQ ID NO: 1274366 - RNA, 12 nt, Human
uccucccagaaa

SEQ ID NO: 1274367 - RNA, 14 nt, Human
uccucauccacccc

SEQ ID NO: 1274368 - RNA, 15 nt, Human
uccucauccacccca

SEQ ID NO: 1274369 - RNA, 17 nt, Human
uccucauccaccccauc

SEQ ID NO: 1274370 - RNA, 18 nt, Human
uccucauccaccccaucc

SEQ ID NO: 1274371 - RNA, 19 nt, Human
uccucccaggcgccccuuc

SEQ ID NO: 1274372 - RNA, 21 nt, Human
uccucccaggcgccccuuccc

SEQ ID NO: 1274373 - RNA, 11 nt, Human
uccucccaggg

SEQ ID NO: 1274374 - RNA, 12 nt, Human
uccucccagggu

SEQ ID NO: 1274375 - RNA, 22 nt, Human
uccucccaggguuuuaacuuug

SEQ ID NO: 1274376 - RNA, 23 nt, Human
uccucccaggguuuuaacuuugu

SEQ ID NO: 1274377 - RNA, 20 nt, Human
uccucccgagcuccucuucc

SEQ ID NO: 1274378 - RNA, 17 nt, Human
uccucccgagcuccucu

SEQ ID NO: 1274379 - RNA, 15 nt, Human
uccucccucagugcc

SEQ ID NO: 1274380 - RNA, 21 nt, Human
uccucagccuugccagagauc

SEQ ID NO: 1274381 - RNA, 15 nt, Human
uccucaggcacacag

SEQ ID NO: 1274382 - RNA, 16 nt, Human
uccucaggcacacagc

SEQ ID NO: 1274383 - RNA, 17 nt, Human
uccucaggcacacagcu

SEQ ID NO: 1274384 - RNA, 22 nt, Human
uccucaggcacacagcuacucu

SEQ ID NO: 1274385 - RNA, 20 nt, Human
uccucagccuugccagagau

SEQ ID NO: 1274386 - RNA, 16 nt, Human
acucugccuccucuuc

SEQ ID NO: 1274387 - RNA, 12 nt, Human
acucugccuccu

SEQ ID NO: 1274388 - RNA, 19 nt, Human
acucugccuacagaacuuc

SEQ ID NO: 1274389 - RNA, 21 nt, Human
acucugaguguuuuaugagaa

SEQ ID NO: 1274390 - RNA, 20 nt, Human
acucugaguguuuuaugaga

SEQ ID NO: 1274391 - RNA, 22 nt, Human
acucucuggaagccccugggcc

SEQ ID NO: 1274392 - RNA, 20 nt, Human
acucucuuauugccucacuu

SEQ ID NO: 1274393 - RNA, 14 nt, Human
acucugaguguuuu

SEQ ID NO: 1274394 - RNA, 19 nt, Human
uccuaggcauucuggaccu

SEQ ID NO: 1274395 - RNA, 23 nt, Human
uccuaggcauucuggaccucugg

SEQ ID NO: 1274396 - RNA, 15 nt, Human
acuccuuccugcccc

SEQ ID NO: 1274397 - RNA, 14 nt, Human
acuccuuccugccc

SEQ ID NO: 1274398 - RNA, 23 nt, Human
acuccuugauuuuagccuucucu

SEQ ID NO: 1274399 - RNA, 20 nt, Human
acucuccuaggcauucugga

SEQ ID NO: 1274400 - RNA, 23 nt, Human
acucuccuaggcauucuggaccu

SEQ ID NO: 1274401 - RNA, 12 nt, Human
acucuccugccu

SEQ ID NO: 1274402 - RNA, 14 nt, Human
acucuccugccuug

SEQ ID NO: 1274403 - RNA, 23 nt, Human
acucuccugccuugaaaaagaca

SEQ ID NO: 1274404 - RNA, 20 nt, Human
uccagccugcugccugcuuu

SEQ ID NO: 1274405 - RNA, 14 nt, Human
uccagccucagcuc

SEQ ID NO: 1274406 - RNA, 11 nt, Human
uccagccuggg

SEQ ID NO: 1274407 - RNA, 13 nt, Human
uccaggagccugg

SEQ ID NO: 1274408 - RNA, 14 nt, Human
uccaggagccuggc

SEQ ID NO: 1274409 - RNA, 23 nt, Human
uccaggagccuggcuccguccag

SEQ ID NO: 1274410 - RNA, 15 nt, Human
uccaggagccugugc

SEQ ID NO: 1274411 - RNA, 19 nt, Human
uccagacagggaauuaggc

SEQ ID NO: 1274412 - RNA, 13 nt, Human
uccagaccccugg

SEQ ID NO: 1274413 - RNA, 18 nt, Human
uccaggagccugugccuc

SEQ ID NO: 1274414 - RNA, 13 nt, Human
uccaggagcucca

SEQ ID NO: 1274415 - RNA, 15 nt, Human
uccaggagcuccagu

SEQ ID NO: 1274416 - RNA, 17 nt, Human
uccaggagcuccagugu

SEQ ID NO: 1274417 - RNA, 20 nt, Human
uccaggagcuccaguguccu

SEQ ID NO: 1274418 - RNA, 21 nt, Human
uccaggagcuccaguguccug

SEQ ID NO: 1274419 - RNA, 22 nt, Human
uccaggagcuccaguguccuga

SEQ ID NO: 1274420 - RNA, 24 nt, Human
uccaggagcuccaguguccugagc

SEQ ID NO: 1274421 - RNA, 19 nt, Human
uccaggaugcuaacaucua

SEQ ID NO: 1274422 - RNA, 22 nt, Human
uccaggaugcuaacaucuaaaa

SEQ ID NO: 1274423 - RNA, 23 nt, Human
uccaggagcuccaguguccugag

SEQ ID NO: 1274424 - RNA, 23 nt, Human
accuuuuuucaacagugaagaca

SEQ ID NO: 1274425 - RNA, 18 nt, Human
accuuuuuucaacaguga

SEQ ID NO: 1274426 - RNA, 14 nt, Human
acgaaacaaagaca

SEQ ID NO: 1274427 - RNA, 17 nt, Human
acgaaauaauuguuguu

SEQ ID NO: 1274428 - RNA, 21 nt, Human
acgaaauaauuguuguucugu

SEQ ID NO: 1274429 - RNA, 23 nt, Human
acgaaauaauuguuguucuguua

SEQ ID NO: 1274430 - RNA, 12 nt, Human
acgaaauguuau

SEQ ID NO: 1274431 - RNA, 13 nt, Human
acgaaauguuauu

SEQ ID NO: 1274432 - RNA, 23 nt, Human
acgaaauguuauuuuuuaauuau

SEQ ID NO: 1274433 - RNA, 16 nt, Human
acgaaauguuauuuuu

SEQ ID NO: 1274434 - RNA, 22 nt, Human
accuuuguuugcaucugaaaau

SEQ ID NO: 1274435 - RNA, 17 nt, Human
accuuugugcccuauca

SEQ ID NO: 1274436 - RNA, 13 nt, Human
accuuugugcccu

SEQ ID NO: 1274437 - RNA, 18 nt, Human
accuuugugcccuaucac

SEQ ID NO: 1274438 - RNA, 18 nt, Human
accuuugacaaagguaaa

SEQ ID NO: 1274439 - RNA, 17 nt, Human
accuuugacaaagguaa

SEQ ID NO: 1274440 - RNA, 20 nt, Human
accuuucuucaccaaaucuu

SEQ ID NO: 1274441 - RNA, 14 nt, Human
ucauuccuccaggu

SEQ ID NO: 1274442 - RNA, 13 nt, Human
ucauuccuccagg

SEQ ID NO: 1274443 - RNA, 12 nt, Human
ucauuccuccag

SEQ ID NO: 1274444 - RNA, 19 nt, Human
accuugaaaacuuuaugcu

SEQ ID NO: 1274445 - RNA, 20 nt, Human
accuugaaaauaagaauaga

SEQ ID NO: 1274446 - RNA, 15 nt, Human
uccacucguguguuu

SEQ ID NO: 1274447 - RNA, 14 nt, Human
uccacucguguguu

SEQ ID NO: 1274448 - RNA, 19 nt, Human
accuuuuuauuugcaugug

SEQ ID NO: 1274449 - RNA, 15 nt, Human
accuuuuauguagua

SEQ ID NO: 1274450 - RNA, 20 nt, Human
accuuuuauguaguaauuga

SEQ ID NO: 1274451 - RNA, 20 nt, Human
accuuuuauugacacagaaa

SEQ ID NO: 1274452 - RNA, 16 nt, Human
accuuuuauugacaca

SEQ ID NO: 1274453 - RNA, 17 nt, Human
accuuuugaggagcccc

SEQ ID NO: 1274454 - RNA, 21 nt, Human
accuuuugaggagccccagcu

SEQ ID NO: 1274455 - RNA, 18 nt, Human
uccacucguguguuucua

SEQ ID NO: 1274456 - RNA, 16 nt, Human
uccacucguguguuuc

SEQ ID NO: 1274457 - RNA, 22 nt, Human
uccacugguucuucuuggucuc

SEQ ID NO: 1274458 - RNA, 18 nt, Human
uccagaauggucuuucua

SEQ ID NO: 1274459 - RNA, 21 nt, Human
uccagaaugcuguacaucuau

SEQ ID NO: 1274460 - RNA, 19 nt, Human
uccacugugcagguuccca

SEQ ID NO: 1274461 - RNA, 18 nt, Human
uccagaaugcuguacauc

SEQ ID NO: 1274462 - RNA, 23 nt, Human
uccagugggaggugagaccaccu

SEQ ID NO: 1274463 - RNA, 23 nt, Human
uccaguggacuucgcaguccacu

SEQ ID NO: 1274464 - RNA, 18 nt, Human
uccagugagacagcucug

SEQ ID NO: 1274465 - RNA, 16 nt, Human
uccaguaggauccagu

SEQ ID NO: 1274466 - RNA, 21 nt, Human
uccaguauaagacuacugaau

SEQ ID NO: 1274467 - RNA, 20 nt, Human
uccagucaggccuaucuaaa

SEQ ID NO: 1274468 - RNA, 18 nt, Human
uccaguccuaucugggcu

SEQ ID NO: 1274469 - RNA, 19 nt, Human
uccaguccuaucugggcuu

SEQ ID NO: 1274470 - RNA, 22 nt, Human
uccaguccuaucugggcuuccu

SEQ ID NO: 1274471 - RNA, 23 nt, Human
uccaguccuaucugggcuuccug

SEQ ID NO: 1274472 - RNA, 13 nt, Human
uccagucuauuca

SEQ ID NO: 1274473 - RNA, 15 nt, Human
acggccacacagcug

SEQ ID NO: 1274474 - RNA, 16 nt, Human
acggccacacagcugc

SEQ ID NO: 1274475 - RNA, 17 nt, Human
acggccacacagcugcc

SEQ ID NO: 1274476 - RNA, 18 nt, Human
acggccacacagcugccg

SEQ ID NO: 1274477 - RNA, 19 nt, Human
acggcucuguccccagccu

SEQ ID NO: 1274478 - RNA, 20 nt, Human
acggcucuguccccagccug

SEQ ID NO: 1274479 - RNA, 18 nt, Human
acggcugcgcacuguguc

SEQ ID NO: 1274480 - RNA, 16 nt, Human
acggcugcgcacugug

SEQ ID NO: 1274481 - RNA, 19 nt, Human
acggccacacagcugccgg

SEQ ID NO: 1274482 - RNA, 20 nt, Human
acggccacacagcugccggu

SEQ ID NO: 1274483 - RNA, 13 nt, Human
acggccacaucaa

SEQ ID NO: 1274484 - RNA, 18 nt, Human
acggccacaucaaagagg

SEQ ID NO: 1274485 - RNA, 18 nt, Human
acggcucgauuucuccag

SEQ ID NO: 1274486 - RNA, 19 nt, Human
acggcucgauuucuccagg

SEQ ID NO: 1274487 - RNA, 21 nt, Human
acgggacccacaugcuccaga

SEQ ID NO: 1274488 - RNA, 15 nt, Human
uccaguaaucuaaua

SEQ ID NO: 1274489 - RNA, 19 nt, Human
uccaguaaucuaauauggc

SEQ ID NO: 1274490 - RNA, 23 nt, Human
acgcgccucgccggaucugaggg

SEQ ID NO: 1274491 - RNA, 20 nt, Human
acgcgguuugguuugcagcg

SEQ ID NO: 1274492 - RNA, 15 nt, Human
acgcgguuugguuug

SEQ ID NO: 1274493 - RNA, 13 nt, Human
acgcgucuuccug

SEQ ID NO: 1274494 - RNA, 15 nt, Human
acgcgucuuccugag

SEQ ID NO: 1274495 - RNA, 17 nt, Human
acgccuggcugcugauc

SEQ ID NO: 1274496 - RNA, 18 nt, Human
acgccugggggugccagg

SEQ ID NO: 1274497 - RNA, 15 nt, Human
acgccucuugaccag

SEQ ID NO: 1274498 - RNA, 16 nt, Human
acgccucuugaccagg

SEQ ID NO: 1274499 - RNA, 24 nt, Human
acgccucuugaccaggcugccucc

SEQ ID NO: 1274500 - RNA, 11 nt, Human
acgccugagcc

SEQ ID NO: 1274501 - RNA, 12 nt, Human
acgccugagccc

SEQ ID NO: 1274502 - RNA, 13 nt, Human
acgccugagccca

SEQ ID NO: 1274503 - RNA, 15 nt, Human
acgccugagcccagg

SEQ ID NO: 1274504 - RNA, 16 nt, Human
acgccugagcccaggg

SEQ ID NO: 1274505 - RNA, 17 nt, Human
acgccugagcccaggga

SEQ ID NO: 1274506 - RNA, 18 nt, Human
acgccugagcccagggag

SEQ ID NO: 1274507 - RNA, 19 nt, Human
acgccugagcccagggagg

SEQ ID NO: 1274508 - RNA, 20 nt, Human
acgccugagcccagggaggc

SEQ ID NO: 1274509 - RNA, 21 nt, Human
acgccugagcccagggaggcc

SEQ ID NO: 1274510 - RNA, 13 nt, Human
acgccugaggaac

SEQ ID NO: 1274511 - RNA, 21 nt, Human
acgccugaggaacccuuacag

SEQ ID NO: 1274512 - RNA, 15 nt, Human
acgccugaggcaauu

SEQ ID NO: 1274513 - RNA, 19 nt, Human
acgccugaggcaauuagac

SEQ ID NO: 1274514 - RNA, 21 nt, Human
acggagucucacucugucacc

SEQ ID NO: 1274515 - RNA, 19 nt, Human
acgcugcugucacaaccaa

SEQ ID NO: 1274516 - RNA, 21 nt, Human
acgcugcugucacaaccaaga

SEQ ID NO: 1274517 - RNA, 14 nt, Human
acgcucucuggccu

SEQ ID NO: 1274518 - RNA, 11 nt, Human
acgcucucugg

SEQ ID NO: 1274519 - RNA, 14 nt, Human
acgcuccuuccucu

SEQ ID NO: 1274520 - RNA, 15 nt, Human
acgcuccuuccucug

SEQ ID NO: 1274521 - RNA, 14 nt, Human
acgcuauuccagcu

SEQ ID NO: 1274522 - RNA, 22 nt, Human
acgcuauuccagcugucccccc

SEQ ID NO: 1274523 - RNA, 13 nt, Human
acgcucagugggg

SEQ ID NO: 1274524 - RNA, 13 nt, Human
acgcuccaaaguc

SEQ ID NO: 1274525 - RNA, 21 nt, Human
acgcuccaaagucauaauugc

SEQ ID NO: 1274526 - RNA, 11 nt, Human
acgcuccagcu

SEQ ID NO: 1274527 - RNA, 14 nt, Human
acgcuccagcugcc

SEQ ID NO: 1274528 - RNA, 16 nt, Human
acgcuccagcugcccc

SEQ ID NO: 1274529 - RNA, 17 nt, Human
acgcuccagcugccccg

SEQ ID NO: 1274530 - RNA, 19 nt, Human
acgcuccagcugccccggc

SEQ ID NO: 1274531 - RNA, 21 nt, Human
acggucggggcaucuggccug

SEQ ID NO: 1274532 - RNA, 22 nt, Human
acggucggggcaucuggccugg

SEQ ID NO: 1274533 - RNA, 19 nt, Human
uccauccugaggcuccacu

SEQ ID NO: 1274534 - RNA, 19 nt, Human
uccaguuaaaaaaaauuuu

SEQ ID NO: 1274535 - RNA, 15 nt, Human
uccauccugaggcuc

SEQ ID NO: 1274536 - RNA, 12 nt, Human
uccauccugagg

SEQ ID NO: 1274537 - RNA, 15 nt, Human
uccaguguccugagc

SEQ ID NO: 1274538 - RNA, 16 nt, Human
uccaguguccugagcu

SEQ ID NO: 1274539 - RNA, 17 nt, Human
uccaguguccugagcuc

SEQ ID NO: 1274540 - RNA, 19 nt, Human
uccaguguccugagcucag

SEQ ID NO: 1274541 - RNA, 20 nt, Human
uccaguguccugagcucagc

SEQ ID NO: 1274542 - RNA, 22 nt, Human
uccaguguccugagcucagcgu

SEQ ID NO: 1274543 - RNA, 21 nt, Human
uccaguguccugagcucagcg

SEQ ID NO: 1274544 - RNA, 21 nt, Human
uccaguuaaaaaaaauuuuaa

SEQ ID NO: 1274545 - RNA, 14 nt, Human
acggugcccaagcc

SEQ ID NO: 1274546 - RNA, 15 nt, Human
acggugcccaagcca

SEQ ID NO: 1274547 - RNA, 17 nt, Human
acguaauaagguuuuaa

SEQ ID NO: 1274548 - RNA, 19 nt, Human
acguaaaguacuuguaguu

SEQ ID NO: 1274549 - RNA, 16 nt, Human
acguaaaguacuugua

SEQ ID NO: 1274550 - RNA, 15 nt, Human
acguaauaagguuuu

SEQ ID NO: 1274551 - RNA, 21 nt, Human
acguauuuaauagcaaagaau

SEQ ID NO: 1274552 - RNA, 19 nt, Human
acguuggagaagcccgugu

SEQ ID NO: 1274553 - RNA, 15 nt, Human
acguuaccaggcagg

SEQ ID NO: 1274554 - RNA, 22 nt, Human
acguguguuuuucuauuaaaag

SEQ ID NO: 1274555 - RNA, 17 nt, Human
acguuuaagccaaaaca

SEQ ID NO: 1274556 - RNA, 21 nt, Human
acgucacuggaccacugggca

SEQ ID NO: 1274557 - RNA, 20 nt, Human
acguccaucacguuagcugu

SEQ ID NO: 1274558 - RNA, 16 nt, Human
acguccugagaaagcu

SEQ ID NO: 1274559 - RNA, 14 nt, Human
acguguguuuuucu

SEQ ID NO: 1274560 - RNA, 16 nt, Human
acguguguuuuucuau

SEQ ID NO: 1274561 - RNA, 17 nt, Human
acguguguuuuucuauu

SEQ ID NO: 1274562 - RNA, 18 nt, Human
acguguguuuuucuauua

SEQ ID NO: 1274563 - RNA, 23 nt, Human
acguguguuuuucuauuaaaaga

SEQ ID NO: 1274564 - RNA, 16 nt, Human
acguguuugugcugug

SEQ ID NO: 1274565 - RNA, 15 nt, Human
acuacacccagcaau

SEQ ID NO: 1274566 - RNA, 16 nt, Human
acuacacccagcaaua

SEQ ID NO: 1274567 - RNA, 14 nt, Human
acuacacccagcaa

SEQ ID NO: 1274568 - RNA, 13 nt, Human
acuacacccagca

SEQ ID NO: 1274569 - RNA, 12 nt, Human
ucccacuuguca

SEQ ID NO: 1274570 - RNA, 19 nt, Human
ucccagaaaaaguaacuca

SEQ ID NO: 1274571 - RNA, 13 nt, Human
ucccagaagauga

SEQ ID NO: 1274572 - RNA, 17 nt, Human
ucccagaagaugacuga

SEQ ID NO: 1274573 - RNA, 20 nt, Human
ucccagaagaugacugaggg

SEQ ID NO: 1274574 - RNA, 14 nt, Human
ucccagagagcccg

SEQ ID NO: 1274575 - RNA, 16 nt, Human
ucccagagcaaaauaa

SEQ ID NO: 1274576 - RNA, 15 nt, Human
ucccagagagcccga

SEQ ID NO: 1274577 - RNA, 13 nt, Human
ucccagagcaccu

SEQ ID NO: 1274578 - RNA, 23 nt, Human
ucccagaggagccaccaguucuc

SEQ ID NO: 1274579 - RNA, 23 nt, Human
ucccagaggggccugccaccugg

SEQ ID NO: 1274580 - RNA, 15 nt, Human
ucccagagcaccugc

SEQ ID NO: 1274581 - RNA, 19 nt, Human
ucccagagcaccugcuguc

SEQ ID NO: 1274582 - RNA, 12 nt, Human
ucccagagcagg

SEQ ID NO: 1274583 - RNA, 16 nt, Human
ucccagaggagccacc

SEQ ID NO: 1274584 - RNA, 20 nt, Human
ucccagaggagccaccaguu

SEQ ID NO: 1274585 - RNA, 21 nt, Human
ucccagaggagccaccaguuc

SEQ ID NO: 1274586 - RNA, 16 nt, Human
ucccagaggggccugc

SEQ ID NO: 1274587 - RNA, 19 nt, Human
ucccagaggggccugccac

SEQ ID NO: 1274588 - RNA, 15 nt, Human
ucccagaguccucug

SEQ ID NO: 1274589 - RNA, 16 nt, Human
ucccagauaaugugaa

SEQ ID NO: 1274590 - RNA, 22 nt, Human
ucccagaggggccugccaccug

SEQ ID NO: 1274591 - RNA, 14 nt, Human
ucccagcccccuga

SEQ ID NO: 1274592 - RNA, 15 nt, Human
ucccagcccccugac

SEQ ID NO: 1274593 - RNA, 16 nt, Human
ucccagcccccugacc

SEQ ID NO: 1274594 - RNA, 17 nt, Human
ucccagcccccugacca

SEQ ID NO: 1274595 - RNA, 15 nt, Human
acuaauuuuaaaaug

SEQ ID NO: 1274596 - RNA, 18 nt, Human
acuaacaaccaaagacua

SEQ ID NO: 1274597 - RNA, 15 nt, Human
acuaacacucagaag

SEQ ID NO: 1274598 - RNA, 17 nt, Human
acuaacacucagaagcc

SEQ ID NO: 1274599 - RNA, 18 nt, Human
acuaacacucagaagccu

SEQ ID NO: 1274600 - RNA, 19 nt, Human
acuaacacucagaagccug

SEQ ID NO: 1274601 - RNA, 20 nt, Human
acuaacacucagaagccugg

SEQ ID NO: 1274602 - RNA, 21 nt, Human
acuaacacucagaagccuggg

SEQ ID NO: 1274603 - RNA, 15 nt, Human
acuaauuuuuauuuu

SEQ ID NO: 1274604 - RNA, 17 nt, Human
acuaaacuuuuuuucug

SEQ ID NO: 1274605 - RNA, 18 nt, Human
acuaaacuuuuuuucugu

SEQ ID NO: 1274606 - RNA, 19 nt, Human
acuaaacuuuuuuucugua

SEQ ID NO: 1274607 - RNA, 20 nt, Human
acuaaacuuuuuuucuguac

SEQ ID NO: 1274608 - RNA, 22 nt, Human
acuaaacuuuuuuucuguacca

SEQ ID NO: 1274609 - RNA, 17 nt, Human
acuaaagcaggccuuuu

SEQ ID NO: 1274610 - RNA, 20 nt, Human
acuaaagcaggccuuuugau

SEQ ID NO: 1274611 - RNA, 13 nt, Human
acuaaaucuuuua

SEQ ID NO: 1274612 - RNA, 15 nt, Human
acuaaaugcccugcu

SEQ ID NO: 1274613 - RNA, 15 nt, Human
acuaaaucuuuuaua

SEQ ID NO: 1274614 - RNA, 17 nt, Human
acucacaacagcugccu

SEQ ID NO: 1274615 - RNA, 18 nt, Human
acucaaggcggugcuuga

SEQ ID NO: 1274616 - RNA, 17 nt, Human
acucaaggacuuugcag

SEQ ID NO: 1274617 - RNA, 20 nt, Human
acuauggagugcaccaaaga

SEQ ID NO: 1274618 - RNA, 22 nt, Human
acuauggagugcaccaaagaga

SEQ ID NO: 1274619 - RNA, 23 nt, Human
acuauggagugcaccaaagagaa

SEQ ID NO: 1274620 - RNA, 21 nt, Human
acuauggauaaacuaaacacg

SEQ ID NO: 1274621 - RNA, 24 nt, Human
acuauggauaaacuaaacacguga

SEQ ID NO: 1274622 - RNA, 16 nt, Human
acuaucucauuuccaa

SEQ ID NO: 1274623 - RNA, 17 nt, Human
acuaucucauuuccaag

SEQ ID NO: 1274624 - RNA, 20 nt, Human
acuaucucuacugaauguca

SEQ ID NO: 1274625 - RNA, 14 nt, Human
acuaucugucuggu

SEQ ID NO: 1274626 - RNA, 17 nt, Human
acuaucugucugguggc

SEQ ID NO: 1274627 - RNA, 15 nt, Human
acuaucucauuucca

SEQ ID NO: 1274628 - RNA, 20 nt, Human
acuauaggcaugcgccacca

SEQ ID NO: 1274629 - RNA, 18 nt, Human
acuauagcggcauauaga

SEQ ID NO: 1274630 - RNA, 17 nt, Human
acuauauuguuugcuaa

SEQ ID NO: 1274631 - RNA, 22 nt, Human
acuauaggcaugcgccaccaug

SEQ ID NO: 1274632 - RNA, 22 nt, Human
acuauauuugggccugcuccag

SEQ ID NO: 1274633 - RNA, 23 nt, Human
acuauauuugggccugcuccaga

SEQ ID NO: 1274634 - RNA, 21 nt, Human
acuauaguccagcuuuguucu

SEQ ID NO: 1274635 - RNA, 22 nt, Human
acuauauuguuugcuaagcauu

SEQ ID NO: 1274636 - RNA, 16 nt, Human
acuagaccuccagcug

SEQ ID NO: 1274637 - RNA, 16 nt, Human
acuagagcaagcagga

SEQ ID NO: 1274638 - RNA, 18 nt, Human
acuacugacauguggggc

SEQ ID NO: 1274639 - RNA, 23 nt, Human
acuacugacauguggggccaggu

SEQ ID NO: 1274640 - RNA, 22 nt, Human
acuacugacggaguccuguguu

SEQ ID NO: 1274641 - RNA, 19 nt, Human
acuagacucccaagcugga

SEQ ID NO: 1274642 - RNA, 16 nt, Human
acuacuguguuaugca

SEQ ID NO: 1274643 - RNA, 15 nt, Human
uccccagguccagcu

SEQ ID NO: 1274644 - RNA, 16 nt, Human
uccccagguccagcuc

SEQ ID NO: 1274645 - RNA, 17 nt, Human
uccccagguccagcucu

SEQ ID NO: 1274646 - RNA, 23 nt, Human
uccccagguccagcucuggaggg

SEQ ID NO: 1274647 - RNA, 16 nt, Human
ucccauuuaucgcaga

SEQ ID NO: 1274648 - RNA, 13 nt, Human
ucccauuucagcu

SEQ ID NO: 1274649 - RNA, 17 nt, Human
ucccauuuaucuaaaua

SEQ ID NO: 1274650 - RNA, 18 nt, Human
ucccagcccccugaccac

SEQ ID NO: 1274651 - RNA, 16 nt, Human
ucccagcuaggaagag

SEQ ID NO: 1274652 - RNA, 23 nt, Human
ucccagcuaggaagagcaggacu

SEQ ID NO: 1274653 - RNA, 20 nt, Human
ucccagcuaggaagagcagg

SEQ ID NO: 1274654 - RNA, 11 nt, Human
ucacacuggga

SEQ ID NO: 1274655 - RNA, 16 nt, Human
ucacacuggguggugg

SEQ ID NO: 1274656 - RNA, 21 nt, Human
ucacacugggugguggccugg

SEQ ID NO: 1274657 - RNA, 22 nt, Human
ucacacugggugguggccuggu

SEQ ID NO: 1274658 - RNA, 23 nt, Human
ucacacugggugguggccugguc

SEQ ID NO: 1274659 - RNA, 17 nt, Human
ucacacuggucugcugu

SEQ ID NO: 1274660 - RNA, 18 nt, Human
ucacacuggucugcuguc

SEQ ID NO: 1274661 - RNA, 14 nt, Human
ucacaaccuucugu

SEQ ID NO: 1274662 - RNA, 14 nt, Human
ucacaacagccuga

SEQ ID NO: 1274663 - RNA, 22 nt, Human
ucacaacagccugacaacauuu

SEQ ID NO: 1274664 - RNA, 13 nt, Human
ucacaaccaagaa

SEQ ID NO: 1274665 - RNA, 23 nt, Human
ucacagaugugugauucacagug

SEQ ID NO: 1274666 - RNA, 21 nt, Human
ucacagaugugugauucacag

SEQ ID NO: 1274667 - RNA, 16 nt, Human
ucaauucuugccaaau

SEQ ID NO: 1274668 - RNA, 16 nt, Human
ucaauugcaucuccca

SEQ ID NO: 1274669 - RNA, 17 nt, Human
ucaauugcaucucccag

SEQ ID NO: 1274670 - RNA, 18 nt, Human
ucaauugcaucucccaga

SEQ ID NO: 1274671 - RNA, 22 nt, Human
ucaauugcaucucccagauaau

SEQ ID NO: 1274672 - RNA, 14 nt, Human
ucaauugcuuugua

SEQ ID NO: 1274673 - RNA, 20 nt, Human
accaaagcaccuuagcuggc

SEQ ID NO: 1274674 - RNA, 11 nt, Human
accaaagcaca

SEQ ID NO: 1274675 - RNA, 17 nt, Human
accaaagggagucugcc

SEQ ID NO: 1274676 - RNA, 19 nt, Human
accaaagggagucugccag

SEQ ID NO: 1274677 - RNA, 20 nt, Human
accaaagggagucugccagg

SEQ ID NO: 1274678 - RNA, 21 nt, Human
accaaaguccuuuuuuuccau

SEQ ID NO: 1274679 - RNA, 11 nt, Human
accaaaguucu

SEQ ID NO: 1274680 - RNA, 12 nt, Human
accaaaguucua

SEQ ID NO: 1274681 - RNA, 15 nt, Human
ucacaaaauaucacc

SEQ ID NO: 1274682 - RNA, 20 nt, Human
ucacaaaauauauuuuguuu

SEQ ID NO: 1274683 - RNA, 19 nt, Human
ucacaaacuucauuucaga

SEQ ID NO: 1274684 - RNA, 15 nt, Human
ucacaaacuuuuaua

SEQ ID NO: 1274685 - RNA, 17 nt, Human
ucacaaacuuuuauacu

SEQ ID NO: 1274686 - RNA, 21 nt, Human
ucacaaacuuuuauacucuuu

SEQ ID NO: 1274687 - RNA, 16 nt, Human
ucaauuugauguggug

SEQ ID NO: 1274688 - RNA, 23 nt, Human
ucaauuucuguguugccaagcuc

SEQ ID NO: 1274689 - RNA, 15 nt, Human
ucaauuucuguguug

SEQ ID NO: 1274690 - RNA, 15 nt, Human
ucaauuucugaacac

SEQ ID NO: 1274691 - RNA, 19 nt, Human
ucaauuuauaccucaauuu

SEQ ID NO: 1274692 - RNA, 14 nt, Human
ucaauuuauuugaa

SEQ ID NO: 1274693 - RNA, 20 nt, Human
ucaauuuauuugaaugauuu

SEQ ID NO: 1274694 - RNA, 16 nt, Human
ucaauuuauuugaaug

SEQ ID NO: 1274695 - RNA, 16 nt, Human
accaccacgccuggcu

SEQ ID NO: 1274696 - RNA, 16 nt, Human
accaccaagccaaggg

SEQ ID NO: 1274697 - RNA, 15 nt, Human
accacauugcuuuuc

SEQ ID NO: 1274698 - RNA, 12 nt, Human
accaccaagccu

SEQ ID NO: 1274699 - RNA, 14 nt, Human
accaccaagccuug

SEQ ID NO: 1274700 - RNA, 15 nt, Human
accaccaagccuuga

SEQ ID NO: 1274701 - RNA, 19 nt, Human
accaccaagccuugauugg

SEQ ID NO: 1274702 - RNA, 24 nt, Human
accacauuggagauguuuaguaau

SEQ ID NO: 1274703 - RNA, 23 nt, Human
accacaugccccaucccaugcug

SEQ ID NO: 1274704 - RNA, 22 nt, Human
accacaugccccaucccaugcu

SEQ ID NO: 1274705 - RNA, 13 nt, Human
accacauugcuuu

SEQ ID NO: 1274706 - RNA, 19 nt, Human
accaccaacuacuaccugu

SEQ ID NO: 1274707 - RNA, 15 nt, Human
accacaggcucaggc

SEQ ID NO: 1274708 - RNA, 16 nt, Human
accacaggcucaggca

SEQ ID NO: 1274709 - RNA, 17 nt, Human
accacaggcucaggcag

SEQ ID NO: 1274710 - RNA, 13 nt, Human
ucacccccuucuc

SEQ ID NO: 1274711 - RNA, 16 nt, Human
ucacccccuucuccau

SEQ ID NO: 1274712 - RNA, 22 nt, Human
ucacccccuucuccauccacau

SEQ ID NO: 1274713 - RNA, 18 nt, Human
ucacccccuucuccaucc

SEQ ID NO: 1274714 - RNA, 19 nt, Human
accacagccagcaccuggc

SEQ ID NO: 1274715 - RNA, 20 nt, Human
accacagccagcaccuggca

SEQ ID NO: 1274716 - RNA, 22 nt, Human
ucaccauguuggccaggcuggu

SEQ ID NO: 1274717 - RNA, 15 nt, Human
ucaccauuauaauga

SEQ ID NO: 1274718 - RNA, 20 nt, Human
ucaccauuauaaugaauuua

SEQ ID NO: 1274719 - RNA, 13 nt, Human
ucaccauucccag

SEQ ID NO: 1274720 - RNA, 17 nt, Human
ucaccauguuagccagg

SEQ ID NO: 1274721 - RNA, 23 nt, Human
ucaccauuauaaugaauuuagug

SEQ ID NO: 1274722 - RNA, 17 nt, Human
ucaccauuugauuaugu

SEQ ID NO: 1274723 - RNA, 22 nt, Human
ucaccauuugauuauguagcaa

SEQ ID NO: 1274724 - RNA, 16 nt, Human
ucaccauuuggauccu

SEQ ID NO: 1274725 - RNA, 23 nt, Human
ucaccauuuggcaaugccaucau

SEQ ID NO: 1274726 - RNA, 13 nt, Human
ucacccaacgcuc

SEQ ID NO: 1274727 - RNA, 20 nt, Human
ucaccauuuggauccugugu

SEQ ID NO: 1274728 - RNA, 13 nt, Human
ucacccaccccug

SEQ ID NO: 1274729 - RNA, 14 nt, Human
ucacccaccccugc

SEQ ID NO: 1274730 - RNA, 15 nt, Human
ucacccagacauaaa

SEQ ID NO: 1274731 - RNA, 19 nt, Human
ucacccagacauaaaggaa

SEQ ID NO: 1274732 - RNA, 20 nt, Human
ucacccagacauaaaggaaa

SEQ ID NO: 1274733 - RNA, 22 nt, Human
ucacccagacauaaaggaaaag

SEQ ID NO: 1274734 - RNA, 13 nt, Human
ucacccccagcuu

SEQ ID NO: 1274735 - RNA, 18 nt, Human
ucacccccagcuuugcua

SEQ ID NO: 1274736 - RNA, 13 nt, Human
ucacagcggaggu

SEQ ID NO: 1274737 - RNA, 19 nt, Human
ucacaguucuuugggccag

SEQ ID NO: 1274738 - RNA, 20 nt, Human
ucacaguucuuugggccaga

SEQ ID NO: 1274739 - RNA, 22 nt, Human
ucacaguucuuugggccagaca

SEQ ID NO: 1274740 - RNA, 17 nt, Human
ucacaguuugaaauaag

SEQ ID NO: 1274741 - RNA, 15 nt, Human
ucacaguuugaaaua

SEQ ID NO: 1274742 - RNA, 16 nt, Human
ucacaguuugaaauaa

SEQ ID NO: 1274743 - RNA, 14 nt, Human
ucacauagcccacu

SEQ ID NO: 1274744 - RNA, 19 nt, Human
ucacauagcccacuuacau

SEQ ID NO: 1274745 - RNA, 20 nt, Human
ucacauagcccacuuacauu

SEQ ID NO: 1274746 - RNA, 21 nt, Human
ucaccauguuagccaggcugg

SEQ ID NO: 1274747 - RNA, 17 nt, Human
ucacguuuggugcuucu

SEQ ID NO: 1274748 - RNA, 22 nt, Human
ucacguuucauguaauccucaa

SEQ ID NO: 1274749 - RNA, 20 nt, Human
ucacguuaccauuuacaugu

SEQ ID NO: 1274750 - RNA, 20 nt, Human
ucacguccugagaaagcuca

SEQ ID NO: 1274751 - RNA, 21 nt, Human
ucacguuuggugcuucucaga

SEQ ID NO: 1274752 - RNA, 17 nt, Human
ucacuaaaucuuuuaua

SEQ ID NO: 1274753 - RNA, 12 nt, Human
ucacuaaaucuu

SEQ ID NO: 1274754 - RNA, 16 nt, Human
ucacuaggcuucuggu

SEQ ID NO: 1274755 - RNA, 23 nt, Human
ucacuaggcccccacuugccucu

SEQ ID NO: 1274756 - RNA, 14 nt, Human
ucacuaauucauua

SEQ ID NO: 1274757 - RNA, 15 nt, Human
ucacuaauucauuaa

SEQ ID NO: 1274758 - RNA, 18 nt, Human
ucacuaauucauuaaucu

SEQ ID NO: 1274759 - RNA, 14 nt, Human
ucaccugugcuucg

SEQ ID NO: 1274760 - RNA, 16 nt, Human
ucaccuguaaaccuga

SEQ ID NO: 1274761 - RNA, 17 nt, Human
ucaccuguaaaccugag

SEQ ID NO: 1274762 - RNA, 19 nt, Human
ucaccuguaaaccugaguc

SEQ ID NO: 1274763 - RNA, 12 nt, Human
ucaccucaugga

SEQ ID NO: 1274764 - RNA, 13 nt, Human
ucaccucauggaa

SEQ ID NO: 1274765 - RNA, 14 nt, Human
ucaccucauggaau

SEQ ID NO: 1274766 - RNA, 15 nt, Human
accacuagccucagg

SEQ ID NO: 1274767 - RNA, 13 nt, Human
accagcucagcac

SEQ ID NO: 1274768 - RNA, 14 nt, Human
accagcucagcacu

SEQ ID NO: 1274769 - RNA, 16 nt, Human
accagcucagcacugc

SEQ ID NO: 1274770 - RNA, 13 nt, Human
accagcucaggac

SEQ ID NO: 1274771 - RNA, 14 nt, Human
accagcucaggaca

SEQ ID NO: 1274772 - RNA, 15 nt, Human
accagcucaggacag

SEQ ID NO: 1274773 - RNA, 16 nt, Human
accagcucaggacaga

SEQ ID NO: 1274774 - RNA, 16 nt, Human
accacuagccucaggg

SEQ ID NO: 1274775 - RNA, 23 nt, Human
accagcucaggacagaugccaca

SEQ ID NO: 1274776 - RNA, 20 nt, Human
accagcucccccucccuccc

SEQ ID NO: 1274777 - RNA, 19 nt, Human
accagcucccccucccucc

SEQ ID NO: 1274778 - RNA, 22 nt, Human
accagcugcuccgaggacccag

SEQ ID NO: 1274779 - RNA, 15 nt, Human
accagcuuccuucag

SEQ ID NO: 1274780 - RNA, 17 nt, Human
accagcuuccuucagag

SEQ ID NO: 1274781 - RNA, 18 nt, Human
accagcuuccuucagaga

SEQ ID NO: 1274782 - RNA, 20 nt, Human
accagcuuccuucagagagc

SEQ ID NO: 1274783 - RNA, 21 nt, Human
accagcuuccuucagagagca

SEQ ID NO: 1274784 - RNA, 23 nt, Human
accagcuuccuucagagagcagu

SEQ ID NO: 1274785 - RNA, 22 nt, Human
accagcuuccuucagagagcag

SEQ ID NO: 1274786 - RNA, 13 nt, Human
accaggaacagca

SEQ ID NO: 1274787 - RNA, 12 nt, Human
accaggaagccg

SEQ ID NO: 1274788 - RNA, 12 nt, Human
accaggacccug

SEQ ID NO: 1274789 - RNA, 22 nt, Human
accaggacuagggcuggaguga

SEQ ID NO: 1274790 - RNA, 20 nt, Human
accaguaucgcucauagauc

SEQ ID NO: 1274791 - RNA, 11 nt, Human
accaguauuua

SEQ ID NO: 1274792 - RNA, 18 nt, Human
accaguauuuaacuucug

SEQ ID NO: 1274793 - RNA, 14 nt, Human
accaguauuuagaa

SEQ ID NO: 1274794 - RNA, 18 nt, Human
accaguauuuagaagcca

SEQ ID NO: 1274795 - RNA, 19 nt, Human
accaguauuuagaagccaa

SEQ ID NO: 1274796 - RNA, 14 nt, Human
accagucugacugu

SEQ ID NO: 1274797 - RNA, 15 nt, Human
accagucccagagca

SEQ ID NO: 1274798 - RNA, 15 nt, Human
accaguccccccacc

SEQ ID NO: 1274799 - RNA, 17 nt, Human
accaguccccccacccu

SEQ ID NO: 1274800 - RNA, 20 nt, Human
accaguaggggcuuauaaua

SEQ ID NO: 1274801 - RNA, 23 nt, Human
ucacuugaacccgggaggcagag

SEQ ID NO: 1274802 - RNA, 15 nt, Human
ucacuguuucacuac

SEQ ID NO: 1274803 - RNA, 21 nt, Human
ucacuguuucacuacucagca

SEQ ID NO: 1274804 - RNA, 14 nt, Human
ucacuguuucacua

SEQ ID NO: 1274805 - RNA, 20 nt, Human
ucacuguuuagaacacacac

SEQ ID NO: 1274806 - RNA, 17 nt, Human
ucacuguuuagaacaca

SEQ ID NO: 1274807 - RNA, 19 nt, Human
ucacuaucccggcugcccu

SEQ ID NO: 1274808 - RNA, 20 nt, Human
ucacuaucccggcugcccuu

SEQ ID NO: 1274809 - RNA, 13 nt, Human
ucacugcauccuc

SEQ ID NO: 1274810 - RNA, 20 nt, Human
ucacugugcuguuguuauga

SEQ ID NO: 1274811 - RNA, 19 nt, Human
ucacugugcuguuguuaug

SEQ ID NO: 1274812 - RNA, 16 nt, Human
ucacugugcuguuguu

SEQ ID NO: 1274813 - RNA, 15 nt, Human
ucacuguguccaggu

SEQ ID NO: 1274814 - RNA, 17 nt, Human
ucacugugucacccagg

SEQ ID NO: 1274815 - RNA, 23 nt, Human
ucacugugcuguuguuaugaugu

SEQ ID NO: 1274816 - RNA, 18 nt, Human
ucaaauugugugaaaggu

SEQ ID NO: 1274817 - RNA, 15 nt, Human
acauucugaaugcuu

SEQ ID NO: 1274818 - RNA, 18 nt, Human
acauucugaaugcuucua

SEQ ID NO: 1274819 - RNA, 21 nt, Human
acauucugaaugcuucuaagu

SEQ ID NO: 1274820 - RNA, 23 nt, Human
acauucugauucgaaugacacug

SEQ ID NO: 1274821 - RNA, 11 nt, Human
acauucugaau

SEQ ID NO: 1274822 - RNA, 14 nt, Human
acauucugaaugcu

SEQ ID NO: 1274823 - RNA, 14 nt, Human
acauuccugaacag

SEQ ID NO: 1274824 - RNA, 15 nt, Human
acauuccugaacagg

SEQ ID NO: 1274825 - RNA, 14 nt, Human
acauuccuugcuga

SEQ ID NO: 1274826 - RNA, 22 nt, Human
acauuccucaugaauguaaauu

SEQ ID NO: 1274827 - RNA, 21 nt, Human
acauuccuugcugaaacgcau

SEQ ID NO: 1274828 - RNA, 20 nt, Human
acauuccucaugaauguaaa

SEQ ID NO: 1274829 - RNA, 21 nt, Human
acauuccucaugaauguaaau

SEQ ID NO: 1274830 - RNA, 17 nt, Human
acauguaggaaguagga

SEQ ID NO: 1274831 - RNA, 12 nt, Human
acaugucaaucu

SEQ ID NO: 1274832 - RNA, 15 nt, Human
acaugucaaucuguc

SEQ ID NO: 1274833 - RNA, 18 nt, Human
acaugucaguaccuucaa

SEQ ID NO: 1274834 - RNA, 19 nt, Human
acaugucaguaccuucaaa

SEQ ID NO: 1274835 - RNA, 21 nt, Human
acaugucaguaccuucaaacu

SEQ ID NO: 1274836 - RNA, 18 nt, Human
acauucccaagguuacuu

SEQ ID NO: 1274837 - RNA, 19 nt, Human
acauucccaagguuacuua

SEQ ID NO: 1274838 - RNA, 17 nt, Human
acauuccucaugaaugu

SEQ ID NO: 1274839 - RNA, 18 nt, Human
acauuccucaugaaugua

SEQ ID NO: 1274840 - RNA, 19 nt, Human
acauuccucaugaauguaa

SEQ ID NO: 1274841 - RNA, 15 nt, Human
ucaaccauuccccau

SEQ ID NO: 1274842 - RNA, 18 nt, Human
ucaaccauuccccauggg

SEQ ID NO: 1274843 - RNA, 16 nt, Human
ucaaccaucgcuuuau

SEQ ID NO: 1274844 - RNA, 16 nt, Human
ucaaccccagacacug

SEQ ID NO: 1274845 - RNA, 17 nt, Human
ucaaccccagacacugg

SEQ ID NO: 1274846 - RNA, 18 nt, Human
ucaaccccagacacuggu

SEQ ID NO: 1274847 - RNA, 16 nt, Human
ucaaccccuccccucc

SEQ ID NO: 1274848 - RNA, 15 nt, Human
ucaaccccuccccuc

SEQ ID NO: 1274849 - RNA, 14 nt, Human
ucaacugccuacuc

SEQ ID NO: 1274850 - RNA, 18 nt, Human
ucaacugccuacuccaaa

SEQ ID NO: 1274851 - RNA, 20 nt, Human
ucaacugccuacuccaaaau

SEQ ID NO: 1274852 - RNA, 14 nt, Human
ucaaauuuuaucug

SEQ ID NO: 1274853 - RNA, 20 nt, Human
acauucugaaugcuucuaag

SEQ ID NO: 1274854 - RNA, 22 nt, Human
ucaaauuuuaucugccucucuu

SEQ ID NO: 1274855 - RNA, 15 nt, Human
ucaacaaaaauuguc

SEQ ID NO: 1274856 - RNA, 18 nt, Human
ucaacaaaaauugucccu

SEQ ID NO: 1274857 - RNA, 12 nt, Human
ucaacaaacauu

SEQ ID NO: 1274858 - RNA, 14 nt, Human
ucaacaaagaaaca

SEQ ID NO: 1274859 - RNA, 20 nt, Human
ucaacaaagaaacaaagaug

SEQ ID NO: 1274860 - RNA, 21 nt, Human
ucaacaaagaaacaaagaugu

SEQ ID NO: 1274861 - RNA, 14 nt, Human
ucaacauuucucaa

SEQ ID NO: 1274862 - RNA, 15 nt, Human
acaugggacauuugc

SEQ ID NO: 1274863 - RNA, 20 nt, Human
acaugggacauuugcucaug

SEQ ID NO: 1274864 - RNA, 21 nt, Human
acaugggacauuugcucaugg

SEQ ID NO: 1274865 - RNA, 20 nt, Human
acaugggagccgggucugcc

SEQ ID NO: 1274866 - RNA, 11 nt, Human
acaugggacau

SEQ ID NO: 1274867 - RNA, 14 nt, Human
acaugggacauuug

SEQ ID NO: 1274868 - RNA, 23 nt, Human
acaugggagccgggucugccucu

SEQ ID NO: 1274869 - RNA, 11 nt, Human
acauggggagg

SEQ ID NO: 1274870 - RNA, 15 nt, Human
acauggggaggagga

SEQ ID NO: 1274871 - RNA, 13 nt, Human
acauggggaggag

SEQ ID NO: 1274872 - RNA, 19 nt, Human
acaugcuucccuuuccuga

SEQ ID NO: 1274873 - RNA, 18 nt, Human
acaugcuucccuuuccug

SEQ ID NO: 1274874 - RNA, 16 nt, Human
acaugcuucccuuucc

SEQ ID NO: 1274875 - RNA, 13 nt, Human
acaugcuucccuu

SEQ ID NO: 1274876 - RNA, 23 nt, Human
acaugcuuagcaguccccuuccc

SEQ ID NO: 1274877 - RNA, 15 nt, Human
acaugcuuauuccau

SEQ ID NO: 1274878 - RNA, 17 nt, Human
acaugcuuauuccauga

SEQ ID NO: 1274879 - RNA, 18 nt, Human
acaugcuuauuccaugac

SEQ ID NO: 1274880 - RNA, 21 nt, Human
acaugcuuauuccaugacugc

SEQ ID NO: 1274881 - RNA, 22 nt, Human
acaugcuuauuccaugacugcu

SEQ ID NO: 1274882 - RNA, 23 nt, Human
acaugcuuauuccaugacugcuu

SEQ ID NO: 1274883 - RNA, 17 nt, Human
acaugcuaagagaagua

SEQ ID NO: 1274884 - RNA, 18 nt, Human
acaugcuaagagaaguag

SEQ ID NO: 1274885 - RNA, 19 nt, Human
acaugcuaagagaaguaga

SEQ ID NO: 1274886 - RNA, 24 nt, Human
acaugcuaagagaaguagaaauca

SEQ ID NO: 1274887 - RNA, 13 nt, Human
acaugcuguuauu

SEQ ID NO: 1274888 - RNA, 19 nt, Human
acaugcuuagcaguccccu

SEQ ID NO: 1274889 - RNA, 23 nt, Human
acaugagguacugagagugaaca

SEQ ID NO: 1274890 - RNA, 20 nt, Human
acaugcgguagccagcacac

SEQ ID NO: 1274891 - RNA, 22 nt, Human
acaugcgguagccagcacacag

SEQ ID NO: 1274892 - RNA, 23 nt, Human
acaugcgguagccagcacacagg

SEQ ID NO: 1274893 - RNA, 20 nt, Human
acaugaauauuuaguguuca

SEQ ID NO: 1274894 - RNA, 20 nt, Human
acaugagguacugagaguga

SEQ ID NO: 1274895 - RNA, 18 nt, Human
acaugaauuuuagcuuuu

SEQ ID NO: 1274896 - RNA, 18 nt, Human
acagucccuauggaaaga

SEQ ID NO: 1274897 - RNA, 17 nt, Human
acaugaauuauuacagu

SEQ ID NO: 1274898 - RNA, 19 nt, Human
acaugaauuauuacagugu

SEQ ID NO: 1274899 - RNA, 21 nt, Human
acaugaauuauuacaguguuu

SEQ ID NO: 1274900 - RNA, 15 nt, Human
acaugaauuuuagcu

SEQ ID NO: 1274901 - RNA, 17 nt, Human
acaugaauuuuagcuuu

SEQ ID NO: 1274902 - RNA, 15 nt, Human
ucaauauuucagaua

SEQ ID NO: 1274903 - RNA, 19 nt, Human
ucaauauuucagauaauca

SEQ ID NO: 1274904 - RNA, 23 nt, Human
ucaauauuucagauaaucacaau

SEQ ID NO: 1274905 - RNA, 17 nt, Human
ucaaucuucaauccuug

SEQ ID NO: 1274906 - RNA, 17 nt, Human
ucaaucuguaaacugug

SEQ ID NO: 1274907 - RNA, 15 nt, Human
ucaaucuugcaugua

SEQ ID NO: 1274908 - RNA, 16 nt, Human
ucaaucuugcauguaa

SEQ ID NO: 1274909 - RNA, 17 nt, Human
ucaaucuugcauguaac

SEQ ID NO: 1274910 - RNA, 18 nt, Human
ucaaucuugcauguaacg

SEQ ID NO: 1274911 - RNA, 13 nt, Human
ucaaucuguaaac

SEQ ID NO: 1274912 - RNA, 14 nt, Human
ucaaucuguaaacu

SEQ ID NO: 1274913 - RNA, 16 nt, Human
ucaaucuguaaacugu

SEQ ID NO: 1274914 - RNA, 18 nt, Human
ucaaucucaauugcuuug

SEQ ID NO: 1274915 - RNA, 19 nt, Human
ucaaucucugggggcugag

SEQ ID NO: 1274916 - RNA, 23 nt, Human
ucaaugaaugaaugaauggcuaa

SEQ ID NO: 1274917 - RNA, 18 nt, Human
ucaaucuuuaaaccaauu

SEQ ID NO: 1274918 - RNA, 20 nt, Human
ucaaucuugcauguaacgca

SEQ ID NO: 1274919 - RNA, 21 nt, Human
ucaaugaauuuuauaaucugc

SEQ ID NO: 1274920 - RNA, 14 nt, Human
ucaaugacaugaau

SEQ ID NO: 1274921 - RNA, 15 nt, Human
ucaaugacaugaauu

SEQ ID NO: 1274922 - RNA, 16 nt, Human
ucaaugacaugaauuu

SEQ ID NO: 1274923 - RNA, 21 nt, Human
ucaaugacaugaauuuuagcu

SEQ ID NO: 1274924 - RNA, 23 nt, Human
ucaaugacaugaauuuuagcuuu

SEQ ID NO: 1274925 - RNA, 22 nt, Human
ucaaugacaugaauuuuagcuu

SEQ ID NO: 1274926 - RNA, 12 nt, Human
ucaaugagcaug

SEQ ID NO: 1274927 - RNA, 13 nt, Human
ucaaugagcaugu

SEQ ID NO: 1274928 - RNA, 14 nt, Human
ucaaugagcauguu

SEQ ID NO: 1274929 - RNA, 17 nt, Human
ucaaugagcauguuuag

SEQ ID NO: 1274930 - RNA, 19 nt, Human
ucaaugagcauguuuagac

SEQ ID NO: 1274931 - RNA, 21 nt, Human
ucaaugagcauguuuagacuu

SEQ ID NO: 1274932 - RNA, 16 nt, Human
ucaaugagguguccaa

SEQ ID NO: 1274933 - RNA, 21 nt, Human
acauucuucaagaucccauuu

SEQ ID NO: 1274934 - RNA, 17 nt, Human
ucaaugagguguccaac

SEQ ID NO: 1274935 - RNA, 17 nt, Human
ucaauauucaauaaagc

SEQ ID NO: 1274936 - RNA, 16 nt, Human
ucaauauucaauaaag

SEQ ID NO: 1274937 - RNA, 15 nt, Human
ucaauauucaauaaa

SEQ ID NO: 1274938 - RNA, 22 nt, Human
ucaauaucuuuuuuuuaauaaa

SEQ ID NO: 1274939 - RNA, 19 nt, Human
ucaagucuguuuacugcaa

SEQ ID NO: 1274940 - RNA, 15 nt, Human
ucaagucuuucucuu

SEQ ID NO: 1274941 - RNA, 18 nt, Human
ucaagucuuucucuuucc

SEQ ID NO: 1274942 - RNA, 20 nt, Human
ucaagucuuucucuuucccu

SEQ ID NO: 1274943 - RNA, 21 nt, Human
ucaagucuuucucuuucccug

SEQ ID NO: 1274944 - RNA, 22 nt, Human
ucaagucuuucucuuucccugg

SEQ ID NO: 1274945 - RNA, 23 nt, Human
ucaagucuuucucuuucccuggu

SEQ ID NO: 1274946 - RNA, 18 nt, Human
ucaauauaagcuuuucuu

SEQ ID NO: 1274947 - RNA, 18 nt, Human
ucaagucuaccaauuaua

SEQ ID NO: 1274948 - RNA, 22 nt, Human
ucaagucuaccaaccuguucaa

SEQ ID NO: 1274949 - RNA, 15 nt, Human
ucaagucuaccaacc

SEQ ID NO: 1274950 - RNA, 19 nt, Human
ucaaguccugccucuuaaa

SEQ ID NO: 1274951 - RNA, 20 nt, Human
ucaaguccugccucuuaaau

SEQ ID NO: 1274952 - RNA, 21 nt, Human
ucaacuuuuccuuugaauccu

SEQ ID NO: 1274953 - RNA, 19 nt, Human
ucaacuugcaaaaucaguu

SEQ ID NO: 1274954 - RNA, 15 nt, Human
ucaacuuuuccuuug

SEQ ID NO: 1274955 - RNA, 20 nt, Human
ucaacuugcaaaaucaguuu

SEQ ID NO: 1274956 - RNA, 14 nt, Human
ucaacuugcuuauc

SEQ ID NO: 1274957 - RNA, 16 nt, Human
ucaacuugcaaaauca

SEQ ID NO: 1274958 - RNA, 14 nt, Human
ucaacuugcaaaau

SEQ ID NO: 1274959 - RNA, 13 nt, Human
ucaacuugcaaaa

SEQ ID NO: 1274960 - RNA, 20 nt, Human
ucaacuugagcauguuacug

SEQ ID NO: 1274961 - RNA, 16 nt, Human
ucaacuugagcauguu

SEQ ID NO: 1274962 - RNA, 22 nt, Human
ucaacugucuccuaccucugcu

SEQ ID NO: 1274963 - RNA, 19 nt, Human
ucaacuuaacuaucaucuu

SEQ ID NO: 1274964 - RNA, 19 nt, Human
ucaacuuauuaacaauuag

SEQ ID NO: 1274965 - RNA, 14 nt, Human
acauuguugagcua

SEQ ID NO: 1274966 - RNA, 12 nt, Human
acauuuucagug

SEQ ID NO: 1274967 - RNA, 12 nt, Human
acauuuuccuuu

SEQ ID NO: 1274968 - RNA, 19 nt, Human
acauuuuccuuuucaaaua

SEQ ID NO: 1274969 - RNA, 18 nt, Human
acauuuucuaagaaacau

SEQ ID NO: 1274970 - RNA, 19 nt, Human
acauuuucuaagaaacauu

SEQ ID NO: 1274971 - RNA, 11 nt, Human
acauuuucucc

SEQ ID NO: 1274972 - RNA, 17 nt, Human
acauuuucucccuggau

SEQ ID NO: 1274973 - RNA, 13 nt, Human
acauuuugaaagu

SEQ ID NO: 1274974 - RNA, 17 nt, Human
acauuuugaaagucugu

SEQ ID NO: 1274975 - RNA, 21 nt, Human
acauuuugaaagucuguccuu

SEQ ID NO: 1274976 - RNA, 20 nt, Human
acauuuuguaacaaagaacu

SEQ ID NO: 1274977 - RNA, 16 nt, Human
acauucuuauauuuca

SEQ ID NO: 1274978 - RNA, 17 nt, Human
acauugcaucaaagcau

SEQ ID NO: 1274979 - RNA, 18 nt, Human
acauugcaucaaagcauc

SEQ ID NO: 1274980 - RNA, 11 nt, Human
acauugugcca

SEQ ID NO: 1274981 - RNA, 17 nt, Human
acauuguugagcuauug

SEQ ID NO: 1274982 - RNA, 16 nt, Human
accaaaacaguuaauc

SEQ ID NO: 1274983 - RNA, 14 nt, Human
accaaaacugcucc

SEQ ID NO: 1274984 - RNA, 13 nt, Human
accaaaacugcuc

SEQ ID NO: 1274985 - RNA, 13 nt, Human
accaaaagaagua

SEQ ID NO: 1274986 - RNA, 21 nt, Human
accaaaagaaguaaaagcaaa

SEQ ID NO: 1274987 - RNA, 14 nt, Human
accaaaagaaguaa

SEQ ID NO: 1274988 - RNA, 14 nt, Human
accaaaaguuacau

SEQ ID NO: 1274989 - RNA, 21 nt, Human
accaaaaguuacauguuugca

SEQ ID NO: 1274990 - RNA, 23 nt, Human
accaaaaguuacauguuugcacc

SEQ ID NO: 1274991 - RNA, 21 nt, Human
accaaacaauauugcuccaug

SEQ ID NO: 1274992 - RNA, 15 nt, Human
accaaagaagaaagu

SEQ ID NO: 1274993 - RNA, 18 nt, Human
accaaagaugaaugaagc

SEQ ID NO: 1274994 - RNA, 23 nt, Human
accaaagaugaaugaagcaaaug

SEQ ID NO: 1274995 - RNA, 14 nt, Human
ucagauuuuuuccu

SEQ ID NO: 1274996 - RNA, 17 nt, Human
ucagccacccugaguug

SEQ ID NO: 1274997 - RNA, 16 nt, Human
ucagccacccugaguu

SEQ ID NO: 1274998 - RNA, 12 nt, Human
ucagccagcacu

SEQ ID NO: 1274999 - RNA, 14 nt, Human
ucagccagcacuug

SEQ ID NO: 1275000 - RNA, 23 nt, Human
ucagccagcacuuguccagcuga

SEQ ID NO: 1275001 - RNA, 16 nt, Human
ucagauuucugaggaa

SEQ ID NO: 1275002 - RNA, 19 nt, Human
ucagauuucugguuguuau

SEQ ID NO: 1275003 - RNA, 13 nt, Human
accauaauguuac

SEQ ID NO: 1275004 - RNA, 15 nt, Human
accauaauguuacau

SEQ ID NO: 1275005 - RNA, 18 nt, Human
accauaauguuacauuau

SEQ ID NO: 1275006 - RNA, 23 nt, Human
accaguguguggcuuucagagcc

SEQ ID NO: 1275007 - RNA, 22 nt, Human
accaguguuagggaagggccug

SEQ ID NO: 1275008 - RNA, 17 nt, Human
ucagcccucccugcccc

SEQ ID NO: 1275009 - RNA, 13 nt, Human
ucagcccucccug

SEQ ID NO: 1275010 - RNA, 14 nt, Human
ucagcccucccugc

SEQ ID NO: 1275011 - RNA, 15 nt, Human
ucagcccucccugcc

SEQ ID NO: 1275012 - RNA, 16 nt, Human
ucagcccucccugccc

SEQ ID NO: 1275013 - RNA, 12 nt, Human
ucagccagccuc

SEQ ID NO: 1275014 - RNA, 21 nt, Human
ucagccagccucgcccauccc

SEQ ID NO: 1275015 - RNA, 13 nt, Human
ucagccagccucg

SEQ ID NO: 1275016 - RNA, 18 nt, Human
accccacccacuucugca

SEQ ID NO: 1275017 - RNA, 19 nt, Human
accccagacuagauguagu

SEQ ID NO: 1275018 - RNA, 17 nt, Human
accccaucccuccccag

SEQ ID NO: 1275019 - RNA, 23 nt, Human
accccaucaccuacucacacagg

SEQ ID NO: 1275020 - RNA, 17 nt, Human
accccauccaguucaug

SEQ ID NO: 1275021 - RNA, 15 nt, Human
acccccucucccugc

SEQ ID NO: 1275022 - RNA, 15 nt, Human
accccugagcuugca

SEQ ID NO: 1275023 - RNA, 10 nt, Human
accccugcau

SEQ ID NO: 1275024 - RNA, 23 nt, Human
accccugcauuggaacuggaggc

SEQ ID NO: 1275025 - RNA, 22 nt, Human
accccugcauuggaacuggagg

SEQ ID NO: 1275026 - RNA, 22 nt, Human
accccugcuuugggcuugggcc

SEQ ID NO: 1275027 - RNA, 14 nt, Human
ucagcuaagcucac

SEQ ID NO: 1275028 - RNA, 23 nt, Human
ucagcguggagggguaggggcug

SEQ ID NO: 1275029 - RNA, 13 nt, Human
ucagcguggccuu

SEQ ID NO: 1275030 - RNA, 14 nt, Human
ucagcguggccuug

SEQ ID NO: 1275031 - RNA, 17 nt, Human
ucagcguggccuuguuc

SEQ ID NO: 1275032 - RNA, 15 nt, Human
ucagcuaagcucacg

SEQ ID NO: 1275033 - RNA, 18 nt, Human
accccuggcuuuucacug

SEQ ID NO: 1275034 - RNA, 19 nt, Human
accccuggcuuuucacugc

SEQ ID NO: 1275035 - RNA, 20 nt, Human
accccuggcuuuucacugcu

SEQ ID NO: 1275036 - RNA, 21 nt, Human
accccuggcuuuucacugcug

SEQ ID NO: 1275037 - RNA, 17 nt, Human
ucagccuuaagaaccau

SEQ ID NO: 1275038 - RNA, 15 nt, Human
ucagccuuagcucuc

SEQ ID NO: 1275039 - RNA, 23 nt, Human
acccucguggacaccugcccugc

SEQ ID NO: 1275040 - RNA, 22 nt, Human
acccucguggacaccugcccug

SEQ ID NO: 1275041 - RNA, 20 nt, Human
acccucguggacaccugccc

SEQ ID NO: 1275042 - RNA, 23 nt, Human
acccucggggauguguccugaca

SEQ ID NO: 1275043 - RNA, 19 nt, Human
acccucguggacaccugcc

SEQ ID NO: 1275044 - RNA, 18 nt, Human
acccucguggacaccugc

SEQ ID NO: 1275045 - RNA, 17 nt, Human
acccucguggacaccug

SEQ ID NO: 1275046 - RNA, 15 nt, Human
acccucguggacacc

SEQ ID NO: 1275047 - RNA, 17 nt, Human
acccucggggauguguc

SEQ ID NO: 1275048 - RNA, 19 nt, Human
acccucggggauguguccu

SEQ ID NO: 1275049 - RNA, 20 nt, Human
acccucggggauguguccug

SEQ ID NO: 1275050 - RNA, 15 nt, Human
acccucucagcucca

SEQ ID NO: 1275051 - RNA, 16 nt, Human
acccucucagcuccag

SEQ ID NO: 1275052 - RNA, 16 nt, Human
acccucugaaauacau

SEQ ID NO: 1275053 - RNA, 14 nt, Human
acccucugaaauac

SEQ ID NO: 1275054 - RNA, 18 nt, Human
acccugaaggggccauga

SEQ ID NO: 1275055 - RNA, 12 nt, Human
acccugaagggg

SEQ ID NO: 1275056 - RNA, 17 nt, Human
acccugaaggggccaug

SEQ ID NO: 1275057 - RNA, 21 nt, Human
acccugcccuuguuuggggca

SEQ ID NO: 1275058 - RNA, 11 nt, Human
acccuugacac

SEQ ID NO: 1275059 - RNA, 17 nt, Human
acccuuucuucagcucu

SEQ ID NO: 1275060 - RNA, 21 nt, Human
acccuuuuggguuucugcccu

SEQ ID NO: 1275061 - RNA, 17 nt, Human
acccuuuuucuccagcu

SEQ ID NO: 1275062 - RNA, 18 nt, Human
acccggaggggccuggca

SEQ ID NO: 1275063 - RNA, 21 nt, Human
acccggaggggccuggcagcc

SEQ ID NO: 1275064 - RNA, 15 nt, Human
ucagguaauacaaac

SEQ ID NO: 1275065 - RNA, 16 nt, Human
ucagguaauacaaacu

SEQ ID NO: 1275066 - RNA, 16 nt, Human
acccggcacccccugc

SEQ ID NO: 1275067 - RNA, 18 nt, Human
acccggcacccccugcag

SEQ ID NO: 1275068 - RNA, 19 nt, Human
acccggcacccccugcagc

SEQ ID NO: 1275069 - RNA, 20 nt, Human
acccggcacccccugcagcu

SEQ ID NO: 1275070 - RNA, 22 nt, Human
acccggcacccccugcagcuug

SEQ ID NO: 1275071 - RNA, 13 nt, Human
acccggcuaauuu

SEQ ID NO: 1275072 - RNA, 17 nt, Human
acccgggaggcagaggu

SEQ ID NO: 1275073 - RNA, 14 nt, Human
acccggcugcagag

SEQ ID NO: 1275074 - RNA, 21 nt, Human
ucagcuuucuuuaaaguucuu

SEQ ID NO: 1275075 - RNA, 23 nt, Human
ucagggcuccuugugggccuggg

SEQ ID NO: 1275076 - RNA, 16 nt, Human
ucagggcuucuaguuu

SEQ ID NO: 1275077 - RNA, 22 nt, Human
ucagggcuucuaguuucucuua

SEQ ID NO: 1275078 - RNA, 19 nt, Human
accuauuuccagaaauaca

SEQ ID NO: 1275079 - RNA, 12 nt, Human
accuauuuccau

SEQ ID NO: 1275080 - RNA, 23 nt, Human
accuauuucuuaaacacuugcaa

SEQ ID NO: 1275081 - RNA, 18 nt, Human
accuauuucuuaaacacu

SEQ ID NO: 1275082 - RNA, 17 nt, Human
accuauuuccagaaaua

SEQ ID NO: 1275083 - RNA, 16 nt, Human
accuauuuccagaaau

SEQ ID NO: 1275084 - RNA, 16 nt, Human
accuauuaucccagcu

SEQ ID NO: 1275085 - RNA, 22 nt, Human
accuaugucauuucauuuccua

SEQ ID NO: 1275086 - RNA, 16 nt, Human
accuagggugauauua

SEQ ID NO: 1275087 - RNA, 18 nt, Human
accuaggaagccucagau

SEQ ID NO: 1275088 - RNA, 15 nt, Human
accgcagaaggaagg

SEQ ID NO: 1275089 - RNA, 15 nt, Human
accuaccuguugagc

SEQ ID NO: 1275090 - RNA, 17 nt, Human
accuaccuguugagcau

SEQ ID NO: 1275091 - RNA, 24 nt, Human
accuaccuguugagcaucacagaa

SEQ ID NO: 1275092 - RNA, 14 nt, Human
accuacucacacag

SEQ ID NO: 1275093 - RNA, 16 nt, Human
accuacucacacaggc

SEQ ID NO: 1275094 - RNA, 17 nt, Human
accuacucacacaggca

SEQ ID NO: 1275095 - RNA, 18 nt, Human
accuacucuggcuagaag

SEQ ID NO: 1275096 - RNA, 12 nt, Human
accuaggcuagg

SEQ ID NO: 1275097 - RNA, 17 nt, Human
accuaggcuaggguggg

SEQ ID NO: 1275098 - RNA, 17 nt, Human
accuaggaagccucaga

SEQ ID NO: 1275099 - RNA, 22 nt, Human
accuaggaagccucagauuccu

SEQ ID NO: 1275100 - RNA, 19 nt, Human
accuacugcccaggcacug

SEQ ID NO: 1275101 - RNA, 23 nt, Human
accuacugcccaggcacugcaaa

SEQ ID NO: 1275102 - RNA, 15 nt, Human
accuacuguucuaaa

SEQ ID NO: 1275103 - RNA, 16 nt, Human
accuacuguucuaaag

SEQ ID NO: 1275104 - RNA, 17 nt, Human
accuacuguucuaaagc

SEQ ID NO: 1275105 - RNA, 18 nt, Human
accuacuguucuaaagcu

SEQ ID NO: 1275106 - RNA, 20 nt, Human
accuacuguucuaaagcucu

SEQ ID NO: 1275107 - RNA, 21 nt, Human
accuacuguucuaaagcucug

SEQ ID NO: 1275108 - RNA, 23 nt, Human
accuacuguucuaaagcucugac

SEQ ID NO: 1275109 - RNA, 20 nt, Human
accuacuuugacuuuuugca

SEQ ID NO: 1275110 - RNA, 21 nt, Human
accuacuuugacuuuuugcau

SEQ ID NO: 1275111 - RNA, 17 nt, Human
accucccucaaccucau

SEQ ID NO: 1275112 - RNA, 17 nt, Human
accucccuauacugcuu

SEQ ID NO: 1275113 - RNA, 12 nt, Human
accuccccuugg

SEQ ID NO: 1275114 - RNA, 13 nt, Human
accuccccuuggg

SEQ ID NO: 1275115 - RNA, 14 nt, Human
accuccccuugggc

SEQ ID NO: 1275116 - RNA, 22 nt, Human
accuccccuugggcccacaccu

SEQ ID NO: 1275117 - RNA, 17 nt, Human
accuccugacacccuuc

SEQ ID NO: 1275118 - RNA, 18 nt, Human
accuccugacacccuucu

SEQ ID NO: 1275119 - RNA, 19 nt, Human
accuccugacacccuucuc

SEQ ID NO: 1275120 - RNA, 21 nt, Human
accuccugacacccuucuccc

SEQ ID NO: 1275121 - RNA, 22 nt, Human
accuccugacacccuucuccca

SEQ ID NO: 1275122 - RNA, 13 nt, Human
accuccugagaaa

SEQ ID NO: 1275123 - RNA, 15 nt, Human
accuccccagcauuc

SEQ ID NO: 1275124 - RNA, 21 nt, Human
accuccccagcauuccagccc

SEQ ID NO: 1275125 - RNA, 23 nt, Human
accuccccagcauuccagccccu

SEQ ID NO: 1275126 - RNA, 17 nt, Human
accuccagcuuuccugu

SEQ ID NO: 1275127 - RNA, 14 nt, Human
accuccacauccuc

SEQ ID NO: 1275128 - RNA, 16 nt, Human
accuccacauccucca

SEQ ID NO: 1275129 - RNA, 15 nt, Human
accuccaccuccugg

SEQ ID NO: 1275130 - RNA, 17 nt, Human
accuccaccuccugggu

SEQ ID NO: 1275131 - RNA, 13 nt, Human
accuccagcuguu

SEQ ID NO: 1275132 - RNA, 16 nt, Human
accuccagcuuuccug

SEQ ID NO: 1275133 - RNA, 18 nt, Human
accuccagcuuuccugua

SEQ ID NO: 1275134 - RNA, 23 nt, Human
ucaugcaaacuuuauuuuguguu

SEQ ID NO: 1275135 - RNA, 14 nt, Human
ucaugcaaacucuu

SEQ ID NO: 1275136 - RNA, 20 nt, Human
ucaugcacaguauuuguaau

SEQ ID NO: 1275137 - RNA, 17 nt, Human
ucaugcacaguauuugu

SEQ ID NO: 1275138 - RNA, 12 nt, Human
ucaugcagcugu

SEQ ID NO: 1275139 - RNA, 14 nt, Human
ucaugcagcugugg

SEQ ID NO: 1275140 - RNA, 17 nt, Human
ucaugugaaaucauuca

SEQ ID NO: 1275141 - RNA, 14 nt, Human
ucaugcauggaaau

SEQ ID NO: 1275142 - RNA, 17 nt, Human
ucaugugaccacucugu

SEQ ID NO: 1275143 - RNA, 14 nt, Human
ucaugugacucuuu

SEQ ID NO: 1275144 - RNA, 17 nt, Human
ucaugugacucuuucca

SEQ ID NO: 1275145 - RNA, 15 nt, Human
ucauguguauaaaaa

SEQ ID NO: 1275146 - RNA, 13 nt, Human
ucaugugucccag

SEQ ID NO: 1275147 - RNA, 14 nt, Human
ucaugugucccaga

SEQ ID NO: 1275148 - RNA, 18 nt, Human
ucaugugacucuuuccaa

SEQ ID NO: 1275149 - RNA, 19 nt, Human
ucaugugacucuuuccaac

SEQ ID NO: 1275150 - RNA, 21 nt, Human
ucaugugcauuauuuuccaga

SEQ ID NO: 1275151 - RNA, 13 nt, Human
ucauguggcugga

SEQ ID NO: 1275152 - RNA, 16 nt, Human
ucauguggcuggaaga

SEQ ID NO: 1275153 - RNA, 21 nt, Human
ucauguggcuggaagauccug

SEQ ID NO: 1275154 - RNA, 20 nt, Human
ucauguguacaaaaguuuca

SEQ ID NO: 1275155 - RNA, 10 nt, Human
ucauguguau

SEQ ID NO: 1275156 - RNA, 14 nt, Human
ucauguguauaaaa

SEQ ID NO: 1275157 - RNA, 14 nt, Human
ucaugcaaacuuua

SEQ ID NO: 1275158 - RNA, 11 nt, Human
ucaugauuuuu

SEQ ID NO: 1275159 - RNA, 21 nt, Human
ucaugauuuugaaaucaugaa

SEQ ID NO: 1275160 - RNA, 13 nt, Human
ucaugcaaacucu

SEQ ID NO: 1275161 - RNA, 19 nt, Human
ucaugaagauauuuuucca

SEQ ID NO: 1275162 - RNA, 17 nt, Human
ucaugauuucauuucaa

SEQ ID NO: 1275163 - RNA, 23 nt, Human
ucaugauuucauuucaacuguuu

SEQ ID NO: 1275164 - RNA, 22 nt, Human
ucaugauuuuaaguuucucugc

SEQ ID NO: 1275165 - RNA, 14 nt, Human
ucaugauuuugaaa

SEQ ID NO: 1275166 - RNA, 14 nt, Human
ucaucuaggauuuu

SEQ ID NO: 1275167 - RNA, 14 nt, Human
ucaucuaccuagau

SEQ ID NO: 1275168 - RNA, 20 nt, Human
ucaucuaccauuuucugguu

SEQ ID NO: 1275169 - RNA, 22 nt, Human
ucaucuaccauuuucugguucu

SEQ ID NO: 1275170 - RNA, 20 nt, Human
ucaucuaccuagauuuaaua

SEQ ID NO: 1275171 - RNA, 16 nt, Human
ucaugaaagauucaau

SEQ ID NO: 1275172 - RNA, 17 nt, Human
ucaugaaagauucaaug

SEQ ID NO: 1275173 - RNA, 11 nt, Human
ucaugaaccuc

SEQ ID NO: 1275174 - RNA, 22 nt, Human
ucaugaaccucaagcugcaucu

SEQ ID NO: 1275175 - RNA, 13 nt, Human
ucaucuaggauuu

SEQ ID NO: 1275176 - RNA, 16 nt, Human
ucaucuaaaagaaaaa

SEQ ID NO: 1275177 - RNA, 15 nt, Human
ucauccauaacugaa

SEQ ID NO: 1275178 - RNA, 12 nt, Human
ucaucccacucc

SEQ ID NO: 1275179 - RNA, 14 nt, Human
ucaucgaaucuacu

SEQ ID NO: 1275180 - RNA, 21 nt, Human
ucaucgaaucuacuaauucca

SEQ ID NO: 1275181 - RNA, 11 nt, Human
ucauccaucau

SEQ ID NO: 1275182 - RNA, 12 nt, Human
ucauccaucauc

SEQ ID NO: 1275183 - RNA, 14 nt, Human
ucauccaucaucau

SEQ ID NO: 1275184 - RNA, 13 nt, Human
ucauccauccagg

SEQ ID NO: 1275185 - RNA, 15 nt, Human
ucauccaucaucaug

SEQ ID NO: 1275186 - RNA, 16 nt, Human
ucauccaucaucaugu

SEQ ID NO: 1275187 - RNA, 17 nt, Human
ucauccaucaucaugug

SEQ ID NO: 1275188 - RNA, 14 nt, Human
ucauccauucuauu

SEQ ID NO: 1275189 - RNA, 19 nt, Human
ucauccauucuauuguuaa

SEQ ID NO: 1275190 - RNA, 23 nt, Human
ucaucccaaaggacagccgccug

SEQ ID NO: 1275191 - RNA, 15 nt, Human
ucaguuuuugugaaa

SEQ ID NO: 1275192 - RNA, 20 nt, Human
ucaguggggcccauggaugu

SEQ ID NO: 1275193 - RNA, 14 nt, Human
ucaguggggcaguc

SEQ ID NO: 1275194 - RNA, 16 nt, Human
ucaguuuuaucauuuu

SEQ ID NO: 1275195 - RNA, 17 nt, Human
ucaguuuuaucauuuuc

SEQ ID NO: 1275196 - RNA, 19 nt, Human
ucaguuuuaucauuuucaa

SEQ ID NO: 1275197 - RNA, 17 nt, Human
ucaguuuuugugaaaag

SEQ ID NO: 1275198 - RNA, 20 nt, Human
ucaguuuuccucucaauaaa

SEQ ID NO: 1275199 - RNA, 12 nt, Human
ucaguuuucauu

SEQ ID NO: 1275200 - RNA, 13 nt, Human
ucaguuuucauuu

SEQ ID NO: 1275201 - RNA, 16 nt, Human
ucaguggggaggggcu

SEQ ID NO: 1275202 - RNA, 20 nt, Human
ucagugcccuccaggauaga

SEQ ID NO: 1275203 - RNA, 13 nt, Human
ucaguaugaauua

SEQ ID NO: 1275204 - RNA, 17 nt, Human
ucaguaugaauuauuca

SEQ ID NO: 1275205 - RNA, 14 nt, Human
accgcagaaggaag

SEQ ID NO: 1275206 - RNA, 13 nt, Human
accgcagaaggaa

SEQ ID NO: 1275207 - RNA, 12 nt, Human
accgcagaagga

SEQ ID NO: 1275208 - RNA, 17 nt, Human
accgagucucuucucca

SEQ ID NO: 1275209 - RNA, 18 nt, Human
accgagucucuucuccac

SEQ ID NO: 1275210 - RNA, 16 nt, Human
accgagucucuucucc

SEQ ID NO: 1275211 - RNA, 15 nt, Human
ucauauuuucaugcu

SEQ ID NO: 1275212 - RNA, 13 nt, Human
accgaggcaggga

SEQ ID NO: 1275213 - RNA, 15 nt, Human
ucauauuuucuuuca

SEQ ID NO: 1275214 - RNA, 18 nt, Human
ucauauuuucuuucaaaa

SEQ ID NO: 1275215 - RNA, 21 nt, Human
ucauauuucccaugauuucau

SEQ ID NO: 1275216 - RNA, 19 nt, Human
ucauauuucccaugauuuc

SEQ ID NO: 1275217 - RNA, 13 nt, Human
ucauauuucccau

SEQ ID NO: 1275218 - RNA, 22 nt, Human
ucauauuucccaugauuucaug

SEQ ID NO: 1275219 - RNA, 20 nt, Human
ucauauuuuaaacagaggau

SEQ ID NO: 1275220 - RNA, 21 nt, Human
ucauauugugauucugccuuu

SEQ ID NO: 1275221 - RNA, 13 nt, Human
ucauaugcauauu

SEQ ID NO: 1275222 - RNA, 21 nt, Human
ucauauguaccauguacauga

SEQ ID NO: 1275223 - RNA, 22 nt, Human
ucauauguaccauguacaugaa

SEQ ID NO: 1275224 - RNA, 13 nt, Human
ucauaucauccac

SEQ ID NO: 1275225 - RNA, 16 nt, Human
ucauaucauccacaca

SEQ ID NO: 1275226 - RNA, 14 nt, Human
ucauaucauccaca

SEQ ID NO: 1275227 - RNA, 22 nt, Human
ucauauaaauagaauguaaaug

SEQ ID NO: 1275228 - RNA, 15 nt, Human
ucauauaauaaaugu

SEQ ID NO: 1275229 - RNA, 21 nt, Human
ucauauaaauagaauguaaau

SEQ ID NO: 1275230 - RNA, 18 nt, Human
ucauauaaauagaaugua

SEQ ID NO: 1275231 - RNA, 16 nt, Human
ucauauaaauagaaug

SEQ ID NO: 1275232 - RNA, 14 nt, Human
ucauauaaauagaa

SEQ ID NO: 1275233 - RNA, 16 nt, Human
ucauauaauaaaugua

SEQ ID NO: 1275234 - RNA, 16 nt, Human
ucauauaauuauaugu

SEQ ID NO: 1275235 - RNA, 20 nt, Human
ucauauaguuagcuaauaaa

SEQ ID NO: 1275236 - RNA, 14 nt, Human
ucauauauauacau

SEQ ID NO: 1275237 - RNA, 22 nt, Human
ucauauauaucacccagacaua

SEQ ID NO: 1275238 - RNA, 17 nt, Human
ucauauauaucacccag

SEQ ID NO: 1275239 - RNA, 13 nt, Human
ucauaguucagaa

SEQ ID NO: 1275240 - RNA, 13 nt, Human
ucauauaaauaga

SEQ ID NO: 1275241 - RNA, 18 nt, Human
ucauauaaaguaucauca

SEQ ID NO: 1275242 - RNA, 13 nt, Human
ucauauaaaguau

SEQ ID NO: 1275243 - RNA, 16 nt, Human
ucauauaaaguaucau

SEQ ID NO: 1275244 - RNA, 14 nt, Human
ucauaguucagaau

SEQ ID NO: 1275245 - RNA, 16 nt, Human
ucauaguucagaauuu

SEQ ID NO: 1275246 - RNA, 18 nt, Human
ucauaguucagaauuuag

SEQ ID NO: 1275247 - RNA, 13 nt, Human
ucauaguuuaauu

SEQ ID NO: 1275248 - RNA, 20 nt, Human
uaacgauaaaagacagugaa

SEQ ID NO: 1275249 - RNA, 16 nt, Human
uaaccuuaauuuauua

SEQ ID NO: 1275250 - RNA, 21 nt, Human
uaaccuuaccagauuuuuaca

SEQ ID NO: 1275251 - RNA, 16 nt, Human
uaaccuugccugguac

SEQ ID NO: 1275252 - RNA, 19 nt, Human
uaaccuugccugguacagu

SEQ ID NO: 1275253 - RNA, 21 nt, Human
uaaccuugccugguacaguau

SEQ ID NO: 1275254 - RNA, 14 nt, Human
uaaccuuuacauga

SEQ ID NO: 1275255 - RNA, 16 nt, Human
uaacuacuuuauaacu

SEQ ID NO: 1275256 - RNA, 17 nt, Human
uaacuacuuuauaacua

SEQ ID NO: 1275257 - RNA, 23 nt, Human
uaacuacuuuauaacuaacaugu

SEQ ID NO: 1275258 - RNA, 14 nt, Human
uaacuuaaauagua

SEQ ID NO: 1275259 - RNA, 16 nt, Human
uaacuuaaauaguauu

SEQ ID NO: 1275260 - RNA, 17 nt, Human
uaacuuaaauaguauuu

SEQ ID NO: 1275261 - RNA, 17 nt, Human
uaacuagacaccaaagu

SEQ ID NO: 1275262 - RNA, 18 nt, Human
uaacuagacaccaaaguu

SEQ ID NO: 1275263 - RNA, 20 nt, Human
uaacuagacaccaaaguucu

SEQ ID NO: 1275264 - RNA, 21 nt, Human
uaacuagacaccaaaguucua

SEQ ID NO: 1275265 - RNA, 22 nt, Human
uaacuagacaccaaaguucuaa

SEQ ID NO: 1275266 - RNA, 15 nt, Human
uaacuuucucuauga

SEQ ID NO: 1275267 - RNA, 23 nt, Human
uaacuucuuauggaauugauuug

SEQ ID NO: 1275268 - RNA, 12 nt, Human
uaacuucuugcu

SEQ ID NO: 1275269 - RNA, 13 nt, Human
uaacuucuugcuu

SEQ ID NO: 1275270 - RNA, 15 nt, Human
uaacuucuugcuucu

SEQ ID NO: 1275271 - RNA, 19 nt, Human
uaacuucuugcuucuuucu

SEQ ID NO: 1275272 - RNA, 20 nt, Human
uaacuucuugcuucuuucua

SEQ ID NO: 1275273 - RNA, 19 nt, Human
uaacuugauccauuucuaa

SEQ ID NO: 1275274 - RNA, 20 nt, Human
uaacuugauccauuucuaau

SEQ ID NO: 1275275 - RNA, 22 nt, Human
uaacuugauccauuucuaauua

SEQ ID NO: 1275276 - RNA, 16 nt, Human
uaagacaugauuuccu

SEQ ID NO: 1275277 - RNA, 19 nt, Human
uaagaauaucuguaauggu

SEQ ID NO: 1275278 - RNA, 20 nt, Human
uaagacacugaaaaaucuaa

SEQ ID NO: 1275279 - RNA, 23 nt, Human
uaagacacugaaaaaucuaagug

SEQ ID NO: 1275280 - RNA, 15 nt, Human
uaagaauaaacauuu

SEQ ID NO: 1275281 - RNA, 13 nt, Human
uaacuuucugggu

SEQ ID NO: 1275282 - RNA, 15 nt, Human
uaagaaguuuuaaaa

SEQ ID NO: 1275283 - RNA, 21 nt, Human
uaagaaguuuuaaaaagccag

SEQ ID NO: 1275284 - RNA, 18 nt, Human
aauauauuuuaagacgaa

SEQ ID NO: 1275285 - RNA, 22 nt, Human
aauaucacuugucaauaaaauc

SEQ ID NO: 1275286 - RNA, 17 nt, Human
uaacaguggacaaaguu

SEQ ID NO: 1275287 - RNA, 14 nt, Human
uaacaguguuuaaa

SEQ ID NO: 1275288 - RNA, 17 nt, Human
uaacaguuccuuucaaa

SEQ ID NO: 1275289 - RNA, 18 nt, Human
uaacaguuguauuuaaca

SEQ ID NO: 1275290 - RNA, 19 nt, Human
uaacaguuguauuuaacag

SEQ ID NO: 1275291 - RNA, 23 nt, Human
uaacaguuguauuuaacagaaau

SEQ ID NO: 1275292 - RNA, 14 nt, Human
uaacauauaauguu

SEQ ID NO: 1275293 - RNA, 23 nt, Human
uaacauauaauguuguuauuuaa

SEQ ID NO: 1275294 - RNA, 14 nt, Human
uaacaucuaaaaau

SEQ ID NO: 1275295 - RNA, 20 nt, Human
uaacaucuaaaaauagacuu

SEQ ID NO: 1275296 - RNA, 13 nt, Human
uaacaucugagaa

SEQ ID NO: 1275297 - RNA, 14 nt, Human
uaacaugaauauuu

SEQ ID NO: 1275298 - RNA, 15 nt, Human
uaacaugaagaccuu

SEQ ID NO: 1275299 - RNA, 16 nt, Human
aauagucaaauugugu

SEQ ID NO: 1275300 - RNA, 14 nt, Human
uaaaauuuauauug

SEQ ID NO: 1275301 - RNA, 17 nt, Human
uaaaauuuauauuguaa

SEQ ID NO: 1275302 - RNA, 16 nt, Human
uaaaauuuauauugua

SEQ ID NO: 1275303 - RNA, 19 nt, Human
aauagucaaauugugugaa

SEQ ID NO: 1275304 - RNA, 23 nt, Human
aauagugucauccucacagugaa

SEQ ID NO: 1275305 - RNA, 13 nt, Human
uaaaauuuguucu

SEQ ID NO: 1275306 - RNA, 15 nt, Human
aauauauuuuaagac

SEQ ID NO: 1275307 - RNA, 14 nt, Human
aauauauuuuaaga

SEQ ID NO: 1275308 - RNA, 14 nt, Human
aauaguuguugauu

SEQ ID NO: 1275309 - RNA, 11 nt, Human
aauaguuccug

SEQ ID NO: 1275310 - RNA, 13 nt, Human
aauaguuccugcu

SEQ ID NO: 1275311 - RNA, 12 nt, Human
aauauuuagugu

SEQ ID NO: 1275312 - RNA, 18 nt, Human
aauauuuauuuuaauaau

SEQ ID NO: 1275313 - RNA, 19 nt, Human
aauauuuauuuuaauaaug

SEQ ID NO: 1275314 - RNA, 14 nt, Human
aauauuucagauaa

SEQ ID NO: 1275315 - RNA, 14 nt, Human
aauauugacuugua

SEQ ID NO: 1275316 - RNA, 17 nt, Human
aauauugacuuguauau

SEQ ID NO: 1275317 - RNA, 13 nt, Human
aauauuguccauu

SEQ ID NO: 1275318 - RNA, 9 nt, Human
aauauugug

SEQ ID NO: 1275319 - RNA, 12 nt, Human
aauauuuaagac

SEQ ID NO: 1275320 - RNA, 21 nt, Human
aauaugccccauucaacaucu

SEQ ID NO: 1275321 - RNA, 24 nt, Human
aauaugccccauucaacaucuagu

SEQ ID NO: 1275322 - RNA, 21 nt, Human
aauaugccugcuauuugaagu

SEQ ID NO: 1275323 - RNA, 17 nt, Human
aauaugccuuuuugaag

SEQ ID NO: 1275324 - RNA, 15 nt, Human
aauauuccugcauuu

SEQ ID NO: 1275325 - RNA, 18 nt, Human
aauauucauaguuuaauu

SEQ ID NO: 1275326 - RNA, 15 nt, Human
aauauucccuagaaa

SEQ ID NO: 1275327 - RNA, 17 nt, Human
aauauucccuagaaacu

SEQ ID NO: 1275328 - RNA, 13 nt, Human
uaagacuuuacuu

SEQ ID NO: 1275329 - RNA, 12 nt, Human
uaagagaaguag

SEQ ID NO: 1275330 - RNA, 14 nt, Human
uaagagaaguagaa

SEQ ID NO: 1275331 - RNA, 18 nt, Human
uaagagaaguagaaauca

SEQ ID NO: 1275332 - RNA, 20 nt, Human
uaagagaaguagaaaucaua

SEQ ID NO: 1275333 - RNA, 17 nt, Human
uaagacaugauuuccuu

SEQ ID NO: 1275334 - RNA, 19 nt, Human
uaagacaugauuuccuuga

SEQ ID NO: 1275335 - RNA, 20 nt, Human
uaagacuuacucuaagaucu

SEQ ID NO: 1275336 - RNA, 14 nt, Human
uaagacuugacagu

SEQ ID NO: 1275337 - RNA, 17 nt, Human
uaagacuugacagugga

SEQ ID NO: 1275338 - RNA, 15 nt, Human
uaagagaaguuguaa

SEQ ID NO: 1275339 - RNA, 22 nt, Human
aaucaggguuaguauuguccag

SEQ ID NO: 1275340 - RNA, 18 nt, Human
aauauuuuuucuuuucua

SEQ ID NO: 1275341 - RNA, 14 nt, Human
uaagauuccagaga

SEQ ID NO: 1275342 - RNA, 22 nt, Human
uaagaugugauauucuaagacu

SEQ ID NO: 1275343 - RNA, 23 nt, Human
uaagaugugauauucuaagacuu

SEQ ID NO: 1275344 - RNA, 21 nt, Human
uaagaugugcagcauuucacu

SEQ ID NO: 1275345 - RNA, 14 nt, Human
uaagaugugauauu

SEQ ID NO: 1275346 - RNA, 18 nt, Human
uaagaugugauauucuaa

SEQ ID NO: 1275347 - RNA, 19 nt, Human
uaagaugugauauucuaag

SEQ ID NO: 1275348 - RNA, 20 nt, Human
uaagaugugauauucuaaga

SEQ ID NO: 1275349 - RNA, 21 nt, Human
uaagaugugauauucuaagac

SEQ ID NO: 1275350 - RNA, 21 nt, Human
uaagauuccagagaguggcuc

SEQ ID NO: 1275351 - RNA, 10 nt, Human
uaagauucua

SEQ ID NO: 1275352 - RNA, 11 nt, Human
uaagauucuaa

SEQ ID NO: 1275353 - RNA, 12 nt, Human
uaagauucuaaa

SEQ ID NO: 1275354 - RNA, 13 nt, Human
uaagauucuaaag

SEQ ID NO: 1275355 - RNA, 14 nt, Human
uaagauucuaaagg

SEQ ID NO: 1275356 - RNA, 16 nt, Human
uaagauucuaaagguc

SEQ ID NO: 1275357 - RNA, 17 nt, Human
uaagauucuaaaggucc

SEQ ID NO: 1275358 - RNA, 12 nt, Human
uaagauucuaac

SEQ ID NO: 1275359 - RNA, 13 nt, Human
uaagauucuaacg

SEQ ID NO: 1275360 - RNA, 17 nt, Human
uaagauucuaacggucu

SEQ ID NO: 1275361 - RNA, 12 nt, Human
uaagauucuaau

SEQ ID NO: 1275362 - RNA, 21 nt, Human
aaucaggguuaguauugucca

SEQ ID NO: 1275363 - RNA, 17 nt, Human
aauauuuuuaauauaua

SEQ ID NO: 1275364 - RNA, 14 nt, Human
aauauuuuuagaua

SEQ ID NO: 1275365 - RNA, 13 nt, Human
aauauuuuucuua

SEQ ID NO: 1275366 - RNA, 12 nt, Human
aauauuuguaca

SEQ ID NO: 1275367 - RNA, 14 nt, Human
aauauuuguacaua

SEQ ID NO: 1275368 - RNA, 17 nt, Human
aauauuugugacaaaaa

SEQ ID NO: 1275369 - RNA, 11 nt, Human
aauauuuuaaa

SEQ ID NO: 1275370 - RNA, 16 nt, Human
aauauuuuaaaaucag

SEQ ID NO: 1275371 - RNA, 13 nt, Human
aauauuuuaaaga

SEQ ID NO: 1275372 - RNA, 15 nt, Human
aauauuuuaaagaau

SEQ ID NO: 1275373 - RNA, 16 nt, Human
aauauuuuaaagaauu

SEQ ID NO: 1275374 - RNA, 20 nt, Human
aauauuuugcuaguuuuuga

SEQ ID NO: 1275375 - RNA, 16 nt, Human
uaagcuggagugcagu

SEQ ID NO: 1275376 - RNA, 14 nt, Human
uaagcaagaaggca

SEQ ID NO: 1275377 - RNA, 17 nt, Human
uaagcaacauggcuuug

SEQ ID NO: 1275378 - RNA, 22 nt, Human
uaagcaccuguaaugugcgagg

SEQ ID NO: 1275379 - RNA, 13 nt, Human
uaagcagaaagug

SEQ ID NO: 1275380 - RNA, 15 nt, Human
uaagcagaaagugcc

SEQ ID NO: 1275381 - RNA, 16 nt, Human
uaagcagaaagugccu

SEQ ID NO: 1275382 - RNA, 19 nt, Human
uaagcagaaagugccuuuc

SEQ ID NO: 1275383 - RNA, 21 nt, Human
uaagcagaaagugccuuucag

SEQ ID NO: 1275384 - RNA, 22 nt, Human
uaagcagaaagugccuuucagg

SEQ ID NO: 1275385 - RNA, 17 nt, Human
uaagcagaccacugaua

SEQ ID NO: 1275386 - RNA, 20 nt, Human
uaagcagaccacugauaaaa

SEQ ID NO: 1275387 - RNA, 23 nt, Human
uaagcaaaaacaaaaagaaaaga

SEQ ID NO: 1275388 - RNA, 14 nt, Human
uaagcaacauggcu

SEQ ID NO: 1275389 - RNA, 16 nt, Human
uaagcaacauggcuuu

SEQ ID NO: 1275390 - RNA, 13 nt, Human
uaagauucuaaug

SEQ ID NO: 1275391 - RNA, 14 nt, Human
uaagauucuaauga

SEQ ID NO: 1275392 - RNA, 15 nt, Human
uaagauucuaaugau

SEQ ID NO: 1275393 - RNA, 11 nt, Human
uaagauucuag

SEQ ID NO: 1275394 - RNA, 12 nt, Human
uaagauucuaga

SEQ ID NO: 1275395 - RNA, 13 nt, Human
uaagauucuagau

SEQ ID NO: 1275396 - RNA, 14 nt, Human
uaagauucuagauc

SEQ ID NO: 1275397 - RNA, 21 nt, Human
uaagauucuagaucagaugcu

SEQ ID NO: 1275398 - RNA, 17 nt, Human
uaagauucugauuuuag

SEQ ID NO: 1275399 - RNA, 13 nt, Human
uaagauucugauu

SEQ ID NO: 1275400 - RNA, 14 nt, Human
uaagauucugauuu

SEQ ID NO: 1275401 - RNA, 15 nt, Human
uaagauuuccuucuu

SEQ ID NO: 1275402 - RNA, 16 nt, Human
uaagauuuccuucuuu

SEQ ID NO: 1275403 - RNA, 12 nt, Human
uaagauuuguuu

SEQ ID NO: 1275404 - RNA, 15 nt, Human
uaagauuuguuuuua

SEQ ID NO: 1275405 - RNA, 18 nt, Human
uaagauuuguuuuuaaac

SEQ ID NO: 1275406 - RNA, 19 nt, Human
uaagauuuguuuuuaaacu

SEQ ID NO: 1275407 - RNA, 20 nt, Human
uaagauuuguuuuuaaacug

SEQ ID NO: 1275408 - RNA, 22 nt, Human
uaagauuuguuuuuaaacugua

SEQ ID NO: 1275409 - RNA, 23 nt, Human
uaagauuuguuuuuaaacuguac

SEQ ID NO: 1275410 - RNA, 16 nt, Human
aaucuuuaauuuuaca

SEQ ID NO: 1275411 - RNA, 15 nt, Human
aaucuuuaauuuuac

SEQ ID NO: 1275412 - RNA, 15 nt, Human
aaucuuuaaaccaau

SEQ ID NO: 1275413 - RNA, 23 nt, Human
aaucuuuaaaccaauugcugcua

SEQ ID NO: 1275414 - RNA, 21 nt, Human
aaucuuuagagaaguauacau

SEQ ID NO: 1275415 - RNA, 22 nt, Human
aaucuuuagagaaguauacaua

SEQ ID NO: 1275416 - RNA, 16 nt, Human
aaucuuuauaaaugua

SEQ ID NO: 1275417 - RNA, 15 nt, Human
uaaugucuugagcuc

SEQ ID NO: 1275418 - RNA, 21 nt, Human
uaaugugaaaaugguccagga

SEQ ID NO: 1275419 - RNA, 13 nt, Human
uaaugucuugagc

SEQ ID NO: 1275420 - RNA, 17 nt, Human
uaauguguaguucaugu

SEQ ID NO: 1275421 - RNA, 18 nt, Human
uaauguguaguucaugua

SEQ ID NO: 1275422 - RNA, 19 nt, Human
uaauguguaguucauguaa

SEQ ID NO: 1275423 - RNA, 20 nt, Human
uaauguguaguucauguaaa

SEQ ID NO: 1275424 - RNA, 22 nt, Human
uaauguguaguucauguaaaua

SEQ ID NO: 1275425 - RNA, 19 nt, Human
uaauguguauuacaaauau

SEQ ID NO: 1275426 - RNA, 13 nt, Human
uaauguuaauauu

SEQ ID NO: 1275427 - RNA, 17 nt, Human
uaauguuaauauugauu

SEQ ID NO: 1275428 - RNA, 16 nt, Human
uaauguuaauauugau

SEQ ID NO: 1275429 - RNA, 13 nt, Human
uaauguaucaaac

SEQ ID NO: 1275430 - RNA, 19 nt, Human
uaauguaucaaauacauuu

SEQ ID NO: 1275431 - RNA, 16 nt, Human
uaauguauguuaccaa

SEQ ID NO: 1275432 - RNA, 15 nt, Human
uaaugaaugcauaaa

SEQ ID NO: 1275433 - RNA, 23 nt, Human
uaaugaaugcuuaaagaauucaa

SEQ ID NO: 1275434 - RNA, 19 nt, Human
uaauguacauagugcuaac

SEQ ID NO: 1275435 - RNA, 13 nt, Human
uaauguacauagu

SEQ ID NO: 1275436 - RNA, 20 nt, Human
uaaugaaugcuuaaagaauu

SEQ ID NO: 1275437 - RNA, 18 nt, Human
uaaugaaugcuuaaagaa

SEQ ID NO: 1275438 - RNA, 13 nt, Human
uaaugaaugcuua

SEQ ID NO: 1275439 - RNA, 17 nt, Human
uaauguauguuaccaaa

SEQ ID NO: 1275440 - RNA, 14 nt, Human
aaugaaugcuuaaa

SEQ ID NO: 1275441 - RNA, 21 nt, Human
aaugaauggaggaacuuucca

SEQ ID NO: 1275442 - RNA, 22 nt, Human
aaugaauggcuaagcaaaaugu

SEQ ID NO: 1275443 - RNA, 20 nt, Human
aaugaaacuagaaagcagag

SEQ ID NO: 1275444 - RNA, 17 nt, Human
aaugaaugcauaaaaug

SEQ ID NO: 1275445 - RNA, 23 nt, Human
aaugaauguuuacacucuuugua

SEQ ID NO: 1275446 - RNA, 17 nt, Human
aaugaauuaaauaaacc

SEQ ID NO: 1275447 - RNA, 23 nt, Human
aaugaauuuagugagcauaggug

SEQ ID NO: 1275448 - RNA, 16 nt, Human
aaugacaaucaugugu

SEQ ID NO: 1275449 - RNA, 16 nt, Human
aaugaaaaugucuugu

SEQ ID NO: 1275450 - RNA, 23 nt, Human
aaugaaacaaagaguucaagaaa

SEQ ID NO: 1275451 - RNA, 16 nt, Human
aaugaaacaaagaguu

SEQ ID NO: 1275452 - RNA, 12 nt, Human
uaauccaguaaa

SEQ ID NO: 1275453 - RNA, 22 nt, Human
uaauccaggcagauccaggacu

SEQ ID NO: 1275454 - RNA, 23 nt, Human
uaauccaggcagauccaggacua

SEQ ID NO: 1275455 - RNA, 21 nt, Human
uaaucccagcaugcugagauu

SEQ ID NO: 1275456 - RNA, 17 nt, Human
uaauccaggcagaucca

SEQ ID NO: 1275457 - RNA, 18 nt, Human
uaauccaggcagauccag

SEQ ID NO: 1275458 - RNA, 19 nt, Human
uaauccaggcagauccagg

SEQ ID NO: 1275459 - RNA, 22 nt, Human
uaauauuuuccuccugagugcu

SEQ ID NO: 1275460 - RNA, 20 nt, Human
uaauauuuuccuccugagug

SEQ ID NO: 1275461 - RNA, 21 nt, Human
uaauauuuuccuccugagugc

SEQ ID NO: 1275462 - RNA, 17 nt, Human
uaaucaaaagcuauuua

SEQ ID NO: 1275463 - RNA, 23 nt, Human
uaaucaaauuuguaggguuucua

SEQ ID NO: 1275464 - RNA, 18 nt, Human
uaaucacgcuuuccugaa

SEQ ID NO: 1275465 - RNA, 20 nt, Human
uaaucacucuaauuaauugu

SEQ ID NO: 1275466 - RNA, 20 nt, Human
uaaugaauaccuuagugcag

SEQ ID NO: 1275467 - RNA, 18 nt, Human
uaaugaauaccuuagugc

SEQ ID NO: 1275468 - RNA, 13 nt, Human
uaaugaauaccuu

SEQ ID NO: 1275469 - RNA, 12 nt, Human
uaaugaauaccu

SEQ ID NO: 1275470 - RNA, 13 nt, Human
uaaugaaacaaag

SEQ ID NO: 1275471 - RNA, 21 nt, Human
uaaugaaaacagaaugucucu

SEQ ID NO: 1275472 - RNA, 16 nt, Human
uaaugaaacaaagagu

SEQ ID NO: 1275473 - RNA, 18 nt, Human
aaucuuaguguaugauua

SEQ ID NO: 1275474 - RNA, 21 nt, Human
aaucuuaguguaugauuacug

SEQ ID NO: 1275475 - RNA, 23 nt, Human
aaucuuaguguaugauuacuggc

SEQ ID NO: 1275476 - RNA, 14 nt, Human
aaucuuauaguucu

SEQ ID NO: 1275477 - RNA, 15 nt, Human
aaucuuauaguucua

SEQ ID NO: 1275478 - RNA, 18 nt, Human
aaucuuauaguucuaggc

SEQ ID NO: 1275479 - RNA, 19 nt, Human
aaucuuauaguucuaggca

SEQ ID NO: 1275480 - RNA, 14 nt, Human
uaauagauguuuga

SEQ ID NO: 1275481 - RNA, 16 nt, Human
uaauagauguuugaua

SEQ ID NO: 1275482 - RNA, 21 nt, Human
uaauagauguuugauagauuu

SEQ ID NO: 1275483 - RNA, 22 nt, Human
uaauagauguuugauagauuuu

SEQ ID NO: 1275484 - RNA, 12 nt, Human
uaauagauucuc

SEQ ID NO: 1275485 - RNA, 15 nt, Human
uaauagcaaagaauu

SEQ ID NO: 1275486 - RNA, 13 nt, Human
uaauagcaaagaa

SEQ ID NO: 1275487 - RNA, 14 nt, Human
uaauagcagccuuu

SEQ ID NO: 1275488 - RNA, 15 nt, Human
uaauagcagccuuuc

SEQ ID NO: 1275489 - RNA, 21 nt, Human
uaauagcagccuuucucucuu

SEQ ID NO: 1275490 - RNA, 18 nt, Human
uaauaaacacucuugaaa

SEQ ID NO: 1275491 - RNA, 12 nt, Human
uaauaaacacuc

SEQ ID NO: 1275492 - RNA, 15 nt, Human
uaauaaaauucaaca

SEQ ID NO: 1275493 - RNA, 13 nt, Human
uaauaaacauucu

SEQ ID NO: 1275494 - RNA, 13 nt, Human
uaauaaacuaaua

SEQ ID NO: 1275495 - RNA, 20 nt, Human
uaauaaacuaauaauugcag

SEQ ID NO: 1275496 - RNA, 20 nt, Human
uaaguugagauaguuuucau

SEQ ID NO: 1275497 - RNA, 21 nt, Human
uaaguugagauaguuuucauc

SEQ ID NO: 1275498 - RNA, 22 nt, Human
uaaguugagauaguuuucaucc

SEQ ID NO: 1275499 - RNA, 13 nt, Human
uaaguugggcuug

SEQ ID NO: 1275500 - RNA, 16 nt, Human
uaaguugggcuugcua

SEQ ID NO: 1275501 - RNA, 18 nt, Human
uaaguugggcuugcuauu

SEQ ID NO: 1275502 - RNA, 19 nt, Human
uaaguugggcuugcuauuc

SEQ ID NO: 1275503 - RNA, 22 nt, Human
uaaguugggcuugcuauucugu

SEQ ID NO: 1275504 - RNA, 12 nt, Human
aaucaugaauua

SEQ ID NO: 1275505 - RNA, 15 nt, Human
aaucaugaauuaguu

SEQ ID NO: 1275506 - RNA, 22 nt, Human
aaucauauaaauagaauguaaa

SEQ ID NO: 1275507 - RNA, 20 nt, Human
aaucaugaagauauuuuucc

SEQ ID NO: 1275508 - RNA, 21 nt, Human
aaucauauaaauagaauguaa

SEQ ID NO: 1275509 - RNA, 20 nt, Human
aaucauauaaauagaaugua

SEQ ID NO: 1275510 - RNA, 18 nt, Human
aaucauauaauaaaugua

SEQ ID NO: 1275511 - RNA, 21 nt, Human
aaucauauaauaaauguacau

SEQ ID NO: 1275512 - RNA, 18 nt, Human
aaucauauaaauagaaug

SEQ ID NO: 1275513 - RNA, 17 nt, Human
aaucauauaaauagaau

SEQ ID NO: 1275514 - RNA, 12 nt, Human
aaucauauaaau

SEQ ID NO: 1275515 - RNA, 19 nt, Human
uaauaaacuaauaauugca

SEQ ID NO: 1275516 - RNA, 20 nt, Human
aaucauagcugguucacacu

SEQ ID NO: 1275517 - RNA, 15 nt, Human
uaagcuuaugcuuaa

SEQ ID NO: 1275518 - RNA, 16 nt, Human
uaagcuuguauuccuu

SEQ ID NO: 1275519 - RNA, 20 nt, Human
uaagcuuuucuuuucuuugu

SEQ ID NO: 1275520 - RNA, 16 nt, Human
uaagcuuuucuuuucu

SEQ ID NO: 1275521 - RNA, 16 nt, Human
uaaguaaauacaauuu

SEQ ID NO: 1275522 - RNA, 14 nt, Human
uaaguaaauacaau

SEQ ID NO: 1275523 - RNA, 19 nt, Human
uaaguaaugauaacuggaa

SEQ ID NO: 1275524 - RNA, 21 nt, Human
uaaguaacuuauuuaugaaag

SEQ ID NO: 1275525 - RNA, 17 nt, Human
uaaguauuaugucucuu

SEQ ID NO: 1275526 - RNA, 21 nt, Human
uaaguauuaugucucuucuga

SEQ ID NO: 1275527 - RNA, 18 nt, Human
aaucugggccagaauuuc

SEQ ID NO: 1275528 - RNA, 16 nt, Human
aaucugugcuguuuca

SEQ ID NO: 1275529 - RNA, 19 nt, Human
aaucugugcuguuucaaag

SEQ ID NO: 1275530 - RNA, 22 nt, Human
aaucugugcuguuucaaaguuc

SEQ ID NO: 1275531 - RNA, 17 nt, Human
aaucugugggucuggga

SEQ ID NO: 1275532 - RNA, 16 nt, Human
aaucugggccagaauu

SEQ ID NO: 1275533 - RNA, 17 nt, Human
aaucugggccagaauuu

SEQ ID NO: 1275534 - RNA, 21 nt, Human
aaucuggcuucuggccaggaa

SEQ ID NO: 1275535 - RNA, 23 nt, Human
aaucuggcuucuggccaggaagc

SEQ ID NO: 1275536 - RNA, 19 nt, Human
aaucuacacuccagugaga

SEQ ID NO: 1275537 - RNA, 16 nt, Human
aaucuacacacggugc

SEQ ID NO: 1275538 - RNA, 19 nt, Human
aaucuuauaauuuaaaaua

SEQ ID NO: 1275539 - RNA, 19 nt, Human
aaucugugggucugggagu

SEQ ID NO: 1275540 - RNA, 23 nt, Human
aaucugugugaaacuuucauucc

SEQ ID NO: 1275541 - RNA, 20 nt, Human
aaucugugugaaacuuucau

SEQ ID NO: 1275542 - RNA, 15 nt, Human
aaucuguuuuucuaa

SEQ ID NO: 1275543 - RNA, 16 nt, Human
aaucuguuuuucuaac

SEQ ID NO: 1275544 - RNA, 19 nt, Human
aaucuuaagguguagccac

SEQ ID NO: 1275545 - RNA, 20 nt, Human
aaucuuaagguguagccaca

SEQ ID NO: 1275546 - RNA, 12 nt, Human
aauccgcccauc

SEQ ID NO: 1275547 - RNA, 18 nt, Human
aaucccuuaacaguugua

SEQ ID NO: 1275548 - RNA, 22 nt, Human
aaucccuuaacaguuguauuua

SEQ ID NO: 1275549 - RNA, 21 nt, Human
aaucccuuaauauccuaaaca

SEQ ID NO: 1275550 - RNA, 11 nt, Human
aaucccuucau

SEQ ID NO: 1275551 - RNA, 18 nt, Human
aaucccuucauacuugaa

SEQ ID NO: 1275552 - RNA, 12 nt, Human
aaucccuucaua

SEQ ID NO: 1275553 - RNA, 20 nt, Human
aauccuguaggaagguacug

SEQ ID NO: 1275554 - RNA, 18 nt, Human
aauccuguaggaagguac

SEQ ID NO: 1275555 - RNA, 22 nt, Human
aauccuguaggaagguacugua

SEQ ID NO: 1275556 - RNA, 19 nt, Human
aauccugucgauuagacug

SEQ ID NO: 1275557 - RNA, 21 nt, Human
aauccugucgauuagacugga

SEQ ID NO: 1275558 - RNA, 13 nt, Human
aauccuuuacugu

SEQ ID NO: 1275559 - RNA, 23 nt, Human
aauccuguaggaagguacuguau

SEQ ID NO: 1275560 - RNA, 15 nt, Human
aaucgaccugccucg

SEQ ID NO: 1275561 - RNA, 13 nt, Human
aauccuuugugaa

SEQ ID NO: 1275562 - RNA, 20 nt, Human
aauccugucgauuagacugg

SEQ ID NO: 1275563 - RNA, 15 nt, Human
aaucuaagugauaua

SEQ ID NO: 1275564 - RNA, 17 nt, Human
aaucuaagugauauaaa

SEQ ID NO: 1275565 - RNA, 19 nt, Human
aauguauacuauaguacca

SEQ ID NO: 1275566 - RNA, 13 nt, Human
aauguauaguaaa

SEQ ID NO: 1275567 - RNA, 13 nt, Human
aauguauaugcac

SEQ ID NO: 1275568 - RNA, 14 nt, Human
aauguauaugcacu

SEQ ID NO: 1275569 - RNA, 22 nt, Human
aauguauuacaguggggaauga

SEQ ID NO: 1275570 - RNA, 17 nt, Human
aauguauguuaccaaaa

SEQ ID NO: 1275571 - RNA, 21 nt, Human
aauguauguuaccaaaaauaa

SEQ ID NO: 1275572 - RNA, 16 nt, Human
aauguaucaaacugua

SEQ ID NO: 1275573 - RNA, 18 nt, Human
aauguaucaaauacauuu

SEQ ID NO: 1275574 - RNA, 13 nt, Human
aauguauguuacc

SEQ ID NO: 1275575 - RNA, 12 nt, Human
aaugugccuauu

SEQ ID NO: 1275576 - RNA, 18 nt, Human
aaugugcuauacugcaua

SEQ ID NO: 1275577 - RNA, 11 nt, Human
aaugugugugu

SEQ ID NO: 1275578 - RNA, 21 nt, Human
aaugugccuauugcuagagcu

SEQ ID NO: 1275579 - RNA, 19 nt, Human
aaugugauguucuaaggcu

SEQ ID NO: 1275580 - RNA, 20 nt, Human
aaugugauuuacgcucauug

SEQ ID NO: 1275581 - RNA, 15 nt, Human
aaugugcaauagaag

SEQ ID NO: 1275582 - RNA, 17 nt, Human
aaugugcaauagaaggu

SEQ ID NO: 1275583 - RNA, 17 nt, Human
aaugugcacuuuauccu

SEQ ID NO: 1275584 - RNA, 15 nt, Human
aaugugauguucuaa

SEQ ID NO: 1275585 - RNA, 16 nt, Human
aaugugauguucuaag

SEQ ID NO: 1275586 - RNA, 17 nt, Human
aaugugauguucuaagg

SEQ ID NO: 1275587 - RNA, 22 nt, Human
aaugugaaaaugguccaggaga

SEQ ID NO: 1275588 - RNA, 20 nt, Human
uacaucccuuaccugggaaa

SEQ ID NO: 1275589 - RNA, 12 nt, Human
uacaucauuucu

SEQ ID NO: 1275590 - RNA, 13 nt, Human
uacaucauuucuu

SEQ ID NO: 1275591 - RNA, 14 nt, Human
uacaucauuucuuu

SEQ ID NO: 1275592 - RNA, 20 nt, Human
uacaucauuucuuuuuggga

SEQ ID NO: 1275593 - RNA, 19 nt, Human
uacauccaaagcagacagc

SEQ ID NO: 1275594 - RNA, 20 nt, Human
uacauccaaagcagacagcu

SEQ ID NO: 1275595 - RNA, 23 nt, Human
uacauccaaagcagacagcucca

SEQ ID NO: 1275596 - RNA, 17 nt, Human
uacauaugaucugucug

SEQ ID NO: 1275597 - RNA, 17 nt, Human
uacagauuuauuccuuu

SEQ ID NO: 1275598 - RNA, 19 nt, Human
uacagauuuauuccuuugu

SEQ ID NO: 1275599 - RNA, 22 nt, Human
uacaggugugugccaccacacc

SEQ ID NO: 1275600 - RNA, 15 nt, Human
uacauaauucacucu

SEQ ID NO: 1275601 - RNA, 17 nt, Human
uacauaauucacucuga

SEQ ID NO: 1275602 - RNA, 16 nt, Human
uacauaauucacucug

SEQ ID NO: 1275603 - RNA, 17 nt, Human
aauuaauuccuucagca

SEQ ID NO: 1275604 - RNA, 12 nt, Human
aauuaauuguaa

SEQ ID NO: 1275605 - RNA, 15 nt, Human
aauuaauuguaaucu

SEQ ID NO: 1275606 - RNA, 23 nt, Human
aauuaauuccuguuugucuacau

SEQ ID NO: 1275607 - RNA, 22 nt, Human
aauuaaucugggccagaauuuc

SEQ ID NO: 1275608 - RNA, 21 nt, Human
aauuaauaucccuacauguau

SEQ ID NO: 1275609 - RNA, 19 nt, Human
aauuaauaucccuacaugu

SEQ ID NO: 1275610 - RNA, 21 nt, Human
aauuaagaaaggauaaaguug

SEQ ID NO: 1275611 - RNA, 22 nt, Human
aauuaacuggguaaugaaacaa

SEQ ID NO: 1275612 - RNA, 15 nt, Human
aauuaagagagucua

SEQ ID NO: 1275613 - RNA, 19 nt, Human
aauuaagaaggcaaaaaug

SEQ ID NO: 1275614 - RNA, 23 nt, Human
aauuaagaaggcaaaaauguaaa

SEQ ID NO: 1275615 - RNA, 13 nt, Human
aauuaagaaggca

SEQ ID NO: 1275616 - RNA, 14 nt, Human
aauuaagaaggcaa

SEQ ID NO: 1275617 - RNA, 16 nt, Human
aauuaagaaggcaaaa

SEQ ID NO: 1275618 - RNA, 20 nt, Human
uacauucuucaagaucccau

SEQ ID NO: 1275619 - RNA, 21 nt, Human
uacauucuucaagaucccauu

SEQ ID NO: 1275620 - RNA, 17 nt, Human
uacauucuucaagaucc

SEQ ID NO: 1275621 - RNA, 16 nt, Human
uacauucuucaagauc

SEQ ID NO: 1275622 - RNA, 20 nt, Human
uacauguauugcacauugua

SEQ ID NO: 1275623 - RNA, 21 nt, Human
uacauguauugcacauuguaa

SEQ ID NO: 1275624 - RNA, 22 nt, Human
uacauguauugcacauuguaaa

SEQ ID NO: 1275625 - RNA, 15 nt, Human
aauguugaaauauga

SEQ ID NO: 1275626 - RNA, 22 nt, Human
aauguugaaauaugauguuaaa

SEQ ID NO: 1275627 - RNA, 18 nt, Human
aauuaacuggguaaugaa

SEQ ID NO: 1275628 - RNA, 21 nt, Human
aauuaacuggguaaugaaaca

SEQ ID NO: 1275629 - RNA, 10 nt, Human
aauguucuuu

SEQ ID NO: 1275630 - RNA, 11 nt, Human
aauguucuuug

SEQ ID NO: 1275631 - RNA, 14 nt, Human
aauguucuuuggaa

SEQ ID NO: 1275632 - RNA, 17 nt, Human
aauguucuuuggaaagu

SEQ ID NO: 1275633 - RNA, 20 nt, Human
aauguucuuuggaaaguaca

SEQ ID NO: 1275634 - RNA, 21 nt, Human
aauguucuuuggaaaguacac

SEQ ID NO: 1275635 - RNA, 22 nt, Human
aauguucuuuggaaaguacacu

SEQ ID NO: 1275636 - RNA, 23 nt, Human
aauguguuguuccaaauacuaau

SEQ ID NO: 1275637 - RNA, 23 nt, Human
aauguguuucacaguuugaaaua

SEQ ID NO: 1275638 - RNA, 13 nt, Human
aauguuaaaaugu

SEQ ID NO: 1275639 - RNA, 12 nt, Human
aauguuaaaaug

SEQ ID NO: 1275640 - RNA, 16 nt, Human
aauguuaaaauguguu

SEQ ID NO: 1275641 - RNA, 15 nt, Human
aauguuaaaaugugu

SEQ ID NO: 1275642 - RNA, 19 nt, Human
aauguuaagacuugacagu

SEQ ID NO: 1275643 - RNA, 14 nt, Human
uacacuaagagaga

SEQ ID NO: 1275644 - RNA, 18 nt, Human
uacacuaagagagaauga

SEQ ID NO: 1275645 - RNA, 13 nt, Human
aauguaacuuacu

SEQ ID NO: 1275646 - RNA, 15 nt, Human
aauguaacuuuugua

SEQ ID NO: 1275647 - RNA, 16 nt, Human
aauguaacuuuuguaa

SEQ ID NO: 1275648 - RNA, 22 nt, Human
aauguaacuuuuguaagacaaa

SEQ ID NO: 1275649 - RNA, 23 nt, Human
uacacguauuugaauggccuuca

SEQ ID NO: 1275650 - RNA, 20 nt, Human
uacagauccccaagccuggc

SEQ ID NO: 1275651 - RNA, 13 nt, Human
uacagauauauuu

SEQ ID NO: 1275652 - RNA, 21 nt, Human
uacagauauauuuucuuucuc

SEQ ID NO: 1275653 - RNA, 14 nt, Human
uacagauaaaaugu

SEQ ID NO: 1275654 - RNA, 17 nt, Human
uacagacgcugcuguca

SEQ ID NO: 1275655 - RNA, 19 nt, Human
uacagaguguggacucugg

SEQ ID NO: 1275656 - RNA, 17 nt, Human
aauggacuggaagggga

SEQ ID NO: 1275657 - RNA, 23 nt, Human
aauggacuggaaggggaagggac

SEQ ID NO: 1275658 - RNA, 23 nt, Human
aauggcacaaucucggcucacug

SEQ ID NO: 1275659 - RNA, 13 nt, Human
aauggauuuuucu

SEQ ID NO: 1275660 - RNA, 17 nt, Human
aauggauuuuucuuuaa

SEQ ID NO: 1275661 - RNA, 18 nt, Human
aauggauuuuucuuuaac

SEQ ID NO: 1275662 - RNA, 20 nt, Human
aauggauuuuucuuuaacug

SEQ ID NO: 1275663 - RNA, 13 nt, Human
aauggcagcaggg

SEQ ID NO: 1275664 - RNA, 19 nt, Human
aauggcagcagggguuggg

SEQ ID NO: 1275665 - RNA, 17 nt, Human
aauggcaguuauauuuu

SEQ ID NO: 1275666 - RNA, 20 nt, Human
aauggcaguuauauuuugca

SEQ ID NO: 1275667 - RNA, 23 nt, Human
aauggcaugagaaauacaaaaau

SEQ ID NO: 1275668 - RNA, 24 nt, Human
aauguaaaugucucacugagcacu

SEQ ID NO: 1275669 - RNA, 12 nt, Human
aauguaaauuug

SEQ ID NO: 1275670 - RNA, 13 nt, Human
aauguaaauuugu

SEQ ID NO: 1275671 - RNA, 14 nt, Human
aauguaaauuugua

SEQ ID NO: 1275672 - RNA, 15 nt, Human
aauguaaauuuguac

SEQ ID NO: 1275673 - RNA, 16 nt, Human
aauguaaauuuguacu

SEQ ID NO: 1275674 - RNA, 18 nt, Human
aauguaaauuuguacuau

SEQ ID NO: 1275675 - RNA, 17 nt, Human
aauguaaauuuguacua

SEQ ID NO: 1275676 - RNA, 18 nt, Human
aauguaaaugucucacug

SEQ ID NO: 1275677 - RNA, 16 nt, Human
aauguaaaugucucac

SEQ ID NO: 1275678 - RNA, 15 nt, Human
aauguaaaugucuca

SEQ ID NO: 1275679 - RNA, 14 nt, Human
aauguaaaugucuc

SEQ ID NO: 1275680 - RNA, 13 nt, Human
aauguaaaugucu

SEQ ID NO: 1275681 - RNA, 12 nt, Human
aauguaaauguc

SEQ ID NO: 1275682 - RNA, 15 nt, Human
aauggcugauaauuu

SEQ ID NO: 1275683 - RNA, 20 nt, Human
aauggcuauguuuuuaaugu

SEQ ID NO: 1275684 - RNA, 16 nt, Human
aauggcuauguuuuua

SEQ ID NO: 1275685 - RNA, 20 nt, Human
aauggcaugagaaauacaaa

SEQ ID NO: 1275686 - RNA, 17 nt, Human
aauggccauuugcuuuu

SEQ ID NO: 1275687 - RNA, 21 nt, Human
aauggcccugggucccaggac

SEQ ID NO: 1275688 - RNA, 15 nt, Human
aauggccucaugugg

SEQ ID NO: 1275689 - RNA, 20 nt, Human
aauggccucauguggcugga

SEQ ID NO: 1275690 - RNA, 22 nt, Human
aauggccucauguggcuggaag

SEQ ID NO: 1275691 - RNA, 14 nt, Human
aauggccuucauau

SEQ ID NO: 1275692 - RNA, 13 nt, Human
aauggccuuuauu

SEQ ID NO: 1275693 - RNA, 17 nt, Human
aauggccuucauaucau

SEQ ID NO: 1275694 - RNA, 20 nt, Human
aauggcgucuggaaguccaa

SEQ ID NO: 1275695 - RNA, 14 nt, Human
aauggcuauguuuu

SEQ ID NO: 1275696 - RNA, 15 nt, Human
aaugccaucaucucc

SEQ ID NO: 1275697 - RNA, 22 nt, Human
aaugccaugaugccucugucuu

SEQ ID NO: 1275698 - RNA, 21 nt, Human
aaugccaguaacgcgucuucc

SEQ ID NO: 1275699 - RNA, 23 nt, Human
aaugccaguaacgcgucuuccug

SEQ ID NO: 1275700 - RNA, 14 nt, Human
aaugccacagcccu

SEQ ID NO: 1275701 - RNA, 15 nt, Human
aaugccacagcccug

SEQ ID NO: 1275702 - RNA, 16 nt, Human
aaugccacagcccugu

SEQ ID NO: 1275703 - RNA, 18 nt, Human
aaugccacagcccuguca

SEQ ID NO: 1275704 - RNA, 19 nt, Human
aaugccacagcccugucag

SEQ ID NO: 1275705 - RNA, 22 nt, Human
aaugccacagcccugucagcau

SEQ ID NO: 1275706 - RNA, 23 nt, Human
aaugccacagcccugucagcaug

SEQ ID NO: 1275707 - RNA, 22 nt, Human
aaugccacugccuucgcuucuu

SEQ ID NO: 1275708 - RNA, 15 nt, Human
aaugacaaucaugug

SEQ ID NO: 1275709 - RNA, 13 nt, Human
uacaauguaauua

SEQ ID NO: 1275710 - RNA, 15 nt, Human
uacaauguaauuauu

SEQ ID NO: 1275711 - RNA, 14 nt, Human
uacaauguaauuau

SEQ ID NO: 1275712 - RNA, 16 nt, Human
aaugcuucaucccuuu

SEQ ID NO: 1275713 - RNA, 22 nt, Human
aaugcuuaaucagauagauauu

SEQ ID NO: 1275714 - RNA, 14 nt, Human
aaugcuuaaucaga

SEQ ID NO: 1275715 - RNA, 20 nt, Human
aaugcuguauuuuaaaagaa

SEQ ID NO: 1275716 - RNA, 22 nt, Human
aaugcuguauuagucacagaga

SEQ ID NO: 1275717 - RNA, 16 nt, Human
aaugcuguauuuuaaa

SEQ ID NO: 1275718 - RNA, 22 nt, Human
aaugcuuaaagaauucaaauuu

SEQ ID NO: 1275719 - RNA, 21 nt, Human
aaugcuuaaagaauucaaauu

SEQ ID NO: 1275720 - RNA, 19 nt, Human
aaugcuuaaagaauucaaa

SEQ ID NO: 1275721 - RNA, 15 nt, Human
aaugcuuagaaauuc

SEQ ID NO: 1275722 - RNA, 23 nt, Human
aaugcuguacaucuauuuuggau

SEQ ID NO: 1275723 - RNA, 11 nt, Human
aaugcccagac

SEQ ID NO: 1275724 - RNA, 12 nt, Human
aaugcccagaca

SEQ ID NO: 1275725 - RNA, 12 nt, Human
aaugcuguacau

SEQ ID NO: 1275726 - RNA, 13 nt, Human
aaugcuguacauc

SEQ ID NO: 1275727 - RNA, 15 nt, Human
aaugcuguacaucua

SEQ ID NO: 1275728 - RNA, 17 nt, Human
aaugcuguacaucuauu

SEQ ID NO: 1275729 - RNA, 14 nt, Human
aauuacgugcucug

SEQ ID NO: 1275730 - RNA, 14 nt, Human
aauuaccuucuauu

SEQ ID NO: 1275731 - RNA, 14 nt, Human
aauuacacccaaag

SEQ ID NO: 1275732 - RNA, 17 nt, Human
aauuacagaaauuuaau

SEQ ID NO: 1275733 - RNA, 22 nt, Human
aauuacagaaauuuaauucaga

SEQ ID NO: 1275734 - RNA, 14 nt, Human
aauuaccuacucug

SEQ ID NO: 1275735 - RNA, 14 nt, Human
aauuaccuguggau

SEQ ID NO: 1275736 - RNA, 21 nt, Human
aauuaccuugagccaguaauu

SEQ ID NO: 1275737 - RNA, 18 nt, Human
aauuacaacggagucaaa

SEQ ID NO: 1275738 - RNA, 16 nt, Human
aauuacaacuaaguga

SEQ ID NO: 1275739 - RNA, 14 nt, Human
aauuacaacuaagu

SEQ ID NO: 1275740 - RNA, 18 nt, Human
aauuacaaaaaaaaauuu

SEQ ID NO: 1275741 - RNA, 14 nt, Human
aauuacugguccaa

SEQ ID NO: 1275742 - RNA, 23 nt, Human
aauuacuguuuauuaaaguacaa

SEQ ID NO: 1275743 - RNA, 19 nt, Human
aauuagccaguaauccugu

SEQ ID NO: 1275744 - RNA, 18 nt, Human
aauuagccaguaauccug

SEQ ID NO: 1275745 - RNA, 17 nt, Human
aauuagccaguaauccu

SEQ ID NO: 1275746 - RNA, 20 nt, Human
aauuagccaguaauccugua

SEQ ID NO: 1275747 - RNA, 14 nt, Human
aauuagccaguaau

SEQ ID NO: 1275748 - RNA, 12 nt, Human
aauuagccagua

SEQ ID NO: 1275749 - RNA, 12 nt, Human
aauuagcaauug

SEQ ID NO: 1275750 - RNA, 16 nt, Human
aauuagcuuauguuaa

SEQ ID NO: 1275751 - RNA, 22 nt, Human
aauuagcuuauguuaacugaca

SEQ ID NO: 1275752 - RNA, 20 nt, Human
aauuaggcccccaucauccu

SEQ ID NO: 1275753 - RNA, 15 nt, Human
aauuaggcuguaacu

SEQ ID NO: 1275754 - RNA, 16 nt, Human
aauuaggcuguaacua

SEQ ID NO: 1275755 - RNA, 17 nt, Human
aauuaggcuguaacuac

SEQ ID NO: 1275756 - RNA, 18 nt, Human
aauuaggcuguaacuacu

SEQ ID NO: 1275757 - RNA, 19 nt, Human
aauuaggcuguaacuacuu

SEQ ID NO: 1275758 - RNA, 21 nt, Human
aauuaggcuguaacuacuuua

SEQ ID NO: 1275759 - RNA, 22 nt, Human
aauuaggcuguaacuacuuuau

SEQ ID NO: 1275760 - RNA, 15 nt, Human
uaccacucuguaauu

SEQ ID NO: 1275761 - RNA, 16 nt, Human
uaccacucuguaauug

SEQ ID NO: 1275762 - RNA, 17 nt, Human
uaccacucuguaauugc

SEQ ID NO: 1275763 - RNA, 18 nt, Human
uaccacucuguaauugca

SEQ ID NO: 1275764 - RNA, 19 nt, Human
uaccacucuguaauugcaa

SEQ ID NO: 1275765 - RNA, 20 nt, Human
uaccugccccacuuguccuu

SEQ ID NO: 1275766 - RNA, 14 nt, Human
uaccaccugacauu

SEQ ID NO: 1275767 - RNA, 13 nt, Human
uaccacucuguaa

SEQ ID NO: 1275768 - RNA, 14 nt, Human
uaccacucuguaau

SEQ ID NO: 1275769 - RNA, 19 nt, Human
uaccuguagauucagguaa

SEQ ID NO: 1275770 - RNA, 17 nt, Human
uaccugcucagcccugc

SEQ ID NO: 1275771 - RNA, 21 nt, Human
uaccugcucacgucaaaugca

SEQ ID NO: 1275772 - RNA, 16 nt, Human
aauuauuauuuggccc

SEQ ID NO: 1275773 - RNA, 15 nt, Human
aauuauuauuugugu

SEQ ID NO: 1275774 - RNA, 16 nt, Human
aauuauuauuuguguu

SEQ ID NO: 1275775 - RNA, 18 nt, Human
aauuauuauuuguguuuu

SEQ ID NO: 1275776 - RNA, 14 nt, Human
aauuauucaauuua

SEQ ID NO: 1275777 - RNA, 17 nt, Human
aauuagugccacuuaau

SEQ ID NO: 1275778 - RNA, 20 nt, Human
aauuagugccacuuaaugua

SEQ ID NO: 1275779 - RNA, 22 nt, Human
aauuauuauuuauauauguauu

SEQ ID NO: 1275780 - RNA, 12 nt, Human
aauuauuauuug

SEQ ID NO: 1275781 - RNA, 23 nt, Human
aauuaggcuguaacuacuuuaua

SEQ ID NO: 1275782 - RNA, 21 nt, Human
aauuaggcccccaucauccuc

SEQ ID NO: 1275783 - RNA, 17 nt, Human
aauuaguaacauguguu

SEQ ID NO: 1275784 - RNA, 15 nt, Human
aauuagugccacuua

SEQ ID NO: 1275785 - RNA, 13 nt, Human
aauuauuuucauc

SEQ ID NO: 1275786 - RNA, 11 nt, Human
aauuauuuugu

SEQ ID NO: 1275787 - RNA, 19 nt, Human
aauuauuuuuuuucuuuua

SEQ ID NO: 1275788 - RNA, 16 nt, Human
aauuauuuuuuuucuu

SEQ ID NO: 1275789 - RNA, 16 nt, Human
aauucaaaaguuccaa

SEQ ID NO: 1275790 - RNA, 22 nt, Human
aauucaaaaguuccaagagucu

SEQ ID NO: 1275791 - RNA, 23 nt, Human
aauucaaaaguuccaagagucua

SEQ ID NO: 1275792 - RNA, 22 nt, Human
aauucaaagcuguguguuugga

SEQ ID NO: 1275793 - RNA, 17 nt, Human
aauucaaauaaaaaucc

SEQ ID NO: 1275794 - RNA, 18 nt, Human
aauuccaagugauugaaa

SEQ ID NO: 1275795 - RNA, 12 nt, Human
aauucacucuga

SEQ ID NO: 1275796 - RNA, 23 nt, Human
aauucacucugaguguuuuauga

SEQ ID NO: 1275797 - RNA, 13 nt, Human
aauucacuguacu

SEQ ID NO: 1275798 - RNA, 21 nt, Human
aauucacuguacuaucagguu

SEQ ID NO: 1275799 - RNA, 15 nt, Human
aauucacuuaggguc

SEQ ID NO: 1275800 - RNA, 23 nt, Human
aauucacuuagggucgagcaucc

SEQ ID NO: 1275801 - RNA, 13 nt, Human
aauucauuucacu

SEQ ID NO: 1275802 - RNA, 15 nt, Human
aauucauuucacugu

SEQ ID NO: 1275803 - RNA, 18 nt, Human
aauucauuuuuuaaauuc

SEQ ID NO: 1275804 - RNA, 22 nt, Human
aauucaaauuuuaucugccucu

SEQ ID NO: 1275805 - RNA, 15 nt, Human
aauucaacaaacauu

SEQ ID NO: 1275806 - RNA, 19 nt, Human
aauucacaaacuuuuauac

SEQ ID NO: 1275807 - RNA, 14 nt, Human
aauucacaaacuuu

SEQ ID NO: 1275808 - RNA, 12 nt, Human
aauucaacuuaa

SEQ ID NO: 1275809 - RNA, 20 nt, Human
aauucacagugcucuuuucu

SEQ ID NO: 1275810 - RNA, 21 nt, Human
aauucacaucuaaccucaucu

SEQ ID NO: 1275811 - RNA, 22 nt, Human
aauucacaucuaaccucaucuu

SEQ ID NO: 1275812 - RNA, 21 nt, Human
aauucacaugaugcacuucaa

SEQ ID NO: 1275813 - RNA, 21 nt, Human
aauucacccccuuuccuggac

SEQ ID NO: 1275814 - RNA, 22 nt, Human
aauuccacuuauaggaauugac

SEQ ID NO: 1275815 - RNA, 12 nt, Human
aauuccaaaguc

SEQ ID NO: 1275816 - RNA, 13 nt, Human
aauuccaaagucu

SEQ ID NO: 1275817 - RNA, 18 nt, Human
aauuccaaagucucuaau

SEQ ID NO: 1275818 - RNA, 20 nt, Human
aauuccaacaguuuaaugaa

SEQ ID NO: 1275819 - RNA, 18 nt, Human
aauuccaacaguuuaaug

SEQ ID NO: 1275820 - RNA, 19 nt, Human
aauugaugggauuugguca

SEQ ID NO: 1275821 - RNA, 16 nt, Human
aauugaguaauggugu

SEQ ID NO: 1275822 - RNA, 18 nt, Human
aauugaguguuuaaaguu

SEQ ID NO: 1275823 - RNA, 17 nt, Human
aauugaguuuucagugg

SEQ ID NO: 1275824 - RNA, 21 nt, Human
aauugaguaaugguguagaac

SEQ ID NO: 1275825 - RNA, 17 nt, Human
aauugaucgacuugcca

SEQ ID NO: 1275826 - RNA, 23 nt, Human
aauugccaaaaagugaaauaaug

SEQ ID NO: 1275827 - RNA, 21 nt, Human
aauugccaaaaagugaaauaa

SEQ ID NO: 1275828 - RNA, 23 nt, Human
aauugccaccucuaacagcacca

SEQ ID NO: 1275829 - RNA, 20 nt, Human
aauugccauguacaguaugu

SEQ ID NO: 1275830 - RNA, 15 nt, Human
aauugccugacgaac

SEQ ID NO: 1275831 - RNA, 23 nt, Human
aauugccugacgaacuccuugau

SEQ ID NO: 1275832 - RNA, 22 nt, Human
aauugacccacaagaaaugaaa

SEQ ID NO: 1275833 - RNA, 14 nt, Human
aauugacugucacu

SEQ ID NO: 1275834 - RNA, 14 nt, Human
uacuguaguauucu

SEQ ID NO: 1275835 - RNA, 15 nt, Human
uacuguauauucagg

SEQ ID NO: 1275836 - RNA, 18 nt, Human
uacuguaaggcaaucaug

SEQ ID NO: 1275837 - RNA, 14 nt, Human
uacuguaagaaaau

SEQ ID NO: 1275838 - RNA, 18 nt, Human
uacuggccuuuuucauuu

SEQ ID NO: 1275839 - RNA, 19 nt, Human
uacuguaaggcaaucaugg

SEQ ID NO: 1275840 - RNA, 20 nt, Human
uacucugugccagagccugg

SEQ ID NO: 1275841 - RNA, 21 nt, Human
uacucugugccagagccuggg

SEQ ID NO: 1275842 - RNA, 22 nt, Human
uacucugugccagagccugggg

SEQ ID NO: 1275843 - RNA, 23 nt, Human
uacucugugccagagccuggggc

SEQ ID NO: 1275844 - RNA, 21 nt, Human
uacucugaaauuguaacuaaa

SEQ ID NO: 1275845 - RNA, 14 nt, Human
uacucugugccaga

SEQ ID NO: 1275846 - RNA, 15 nt, Human
uacucugugccagag

SEQ ID NO: 1275847 - RNA, 16 nt, Human
uacucugugccagagc

SEQ ID NO: 1275848 - RNA, 17 nt, Human
uacucugugccagagcc

SEQ ID NO: 1275849 - RNA, 18 nt, Human
uacucugugccagagccu

SEQ ID NO: 1275850 - RNA, 19 nt, Human
uacucugugccagagccug

SEQ ID NO: 1275851 - RNA, 16 nt, Human
uacuauaguaccagua

SEQ ID NO: 1275852 - RNA, 13 nt, Human
uacuauaguacca

SEQ ID NO: 1275853 - RNA, 12 nt, Human
uacuauaguacc

SEQ ID NO: 1275854 - RNA, 20 nt, Human
uacuaucaugucaaacguga

SEQ ID NO: 1275855 - RNA, 14 nt, Human
uacuauauuuaugg

SEQ ID NO: 1275856 - RNA, 16 nt, Human
uacuacugaaucucua

SEQ ID NO: 1275857 - RNA, 17 nt, Human
uacuacugaaucucuaa

SEQ ID NO: 1275858 - RNA, 14 nt, Human
uacuacuguguaag

SEQ ID NO: 1275859 - RNA, 17 nt, Human
uacuacuuaugaaaugu

SEQ ID NO: 1275860 - RNA, 16 nt, Human
uacuaaaaaaaagaug

SEQ ID NO: 1275861 - RNA, 18 nt, Human
uacuaaaaaaaagaugaa

SEQ ID NO: 1275862 - RNA, 16 nt, Human
uacguaauaagguuuu

SEQ ID NO: 1275863 - RNA, 19 nt, Human
uacguaauaagguuuuaau

SEQ ID NO: 1275864 - RNA, 22 nt, Human
uacuaugaaauauguauaacuu

SEQ ID NO: 1275865 - RNA, 12 nt, Human
uacggugggggu

SEQ ID NO: 1275866 - RNA, 13 nt, Human
uacggugggggua

SEQ ID NO: 1275867 - RNA, 20 nt, Human
uacgguuugccccuuuauaa

SEQ ID NO: 1275868 - RNA, 24 nt, Human
uacgcuccaucgcugucaucucag

SEQ ID NO: 1275869 - RNA, 22 nt, Human
uacgcagcgugcuuuaaaaaau

SEQ ID NO: 1275870 - RNA, 13 nt, Human
uacgaugcuucaa

SEQ ID NO: 1275871 - RNA, 19 nt, Human
uacgagagcagaggucucc

SEQ ID NO: 1275872 - RNA, 20 nt, Human
aauucccguuuugucacuuu

SEQ ID NO: 1275873 - RNA, 21 nt, Human
aauucccguuuugucacuuuu

SEQ ID NO: 1275874 - RNA, 20 nt, Human
aauucccucacucgucuccc

SEQ ID NO: 1275875 - RNA, 13 nt, Human
aauuccgucacca

SEQ ID NO: 1275876 - RNA, 22 nt, Human
aauuccuauacgcagcgugcuu

SEQ ID NO: 1275877 - RNA, 16 nt, Human
acagccucuuagaugc

SEQ ID NO: 1275878 - RNA, 15 nt, Human
uaugguaaaaaauuu

SEQ ID NO: 1275879 - RNA, 16 nt, Human
uaugguaccagaugca

SEQ ID NO: 1275880 - RNA, 17 nt, Human
uaugguaccagaugcag

SEQ ID NO: 1275881 - RNA, 12 nt, Human
acagccuggcac

SEQ ID NO: 1275882 - RNA, 17 nt, Human
acagccugacaacauuu

SEQ ID NO: 1275883 - RNA, 20 nt, Human
acagccugacaacauuucua

SEQ ID NO: 1275884 - RNA, 21 nt, Human
acagccugacaacauuucuau

SEQ ID NO: 1275885 - RNA, 17 nt, Human
uauggggaugguaguuu

SEQ ID NO: 1275886 - RNA, 19 nt, Human
uauggggguuguaaauugg

SEQ ID NO: 1275887 - RNA, 23 nt, Human
uauggggguuguaaauuggcaug

SEQ ID NO: 1275888 - RNA, 18 nt, Human
uauggguaggguaaauca

SEQ ID NO: 1275889 - RNA, 19 nt, Human
uauggguaggguaaaucag

SEQ ID NO: 1275890 - RNA, 11 nt, Human
uaugggucaca

SEQ ID NO: 1275891 - RNA, 13 nt, Human
uaugggucacagg

SEQ ID NO: 1275892 - RNA, 14 nt, Human
uaugggucacagga

SEQ ID NO: 1275893 - RNA, 14 nt, Human
uaugggucuaggac

SEQ ID NO: 1275894 - RNA, 15 nt, Human
uaugggucacaggaa

SEQ ID NO: 1275895 - RNA, 11 nt, Human
uaugguaaaaa

SEQ ID NO: 1275896 - RNA, 19 nt, Human
uaugguaacugcuuucugu

SEQ ID NO: 1275897 - RNA, 15 nt, Human
uaugcuguacccagu

SEQ ID NO: 1275898 - RNA, 13 nt, Human
uaugcuuaaaaua

SEQ ID NO: 1275899 - RNA, 16 nt, Human
uaugcuuaaaauaagc

SEQ ID NO: 1275900 - RNA, 15 nt, Human
uaugcuuacugauau

SEQ ID NO: 1275901 - RNA, 17 nt, Human
uaugcuaccaccagcug

SEQ ID NO: 1275902 - RNA, 18 nt, Human
uaugcuaccaccagcugu

SEQ ID NO: 1275903 - RNA, 19 nt, Human
uaugcuaccaccagcugug

SEQ ID NO: 1275904 - RNA, 15 nt, Human
uaugcugauuuauuu

SEQ ID NO: 1275905 - RNA, 19 nt, Human
uaugcuuaaaauaagcagg

SEQ ID NO: 1275906 - RNA, 16 nt, Human
uaugcuuacugauaua

SEQ ID NO: 1275907 - RNA, 21 nt, Human
uaugcuuacugauauauuuua

SEQ ID NO: 1275908 - RNA, 19 nt, Human
uaugccccauucaacaucu

SEQ ID NO: 1275909 - RNA, 21 nt, Human
uaugcauuuaaauacagucuu

SEQ ID NO: 1275910 - RNA, 22 nt, Human
uaugcauuuaaauacagucuuc

SEQ ID NO: 1275911 - RNA, 14 nt, Human
uaugccugcuauuu

SEQ ID NO: 1275912 - RNA, 16 nt, Human
uaugccuuguuucaua

SEQ ID NO: 1275913 - RNA, 13 nt, Human
uaugcgguuaauu

SEQ ID NO: 1275914 - RNA, 13 nt, Human
uaugcuaaucagg

SEQ ID NO: 1275915 - RNA, 14 nt, Human
uaugcuaccaccag

SEQ ID NO: 1275916 - RNA, 15 nt, Human
uaugcuaccaccagc

SEQ ID NO: 1275917 - RNA, 18 nt, Human
uaugccugcuauuugaag

SEQ ID NO: 1275918 - RNA, 19 nt, Human
uaugaacuugaggacacau

SEQ ID NO: 1275919 - RNA, 18 nt, Human
uaugaacuugaggacaca

SEQ ID NO: 1275920 - RNA, 16 nt, Human
uaugaacuugaggaca

SEQ ID NO: 1275921 - RNA, 19 nt, Human
uaugaacauauuguugaaa

SEQ ID NO: 1275922 - RNA, 17 nt, Human
uaugaacauauuguuga

SEQ ID NO: 1275923 - RNA, 16 nt, Human
uaugauuaaguaauga

SEQ ID NO: 1275924 - RNA, 20 nt, Human
uaugauuaaguaaugauaac

SEQ ID NO: 1275925 - RNA, 21 nt, Human
uaugauuaaguaaugauaacu

SEQ ID NO: 1275926 - RNA, 22 nt, Human
uaucuuugccacccucaugcug

SEQ ID NO: 1275927 - RNA, 23 nt, Human
uaucuuuucauacauuuucuaag

SEQ ID NO: 1275928 - RNA, 21 nt, Human
uaucuuuucauacauuuucua

SEQ ID NO: 1275929 - RNA, 18 nt, Human
uaucuuuuuaccuuucau

SEQ ID NO: 1275930 - RNA, 17 nt, Human
uaugaaaugugcacuuu

SEQ ID NO: 1275931 - RNA, 14 nt, Human
uaugaacauauugu

SEQ ID NO: 1275932 - RNA, 16 nt, Human
uaucuuugccacccuc

SEQ ID NO: 1275933 - RNA, 14 nt, Human
uaucuuugccaccc

SEQ ID NO: 1275934 - RNA, 11 nt, Human
uaucuuugcca

SEQ ID NO: 1275935 - RNA, 18 nt, Human
acagccguuuguucccca

SEQ ID NO: 1275936 - RNA, 17 nt, Human
acagauuuauuccuuug

SEQ ID NO: 1275937 - RNA, 20 nt, Human
acagauuuauuccuuuguua

SEQ ID NO: 1275938 - RNA, 12 nt, Human
acagauauauuu

SEQ ID NO: 1275939 - RNA, 17 nt, Human
acagauccccaagccug

SEQ ID NO: 1275940 - RNA, 18 nt, Human
acagauccccaagccugg

SEQ ID NO: 1275941 - RNA, 12 nt, Human
acagaucaguaa

SEQ ID NO: 1275942 - RNA, 23 nt, Human
acagaucgaaccguuuugaagcu

SEQ ID NO: 1275943 - RNA, 22 nt, Human
acagaucucugcuuuggaaauc

SEQ ID NO: 1275944 - RNA, 22 nt, Human
acagaucaucuuggaacugcau

SEQ ID NO: 1275945 - RNA, 12 nt, Human
acagaucuggaa

SEQ ID NO: 1275946 - RNA, 21 nt, Human
acagagaagucacagggcagu

SEQ ID NO: 1275947 - RNA, 14 nt, Human
acagauuugagcuc

SEQ ID NO: 1275948 - RNA, 15 nt, Human
acagauuugagcuca

SEQ ID NO: 1275949 - RNA, 14 nt, Human
acagauuguuugca

SEQ ID NO: 1275950 - RNA, 15 nt, Human
acagauuguuugcaa

SEQ ID NO: 1275951 - RNA, 14 nt, Human
acagaucuggaacc

SEQ ID NO: 1275952 - RNA, 16 nt, Human
acagaucuggaaccuc

SEQ ID NO: 1275953 - RNA, 20 nt, Human
acagaucuggaaccucagcc

SEQ ID NO: 1275954 - RNA, 21 nt, Human
acagaucuggaaccucagccu

SEQ ID NO: 1275955 - RNA, 22 nt, Human
acagaucuggaaccucagccug

SEQ ID NO: 1275956 - RNA, 13 nt, Human
acagaugagucac

SEQ ID NO: 1275957 - RNA, 18 nt, Human
acagaugccacacaagga

SEQ ID NO: 1275958 - RNA, 23 nt, Human
uaucuauauuuuacauaaauuua

SEQ ID NO: 1275959 - RNA, 14 nt, Human
uaucuauguuuuac

SEQ ID NO: 1275960 - RNA, 16 nt, Human
uaucuauguuuuacca

SEQ ID NO: 1275961 - RNA, 11 nt, Human
uaucucaucuc

SEQ ID NO: 1275962 - RNA, 16 nt, Human
uaucuccagcggcccu

SEQ ID NO: 1275963 - RNA, 18 nt, Human
uaucuccagcggcccugu

SEQ ID NO: 1275964 - RNA, 16 nt, Human
acagagaaaccagcuu

SEQ ID NO: 1275965 - RNA, 17 nt, Human
acagagaaaccagcuuc

SEQ ID NO: 1275966 - RNA, 18 nt, Human
acagagaaaccagcuucc

SEQ ID NO: 1275967 - RNA, 19 nt, Human
acagagaaaccagcuuccu

SEQ ID NO: 1275968 - RNA, 20 nt, Human
acagagaaaccagcuuccuu

SEQ ID NO: 1275969 - RNA, 22 nt, Human
acagagaaaccagcuuccuuca

SEQ ID NO: 1275970 - RNA, 23 nt, Human
acagagaaaccagcuuccuucag

SEQ ID NO: 1275971 - RNA, 9 nt, Human
acagagaag

SEQ ID NO: 1275972 - RNA, 10 nt, Human
acagagaagc

SEQ ID NO: 1275973 - RNA, 11 nt, Human
acagagaagcc

SEQ ID NO: 1275974 - RNA, 12 nt, Human
acagagaagcca

SEQ ID NO: 1275975 - RNA, 13 nt, Human
acagagaagccag

SEQ ID NO: 1275976 - RNA, 14 nt, Human
acagagaagccagc

SEQ ID NO: 1275977 - RNA, 15 nt, Human
acagagaagccagcu

SEQ ID NO: 1275978 - RNA, 16 nt, Human
acagagaagccagcuu

SEQ ID NO: 1275979 - RNA, 17 nt, Human
acagagaagccagcuug

SEQ ID NO: 1275980 - RNA, 18 nt, Human
acagagaagccagcuugu

SEQ ID NO: 1275981 - RNA, 19 nt, Human
acagagaagccagcuuguu

SEQ ID NO: 1275982 - RNA, 13 nt, Human
acagagaagccau

SEQ ID NO: 1275983 - RNA, 14 nt, Human
acagagaagccauc

SEQ ID NO: 1275984 - RNA, 15 nt, Human
acagagaagccauca

SEQ ID NO: 1275985 - RNA, 20 nt, Human
acagagaagccaucaccuca

SEQ ID NO: 1275986 - RNA, 21 nt, Human
acagagaagccaucaccucag

SEQ ID NO: 1275987 - RNA, 12 nt, Human
acagagaagccu

SEQ ID NO: 1275988 - RNA, 13 nt, Human
acagagaagccuu

SEQ ID NO: 1275989 - RNA, 14 nt, Human
acagagaagccuuc

SEQ ID NO: 1275990 - RNA, 15 nt, Human
acagagaagccuuca

SEQ ID NO: 1275991 - RNA, 16 nt, Human
acagagaagccuucaa

SEQ ID NO: 1275992 - RNA, 20 nt, Human
acagagaagccuucaagcuc

SEQ ID NO: 1275993 - RNA, 23 nt, Human
acagagaagccuucaagcucuga

SEQ ID NO: 1275994 - RNA, 22 nt, Human
acagagaagccuucaagcucug

SEQ ID NO: 1275995 - RNA, 12 nt, Human
acagagaaguca

SEQ ID NO: 1275996 - RNA, 13 nt, Human
acagagaagucac

SEQ ID NO: 1275997 - RNA, 14 nt, Human
acagagaagucaca

SEQ ID NO: 1275998 - RNA, 16 nt, Human
acagagaagucacagg

SEQ ID NO: 1275999 - RNA, 17 nt, Human
acagagaagucacaggg

SEQ ID NO: 1276000 - RNA, 18 nt, Human
acagagaagucacagggc

SEQ ID NO: 1276001 - RNA, 19 nt, Human
acagagaagucacagggca

SEQ ID NO: 1276002 - RNA, 21 nt, Human
uaucaaggucguuuuuuucau

SEQ ID NO: 1276003 - RNA, 17 nt, Human
uaucaaccccagacacu

SEQ ID NO: 1276004 - RNA, 18 nt, Human
uaucaaccccagacacug

SEQ ID NO: 1276005 - RNA, 21 nt, Human
uaucaaccccagacacugguu

SEQ ID NO: 1276006 - RNA, 19 nt, Human
uaucaaccccagacacugg

SEQ ID NO: 1276007 - RNA, 14 nt, Human
uaucaacuuccuaa

SEQ ID NO: 1276008 - RNA, 19 nt, Human
uaucaacuuccuaaauauu

SEQ ID NO: 1276009 - RNA, 13 nt, Human
uauccaaaagcuu

SEQ ID NO: 1276010 - RNA, 15 nt, Human
uauccacuuugcaca

SEQ ID NO: 1276011 - RNA, 18 nt, Human
uauccacuuugcacagcu

SEQ ID NO: 1276012 - RNA, 15 nt, Human
uauccaggcaccagg

SEQ ID NO: 1276013 - RNA, 17 nt, Human
uauccaggcaccaggac

SEQ ID NO: 1276014 - RNA, 21 nt, Human
uauccagguaauccaagauau

SEQ ID NO: 1276015 - RNA, 18 nt, Human
uauccagguaauccaaga

SEQ ID NO: 1276016 - RNA, 19 nt, Human
uauccagguucccucccag

SEQ ID NO: 1276017 - RNA, 24 nt, Human
uauccauaaugcauucuucucugu

SEQ ID NO: 1276018 - RNA, 18 nt, Human
uauccaggcaccaggacu

SEQ ID NO: 1276019 - RNA, 17 nt, Human
uauccauauugagucaa

SEQ ID NO: 1276020 - RNA, 18 nt, Human
uauccggacagagcacgu

SEQ ID NO: 1276021 - RNA, 16 nt, Human
uauccuaaacaucauu

SEQ ID NO: 1276022 - RNA, 23 nt, Human
uauaaguguguguuuuucauaaa

SEQ ID NO: 1276023 - RNA, 17 nt, Human
uauaaguguguguuuuu

SEQ ID NO: 1276024 - RNA, 12 nt, Human
uauaagaaagcc

SEQ ID NO: 1276025 - RNA, 15 nt, Human
uauaaguguacauau

SEQ ID NO: 1276026 - RNA, 18 nt, Human
uauaaguguacauaugug

SEQ ID NO: 1276027 - RNA, 16 nt, Human
uauauuuaguaucuuu

SEQ ID NO: 1276028 - RNA, 19 nt, Human
uauauuguucagcaugcaa

SEQ ID NO: 1276029 - RNA, 15 nt, Human
uauauuguuugcuaa

SEQ ID NO: 1276030 - RNA, 17 nt, Human
uauauuguucacuucuu

SEQ ID NO: 1276031 - RNA, 19 nt, Human
uauauuguguuuguguauu

SEQ ID NO: 1276032 - RNA, 14 nt, Human
uauauuuaaaaaua

SEQ ID NO: 1276033 - RNA, 14 nt, Human
uauauuauauggaa

SEQ ID NO: 1276034 - RNA, 12 nt, Human
uauauuguaauu

SEQ ID NO: 1276035 - RNA, 14 nt, Human
uauauuguaauuua

SEQ ID NO: 1276036 - RNA, 18 nt, Human
uauauuguguuuguguau

SEQ ID NO: 1276037 - RNA, 17 nt, Human
uauauuacaaugaucac

SEQ ID NO: 1276038 - RNA, 22 nt, Human
uauauuacacuacacacugugu

SEQ ID NO: 1276039 - RNA, 17 nt, Human
uauauuacagauauuug

SEQ ID NO: 1276040 - RNA, 13 nt, Human
uauauuacaauga

SEQ ID NO: 1276041 - RNA, 12 nt, Human
uauauuacaaug

SEQ ID NO: 1276042 - RNA, 17 nt, Human
uauauuauacuuguaau

SEQ ID NO: 1276043 - RNA, 18 nt, Human
uauauuauacuuguaauu

SEQ ID NO: 1276044 - RNA, 20 nt, Human
uauauuauacuuguaauuau

SEQ ID NO: 1276045 - RNA, 13 nt, Human
uauauuauaugga

SEQ ID NO: 1276046 - RNA, 19 nt, Human
uauauuauauggaaauaua

SEQ ID NO: 1276047 - RNA, 17 nt, Human
uauguguaucucacacu

SEQ ID NO: 1276048 - RNA, 20 nt, Human
uauguguaugcacaguaaaa

SEQ ID NO: 1276049 - RNA, 17 nt, Human
uaugugggcagauuuuc

SEQ ID NO: 1276050 - RNA, 23 nt, Human
uaugugggcagauuuucagcaaa

SEQ ID NO: 1276051 - RNA, 22 nt, Human
uauguuuugacauuuuuaguuu

SEQ ID NO: 1276052 - RNA, 18 nt, Human
uauguuuucgaaaaucaa

SEQ ID NO: 1276053 - RNA, 13 nt, Human
uauguuuuuaaug

SEQ ID NO: 1276054 - RNA, 16 nt, Human
uauguuuuuguucaaa

SEQ ID NO: 1276055 - RNA, 15 nt, Human
uauguuuuuguucaa

SEQ ID NO: 1276056 - RNA, 20 nt, Human
uauuaaaaagguuuacagaa

SEQ ID NO: 1276057 - RNA, 12 nt, Human
uauuaaaagacu

SEQ ID NO: 1276058 - RNA, 13 nt, Human
uauuaaaagacuc

SEQ ID NO: 1276059 - RNA, 14 nt, Human
uauuaaaagacuca

SEQ ID NO: 1276060 - RNA, 15 nt, Human
uauuaaaagacucau

SEQ ID NO: 1276061 - RNA, 16 nt, Human
uauuaaaagacucauc

SEQ ID NO: 1276062 - RNA, 18 nt, Human
uauuaaaagacucauccg

SEQ ID NO: 1276063 - RNA, 18 nt, Human
uaugugacauuuuacauu

SEQ ID NO: 1276064 - RNA, 14 nt, Human
uaugugacauuuua

SEQ ID NO: 1276065 - RNA, 17 nt, Human
uaugugaaacauguuuc

SEQ ID NO: 1276066 - RNA, 12 nt, Human
uaugugaacagu

SEQ ID NO: 1276067 - RNA, 22 nt, Human
uaugugaacaguuguguuugaa

SEQ ID NO: 1276068 - RNA, 19 nt, Human
uaugugacauuuuacauua

SEQ ID NO: 1276069 - RNA, 21 nt, Human
uaugugacauuuuacauuaaa

SEQ ID NO: 1276070 - RNA, 14 nt, Human
uaugugaaacaugu

SEQ ID NO: 1276071 - RNA, 14 nt, Human
uaugucuuaaaacc

SEQ ID NO: 1276072 - RNA, 17 nt, Human
uaugucuuaaaaccugc

SEQ ID NO: 1276073 - RNA, 17 nt, Human
acaggcauuuccugggu

SEQ ID NO: 1276074 - RNA, 20 nt, Human
acaggcauuuccuggguggc

SEQ ID NO: 1276075 - RNA, 18 nt, Human
acaggcauuuccugggug

SEQ ID NO: 1276076 - RNA, 19 nt, Human
acaggcaugugucaccaug

SEQ ID NO: 1276077 - RNA, 16 nt, Human
acaggcaugugucacc

SEQ ID NO: 1276078 - RNA, 23 nt, Human
acaggaguguccucuucccucuc

SEQ ID NO: 1276079 - RNA, 19 nt, Human
acaggagggcggccuccuu

SEQ ID NO: 1276080 - RNA, 20 nt, Human
acaggagggcggccuccuuc

SEQ ID NO: 1276081 - RNA, 23 nt, Human
acaggagggggucguggagagcu

SEQ ID NO: 1276082 - RNA, 20 nt, Human
acaggagggggucguggaga

SEQ ID NO: 1276083 - RNA, 17 nt, Human
acaggaguguccucuuc

SEQ ID NO: 1276084 - RNA, 21 nt, Human
acaggaguguccucuucccuc

SEQ ID NO: 1276085 - RNA, 22 nt, Human
acaggacaugcgguagccagca

SEQ ID NO: 1276086 - RNA, 14 nt, Human
acaggacucugccu

SEQ ID NO: 1276087 - RNA, 16 nt, Human
acaggacuaacacuca

SEQ ID NO: 1276088 - RNA, 18 nt, Human
acaggacuaacacucaga

SEQ ID NO: 1276089 - RNA, 19 nt, Human
acaggacuaacacucagaa

SEQ ID NO: 1276090 - RNA, 20 nt, Human
acaggacuaacacucagaag

SEQ ID NO: 1276091 - RNA, 21 nt, Human
acaggacuaacacucagaagc

SEQ ID NO: 1276092 - RNA, 22 nt, Human
acaggacuaacacucagaagcc

SEQ ID NO: 1276093 - RNA, 23 nt, Human
acaggacuaacacucagaagccu

SEQ ID NO: 1276094 - RNA, 24 nt, Human
acaggacuaacacucagaagccug

SEQ ID NO: 1276095 - RNA, 12 nt, Human
acaggaaaaagu

SEQ ID NO: 1276096 - RNA, 21 nt, Human
acagcuuuugcaacuuaauac

SEQ ID NO: 1276097 - RNA, 17 nt, Human
acaggaaguagaggagg

SEQ ID NO: 1276098 - RNA, 19 nt, Human
acagcgugcuaaaauaaca

SEQ ID NO: 1276099 - RNA, 22 nt, Human
acagcguuccuagagaagacag

SEQ ID NO: 1276100 - RNA, 13 nt, Human
acagcguuccuag

SEQ ID NO: 1276101 - RNA, 15 nt, Human
acagccugcaaguca

SEQ ID NO: 1276102 - RNA, 11 nt, Human
acagccuggca

SEQ ID NO: 1276103 - RNA, 12 nt, Human
acagcuuuugca

SEQ ID NO: 1276104 - RNA, 13 nt, Human
acagcuuuugcaa

SEQ ID NO: 1276105 - RNA, 14 nt, Human
acagcuuuugcaac

SEQ ID NO: 1276106 - RNA, 15 nt, Human
acagcuuuugcaacu

SEQ ID NO: 1276107 - RNA, 22 nt, Human
acagcuuuugcaacuuaauacu

SEQ ID NO: 1276108 - RNA, 23 nt, Human
acaguagucuugaugaccaaagu

SEQ ID NO: 1276109 - RNA, 14 nt, Human
acaguaggagccca

SEQ ID NO: 1276110 - RNA, 22 nt, Human
acaguaggagcccagcucugaa

SEQ ID NO: 1276111 - RNA, 14 nt, Human
acaguagucuugau

SEQ ID NO: 1276112 - RNA, 16 nt, Human
acagucaccucaugga

SEQ ID NO: 1276113 - RNA, 17 nt, Human
acagucaccucauggaa

SEQ ID NO: 1276114 - RNA, 18 nt, Human
acagucaccucauggaau

SEQ ID NO: 1276115 - RNA, 14 nt, Human
acagucacugcucu

SEQ ID NO: 1276116 - RNA, 18 nt, Human
acagggauaaggccugug

SEQ ID NO: 1276117 - RNA, 22 nt, Human
acagggauaaggccuguggggg

SEQ ID NO: 1276118 - RNA, 21 nt, Human
acaguaauuguguuuacauuu

SEQ ID NO: 1276119 - RNA, 14 nt, Human
acaguacacuguca

SEQ ID NO: 1276120 - RNA, 18 nt, Human
acaguaauuguguuuaca

SEQ ID NO: 1276121 - RNA, 17 nt, Human
acaguaauuguguuuac

SEQ ID NO: 1276122 - RNA, 15 nt, Human
acaguaauuguguuu

SEQ ID NO: 1276123 - RNA, 15 nt, Human
acaguacccaaacug

SEQ ID NO: 1276124 - RNA, 13 nt, Human
acaguaggagccc

SEQ ID NO: 1276125 - RNA, 18 nt, Human
acaggcuggaagauagcu

SEQ ID NO: 1276126 - RNA, 20 nt, Human
acaggcuggaagauagcugu

SEQ ID NO: 1276127 - RNA, 13 nt, Human
acaggcuccugcc

SEQ ID NO: 1276128 - RNA, 15 nt, Human
acaggcuccugccac

SEQ ID NO: 1276129 - RNA, 21 nt, Human
acaggcuccugccaccacgcc

SEQ ID NO: 1276130 - RNA, 22 nt, Human
acaggcuccugccaccacgccc

SEQ ID NO: 1276131 - RNA, 13 nt, Human
acaggcucuuagc

SEQ ID NO: 1276132 - RNA, 15 nt, Human
acaggcucuuagcag

SEQ ID NO: 1276133 - RNA, 19 nt, Human
acaggcucuuagcagcuuc

SEQ ID NO: 1276134 - RNA, 20 nt, Human
acaggcucuuagcagcuucc

SEQ ID NO: 1276135 - RNA, 21 nt, Human
acagggaggacgcucucuggc

SEQ ID NO: 1276136 - RNA, 20 nt, Human
acagggaggacgcucucugg

SEQ ID NO: 1276137 - RNA, 23 nt, Human
acagggaaggcaggcagggcucu

SEQ ID NO: 1276138 - RNA, 22 nt, Human
acagggaauuaggcccccauca

SEQ ID NO: 1276139 - RNA, 22 nt, Human
acagggaacgugauuagugaaa

SEQ ID NO: 1276140 - RNA, 21 nt, Human
acagggaacgugauuagugaa

SEQ ID NO: 1276141 - RNA, 17 nt, Human
acaggcuucugagcagc

SEQ ID NO: 1276142 - RNA, 18 nt, Human
acaggcuucugagcagcg

SEQ ID NO: 1276143 - RNA, 23 nt, Human
acaggcuucugagcagcgagccu

SEQ ID NO: 1276144 - RNA, 21 nt, Human
acaggcuggaagauagcugug

SEQ ID NO: 1276145 - RNA, 16 nt, Human
acaggcuucugagcag

SEQ ID NO: 1276146 - RNA, 12 nt, Human
acagggaaggca

SEQ ID NO: 1276147 - RNA, 13 nt, Human
acagggaaggcag

SEQ ID NO: 1276148 - RNA, 14 nt, Human
acagggaaggcagg

SEQ ID NO: 1276149 - RNA, 15 nt, Human
acagggaaggcaggc

SEQ ID NO: 1276150 - RNA, 17 nt, Human
acagggaaggcaggcag

SEQ ID NO: 1276151 - RNA, 19 nt, Human
acagggaaggcaggcaggg

SEQ ID NO: 1276152 - RNA, 20 nt, Human
acagggaaggcaggcagggc

SEQ ID NO: 1276153 - RNA, 21 nt, Human
acagggaaggcaggcagggcu

SEQ ID NO: 1276154 - RNA, 22 nt, Human
acagggaaggcaggcagggcuc

SEQ ID NO: 1276155 - RNA, 21 nt, Human
uauucagcucauggacuucug

SEQ ID NO: 1276156 - RNA, 16 nt, Human
uauucaauucuuuuaa

SEQ ID NO: 1276157 - RNA, 15 nt, Human
uauucacaaaauauc

SEQ ID NO: 1276158 - RNA, 14 nt, Human
uauucaauaaagcu

SEQ ID NO: 1276159 - RNA, 17 nt, Human
uauucaauaagagauua

SEQ ID NO: 1276160 - RNA, 13 nt, Human
uauucaauaaagc

SEQ ID NO: 1276161 - RNA, 12 nt, Human
uauucaauaaag

SEQ ID NO: 1276162 - RNA, 14 nt, Human
uauucauaauuauu

SEQ ID NO: 1276163 - RNA, 22 nt, Human
acaggcgugagccaccgugccu

SEQ ID NO: 1276164 - RNA, 15 nt, Human
uauucagugucacug

SEQ ID NO: 1276165 - RNA, 12 nt, Human
acaggcuccugc

SEQ ID NO: 1276166 - RNA, 12 nt, Human
acaggcucaggc

SEQ ID NO: 1276167 - RNA, 14 nt, Human
acaggcucaggcag

SEQ ID NO: 1276168 - RNA, 15 nt, Human
acaggcucaggcagg

SEQ ID NO: 1276169 - RNA, 16 nt, Human
acaggcucaggcaggg

SEQ ID NO: 1276170 - RNA, 19 nt, Human
acaggcgugagccaccucg

SEQ ID NO: 1276171 - RNA, 20 nt, Human
acaggcgugagccaccucgc

SEQ ID NO: 1276172 - RNA, 20 nt, Human
acaggcucaaacaaugacaa

SEQ ID NO: 1276173 - RNA, 19 nt, Human
uauucagcuuuaguagaua

SEQ ID NO: 1276174 - RNA, 23 nt, Human
uauucaaaaauuaucuauagcua

SEQ ID NO: 1276175 - RNA, 21 nt, Human
uauuagugaccucagcuuuga

SEQ ID NO: 1276176 - RNA, 19 nt, Human
uauuagugaccucagcuuu

SEQ ID NO: 1276177 - RNA, 19 nt, Human
uauuaguauuguuguccuu

SEQ ID NO: 1276178 - RNA, 20 nt, Human
uauuaguauuguuguccuuu

SEQ ID NO: 1276179 - RNA, 21 nt, Human
uauuaguauuguuguccuuuu

SEQ ID NO: 1276180 - RNA, 15 nt, Human
uauuagaauaccaca

SEQ ID NO: 1276181 - RNA, 19 nt, Human
uauuacuuguaaauauaaa

SEQ ID NO: 1276182 - RNA, 21 nt, Human
uauuacuuguaaauauaaaga

SEQ ID NO: 1276183 - RNA, 23 nt, Human
uauuacuuguaaauauaaagacg

SEQ ID NO: 1276184 - RNA, 22 nt, Human
uauuacuuguaaauauaaagac

SEQ ID NO: 1276185 - RNA, 17 nt, Human
uauuaggugcaauuuca

SEQ ID NO: 1276186 - RNA, 21 nt, Human
uauuaggugcaauuucaaggu

SEQ ID NO: 1276187 - RNA, 13 nt, Human
uauuaguauuguu

SEQ ID NO: 1276188 - RNA, 15 nt, Human
uauuaguauuguugu

SEQ ID NO: 1276189 - RNA, 16 nt, Human
uauuaguauuguuguc

SEQ ID NO: 1276190 - RNA, 17 nt, Human
uauuaguauuguugucc

SEQ ID NO: 1276191 - RNA, 14 nt, Human
uauuacuguaagaa

SEQ ID NO: 1276192 - RNA, 16 nt, Human
uauuacgguuugcccc

SEQ ID NO: 1276193 - RNA, 16 nt, Human
uauuacguaugucugg

SEQ ID NO: 1276194 - RNA, 22 nt, Human
uauuacguaugucugguucuca

SEQ ID NO: 1276195 - RNA, 12 nt, Human
uauuaaaaugua

SEQ ID NO: 1276196 - RNA, 13 nt, Human
uauuaaaauguau

SEQ ID NO: 1276197 - RNA, 16 nt, Human
uauuaaaauguaugca

SEQ ID NO: 1276198 - RNA, 23 nt, Human
uauuacuuauuuuugacaguguu

SEQ ID NO: 1276199 - RNA, 18 nt, Human
uauuacuuguaaauauaa

SEQ ID NO: 1276200 - RNA, 15 nt, Human
uauaaguguguguuu

SEQ ID NO: 1276201 - RNA, 16 nt, Human
uauaacuuuaacuucu

SEQ ID NO: 1276202 - RNA, 17 nt, Human
uauaacuuuaacuucug

SEQ ID NO: 1276203 - RNA, 13 nt, Human
acacuaagagaga

SEQ ID NO: 1276204 - RNA, 14 nt, Human
acacuaagagagaa

SEQ ID NO: 1276205 - RNA, 23 nt, Human
acaccuuuuauugacacagaaaa

SEQ ID NO: 1276206 - RNA, 21 nt, Human
acaccuuuuauugacacagaa

SEQ ID NO: 1276207 - RNA, 22 nt, Human
acaccuuggacauccuccuccc

SEQ ID NO: 1276208 - RNA, 15 nt, Human
acaccuuuagguucu

SEQ ID NO: 1276209 - RNA, 16 nt, Human
acaccuuuagguucuu

SEQ ID NO: 1276210 - RNA, 21 nt, Human
acaccuuagccugcccuccuu

SEQ ID NO: 1276211 - RNA, 20 nt, Human
acaccuguagcacuuacugg

SEQ ID NO: 1276212 - RNA, 14 nt, Human
acaccuuccagcuc

SEQ ID NO: 1276213 - RNA, 16 nt, Human
acaccuuccagcuccu

SEQ ID NO: 1276214 - RNA, 20 nt, Human
acaccuuccagcuccuguaa

SEQ ID NO: 1276215 - RNA, 23 nt, Human
acaccuuggacauccuccuccca

SEQ ID NO: 1276216 - RNA, 14 nt, Human
acaccgggccugga

SEQ ID NO: 1276217 - RNA, 17 nt, Human
acacccuucucccacuc

SEQ ID NO: 1276218 - RNA, 21 nt, Human
acacccuucucccacucuccu

SEQ ID NO: 1276219 - RNA, 22 nt, Human
acacccuucucccacucuccua

SEQ ID NO: 1276220 - RNA, 16 nt, Human
acaccgggccuggaga

SEQ ID NO: 1276221 - RNA, 16 nt, Human
acaccucuuggggagu

SEQ ID NO: 1276222 - RNA, 13 nt, Human
acacccucacacu

SEQ ID NO: 1276223 - RNA, 14 nt, Human
acacccuccagaga

SEQ ID NO: 1276224 - RNA, 16 nt, Human
acacccucacacuggg

SEQ ID NO: 1276225 - RNA, 20 nt, Human
acacccaaagagguauuuau

SEQ ID NO: 1276226 - RNA, 19 nt, Human
acacccaaagagguauuua

SEQ ID NO: 1276227 - RNA, 16 nt, Human
acaccaugauuccuuu

SEQ ID NO: 1276228 - RNA, 18 nt, Human
acaccaugauuccuuuaa

SEQ ID NO: 1276229 - RNA, 17 nt, Human
acaccauugaaggcuua

SEQ ID NO: 1276230 - RNA, 20 nt, Human
acaccaugauuccuuuaaca

SEQ ID NO: 1276231 - RNA, 15 nt, Human
acacaucacagauga

SEQ ID NO: 1276232 - RNA, 17 nt, Human
acaccauagguagaaug

SEQ ID NO: 1276233 - RNA, 21 nt, Human
acaccauagguagaauguaaa

SEQ ID NO: 1276234 - RNA, 15 nt, Human
acaccaugauuccuu

SEQ ID NO: 1276235 - RNA, 18 nt, Human
acacaugauccugcaauu

SEQ ID NO: 1276236 - RNA, 15 nt, Human
acacaugaaguccaa

SEQ ID NO: 1276237 - RNA, 22 nt, Human
uauaaaagggacugagaaauuu

SEQ ID NO: 1276238 - RNA, 20 nt, Human
uauaaaaauaaaaaacacug

SEQ ID NO: 1276239 - RNA, 20 nt, Human
uauaaaagccuguuuaagag

SEQ ID NO: 1276240 - RNA, 19 nt, Human
uauaaaaauaaaaaacacu

SEQ ID NO: 1276241 - RNA, 22 nt, Human
acacauacucauuuuucaugau

SEQ ID NO: 1276242 - RNA, 19 nt, Human
acacauacucauuuuucau

SEQ ID NO: 1276243 - RNA, 15 nt, Human
uaguucauguaaaua

SEQ ID NO: 1276244 - RNA, 16 nt, Human
uaguucauguaaauaa

SEQ ID NO: 1276245 - RNA, 21 nt, Human
uaguucauguaaauaauacau

SEQ ID NO: 1276246 - RNA, 22 nt, Human
uaguucauguaaauaauacauu

SEQ ID NO: 1276247 - RNA, 14 nt, Human
uaguuccacugaga

SEQ ID NO: 1276248 - RNA, 15 nt, Human
uaguuccacugagac

SEQ ID NO: 1276249 - RNA, 22 nt, Human
uaguuaccuuauaguuacugug

SEQ ID NO: 1276250 - RNA, 23 nt, Human
uaguuaccuuauaguuacugugu

SEQ ID NO: 1276251 - RNA, 14 nt, Human
uaguucauguaaau

SEQ ID NO: 1276252 - RNA, 16 nt, Human
uaguuccccuguuuau

SEQ ID NO: 1276253 - RNA, 15 nt, Human
uaguuccccuguuua

SEQ ID NO: 1276254 - RNA, 17 nt, Human
uaguucaugucugcuau

SEQ ID NO: 1276255 - RNA, 18 nt, Human
uaguuccacuuauagccu

SEQ ID NO: 1276256 - RNA, 20 nt, Human
uaguuccacuuauagccucu

SEQ ID NO: 1276257 - RNA, 18 nt, Human
uaguuuuuucuuccuuuu

SEQ ID NO: 1276258 - RNA, 20 nt, Human
uaguuuuuucuuccuuuuca

SEQ ID NO: 1276259 - RNA, 23 nt, Human
uaguuuuuucuuccuuuucacug

SEQ ID NO: 1276260 - RNA, 14 nt, Human
uauaaaaaaugguu

SEQ ID NO: 1276261 - RNA, 15 nt, Human
uauaaaaaaugguuc

SEQ ID NO: 1276262 - RNA, 16 nt, Human
uauaaaaaaugguuca

SEQ ID NO: 1276263 - RNA, 21 nt, Human
uauaaaaaaugguucagaauu

SEQ ID NO: 1276264 - RNA, 17 nt, Human
uauaaaaaaugguucag

SEQ ID NO: 1276265 - RNA, 18 nt, Human
uauaaaaagcuuccauga

SEQ ID NO: 1276266 - RNA, 20 nt, Human
acacaccaccacgccuggcu

SEQ ID NO: 1276267 - RNA, 17 nt, Human
acacaccaccacgccug

SEQ ID NO: 1276268 - RNA, 20 nt, Human
acacacuaccgaaugugucu

SEQ ID NO: 1276269 - RNA, 13 nt, Human
acacacugaugcu

SEQ ID NO: 1276270 - RNA, 16 nt, Human
acacacggugccuuua

SEQ ID NO: 1276271 - RNA, 23 nt, Human
acacacggugccuuuauuuccac

SEQ ID NO: 1276272 - RNA, 22 nt, Human
acacacuaccgaaugugucuuu

SEQ ID NO: 1276273 - RNA, 22 nt, Human
acaauguccuaacugaaagaug

SEQ ID NO: 1276274 - RNA, 16 nt, Human
acaauggaccggagag

SEQ ID NO: 1276275 - RNA, 23 nt, Human
acaauggaccggagagugggggu

SEQ ID NO: 1276276 - RNA, 22 nt, Human
acacacaaauuaucuuaaaacu

SEQ ID NO: 1276277 - RNA, 14 nt, Human
acacaaugugucug

SEQ ID NO: 1276278 - RNA, 19 nt, Human
acaauggauaggcacagga

SEQ ID NO: 1276279 - RNA, 22 nt, Human
acaaugcuguauuuuaaaagaa

SEQ ID NO: 1276280 - RNA, 17 nt, Human
uagggagccauuugaga

SEQ ID NO: 1276281 - RNA, 12 nt, Human
uagggagccaug

SEQ ID NO: 1276282 - RNA, 18 nt, Human
uagggagggcggcagggg

SEQ ID NO: 1276283 - RNA, 22 nt, Human
uagugaaacucguuaauuugua

SEQ ID NO: 1276284 - RNA, 21 nt, Human
uagugaaaggaagauaaacgu

SEQ ID NO: 1276285 - RNA, 14 nt, Human
uagugaacuugaaa

SEQ ID NO: 1276286 - RNA, 19 nt, Human
uagugaaggcuucucucug

SEQ ID NO: 1276287 - RNA, 14 nt, Human
uaguacuaacuccu

SEQ ID NO: 1276288 - RNA, 20 nt, Human
uaguaccuuuuauaucccau

SEQ ID NO: 1276289 - RNA, 22 nt, Human
uaguccagcuuuguucuucuua

SEQ ID NO: 1276290 - RNA, 23 nt, Human
uaguccagcuuuguucuucuuaa

SEQ ID NO: 1276291 - RNA, 18 nt, Human
uagucccucaugcaaauc

SEQ ID NO: 1276292 - RNA, 23 nt, Human
uaguguuggagaagaacugaaau

SEQ ID NO: 1276293 - RNA, 18 nt, Human
uagugaauacugcuacag

SEQ ID NO: 1276294 - RNA, 21 nt, Human
uagugaaggcuucucucugug

SEQ ID NO: 1276295 - RNA, 15 nt, Human
uagugacccacaugc

SEQ ID NO: 1276296 - RNA, 14 nt, Human
uaguuaacacacua

SEQ ID NO: 1276297 - RNA, 14 nt, Human
uaguuaagacauga

SEQ ID NO: 1276298 - RNA, 19 nt, Human
uaguuaagacaugauuucc

SEQ ID NO: 1276299 - RNA, 21 nt, Human
uaguuaagacaugauuuccuu

SEQ ID NO: 1276300 - RNA, 23 nt, Human
uaguuaagacaugauuuccuuga

SEQ ID NO: 1276301 - RNA, 20 nt, Human
uaguuaacacacuaccgaau

SEQ ID NO: 1276302 - RNA, 16 nt, Human
uaguuaaucaucaaga

SEQ ID NO: 1276303 - RNA, 20 nt, Human
uaguuaaucaucaagagaau

SEQ ID NO: 1276304 - RNA, 12 nt, Human
uaguuaccuuau

SEQ ID NO: 1276305 - RNA, 14 nt, Human
uaguuaccuuauag

SEQ ID NO: 1276306 - RNA, 17 nt, Human
uaguuaccuuauaguua

SEQ ID NO: 1276307 - RNA, 18 nt, Human
uaguuaccuuauaguuac

SEQ ID NO: 1276308 - RNA, 19 nt, Human
uaguuaccuuauaguuacu

SEQ ID NO: 1276309 - RNA, 21 nt, Human
uaguuaccuuauaguuacugu

SEQ ID NO: 1276310 - RNA, 14 nt, Human
acacacuuacuuuu

SEQ ID NO: 1276311 - RNA, 15 nt, Human
acacacugaugcuua

SEQ ID NO: 1276312 - RNA, 17 nt, Human
acacacugaugcuuaga

SEQ ID NO: 1276313 - RNA, 22 nt, Human
acacagugcugaccagacagcc

SEQ ID NO: 1276314 - RNA, 15 nt, Human
acacaguuccuggga

SEQ ID NO: 1276315 - RNA, 16 nt, Human
acacaguuccugggaa

SEQ ID NO: 1276316 - RNA, 18 nt, Human
acacaguuccugggaaca

SEQ ID NO: 1276317 - RNA, 15 nt, Human
acacauacccucuuc

SEQ ID NO: 1276318 - RNA, 11 nt, Human
uaguaaaccaa

SEQ ID NO: 1276319 - RNA, 12 nt, Human
uaguaaaccaau

SEQ ID NO: 1276320 - RNA, 22 nt, Human
uaguaaaccaauccuaugcaug

SEQ ID NO: 1276321 - RNA, 17 nt, Human
uaguaaaccaauccuau

SEQ ID NO: 1276322 - RNA, 17 nt, Human
uaguaaagucaaggaga

SEQ ID NO: 1276323 - RNA, 14 nt, Human
uaguaaauaaugcu

SEQ ID NO: 1276324 - RNA, 15 nt, Human
uaguaaauaaugcuu

SEQ ID NO: 1276325 - RNA, 16 nt, Human
uaguaaauaaugcuuu

SEQ ID NO: 1276326 - RNA, 17 nt, Human
uaguaaauaaugcuuug

SEQ ID NO: 1276327 - RNA, 19 nt, Human
uaguaaauaaugcuuugaa

SEQ ID NO: 1276328 - RNA, 18 nt, Human
uaguaaaucacgcuuuuu

SEQ ID NO: 1276329 - RNA, 21 nt, Human
uaguaaaucacgcuuuuugaa

SEQ ID NO: 1276330 - RNA, 22 nt, Human
uaguaaaucacgcuuuuugaaa

SEQ ID NO: 1276331 - RNA, 14 nt, Human
uaguaacacuaaua

SEQ ID NO: 1276332 - RNA, 15 nt, Human
uaguaacacuaauau

SEQ ID NO: 1276333 - RNA, 22 nt, Human
uaguaacacuaauauauuuaaa

SEQ ID NO: 1276334 - RNA, 18 nt, Human
uaguaacuucuuauggaa

SEQ ID NO: 1276335 - RNA, 19 nt, Human
uaguaacuucuuauggaau

SEQ ID NO: 1276336 - RNA, 16 nt, Human
uaguacaaaguuucaa

SEQ ID NO: 1276337 - RNA, 17 nt, Human
uaguacaaaguuucaau

SEQ ID NO: 1276338 - RNA, 14 nt, Human
uaguaccaaaauaa

SEQ ID NO: 1276339 - RNA, 16 nt, Human
uaguaccaaucauuuu

SEQ ID NO: 1276340 - RNA, 23 nt, Human
uaguaccaaucauuuuaauuauu

SEQ ID NO: 1276341 - RNA, 19 nt, Human
uaggaaauauuuauuuuaa

SEQ ID NO: 1276342 - RNA, 16 nt, Human
uaggaaauccagggug

SEQ ID NO: 1276343 - RNA, 20 nt, Human
uaggaaaucuagaaguaguc

SEQ ID NO: 1276344 - RNA, 21 nt, Human
uaggaccuuuccaccacagcc

SEQ ID NO: 1276345 - RNA, 22 nt, Human
uaggaccuuuccaccacagcca

SEQ ID NO: 1276346 - RNA, 18 nt, Human
uaggaaauauuuauuuua

SEQ ID NO: 1276347 - RNA, 13 nt, Human
uagcugugggggu

SEQ ID NO: 1276348 - RNA, 14 nt, Human
uagcugugggggug

SEQ ID NO: 1276349 - RNA, 22 nt, Human
uagcugugugaauaccugcuca

SEQ ID NO: 1276350 - RNA, 17 nt, Human
uaggagaaccaaaucug

SEQ ID NO: 1276351 - RNA, 20 nt, Human
uaggagaaccaaaucuggaa

SEQ ID NO: 1276352 - RNA, 12 nt, Human
uaggagaagcca

SEQ ID NO: 1276353 - RNA, 15 nt, Human
uaggagaagccagga

SEQ ID NO: 1276354 - RNA, 16 nt, Human
uaggagaagccaggaa

SEQ ID NO: 1276355 - RNA, 14 nt, Human
uaggagagaaggua

SEQ ID NO: 1276356 - RNA, 17 nt, Human
uaggagcaaagccuguu

SEQ ID NO: 1276357 - RNA, 16 nt, Human
uaggagcaaagccugu

SEQ ID NO: 1276358 - RNA, 13 nt, Human
uaggagcuaaggc

SEQ ID NO: 1276359 - RNA, 14 nt, Human
uaggagcuaaggcu

SEQ ID NO: 1276360 - RNA, 17 nt, Human
uaggagcuaaggcucua

SEQ ID NO: 1276361 - RNA, 16 nt, Human
uaggagcuaaggcucu

SEQ ID NO: 1276362 - RNA, 19 nt, Human
uaggagcuuugacucagga

SEQ ID NO: 1276363 - RNA, 20 nt, Human
uaggaggaccagagcuacug

SEQ ID NO: 1276364 - RNA, 22 nt, Human
uaggcagacucuuuaugcuugc

SEQ ID NO: 1276365 - RNA, 23 nt, Human
uaggagcuuugacucaggagccu

SEQ ID NO: 1276366 - RNA, 12 nt, Human
uaggagggacug

SEQ ID NO: 1276367 - RNA, 14 nt, Human
uaggagggacuguc

SEQ ID NO: 1276368 - RNA, 14 nt, Human
uaggagggagacac

SEQ ID NO: 1276369 - RNA, 23 nt, Human
uaggagggacugucgcugcuucg

SEQ ID NO: 1276370 - RNA, 16 nt, Human
uaggagggugggaagg

SEQ ID NO: 1276371 - RNA, 13 nt, Human
uaggaggguccuc

SEQ ID NO: 1276372 - RNA, 18 nt, Human
uaggcacuguaguucuaa

SEQ ID NO: 1276373 - RNA, 19 nt, Human
uaggcacuguaguucuaag

SEQ ID NO: 1276374 - RNA, 20 nt, Human
uaggcacuguaguucuaaga

SEQ ID NO: 1276375 - RNA, 22 nt, Human
uaggcacuguaguucuaagacu

SEQ ID NO: 1276376 - RNA, 21 nt, Human
uaggcacuguaguucuaagac

SEQ ID NO: 1276377 - RNA, 22 nt, Human
uaggcaggaagcccaauugcug

SEQ ID NO: 1276378 - RNA, 12 nt, Human
uaggcauuuccu

SEQ ID NO: 1276379 - RNA, 19 nt, Human
uaggcauuuuuaccaucac

SEQ ID NO: 1276380 - RNA, 21 nt, Human
uaggcauuuuuaccaucacug

SEQ ID NO: 1276381 - RNA, 14 nt, Human
uagggaagggccug

SEQ ID NO: 1276382 - RNA, 14 nt, Human
uagggacugaccag

SEQ ID NO: 1276383 - RNA, 15 nt, Human
uagggacugaccagc

SEQ ID NO: 1276384 - RNA, 17 nt, Human
uagggacugaccagcag

SEQ ID NO: 1276385 - RNA, 13 nt, Human
acaagacugcaca

SEQ ID NO: 1276386 - RNA, 14 nt, Human
acaagacugcacau

SEQ ID NO: 1276387 - RNA, 15 nt, Human
acaagacccccagca

SEQ ID NO: 1276388 - RNA, 22 nt, Human
acaagacugacgccaggguaug

SEQ ID NO: 1276389 - RNA, 14 nt, Human
acaagagaaaaagc

SEQ ID NO: 1276390 - RNA, 14 nt, Human
acaagagaagcauu

SEQ ID NO: 1276391 - RNA, 15 nt, Human
acaagagaagcauuc

SEQ ID NO: 1276392 - RNA, 17 nt, Human
acaagagaagcauucuc

SEQ ID NO: 1276393 - RNA, 22 nt, Human
acaaggacagccccuccuccau

SEQ ID NO: 1276394 - RNA, 21 nt, Human
acaaggacagccccuccucca

SEQ ID NO: 1276395 - RNA, 18 nt, Human
acaaggacuaggguccug

SEQ ID NO: 1276396 - RNA, 19 nt, Human
acaaggacuaggguccugg

SEQ ID NO: 1276397 - RNA, 15 nt, Human
acaaggacuuccugu

SEQ ID NO: 1276398 - RNA, 16 nt, Human
acaaggauagaugcug

SEQ ID NO: 1276399 - RNA, 17 nt, Human
acaaggauagaugcugg

SEQ ID NO: 1276400 - RNA, 18 nt, Human
acaaggauagaugcuggc

SEQ ID NO: 1276401 - RNA, 21 nt, Human
acaaggauagaugcuggccca

SEQ ID NO: 1276402 - RNA, 22 nt, Human
acaaggauagaugcuggcccag

SEQ ID NO: 1276403 - RNA, 16 nt, Human
acaauaagcaaaaaca

SEQ ID NO: 1276404 - RNA, 15 nt, Human
acaauaagcaaaaac

SEQ ID NO: 1276405 - RNA, 15 nt, Human
acaauaacuccuccc

SEQ ID NO: 1276406 - RNA, 16 nt, Human
acaauaacuccuccca

SEQ ID NO: 1276407 - RNA, 19 nt, Human
acaauaacuccucccaggg

SEQ ID NO: 1276408 - RNA, 13 nt, Human
acaauaaauagac

SEQ ID NO: 1276409 - RNA, 16 nt, Human
acaauaaauggcugua

SEQ ID NO: 1276410 - RNA, 23 nt, Human
acaauacaucccuuaccugggaa

SEQ ID NO: 1276411 - RNA, 14 nt, Human
acaauaauuuucua

SEQ ID NO: 1276412 - RNA, 12 nt, Human
acaauacaaaug

SEQ ID NO: 1276413 - RNA, 13 nt, Human
acaauacaaaugg

SEQ ID NO: 1276414 - RNA, 10 nt, Human
acaauaccug

SEQ ID NO: 1276415 - RNA, 17 nt, Human
acaauacagaucaucuu

SEQ ID NO: 1276416 - RNA, 14 nt, Human
acaauacaaaugga

SEQ ID NO: 1276417 - RNA, 15 nt, Human
acaauacaaauggau

SEQ ID NO: 1276418 - RNA, 16 nt, Human
acaauacaaauggauu

SEQ ID NO: 1276419 - RNA, 20 nt, Human
uagcuacagagaaaccagcu

SEQ ID NO: 1276420 - RNA, 21 nt, Human
uagcuacagagaaaccagcuu

SEQ ID NO: 1276421 - RNA, 22 nt, Human
uagcuacagagaaaccagcuuc

SEQ ID NO: 1276422 - RNA, 23 nt, Human
uagcuacagagaaaccagcuucc

SEQ ID NO: 1276423 - RNA, 24 nt, Human
uagcuacagagaaaccagcuuccu

SEQ ID NO: 1276424 - RNA, 22 nt, Human
uagcuaauaaaaagcuuuuguc

SEQ ID NO: 1276425 - RNA, 11 nt, Human
uagcuacagag

SEQ ID NO: 1276426 - RNA, 12 nt, Human
uagcuacagaga

SEQ ID NO: 1276427 - RNA, 13 nt, Human
uagcuacagagaa

SEQ ID NO: 1276428 - RNA, 14 nt, Human
uagcuacagagaaa

SEQ ID NO: 1276429 - RNA, 17 nt, Human
uagcuacagagaaacca

SEQ ID NO: 1276430 - RNA, 13 nt, Human
uagcugugaccug

SEQ ID NO: 1276431 - RNA, 14 nt, Human
uagcugugaccugc

SEQ ID NO: 1276432 - RNA, 15 nt, Human
uagcugugaccugcu

SEQ ID NO: 1276433 - RNA, 17 nt, Human
uagcugugaccugcuga

SEQ ID NO: 1276434 - RNA, 18 nt, Human
uagcugugaccugcugag

SEQ ID NO: 1276435 - RNA, 19 nt, Human
uagcugugaccugcugagc

SEQ ID NO: 1276436 - RNA, 20 nt, Human
uagcugugaccugcugagcu

SEQ ID NO: 1276437 - RNA, 22 nt, Human
uagcugugaccugcugagcucu

SEQ ID NO: 1276438 - RNA, 24 nt, Human
uagcugugaccugcugagcucuga

SEQ ID NO: 1276439 - RNA, 10 nt, Human
uagcuguggg

SEQ ID NO: 1276440 - RNA, 22 nt, Human
uagcuaaguacacaauaagcaa

SEQ ID NO: 1276441 - RNA, 15 nt, Human
uagcuaaguacacaa

SEQ ID NO: 1276442 - RNA, 20 nt, Human
uagcuaauaaaaagcuuuug

SEQ ID NO: 1276443 - RNA, 21 nt, Human
uagcuaauaaaaagcuuuugu

SEQ ID NO: 1276444 - RNA, 19 nt, Human
uagcuaauaacaugugaaa

SEQ ID NO: 1276445 - RNA, 16 nt, Human
acaaugacauuuauau

SEQ ID NO: 1276446 - RNA, 14 nt, Human
acaaucaugugugu

SEQ ID NO: 1276447 - RNA, 21 nt, Human
acaaucauguguguuaaccca

SEQ ID NO: 1276448 - RNA, 15 nt, Human
acaaucauguguguu

SEQ ID NO: 1276449 - RNA, 21 nt, Human
uagagauuaccuccugagaaa

SEQ ID NO: 1276450 - RNA, 11 nt, Human
uagagcacugc

SEQ ID NO: 1276451 - RNA, 17 nt, Human
uagagauuaccuccuga

SEQ ID NO: 1276452 - RNA, 18 nt, Human
uagagauuaccuccugag

SEQ ID NO: 1276453 - RNA, 19 nt, Human
uagagauuaccuccugaga

SEQ ID NO: 1276454 - RNA, 20 nt, Human
uagauaucaugcaaauuuca

SEQ ID NO: 1276455 - RNA, 19 nt, Human
uagauauccacuugagaca

SEQ ID NO: 1276456 - RNA, 23 nt, Human
uagauaucgacuuguuuuugcac

SEQ ID NO: 1276457 - RNA, 15 nt, Human
uagauaugaaagcug

SEQ ID NO: 1276458 - RNA, 16 nt, Human
uagauauuggacaaag

SEQ ID NO: 1276459 - RNA, 12 nt, Human
uagaugauaaag

SEQ ID NO: 1276460 - RNA, 22 nt, Human
uagaggagaaacuggaacucuc

SEQ ID NO: 1276461 - RNA, 22 nt, Human
uagaggauggucuuacagcagg

SEQ ID NO: 1276462 - RNA, 16 nt, Human
aauuguuacaaauugu

SEQ ID NO: 1276463 - RNA, 13 nt, Human
aauuguucucaga

SEQ ID NO: 1276464 - RNA, 21 nt, Human
aauuguguuuauaauuuuaaa

SEQ ID NO: 1276465 - RNA, 23 nt, Human
aauugccuuuuuucuguauaaau

SEQ ID NO: 1276466 - RNA, 20 nt, Human
aauugccuuuuuucuguaua

SEQ ID NO: 1276467 - RNA, 20 nt, Human
aauuguguuuuaauuguaaa

SEQ ID NO: 1276468 - RNA, 18 nt, Human
acaaaaggauaaugaaua

SEQ ID NO: 1276469 - RNA, 13 nt, Human
acaaagcagccac

SEQ ID NO: 1276470 - RNA, 14 nt, Human
acaaagcagccacg

SEQ ID NO: 1276471 - RNA, 21 nt, Human
acaaagcagaauaguauuuuu

SEQ ID NO: 1276472 - RNA, 11 nt, Human
acaaaggcaag

SEQ ID NO: 1276473 - RNA, 18 nt, Human
acaaaggcuuauuaauuu

SEQ ID NO: 1276474 - RNA, 17 nt, Human
aauuguugagauacuuu

SEQ ID NO: 1276475 - RNA, 23 nt, Human
aauuguugcuaaucuucuuaugc

SEQ ID NO: 1276476 - RNA, 19 nt, Human
acaaagaguucaagaaaua

SEQ ID NO: 1276477 - RNA, 22 nt, Human
acaaagaguucaagaaauaagu

SEQ ID NO: 1276478 - RNA, 21 nt, Human
acaaagaguucaagaaauaag

SEQ ID NO: 1276479 - RNA, 19 nt, Human
acaaagauucucuauguau

SEQ ID NO: 1276480 - RNA, 15 nt, Human
acaaagcaauucuuu

SEQ ID NO: 1276481 - RNA, 12 nt, Human
acaaagcagcca

SEQ ID NO: 1276482 - RNA, 14 nt, Human
uagccaagugcagg

SEQ ID NO: 1276483 - RNA, 18 nt, Human
uagccaauauuuuucuua

SEQ ID NO: 1276484 - RNA, 14 nt, Human
uagccacaccagga

SEQ ID NO: 1276485 - RNA, 15 nt, Human
uagccacaccaggau

SEQ ID NO: 1276486 - RNA, 17 nt, Human
uagccacaccaggauag

SEQ ID NO: 1276487 - RNA, 16 nt, Human
uagccacauuuggaau

SEQ ID NO: 1276488 - RNA, 19 nt, Human
acaaauuuacagagacaga

SEQ ID NO: 1276489 - RNA, 18 nt, Human
uagccagcacacagggca

SEQ ID NO: 1276490 - RNA, 19 nt, Human
uagccagcacacagggcag

SEQ ID NO: 1276491 - RNA, 20 nt, Human
uagccagcacacagggcagu

SEQ ID NO: 1276492 - RNA, 18 nt, Human
acaaauuuacagagacag

SEQ ID NO: 1276493 - RNA, 18 nt, Human
acaaauuuuucugcuuua

SEQ ID NO: 1276494 - RNA, 23 nt, Human
acaaauuuuucugcuuuaaaaau

SEQ ID NO: 1276495 - RNA, 14 nt, Human
acaacacuguagua

SEQ ID NO: 1276496 - RNA, 23 nt, Human
acaacacuguaguaaauaaugcu

SEQ ID NO: 1276497 - RNA, 20 nt, Human
acaagacccaaaaggcagaa

SEQ ID NO: 1276498 - RNA, 18 nt, Human
uagcaugucgucaaagcu

SEQ ID NO: 1276499 - RNA, 17 nt, Human
uagcaugucacuaaagc

SEQ ID NO: 1276500 - RNA, 19 nt, Human
uagcauuuucugcaucucc

SEQ ID NO: 1276501 - RNA, 17 nt, Human
uagcauuuucugcaucu

SEQ ID NO: 1276502 - RNA, 16 nt, Human
uagccaaaaauagcua

SEQ ID NO: 1276503 - RNA, 21 nt, Human
uagccaaaaauagcuaaauac

SEQ ID NO: 1276504 - RNA, 16 nt, Human
uagaugcaguucugaa

SEQ ID NO: 1276505 - RNA, 13 nt, Human
uagaugcuggccc

SEQ ID NO: 1276506 - RNA, 14 nt, Human
uagaugcuggccca

SEQ ID NO: 1276507 - RNA, 15 nt, Human
uagaugcuggcccag

SEQ ID NO: 1276508 - RNA, 23 nt, Human
uagaugcugacuguacuccuccc

SEQ ID NO: 1276509 - RNA, 14 nt, Human
uagaugcugacugu

SEQ ID NO: 1276510 - RNA, 15 nt, Human
uagaugcaguucuga

SEQ ID NO: 1276511 - RNA, 19 nt, Human
uagaugauuaaauaagauu

SEQ ID NO: 1276512 - RNA, 20 nt, Human
uagaugauuaaauaagauuc

SEQ ID NO: 1276513 - RNA, 21 nt, Human
uagaugauuaaauaagauucu

SEQ ID NO: 1276514 - RNA, 23 nt, Human
uagaugauuaaauaagauucuaa

SEQ ID NO: 1276515 - RNA, 22 nt, Human
uagaugauuucaguucuaggaa

SEQ ID NO: 1276516 - RNA, 18 nt, Human
uagaugauuucaguucua

SEQ ID NO: 1276517 - RNA, 16 nt, Human
uagaugcuggcccagg

SEQ ID NO: 1276518 - RNA, 18 nt, Human
uagaugcuggcccagggc

SEQ ID NO: 1276519 - RNA, 21 nt, Human
uagaugcuggcccagggccca

SEQ ID NO: 1276520 - RNA, 22 nt, Human
uagaugcuggcccagggcccag

SEQ ID NO: 1276521 - RNA, 17 nt, Human
guguaacaauuguguag

SEQ ID NO: 1276522 - RNA, 19 nt, Human
guguaacaauuguguagcc

SEQ ID NO: 1276523 - RNA, 23 nt, Human
guguaacaauuguguagccuuuu

SEQ ID NO: 1276524 - RNA, 20 nt, Human
guguaacugcccaaagcagc

SEQ ID NO: 1276525 - RNA, 17 nt, Human
gugguuuauauauuuaa

SEQ ID NO: 1276526 - RNA, 18 nt, Human
gugguuuaggcuauuugu

SEQ ID NO: 1276527 - RNA, 19 nt, Human
gugguuuucuuuugccaug

SEQ ID NO: 1276528 - RNA, 17 nt, Human
guguaaaauauuuugaa

SEQ ID NO: 1276529 - RNA, 18 nt, Human
guguaaaauauuuugaau

SEQ ID NO: 1276530 - RNA, 19 nt, Human
guguaaaauauuuugaauc

SEQ ID NO: 1276531 - RNA, 16 nt, Human
gugcucucuuucuguc

SEQ ID NO: 1276532 - RNA, 18 nt, Human
gugcugccgcgcagugug

SEQ ID NO: 1276533 - RNA, 22 nt, Human
gugcucuccauucugcuccuuc

SEQ ID NO: 1276534 - RNA, 13 nt, Human
gugcucucuuucu

SEQ ID NO: 1276535 - RNA, 11 nt, Human
gugcugccucu

SEQ ID NO: 1276536 - RNA, 12 nt, Human
gugcugccucua

SEQ ID NO: 1276537 - RNA, 19 nt, Human
gugcugccucuaccugaca

SEQ ID NO: 1276538 - RNA, 20 nt, Human
gugguucugagauggcuccc

SEQ ID NO: 1276539 - RNA, 18 nt, Human
guguaagaaauacagacu

SEQ ID NO: 1276540 - RNA, 19 nt, Human
guguaacugcccaaagcag

SEQ ID NO: 1276541 - RNA, 15 nt, Human
aagaggcaccugucc

SEQ ID NO: 1276542 - RNA, 18 nt, Human
aagaggcaccugucccag

SEQ ID NO: 1276543 - RNA, 18 nt, Human
aagaggcaccaggaagcc

SEQ ID NO: 1276544 - RNA, 18 nt, Human
aagaggccguggcugcug

SEQ ID NO: 1276545 - RNA, 17 nt, Human
aagaggcugcccuccug

SEQ ID NO: 1276546 - RNA, 16 nt, Human
aagagggacgccuggg

SEQ ID NO: 1276547 - RNA, 17 nt, Human
aagagggacgccugggg

SEQ ID NO: 1276548 - RNA, 13 nt, Human
aagagguguuauu

SEQ ID NO: 1276549 - RNA, 21 nt, Human
aagaggugaccccagggcaca

SEQ ID NO: 1276550 - RNA, 22 nt, Human
aagaggugaccccagggcacag

SEQ ID NO: 1276551 - RNA, 24 nt, Human
aagaggugaccccagggcacagga

SEQ ID NO: 1276552 - RNA, 21 nt, Human
aagagguauuuaucuuuacuu

SEQ ID NO: 1276553 - RNA, 16 nt, Human
aagaggugaccccagg

SEQ ID NO: 1276554 - RNA, 17 nt, Human
aagaggugaccccaggg

SEQ ID NO: 1276555 - RNA, 18 nt, Human
aagaggugaccccagggc

SEQ ID NO: 1276556 - RNA, 19 nt, Human
aagaggugaccccagggca

SEQ ID NO: 1276557 - RNA, 20 nt, Human
aagaggugaccccagggcac

SEQ ID NO: 1276558 - RNA, 15 nt, Human
aagagguguuauuug

SEQ ID NO: 1276559 - RNA, 15 nt, Human
aagauagcugugacu

SEQ ID NO: 1276560 - RNA, 14 nt, Human
aagauagcugugac

SEQ ID NO: 1276561 - RNA, 15 nt, Human
aagcaaccucaguaa

SEQ ID NO: 1276562 - RNA, 16 nt, Human
guguaugugugugugu

SEQ ID NO: 1276563 - RNA, 13 nt, Human
guguauuccaaga

SEQ ID NO: 1276564 - RNA, 20 nt, Human
guguauuccaagacaugucu

SEQ ID NO: 1276565 - RNA, 14 nt, Human
gugucaccugugcu

SEQ ID NO: 1276566 - RNA, 15 nt, Human
gugucacucaaggcg

SEQ ID NO: 1276567 - RNA, 21 nt, Human
gugucacucaaggcggugcuu

SEQ ID NO: 1276568 - RNA, 14 nt, Human
gugucuuaauuauu

SEQ ID NO: 1276569 - RNA, 15 nt, Human
gugucuuaauuauua

SEQ ID NO: 1276570 - RNA, 19 nt, Human
gugucuuaauuauuauuug

SEQ ID NO: 1276571 - RNA, 17 nt, Human
aagauauuuuuaucuuu

SEQ ID NO: 1276572 - RNA, 19 nt, Human
aagauauuuuuaucuuuau

SEQ ID NO: 1276573 - RNA, 15 nt, Human
aagauauuuuucaug

SEQ ID NO: 1276574 - RNA, 17 nt, Human
aagauauuuuucaugau

SEQ ID NO: 1276575 - RNA, 13 nt, Human
aagauauuuuucc

SEQ ID NO: 1276576 - RNA, 16 nt, Human
aagauggaguuucuaa

SEQ ID NO: 1276577 - RNA, 17 nt, Human
aagauggaguuucuaag

SEQ ID NO: 1276578 - RNA, 16 nt, Human
aagauggcugugccuc

SEQ ID NO: 1276579 - RNA, 15 nt, Human
aagauggcccauccu

SEQ ID NO: 1276580 - RNA, 18 nt, Human
aagauggcugugccucug

SEQ ID NO: 1276581 - RNA, 18 nt, Human
aagauuuuuguuuguuua

SEQ ID NO: 1276582 - RNA, 13 nt, Human
aagauuuuuuaau

SEQ ID NO: 1276583 - RNA, 18 nt, Human
aagauggaguuucuaagg

SEQ ID NO: 1276584 - RNA, 20 nt, Human
aagauggaguuucuaagguc

SEQ ID NO: 1276585 - RNA, 19 nt, Human
aagauggcauaaccugucu

SEQ ID NO: 1276586 - RNA, 17 nt, Human
aagcaacccaaauguuc

SEQ ID NO: 1276587 - RNA, 16 nt, Human
aagcaacacuuuuuau

SEQ ID NO: 1276588 - RNA, 13 nt, Human
aagcaacauggcu

SEQ ID NO: 1276589 - RNA, 14 nt, Human
aagcaacauggcuu

SEQ ID NO: 1276590 - RNA, 15 nt, Human
aagcaacauggcuuu

SEQ ID NO: 1276591 - RNA, 20 nt, Human
aagcaacauucauagucuuu

SEQ ID NO: 1276592 - RNA, 13 nt, Human
aagcaaaauguga

SEQ ID NO: 1276593 - RNA, 17 nt, Human
aagauuuuuuaauaauu

SEQ ID NO: 1276594 - RNA, 14 nt, Human
aagauuuuuuaaua

SEQ ID NO: 1276595 - RNA, 16 nt, Human
aagauuuuuuaauaau

SEQ ID NO: 1276596 - RNA, 15 nt, Human
aagcaaaaaagaaaa

SEQ ID NO: 1276597 - RNA, 23 nt, Human
aagauuuuuuuuuuuucucucaa

SEQ ID NO: 1276598 - RNA, 12 nt, Human
guguuugaagca

SEQ ID NO: 1276599 - RNA, 14 nt, Human
guguuucuugccuc

SEQ ID NO: 1276600 - RNA, 15 nt, Human
guguuucuugccuca

SEQ ID NO: 1276601 - RNA, 13 nt, Human
guguuugcuuucu

SEQ ID NO: 1276602 - RNA, 13 nt, Human
gugugaaugaaca

SEQ ID NO: 1276603 - RNA, 13 nt, Human
guguuucugacuc

SEQ ID NO: 1276604 - RNA, 18 nt, Human
guguuucuguaagaaacc

SEQ ID NO: 1276605 - RNA, 16 nt, Human
guguuucuugccucau

SEQ ID NO: 1276606 - RNA, 11 nt, Human
aagcacagcag

SEQ ID NO: 1276607 - RNA, 16 nt, Human
aagcacagcagccugg

SEQ ID NO: 1276608 - RNA, 13 nt, Human
aagcacagcccuu

SEQ ID NO: 1276609 - RNA, 16 nt, Human
aagcacuaaacaaaga

SEQ ID NO: 1276610 - RNA, 13 nt, Human
aagcaccuguaau

SEQ ID NO: 1276611 - RNA, 16 nt, Human
aagcaccuuagcuggc

SEQ ID NO: 1276612 - RNA, 19 nt, Human
aagcaccuuagcuggcauu

SEQ ID NO: 1276613 - RNA, 15 nt, Human
aagcacgaaauguua

SEQ ID NO: 1276614 - RNA, 21 nt, Human
aagcacgugguaaaacacuug

SEQ ID NO: 1276615 - RNA, 22 nt, Human
aagcacugacugggaccaggca

SEQ ID NO: 1276616 - RNA, 18 nt, Human
aagcacauuuuaaaagug

SEQ ID NO: 1276617 - RNA, 18 nt, Human
aagccaagggaaccugug

SEQ ID NO: 1276618 - RNA, 19 nt, Human
aagccaagggaaccugugu

SEQ ID NO: 1276619 - RNA, 20 nt, Human
aagccaagggaaccuguguc

SEQ ID NO: 1276620 - RNA, 23 nt, Human
aagcauuuaaccccccuguacac

SEQ ID NO: 1276621 - RNA, 22 nt, Human
aagcauuuaaccccccuguaca

SEQ ID NO: 1276622 - RNA, 21 nt, Human
aagcauuuaaccccccuguac

SEQ ID NO: 1276623 - RNA, 19 nt, Human
aagcauuuguuucuacuuu

SEQ ID NO: 1276624 - RNA, 23 nt, Human
aagcauuuguuucuacuuugaua

SEQ ID NO: 1276625 - RNA, 12 nt, Human
aagcauuuugua

SEQ ID NO: 1276626 - RNA, 13 nt, Human
aagcauuuuguaa

SEQ ID NO: 1276627 - RNA, 23 nt, Human
aagcauuuuguaaguugaagcaa

SEQ ID NO: 1276628 - RNA, 19 nt, Human
aagcauuuuguaaguugaa

SEQ ID NO: 1276629 - RNA, 12 nt, Human
aagccaaagagu

SEQ ID NO: 1276630 - RNA, 13 nt, Human
aagcaucagaaag

SEQ ID NO: 1276631 - RNA, 14 nt, Human
aagcaucauuauuu

SEQ ID NO: 1276632 - RNA, 15 nt, Human
aagcaucauuauuua

SEQ ID NO: 1276633 - RNA, 17 nt, Human
aagcaucauuauuuaug

SEQ ID NO: 1276634 - RNA, 19 nt, Human
aagcaucauuauuuaugua

SEQ ID NO: 1276635 - RNA, 18 nt, Human
aagcaucauuauuuaugu

SEQ ID NO: 1276636 - RNA, 14 nt, Human
aagcaucuugcauu

SEQ ID NO: 1276637 - RNA, 12 nt, Human
aagcaugaaaug

SEQ ID NO: 1276638 - RNA, 23 nt, Human
aagcaugcacaaauucugucucu

SEQ ID NO: 1276639 - RNA, 20 nt, Human
aagcaucuuggggggguggc

SEQ ID NO: 1276640 - RNA, 15 nt, Human
aagcauggcuauuuu

SEQ ID NO: 1276641 - RNA, 23 nt, Human
aagcauggcuugaauaaggaaau

SEQ ID NO: 1276642 - RNA, 17 nt, Human
aagcaugggauuauuag

SEQ ID NO: 1276643 - RNA, 17 nt, Human
aagcauggucccacauc

SEQ ID NO: 1276644 - RNA, 22 nt, Human
aagcauggucccacaucccugg

SEQ ID NO: 1276645 - RNA, 23 nt, Human
aagcauggucccacaucccuggg

SEQ ID NO: 1276646 - RNA, 18 nt, Human
aagcauguauucagcuuu

SEQ ID NO: 1276647 - RNA, 21 nt, Human
aagccuuggggcugaugcagu

SEQ ID NO: 1276648 - RNA, 12 nt, Human
aagccuuccccu

SEQ ID NO: 1276649 - RNA, 20 nt, Human
aagccuuccccuuauccucc

SEQ ID NO: 1276650 - RNA, 21 nt, Human
aagccuuccccuuauccuccc

SEQ ID NO: 1276651 - RNA, 22 nt, Human
aagccuuccccuuauccucccu

SEQ ID NO: 1276652 - RNA, 13 nt, Human
aagccuucaagcu

SEQ ID NO: 1276653 - RNA, 14 nt, Human
aagccuucaagcuc

SEQ ID NO: 1276654 - RNA, 16 nt, Human
aagccuucaagcucug

SEQ ID NO: 1276655 - RNA, 18 nt, Human
aagccuucaagcucugag

SEQ ID NO: 1276656 - RNA, 21 nt, Human
aagccuucaagcucugaggga

SEQ ID NO: 1276657 - RNA, 20 nt, Human
aagccuugauugguguugcc

SEQ ID NO: 1276658 - RNA, 23 nt, Human
aagccuugauugguguugccagu

SEQ ID NO: 1276659 - RNA, 21 nt, Human
aagcuaggugcuauuugucau

SEQ ID NO: 1276660 - RNA, 23 nt, Human
aagcuaggugcuauuugucaucu

SEQ ID NO: 1276661 - RNA, 12 nt, Human
aagcuagucuuu

SEQ ID NO: 1276662 - RNA, 14 nt, Human
aagcuagucuuuug

SEQ ID NO: 1276663 - RNA, 15 nt, Human
aagcuagucuuuugc

SEQ ID NO: 1276664 - RNA, 16 nt, Human
aagcuagucuuuugcu

SEQ ID NO: 1276665 - RNA, 17 nt, Human
aagcuagucuuuugcuu

SEQ ID NO: 1276666 - RNA, 19 nt, Human
aagcuagucuuuugcuuuu

SEQ ID NO: 1276667 - RNA, 20 nt, Human
aagcuagucuuuugcuuuug

SEQ ID NO: 1276668 - RNA, 21 nt, Human
aagcuagucuuuugcuuuugc

SEQ ID NO: 1276669 - RNA, 18 nt, Human
aagccuguuuaagagaca

SEQ ID NO: 1276670 - RNA, 17 nt, Human
aagccuguucauggcag

SEQ ID NO: 1276671 - RNA, 18 nt, Human
aagccuguucauggcaga

SEQ ID NO: 1276672 - RNA, 15 nt, Human
aagccuguuuaagag

SEQ ID NO: 1276673 - RNA, 21 nt, Human
aagccucagauuccuucccau

SEQ ID NO: 1276674 - RNA, 22 nt, Human
aagccgugcucgccccagcagg

SEQ ID NO: 1276675 - RNA, 13 nt, Human
aagccguggcuuc

SEQ ID NO: 1276676 - RNA, 14 nt, Human
aagccguggcuucc

SEQ ID NO: 1276677 - RNA, 15 nt, Human
aagccguggcuuccc

SEQ ID NO: 1276678 - RNA, 23 nt, Human
aagccuaaaagugggcuugauuc

SEQ ID NO: 1276679 - RNA, 14 nt, Human
guucaguaccacau

SEQ ID NO: 1276680 - RNA, 19 nt, Human
guucaggcccggcagggcg

SEQ ID NO: 1276681 - RNA, 18 nt, Human
guuauuuugauguaaaga

SEQ ID NO: 1276682 - RNA, 20 nt, Human
guuauuuugauguaaagaug

SEQ ID NO: 1276683 - RNA, 20 nt, Human
guuauuauauuuacaaaugg

SEQ ID NO: 1276684 - RNA, 18 nt, Human
guuagagcaggacugaug

SEQ ID NO: 1276685 - RNA, 13 nt, Human
guuauugcaguuu

SEQ ID NO: 1276686 - RNA, 14 nt, Human
guuauugcaguuua

SEQ ID NO: 1276687 - RNA, 16 nt, Human
guuauugcaguuuauc

SEQ ID NO: 1276688 - RNA, 23 nt, Human
guuauugcaguuuaucauucaag

SEQ ID NO: 1276689 - RNA, 22 nt, Human
guuauugguguaagguacuuuc

SEQ ID NO: 1276690 - RNA, 13 nt, Human
guuauuuaaagaa

SEQ ID NO: 1276691 - RNA, 19 nt, Human
guuauuauauuuacaaaug

SEQ ID NO: 1276692 - RNA, 15 nt, Human
guuagagaauaaauu

SEQ ID NO: 1276693 - RNA, 13 nt, Human
guuacuguaauuc

SEQ ID NO: 1276694 - RNA, 19 nt, Human
guuacugugccauguguuu

SEQ ID NO: 1276695 - RNA, 13 nt, Human
guuacuguguaau

SEQ ID NO: 1276696 - RNA, 14 nt, Human
guuagaccuacagg

SEQ ID NO: 1276697 - RNA, 22 nt, Human
aagccauucuccugccucagcc

SEQ ID NO: 1276698 - RNA, 17 nt, Human
aagccauuuuuacaucu

SEQ ID NO: 1276699 - RNA, 18 nt, Human
aagcccagagggucuggg

SEQ ID NO: 1276700 - RNA, 14 nt, Human
guuaauaguuccug

SEQ ID NO: 1276701 - RNA, 18 nt, Human
guuaauauugauuuauua

SEQ ID NO: 1276702 - RNA, 15 nt, Human
guuaauauuuaagac

SEQ ID NO: 1276703 - RNA, 13 nt, Human
aagcccagcuuga

SEQ ID NO: 1276704 - RNA, 18 nt, Human
aagcccagcccauggaga

SEQ ID NO: 1276705 - RNA, 16 nt, Human
aagcccaccauuuggc

SEQ ID NO: 1276706 - RNA, 16 nt, Human
aagcccagagggucug

SEQ ID NO: 1276707 - RNA, 17 nt, Human
aagcccagagggucugg

SEQ ID NO: 1276708 - RNA, 20 nt, Human
aagcccagcacugcuugagg

SEQ ID NO: 1276709 - RNA, 23 nt, Human
aagcccagcacugcuugaggaaa

SEQ ID NO: 1276710 - RNA, 19 nt, Human
guuaauauuuauaggucac

SEQ ID NO: 1276711 - RNA, 21 nt, Human
guuaauauugauuuauuaaua

SEQ ID NO: 1276712 - RNA, 12 nt, Human
guuaauuuaaag

SEQ ID NO: 1276713 - RNA, 23 nt, Human
guuaauuuaaaguuguuugugcc

SEQ ID NO: 1276714 - RNA, 19 nt, Human
guuaauuuagaaaacuuua

SEQ ID NO: 1276715 - RNA, 23 nt, Human
guuacucuucaguuaagccuuug

SEQ ID NO: 1276716 - RNA, 12 nt, Human
guuaauuuuuga

SEQ ID NO: 1276717 - RNA, 14 nt, Human
guuaauuuuugaua

SEQ ID NO: 1276718 - RNA, 22 nt, Human
guuaauuuaguggaaaaggcac

SEQ ID NO: 1276719 - RNA, 17 nt, Human
guuaauuuugaagugcu

SEQ ID NO: 1276720 - RNA, 22 nt, Human
guuaauuuugaagugcuguuua

SEQ ID NO: 1276721 - RNA, 14 nt, Human
guuaauuuuuccaa

SEQ ID NO: 1276722 - RNA, 20 nt, Human
guuaauuuuuccaacuacua

SEQ ID NO: 1276723 - RNA, 14 nt, Human
guuaauuuuuccua

SEQ ID NO: 1276724 - RNA, 18 nt, Human
aagcuuaugcuuaaauuc

SEQ ID NO: 1276725 - RNA, 14 nt, Human
aagcuuaguauaaa

SEQ ID NO: 1276726 - RNA, 21 nt, Human
aagcuuccaugauucuauuua

SEQ ID NO: 1276727 - RNA, 23 nt, Human
aagcuucccacggccuuucuagc

SEQ ID NO: 1276728 - RNA, 23 nt, Human
aagcuuguauuccuuuuucucuc

SEQ ID NO: 1276729 - RNA, 19 nt, Human
aagcucuuggagcugugag

SEQ ID NO: 1276730 - RNA, 13 nt, Human
aagcuuaaaacuu

SEQ ID NO: 1276731 - RNA, 14 nt, Human
aagcuuaaaacuuu

SEQ ID NO: 1276732 - RNA, 15 nt, Human
aagcuuaaaacuuug

SEQ ID NO: 1276733 - RNA, 17 nt, Human
aagcuuaaaacuuugaa

SEQ ID NO: 1276734 - RNA, 19 nt, Human
aagcuuaauggcugauaau

SEQ ID NO: 1276735 - RNA, 21 nt, Human
aagcuuaauggcugauaauuu

SEQ ID NO: 1276736 - RNA, 13 nt, Human
aagcuauaaagca

SEQ ID NO: 1276737 - RNA, 15 nt, Human
aagcuauaaagcagu

SEQ ID NO: 1276738 - RNA, 20 nt, Human
aagcuauaaagcaguauuuu

SEQ ID NO: 1276739 - RNA, 15 nt, Human
aagcucacguccuga

SEQ ID NO: 1276740 - RNA, 17 nt, Human
aagcucacguccugaga

SEQ ID NO: 1276741 - RNA, 18 nt, Human
aagcucacguccugagaa

SEQ ID NO: 1276742 - RNA, 14 nt, Human
aagcucacuucugg

SEQ ID NO: 1276743 - RNA, 23 nt, Human
aagcucacuucugggcuucaucu

SEQ ID NO: 1276744 - RNA, 19 nt, Human
aagcucacguccugagaaa

SEQ ID NO: 1276745 - RNA, 22 nt, Human
aagcucagaggcgcacugugac

SEQ ID NO: 1276746 - RNA, 23 nt, Human
aagcucagaggcgcacugugacc

SEQ ID NO: 1276747 - RNA, 12 nt, Human
aagcucuuccuu

SEQ ID NO: 1276748 - RNA, 12 nt, Human
aagcugaaaaua

SEQ ID NO: 1276749 - RNA, 21 nt, Human
aagcuuuuaugugaaacaugu

SEQ ID NO: 1276750 - RNA, 19 nt, Human
aagcuuuuaugugaaacau

SEQ ID NO: 1276751 - RNA, 12 nt, Human
aagcuuggggaa

SEQ ID NO: 1276752 - RNA, 13 nt, Human
aagcuuuucuauu

SEQ ID NO: 1276753 - RNA, 17 nt, Human
aagcuuuucuauuuuaa

SEQ ID NO: 1276754 - RNA, 19 nt, Human
aagcuuuugucuacacacc

SEQ ID NO: 1276755 - RNA, 22 nt, Human
aagcuuuugucuacacacccug

SEQ ID NO: 1276756 - RNA, 23 nt, Human
aagcuuuuuauuccuccugcuca

SEQ ID NO: 1276757 - RNA, 13 nt, Human
guuccccacugga

SEQ ID NO: 1276758 - RNA, 14 nt, Human
guuccccacuggag

SEQ ID NO: 1276759 - RNA, 17 nt, Human
guuccccacuggagcag

SEQ ID NO: 1276760 - RNA, 20 nt, Human
guuccccacuguaucuaggc

SEQ ID NO: 1276761 - RNA, 12 nt, Human
guuccccagaga

SEQ ID NO: 1276762 - RNA, 13 nt, Human
guuccccagagaa

SEQ ID NO: 1276763 - RNA, 14 nt, Human
guuccccagagaaa

SEQ ID NO: 1276764 - RNA, 18 nt, Human
guucccccuguuucagag

SEQ ID NO: 1276765 - RNA, 18 nt, Human
guucccuugaugaagaag

SEQ ID NO: 1276766 - RNA, 14 nt, Human
guuccggcauggac

SEQ ID NO: 1276767 - RNA, 24 nt, Human
guugacuuauaguacaugauaaau

SEQ ID NO: 1276768 - RNA, 16 nt, Human
guugagaaucccaaau

SEQ ID NO: 1276769 - RNA, 19 nt, Human
guugagaaucccaaauuug

SEQ ID NO: 1276770 - RNA, 15 nt, Human
guugagacaagaaaa

SEQ ID NO: 1276771 - RNA, 12 nt, Human
guugauacuguu

SEQ ID NO: 1276772 - RNA, 13 nt, Human
guugauacuguug

SEQ ID NO: 1276773 - RNA, 14 nt, Human
guugauacuguugc

SEQ ID NO: 1276774 - RNA, 15 nt, Human
guugauacuguugca

SEQ ID NO: 1276775 - RNA, 16 nt, Human
guugauacuguugcac

SEQ ID NO: 1276776 - RNA, 17 nt, Human
guugauacuguugcacg

SEQ ID NO: 1276777 - RNA, 18 nt, Human
guugauacuguugcacgu

SEQ ID NO: 1276778 - RNA, 21 nt, Human
guugauacuguugcacgugug

SEQ ID NO: 1276779 - RNA, 19 nt, Human
guugauacuguugcacgug

SEQ ID NO: 1276780 - RNA, 15 nt, Human
aaggaaaaacaaacu

SEQ ID NO: 1276781 - RNA, 19 nt, Human
guugacuuauaguacauga

SEQ ID NO: 1276782 - RNA, 15 nt, Human
guugaccccagagga

SEQ ID NO: 1276783 - RNA, 14 nt, Human
guugaccccagagg

SEQ ID NO: 1276784 - RNA, 23 nt, Human
guucuugaggggaccaggagugg

SEQ ID NO: 1276785 - RNA, 22 nt, Human
guucuugaggggaccaggagug

SEQ ID NO: 1276786 - RNA, 19 nt, Human
guucuucgacuguuguuau

SEQ ID NO: 1276787 - RNA, 20 nt, Human
guucuuccucagccagccuc

SEQ ID NO: 1276788 - RNA, 19 nt, Human
guucuucuaccacccacca

SEQ ID NO: 1276789 - RNA, 16 nt, Human
guucuugaggggacca

SEQ ID NO: 1276790 - RNA, 20 nt, Human
guucuugaggggaccaggag

SEQ ID NO: 1276791 - RNA, 21 nt, Human
guucuugaggggaccaggagu

SEQ ID NO: 1276792 - RNA, 17 nt, Human
guucuagcgcaguuuuu

SEQ ID NO: 1276793 - RNA, 12 nt, Human
guucuaggaaaa

SEQ ID NO: 1276794 - RNA, 13 nt, Human
guucuaggaaaau

SEQ ID NO: 1276795 - RNA, 17 nt, Human
guucuaggaaaauaaaa

SEQ ID NO: 1276796 - RNA, 22 nt, Human
guucuaggcacuguaguucuaa

SEQ ID NO: 1276797 - RNA, 23 nt, Human
guucuaggcacuguaguucuaag

SEQ ID NO: 1276798 - RNA, 14 nt, Human
guucuagguuucaa

SEQ ID NO: 1276799 - RNA, 16 nt, Human
guucuagguuucaaag

SEQ ID NO: 1276800 - RNA, 19 nt, Human
guucuagguuucaaagaug

SEQ ID NO: 1276801 - RNA, 22 nt, Human
guucuagguuucaaagaugcug

SEQ ID NO: 1276802 - RNA, 15 nt, Human
guucucucuuugcau

SEQ ID NO: 1276803 - RNA, 13 nt, Human
guucuuccucagc

SEQ ID NO: 1276804 - RNA, 14 nt, Human
guucuuccucagcc

SEQ ID NO: 1276805 - RNA, 15 nt, Human
guucuuccucagcca

SEQ ID NO: 1276806 - RNA, 16 nt, Human
guucuuccucagccag

SEQ ID NO: 1276807 - RNA, 17 nt, Human
guucuuccucagccagc

SEQ ID NO: 1276808 - RNA, 18 nt, Human
guucuuccucagccagcc

SEQ ID NO: 1276809 - RNA, 19 nt, Human
guucuuccucagccagccu

SEQ ID NO: 1276810 - RNA, 13 nt, Human
aagucaacaguaa

SEQ ID NO: 1276811 - RNA, 18 nt, Human
aagucagaacagcagacu

SEQ ID NO: 1276812 - RNA, 22 nt, Human
aagucacugcacagugcaucuc

SEQ ID NO: 1276813 - RNA, 20 nt, Human
aagucaaagcaaggaaacua

SEQ ID NO: 1276814 - RNA, 15 nt, Human
aaguauuuuuaauua

SEQ ID NO: 1276815 - RNA, 18 nt, Human
aaguauuuuuaauuaauu

SEQ ID NO: 1276816 - RNA, 15 nt, Human
aaguauuuuuucagu

SEQ ID NO: 1276817 - RNA, 16 nt, Human
aaguauuuuuucagua

SEQ ID NO: 1276818 - RNA, 19 nt, Human
aaguauuuuuucaguauua

SEQ ID NO: 1276819 - RNA, 15 nt, Human
aagucaaacuuggau

SEQ ID NO: 1276820 - RNA, 13 nt, Human
aaguauuaucaga

SEQ ID NO: 1276821 - RNA, 12 nt, Human
aaguauuauuag

SEQ ID NO: 1276822 - RNA, 15 nt, Human
aaguauuaugucucu

SEQ ID NO: 1276823 - RNA, 15 nt, Human
aaguauuuugcugga

SEQ ID NO: 1276824 - RNA, 18 nt, Human
aaguauguuagugcaaau

SEQ ID NO: 1276825 - RNA, 19 nt, Human
aaguauguuagugcaaauu

SEQ ID NO: 1276826 - RNA, 21 nt, Human
aaguauguuagugcaaauugu

SEQ ID NO: 1276827 - RNA, 19 nt, Human
aaguacuaagcgcuagagg

SEQ ID NO: 1276828 - RNA, 18 nt, Human
aaguacacaauaagcaaa

SEQ ID NO: 1276829 - RNA, 17 nt, Human
aaguacacaauaagcaa

SEQ ID NO: 1276830 - RNA, 16 nt, Human
aaguacacaauaagca

SEQ ID NO: 1276831 - RNA, 19 nt, Human
guuuugauuuguacugaaa

SEQ ID NO: 1276832 - RNA, 15 nt, Human
guuuugcacagccaa

SEQ ID NO: 1276833 - RNA, 22 nt, Human
guuuugcacagccaaauuuaaa

SEQ ID NO: 1276834 - RNA, 19 nt, Human
aaguacacaauaagcaaaa

SEQ ID NO: 1276835 - RNA, 15 nt, Human
aaguacacucugcug

SEQ ID NO: 1276836 - RNA, 16 nt, Human
aaguacacucugcugu

SEQ ID NO: 1276837 - RNA, 19 nt, Human
aaguacacucugcuguuug

SEQ ID NO: 1276838 - RNA, 23 nt, Human
aaguacggcuggcuacaacugcu

SEQ ID NO: 1276839 - RNA, 13 nt, Human
guuuggagacaga

SEQ ID NO: 1276840 - RNA, 19 nt, Human
guuuggacaaaauggaaua

SEQ ID NO: 1276841 - RNA, 20 nt, Human
guuugcuuugcccuucuuuc

SEQ ID NO: 1276842 - RNA, 13 nt, Human
guuuggaaggagc

SEQ ID NO: 1276843 - RNA, 16 nt, Human
guuuggaaggagcaga

SEQ ID NO: 1276844 - RNA, 20 nt, Human
guuugcuuuguaugcacuuu

SEQ ID NO: 1276845 - RNA, 11 nt, Human
guuugcuuucu

SEQ ID NO: 1276846 - RNA, 21 nt, Human
guuugcuuucugaucaaggcc

SEQ ID NO: 1276847 - RNA, 21 nt, Human
guuuggaaauugauuuugaac

SEQ ID NO: 1276848 - RNA, 15 nt, Human
guuuuaaagcuucca

SEQ ID NO: 1276849 - RNA, 23 nt, Human
guuuuaaacauuaauagcagccu

SEQ ID NO: 1276850 - RNA, 21 nt, Human
guuuggagagagcagacuggc

SEQ ID NO: 1276851 - RNA, 17 nt, Human
guuuggagagagcagac

SEQ ID NO: 1276852 - RNA, 20 nt, Human
guuuggauauguaaaacauu

SEQ ID NO: 1276853 - RNA, 21 nt, Human
guuuggauauguaaaacauuu

SEQ ID NO: 1276854 - RNA, 21 nt, Human
guuugcugucaagccauuuuu

SEQ ID NO: 1276855 - RNA, 19 nt, Human
guuugcuucaacugucucc

SEQ ID NO: 1276856 - RNA, 15 nt, Human
guuugcuucaugugu

SEQ ID NO: 1276857 - RNA, 20 nt, Human
guuugcuucaugugucccag

SEQ ID NO: 1276858 - RNA, 21 nt, Human
guuugcuucaugugucccaga

SEQ ID NO: 1276859 - RNA, 15 nt, Human
guuuuaacuguggau

SEQ ID NO: 1276860 - RNA, 16 nt, Human
guuuuaacuguggaua

SEQ ID NO: 1276861 - RNA, 14 nt, Human
guuuuaauuuaaac

SEQ ID NO: 1276862 - RNA, 21 nt, Human
guuuuaauuuaaacaccuccu

SEQ ID NO: 1276863 - RNA, 20 nt, Human
guuuuaauuuaguaaaccaa

SEQ ID NO: 1276864 - RNA, 21 nt, Human
guuuuaugagaaagccuucuu

SEQ ID NO: 1276865 - RNA, 17 nt, Human
guuuuauucuugguuuu

SEQ ID NO: 1276866 - RNA, 12 nt, Human
guuuuauuucau

SEQ ID NO: 1276867 - RNA, 21 nt, Human
guuuugaaggcaaaauugcaa

SEQ ID NO: 1276868 - RNA, 14 nt, Human
guuuugacauuuuu

SEQ ID NO: 1276869 - RNA, 17 nt, Human
guuuugacauuuuuagu

SEQ ID NO: 1276870 - RNA, 20 nt, Human
guuuugauuuaauguuuuca

SEQ ID NO: 1276871 - RNA, 23 nt, Human
aaguaacugggauuacaggcaug

SEQ ID NO: 1276872 - RNA, 12 nt, Human
aaguaacaaaaa

SEQ ID NO: 1276873 - RNA, 13 nt, Human
aaguaacaaaaau

SEQ ID NO: 1276874 - RNA, 16 nt, Human
aaguaacaaaaauaaa

SEQ ID NO: 1276875 - RNA, 15 nt, Human
aaguaacucauugcu

SEQ ID NO: 1276876 - RNA, 18 nt, Human
aagguuuggaaggagcag

SEQ ID NO: 1276877 - RNA, 20 nt, Human
aagguuuuaauuuaguaaac

SEQ ID NO: 1276878 - RNA, 23 nt, Human
aagguuuuaauuuaguaaaccaa

SEQ ID NO: 1276879 - RNA, 15 nt, Human
aagguuuuagguucu

SEQ ID NO: 1276880 - RNA, 16 nt, Human
aagguuuuagguucua

SEQ ID NO: 1276881 - RNA, 17 nt, Human
aagguuuuagguucuaa

SEQ ID NO: 1276882 - RNA, 19 nt, Human
aagguuuuagguucuaaag

SEQ ID NO: 1276883 - RNA, 20 nt, Human
aagguuuuagguucuaaagu

SEQ ID NO: 1276884 - RNA, 20 nt, Human
aagguuuuauaaggcugaug

SEQ ID NO: 1276885 - RNA, 23 nt, Human
aagguuuuagguucuaaaguucu

SEQ ID NO: 1276886 - RNA, 23 nt, Human
aagguuucagaaagaagugggga

SEQ ID NO: 1276887 - RNA, 19 nt, Human
aagguuuggaaggagcaga

SEQ ID NO: 1276888 - RNA, 22 nt, Human
aagguauaucuagguuuaugac

SEQ ID NO: 1276889 - RNA, 23 nt, Human
aagguauaucuagguuuaugaca

SEQ ID NO: 1276890 - RNA, 18 nt, Human
aagguauuaaauugaugu

SEQ ID NO: 1276891 - RNA, 22 nt, Human
aagguauuaaauugauguugcu

SEQ ID NO: 1276892 - RNA, 17 nt, Human
aagguuuaugaaaaaga

SEQ ID NO: 1276893 - RNA, 13 nt, Human
aaggggagcccac

SEQ ID NO: 1276894 - RNA, 22 nt, Human
aaggggcuucagguccaggcug

SEQ ID NO: 1276895 - RNA, 22 nt, Human
aagggggcggccuaugacuugg

SEQ ID NO: 1276896 - RNA, 15 nt, Human
aagggcuguuauaau

SEQ ID NO: 1276897 - RNA, 19 nt, Human
aagggcugccggggcagcc

SEQ ID NO: 1276898 - RNA, 21 nt, Human
aagggcugccggggcagcccc

SEQ ID NO: 1276899 - RNA, 13 nt, Human
aaggcuguguaag

SEQ ID NO: 1276900 - RNA, 14 nt, Human
aaggcuguguaaga

SEQ ID NO: 1276901 - RNA, 16 nt, Human
aaggcuguguaagauu

SEQ ID NO: 1276902 - RNA, 21 nt, Human
aaggcuguguaagauuuguuu

SEQ ID NO: 1276903 - RNA, 20 nt, Human
aaggcuguuaaauacaggaa

SEQ ID NO: 1276904 - RNA, 21 nt, Human
aaggcuguuaaauacaggaaa

SEQ ID NO: 1276905 - RNA, 22 nt, Human
aaggcuguuaaauacaggaaac

SEQ ID NO: 1276906 - RNA, 15 nt, Human
aaggcuuaaacccau

SEQ ID NO: 1276907 - RNA, 17 nt, Human
aagggcuguuauaaucu

SEQ ID NO: 1276908 - RNA, 16 nt, Human
aagggcugcuucccug

SEQ ID NO: 1276909 - RNA, 19 nt, Human
aaggggacccuccgcucug

SEQ ID NO: 1276910 - RNA, 23 nt, Human
guuuauuacguaugucugguucu

SEQ ID NO: 1276911 - RNA, 23 nt, Human
guuuauuaaucuuaguguaugau

SEQ ID NO: 1276912 - RNA, 15 nt, Human
guuuaugacaguaau

SEQ ID NO: 1276913 - RNA, 17 nt, Human
guuuaugacaguaauug

SEQ ID NO: 1276914 - RNA, 14 nt, Human
guuuaugauuccac

SEQ ID NO: 1276915 - RNA, 18 nt, Human
guuuauucauaugcauau

SEQ ID NO: 1276916 - RNA, 19 nt, Human
guuuauucauaugcauauu

SEQ ID NO: 1276917 - RNA, 15 nt, Human
guuuauucuucuaga

SEQ ID NO: 1276918 - RNA, 16 nt, Human
guuuauucuucuagag

SEQ ID NO: 1276919 - RNA, 19 nt, Human
guuuauucuucuagaguuc

SEQ ID NO: 1276920 - RNA, 20 nt, Human
guuuauucuucuagaguuca

SEQ ID NO: 1276921 - RNA, 17 nt, Human
guuuauucauaugcaua

SEQ ID NO: 1276922 - RNA, 16 nt, Human
guuuauucauaugcau

SEQ ID NO: 1276923 - RNA, 14 nt, Human
guuuauucauaugc

SEQ ID NO: 1276924 - RNA, 13 nt, Human
guuuauucauaug

SEQ ID NO: 1276925 - RNA, 13 nt, Human
guuuauuacguau

SEQ ID NO: 1276926 - RNA, 22 nt, Human
guuuauugaauucauuucacug

SEQ ID NO: 1276927 - RNA, 19 nt, Human
guuucaaagaugcugugag

SEQ ID NO: 1276928 - RNA, 20 nt, Human
guuucaaagaugcugugagu

SEQ ID NO: 1276929 - RNA, 18 nt, Human
guuucaacggaaagugcu

SEQ ID NO: 1276930 - RNA, 13 nt, Human
guuucaagaggag

SEQ ID NO: 1276931 - RNA, 20 nt, Human
guuucaagaggagcccccac

SEQ ID NO: 1276932 - RNA, 18 nt, Human
guuucaaggcacucuaga

SEQ ID NO: 1276933 - RNA, 23 nt, Human
guuucaaggcacucuagauucca

SEQ ID NO: 1276934 - RNA, 19 nt, Human
guuucaaggcacucuagau

SEQ ID NO: 1276935 - RNA, 22 nt, Human
guuucaauuccaccugcaauca

SEQ ID NO: 1276936 - RNA, 16 nt, Human
guuucaauugcaucuc

SEQ ID NO: 1276937 - RNA, 17 nt, Human
guuucaauugcaucucc

SEQ ID NO: 1276938 - RNA, 22 nt, Human
guuucaauugcaucucccagau

SEQ ID NO: 1276939 - RNA, 19 nt, Human
guuucacaaggucuuuaaa

SEQ ID NO: 1276940 - RNA, 14 nt, Human
guuucacagaaaau

SEQ ID NO: 1276941 - RNA, 23 nt, Human
guuucacagccuauaaccagaca

SEQ ID NO: 1276942 - RNA, 16 nt, Human
guuucacaguuugaaa

SEQ ID NO: 1276943 - RNA, 18 nt, Human
guuucacaguuugaaaua

SEQ ID NO: 1276944 - RNA, 19 nt, Human
guuucacaguuugaaauaa

SEQ ID NO: 1276945 - RNA, 13 nt, Human
guuguuugugccu

SEQ ID NO: 1276946 - RNA, 14 nt, Human
guuuaaagaaagug

SEQ ID NO: 1276947 - RNA, 15 nt, Human
guuuaaagaaagugu

SEQ ID NO: 1276948 - RNA, 16 nt, Human
guuuaaagaaagugua

SEQ ID NO: 1276949 - RNA, 17 nt, Human
guuuaaagaaaguguau

SEQ ID NO: 1276950 - RNA, 18 nt, Human
guuuaaagaaaguguauu

SEQ ID NO: 1276951 - RNA, 21 nt, Human
guuuaaagaaaguguauuugg

SEQ ID NO: 1276952 - RNA, 14 nt, Human
guuuaaagagucua

SEQ ID NO: 1276953 - RNA, 17 nt, Human
guuuaaagagucuagau

SEQ ID NO: 1276954 - RNA, 11 nt, Human
guuuaaaugaa

SEQ ID NO: 1276955 - RNA, 14 nt, Human
guuuaaaugaacaa

SEQ ID NO: 1276956 - RNA, 19 nt, Human
guuuaaaugaacaagagaa

SEQ ID NO: 1276957 - RNA, 23 nt, Human
guuuaaaugaacaagagaagcau

SEQ ID NO: 1276958 - RNA, 18 nt, Human
guuuaaagagucuagauu

SEQ ID NO: 1276959 - RNA, 19 nt, Human
guuuaaagagucuagauuc

SEQ ID NO: 1276960 - RNA, 12 nt, Human
aaggaaagaaaa

SEQ ID NO: 1276961 - RNA, 21 nt, Human
aaguguguguuuuucauaaag

SEQ ID NO: 1276962 - RNA, 16 nt, Human
aaguguguguuuuuca

SEQ ID NO: 1276963 - RNA, 11 nt, Human
aaguuaagaau

SEQ ID NO: 1276964 - RNA, 23 nt, Human
aaguuaagaauguucuuauguug

SEQ ID NO: 1276965 - RNA, 19 nt, Human
aaguuaauccacugugacu

SEQ ID NO: 1276966 - RNA, 12 nt, Human
aaguuaauuuaa

SEQ ID NO: 1276967 - RNA, 15 nt, Human
aaguuaauuuaaagu

SEQ ID NO: 1276968 - RNA, 16 nt, Human
aaguuaauuuaaaguu

SEQ ID NO: 1276969 - RNA, 17 nt, Human
aaguuaauuuaaaguug

SEQ ID NO: 1276970 - RNA, 16 nt, Human
aaguuagcuuuaacuu

SEQ ID NO: 1276971 - RNA, 16 nt, Human
aaguuaguaucuuuug

SEQ ID NO: 1276972 - RNA, 20 nt, Human
aaguuaguaucuuuugauau

SEQ ID NO: 1276973 - RNA, 19 nt, Human
aaguuaguaucuuuugaua

SEQ ID NO: 1276974 - RNA, 18 nt, Human
aaguuaguuccacugaga

SEQ ID NO: 1276975 - RNA, 19 nt, Human
aaguuaguuccacugagac

SEQ ID NO: 1276976 - RNA, 15 nt, Human
aaguuaguuuguaua

SEQ ID NO: 1276977 - RNA, 17 nt, Human
aaguuaguuuguauaua

SEQ ID NO: 1276978 - RNA, 22 nt, Human
aaguuaguuuguauauauuauu

SEQ ID NO: 1276979 - RNA, 23 nt, Human
aaguuaguuuguauauauuauua

SEQ ID NO: 1276980 - RNA, 15 nt, Human
aaguuauaagacucu

SEQ ID NO: 1276981 - RNA, 14 nt, Human
aaguuauaagacuc

SEQ ID NO: 1276982 - RNA, 15 nt, Human
aaguuauagugaaua

SEQ ID NO: 1276983 - RNA, 17 nt, Human
aaguuauagugaauacu

SEQ ID NO: 1276984 - RNA, 17 nt, Human
aaguuauuaacuuuaau

SEQ ID NO: 1276985 - RNA, 15 nt, Human
aaguuauuaacuuua

SEQ ID NO: 1276986 - RNA, 16 nt, Human
aaguuauuuaaaucug

SEQ ID NO: 1276987 - RNA, 12 nt, Human
aaguguguguuu

SEQ ID NO: 1276988 - RNA, 20 nt, Human
aaguguggggauuuucacug

SEQ ID NO: 1276989 - RNA, 14 nt, Human
aagugccaguauuu

SEQ ID NO: 1276990 - RNA, 15 nt, Human
aagugccaguauuuu

SEQ ID NO: 1276991 - RNA, 21 nt, Human
aagugcaucuggagagaacag

SEQ ID NO: 1276992 - RNA, 23 nt, Human
aagugccaguauuuuaaaauagc

SEQ ID NO: 1276993 - RNA, 17 nt, Human
aagugccauuaacaaau

SEQ ID NO: 1276994 - RNA, 16 nt, Human
aagugccauuaacaaa

SEQ ID NO: 1276995 - RNA, 16 nt, Human
aagugucaacucuuug

SEQ ID NO: 1276996 - RNA, 17 nt, Human
aagugucaacucuuugu

SEQ ID NO: 1276997 - RNA, 16 nt, Human
aaguuuccaucaucua

SEQ ID NO: 1276998 - RNA, 11 nt, Human
aaguucuaaga

SEQ ID NO: 1276999 - RNA, 20 nt, Human
aaguuccuuggccaugcaga

SEQ ID NO: 1277000 - RNA, 12 nt, Human
aaguucgucugu

SEQ ID NO: 1277001 - RNA, 15 nt, Human
aaguucgucuguugu

SEQ ID NO: 1277002 - RNA, 14 nt, Human
aaguucccuacuuc

SEQ ID NO: 1277003 - RNA, 17 nt, Human
aaguucccuacuuccug

SEQ ID NO: 1277004 - RNA, 20 nt, Human
aaguucccuacuuccuguga

SEQ ID NO: 1277005 - RNA, 18 nt, Human
aaguucccaguuggagcu

SEQ ID NO: 1277006 - RNA, 19 nt, Human
aaguucccaguuggagcuc

SEQ ID NO: 1277007 - RNA, 21 nt, Human
aaguucaccagacucuauaaa

SEQ ID NO: 1277008 - RNA, 22 nt, Human
aaguucaauauaagcuuuucuu

SEQ ID NO: 1277009 - RNA, 13 nt, Human
aaguucccaguug

SEQ ID NO: 1277010 - RNA, 17 nt, Human
aaguucccaguuggagc

SEQ ID NO: 1277011 - RNA, 19 nt, Human
aaguuauuuuuaauuuggu

SEQ ID NO: 1277012 - RNA, 11 nt, Human
aaguucaaacu

SEQ ID NO: 1277013 - RNA, 23 nt, Human
aaguucaaauucuucugaacuca

SEQ ID NO: 1277014 - RNA, 16 nt, Human
aaguucaacauguuau

SEQ ID NO: 1277015 - RNA, 15 nt, Human
aaguuucucugcaga

SEQ ID NO: 1277016 - RNA, 11 nt, Human
aaguuucuaag

SEQ ID NO: 1277017 - RNA, 12 nt, Human
aaguuucuaaga

SEQ ID NO: 1277018 - RNA, 13 nt, Human
aaguuucuaagau

SEQ ID NO: 1277019 - RNA, 15 nt, Human
aaguuucuaagauuc

SEQ ID NO: 1277020 - RNA, 16 nt, Human
aaguuucuaagauucu

SEQ ID NO: 1277021 - RNA, 17 nt, Human
aaguuucuaagauucua

SEQ ID NO: 1277022 - RNA, 18 nt, Human
aaguuucuaagauucuaa

SEQ ID NO: 1277023 - RNA, 19 nt, Human
aaguuucuaagauucuaaa

SEQ ID NO: 1277024 - RNA, 20 nt, Human
aaguuucuaagauucuaaag

SEQ ID NO: 1277025 - RNA, 21 nt, Human
aaguuucuaagauucuaaagg

SEQ ID NO: 1277026 - RNA, 9 nt, Human
uaaaauggu

SEQ ID NO: 1277027 - RNA, 15 nt, Human
aaguuugauuucauu

SEQ ID NO: 1277028 - RNA, 16 nt, Human
aaguuugauuucauua

SEQ ID NO: 1277029 - RNA, 15 nt, Human
uaaaauguaaacugu

SEQ ID NO: 1277030 - RNA, 15 nt, Human
uaaaauguaaagcca

SEQ ID NO: 1277031 - RNA, 18 nt, Human
uaaaauguaaagccaugc

SEQ ID NO: 1277032 - RNA, 23 nt, Human
uaaaauguaaagccaugcuggaa

SEQ ID NO: 1277033 - RNA, 14 nt, Human
uaaaauguaagauu

SEQ ID NO: 1277034 - RNA, 16 nt, Human
uaaaauguaugcaugu

SEQ ID NO: 1277035 - RNA, 19 nt, Human
uaaaauguaugcauguugu

SEQ ID NO: 1277036 - RNA, 17 nt, Human
uaaaauguaugcauguu

SEQ ID NO: 1277037 - RNA, 17 nt, Human
uaaaaugugauguucua

SEQ ID NO: 1277038 - RNA, 19 nt, Human
uaaaaugugauguucuaag

SEQ ID NO: 1277039 - RNA, 20 nt, Human
uaaaaugugauguucuaagg

SEQ ID NO: 1277040 - RNA, 21 nt, Human
uaaaaugugauguucuaaggc

SEQ ID NO: 1277041 - RNA, 22 nt, Human
uaaaaugugauguucuaaggcu

SEQ ID NO: 1277042 - RNA, 18 nt, Human
uaaaaugugggauuaugg

SEQ ID NO: 1277043 - RNA, 20 nt, Human
uaaaaugugggauuaugggu

SEQ ID NO: 1277044 - RNA, 23 nt, Human
uaaaaugugggauuaugggucac

SEQ ID NO: 1277045 - RNA, 23 nt, Human
uaaaauguguuguuccaaauacu

SEQ ID NO: 1277046 - RNA, 22 nt, Human
uaaaauaauuuuuauauuugaa

SEQ ID NO: 1277047 - RNA, 18 nt, Human
uaaaauacaagacugcca

SEQ ID NO: 1277048 - RNA, 16 nt, Human
uaaaauaagcaggugg

SEQ ID NO: 1277049 - RNA, 21 nt, Human
uaaaauaagcagguggaucua

SEQ ID NO: 1277050 - RNA, 15 nt, Human
uaaaauaaugggauu

SEQ ID NO: 1277051 - RNA, 19 nt, Human
uaaaagugggcuugauucu

SEQ ID NO: 1277052 - RNA, 17 nt, Human
uaaaagugccauuaaca

SEQ ID NO: 1277053 - RNA, 22 nt, Human
uaaaagugggcuugauucugca

SEQ ID NO: 1277054 - RNA, 17 nt, Human
uaaaauaaagaaauaga

SEQ ID NO: 1277055 - RNA, 13 nt, Human
uaaaauaaagaaa

SEQ ID NO: 1277056 - RNA, 19 nt, Human
uaaaauaacagauuucuca

SEQ ID NO: 1277057 - RNA, 17 nt, Human
uaaaagaaacccugcac

SEQ ID NO: 1277058 - RNA, 13 nt, Human
uaaaagaaacuuu

SEQ ID NO: 1277059 - RNA, 14 nt, Human
uaaaagaaacuuuc

SEQ ID NO: 1277060 - RNA, 17 nt, Human
uaaaagaaacuuucuuu

SEQ ID NO: 1277061 - RNA, 16 nt, Human
uaaaagaaacccugca

SEQ ID NO: 1277062 - RNA, 12 nt, Human
uaaaagaaaauu

SEQ ID NO: 1277063 - RNA, 18 nt, Human
uaaaauagucucuuuaaa

SEQ ID NO: 1277064 - RNA, 19 nt, Human
uaaaauagcguucuuguaa

SEQ ID NO: 1277065 - RNA, 20 nt, Human
uaaaauagcguucuuguaau

SEQ ID NO: 1277066 - RNA, 21 nt, Human
uaaaauagcguucuuguaauu

SEQ ID NO: 1277067 - RNA, 17 nt, Human
uaaaauagcaaaagaag

SEQ ID NO: 1277068 - RNA, 21 nt, Human
uaaaauagcaaaagaagaagu

SEQ ID NO: 1277069 - RNA, 22 nt, Human
uaaaauagcaaaagaagaaguu

SEQ ID NO: 1277070 - RNA, 17 nt, Human
uaaaauagcguucuugu

SEQ ID NO: 1277071 - RNA, 16 nt, Human
uaaaauacagaauaca

SEQ ID NO: 1277072 - RNA, 13 nt, Human
uaaaauagcaaaa

SEQ ID NO: 1277073 - RNA, 16 nt, Human
uaaaauagcaaaagaa

SEQ ID NO: 1277074 - RNA, 13 nt, Human
aagugauucucau

SEQ ID NO: 1277075 - RNA, 16 nt, Human
aagugauucucaugcc

SEQ ID NO: 1277076 - RNA, 19 nt, Human
aagugauucucaugccuca

SEQ ID NO: 1277077 - RNA, 17 nt, Human
aagugauucucaugccu

SEQ ID NO: 1277078 - RNA, 13 nt, Human
aagugauuguaug

SEQ ID NO: 1277079 - RNA, 18 nt, Human
aagugauuguaugaauuu

SEQ ID NO: 1277080 - RNA, 22 nt, Human
aagugcaauaaaucugacccag

SEQ ID NO: 1277081 - RNA, 23 nt, Human
aagugcaauaaaucugacccagu

SEQ ID NO: 1277082 - RNA, 17 nt, Human
aagugcagaaugcuccu

SEQ ID NO: 1277083 - RNA, 17 nt, Human
uaaaaaggcuaaaugga

SEQ ID NO: 1277084 - RNA, 21 nt, Human
uaaaaaggacaucagcaaaca

SEQ ID NO: 1277085 - RNA, 19 nt, Human
uaaaaaggacaucagcaaa

SEQ ID NO: 1277086 - RNA, 18 nt, Human
uaaaaaggacaucagcaa

SEQ ID NO: 1277087 - RNA, 11 nt, Human
uaaaaaggaca

SEQ ID NO: 1277088 - RNA, 17 nt, Human
uaaaaagcuuuugucua

SEQ ID NO: 1277089 - RNA, 16 nt, Human
uaaaaaggccuccugg

SEQ ID NO: 1277090 - RNA, 19 nt, Human
uaaaaaguaauaaaauuca

SEQ ID NO: 1277091 - RNA, 16 nt, Human
uaaaaagucaauguuu

SEQ ID NO: 1277092 - RNA, 22 nt, Human
uaaaaauaugcuaauucucaga

SEQ ID NO: 1277093 - RNA, 20 nt, Human
aagucagauggaaaauucau

SEQ ID NO: 1277094 - RNA, 23 nt, Human
aagucagauggaaaauucauuuu

SEQ ID NO: 1277095 - RNA, 16 nt, Human
aagucaggaaucauca

SEQ ID NO: 1277096 - RNA, 18 nt, Human
aagucagcucuucuccau

SEQ ID NO: 1277097 - RNA, 21 nt, Human
aagucaggcccuuauuuucaa

SEQ ID NO: 1277098 - RNA, 23 nt, Human
aagucaguccaggaugcuaacau

SEQ ID NO: 1277099 - RNA, 22 nt, Human
uaaaaaaaaaaaaaauguucuu

SEQ ID NO: 1277100 - RNA, 21 nt, Human
uaaaaaaaaaccugagcccca

SEQ ID NO: 1277101 - RNA, 22 nt, Human
uaaaaagcuccaaaugcagcuu

SEQ ID NO: 1277102 - RNA, 20 nt, Human
uaaaaagcuuccaugauucu

SEQ ID NO: 1277103 - RNA, 21 nt, Human
uaaaaccauguagaaaauuug

SEQ ID NO: 1277104 - RNA, 19 nt, Human
uaaaacccauuuaaauuuu

SEQ ID NO: 1277105 - RNA, 22 nt, Human
uaaaacuucaguuucacagaaa

SEQ ID NO: 1277106 - RNA, 21 nt, Human
uaaaacuuugaaguuagcuuu

SEQ ID NO: 1277107 - RNA, 14 nt, Human
gugaucucagcuca

SEQ ID NO: 1277108 - RNA, 15 nt, Human
gugaucucagaucag

SEQ ID NO: 1277109 - RNA, 14 nt, Human
gugaucucagauca

SEQ ID NO: 1277110 - RNA, 23 nt, Human
gugaugguuccccuguucacucu

SEQ ID NO: 1277111 - RNA, 18 nt, Human
gugaucugggucucuaau

SEQ ID NO: 1277112 - RNA, 15 nt, Human
gugaugugaguugca

SEQ ID NO: 1277113 - RNA, 15 nt, Human
gugauguucaugggu

SEQ ID NO: 1277114 - RNA, 12 nt, Human
gugauguucuaa

SEQ ID NO: 1277115 - RNA, 13 nt, Human
gugauguucuaag

SEQ ID NO: 1277116 - RNA, 16 nt, Human
gugauguucuaaggcu

SEQ ID NO: 1277117 - RNA, 18 nt, Human
gugauguucuaaggcucu

SEQ ID NO: 1277118 - RNA, 19 nt, Human
gugauguucuaaggcucug

SEQ ID NO: 1277119 - RNA, 22 nt, Human
gugauguucuaaggcucugaga

SEQ ID NO: 1277120 - RNA, 16 nt, Human
gugaugucauacagag

SEQ ID NO: 1277121 - RNA, 17 nt, Human
gugaugucauacagaga

SEQ ID NO: 1277122 - RNA, 18 nt, Human
gugaugucauacagagaa

SEQ ID NO: 1277123 - RNA, 19 nt, Human
gugaugucauacagagaag

SEQ ID NO: 1277124 - RNA, 20 nt, Human
gugaugucauacagagaagu

SEQ ID NO: 1277125 - RNA, 22 nt, Human
gugaugucauacagagaaguca

SEQ ID NO: 1277126 - RNA, 15 nt, Human
gugaugugaagccaa

SEQ ID NO: 1277127 - RNA, 21 nt, Human
gugaugucauacagagaaguc

SEQ ID NO: 1277128 - RNA, 17 nt, Human
gugauuaccagggacug

SEQ ID NO: 1277129 - RNA, 16 nt, Human
gugauuaccagggacu

SEQ ID NO: 1277130 - RNA, 11 nt, Human
gugauuaccag

SEQ ID NO: 1277131 - RNA, 21 nt, Human
gugauucaaucuguaaacugu

SEQ ID NO: 1277132 - RNA, 23 nt, Human
gugauucaaucuguaaacugugu

SEQ ID NO: 1277133 - RNA, 13 nt, Human
gugauuagugaaa

SEQ ID NO: 1277134 - RNA, 22 nt, Human
gugauuagagggaggagaauga

SEQ ID NO: 1277135 - RNA, 14 nt, Human
gugauucaaucugu

SEQ ID NO: 1277136 - RNA, 16 nt, Human
gugauucaaucuguaa

SEQ ID NO: 1277137 - RNA, 20 nt, Human
gugcaaguugaggacuucuu

SEQ ID NO: 1277138 - RNA, 19 nt, Human
gugcaauaaaucugaccca

SEQ ID NO: 1277139 - RNA, 21 nt, Human
gugcaauaaaucugacccagu

SEQ ID NO: 1277140 - RNA, 22 nt, Human
gugcaauaaaucugacccagug

SEQ ID NO: 1277141 - RNA, 23 nt, Human
gugcaauaaaucugacccagugc

SEQ ID NO: 1277142 - RNA, 12 nt, Human
gugcaauagaag

SEQ ID NO: 1277143 - RNA, 13 nt, Human
gugcaccugcccc

SEQ ID NO: 1277144 - RNA, 17 nt, Human
gugcauuuaugagcucu

SEQ ID NO: 1277145 - RNA, 22 nt, Human
gugccaaacaaaaagguucuca

SEQ ID NO: 1277146 - RNA, 20 nt, Human
aacuugaggacacaugucca

SEQ ID NO: 1277147 - RNA, 19 nt, Human
aacuugaggacacaugucc

SEQ ID NO: 1277148 - RNA, 18 nt, Human
aacuugaggacacauguc

SEQ ID NO: 1277149 - RNA, 17 nt, Human
aacuugaggacacaugu

SEQ ID NO: 1277150 - RNA, 16 nt, Human
aacuugaggacacaug

SEQ ID NO: 1277151 - RNA, 15 nt, Human
aacuugaggacacau

SEQ ID NO: 1277152 - RNA, 14 nt, Human
aacuugaggacaca

SEQ ID NO: 1277153 - RNA, 13 nt, Human
aacuugaggacac

SEQ ID NO: 1277154 - RNA, 12 nt, Human
aacuugaggaca

SEQ ID NO: 1277155 - RNA, 15 nt, Human
aacuugagcauguua

SEQ ID NO: 1277156 - RNA, 15 nt, Human
aacuugacccugagc

SEQ ID NO: 1277157 - RNA, 19 nt, Human
aacuugacccugagcugac

SEQ ID NO: 1277158 - RNA, 18 nt, Human
aacuugacccugagcuga

SEQ ID NO: 1277159 - RNA, 21 nt, Human
aacuugaacugauucacaucu

SEQ ID NO: 1277160 - RNA, 14 nt, Human
aacuugaacugauu

SEQ ID NO: 1277161 - RNA, 21 nt, Human
aacuugaaauauccugcuuga

SEQ ID NO: 1277162 - RNA, 22 nt, Human
aacuucuugcuucuuucuagaa

SEQ ID NO: 1277163 - RNA, 18 nt, Human
aacuucagcgguuuauau

SEQ ID NO: 1277164 - RNA, 13 nt, Human
aacuucagacaua

SEQ ID NO: 1277165 - RNA, 22 nt, Human
aacuguguaacugcccaaagca

SEQ ID NO: 1277166 - RNA, 14 nt, Human
aacuucagaaagac

SEQ ID NO: 1277167 - RNA, 21 nt, Human
aacuucagcgguuuauauaag

SEQ ID NO: 1277168 - RNA, 15 nt, Human
aacuucuaauugcca

SEQ ID NO: 1277169 - RNA, 16 nt, Human
aacuucuaauugccau

SEQ ID NO: 1277170 - RNA, 17 nt, Human
aacuucuaauugccaug

SEQ ID NO: 1277171 - RNA, 20 nt, Human
aacuucuugcuucuuucuag

SEQ ID NO: 1277172 - RNA, 19 nt, Human
aacugucucucaugaaccu

SEQ ID NO: 1277173 - RNA, 21 nt, Human
aacugucuccuaccucugcuc

SEQ ID NO: 1277174 - RNA, 11 nt, Human
aacuguggaua

SEQ ID NO: 1277175 - RNA, 13 nt, Human
aacuguggauauu

SEQ ID NO: 1277176 - RNA, 14 nt, Human
aacuguggauauug

SEQ ID NO: 1277177 - RNA, 18 nt, Human
aacuguggauauuguuac

SEQ ID NO: 1277178 - RNA, 13 nt, Human
aacuguguaacug

SEQ ID NO: 1277179 - RNA, 20 nt, Human
aacuguguacauaacugaaa

SEQ ID NO: 1277180 - RNA, 21 nt, Human
aacuguguacauaacugaaaa

SEQ ID NO: 1277181 - RNA, 23 nt, Human
aacuguguacauaacugaaaaug

SEQ ID NO: 1277182 - RNA, 16 nt, Human
aacugcccccucugcc

SEQ ID NO: 1277183 - RNA, 17 nt, Human
aacugcccccucugccc

SEQ ID NO: 1277184 - RNA, 14 nt, Human
aacugccaggcucu

SEQ ID NO: 1277185 - RNA, 14 nt, Human
aacugcccaaagca

SEQ ID NO: 1277186 - RNA, 18 nt, Human
aacugcccccucugcccu

SEQ ID NO: 1277187 - RNA, 19 nt, Human
aacugcccccucugcccug

SEQ ID NO: 1277188 - RNA, 20 nt, Human
aacugcccccucugcccugc

SEQ ID NO: 1277189 - RNA, 21 nt, Human
aacugcccccucugcccugcg

SEQ ID NO: 1277190 - RNA, 16 nt, Human
aacugccguaauuuaa

SEQ ID NO: 1277191 - RNA, 17 nt, Human
aacugccguaauuuaac

SEQ ID NO: 1277192 - RNA, 18 nt, Human
aacugccguaauuuaacu

SEQ ID NO: 1277193 - RNA, 16 nt, Human
aacugccuacuccaaa

SEQ ID NO: 1277194 - RNA, 20 nt, Human
aacugccuacuccaaaaugu

SEQ ID NO: 1277195 - RNA, 13 nt, Human
aacuguauuugaa

SEQ ID NO: 1277196 - RNA, 20 nt, Human
aacuguauuugaaauaagaa

SEQ ID NO: 1277197 - RNA, 23 nt, Human
aacugucucgaugcaaugaacac

SEQ ID NO: 1277198 - RNA, 16 nt, Human
gugcucauuucaggau

SEQ ID NO: 1277199 - RNA, 14 nt, Human
gugcucgccccagc

SEQ ID NO: 1277200 - RNA, 16 nt, Human
gugcucgccccagcag

SEQ ID NO: 1277201 - RNA, 14 nt, Human
gugcucgcccugcg

SEQ ID NO: 1277202 - RNA, 19 nt, Human
gugcucaggagcccuggga

SEQ ID NO: 1277203 - RNA, 21 nt, Human
gugcucagggggcgccugugg

SEQ ID NO: 1277204 - RNA, 18 nt, Human
gugcucaggagcccuggg

SEQ ID NO: 1277205 - RNA, 13 nt, Human
gugcucuccauuc

SEQ ID NO: 1277206 - RNA, 22 nt, Human
aagaagcaccaaucaugaauua

SEQ ID NO: 1277207 - RNA, 13 nt, Human
aagaaagccugag

SEQ ID NO: 1277208 - RNA, 20 nt, Human
aagaaaggaagcauuguaaa

SEQ ID NO: 1277209 - RNA, 13 nt, Human
aagaagacuuuuu

SEQ ID NO: 1277210 - RNA, 19 nt, Human
aagaagagcgagagaucaa

SEQ ID NO: 1277211 - RNA, 22 nt, Human
aagaagagcgagagaucaaaga

SEQ ID NO: 1277212 - RNA, 23 nt, Human
aagaagagcgagagaucaaagau

SEQ ID NO: 1277213 - RNA, 21 nt, Human
aagaagcaaccucaguaauuu

SEQ ID NO: 1277214 - RNA, 15 nt, Human
aagaaguuucaucau

SEQ ID NO: 1277215 - RNA, 18 nt, Human
aagaaguuucaucauuuu

SEQ ID NO: 1277216 - RNA, 13 nt, Human
aagaaguuuuaaa

SEQ ID NO: 1277217 - RNA, 23 nt, Human
aagaaguuuuaaaaagccaguuu

SEQ ID NO: 1277218 - RNA, 18 nt, Human
aagaaguuuuaaaaagcc

SEQ ID NO: 1277219 - RNA, 14 nt, Human
aagaauaaacauuu

SEQ ID NO: 1277220 - RNA, 16 nt, Human
aagaauaaucacgcuu

SEQ ID NO: 1277221 - RNA, 22 nt, Human
aagaauaaucacgcuuuccuga

SEQ ID NO: 1277222 - RNA, 19 nt, Human
gugcuacuggggaaacugg

SEQ ID NO: 1277223 - RNA, 21 nt, Human
gugcuauacugcauacuuuuu

SEQ ID NO: 1277224 - RNA, 23 nt, Human
aagaauaaucacgcuuuccugaa

SEQ ID NO: 1277225 - RNA, 21 nt, Human
gugcuacacccuuuuccagcu

SEQ ID NO: 1277226 - RNA, 11 nt, Human
gugcuacuggg

SEQ ID NO: 1277227 - RNA, 13 nt, Human
gugcuacugggga

SEQ ID NO: 1277228 - RNA, 18 nt, Human
gugcuacuggggaaacug

SEQ ID NO: 1277229 - RNA, 14 nt, Human
aagaaagaacggaa

SEQ ID NO: 1277230 - RNA, 23 nt, Human
aagaaagaggugaccccagggca

SEQ ID NO: 1277231 - RNA, 12 nt, Human
aagaaagccuga

SEQ ID NO: 1277232 - RNA, 22 nt, Human
aagaaagccugaguacuccaca

SEQ ID NO: 1277233 - RNA, 22 nt, Human
aagaaagcuucaaacugcauga

SEQ ID NO: 1277234 - RNA, 16 nt, Human
aagaaagaaaaucagg

SEQ ID NO: 1277235 - RNA, 14 nt, Human
aagaaagaaaauca

SEQ ID NO: 1277236 - RNA, 15 nt, Human
aagaaaccuacugcc

SEQ ID NO: 1277237 - RNA, 11 nt, Human
aagaaacauuu

SEQ ID NO: 1277238 - RNA, 14 nt, Human
aagaaacauuuaua

SEQ ID NO: 1277239 - RNA, 14 nt, Human
aagaaacaaagaug

SEQ ID NO: 1277240 - RNA, 15 nt, Human
aagaaacaaagaugu

SEQ ID NO: 1277241 - RNA, 19 nt, Human
aagaaacaacucuuugaga

SEQ ID NO: 1277242 - RNA, 16 nt, Human
aagaaacaagguuuuc

SEQ ID NO: 1277243 - RNA, 19 nt, Human
gugccagauuuaugcauau

SEQ ID NO: 1277244 - RNA, 18 nt, Human
gugccagagaacccagcc

SEQ ID NO: 1277245 - RNA, 12 nt, Human
gugccagagccu

SEQ ID NO: 1277246 - RNA, 13 nt, Human
gugccagagccug

SEQ ID NO: 1277247 - RNA, 14 nt, Human
gugccagagccugg

SEQ ID NO: 1277248 - RNA, 15 nt, Human
gugccagagccuggg

SEQ ID NO: 1277249 - RNA, 16 nt, Human
gugccagagccugggg

SEQ ID NO: 1277250 - RNA, 17 nt, Human
gugccagagccuggggc

SEQ ID NO: 1277251 - RNA, 18 nt, Human
gugccagagccuggggcu

SEQ ID NO: 1277252 - RNA, 20 nt, Human
aagaaaaacaaacucguuuu

SEQ ID NO: 1277253 - RNA, 16 nt, Human
gucuuauucccuuccu

SEQ ID NO: 1277254 - RNA, 18 nt, Human
gucuuuccacggagccac

SEQ ID NO: 1277255 - RNA, 23 nt, Human
gucuuucagcaagauaaacauua

SEQ ID NO: 1277256 - RNA, 22 nt, Human
gucuuguuuuuuuuuuccacuu

SEQ ID NO: 1277257 - RNA, 23 nt, Human
gucuuguguuuccacagccugca

SEQ ID NO: 1277258 - RNA, 13 nt, Human
gucuuaaaaccug

SEQ ID NO: 1277259 - RNA, 14 nt, Human
gucuuaaaaccugc

SEQ ID NO: 1277260 - RNA, 20 nt, Human
gucuuaaaaccugcuuuuca

SEQ ID NO: 1277261 - RNA, 17 nt, Human
gucuuaaacuaaaugug

SEQ ID NO: 1277262 - RNA, 22 nt, Human
gucuuaaacuaaaugugcaaua

SEQ ID NO: 1277263 - RNA, 15 nt, Human
gucugaacagcugua

SEQ ID NO: 1277264 - RNA, 13 nt, Human
gucugaaauuuuu

SEQ ID NO: 1277265 - RNA, 14 nt, Human
gucucuuuuacccu

SEQ ID NO: 1277266 - RNA, 18 nt, Human
gucucuuuuacccuggcc

SEQ ID NO: 1277267 - RNA, 23 nt, Human
gucucuuuuacccuggccccucu

SEQ ID NO: 1277268 - RNA, 20 nt, Human
gucucuuuuacccuggcccc

SEQ ID NO: 1277269 - RNA, 21 nt, Human
gucucuuuuacccuggccccu

SEQ ID NO: 1277270 - RNA, 22 nt, Human
gucucuuuuacccuggccccuc

SEQ ID NO: 1277271 - RNA, 14 nt, Human
gucuggaagauggg

SEQ ID NO: 1277272 - RNA, 23 nt, Human
gucuggaagauggggaccagcag

SEQ ID NO: 1277273 - RNA, 14 nt, Human
gucuggaaguccaa

SEQ ID NO: 1277274 - RNA, 15 nt, Human
aaccuuccacccagu

SEQ ID NO: 1277275 - RNA, 13 nt, Human
aaccuuccaccca

SEQ ID NO: 1277276 - RNA, 21 nt, Human
aaccuucgccaccuggguucc

SEQ ID NO: 1277277 - RNA, 12 nt, Human
aacgucuuaaau

SEQ ID NO: 1277278 - RNA, 14 nt, Human
aacgucuuaaauau

SEQ ID NO: 1277279 - RNA, 13 nt, Human
aaccuucucuaug

SEQ ID NO: 1277280 - RNA, 15 nt, Human
aacgucuuaaauauu

SEQ ID NO: 1277281 - RNA, 12 nt, Human
aacgugaaaaug

SEQ ID NO: 1277282 - RNA, 17 nt, Human
aacgugcucuuuguuuu

SEQ ID NO: 1277283 - RNA, 20 nt, Human
aacgugcucuuuguuuugug

SEQ ID NO: 1277284 - RNA, 19 nt, Human
aacgugcucuuuguuuugu

SEQ ID NO: 1277285 - RNA, 23 nt, Human
aaccuggucacaggacucugccu

SEQ ID NO: 1277286 - RNA, 19 nt, Human
aaccuggguugcagacagg

SEQ ID NO: 1277287 - RNA, 20 nt, Human
aaccuggguugcagacagga

SEQ ID NO: 1277288 - RNA, 17 nt, Human
aaccuggguugcagaca

SEQ ID NO: 1277289 - RNA, 20 nt, Human
gucuuuccauuggaucucau

SEQ ID NO: 1277290 - RNA, 19 nt, Human
gucuuucccauggggaggg

SEQ ID NO: 1277291 - RNA, 20 nt, Human
gucuuucccauggggaggga

SEQ ID NO: 1277292 - RNA, 16 nt, Human
gucuuuccuggcacua

SEQ ID NO: 1277293 - RNA, 14 nt, Human
gucuuucucucuca

SEQ ID NO: 1277294 - RNA, 14 nt, Human
gucuuucucuuucc

SEQ ID NO: 1277295 - RNA, 21 nt, Human
gucuuucucuuucccuggucc

SEQ ID NO: 1277296 - RNA, 16 nt, Human
gucuuucucuuucccu

SEQ ID NO: 1277297 - RNA, 12 nt, Human
aaccuggccuuc

SEQ ID NO: 1277298 - RNA, 11 nt, Human
aaccuggccuu

SEQ ID NO: 1277299 - RNA, 15 nt, Human
aacuauugcauuuau

SEQ ID NO: 1277300 - RNA, 13 nt, Human
aacuauucacaaa

SEQ ID NO: 1277301 - RNA, 15 nt, Human
aacuauguugauaaa

SEQ ID NO: 1277302 - RNA, 12 nt, Human
aacuauggccug

SEQ ID NO: 1277303 - RNA, 18 nt, Human
aacuauggaucagaauag

SEQ ID NO: 1277304 - RNA, 17 nt, Human
aacuagggccaagccca

SEQ ID NO: 1277305 - RNA, 15 nt, Human
aacuaggcugagcaa

SEQ ID NO: 1277306 - RNA, 24 nt, Human
aacuauauauaaucaucaaguaau

SEQ ID NO: 1277307 - RNA, 21 nt, Human
aacuaggugcauauuuauaaa

SEQ ID NO: 1277308 - RNA, 20 nt, Human
aacuaaaacaaagccacuuu

SEQ ID NO: 1277309 - RNA, 15 nt, Human
aacuaaaauaauuuu

SEQ ID NO: 1277310 - RNA, 17 nt, Human
aacuaaaacaaagccac

SEQ ID NO: 1277311 - RNA, 13 nt, Human
aacuaaaacaaag

SEQ ID NO: 1277312 - RNA, 19 nt, Human
aacuaaaauaauuuuguaa

SEQ ID NO: 1277313 - RNA, 17 nt, Human
aacuaaaauaauuuugu

SEQ ID NO: 1277314 - RNA, 13 nt, Human
aacguuuucuaau

SEQ ID NO: 1277315 - RNA, 15 nt, Human
aacguuuucuaauug

SEQ ID NO: 1277316 - RNA, 17 nt, Human
aacguuuucuaauugcu

SEQ ID NO: 1277317 - RNA, 21 nt, Human
aacguuuucuaauugcuuauu

SEQ ID NO: 1277318 - RNA, 20 nt, Human
gugagaccaccucucaauau

SEQ ID NO: 1277319 - RNA, 20 nt, Human
gugagacccagcccucaucc

SEQ ID NO: 1277320 - RNA, 13 nt, Human
gugagaccugccc

SEQ ID NO: 1277321 - RNA, 14 nt, Human
gugagaccugcccc

SEQ ID NO: 1277322 - RNA, 15 nt, Human
gugagaccugccccu

SEQ ID NO: 1277323 - RNA, 16 nt, Human
gugagaccugccccuc

SEQ ID NO: 1277324 - RNA, 23 nt, Human
gugagaccugccccuccucucug

SEQ ID NO: 1277325 - RNA, 14 nt, Human
gugagaccaccucu

SEQ ID NO: 1277326 - RNA, 13 nt, Human
gugagaccaccuc

SEQ ID NO: 1277327 - RNA, 20 nt, Human
gugacuuuggcugcaugcga

SEQ ID NO: 1277328 - RNA, 18 nt, Human
gugacuuuggcugcaugc

SEQ ID NO: 1277329 - RNA, 23 nt, Human
gugacuugugucccaugaucccu

SEQ ID NO: 1277330 - RNA, 11 nt, Human
gugacuucuga

SEQ ID NO: 1277331 - RNA, 17 nt, Human
gugacuugugucccaug

SEQ ID NO: 1277332 - RNA, 16 nt, Human
gugacuucagcucugu

SEQ ID NO: 1277333 - RNA, 13 nt, Human
gugacuucugaga

SEQ ID NO: 1277334 - RNA, 22 nt, Human
gugacauguguuggcagccucu

SEQ ID NO: 1277335 - RNA, 21 nt, Human
gugacauugcaucaaagcauc

SEQ ID NO: 1277336 - RNA, 22 nt, Human
gugacauuugggagacauguga

SEQ ID NO: 1277337 - RNA, 16 nt, Human
gugacugucuggggag

SEQ ID NO: 1277338 - RNA, 15 nt, Human
gugacugucugggga

SEQ ID NO: 1277339 - RNA, 18 nt, Human
aacuccugaccucaggca

SEQ ID NO: 1277340 - RNA, 17 nt, Human
aacuccugaccucaggc

SEQ ID NO: 1277341 - RNA, 13 nt, Human
gugaaguugcugc

SEQ ID NO: 1277342 - RNA, 14 nt, Human
gugaaguugcugcu

SEQ ID NO: 1277343 - RNA, 15 nt, Human
gugaaguugcugcuu

SEQ ID NO: 1277344 - RNA, 23 nt, Human
gugaaguugcugcuucucccagg

SEQ ID NO: 1277345 - RNA, 14 nt, Human
aacuccuaguucua

SEQ ID NO: 1277346 - RNA, 15 nt, Human
aacuccuaguucuag

SEQ ID NO: 1277347 - RNA, 15 nt, Human
aacuccaccuuccca

SEQ ID NO: 1277348 - RNA, 12 nt, Human
aacuccugaccu

SEQ ID NO: 1277349 - RNA, 14 nt, Human
aacuccugaccuca

SEQ ID NO: 1277350 - RNA, 21 nt, Human
aacuccuaguucuagaaaaac

SEQ ID NO: 1277351 - RNA, 19 nt, Human
aacuccuaguucuagaaaa

SEQ ID NO: 1277352 - RNA, 16 nt, Human
aacuccucauuguaaa

SEQ ID NO: 1277353 - RNA, 14 nt, Human
aacuccucccaggg

SEQ ID NO: 1277354 - RNA, 11 nt, Human
aacuccuccca

SEQ ID NO: 1277355 - RNA, 13 nt, Human
gugaauaaauguc

SEQ ID NO: 1277356 - RNA, 16 nt, Human
gugaauaaaugucuug

SEQ ID NO: 1277357 - RNA, 19 nt, Human
gugacagggcggggguggc

SEQ ID NO: 1277358 - RNA, 22 nt, Human
gugacagggcggggguggcggc

SEQ ID NO: 1277359 - RNA, 22 nt, Human
gugagucaauacauagugcugc

SEQ ID NO: 1277360 - RNA, 20 nt, Human
aacucucuggaagccccugg

SEQ ID NO: 1277361 - RNA, 18 nt, Human
aacucucuuauugccuca

SEQ ID NO: 1277362 - RNA, 19 nt, Human
aacucucuuauugccucac

SEQ ID NO: 1277363 - RNA, 21 nt, Human
aacucucuuauugccucacuu

SEQ ID NO: 1277364 - RNA, 16 nt, Human
aacucugacaacagac

SEQ ID NO: 1277365 - RNA, 17 nt, Human
aacucuucacucuucaa

SEQ ID NO: 1277366 - RNA, 23 nt, Human
aacucuucacucuucaaaugccu

SEQ ID NO: 1277367 - RNA, 23 nt, Human
aacucuucccccucucccaguug

SEQ ID NO: 1277368 - RNA, 11 nt, Human
aacucuugauu

SEQ ID NO: 1277369 - RNA, 17 nt, Human
aacucuugauuauccau

SEQ ID NO: 1277370 - RNA, 12 nt, Human
aacucuuucaaa

SEQ ID NO: 1277371 - RNA, 13 nt, Human
aacucuuucaaaa

SEQ ID NO: 1277372 - RNA, 13 nt, Human
aacucuuucggua

SEQ ID NO: 1277373 - RNA, 14 nt, Human
aacucuuugagaaa

SEQ ID NO: 1277374 - RNA, 13 nt, Human
aacucuuugcugc

SEQ ID NO: 1277375 - RNA, 23 nt, Human
aacucuuugcugcugcccauguu

SEQ ID NO: 1277376 - RNA, 15 nt, Human
aacucuuuguuauuu

SEQ ID NO: 1277377 - RNA, 19 nt, Human
aacucuuuguuauuugaaa

SEQ ID NO: 1277378 - RNA, 23 nt, Human
gugagacugggaaggcuugggau

SEQ ID NO: 1277379 - RNA, 23 nt, Human
gugagagacauuaacucauuaga

SEQ ID NO: 1277380 - RNA, 19 nt, Human
gugagagacauuaacucau

SEQ ID NO: 1277381 - RNA, 15 nt, Human
gugagagaguggcug

SEQ ID NO: 1277382 - RNA, 16 nt, Human
gugagagaguggcugg

SEQ ID NO: 1277383 - RNA, 18 nt, Human
gugagagaguggcugggg

SEQ ID NO: 1277384 - RNA, 19 nt, Human
gugagagaguggcuggggc

SEQ ID NO: 1277385 - RNA, 20 nt, Human
gugagagaguggcuggggca

SEQ ID NO: 1277386 - RNA, 14 nt, Human
gugaggcuguccug

SEQ ID NO: 1277387 - RNA, 16 nt, Human
gugaggcuguccugua

SEQ ID NO: 1277388 - RNA, 17 nt, Human
gugagggagggcuguca

SEQ ID NO: 1277389 - RNA, 12 nt, Human
gucccuaauaaa

SEQ ID NO: 1277390 - RNA, 22 nt, Human
gucccggggccagcacuuccau

SEQ ID NO: 1277391 - RNA, 21 nt, Human
gucccggggccagcacuucca

SEQ ID NO: 1277392 - RNA, 22 nt, Human
gucccgggacaccuaggcuagg

SEQ ID NO: 1277393 - RNA, 18 nt, Human
guccccugcuacaccuau

SEQ ID NO: 1277394 - RNA, 15 nt, Human
gucccggggccagca

SEQ ID NO: 1277395 - RNA, 17 nt, Human
gucccggggccagcacu

SEQ ID NO: 1277396 - RNA, 15 nt, Human
guccccuccuuccca

SEQ ID NO: 1277397 - RNA, 13 nt, Human
guccccugcuaca

SEQ ID NO: 1277398 - RNA, 14 nt, Human
guccccagcagaga

SEQ ID NO: 1277399 - RNA, 12 nt, Human
guccccagcaga

SEQ ID NO: 1277400 - RNA, 13 nt, Human
guccccagccugg

SEQ ID NO: 1277401 - RNA, 17 nt, Human
guccccuccuucccaag

SEQ ID NO: 1277402 - RNA, 15 nt, Human
gucccuaauaaagcu

SEQ ID NO: 1277403 - RNA, 13 nt, Human
gucccacaucccu

SEQ ID NO: 1277404 - RNA, 14 nt, Human
gucccacaucccug

SEQ ID NO: 1277405 - RNA, 15 nt, Human
gucccacaucccugg

SEQ ID NO: 1277406 - RNA, 17 nt, Human
gucccacaucccugggc

SEQ ID NO: 1277407 - RNA, 18 nt, Human
gucccacaucccugggcc

SEQ ID NO: 1277408 - RNA, 19 nt, Human
gucccacaucccugggccu

SEQ ID NO: 1277409 - RNA, 20 nt, Human
gucccacaucccugggccug

SEQ ID NO: 1277410 - RNA, 21 nt, Human
gucccacaucccugggccugc

SEQ ID NO: 1277411 - RNA, 14 nt, Human
gucccacagccacg

SEQ ID NO: 1277412 - RNA, 15 nt, Human
gucccacagccacgu

SEQ ID NO: 1277413 - RNA, 23 nt, Human
gucccacaucccugggccugcug

SEQ ID NO: 1277414 - RNA, 22 nt, Human
gucccacaucccugggccugcu

SEQ ID NO: 1277415 - RNA, 21 nt, Human
guccaaaaccgccagcucugu

SEQ ID NO: 1277416 - RNA, 18 nt, Human
guccaaaagauugcugaa

SEQ ID NO: 1277417 - RNA, 16 nt, Human
guccaaagaggcugcc

SEQ ID NO: 1277418 - RNA, 19 nt, Human
guccaaagaggcugccccu

SEQ ID NO: 1277419 - RNA, 23 nt, Human
guccaaaaccgccagcucuguuc

SEQ ID NO: 1277420 - RNA, 15 nt, Human
guccaucagccucca

SEQ ID NO: 1277421 - RNA, 18 nt, Human
guccauaucacacacauu

SEQ ID NO: 1277422 - RNA, 23 nt, Human
guccaugaagauguagaggagaa

SEQ ID NO: 1277423 - RNA, 22 nt, Human
guccaugaagauguagaggaga

SEQ ID NO: 1277424 - RNA, 21 nt, Human
aacacugggagaaaugaaaaa

SEQ ID NO: 1277425 - RNA, 19 nt, Human
aacacucagaagccugggg

SEQ ID NO: 1277426 - RNA, 17 nt, Human
aacacucaguggcccau

SEQ ID NO: 1277427 - RNA, 24 nt, Human
aacacucaguggcccauggcauuu

SEQ ID NO: 1277428 - RNA, 19 nt, Human
aacacuggggacuuggccu

SEQ ID NO: 1277429 - RNA, 23 nt, Human
aacacuggggacuuggccucucu

SEQ ID NO: 1277430 - RNA, 22 nt, Human
aacacuggucugcuguuccagu

SEQ ID NO: 1277431 - RNA, 12 nt, Human
aacacucaccau

SEQ ID NO: 1277432 - RNA, 16 nt, Human
aacacucagaagccug

SEQ ID NO: 1277433 - RNA, 17 nt, Human
aacacucagaagccugg

SEQ ID NO: 1277434 - RNA, 18 nt, Human
aacacucagaagccuggg

SEQ ID NO: 1277435 - RNA, 20 nt, Human
aacacucagaagccuggggg

SEQ ID NO: 1277436 - RNA, 15 nt, Human
aacacaggcaaaauc

SEQ ID NO: 1277437 - RNA, 22 nt, Human
aacacaggcaaaauccuugcuu

SEQ ID NO: 1277438 - RNA, 23 nt, Human
aacacuggucugcuguuccagug

SEQ ID NO: 1277439 - RNA, 15 nt, Human
gucauuucauuuccu

SEQ ID NO: 1277440 - RNA, 16 nt, Human
aaauuugacuuuucug

SEQ ID NO: 1277441 - RNA, 18 nt, Human
aaauuugacuuuucugua

SEQ ID NO: 1277442 - RNA, 13 nt, Human
aacacaaacugua

SEQ ID NO: 1277443 - RNA, 15 nt, Human
aacacaaacuguaaa

SEQ ID NO: 1277444 - RNA, 16 nt, Human
aacacaaacuguaaau

SEQ ID NO: 1277445 - RNA, 19 nt, Human
aacacaaacuguaaauaaa

SEQ ID NO: 1277446 - RNA, 18 nt, Human
aaauuucuguaaaacagg

SEQ ID NO: 1277447 - RNA, 18 nt, Human
aacacaagauugguguuu

SEQ ID NO: 1277448 - RNA, 19 nt, Human
aacacaagauugguguuuu

SEQ ID NO: 1277449 - RNA, 20 nt, Human
aacacaagauugguguuuuu

SEQ ID NO: 1277450 - RNA, 23 nt, Human
aacacaagauugguguuuuuuuc

SEQ ID NO: 1277451 - RNA, 21 nt, Human
aacacaagauugguguuuuuu

SEQ ID NO: 1277452 - RNA, 14 nt, Human
aacacacacaaaag

SEQ ID NO: 1277453 - RNA, 21 nt, Human
aacacacaggugcaacagacu

SEQ ID NO: 1277454 - RNA, 18 nt, Human
aacacagcaauuccucag

SEQ ID NO: 1277455 - RNA, 23 nt, Human
aacacagcaguucugcagaggac

SEQ ID NO: 1277456 - RNA, 19 nt, Human
aacacagcaguucugcaga

SEQ ID NO: 1277457 - RNA, 20 nt, Human
gucuauuuacggaacucaaa

SEQ ID NO: 1277458 - RNA, 13 nt, Human
gucuauucagcuu

SEQ ID NO: 1277459 - RNA, 13 nt, Human
gucuauucuaguc

SEQ ID NO: 1277460 - RNA, 13 nt, Human
gucuauaaagcau

SEQ ID NO: 1277461 - RNA, 22 nt, Human
gucuagauguuuauucuucuag

SEQ ID NO: 1277462 - RNA, 11 nt, Human
gucuagauuca

SEQ ID NO: 1277463 - RNA, 15 nt, Human
gucuagauucaaagg

SEQ ID NO: 1277464 - RNA, 19 nt, Human
gucuagauucaaagguucu

SEQ ID NO: 1277465 - RNA, 20 nt, Human
gucuagauucaaagguucua

SEQ ID NO: 1277466 - RNA, 21 nt, Human
gucuagauucaaagguucuag

SEQ ID NO: 1277467 - RNA, 22 nt, Human
gucuagauucaaagguucuagg

SEQ ID NO: 1277468 - RNA, 12 nt, Human
gucuagauucuc

SEQ ID NO: 1277469 - RNA, 14 nt, Human
gucuaggacacagu

SEQ ID NO: 1277470 - RNA, 22 nt, Human
gucuagucacgcaugcaguguu

SEQ ID NO: 1277471 - RNA, 12 nt, Human
gucgccucugca

SEQ ID NO: 1277472 - RNA, 22 nt, Human
gucgcccuuugcugcauggcag

SEQ ID NO: 1277473 - RNA, 13 nt, Human
gucgauuagacug

SEQ ID NO: 1277474 - RNA, 14 nt, Human
gucgauuagacugg

SEQ ID NO: 1277475 - RNA, 13 nt, Human
gucgccaggcuag

SEQ ID NO: 1277476 - RNA, 17 nt, Human
gucgcccuuugcugcau

SEQ ID NO: 1277477 - RNA, 21 nt, Human
gucgcccuuugcugcauggca

SEQ ID NO: 1277478 - RNA, 16 nt, Human
gucgcucaugugugca

SEQ ID NO: 1277479 - RNA, 21 nt, Human
gucgcucaugugugcaacagg

SEQ ID NO: 1277480 - RNA, 11 nt, Human
gucgcuccugc

SEQ ID NO: 1277481 - RNA, 15 nt, Human
gucgcuccugcccac

SEQ ID NO: 1277482 - RNA, 19 nt, Human
guccuggaugauacuaaua

SEQ ID NO: 1277483 - RNA, 17 nt, Human
guccuggaugauacuaa

SEQ ID NO: 1277484 - RNA, 20 nt, Human
guccuggaggggcuggggac

SEQ ID NO: 1277485 - RNA, 19 nt, Human
guccuggagcagaccaccc

SEQ ID NO: 1277486 - RNA, 13 nt, Human
guccuggaggggc

SEQ ID NO: 1277487 - RNA, 14 nt, Human
guccuggaggggcu

SEQ ID NO: 1277488 - RNA, 11 nt, Human
guccuuucccu

SEQ ID NO: 1277489 - RNA, 22 nt, Human
guccuuucuagagcacugccac

SEQ ID NO: 1277490 - RNA, 13 nt, Human
guccuuucuuccg

SEQ ID NO: 1277491 - RNA, 20 nt, Human
guccuuucuuccggccccuc

SEQ ID NO: 1277492 - RNA, 21 nt, Human
guccuuuucauaggucugaaa

SEQ ID NO: 1277493 - RNA, 22 nt, Human
guccuuuucauaggucugaaau

SEQ ID NO: 1277494 - RNA, 15 nt, Human
guccuuuugacacug

SEQ ID NO: 1277495 - RNA, 16 nt, Human
guccuuuugacacugc

SEQ ID NO: 1277496 - RNA, 17 nt, Human
guccuuuugacacugcu

SEQ ID NO: 1277497 - RNA, 19 nt, Human
guccuuuugacacugcucu

SEQ ID NO: 1277498 - RNA, 20 nt, Human
guccuuuugacacugcucua

SEQ ID NO: 1277499 - RNA, 21 nt, Human
guccuuuugacacugcucuaa

SEQ ID NO: 1277500 - RNA, 15 nt, Human
gucgaggaguaacaa

SEQ ID NO: 1277501 - RNA, 14 nt, Human
gucgauagagcugu

SEQ ID NO: 1277502 - RNA, 18 nt, Human
guccucuuucagcuccug

SEQ ID NO: 1277503 - RNA, 19 nt, Human
guccucuuucagcuccuga

SEQ ID NO: 1277504 - RNA, 20 nt, Human
guccucuuucagcuccugac

SEQ ID NO: 1277505 - RNA, 14 nt, Human
guccucguuugugu

SEQ ID NO: 1277506 - RNA, 13 nt, Human
guccucuuucagc

SEQ ID NO: 1277507 - RNA, 14 nt, Human
guccucuuucagcu

SEQ ID NO: 1277508 - RNA, 15 nt, Human
guccucuuucagcuc

SEQ ID NO: 1277509 - RNA, 16 nt, Human
guccucuuucagcucc

SEQ ID NO: 1277510 - RNA, 17 nt, Human
guccucuuucagcuccu

SEQ ID NO: 1277511 - RNA, 14 nt, Human
guccugaaggccug

SEQ ID NO: 1277512 - RNA, 19 nt, Human
guccugaaggccugagguu

SEQ ID NO: 1277513 - RNA, 21 nt, Human
guccuggaagcgcgagggccu

SEQ ID NO: 1277514 - RNA, 23 nt, Human
aacauuccauccuugagucaaaa

SEQ ID NO: 1277515 - RNA, 11 nt, Human
aacauuccaag

SEQ ID NO: 1277516 - RNA, 19 nt, Human
aacauuccucaugaaugua

SEQ ID NO: 1277517 - RNA, 20 nt, Human
aacauuccucaugaauguaa

SEQ ID NO: 1277518 - RNA, 14 nt, Human
aacauuccauccuu

SEQ ID NO: 1277519 - RNA, 13 nt, Human
aacauuccauccu

SEQ ID NO: 1277520 - RNA, 10 nt, Human
aacauuccau

SEQ ID NO: 1277521 - RNA, 17 nt, Human
aacauuccaagacucua

SEQ ID NO: 1277522 - RNA, 23 nt, Human
aacauuauuaaguaacuuauuua

SEQ ID NO: 1277523 - RNA, 16 nt, Human
aacauucauagucuuu

SEQ ID NO: 1277524 - RNA, 12 nt, Human
aacauuccaaga

SEQ ID NO: 1277525 - RNA, 17 nt, Human
aacaugugaaaagaaua

SEQ ID NO: 1277526 - RNA, 22 nt, Human
aacauauaauguuguuauuuaa

SEQ ID NO: 1277527 - RNA, 15 nt, Human
aacauguaggaagua

SEQ ID NO: 1277528 - RNA, 19 nt, Human
aacauguccugccuauuau

SEQ ID NO: 1277529 - RNA, 20 nt, Human
aacauguccugccuauuauc

SEQ ID NO: 1277530 - RNA, 22 nt, Human
aacauuccucaugaauguaaau

SEQ ID NO: 1277531 - RNA, 21 nt, Human
aacauuccucaugaauguaaa

SEQ ID NO: 1277532 - RNA, 15 nt, Human
aacauuggaauguuc

SEQ ID NO: 1277533 - RNA, 21 nt, Human
aacauuggaauguucucagau

SEQ ID NO: 1277534 - RNA, 16 nt, Human
aacauuggaauguucu

SEQ ID NO: 1277535 - RNA, 14 nt, Human
aacauuguagccuc

SEQ ID NO: 1277536 - RNA, 13 nt, Human
guccuccuccagg

SEQ ID NO: 1277537 - RNA, 14 nt, Human
guccuccuccaggg

SEQ ID NO: 1277538 - RNA, 17 nt, Human
guccuccuccagggaca

SEQ ID NO: 1277539 - RNA, 20 nt, Human
guccuccuccagggacagca

SEQ ID NO: 1277540 - RNA, 18 nt, Human
guccuccuccagggacag

SEQ ID NO: 1277541 - RNA, 12 nt, Human
guccuccucugu

SEQ ID NO: 1277542 - RNA, 13 nt, Human
guccuccucugug

SEQ ID NO: 1277543 - RNA, 14 nt, Human
guccuccucuguga

SEQ ID NO: 1277544 - RNA, 18 nt, Human
guccucguuuguguucug

SEQ ID NO: 1277545 - RNA, 22 nt, Human
aacauaaaaaggacaucagcaa

SEQ ID NO: 1277546 - RNA, 20 nt, Human
aacauaaaaaggacaucagc

SEQ ID NO: 1277547 - RNA, 19 nt, Human
aacauaaaaaggacaucag

SEQ ID NO: 1277548 - RNA, 15 nt, Human
aacauaaaaaggaca

SEQ ID NO: 1277549 - RNA, 18 nt, Human
aacaguuuuccuaugcuu

SEQ ID NO: 1277550 - RNA, 20 nt, Human
aacaguuuuccuaugcuuug

SEQ ID NO: 1277551 - RNA, 21 nt, Human
aacaguuuuccuaugcuuuga

SEQ ID NO: 1277552 - RNA, 21 nt, Human
aacaguuuuuuaugcuaauca

SEQ ID NO: 1277553 - RNA, 12 nt, Human
aacauauauaac

SEQ ID NO: 1277554 - RNA, 13 nt, Human
aacauauaauguu

SEQ ID NO: 1277555 - RNA, 18 nt, Human
aacauauaauguuguuau

SEQ ID NO: 1277556 - RNA, 21 nt, Human
aacauauaauguuguuauuua

SEQ ID NO: 1277557 - RNA, 13 nt, Human
aacauaaaaauga

SEQ ID NO: 1277558 - RNA, 14 nt, Human
aacauaaaaaugau

SEQ ID NO: 1277559 - RNA, 21 nt, Human
aacauagacagaagaaacaag

SEQ ID NO: 1277560 - RNA, 12 nt, Human
aacauagauaaa

SEQ ID NO: 1277561 - RNA, 14 nt, Human
guccgguguucuaa

SEQ ID NO: 1277562 - RNA, 15 nt, Human
guccgguguucuaag

SEQ ID NO: 1277563 - RNA, 16 nt, Human
guccgguguucuaaga

SEQ ID NO: 1277564 - RNA, 17 nt, Human
guccgguguucuaagau

SEQ ID NO: 1277565 - RNA, 19 nt, Human
guccgugggacggugccca

SEQ ID NO: 1277566 - RNA, 18 nt, Human
gucacauuccugaacagg

SEQ ID NO: 1277567 - RNA, 15 nt, Human
gucacaggaaaaagu

SEQ ID NO: 1277568 - RNA, 23 nt, Human
gucacagggcaguaccugagggu

SEQ ID NO: 1277569 - RNA, 14 nt, Human
gucacauaaaacuu

SEQ ID NO: 1277570 - RNA, 19 nt, Human
gucacaggacucugccucc

SEQ ID NO: 1277571 - RNA, 16 nt, Human
gucacaggagggaggg

SEQ ID NO: 1277572 - RNA, 20 nt, Human
gucacaggaaguagaggagg

SEQ ID NO: 1277573 - RNA, 17 nt, Human
gucacaggacucugccu

SEQ ID NO: 1277574 - RNA, 18 nt, Human
gucacaggacucugccuc

SEQ ID NO: 1277575 - RNA, 13 nt, Human
gucaauuuauaau

SEQ ID NO: 1277576 - RNA, 19 nt, Human
aaauuuaaacuauaagcaa

SEQ ID NO: 1277577 - RNA, 13 nt, Human
aaauuuaaagcag

SEQ ID NO: 1277578 - RNA, 18 nt, Human
aaauuuaaagcagguucu

SEQ ID NO: 1277579 - RNA, 21 nt, Human
aaauuuaaagcagguucuugu

SEQ ID NO: 1277580 - RNA, 15 nt, Human
gucacaggaaguaga

SEQ ID NO: 1277581 - RNA, 13 nt, Human
gucacaggaagua

SEQ ID NO: 1277582 - RNA, 21 nt, Human
gucaauuuuguuauguauauu

SEQ ID NO: 1277583 - RNA, 17 nt, Human
gucaauuucuguguugc

SEQ ID NO: 1277584 - RNA, 22 nt, Human
gucaauuucuguguugccaagc

SEQ ID NO: 1277585 - RNA, 12 nt, Human
gucacagcugua

SEQ ID NO: 1277586 - RNA, 20 nt, Human
gucacugcacagugcaucuc

SEQ ID NO: 1277587 - RNA, 16 nt, Human
gucacugacacacacg

SEQ ID NO: 1277588 - RNA, 23 nt, Human
gucacugcacagugcaucucagc

SEQ ID NO: 1277589 - RNA, 12 nt, Human
gucacugagacc

SEQ ID NO: 1277590 - RNA, 22 nt, Human
gucaccaauguacccaccgggc

SEQ ID NO: 1277591 - RNA, 19 nt, Human
gucaccaauguacccaccg

SEQ ID NO: 1277592 - RNA, 14 nt, Human
gucaggaaagagaa

SEQ ID NO: 1277593 - RNA, 19 nt, Human
gucagaacagcagacucag

SEQ ID NO: 1277594 - RNA, 17 nt, Human
gucacuuuguuuuacug

SEQ ID NO: 1277595 - RNA, 14 nt, Human
gucacuuuuucuga

SEQ ID NO: 1277596 - RNA, 17 nt, Human
gucacuuuuugaggcaa

SEQ ID NO: 1277597 - RNA, 19 nt, Human
gucacuuuuugaggcaaaa

SEQ ID NO: 1277598 - RNA, 18 nt, Human
gucacuuuuugaggcaaa

SEQ ID NO: 1277599 - RNA, 18 nt, Human
gucacuuagguaguacca

SEQ ID NO: 1277600 - RNA, 19 nt, Human
gucacuggaccacugggca

SEQ ID NO: 1277601 - RNA, 21 nt, Human
gucacugguagaccaaaauaa

SEQ ID NO: 1277602 - RNA, 17 nt, Human
gucacuguuccuuguca

SEQ ID NO: 1277603 - RNA, 16 nt, Human
gucagaacagcagacu

SEQ ID NO: 1277604 - RNA, 20 nt, Human
gucaggagugugugugagug

SEQ ID NO: 1277605 - RNA, 17 nt, Human
gucagggaguguucccu

SEQ ID NO: 1277606 - RNA, 18 nt, Human
gucaggagugugugugag

SEQ ID NO: 1277607 - RNA, 16 nt, Human
gucaguaccuucaaac

SEQ ID NO: 1277608 - RNA, 23 nt, Human
gucagugcugugcugugcuaugg

SEQ ID NO: 1277609 - RNA, 23 nt, Human
aaauuaugugccagauuuaugca

SEQ ID NO: 1277610 - RNA, 22 nt, Human
aaauuaugugacauuuuacauu

SEQ ID NO: 1277611 - RNA, 20 nt, Human
aaauuaugugacauuuuaca

SEQ ID NO: 1277612 - RNA, 17 nt, Human
aaauuaugugacauuuu

SEQ ID NO: 1277613 - RNA, 22 nt, Human
aaauuauguaaauuaucaggca

SEQ ID NO: 1277614 - RNA, 11 nt, Human
aaauucaaaua

SEQ ID NO: 1277615 - RNA, 16 nt, Human
aaauucaacaaacauu

SEQ ID NO: 1277616 - RNA, 14 nt, Human
aaauucaacaaaca

SEQ ID NO: 1277617 - RNA, 16 nt, Human
aaauuaucuauagcua

SEQ ID NO: 1277618 - RNA, 15 nt, Human
aaauuauguaaauua

SEQ ID NO: 1277619 - RNA, 19 nt, Human
aaauuaggauuucaugauu

SEQ ID NO: 1277620 - RNA, 18 nt, Human
aaauuaggauuucaugau

SEQ ID NO: 1277621 - RNA, 13 nt, Human
aaauuacaacuaa

SEQ ID NO: 1277622 - RNA, 12 nt, Human
aaauuacaacua

SEQ ID NO: 1277623 - RNA, 16 nt, Human
aaauuacacccaaaga

SEQ ID NO: 1277624 - RNA, 22 nt, Human
aaauuacacccaaagagguauu

SEQ ID NO: 1277625 - RNA, 23 nt, Human
aaauuacauuacugaaaacuuca

SEQ ID NO: 1277626 - RNA, 22 nt, Human
aaauuagccaguaauccuguag

SEQ ID NO: 1277627 - RNA, 21 nt, Human
aaauuagccaguaauccugua

SEQ ID NO: 1277628 - RNA, 20 nt, Human
aaauuagccaguaauccugu

SEQ ID NO: 1277629 - RNA, 15 nt, Human
aaauguggcuccugg

SEQ ID NO: 1277630 - RNA, 14 nt, Human
aaauuaaucugggc

SEQ ID NO: 1277631 - RNA, 19 nt, Human
aaaugugggauuauggguc

SEQ ID NO: 1277632 - RNA, 22 nt, Human
aaaugugccuauugcuagagcu

SEQ ID NO: 1277633 - RNA, 16 nt, Human
aaaugugcuuugagaa

SEQ ID NO: 1277634 - RNA, 17 nt, Human
aaauuguauuacaaauc

SEQ ID NO: 1277635 - RNA, 13 nt, Human
aaauucuccugga

SEQ ID NO: 1277636 - RNA, 18 nt, Human
aaauugucagaugcugug

SEQ ID NO: 1277637 - RNA, 19 nt, Human
aaauuguauauuguaauuu

SEQ ID NO: 1277638 - RNA, 14 nt, Human
aaauucuccuggag

SEQ ID NO: 1277639 - RNA, 16 nt, Human
aaauucuccuggaggu

SEQ ID NO: 1277640 - RNA, 13 nt, Human
aaauuguauauug

SEQ ID NO: 1277641 - RNA, 15 nt, Human
aaauuguauauugua

SEQ ID NO: 1277642 - RNA, 21 nt, Human
aaauugucccuuaaacaaaaa

SEQ ID NO: 1277643 - RNA, 14 nt, Human
aaauuuaaacuaua

SEQ ID NO: 1277644 - RNA, 17 nt, Human
aaauuccaagugauuga

SEQ ID NO: 1277645 - RNA, 14 nt, Human
aaauucacaaacuu

SEQ ID NO: 1277646 - RNA, 15 nt, Human
aaauucacaaacuuu

SEQ ID NO: 1277647 - RNA, 17 nt, Human
aaauucacaaacuuuua

SEQ ID NO: 1277648 - RNA, 18 nt, Human
aaauucacaaacuuuuau

SEQ ID NO: 1277649 - RNA, 15 nt, Human
aaauucguguguuuu

SEQ ID NO: 1277650 - RNA, 19 nt, Human
aaauucacaugaugcacuu

SEQ ID NO: 1277651 - RNA, 21 nt, Human
aaauucacaugaugcacuuca

SEQ ID NO: 1277652 - RNA, 12 nt, Human
aaauuccaaagu

SEQ ID NO: 1277653 - RNA, 14 nt, Human
aaauuccaaagucu

SEQ ID NO: 1277654 - RNA, 17 nt, Human
aaauuccaaagucucua

SEQ ID NO: 1277655 - RNA, 18 nt, Human
aaauuccaaagucucuaa

SEQ ID NO: 1277656 - RNA, 21 nt, Human
aaauuccaaagucucuaauuc

SEQ ID NO: 1277657 - RNA, 22 nt, Human
aaauuccaaagucucuaauucu

SEQ ID NO: 1277658 - RNA, 19 nt, Human
guauugacaaaauguuauu

SEQ ID NO: 1277659 - RNA, 17 nt, Human
guauugacaaaauguua

SEQ ID NO: 1277660 - RNA, 16 nt, Human
guauugacaaaauguu

SEQ ID NO: 1277661 - RNA, 15 nt, Human
guauugacaaaaugu

SEQ ID NO: 1277662 - RNA, 13 nt, Human
guauugacaaaau

SEQ ID NO: 1277663 - RNA, 11 nt, Human
guauugacaaa

SEQ ID NO: 1277664 - RNA, 18 nt, Human
guauugacaaaauguuau

SEQ ID NO: 1277665 - RNA, 16 nt, Human
aaaucauucauuuucu

SEQ ID NO: 1277666 - RNA, 19 nt, Human
aaaucagcuauuuugugaa

SEQ ID NO: 1277667 - RNA, 22 nt, Human
aaaucaucagaaaggaaaaaca

SEQ ID NO: 1277668 - RNA, 15 nt, Human
aaaucaucagaaagg

SEQ ID NO: 1277669 - RNA, 20 nt, Human
aaaucaucagaaaggaaaaa

SEQ ID NO: 1277670 - RNA, 21 nt, Human
aaaucaugaagauauuuuucc

SEQ ID NO: 1277671 - RNA, 11 nt, Human
aaauguauacu

SEQ ID NO: 1277672 - RNA, 20 nt, Human
aaauguaguucugcuccaga

SEQ ID NO: 1277673 - RNA, 14 nt, Human
aaauguauaugcac

SEQ ID NO: 1277674 - RNA, 15 nt, Human
aaauguauaugcacu

SEQ ID NO: 1277675 - RNA, 20 nt, Human
aaauguaucauagaaaugua

SEQ ID NO: 1277676 - RNA, 17 nt, Human
aaauguaucauagaaau

SEQ ID NO: 1277677 - RNA, 17 nt, Human
aaaugucucacugagca

SEQ ID NO: 1277678 - RNA, 16 nt, Human
aaaugucucacugagc

SEQ ID NO: 1277679 - RNA, 14 nt, Human
aaaugucuuccugg

SEQ ID NO: 1277680 - RNA, 12 nt, Human
aaaugucuugug

SEQ ID NO: 1277681 - RNA, 13 nt, Human
aaaugucuugugu

SEQ ID NO: 1277682 - RNA, 11 nt, Human
guauuuauuca

SEQ ID NO: 1277683 - RNA, 22 nt, Human
aaauguaguauggccuguguca

SEQ ID NO: 1277684 - RNA, 13 nt, Human
guauuuaucuuua

SEQ ID NO: 1277685 - RNA, 16 nt, Human
guauuuacgcuuugau

SEQ ID NO: 1277686 - RNA, 17 nt, Human
guauuuacgcuuugauu

SEQ ID NO: 1277687 - RNA, 19 nt, Human
guauuuacgcuuugauuca

SEQ ID NO: 1277688 - RNA, 14 nt, Human
guauuuagaagcca

SEQ ID NO: 1277689 - RNA, 13 nt, Human
guauuuauaaaua

SEQ ID NO: 1277690 - RNA, 16 nt, Human
guauugugauuaucaa

SEQ ID NO: 1277691 - RNA, 17 nt, Human
guauugucugaacuugc

SEQ ID NO: 1277692 - RNA, 14 nt, Human
guauugugcaaugu

SEQ ID NO: 1277693 - RNA, 17 nt, Human
guauugugcaaugugua

SEQ ID NO: 1277694 - RNA, 19 nt, Human
guauugugcaauguguaua

SEQ ID NO: 1277695 - RNA, 22 nt, Human
guauugugcaauguguauaaac

SEQ ID NO: 1277696 - RNA, 23 nt, Human
guauugugcaauguguauaaaca

SEQ ID NO: 1277697 - RNA, 16 nt, Human
guauuguugaaaaagu

SEQ ID NO: 1277698 - RNA, 13 nt, Human
guauuguuguccu

SEQ ID NO: 1277699 - RNA, 15 nt, Human
guauuguuguccuuu

SEQ ID NO: 1277700 - RNA, 18 nt, Human
guauuguuguccuuuuca

SEQ ID NO: 1277701 - RNA, 19 nt, Human
guauuguuguccuuuucau

SEQ ID NO: 1277702 - RNA, 20 nt, Human
guauuguuguccuuuucaua

SEQ ID NO: 1277703 - RNA, 21 nt, Human
guauuguuguccuuuucauag

SEQ ID NO: 1277704 - RNA, 17 nt, Human
guauuuaacagaaauug

SEQ ID NO: 1277705 - RNA, 14 nt, Human
aaaacaaggaugaa

SEQ ID NO: 1277706 - RNA, 20 nt, Human
aaaacaaagcaauucuuuca

SEQ ID NO: 1277707 - RNA, 15 nt, Human
aaaacaaaacugcau

SEQ ID NO: 1277708 - RNA, 15 nt, Human
aaaacaaacucauuc

SEQ ID NO: 1277709 - RNA, 17 nt, Human
aaaacaaggaugaauua

SEQ ID NO: 1277710 - RNA, 22 nt, Human
aaaacaacuauggaucagaaua

SEQ ID NO: 1277711 - RNA, 21 nt, Human
aaaaauugcugacuguagcuu

SEQ ID NO: 1277712 - RNA, 23 nt, Human
aaaaauugcugacuguagcuuug

SEQ ID NO: 1277713 - RNA, 14 nt, Human
aaaaauugugauca

SEQ ID NO: 1277714 - RNA, 21 nt, Human
aaaaauuguuaauuuuuccua

SEQ ID NO: 1277715 - RNA, 20 nt, Human
aaaaauucagcaaagugguu

SEQ ID NO: 1277716 - RNA, 13 nt, Human
aaaaauugaaaug

SEQ ID NO: 1277717 - RNA, 22 nt, Human
aaaaauugaaauguaaggcugu

SEQ ID NO: 1277718 - RNA, 14 nt, Human
aaaaauugaaaugu

SEQ ID NO: 1277719 - RNA, 15 nt, Human
aaaaauugcugacug

SEQ ID NO: 1277720 - RNA, 13 nt, Human
aaaaagauaaaca

SEQ ID NO: 1277721 - RNA, 19 nt, Human
aaaaagauaaacacaagau

SEQ ID NO: 1277722 - RNA, 11 nt, Human
aaaaagauccc

SEQ ID NO: 1277723 - RNA, 14 nt, Human
aaaaagaucccaaa

SEQ ID NO: 1277724 - RNA, 17 nt, Human
aaaaagaaugaagccuc

SEQ ID NO: 1277725 - RNA, 20 nt, Human
aaaaacuuuggaaccagacu

SEQ ID NO: 1277726 - RNA, 14 nt, Human
aaaaagaagugcug

SEQ ID NO: 1277727 - RNA, 21 nt, Human
aaaaacuuuggaaccagacuc

SEQ ID NO: 1277728 - RNA, 18 nt, Human
aaaaagaagcaaccucag

SEQ ID NO: 1277729 - RNA, 15 nt, Human
aaaaacugagugacu

SEQ ID NO: 1277730 - RNA, 21 nt, Human
aaaaacagguauauacuuuga

SEQ ID NO: 1277731 - RNA, 19 nt, Human
aaaaacagguauauacuuu

SEQ ID NO: 1277732 - RNA, 15 nt, Human
aaaaaccaacaucua

SEQ ID NO: 1277733 - RNA, 12 nt, Human
aaaaacaggcac

SEQ ID NO: 1277734 - RNA, 18 nt, Human
aaaaacagguauauacuu

SEQ ID NO: 1277735 - RNA, 15 nt, Human
aguugaauuuuacau

SEQ ID NO: 1277736 - RNA, 12 nt, Human
aguugaauuuuu

SEQ ID NO: 1277737 - RNA, 19 nt, Human
aguuguaccgcaaugugac

SEQ ID NO: 1277738 - RNA, 10 nt, Human
aguugaauuu

SEQ ID NO: 1277739 - RNA, 19 nt, Human
aguuguauuuaacagaaau

SEQ ID NO: 1277740 - RNA, 20 nt, Human
aguuguauuuaacagaaauu

SEQ ID NO: 1277741 - RNA, 22 nt, Human
aguuguauuuaacagaaauugu

SEQ ID NO: 1277742 - RNA, 15 nt, Human
aguuacaguucugug

SEQ ID NO: 1277743 - RNA, 16 nt, Human
aguuacaguucugugg

SEQ ID NO: 1277744 - RNA, 22 nt, Human
aguuacauaauucacucugagu

SEQ ID NO: 1277745 - RNA, 15 nt, Human
aguuacauguuugca

SEQ ID NO: 1277746 - RNA, 13 nt, Human
aguuaagaccugg

SEQ ID NO: 1277747 - RNA, 16 nt, Human
aguuaagaccuggcag

SEQ ID NO: 1277748 - RNA, 17 nt, Human
aguuaagaccuggcagc

SEQ ID NO: 1277749 - RNA, 13 nt, Human
aguuacaguucug

SEQ ID NO: 1277750 - RNA, 14 nt, Human
aguuacaguucugu

SEQ ID NO: 1277751 - RNA, 23 nt, Human
aguuguauuuaacagaaauugua

SEQ ID NO: 1277752 - RNA, 20 nt, Human
agugugaauugcaaaaccca

SEQ ID NO: 1277753 - RNA, 23 nt, Human
agugucuuuccacggagccacuc

SEQ ID NO: 1277754 - RNA, 13 nt, Human
agugucuuuccac

SEQ ID NO: 1277755 - RNA, 15 nt, Human
agugucuuuuuuugu

SEQ ID NO: 1277756 - RNA, 16 nt, Human
agugucuuuuuuugua

SEQ ID NO: 1277757 - RNA, 17 nt, Human
agugucuuuuuuuguau

SEQ ID NO: 1277758 - RNA, 19 nt, Human
agugucuuuuuuuguauag

SEQ ID NO: 1277759 - RNA, 20 nt, Human
agugucuuuuuuuguauagu

SEQ ID NO: 1277760 - RNA, 22 nt, Human
agugucuuuuuuuguauaguua

SEQ ID NO: 1277761 - RNA, 18 nt, Human
agugauuaccagggacug

SEQ ID NO: 1277762 - RNA, 18 nt, Human
agugauucucaugccuca

SEQ ID NO: 1277763 - RNA, 19 nt, Human
agugauucucaugccucag

SEQ ID NO: 1277764 - RNA, 19 nt, Human
aguuaagacaugauuuccu

SEQ ID NO: 1277765 - RNA, 20 nt, Human
aguuaagacaugauuuccuu

SEQ ID NO: 1277766 - RNA, 16 nt, Human
aguccaagcauuuaga

SEQ ID NO: 1277767 - RNA, 17 nt, Human
agucauucguucugugg

SEQ ID NO: 1277768 - RNA, 15 nt, Human
agucauuggcugucu

SEQ ID NO: 1277769 - RNA, 21 nt, Human
aguccaagcauuuagauguau

SEQ ID NO: 1277770 - RNA, 11 nt, Human
aguccaagcug

SEQ ID NO: 1277771 - RNA, 14 nt, Human
aguccaagcuggga

SEQ ID NO: 1277772 - RNA, 16 nt, Human
aguccaagcugggaga

SEQ ID NO: 1277773 - RNA, 13 nt, Human
aguccaagguuua

SEQ ID NO: 1277774 - RNA, 16 nt, Human
aguccaagguuuaaag

SEQ ID NO: 1277775 - RNA, 14 nt, Human
aguccaauguggca

SEQ ID NO: 1277776 - RNA, 14 nt, Human
aguccacaaaauaa

SEQ ID NO: 1277777 - RNA, 15 nt, Human
agucauucagauaug

SEQ ID NO: 1277778 - RNA, 20 nt, Human
agucauucagauaugauuca

SEQ ID NO: 1277779 - RNA, 23 nt, Human
agucauucagauaugauucaaau

SEQ ID NO: 1277780 - RNA, 19 nt, Human
agucaaauugugugaaagg

SEQ ID NO: 1277781 - RNA, 22 nt, Human
agucaacccuccuaaaaguuca

SEQ ID NO: 1277782 - RNA, 15 nt, Human
agucaaccugccuga

SEQ ID NO: 1277783 - RNA, 14 nt, Human
agucaaccugggca

SEQ ID NO: 1277784 - RNA, 15 nt, Human
agucaaccugggcaa

SEQ ID NO: 1277785 - RNA, 15 nt, Human
agucaaauuguguga

SEQ ID NO: 1277786 - RNA, 17 nt, Human
agucaaauugugugaaa

SEQ ID NO: 1277787 - RNA, 18 nt, Human
agucaaggguaggguggg

SEQ ID NO: 1277788 - RNA, 13 nt, Human
agucaaauugugu

SEQ ID NO: 1277789 - RNA, 21 nt, Human
agucaauacauagugcugcug

SEQ ID NO: 1277790 - RNA, 17 nt, Human
agucaauauuuuuagau

SEQ ID NO: 1277791 - RNA, 20 nt, Human
agucaagugcguccacgagc

SEQ ID NO: 1277792 - RNA, 10 nt, Human
agucaauaca

SEQ ID NO: 1277793 - RNA, 12 nt, Human
agucaauacaua

SEQ ID NO: 1277794 - RNA, 14 nt, Human
agugaucaaacuac

SEQ ID NO: 1277795 - RNA, 15 nt, Human
agugauauuggaacu

SEQ ID NO: 1277796 - RNA, 16 nt, Human
agugacagacaggcuc

SEQ ID NO: 1277797 - RNA, 17 nt, Human
agugacagacaggcucu

SEQ ID NO: 1277798 - RNA, 22 nt, Human
aguccuggaugauacuaauaaa

SEQ ID NO: 1277799 - RNA, 22 nt, Human
aguccugcgaaaacccccaaac

SEQ ID NO: 1277800 - RNA, 20 nt, Human
aguccacuucugacagccuc

SEQ ID NO: 1277801 - RNA, 14 nt, Human
aguccuggaagcca

SEQ ID NO: 1277802 - RNA, 20 nt, Human
aguccuggaagccagcuuuc

SEQ ID NO: 1277803 - RNA, 22 nt, Human
aguccuggaagccagcuuuccc

SEQ ID NO: 1277804 - RNA, 23 nt, Human
aguccuggaagccagcuuucccu

SEQ ID NO: 1277805 - RNA, 17 nt, Human
aguccuggaugauacua

SEQ ID NO: 1277806 - RNA, 19 nt, Human
aguccuggaugauacuaau

SEQ ID NO: 1277807 - RNA, 18 nt, Human
aguccacccuugguuccu

SEQ ID NO: 1277808 - RNA, 15 nt, Human
aguccaccugaggaa

SEQ ID NO: 1277809 - RNA, 14 nt, Human
aguccacuuuguuu

SEQ ID NO: 1277810 - RNA, 18 nt, Human
auaucacuugucaauaaa

SEQ ID NO: 1277811 - RNA, 22 nt, Human
auaucacccagacauaaaggaa

SEQ ID NO: 1277812 - RNA, 21 nt, Human
auaucacccagacauaaagga

SEQ ID NO: 1277813 - RNA, 14 nt, Human
auaucacacacauu

SEQ ID NO: 1277814 - RNA, 18 nt, Human
auaucacauguuuucucu

SEQ ID NO: 1277815 - RNA, 13 nt, Human
auaucacagaaaa

SEQ ID NO: 1277816 - RNA, 22 nt, Human
auaucaccaaaaaccuauucca

SEQ ID NO: 1277817 - RNA, 14 nt, Human
auaucacccagaca

SEQ ID NO: 1277818 - RNA, 16 nt, Human
auaucacccagacaua

SEQ ID NO: 1277819 - RNA, 19 nt, Human
auaucacccagacauaaag

SEQ ID NO: 1277820 - RNA, 20 nt, Human
auaucacccagacauaaagg

SEQ ID NO: 1277821 - RNA, 21 nt, Human
auauccaugaccuaguuuucc

SEQ ID NO: 1277822 - RNA, 13 nt, Human
auaucccacuggg

SEQ ID NO: 1277823 - RNA, 15 nt, Human
auaucccuacaugua

SEQ ID NO: 1277824 - RNA, 16 nt, Human
auaucccuacauguau

SEQ ID NO: 1277825 - RNA, 17 nt, Human
auaucccuacauguauu

SEQ ID NO: 1277826 - RNA, 15 nt, Human
auaugcguauuauac

SEQ ID NO: 1277827 - RNA, 16 nt, Human
auaugcuaccaccagc

SEQ ID NO: 1277828 - RNA, 17 nt, Human
auaugcuaccaccagcu

SEQ ID NO: 1277829 - RNA, 19 nt, Human
auaugcuaccaccagcugu

SEQ ID NO: 1277830 - RNA, 21 nt, Human
auaugcuaccaccagcugugu

SEQ ID NO: 1277831 - RNA, 14 nt, Human
auaugcauauuugu

SEQ ID NO: 1277832 - RNA, 20 nt, Human
auaucccuccuguugggaga

SEQ ID NO: 1277833 - RNA, 13 nt, Human
auauccugcuuga

SEQ ID NO: 1277834 - RNA, 19 nt, Human
auaugcuuguaacuaaaau

SEQ ID NO: 1277835 - RNA, 15 nt, Human
auauggaaauauaua

SEQ ID NO: 1277836 - RNA, 16 nt, Human
auauggaaauauauau

SEQ ID NO: 1277837 - RNA, 18 nt, Human
auauggaaauauauauua

SEQ ID NO: 1277838 - RNA, 23 nt, Human
auauggaaauauauauuauacuu

SEQ ID NO: 1277839 - RNA, 15 nt, Human
auauggaauuuugca

SEQ ID NO: 1277840 - RNA, 22 nt, Human
auauggacaaaacaagaaagac

SEQ ID NO: 1277841 - RNA, 15 nt, Human
auauggacacuuaau

SEQ ID NO: 1277842 - RNA, 20 nt, Human
auauggacacuuaauacuac

SEQ ID NO: 1277843 - RNA, 19 nt, Human
auauggaauuuugcaaaga

SEQ ID NO: 1277844 - RNA, 23 nt, Human
auauuucagauaaucacaauaca

SEQ ID NO: 1277845 - RNA, 19 nt, Human
auauuuauuuuuuuuaagu

SEQ ID NO: 1277846 - RNA, 16 nt, Human
auauuuauaaaaauaa

SEQ ID NO: 1277847 - RNA, 18 nt, Human
auauuuaguguucauaaa

SEQ ID NO: 1277848 - RNA, 22 nt, Human
auauuauacuuguaauuaugga

SEQ ID NO: 1277849 - RNA, 14 nt, Human
auauuuauuacugu

SEQ ID NO: 1277850 - RNA, 19 nt, Human
auauuuauuacuguaagaa

SEQ ID NO: 1277851 - RNA, 18 nt, Human
auauuuauuuuaauaaug

SEQ ID NO: 1277852 - RNA, 22 nt, Human
auauuuauuacuguaagaaaau

SEQ ID NO: 1277853 - RNA, 21 nt, Human
auauuuauuuucuuucuguaa

SEQ ID NO: 1277854 - RNA, 14 nt, Human
auauuauacuugua

SEQ ID NO: 1277855 - RNA, 16 nt, Human
auauuauacuuguaau

SEQ ID NO: 1277856 - RNA, 19 nt, Human
auauuauacuuguaauuau

SEQ ID NO: 1277857 - RNA, 20 nt, Human
auauuuagauguaauuuugu

SEQ ID NO: 1277858 - RNA, 22 nt, Human
auauuuagauguaauuuugugu

SEQ ID NO: 1277859 - RNA, 12 nt, Human
auauaauucuua

SEQ ID NO: 1277860 - RNA, 15 nt, Human
auauaauugccaaaa

SEQ ID NO: 1277861 - RNA, 18 nt, Human
auauaauuguuuuaucug

SEQ ID NO: 1277862 - RNA, 17 nt, Human
auauaccaaagcacauu

SEQ ID NO: 1277863 - RNA, 19 nt, Human
auauacucaagagugguau

SEQ ID NO: 1277864 - RNA, 22 nt, Human
auauacuauuaaaaagguuuac

SEQ ID NO: 1277865 - RNA, 19 nt, Human
auauacucacuuucuagau

SEQ ID NO: 1277866 - RNA, 12 nt, Human
auauaccaaagc

SEQ ID NO: 1277867 - RNA, 17 nt, Human
auauagcugaucaguuu

SEQ ID NO: 1277868 - RNA, 18 nt, Human
auauagcugaucaguuuu

SEQ ID NO: 1277869 - RNA, 15 nt, Human
auauaaguguguguu

SEQ ID NO: 1277870 - RNA, 15 nt, Human
auauaaguguacaua

SEQ ID NO: 1277871 - RNA, 18 nt, Human
auauaaguguacauaugu

SEQ ID NO: 1277872 - RNA, 21 nt, Human
auauaauguuguuauuuaaag

SEQ ID NO: 1277873 - RNA, 22 nt, Human
auauaauguuguuauuuaaaga

SEQ ID NO: 1277874 - RNA, 15 nt, Human
auauaauuauauguu

SEQ ID NO: 1277875 - RNA, 14 nt, Human
auauaauuauaugu

SEQ ID NO: 1277876 - RNA, 15 nt, Human
auauaagugauugcu

SEQ ID NO: 1277877 - RNA, 14 nt, Human
auauaaguguacau

SEQ ID NO: 1277878 - RNA, 16 nt, Human
auacuugaaaauuaac

SEQ ID NO: 1277879 - RNA, 15 nt, Human
auacuugaaaauuaa

SEQ ID NO: 1277880 - RNA, 18 nt, Human
auacuuauuuguauaugg

SEQ ID NO: 1277881 - RNA, 15 nt, Human
auacuucgacacugu

SEQ ID NO: 1277882 - RNA, 19 nt, Human
auacuucgacacuguucuu

SEQ ID NO: 1277883 - RNA, 19 nt, Human
auacuugaaaauuaacaug

SEQ ID NO: 1277884 - RNA, 16 nt, Human
auacuucucauuuuuu

SEQ ID NO: 1277885 - RNA, 15 nt, Human
auacuucuugugugu

SEQ ID NO: 1277886 - RNA, 16 nt, Human
auacuucuugugugua

SEQ ID NO: 1277887 - RNA, 18 nt, Human
auacuucuuguguguaug

SEQ ID NO: 1277888 - RNA, 12 nt, Human
auaguauaaacc

SEQ ID NO: 1277889 - RNA, 20 nt, Human
auacuucuuguguguaugca

SEQ ID NO: 1277890 - RNA, 19 nt, Human
auaaguauuuaauucaugu

SEQ ID NO: 1277891 - RNA, 16 nt, Human
auaaguauuucaaauu

SEQ ID NO: 1277892 - RNA, 18 nt, Human
auaaguauuucaaauugg

SEQ ID NO: 1277893 - RNA, 19 nt, Human
auaaguauuucaaauugga

SEQ ID NO: 1277894 - RNA, 14 nt, Human
auaagucaacagua

SEQ ID NO: 1277895 - RNA, 15 nt, Human
auaagucaacaguaa

SEQ ID NO: 1277896 - RNA, 16 nt, Human
auaagucaacaguaaa

SEQ ID NO: 1277897 - RNA, 18 nt, Human
auaagucaacaguaaacc

SEQ ID NO: 1277898 - RNA, 17 nt, Human
auaagucaacaguaaac

SEQ ID NO: 1277899 - RNA, 13 nt, Human
auaaguguacaua

SEQ ID NO: 1277900 - RNA, 14 nt, Human
auaaguguacauau

SEQ ID NO: 1277901 - RNA, 19 nt, Human
auaaguguacauaugugcu

SEQ ID NO: 1277902 - RNA, 20 nt, Human
auaaguguacauaugugcug

SEQ ID NO: 1277903 - RNA, 22 nt, Human
auaaguguguguuuuucauaaa

SEQ ID NO: 1277904 - RNA, 19 nt, Human
auaaguguguguuuuucau

SEQ ID NO: 1277905 - RNA, 17 nt, Human
auaaguguucugucuga

SEQ ID NO: 1277906 - RNA, 13 nt, Human
auaaugugaaaau

SEQ ID NO: 1277907 - RNA, 16 nt, Human
auaaugugaaaauggu

SEQ ID NO: 1277908 - RNA, 23 nt, Human
auaacagaaagccugggugacau

SEQ ID NO: 1277909 - RNA, 15 nt, Human
auaacagauuucuca

SEQ ID NO: 1277910 - RNA, 22 nt, Human
auacccucccucccuacccuaa

SEQ ID NO: 1277911 - RNA, 16 nt, Human
auacccucccucccua

SEQ ID NO: 1277912 - RNA, 14 nt, Human
auacccucccuccc

SEQ ID NO: 1277913 - RNA, 18 nt, Human
auaccccuuacaaaugaa

SEQ ID NO: 1277914 - RNA, 22 nt, Human
auacccccugcaaagcccagcu

SEQ ID NO: 1277915 - RNA, 20 nt, Human
auacaauuuuuuuuauuagu

SEQ ID NO: 1277916 - RNA, 17 nt, Human
auacaauuuuuuuuauu

SEQ ID NO: 1277917 - RNA, 11 nt, Human
auacacaaauu

SEQ ID NO: 1277918 - RNA, 14 nt, Human
auaauuacuauguc

SEQ ID NO: 1277919 - RNA, 16 nt, Human
auaauuauaauauacu

SEQ ID NO: 1277920 - RNA, 19 nt, Human
auaccugaaugcucuguag

SEQ ID NO: 1277921 - RNA, 20 nt, Human
auaccugauuuuuuuuccuu

SEQ ID NO: 1277922 - RNA, 15 nt, Human
auacccugaccuggc

SEQ ID NO: 1277923 - RNA, 19 nt, Human
auacccuggccgcccccug

SEQ ID NO: 1277924 - RNA, 22 nt, Human
auacccuuggaaauacuguaug

SEQ ID NO: 1277925 - RNA, 21 nt, Human
auaccuaagaaguacauuguu

SEQ ID NO: 1277926 - RNA, 15 nt, Human
auaccuaagaaguac

SEQ ID NO: 1277927 - RNA, 19 nt, Human
auacuuauauggaaauucu

SEQ ID NO: 1277928 - RNA, 18 nt, Human
auguuucuuuguaaugaa

SEQ ID NO: 1277929 - RNA, 13 nt, Human
augugucuuuaga

SEQ ID NO: 1277930 - RNA, 21 nt, Human
augugucuuuagauagcccug

SEQ ID NO: 1277931 - RNA, 11 nt, Human
augugucccag

SEQ ID NO: 1277932 - RNA, 12 nt, Human
augugucccaga

SEQ ID NO: 1277933 - RNA, 14 nt, Human
augugucccagaag

SEQ ID NO: 1277934 - RNA, 16 nt, Human
augugucccagaagau

SEQ ID NO: 1277935 - RNA, 14 nt, Human
auguguccugacac

SEQ ID NO: 1277936 - RNA, 17 nt, Human
auguguccugacacugc

SEQ ID NO: 1277937 - RNA, 13 nt, Human
auguguccugguu

SEQ ID NO: 1277938 - RNA, 22 nt, Human
auguguacaaaaguuucauccu

SEQ ID NO: 1277939 - RNA, 18 nt, Human
auguguauuacaaauauu

SEQ ID NO: 1277940 - RNA, 15 nt, Human
auguuugcauauaag

SEQ ID NO: 1277941 - RNA, 13 nt, Human
auguuugcauaua

SEQ ID NO: 1277942 - RNA, 21 nt, Human
auguuugcaccuuucuaguug

SEQ ID NO: 1277943 - RNA, 21 nt, Human
auguuugauagauuuucugcu

SEQ ID NO: 1277944 - RNA, 17 nt, Human
auguuugcaccuuucua

SEQ ID NO: 1277945 - RNA, 19 nt, Human
auguuugcaccuuucuagu

SEQ ID NO: 1277946 - RNA, 22 nt, Human
auguuugcaccuuucuaguuga

SEQ ID NO: 1277947 - RNA, 14 nt, Human
auguuugcauauaa

SEQ ID NO: 1277948 - RNA, 17 nt, Human
auuaaagugcuaagguu

SEQ ID NO: 1277949 - RNA, 18 nt, Human
auuaaagugcuaagguuc

SEQ ID NO: 1277950 - RNA, 19 nt, Human
auuaaagugcuaagguucu

SEQ ID NO: 1277951 - RNA, 20 nt, Human
auuaaagugcuaagguucua

SEQ ID NO: 1277952 - RNA, 21 nt, Human
auuaaagugcuaagguucuaa

SEQ ID NO: 1277953 - RNA, 22 nt, Human
auuaaagugcuaagguucuaag

SEQ ID NO: 1277954 - RNA, 23 nt, Human
auuaaagugcuaagguucuaagg

SEQ ID NO: 1277955 - RNA, 13 nt, Human
auuaaauaaauuu

SEQ ID NO: 1277956 - RNA, 15 nt, Human
auuaaauaagauucu

SEQ ID NO: 1277957 - RNA, 16 nt, Human
auuaaauaagauucua

SEQ ID NO: 1277958 - RNA, 19 nt, Human
auuaaauaagauucuaacg

SEQ ID NO: 1277959 - RNA, 13 nt, Human
auuaaauucacaa

SEQ ID NO: 1277960 - RNA, 14 nt, Human
auuaaauucacaaa

SEQ ID NO: 1277961 - RNA, 16 nt, Human
auuaaauucacaaacu

SEQ ID NO: 1277962 - RNA, 17 nt, Human
auuaaauucacaaacuu

SEQ ID NO: 1277963 - RNA, 18 nt, Human
auuaaauucacaaacuuu

SEQ ID NO: 1277964 - RNA, 13 nt, Human
auguggggccagg

SEQ ID NO: 1277965 - RNA, 16 nt, Human
auguggggccagguca

SEQ ID NO: 1277966 - RNA, 15 nt, Human
auguggguuccacag

SEQ ID NO: 1277967 - RNA, 16 nt, Human
auguggguuccacaga

SEQ ID NO: 1277968 - RNA, 20 nt, Human
auguggugaaaagcagguug

SEQ ID NO: 1277969 - RNA, 16 nt, Human
auguggugaaaagcag

SEQ ID NO: 1277970 - RNA, 18 nt, Human
augugguggcacaggccc

SEQ ID NO: 1277971 - RNA, 22 nt, Human
augugguggcacaggcccccuu

SEQ ID NO: 1277972 - RNA, 17 nt, Human
auguggguuccacagac

SEQ ID NO: 1277973 - RNA, 15 nt, Human
auguggucacagcug

SEQ ID NO: 1277974 - RNA, 16 nt, Human
auguggucacagcugu

SEQ ID NO: 1277975 - RNA, 17 nt, Human
auguggucacagcugua

SEQ ID NO: 1277976 - RNA, 22 nt, Human
auguggucacagcuguauagcu

SEQ ID NO: 1277977 - RNA, 19 nt, Human
auguggucacagcuguaua

SEQ ID NO: 1277978 - RNA, 16 nt, Human
auguaaguaaacgguc

SEQ ID NO: 1277979 - RNA, 24 nt, Human
auguaagauuauagauucuaaaga

SEQ ID NO: 1277980 - RNA, 14 nt, Human
auguaauaaacuuu

SEQ ID NO: 1277981 - RNA, 15 nt, Human
auguaauaaacuuua

SEQ ID NO: 1277982 - RNA, 16 nt, Human
auguaauaaacuuuaa

SEQ ID NO: 1277983 - RNA, 22 nt, Human
auguaauaagguugaacacuuu

SEQ ID NO: 1277984 - RNA, 12 nt, Human
auguaauacuuc

SEQ ID NO: 1277985 - RNA, 15 nt, Human
auguaaucaauguuu

SEQ ID NO: 1277986 - RNA, 16 nt, Human
auguaaucaauguuuc

SEQ ID NO: 1277987 - RNA, 16 nt, Human
auguaagcugaaaaua

SEQ ID NO: 1277988 - RNA, 16 nt, Human
auguaacuuuuguaag

SEQ ID NO: 1277989 - RNA, 17 nt, Human
auguaacuuuuguaaga

SEQ ID NO: 1277990 - RNA, 18 nt, Human
auguaacuuuuguaagac

SEQ ID NO: 1277991 - RNA, 15 nt, Human
auguaagauuauaga

SEQ ID NO: 1277992 - RNA, 17 nt, Human
auguaagauuauagauu

SEQ ID NO: 1277993 - RNA, 19 nt, Human
auguaagauuauagauucu

SEQ ID NO: 1277994 - RNA, 20 nt, Human
auguaagauuauagauucua

SEQ ID NO: 1277995 - RNA, 21 nt, Human
auguaagauuauagauucuaa

SEQ ID NO: 1277996 - RNA, 22 nt, Human
auguaagauuauagauucuaaa

SEQ ID NO: 1277997 - RNA, 16 nt, Human
auggucugcccucugc

SEQ ID NO: 1277998 - RNA, 15 nt, Human
auggucuuacagcag

SEQ ID NO: 1277999 - RNA, 16 nt, Human
auggucuuacagcagg

SEQ ID NO: 1278000 - RNA, 17 nt, Human
auggucuuacagcaggc

SEQ ID NO: 1278001 - RNA, 17 nt, Human
auguacauguacugauu

SEQ ID NO: 1278002 - RNA, 17 nt, Human
auguacauagugcuaac

SEQ ID NO: 1278003 - RNA, 15 nt, Human
auguacauagugcua

SEQ ID NO: 1278004 - RNA, 21 nt, Human
auguaauacuucuugugugua

SEQ ID NO: 1278005 - RNA, 19 nt, Human
auguaaucuugaauuguaa

SEQ ID NO: 1278006 - RNA, 14 nt, Human
auguacaagaugaa

SEQ ID NO: 1278007 - RNA, 16 nt, Human
augucaaucagccuag

SEQ ID NO: 1278008 - RNA, 23 nt, Human
augucaagggcagcuuugcucau

SEQ ID NO: 1278009 - RNA, 21 nt, Human
augucaagggcagcuuugcuc

SEQ ID NO: 1278010 - RNA, 14 nt, Human
augucaagggcagc

SEQ ID NO: 1278011 - RNA, 18 nt, Human
augucaagauucagcuag

SEQ ID NO: 1278012 - RNA, 17 nt, Human
augucaagauucagcua

SEQ ID NO: 1278013 - RNA, 16 nt, Human
augucaagauucagcu

SEQ ID NO: 1278014 - RNA, 15 nt, Human
augucaagauucagc

SEQ ID NO: 1278015 - RNA, 22 nt, Human
augucaaggguucaagauuguu

SEQ ID NO: 1278016 - RNA, 18 nt, Human
auguacauagugcuaaca

SEQ ID NO: 1278017 - RNA, 15 nt, Human
auguacaugagaagg

SEQ ID NO: 1278018 - RNA, 19 nt, Human
augucaaauauuuagaugu

SEQ ID NO: 1278019 - RNA, 23 nt, Human
augucaaauauuuagauguaauu

SEQ ID NO: 1278020 - RNA, 16 nt, Human
augucacuaaagcagg

SEQ ID NO: 1278021 - RNA, 22 nt, Human
augucacuaaagcaggccuuuu

SEQ ID NO: 1278022 - RNA, 10 nt, Human
augucacuuu

SEQ ID NO: 1278023 - RNA, 20 nt, Human
augucacuuuuugaggcaaa

SEQ ID NO: 1278024 - RNA, 21 nt, Human
augucacuuuuugaggcaaaa

SEQ ID NO: 1278025 - RNA, 21 nt, Human
augucuugagcucuauuauga

SEQ ID NO: 1278026 - RNA, 15 nt, Human
augucuucucccugg

SEQ ID NO: 1278027 - RNA, 23 nt, Human
augucuugaugcaugcacuguuc

SEQ ID NO: 1278028 - RNA, 15 nt, Human
augucuugagcucua

SEQ ID NO: 1278029 - RNA, 16 nt, Human
augucuugagcucuau

SEQ ID NO: 1278030 - RNA, 20 nt, Human
augucuuggaacauuggaau

SEQ ID NO: 1278031 - RNA, 18 nt, Human
auggcuggagcuagaauu

SEQ ID NO: 1278032 - RNA, 20 nt, Human
auggcugauaauuuuaaauu

SEQ ID NO: 1278033 - RNA, 15 nt, Human
auggaaauuuaaagc

SEQ ID NO: 1278034 - RNA, 16 nt, Human
auggaggaaaaccaag

SEQ ID NO: 1278035 - RNA, 14 nt, Human
auggagcugggcua

SEQ ID NO: 1278036 - RNA, 13 nt, Human
auggaugccaaua

SEQ ID NO: 1278037 - RNA, 22 nt, Human
auggaugccaauauuaaaucug

SEQ ID NO: 1278038 - RNA, 23 nt, Human
auggaugccaauauuaaaucugc

SEQ ID NO: 1278039 - RNA, 15 nt, Human
auggaacacagaacu

SEQ ID NO: 1278040 - RNA, 19 nt, Human
auggaugggggaacucaga

SEQ ID NO: 1278041 - RNA, 17 nt, Human
auggauguccccagcag

SEQ ID NO: 1278042 - RNA, 18 nt, Human
auggauguccccagcaga

SEQ ID NO: 1278043 - RNA, 12 nt, Human
auggauucuaaa

SEQ ID NO: 1278044 - RNA, 20 nt, Human
auggaaauucccuucaucug

SEQ ID NO: 1278045 - RNA, 18 nt, Human
auggaaauucugcucaga

SEQ ID NO: 1278046 - RNA, 17 nt, Human
auggaaauuuaaagcag

SEQ ID NO: 1278047 - RNA, 13 nt, Human
auggaaauguuua

SEQ ID NO: 1278048 - RNA, 22 nt, Human
augcuuuuuauuauuauuauuu

SEQ ID NO: 1278049 - RNA, 16 nt, Human
augcuuuuuauuucug

SEQ ID NO: 1278050 - RNA, 19 nt, Human
augcuuuuuauuucugcau

SEQ ID NO: 1278051 - RNA, 23 nt, Human
augcuuuuuauuucugcauaugu

SEQ ID NO: 1278052 - RNA, 16 nt, Human
augcuugcaaaaacua

SEQ ID NO: 1278053 - RNA, 19 nt, Human
augcuugcaaaaacuacaa

SEQ ID NO: 1278054 - RNA, 17 nt, Human
augcuugcauaagagcu

SEQ ID NO: 1278055 - RNA, 18 nt, Human
augcuugcauaagagcuu

SEQ ID NO: 1278056 - RNA, 21 nt, Human
augccuuuguacuuuagggaa

SEQ ID NO: 1278057 - RNA, 14 nt, Human
augccuuuucccaa

SEQ ID NO: 1278058 - RNA, 16 nt, Human
augcauggaaauuccc

SEQ ID NO: 1278059 - RNA, 14 nt, Human
augcauuguccucu

SEQ ID NO: 1278060 - RNA, 12 nt, Human
augcauggaaau

SEQ ID NO: 1278061 - RNA, 17 nt, Human
augcaugcacuguuccc

SEQ ID NO: 1278062 - RNA, 21 nt, Human
augcacaguauuuguaauuaa

SEQ ID NO: 1278063 - RNA, 18 nt, Human
augcacaguauuuguaau

SEQ ID NO: 1278064 - RNA, 17 nt, Human
augcacaguaaaaaugg

SEQ ID NO: 1278065 - RNA, 14 nt, Human
augcacaguauuug

SEQ ID NO: 1278066 - RNA, 15 nt, Human
augcacaguauuugu

SEQ ID NO: 1278067 - RNA, 17 nt, Human
augcaauuuccuuuuuu

SEQ ID NO: 1278068 - RNA, 23 nt, Human
augauguauguugaagccuuugu

SEQ ID NO: 1278069 - RNA, 11 nt, Human
augaugugcuu

SEQ ID NO: 1278070 - RNA, 16 nt, Human
augaugugugaaaacu

SEQ ID NO: 1278071 - RNA, 13 nt, Human
augaugugcuuaa

SEQ ID NO: 1278072 - RNA, 21 nt, Human
augcaauauacuggaaagcuu

SEQ ID NO: 1278073 - RNA, 23 nt, Human
augaaaaaauauauaucaaauau

SEQ ID NO: 1278074 - RNA, 22 nt, Human
augaaaaaauauauaucaaaua

SEQ ID NO: 1278075 - RNA, 17 nt, Human
augaaaaaauauauauc

SEQ ID NO: 1278076 - RNA, 14 nt, Human
augaaaaaauauau

SEQ ID NO: 1278077 - RNA, 16 nt, Human
augaaaaugucuugug

SEQ ID NO: 1278078 - RNA, 16 nt, Human
augaaaaguauauuga

SEQ ID NO: 1278079 - RNA, 14 nt, Human
augaaaauaaagaa

SEQ ID NO: 1278080 - RNA, 17 nt, Human
augaaaauaaagaaugg

SEQ ID NO: 1278081 - RNA, 15 nt, Human
augaaaauaaagaau

SEQ ID NO: 1278082 - RNA, 16 nt, Human
augaaaacucuuugcu

SEQ ID NO: 1278083 - RNA, 13 nt, Human
augaaaagcuaga

SEQ ID NO: 1278084 - RNA, 18 nt, Human
augaaaagcuagaauuga

SEQ ID NO: 1278085 - RNA, 18 nt, Human
augaaacagaaacaaaaa

SEQ ID NO: 1278086 - RNA, 22 nt, Human
augaaacagaaacaaaaacacu

SEQ ID NO: 1278087 - RNA, 13 nt, Human
augaaacagaaac

SEQ ID NO: 1278088 - RNA, 16 nt, Human
augacuauguaaacua

SEQ ID NO: 1278089 - RNA, 15 nt, Human
augacuauguaaacu

SEQ ID NO: 1278090 - RNA, 16 nt, Human
augacucggggguggg

SEQ ID NO: 1278091 - RNA, 21 nt, Human
augaagcuuuuaugugaaaca

SEQ ID NO: 1278092 - RNA, 20 nt, Human
augaagcuuuuaugugaaac

SEQ ID NO: 1278093 - RNA, 19 nt, Human
augaagcuuuuaugugaaa

SEQ ID NO: 1278094 - RNA, 18 nt, Human
augaagcuuuuaugugaa

SEQ ID NO: 1278095 - RNA, 14 nt, Human
augacccugccucu

SEQ ID NO: 1278096 - RNA, 18 nt, Human
augacccugccucuccca

SEQ ID NO: 1278097 - RNA, 20 nt, Human
augacccugccucucccagg

SEQ ID NO: 1278098 - RNA, 23 nt, Human
augacccugccucucccaggcag

SEQ ID NO: 1278099 - RNA, 18 nt, Human
augaccuaguuuuccaug

SEQ ID NO: 1278100 - RNA, 14 nt, Human
augacccuuuucau

SEQ ID NO: 1278101 - RNA, 12 nt, Human
augaccuccagc

SEQ ID NO: 1278102 - RNA, 13 nt, Human
augaccuccagcu

SEQ ID NO: 1278103 - RNA, 19 nt, Human
augaccuccagcuuuccug

SEQ ID NO: 1278104 - RNA, 21 nt, Human
augaccuccagcuuuccugua

SEQ ID NO: 1278105 - RNA, 17 nt, Human
augacuccauagaccuu

SEQ ID NO: 1278106 - RNA, 18 nt, Human
augagcgugacacucauu

SEQ ID NO: 1278107 - RNA, 22 nt, Human
aucuuauaauuuaaaauaugcu

SEQ ID NO: 1278108 - RNA, 17 nt, Human
aucugggccagaauuuc

SEQ ID NO: 1278109 - RNA, 15 nt, Human
aucugggccuuggcc

SEQ ID NO: 1278110 - RNA, 16 nt, Human
aucugggccuuggccu

SEQ ID NO: 1278111 - RNA, 21 nt, Human
aucugggccuuggccuggagc

SEQ ID NO: 1278112 - RNA, 19 nt, Human
aucugggccuuggccugga

SEQ ID NO: 1278113 - RNA, 17 nt, Human
aucugggcugugggcaa

SEQ ID NO: 1278114 - RNA, 10 nt, Human
aucugggcuu

SEQ ID NO: 1278115 - RNA, 13 nt, Human
aucugggcuuccu

SEQ ID NO: 1278116 - RNA, 14 nt, Human
aucugggcuuccug

SEQ ID NO: 1278117 - RNA, 15 nt, Human
aucugggcuuccugg

SEQ ID NO: 1278118 - RNA, 15 nt, Human
aucugggccagaauu

SEQ ID NO: 1278119 - RNA, 19 nt, Human
aucuggaaccucagccugg

SEQ ID NO: 1278120 - RNA, 20 nt, Human
aucuggaaccucagccuggc

SEQ ID NO: 1278121 - RNA, 21 nt, Human
aucuggaaccucagccuggcc

SEQ ID NO: 1278122 - RNA, 22 nt, Human
aucuggaaccucagccuggcca

SEQ ID NO: 1278123 - RNA, 21 nt, Human
aucuggaagccaaaauguagg

SEQ ID NO: 1278124 - RNA, 14 nt, Human
aucuucaguugucu

SEQ ID NO: 1278125 - RNA, 16 nt, Human
aucuucaguugucucu

SEQ ID NO: 1278126 - RNA, 17 nt, Human
aucuucaguugucucug

SEQ ID NO: 1278127 - RNA, 18 nt, Human
aucuucaguugucucuga

SEQ ID NO: 1278128 - RNA, 19 nt, Human
aucuucaguugucucugau

SEQ ID NO: 1278129 - RNA, 22 nt, Human
aucuuccaauuuaguuguugua

SEQ ID NO: 1278130 - RNA, 15 nt, Human
aucuucucaaguucu

SEQ ID NO: 1278131 - RNA, 16 nt, Human
aucuucucaaguucua

SEQ ID NO: 1278132 - RNA, 18 nt, Human
aucuucucaaguucuaag

SEQ ID NO: 1278133 - RNA, 19 nt, Human
aucuucucaaguucuaaga

SEQ ID NO: 1278134 - RNA, 20 nt, Human
aucuucucaaguucuaagau

SEQ ID NO: 1278135 - RNA, 23 nt, Human
aucuucucaaguucuaagauucu

SEQ ID NO: 1278136 - RNA, 16 nt, Human
aucugggcuuccugga

SEQ ID NO: 1278137 - RNA, 18 nt, Human
aucugggcuuccuggagc

SEQ ID NO: 1278138 - RNA, 16 nt, Human
aucuggggagcaggca

SEQ ID NO: 1278139 - RNA, 20 nt, Human
aucugggcuuccuggagcag

SEQ ID NO: 1278140 - RNA, 15 nt, Human
aucuuauaguucuag

SEQ ID NO: 1278141 - RNA, 17 nt, Human
aucuuauaguucuaggc

SEQ ID NO: 1278142 - RNA, 17 nt, Human
aucucuaccuucucccc

SEQ ID NO: 1278143 - RNA, 19 nt, Human
aucucuaccuucuccccag

SEQ ID NO: 1278144 - RNA, 20 nt, Human
aucucuaccuucuccccagc

SEQ ID NO: 1278145 - RNA, 22 nt, Human
aucucuaccuucuccccagcuc

SEQ ID NO: 1278146 - RNA, 14 nt, Human
aucucucugcccaa

SEQ ID NO: 1278147 - RNA, 14 nt, Human
aucugcuggaguuu

SEQ ID NO: 1278148 - RNA, 18 nt, Human
aucugcuggaguuucaug

SEQ ID NO: 1278149 - RNA, 19 nt, Human
aucuggaacccagacucag

SEQ ID NO: 1278150 - RNA, 23 nt, Human
aucuggaacccagacucagacau

SEQ ID NO: 1278151 - RNA, 11 nt, Human
aucuggaaccu

SEQ ID NO: 1278152 - RNA, 16 nt, Human
aucuggaaccucagcc

SEQ ID NO: 1278153 - RNA, 17 nt, Human
aucuggaaccucagccu

SEQ ID NO: 1278154 - RNA, 18 nt, Human
aucuggaaccucagccug

SEQ ID NO: 1278155 - RNA, 23 nt, Human
aucuugaaauuaagaaggcaaaa

SEQ ID NO: 1278156 - RNA, 21 nt, Human
aucuugaaauuaagaaggcaa

SEQ ID NO: 1278157 - RNA, 22 nt, Human
aucuugaaauuaagaaggcaaa

SEQ ID NO: 1278158 - RNA, 12 nt, Human
aucuugaaauua

SEQ ID NO: 1278159 - RNA, 19 nt, Human
aucaucucagcucacugca

SEQ ID NO: 1278160 - RNA, 14 nt, Human
aucaucucagcuca

SEQ ID NO: 1278161 - RNA, 20 nt, Human
aucaucuccugccuuccucc

SEQ ID NO: 1278162 - RNA, 23 nt, Human
aucaucuccugccuuccuccugg

SEQ ID NO: 1278163 - RNA, 13 nt, Human
aucaucucagcuc

SEQ ID NO: 1278164 - RNA, 19 nt, Human
aucaucuauagaaagcuau

SEQ ID NO: 1278165 - RNA, 18 nt, Human
aucaucuuggaacugcau

SEQ ID NO: 1278166 - RNA, 14 nt, Human
aucaucuuauucag

SEQ ID NO: 1278167 - RNA, 15 nt, Human
aucaucuauagaaag

SEQ ID NO: 1278168 - RNA, 12 nt, Human
aucauggccagc

SEQ ID NO: 1278169 - RNA, 13 nt, Human
aucauggccagcu

SEQ ID NO: 1278170 - RNA, 14 nt, Human
aucauggccagcug

SEQ ID NO: 1278171 - RNA, 17 nt, Human
aucauggccagcuggag

SEQ ID NO: 1278172 - RNA, 19 nt, Human
aucauggccagcuggaggc

SEQ ID NO: 1278173 - RNA, 15 nt, Human
aucauggcuaucugu

SEQ ID NO: 1278174 - RNA, 12 nt, Human
aucaccugcccu

SEQ ID NO: 1278175 - RNA, 13 nt, Human
aucaccugcccug

SEQ ID NO: 1278176 - RNA, 13 nt, Human
aucagccagugac

SEQ ID NO: 1278177 - RNA, 15 nt, Human
aucagccccacccug

SEQ ID NO: 1278178 - RNA, 16 nt, Human
aucagccccacccugg

SEQ ID NO: 1278179 - RNA, 17 nt, Human
aucagccccacccuggc

SEQ ID NO: 1278180 - RNA, 19 nt, Human
aucagccccacccuggccu

SEQ ID NO: 1278181 - RNA, 16 nt, Human
aucagccuacaggccu

SEQ ID NO: 1278182 - RNA, 16 nt, Human
aucagcccuugggggu

SEQ ID NO: 1278183 - RNA, 20 nt, Human
auccacccgccucagccucc

SEQ ID NO: 1278184 - RNA, 23 nt, Human
auccaccccaauccucccagaaa

SEQ ID NO: 1278185 - RNA, 15 nt, Human
auccccuucuccccu

SEQ ID NO: 1278186 - RNA, 20 nt, Human
auccccuucuccccugcacu

SEQ ID NO: 1278187 - RNA, 21 nt, Human
auccccuucuccccugcacug

SEQ ID NO: 1278188 - RNA, 22 nt, Human
auccccuucuccccugcacugu

SEQ ID NO: 1278189 - RNA, 23 nt, Human
auccccuucuccccugcacugua

SEQ ID NO: 1278190 - RNA, 12 nt, Human
auccccuugaac

SEQ ID NO: 1278191 - RNA, 16 nt, Human
auccccuugaacucuu

SEQ ID NO: 1278192 - RNA, 21 nt, Human
auccccuugaggucucagccc

SEQ ID NO: 1278193 - RNA, 22 nt, Human
auccccuugaggucucagcccc

SEQ ID NO: 1278194 - RNA, 14 nt, Human
aucccgagcaccuc

SEQ ID NO: 1278195 - RNA, 17 nt, Human
aucccgagcaccuccac

SEQ ID NO: 1278196 - RNA, 19 nt, Human
aucccgagcaccuccacau

SEQ ID NO: 1278197 - RNA, 19 nt, Human
aucccucacccauccuaga

SEQ ID NO: 1278198 - RNA, 13 nt, Human
aucccucaccugu

SEQ ID NO: 1278199 - RNA, 12 nt, Human
aucccucaccca

SEQ ID NO: 1278200 - RNA, 14 nt, Human
aucccuagcuguga

SEQ ID NO: 1278201 - RNA, 14 nt, Human
aucccggcugcccu

SEQ ID NO: 1278202 - RNA, 14 nt, Human
aucccucaccugua

SEQ ID NO: 1278203 - RNA, 17 nt, Human
aucccucaccuguagca

SEQ ID NO: 1278204 - RNA, 15 nt, Human
auccuuugugaaaaa

SEQ ID NO: 1278205 - RNA, 20 nt, Human
auccuccuaccuccaaagcu

SEQ ID NO: 1278206 - RNA, 20 nt, Human
aucgauuuuuaaaaauuaaa

SEQ ID NO: 1278207 - RNA, 16 nt, Human
aucccucaccuucuga

SEQ ID NO: 1278208 - RNA, 17 nt, Human
aucccucaccuucugag

SEQ ID NO: 1278209 - RNA, 18 nt, Human
aucccucaccuucugagu

SEQ ID NO: 1278210 - RNA, 11 nt, Human
auccucccugu

SEQ ID NO: 1278211 - RNA, 15 nt, Human
auccucccuguaacu

SEQ ID NO: 1278212 - RNA, 16 nt, Human
auccucccuguaacuu

SEQ ID NO: 1278213 - RNA, 15 nt, Human
auccucccuuccucc

SEQ ID NO: 1278214 - RNA, 17 nt, Human
aucgcaccauucugacu

SEQ ID NO: 1278215 - RNA, 18 nt, Human
aucgcaccauucugacuc

SEQ ID NO: 1278216 - RNA, 20 nt, Human
aucgcagaccuuuuuuagga

SEQ ID NO: 1278217 - RNA, 15 nt, Human
aggaacuacugagga

SEQ ID NO: 1278218 - RNA, 17 nt, Human
aggacccggaggggccu

SEQ ID NO: 1278219 - RNA, 17 nt, Human
aggaccugaaauuccaa

SEQ ID NO: 1278220 - RNA, 16 nt, Human
aggagaaccaaaucug

SEQ ID NO: 1278221 - RNA, 19 nt, Human
aggagaaccaaaucuggaa

SEQ ID NO: 1278222 - RNA, 22 nt, Human
aggagaaccaaaucuggaagcc

SEQ ID NO: 1278223 - RNA, 11 nt, Human
aggagaagcca

SEQ ID NO: 1278224 - RNA, 12 nt, Human
aggagaagccag

SEQ ID NO: 1278225 - RNA, 13 nt, Human
aggagaagccagg

SEQ ID NO: 1278226 - RNA, 14 nt, Human
aggagaagccagga

SEQ ID NO: 1278227 - RNA, 15 nt, Human
aggagaagccaggaa

SEQ ID NO: 1278228 - RNA, 12 nt, Human
aggagaagcuca

SEQ ID NO: 1278229 - RNA, 13 nt, Human
aggagaagcucag

SEQ ID NO: 1278230 - RNA, 14 nt, Human
aggagaagcucagc

SEQ ID NO: 1278231 - RNA, 15 nt, Human
aggagaagcucagcu

SEQ ID NO: 1278232 - RNA, 19 nt, Human
aggagaagcucagcugcau

SEQ ID NO: 1278233 - RNA, 13 nt, Human
aggaccagcucag

SEQ ID NO: 1278234 - RNA, 14 nt, Human
aggaccagcucagg

SEQ ID NO: 1278235 - RNA, 15 nt, Human
aggaccagcucagga

SEQ ID NO: 1278236 - RNA, 18 nt, Human
aggaccagcucaggacag

SEQ ID NO: 1278237 - RNA, 23 nt, Human
aggaccagcucaggacagaugcc

SEQ ID NO: 1278238 - RNA, 17 nt, Human
aggaccaagcaucuugg

SEQ ID NO: 1278239 - RNA, 19 nt, Human
aggaccaagcaucuugggg

SEQ ID NO: 1278240 - RNA, 20 nt, Human
aggaccacaggcucaggcag

SEQ ID NO: 1278241 - RNA, 14 nt, Human
aggaccacaggcuc

SEQ ID NO: 1278242 - RNA, 17 nt, Human
aggaccacaggcucagg

SEQ ID NO: 1278243 - RNA, 12 nt, Human
aggaccagaagc

SEQ ID NO: 1278244 - RNA, 16 nt, Human
aggaccagaagcuccc

SEQ ID NO: 1278245 - RNA, 22 nt, Human
aggaccagaagcucccccagca

SEQ ID NO: 1278246 - RNA, 12 nt, Human
aggaccagcuca

SEQ ID NO: 1278247 - RNA, 22 nt, Human
aggauucugcuggccucugcga

SEQ ID NO: 1278248 - RNA, 20 nt, Human
aggauucugcuggccucugc

SEQ ID NO: 1278249 - RNA, 21 nt, Human
aggauucugcuggccucugcg

SEQ ID NO: 1278250 - RNA, 12 nt, Human
aggauucuaaaa

SEQ ID NO: 1278251 - RNA, 14 nt, Human
aggauucuaaaaug

SEQ ID NO: 1278252 - RNA, 13 nt, Human
aggauucugcugg

SEQ ID NO: 1278253 - RNA, 12 nt, Human
aggaggggaaga

SEQ ID NO: 1278254 - RNA, 15 nt, Human
aggaggggaagaggc

SEQ ID NO: 1278255 - RNA, 16 nt, Human
aggaggggaagaggcc

SEQ ID NO: 1278256 - RNA, 18 nt, Human
aggaggggaagaggccug

SEQ ID NO: 1278257 - RNA, 16 nt, Human
aggaggggcuguaaaa

SEQ ID NO: 1278258 - RNA, 14 nt, Human
aggaggggggaggg

SEQ ID NO: 1278259 - RNA, 16 nt, Human
aggaggggggagggaa

SEQ ID NO: 1278260 - RNA, 17 nt, Human
aggaggggggagggaag

SEQ ID NO: 1278261 - RNA, 21 nt, Human
aggaggggggagggaagggag

SEQ ID NO: 1278262 - RNA, 23 nt, Human
aggaggggggagggaagggagcc

SEQ ID NO: 1278263 - RNA, 20 nt, Human
aggagggggucguggagagc

SEQ ID NO: 1278264 - RNA, 21 nt, Human
aggagggggucguggagagcu

SEQ ID NO: 1278265 - RNA, 14 nt, Human
aggauguugaaaaa

SEQ ID NO: 1278266 - RNA, 17 nt, Human
aggauguugaaaaaguu

SEQ ID NO: 1278267 - RNA, 14 nt, Human
aggcacugcugccc

SEQ ID NO: 1278268 - RNA, 16 nt, Human
aggcacugcugcccag

SEQ ID NO: 1278269 - RNA, 22 nt, Human
aggcacugcugcccagccucca

SEQ ID NO: 1278270 - RNA, 21 nt, Human
aggcacugcccugguggcccu

SEQ ID NO: 1278271 - RNA, 13 nt, Human
aggcacugggcau

SEQ ID NO: 1278272 - RNA, 16 nt, Human
aggcacugggcaugag

SEQ ID NO: 1278273 - RNA, 14 nt, Human
aggcacugggcucc

SEQ ID NO: 1278274 - RNA, 16 nt, Human
aggcacuguaguucua

SEQ ID NO: 1278275 - RNA, 17 nt, Human
aggcacuguaguucuaa

SEQ ID NO: 1278276 - RNA, 19 nt, Human
aggcacuguaguucuaaga

SEQ ID NO: 1278277 - RNA, 21 nt, Human
aggcacuguaguucuaagacu

SEQ ID NO: 1278278 - RNA, 19 nt, Human
aggcacugcaaaccgccac

SEQ ID NO: 1278279 - RNA, 13 nt, Human
aggcacugcccug

SEQ ID NO: 1278280 - RNA, 14 nt, Human
aggcacugcccugg

SEQ ID NO: 1278281 - RNA, 15 nt, Human
aggcacugcccuggu

SEQ ID NO: 1278282 - RNA, 22 nt, Human
aggcacugcccugguggcccuc

SEQ ID NO: 1278283 - RNA, 14 nt, Human
agcuguaugauucc

SEQ ID NO: 1278284 - RNA, 21 nt, Human
agcuguauagcugcuuccagu

SEQ ID NO: 1278285 - RNA, 18 nt, Human
agcuuuucccaaaagccc

SEQ ID NO: 1278286 - RNA, 22 nt, Human
aggaaaaagcaaguucgucugu

SEQ ID NO: 1278287 - RNA, 17 nt, Human
aggaaauccaggguggu

SEQ ID NO: 1278288 - RNA, 13 nt, Human
aggaaaucccuuc

SEQ ID NO: 1278289 - RNA, 14 nt, Human
aggaaaucccuuca

SEQ ID NO: 1278290 - RNA, 16 nt, Human
aggaaaucccuucaua

SEQ ID NO: 1278291 - RNA, 18 nt, Human
aggaaaucccuucauacu

SEQ ID NO: 1278292 - RNA, 22 nt, Human
aggaaaucccuucauacuugaa

SEQ ID NO: 1278293 - RNA, 19 nt, Human
aggaaaugaaaaugucuug

SEQ ID NO: 1278294 - RNA, 22 nt, Human
aggaacguaaucguguccccua

SEQ ID NO: 1278295 - RNA, 23 nt, Human
aggaaaugugguagccucacuuu

SEQ ID NO: 1278296 - RNA, 20 nt, Human
aggaaauguuuuuaauaaaa

SEQ ID NO: 1278297 - RNA, 22 nt, Human
aggaaauguuuuuaauaaaaga

SEQ ID NO: 1278298 - RNA, 23 nt, Human
aggaaauguuuuuaauaaaagaa

SEQ ID NO: 1278299 - RNA, 15 nt, Human
agcuuuucccuuuuu

SEQ ID NO: 1278300 - RNA, 21 nt, Human
agcuuuucccuuuuuuuaagu

SEQ ID NO: 1278301 - RNA, 14 nt, Human
aggaaaaacagguc

SEQ ID NO: 1278302 - RNA, 16 nt, Human
agcuuuucccuucuuu

SEQ ID NO: 1278303 - RNA, 23 nt, Human
agcuucuguugcugccucaugcu

SEQ ID NO: 1278304 - RNA, 13 nt, Human
agcuuuucccuuc

SEQ ID NO: 1278305 - RNA, 21 nt, Human
agcuucuguugcugccucaug

SEQ ID NO: 1278306 - RNA, 22 nt, Human
agcuucuguugcugccucaugc

SEQ ID NO: 1278307 - RNA, 19 nt, Human
agcuucucauccugcaggc

SEQ ID NO: 1278308 - RNA, 12 nt, Human
agcuucuccaac

SEQ ID NO: 1278309 - RNA, 21 nt, Human
agcuuccuucagagagcagug

SEQ ID NO: 1278310 - RNA, 20 nt, Human
agcuucguuuauuuucaaga

SEQ ID NO: 1278311 - RNA, 17 nt, Human
agcuucagugcugccga

SEQ ID NO: 1278312 - RNA, 16 nt, Human
agcuuccuucagagag

SEQ ID NO: 1278313 - RNA, 17 nt, Human
agcuuccuucagagagc

SEQ ID NO: 1278314 - RNA, 18 nt, Human
agcuuccuucagagagca

SEQ ID NO: 1278315 - RNA, 19 nt, Human
agcuuccuucagagagcag

SEQ ID NO: 1278316 - RNA, 20 nt, Human
agcuuccuucagagagcagu

SEQ ID NO: 1278317 - RNA, 23 nt, Human
agcuuccuucagagagcagugcu

SEQ ID NO: 1278318 - RNA, 14 nt, Human
agcuggguuggaaa

SEQ ID NO: 1278319 - RNA, 16 nt, Human
agcugggucaggcagg

SEQ ID NO: 1278320 - RNA, 17 nt, Human
agcugggucaggcaggg

SEQ ID NO: 1278321 - RNA, 16 nt, Human
agcugaccagccguga

SEQ ID NO: 1278322 - RNA, 19 nt, Human
agcugaccagccgugagca

SEQ ID NO: 1278323 - RNA, 22 nt, Human
agcugaccagccgugagcaugu

SEQ ID NO: 1278324 - RNA, 22 nt, Human
agcugaggccacacucagcaca

SEQ ID NO: 1278325 - RNA, 12 nt, Human
agcugaggugcc

SEQ ID NO: 1278326 - RNA, 15 nt, Human
agcugaggugcccag

SEQ ID NO: 1278327 - RNA, 16 nt, Human
agcugaggugcccagg

SEQ ID NO: 1278328 - RNA, 17 nt, Human
agcugaggugcccagga

SEQ ID NO: 1278329 - RNA, 18 nt, Human
agcugaggugcccaggag

SEQ ID NO: 1278330 - RNA, 19 nt, Human
agcugaggugcccaggaga

SEQ ID NO: 1278331 - RNA, 22 nt, Human
agcugaggugcccaggagaaga

SEQ ID NO: 1278332 - RNA, 19 nt, Human
agcugaguauuaaaaugua

SEQ ID NO: 1278333 - RNA, 22 nt, Human
agcugaguauuaaaauguaugc

SEQ ID NO: 1278334 - RNA, 21 nt, Human
agcugaguuaggugucugucc

SEQ ID NO: 1278335 - RNA, 13 nt, Human
agcugaguuuccu

SEQ ID NO: 1278336 - RNA, 21 nt, Human
agcugaguuuccuaugggaac

SEQ ID NO: 1278337 - RNA, 20 nt, Human
agcugauacuuugacagugu

SEQ ID NO: 1278338 - RNA, 13 nt, Human
agcugaucaguuu

SEQ ID NO: 1278339 - RNA, 14 nt, Human
agcugaguuuccua

SEQ ID NO: 1278340 - RNA, 18 nt, Human
agcugcuccgaggaccca

SEQ ID NO: 1278341 - RNA, 19 nt, Human
agcugcuccgaggacccag

SEQ ID NO: 1278342 - RNA, 20 nt, Human
agcugcuccgaggacccagg

SEQ ID NO: 1278343 - RNA, 22 nt, Human
agcugcuccgaggacccaggaa

SEQ ID NO: 1278344 - RNA, 16 nt, Human
agcugacaaaauacuu

SEQ ID NO: 1278345 - RNA, 21 nt, Human
agcugacaaaauacuugucug

SEQ ID NO: 1278346 - RNA, 22 nt, Human
agcugaauguuuuucuaaagga

SEQ ID NO: 1278347 - RNA, 24 nt, Human
agcuccuguccccugcuacaccua

SEQ ID NO: 1278348 - RNA, 16 nt, Human
agcuccuguccccugc

SEQ ID NO: 1278349 - RNA, 17 nt, Human
agcuccuguccccugcu

SEQ ID NO: 1278350 - RNA, 18 nt, Human
agcuccuguccccugcua

SEQ ID NO: 1278351 - RNA, 20 nt, Human
agcuccuguccccugcuaca

SEQ ID NO: 1278352 - RNA, 12 nt, Human
agcuccucuguc

SEQ ID NO: 1278353 - RNA, 18 nt, Human
agcuccucugucucgagc

SEQ ID NO: 1278354 - RNA, 24 nt, Human
agcuccucugucucgagcgcccug

SEQ ID NO: 1278355 - RNA, 13 nt, Human
agcuccucuucca

SEQ ID NO: 1278356 - RNA, 14 nt, Human
agcuccucuuccau

SEQ ID NO: 1278357 - RNA, 15 nt, Human
agcuccucuuccaug

SEQ ID NO: 1278358 - RNA, 18 nt, Human
agcuccucuuccaugcug

SEQ ID NO: 1278359 - RNA, 10 nt, Human
agcuccugac

SEQ ID NO: 1278360 - RNA, 18 nt, Human
agcuccugacacugcugg

SEQ ID NO: 1278361 - RNA, 14 nt, Human
agcuccugaccagu

SEQ ID NO: 1278362 - RNA, 15 nt, Human
agcuccugaccaguu

SEQ ID NO: 1278363 - RNA, 16 nt, Human
agcuccugaccaguug

SEQ ID NO: 1278364 - RNA, 19 nt, Human
agcuccugaccaguugcag

SEQ ID NO: 1278365 - RNA, 24 nt, Human
agcuccugaccaguugcagucacu

SEQ ID NO: 1278366 - RNA, 11 nt, Human
agcuccuguaa

SEQ ID NO: 1278367 - RNA, 14 nt, Human
agcuccuguccccu

SEQ ID NO: 1278368 - RNA, 12 nt, Human
agcuccucccac

SEQ ID NO: 1278369 - RNA, 11 nt, Human
agcuccucccc

SEQ ID NO: 1278370 - RNA, 14 nt, Human
agcuccuccccugg

SEQ ID NO: 1278371 - RNA, 17 nt, Human
agcuccuccccuggagg

SEQ ID NO: 1278372 - RNA, 13 nt, Human
agcuccucccucu

SEQ ID NO: 1278373 - RNA, 14 nt, Human
agcuccucccucuc

SEQ ID NO: 1278374 - RNA, 15 nt, Human
agcuccucccucuca

SEQ ID NO: 1278375 - RNA, 17 nt, Human
aggggcagagccaggaa

SEQ ID NO: 1278376 - RNA, 16 nt, Human
aggggcagagccagga

SEQ ID NO: 1278377 - RNA, 15 nt, Human
aggggcagagccagg

SEQ ID NO: 1278378 - RNA, 14 nt, Human
aggggcagagccag

SEQ ID NO: 1278379 - RNA, 13 nt, Human
aggggcagaggcc

SEQ ID NO: 1278380 - RNA, 12 nt, Human
aggggcagcccc

SEQ ID NO: 1278381 - RNA, 13 nt, Human
aggggcagagcca

SEQ ID NO: 1278382 - RNA, 17 nt, Human
aggggccgaugcccaga

SEQ ID NO: 1278383 - RNA, 18 nt, Human
aggggccgaugcccagag

SEQ ID NO: 1278384 - RNA, 19 nt, Human
aggggccgaugcccagaga

SEQ ID NO: 1278385 - RNA, 13 nt, Human
agggcggcagggg

SEQ ID NO: 1278386 - RNA, 15 nt, Human
agggcggcaggggcc

SEQ ID NO: 1278387 - RNA, 16 nt, Human
agggcggcaggggccu

SEQ ID NO: 1278388 - RNA, 18 nt, Human
agggcggcaggggccugg

SEQ ID NO: 1278389 - RNA, 19 nt, Human
agggcggcaggggccugga

SEQ ID NO: 1278390 - RNA, 23 nt, Human
agggcggcaggggccuggagauc

SEQ ID NO: 1278391 - RNA, 17 nt, Human
agggcggccuccuucug

SEQ ID NO: 1278392 - RNA, 17 nt, Human
agggcgggcagagggcu

SEQ ID NO: 1278393 - RNA, 18 nt, Human
agggcgggcagagggcug

SEQ ID NO: 1278394 - RNA, 19 nt, Human
agggcgggcagagggcugg

SEQ ID NO: 1278395 - RNA, 20 nt, Human
agggcgggcagagggcugga

SEQ ID NO: 1278396 - RNA, 17 nt, Human
agggcggggguggcggc

SEQ ID NO: 1278397 - RNA, 18 nt, Human
aggggauuuuuaugucug

SEQ ID NO: 1278398 - RNA, 18 nt, Human
agggcaauuaauuccuuc

SEQ ID NO: 1278399 - RNA, 22 nt, Human
agggcaauuaauuccuucagca

SEQ ID NO: 1278400 - RNA, 19 nt, Human
agggcaauuaauuccuuca

SEQ ID NO: 1278401 - RNA, 12 nt, Human
agggcacaggag

SEQ ID NO: 1278402 - RNA, 13 nt, Human
agggcacaggagc

SEQ ID NO: 1278403 - RNA, 14 nt, Human
agggcacaggagcu

SEQ ID NO: 1278404 - RNA, 15 nt, Human
agggcacaggagcua

SEQ ID NO: 1278405 - RNA, 17 nt, Human
agggcacaggagcuacc

SEQ ID NO: 1278406 - RNA, 18 nt, Human
agggcacaggagcuaccu

SEQ ID NO: 1278407 - RNA, 19 nt, Human
agggcacaggagcuaccug

SEQ ID NO: 1278408 - RNA, 20 nt, Human
agggcacaggagcuaccugu

SEQ ID NO: 1278409 - RNA, 23 nt, Human
agggcacaggagcuaccugugug

SEQ ID NO: 1278410 - RNA, 22 nt, Human
agggcacaggagcuaccugugu

SEQ ID NO: 1278411 - RNA, 23 nt, Human
agggacucaucuuucccuccuug

SEQ ID NO: 1278412 - RNA, 18 nt, Human
agggacucaucuuucccu

SEQ ID NO: 1278413 - RNA, 19 nt, Human
agggacucaucuuucccuc

SEQ ID NO: 1278414 - RNA, 21 nt, Human
agggacucaucuuucccuccu

SEQ ID NO: 1278415 - RNA, 22 nt, Human
agggacucaucuuucccuccuu

SEQ ID NO: 1278416 - RNA, 17 nt, Human
agggacucaucuuuccc

SEQ ID NO: 1278417 - RNA, 17 nt, Human
agggacagaggccccag

SEQ ID NO: 1278418 - RNA, 20 nt, Human
agggacagaggccccagccu

SEQ ID NO: 1278419 - RNA, 21 nt, Human
agggacagaggccccagccuc

SEQ ID NO: 1278420 - RNA, 22 nt, Human
agggacagaggccccagccucc

SEQ ID NO: 1278421 - RNA, 12 nt, Human
aggcugcccucc

SEQ ID NO: 1278422 - RNA, 13 nt, Human
aggcugcccuccu

SEQ ID NO: 1278423 - RNA, 14 nt, Human
aggcugcccuccug

SEQ ID NO: 1278424 - RNA, 22 nt, Human
aggcugcccuccugugcucagc

SEQ ID NO: 1278425 - RNA, 22 nt, Human
aggcugccguccccuagagucc

SEQ ID NO: 1278426 - RNA, 12 nt, Human
aggcugccugag

SEQ ID NO: 1278427 - RNA, 12 nt, Human
aggcugccccuc

SEQ ID NO: 1278428 - RNA, 15 nt, Human
aggcugccccucuca

SEQ ID NO: 1278429 - RNA, 17 nt, Human
aggcugccccucucacc

SEQ ID NO: 1278430 - RNA, 13 nt, Human
aggcugccugagu

SEQ ID NO: 1278431 - RNA, 16 nt, Human
aggcugccguccccua

SEQ ID NO: 1278432 - RNA, 18 nt, Human
aggcuguggaccauggag

SEQ ID NO: 1278433 - RNA, 16 nt, Human
aggcuguggucacagc

SEQ ID NO: 1278434 - RNA, 19 nt, Human
aggcuguggugagggaaga

SEQ ID NO: 1278435 - RNA, 17 nt, Human
aggcuguguaagauuug

SEQ ID NO: 1278436 - RNA, 19 nt, Human
aggcuguguaagauuuguu

SEQ ID NO: 1278437 - RNA, 18 nt, Human
aggcuguguuuggcuuuc

SEQ ID NO: 1278438 - RNA, 20 nt, Human
aggcuguguuuggcuuucag

SEQ ID NO: 1278439 - RNA, 21 nt, Human
aggcuguguuuggcuuucagg

SEQ ID NO: 1278440 - RNA, 22 nt, Human
aggcuguguuuggcuuucaggg

SEQ ID NO: 1278441 - RNA, 19 nt, Human
aggcuguuaaauacaggaa

SEQ ID NO: 1278442 - RNA, 22 nt, Human
aggcuauggacagggcaugcca

SEQ ID NO: 1278443 - RNA, 21 nt, Human
aggcugaugucaauuucugug

SEQ ID NO: 1278444 - RNA, 15 nt, Human
aggcugauuucuagg

SEQ ID NO: 1278445 - RNA, 20 nt, Human
aggcugaacuuguuuucugg

SEQ ID NO: 1278446 - RNA, 21 nt, Human
aggcugaacuuguuuucuggg

SEQ ID NO: 1278447 - RNA, 21 nt, Human
aggcugacaccuaacucuucu

SEQ ID NO: 1278448 - RNA, 21 nt, Human
aggcagacucuuuaugcuugc

SEQ ID NO: 1278449 - RNA, 22 nt, Human
aggcagacucuuuaugcuugca

SEQ ID NO: 1278450 - RNA, 20 nt, Human
aggcagacucuuuaugcuug

SEQ ID NO: 1278451 - RNA, 15 nt, Human
agguggaaauaaacu

SEQ ID NO: 1278452 - RNA, 21 nt, Human
aggugcuucuaguucugccag

SEQ ID NO: 1278453 - RNA, 22 nt, Human
aggugcuucuaguucugccagg

SEQ ID NO: 1278454 - RNA, 17 nt, Human
aggugcuggggccuggu

SEQ ID NO: 1278455 - RNA, 21 nt, Human
aggugcuucaggauaccauau

SEQ ID NO: 1278456 - RNA, 23 nt, Human
aggugcuucuaguucugccagga

SEQ ID NO: 1278457 - RNA, 16 nt, Human
agguggauggccccag

SEQ ID NO: 1278458 - RNA, 23 nt, Human
agguggauggccccagcacagcu

SEQ ID NO: 1278459 - RNA, 20 nt, Human
agguccugguggggcagcuc

SEQ ID NO: 1278460 - RNA, 20 nt, Human
aggucgcuugggaauuuuau

SEQ ID NO: 1278461 - RNA, 20 nt, Human
agguccugagcacugccagg

SEQ ID NO: 1278462 - RNA, 21 nt, Human
agguccugagcacugccagga

SEQ ID NO: 1278463 - RNA, 22 nt, Human
agguccugagcacugccaggag

SEQ ID NO: 1278464 - RNA, 23 nt, Human
agguccugagcacugccaggagg

SEQ ID NO: 1278465 - RNA, 14 nt, Human
agguccuggugggg

SEQ ID NO: 1278466 - RNA, 17 nt, Human
agguccugguggggcag

SEQ ID NO: 1278467 - RNA, 19 nt, Human
agguccugguggggcagcu

SEQ ID NO: 1278468 - RNA, 22 nt, Human
agguccugguggggcagcuccu

SEQ ID NO: 1278469 - RNA, 20 nt, Human
agguccuuaggccucugaga

SEQ ID NO: 1278470 - RNA, 16 nt, Human
aggugcugacggccag

SEQ ID NO: 1278471 - RNA, 17 nt, Human
aggugcugacggccagg

SEQ ID NO: 1278472 - RNA, 20 nt, Human
aggugcugacggccagggag

SEQ ID NO: 1278473 - RNA, 18 nt, Human
aggugcucucuuucuguc

SEQ ID NO: 1278474 - RNA, 17 nt, Human
agguucaugcaaacuuu

SEQ ID NO: 1278475 - RNA, 15 nt, Human
agguucagccaaggu

SEQ ID NO: 1278476 - RNA, 19 nt, Human
agguucagccaagguuuua

SEQ ID NO: 1278477 - RNA, 19 nt, Human
agguucaagcaauccuccc

SEQ ID NO: 1278478 - RNA, 13 nt, Human
agguucagccaag

SEQ ID NO: 1278479 - RNA, 11 nt, Human
agguucuaaaa

SEQ ID NO: 1278480 - RNA, 11 nt, Human
agguucuaaag

SEQ ID NO: 1278481 - RNA, 12 nt, Human
agguucuaaagu

SEQ ID NO: 1278482 - RNA, 18 nt, Human
agguucauggauuuucca

SEQ ID NO: 1278483 - RNA, 18 nt, Human
agguuccacagaggacac

SEQ ID NO: 1278484 - RNA, 14 nt, Human
agguucccaagcuc

SEQ ID NO: 1278485 - RNA, 15 nt, Human
agguucccaagcuca

SEQ ID NO: 1278486 - RNA, 16 nt, Human
agguucccaagcucag

SEQ ID NO: 1278487 - RNA, 13 nt, Human
agguucccacuua

SEQ ID NO: 1278488 - RNA, 14 nt, Human
agguucccucccag

SEQ ID NO: 1278489 - RNA, 16 nt, Human
agguuaauauuuaaga

SEQ ID NO: 1278490 - RNA, 14 nt, Human
agguucaacuuauu

SEQ ID NO: 1278491 - RNA, 13 nt, Human
agguuaauauuua

SEQ ID NO: 1278492 - RNA, 22 nt, Human
agguucuaaggccuaggauucu

SEQ ID NO: 1278493 - RNA, 15 nt, Human
agguucuaaggccua

SEQ ID NO: 1278494 - RNA, 19 nt, Human
agguucuaaggccuaggau

SEQ ID NO: 1278495 - RNA, 23 nt, Human
agguucuaaaguucuaagauucu

SEQ ID NO: 1278496 - RNA, 14 nt, Human
agguucuaacccua

SEQ ID NO: 1278497 - RNA, 12 nt, Human
agguucuaaggc

SEQ ID NO: 1278498 - RNA, 13 nt, Human
agguucuaaggcc

SEQ ID NO: 1278499 - RNA, 13 nt, Human
agguucuaaaguu

SEQ ID NO: 1278500 - RNA, 14 nt, Human
agguucuaaaguuc

SEQ ID NO: 1278501 - RNA, 15 nt, Human
agguucuaaaguucu

SEQ ID NO: 1278502 - RNA, 16 nt, Human
agguucuaaaguucua

SEQ ID NO: 1278503 - RNA, 17 nt, Human
agguucuaaaguucuaa

SEQ ID NO: 1278504 - RNA, 18 nt, Human
agguucuaaaguucuaag

SEQ ID NO: 1278505 - RNA, 19 nt, Human
agguucuaaaguucuaaga

SEQ ID NO: 1278506 - RNA, 20 nt, Human
agguucuaaaguucuaagau

SEQ ID NO: 1278507 - RNA, 17 nt, Human
aggucccuaauaaagcu

SEQ ID NO: 1278508 - RNA, 21 nt, Human
agguaauccaagauauuuuaa

SEQ ID NO: 1278509 - RNA, 12 nt, Human
agguaccauccu

SEQ ID NO: 1278510 - RNA, 19 nt, Human
aggucccuaauaaagcugu

SEQ ID NO: 1278511 - RNA, 18 nt, Human
aggucccuaauaaagcug

SEQ ID NO: 1278512 - RNA, 20 nt, Human
aggucccuaauaaagcugug

SEQ ID NO: 1278513 - RNA, 23 nt, Human
aggucccuaauaaagcugugugg

SEQ ID NO: 1278514 - RNA, 13 nt, Human
agguaaguuuuuu

SEQ ID NO: 1278515 - RNA, 18 nt, Human
agguaauauaaaaagcuu

SEQ ID NO: 1278516 - RNA, 17 nt, Human
agguaaucgaccugccu

SEQ ID NO: 1278517 - RNA, 18 nt, Human
agguaaucgaccugccuc

SEQ ID NO: 1278518 - RNA, 19 nt, Human
agguaaucgaccugccucg

SEQ ID NO: 1278519 - RNA, 22 nt, Human
agguaagaaguuuuaaaaagcc

SEQ ID NO: 1278520 - RNA, 19 nt, Human
agguaagggugacaaaugg

SEQ ID NO: 1278521 - RNA, 17 nt, Human
aggggccgggggcaguc

SEQ ID NO: 1278522 - RNA, 15 nt, Human
agccagcacacaggg

SEQ ID NO: 1278523 - RNA, 18 nt, Human
agccagauuuuuuaaaau

SEQ ID NO: 1278524 - RNA, 23 nt, Human
agccagauuuuuuaaaauuuaua

SEQ ID NO: 1278525 - RNA, 22 nt, Human
agccagauuuuuuaaaauuuau

SEQ ID NO: 1278526 - RNA, 13 nt, Human
agccagcacacag

SEQ ID NO: 1278527 - RNA, 15 nt, Human
agccagauuuuccug

SEQ ID NO: 1278528 - RNA, 19 nt, Human
agccagauuuuccugaaaa

SEQ ID NO: 1278529 - RNA, 15 nt, Human
agccauguuucacaa

SEQ ID NO: 1278530 - RNA, 21 nt, Human
agccauuggcuauuuaaaacu

SEQ ID NO: 1278531 - RNA, 22 nt, Human
agccauuggcuauuuaaaacuu

SEQ ID NO: 1278532 - RNA, 12 nt, Human
agccauuugaga

SEQ ID NO: 1278533 - RNA, 15 nt, Human
agcaugcaucuguuu

SEQ ID NO: 1278534 - RNA, 11 nt, Human
agccagaggcu

SEQ ID NO: 1278535 - RNA, 14 nt, Human
agccagaggcuggg

SEQ ID NO: 1278536 - RNA, 15 nt, Human
agccagaggcugggu

SEQ ID NO: 1278537 - RNA, 18 nt, Human
agccagaggcuggguuca

SEQ ID NO: 1278538 - RNA, 14 nt, Human
agcaugcacaaauu

SEQ ID NO: 1278539 - RNA, 18 nt, Human
agcaugcaauacauacca

SEQ ID NO: 1278540 - RNA, 15 nt, Human
agcaucuugcauuau

SEQ ID NO: 1278541 - RNA, 19 nt, Human
agcaucuuggggggguggc

SEQ ID NO: 1278542 - RNA, 21 nt, Human
agcaucuuggggggguggccg

SEQ ID NO: 1278543 - RNA, 23 nt, Human
agcaucuuggggggguggccgcu

SEQ ID NO: 1278544 - RNA, 19 nt, Human
agcaguugagacaagaaaa

SEQ ID NO: 1278545 - RNA, 22 nt, Human
agcaguugagacaagaaaauaa

SEQ ID NO: 1278546 - RNA, 20 nt, Human
agcaguugagacaagaaaau

SEQ ID NO: 1278547 - RNA, 12 nt, Human
agcacugcucca

SEQ ID NO: 1278548 - RNA, 17 nt, Human
agcacugcuugaggaaa

SEQ ID NO: 1278549 - RNA, 21 nt, Human
agcacugccugcucccauccu

SEQ ID NO: 1278550 - RNA, 14 nt, Human
agcacugccaggag

SEQ ID NO: 1278551 - RNA, 15 nt, Human
agcacugccaggagg

SEQ ID NO: 1278552 - RNA, 17 nt, Human
agcacugccaggaggga

SEQ ID NO: 1278553 - RNA, 16 nt, Human
agcacugccaggaggg

SEQ ID NO: 1278554 - RNA, 13 nt, Human
agcacugccugcu

SEQ ID NO: 1278555 - RNA, 15 nt, Human
agcacugccugcucc

SEQ ID NO: 1278556 - RNA, 16 nt, Human
agcacugccugcuccc

SEQ ID NO: 1278557 - RNA, 19 nt, Human
agcacugccugcucccauc

SEQ ID NO: 1278558 - RNA, 20 nt, Human
agcacugccugcucccaucc

SEQ ID NO: 1278559 - RNA, 17 nt, Human
agcacgugguaaaacac

SEQ ID NO: 1278560 - RNA, 21 nt, Human
agcagugaaugauucaguguu

SEQ ID NO: 1278561 - RNA, 22 nt, Human
agcagugaaugauucaguguua

SEQ ID NO: 1278562 - RNA, 21 nt, Human
agcagucgugccuguguccau

SEQ ID NO: 1278563 - RNA, 20 nt, Human
agcagugaaugauucagugu

SEQ ID NO: 1278564 - RNA, 10 nt, Human
agcagccacg

SEQ ID NO: 1278565 - RNA, 13 nt, Human
agcagccacgagg

SEQ ID NO: 1278566 - RNA, 11 nt, Human
agcagccagcc

SEQ ID NO: 1278567 - RNA, 12 nt, Human
agcagccagccc

SEQ ID NO: 1278568 - RNA, 13 nt, Human
agcagccagcccu

SEQ ID NO: 1278569 - RNA, 14 nt, Human
agcagccagcccug

SEQ ID NO: 1278570 - RNA, 15 nt, Human
agcagccagcccugc

SEQ ID NO: 1278571 - RNA, 16 nt, Human
agcagccagcccugcc

SEQ ID NO: 1278572 - RNA, 17 nt, Human
agcagccagcccugccu

SEQ ID NO: 1278573 - RNA, 18 nt, Human
agcagccagcccugccug

SEQ ID NO: 1278574 - RNA, 19 nt, Human
agcagccagcccugccugg

SEQ ID NO: 1278575 - RNA, 20 nt, Human
agcagccagcccugccugga

SEQ ID NO: 1278576 - RNA, 21 nt, Human
agcagccagcccugccuggag

SEQ ID NO: 1278577 - RNA, 23 nt, Human
agcagccagcccugccuggagga

SEQ ID NO: 1278578 - RNA, 22 nt, Human
agcagccagcccugccuggagg

SEQ ID NO: 1278579 - RNA, 23 nt, Human
agcagccccacaccagggccagc

SEQ ID NO: 1278580 - RNA, 14 nt, Human
agcagcccccagcu

SEQ ID NO: 1278581 - RNA, 17 nt, Human
agcagcccccagcuccc

SEQ ID NO: 1278582 - RNA, 19 nt, Human
agcagcccccagcucccac

SEQ ID NO: 1278583 - RNA, 20 nt, Human
agcagcccccagcucccacc

SEQ ID NO: 1278584 - RNA, 16 nt, Human
agauguagaggagaaa

SEQ ID NO: 1278585 - RNA, 14 nt, Human
agauguagaggaga

SEQ ID NO: 1278586 - RNA, 14 nt, Human
agauguaauuuugu

SEQ ID NO: 1278587 - RNA, 15 nt, Human
agauguaauuuugug

SEQ ID NO: 1278588 - RNA, 17 nt, Human
agauguaauuuugugua

SEQ ID NO: 1278589 - RNA, 19 nt, Human
agauguaauuuuguguaag

SEQ ID NO: 1278590 - RNA, 21 nt, Human
agaugggagaaucacuugaac

SEQ ID NO: 1278591 - RNA, 16 nt, Human
agaugggacaauuaga

SEQ ID NO: 1278592 - RNA, 13 nt, Human
agauguaauuuug

SEQ ID NO: 1278593 - RNA, 23 nt, Human
agccccauaauuuuuuuuuuccu

SEQ ID NO: 1278594 - RNA, 17 nt, Human
agccccagugacagcua

SEQ ID NO: 1278595 - RNA, 17 nt, Human
agcccuagacuggugcu

SEQ ID NO: 1278596 - RNA, 19 nt, Human
agcccugaggacagaugcc

SEQ ID NO: 1278597 - RNA, 22 nt, Human
agcccugaggacagaugccucc

SEQ ID NO: 1278598 - RNA, 23 nt, Human
agcccugaggacagaugccuccu

SEQ ID NO: 1278599 - RNA, 16 nt, Human
agcccuaggguggaga

SEQ ID NO: 1278600 - RNA, 17 nt, Human
agcccuaggguggagag

SEQ ID NO: 1278601 - RNA, 20 nt, Human
agcccuaggguggagagcca

SEQ ID NO: 1278602 - RNA, 13 nt, Human
agccccagccagg

SEQ ID NO: 1278603 - RNA, 14 nt, Human
agccccagccaggg

SEQ ID NO: 1278604 - RNA, 21 nt, Human
agccccagcccagccccacuc

SEQ ID NO: 1278605 - RNA, 19 nt, Human
agccccagcccagccccac

SEQ ID NO: 1278606 - RNA, 16 nt, Human
agccccacccaggcca

SEQ ID NO: 1278607 - RNA, 20 nt, Human
agccccacccaggccaggca

SEQ ID NO: 1278608 - RNA, 18 nt, Human
agccccaccccagggcag

SEQ ID NO: 1278609 - RNA, 22 nt, Human
agccccaccccagggcagccag

SEQ ID NO: 1278610 - RNA, 23 nt, Human
agccccaccccagggcagccagg

SEQ ID NO: 1278611 - RNA, 16 nt, Human
agccccacccuggccu

SEQ ID NO: 1278612 - RNA, 17 nt, Human
agccccacccuggccua

SEQ ID NO: 1278613 - RNA, 13 nt, Human
agccccacuccuc

SEQ ID NO: 1278614 - RNA, 21 nt, Human
agcccaaguucaugcagcugu

SEQ ID NO: 1278615 - RNA, 23 nt, Human
agcccaaguucaugcagcugugg

SEQ ID NO: 1278616 - RNA, 15 nt, Human
agccuccccugccag

SEQ ID NO: 1278617 - RNA, 16 nt, Human
agccuccccugccagg

SEQ ID NO: 1278618 - RNA, 17 nt, Human
agccuccccugccaggg

SEQ ID NO: 1278619 - RNA, 18 nt, Human
agccuccccugccagggc

SEQ ID NO: 1278620 - RNA, 19 nt, Human
agccuccccugccagggca

SEQ ID NO: 1278621 - RNA, 20 nt, Human
agccuccccugccagggcag

SEQ ID NO: 1278622 - RNA, 22 nt, Human
agccuccccugccagggcaggg

SEQ ID NO: 1278623 - RNA, 13 nt, Human
agccucccugaag

SEQ ID NO: 1278624 - RNA, 17 nt, Human
agccucccugaagacca

SEQ ID NO: 1278625 - RNA, 14 nt, Human
agccucccugaagc

SEQ ID NO: 1278626 - RNA, 15 nt, Human
agccucccugaagcc

SEQ ID NO: 1278627 - RNA, 16 nt, Human
agccucccugaagccu

SEQ ID NO: 1278628 - RNA, 20 nt, Human
agccgggucugccucuucug

SEQ ID NO: 1278629 - RNA, 21 nt, Human
agccgggucugccucuucugg

SEQ ID NO: 1278630 - RNA, 22 nt, Human
agccgggucugccucuucuggg

SEQ ID NO: 1278631 - RNA, 16 nt, Human
agccggguguccccaa

SEQ ID NO: 1278632 - RNA, 20 nt, Human
agccgcuuggcgaugccagc

SEQ ID NO: 1278633 - RNA, 21 nt, Human
agccgcuuggcgaugccagcc

SEQ ID NO: 1278634 - RNA, 14 nt, Human
agccggcacagggu

SEQ ID NO: 1278635 - RNA, 15 nt, Human
agccggcacaggguc

SEQ ID NO: 1278636 - RNA, 16 nt, Human
agccggcacagggucu

SEQ ID NO: 1278637 - RNA, 16 nt, Human
agccgggguggggugg

SEQ ID NO: 1278638 - RNA, 19 nt, Human
agccggggugggguggcug

SEQ ID NO: 1278639 - RNA, 20 nt, Human
agccggggugggguggcugc

SEQ ID NO: 1278640 - RNA, 23 nt, Human
agccggggugggguggcugcagc

SEQ ID NO: 1278641 - RNA, 24 nt, Human
agccggggugggguggcugcagcc

SEQ ID NO: 1278642 - RNA, 16 nt, Human
agccgggucugccucu

SEQ ID NO: 1278643 - RNA, 14 nt, Human
agccgagcaggagg

SEQ ID NO: 1278644 - RNA, 15 nt, Human
agccgagcaggaggc

SEQ ID NO: 1278645 - RNA, 23 nt, Human
agacuacaggcacacaccaccac

SEQ ID NO: 1278646 - RNA, 16 nt, Human
agacuacagcuggggu

SEQ ID NO: 1278647 - RNA, 21 nt, Human
agacuacagcuggggugcagg

SEQ ID NO: 1278648 - RNA, 22 nt, Human
agacguuuuauaagcaucauua

SEQ ID NO: 1278649 - RNA, 16 nt, Human
agacguuuuauaagca

SEQ ID NO: 1278650 - RNA, 13 nt, Human
agacuaagccagc

SEQ ID NO: 1278651 - RNA, 15 nt, Human
agacuaagccagcac

SEQ ID NO: 1278652 - RNA, 16 nt, Human
agacuaagccagcacc

SEQ ID NO: 1278653 - RNA, 14 nt, Human
agacgggcccuggu

SEQ ID NO: 1278654 - RNA, 21 nt, Human
agaccaagauggcccauccug

SEQ ID NO: 1278655 - RNA, 11 nt, Human
agaccaauaaa

SEQ ID NO: 1278656 - RNA, 19 nt, Human
agaccaaggcuuucucuac

SEQ ID NO: 1278657 - RNA, 14 nt, Human
agaccacaugcccc

SEQ ID NO: 1278658 - RNA, 13 nt, Human
agaccaccaagcc

SEQ ID NO: 1278659 - RNA, 14 nt, Human
agaccaccaagccu

SEQ ID NO: 1278660 - RNA, 13 nt, Human
agaccauaauguu

SEQ ID NO: 1278661 - RNA, 17 nt, Human
agaccauccaccaggcc

SEQ ID NO: 1278662 - RNA, 12 nt, Human
agaccagggcuc

SEQ ID NO: 1278663 - RNA, 18 nt, Human
agaccagggcuccagccc

SEQ ID NO: 1278664 - RNA, 16 nt, Human
agaccagggcuccagc

SEQ ID NO: 1278665 - RNA, 13 nt, Human
agagaaggagcag

SEQ ID NO: 1278666 - RNA, 23 nt, Human
agagaagccuucaagcucugagg

SEQ ID NO: 1278667 - RNA, 12 nt, Human
agagaagccuuc

SEQ ID NO: 1278668 - RNA, 13 nt, Human
agagaagccuuca

SEQ ID NO: 1278669 - RNA, 14 nt, Human
agagaagccuucaa

SEQ ID NO: 1278670 - RNA, 17 nt, Human
agagaagccuucaagcu

SEQ ID NO: 1278671 - RNA, 21 nt, Human
agagaagccuucaagcucuga

SEQ ID NO: 1278672 - RNA, 22 nt, Human
agagaagccuucaagcucugag

SEQ ID NO: 1278673 - RNA, 15 nt, Human
agagaagcaaguaaa

SEQ ID NO: 1278674 - RNA, 22 nt, Human
agagaagcauucucauuggaaa

SEQ ID NO: 1278675 - RNA, 23 nt, Human
agagaagcauucucauuggaaau

SEQ ID NO: 1278676 - RNA, 11 nt, Human
agagaagccag

SEQ ID NO: 1278677 - RNA, 12 nt, Human
agagaagccagc

SEQ ID NO: 1278678 - RNA, 13 nt, Human
agagaagccagcu

SEQ ID NO: 1278679 - RNA, 14 nt, Human
agagaagccagcuu

SEQ ID NO: 1278680 - RNA, 16 nt, Human
agagaagccagcuugu

SEQ ID NO: 1278681 - RNA, 13 nt, Human
agagaagccauca

SEQ ID NO: 1278682 - RNA, 16 nt, Human
agagaagccaucaccu

SEQ ID NO: 1278683 - RNA, 22 nt, Human
agagaagccaucaccucagaug

SEQ ID NO: 1278684 - RNA, 16 nt, Human
agagagcuucuguugc

SEQ ID NO: 1278685 - RNA, 16 nt, Human
agagaaguagaaauca

SEQ ID NO: 1278686 - RNA, 20 nt, Human
agagagcuucuguugcugcc

SEQ ID NO: 1278687 - RNA, 23 nt, Human
agagagcuucuguugcugccuca

SEQ ID NO: 1278688 - RNA, 17 nt, Human
agacugcauuauauuua

SEQ ID NO: 1278689 - RNA, 21 nt, Human
agacugcauuauauuuauuac

SEQ ID NO: 1278690 - RNA, 18 nt, Human
agagaaaggggagcccac

SEQ ID NO: 1278691 - RNA, 19 nt, Human
agagaaaggggagcccacu

SEQ ID NO: 1278692 - RNA, 21 nt, Human
agagaaaggggagcccacugu

SEQ ID NO: 1278693 - RNA, 23 nt, Human
agagaaaggggagcccacugucc

SEQ ID NO: 1278694 - RNA, 15 nt, Human
agagcccuucauuug

SEQ ID NO: 1278695 - RNA, 15 nt, Human
agagcccugggaccg

SEQ ID NO: 1278696 - RNA, 17 nt, Human
agagcccugggaccgcu

SEQ ID NO: 1278697 - RNA, 12 nt, Human
agagcccuggga

SEQ ID NO: 1278698 - RNA, 13 nt, Human
agagcccugggac

SEQ ID NO: 1278699 - RNA, 19 nt, Human
agagcccugucaguagagu

SEQ ID NO: 1278700 - RNA, 10 nt, Human
agagccuggg

SEQ ID NO: 1278701 - RNA, 12 nt, Human
agagccuggggc

SEQ ID NO: 1278702 - RNA, 13 nt, Human
agagccuggggcu

SEQ ID NO: 1278703 - RNA, 16 nt, Human
agagccuggggcucua

SEQ ID NO: 1278704 - RNA, 23 nt, Human
agagccuggggcucuaacgccug

SEQ ID NO: 1278705 - RNA, 16 nt, Human
agagccuguaaacuuu

SEQ ID NO: 1278706 - RNA, 20 nt, Human
agagccuuccacccaggggc

SEQ ID NO: 1278707 - RNA, 22 nt, Human
agagccuuccacccaggggcag

SEQ ID NO: 1278708 - RNA, 13 nt, Human
agagccuuccacc

SEQ ID NO: 1278709 - RNA, 16 nt, Human
agagccuuccacccag

SEQ ID NO: 1278710 - RNA, 17 nt, Human
agagccuuccacccagg

SEQ ID NO: 1278711 - RNA, 14 nt, Human
agagaguggcuccu

SEQ ID NO: 1278712 - RNA, 16 nt, Human
agagaguggcuccucc

SEQ ID NO: 1278713 - RNA, 22 nt, Human
agagagguuugcagucccaagc

SEQ ID NO: 1278714 - RNA, 22 nt, Human
agagcccgaggaggugucucag

SEQ ID NO: 1278715 - RNA, 21 nt, Human
agagcccgaggaggugucuca

SEQ ID NO: 1278716 - RNA, 14 nt, Human
agagcccugaggcc

SEQ ID NO: 1278717 - RNA, 22 nt, Human
agagcccugaggccuagacucu

SEQ ID NO: 1278718 - RNA, 18 nt, Human
agagcccugaggccuaga

SEQ ID NO: 1278719 - RNA, 16 nt, Human
agaggguguccugcac

SEQ ID NO: 1278720 - RNA, 20 nt, Human
agaggggccgaugcccagag

SEQ ID NO: 1278721 - RNA, 13 nt, Human
agaggggccugcc

SEQ ID NO: 1278722 - RNA, 14 nt, Human
agaggggccugcca

SEQ ID NO: 1278723 - RNA, 17 nt, Human
agaggggccugccaccu

SEQ ID NO: 1278724 - RNA, 20 nt, Human
agaggggccugccaccugga

SEQ ID NO: 1278725 - RNA, 21 nt, Human
agaggggccugccaccuggac

SEQ ID NO: 1278726 - RNA, 22 nt, Human
agaggggccugccaccuggacc

SEQ ID NO: 1278727 - RNA, 23 nt, Human
agaggggccugccaccuggaccc

SEQ ID NO: 1278728 - RNA, 21 nt, Human
agaggggcugaauagcagaag

SEQ ID NO: 1278729 - RNA, 15 nt, Human
agaguuacaguucug

SEQ ID NO: 1278730 - RNA, 16 nt, Human
agaguuacaguucugu

SEQ ID NO: 1278731 - RNA, 17 nt, Human
agaguuacaguucugug

SEQ ID NO: 1278732 - RNA, 22 nt, Human
agaguuacaguucugugguuuc

SEQ ID NO: 1278733 - RNA, 11 nt, Human
agaguuacagu

SEQ ID NO: 1278734 - RNA, 16 nt, Human
agauacuuaagugcug

SEQ ID NO: 1278735 - RNA, 17 nt, Human
agaggagccaccaguuc

SEQ ID NO: 1278736 - RNA, 23 nt, Human
agaggagcccccacccuguuccu

SEQ ID NO: 1278737 - RNA, 21 nt, Human
agaggauggucuuacagcagg

SEQ ID NO: 1278738 - RNA, 21 nt, Human
agauaggucagugcaaauacu

SEQ ID NO: 1278739 - RNA, 17 nt, Human
agauaguuuucauccau

SEQ ID NO: 1278740 - RNA, 13 nt, Human
agauaguuuucau

SEQ ID NO: 1278741 - RNA, 14 nt, Human
agauaguuuucauc

SEQ ID NO: 1278742 - RNA, 21 nt, Human
agaugaggccagaccauggac

SEQ ID NO: 1278743 - RNA, 16 nt, Human
agaugaggccagacca

SEQ ID NO: 1278744 - RNA, 14 nt, Human
agaugaggccagac

SEQ ID NO: 1278745 - RNA, 13 nt, Human
agaugaggccaga

SEQ ID NO: 1278746 - RNA, 22 nt, Human
agaugaggccagaccauggaca

SEQ ID NO: 1278747 - RNA, 23 nt, Human
agauggcugugccucugccuguc

SEQ ID NO: 1278748 - RNA, 15 nt, Human
agaucuuagauucuc

SEQ ID NO: 1278749 - RNA, 18 nt, Human
agaucuguuuugaaggca

SEQ ID NO: 1278750 - RNA, 14 nt, Human
agaucuuagauucu

SEQ ID NO: 1278751 - RNA, 14 nt, Human
agaugacugagggu

SEQ ID NO: 1278752 - RNA, 14 nt, Human
agaugacuugaggc

SEQ ID NO: 1278753 - RNA, 23 nt, Human
agaucuguccucagccuugccag

SEQ ID NO: 1278754 - RNA, 14 nt, Human
agaucuguuuugaa

SEQ ID NO: 1278755 - RNA, 21 nt, Human
agaucuguuuugaaggcaaaa

SEQ ID NO: 1278756 - RNA, 21 nt, Human
aauggcuuuggucucuugcuu

SEQ ID NO: 1278757 - RNA, 18 nt, Human
aauggcuuuggucucuug

SEQ ID NO: 1278758 - RNA, 16 nt, Human
aauggcugauaauuuu

SEQ ID NO: 1278759 - RNA, 17 nt, Human
aauggcugauaauuuua

SEQ ID NO: 1278760 - RNA, 18 nt, Human
aauggcugauaauuuuaa

SEQ ID NO: 1278761 - RNA, 19 nt, Human
aauggcugauaauuuuaaa

SEQ ID NO: 1278762 - RNA, 16 nt, Human
aaugggcucaaccaga

SEQ ID NO: 1278763 - RNA, 14 nt, Human
aaugggcucaaacu

SEQ ID NO: 1278764 - RNA, 12 nt, Human
aauggggccaga

SEQ ID NO: 1278765 - RNA, 13 nt, Human
aauggggccagau

SEQ ID NO: 1278766 - RNA, 14 nt, Human
aauggggccagauc

SEQ ID NO: 1278767 - RNA, 20 nt, Human
aaugguacuccacauauuuc

SEQ ID NO: 1278768 - RNA, 18 nt, Human
aaugguacugacuuugcu

SEQ ID NO: 1278769 - RNA, 17 nt, Human
aaugguaggcauuuccu

SEQ ID NO: 1278770 - RNA, 18 nt, Human
aaugguaggcauuuccua

SEQ ID NO: 1278771 - RNA, 13 nt, Human
aaugucuggagac

SEQ ID NO: 1278772 - RNA, 14 nt, Human
aaugucuggagacc

SEQ ID NO: 1278773 - RNA, 20 nt, Human
aaugucuggagaccaccagg

SEQ ID NO: 1278774 - RNA, 22 nt, Human
aaugucucacugagcacuguuu

SEQ ID NO: 1278775 - RNA, 19 nt, Human
aaugucucacugagcacug

SEQ ID NO: 1278776 - RNA, 16 nt, Human
aaugucucacugagca

SEQ ID NO: 1278777 - RNA, 15 nt, Human
aaugguguagaacac

SEQ ID NO: 1278778 - RNA, 22 nt, Human
aauggucuuucuaaugugugaa

SEQ ID NO: 1278779 - RNA, 16 nt, Human
aauggugccuucauuu

SEQ ID NO: 1278780 - RNA, 20 nt, Human
aaugucuugaugcaugcacu

SEQ ID NO: 1278781 - RNA, 11 nt, Human
aaugucuugug

SEQ ID NO: 1278782 - RNA, 13 nt, Human
aaugucuuguguu

SEQ ID NO: 1278783 - RNA, 13 nt, Human
aaugucuugagcu

SEQ ID NO: 1278784 - RNA, 14 nt, Human
aaugucuugagcuc

SEQ ID NO: 1278785 - RNA, 15 nt, Human
aaugucuugagcucu

SEQ ID NO: 1278786 - RNA, 17 nt, Human
aaugucuugagcucuau

SEQ ID NO: 1278787 - RNA, 19 nt, Human
aaugucuugagcucuauua

SEQ ID NO: 1278788 - RNA, 16 nt, Human
aauuaaaagcaaauca

SEQ ID NO: 1278789 - RNA, 18 nt, Human
aauuaaaagcaaaucauu

SEQ ID NO: 1278790 - RNA, 21 nt, Human
aauuaaaagcaaaucauuugu

SEQ ID NO: 1278791 - RNA, 20 nt, Human
aauuaaaagcaaaucauuug

SEQ ID NO: 1278792 - RNA, 12 nt, Human
aauuaaacuuag

SEQ ID NO: 1278793 - RNA, 14 nt, Human
aauuaaacuuuuaa

SEQ ID NO: 1278794 - RNA, 22 nt, Human
aauguuuuuaauaaaagaaaau

SEQ ID NO: 1278795 - RNA, 14 nt, Human
aauguuuuucuaaa

SEQ ID NO: 1278796 - RNA, 15 nt, Human
aauguuuuucuaaag

SEQ ID NO: 1278797 - RNA, 23 nt, Human
aauguuuuuugccacagcuuuug

SEQ ID NO: 1278798 - RNA, 13 nt, Human
aauguuuuuugcc

SEQ ID NO: 1278799 - RNA, 15 nt, Human
aauguuuuuugccac

SEQ ID NO: 1278800 - RNA, 19 nt, Human
aauuaaacuuuuaauucau

SEQ ID NO: 1278801 - RNA, 15 nt, Human
aauuaaagcuguuau

SEQ ID NO: 1278802 - RNA, 14 nt, Human
aauuaaaguacuuu

SEQ ID NO: 1278803 - RNA, 16 nt, Human
aauuaaaguacuuuaa

SEQ ID NO: 1278804 - RNA, 14 nt, Human
aauuaguuuuauau

SEQ ID NO: 1278805 - RNA, 14 nt, Human
aauuaguuauauau

SEQ ID NO: 1278806 - RNA, 12 nt, Human
aauuaguuuccu

SEQ ID NO: 1278807 - RNA, 13 nt, Human
aauuaguuuccuu

SEQ ID NO: 1278808 - RNA, 14 nt, Human
aauuaguuuccuuu

SEQ ID NO: 1278809 - RNA, 15 nt, Human
aauuaguuuccuuuu

SEQ ID NO: 1278810 - RNA, 23 nt, Human
aauuaguuuccuuuuuaauaugc

SEQ ID NO: 1278811 - RNA, 17 nt, Human
aauuaguuuuauaugcu

SEQ ID NO: 1278812 - RNA, 20 nt, Human
aauuaguuuuauaugcuucu

SEQ ID NO: 1278813 - RNA, 12 nt, Human
aaugaagauacu

SEQ ID NO: 1278814 - RNA, 19 nt, Human
aaugaagacaaaacauaca

SEQ ID NO: 1278815 - RNA, 22 nt, Human
aaugaacagaacauagacagaa

SEQ ID NO: 1278816 - RNA, 11 nt, Human
aaugaagaaag

SEQ ID NO: 1278817 - RNA, 20 nt, Human
aaugauaacuggaaacuuca

SEQ ID NO: 1278818 - RNA, 17 nt, Human
aaugaagauacugaaau

SEQ ID NO: 1278819 - RNA, 21 nt, Human
aaugaucugauugaccguguu

SEQ ID NO: 1278820 - RNA, 18 nt, Human
aaucugcauuauuggaau

SEQ ID NO: 1278821 - RNA, 19 nt, Human
aaucugcuaccaaaacagu

SEQ ID NO: 1278822 - RNA, 21 nt, Human
aaucccaaauuugauugauuu

SEQ ID NO: 1278823 - RNA, 17 nt, Human
aaucucauugcuuacaa

SEQ ID NO: 1278824 - RNA, 17 nt, Human
aaucucaucucagugaa

SEQ ID NO: 1278825 - RNA, 15 nt, Human
aaucugcaauucaaa

SEQ ID NO: 1278826 - RNA, 19 nt, Human
aaucugcaauucaaaaguu

SEQ ID NO: 1278827 - RNA, 16 nt, Human
aaucugcauuauugga

SEQ ID NO: 1278828 - RNA, 17 nt, Human
aaucugcauuauuggaa

SEQ ID NO: 1278829 - RNA, 19 nt, Human
aaucugcuuguauuccaag

SEQ ID NO: 1278830 - RNA, 15 nt, Human
aaugaacagaacaua

SEQ ID NO: 1278831 - RNA, 21 nt, Human
aaugaacaucccuuuuucaau

SEQ ID NO: 1278832 - RNA, 13 nt, Human
aauccauacauuu

SEQ ID NO: 1278833 - RNA, 14 nt, Human
aauccauacauuug

SEQ ID NO: 1278834 - RNA, 18 nt, Human
aauccaggguggugguga

SEQ ID NO: 1278835 - RNA, 21 nt, Human
aauccaggcagauccaggacu

SEQ ID NO: 1278836 - RNA, 22 nt, Human
aauccaggcagauccaggacua

SEQ ID NO: 1278837 - RNA, 11 nt, Human
aaucccaaauu

SEQ ID NO: 1278838 - RNA, 16 nt, Human
aaucccaaauuugauu

SEQ ID NO: 1278839 - RNA, 18 nt, Human
aaucccaaauuugauuga

SEQ ID NO: 1278840 - RNA, 21 nt, Human
aaugaugaucaauuauaguuu

SEQ ID NO: 1278841 - RNA, 23 nt, Human
aaugaugaucaauuauaguuucu

SEQ ID NO: 1278842 - RNA, 13 nt, Human
aaucacaauacau

SEQ ID NO: 1278843 - RNA, 21 nt, Human
aaucaacuugcuuaucaacuu

SEQ ID NO: 1278844 - RNA, 15 nt, Human
aaucaacuugcuuau

SEQ ID NO: 1278845 - RNA, 17 nt, Human
aaucaacuugcuuauca

SEQ ID NO: 1278846 - RNA, 13 nt, Human
aaucaacuugcuu

SEQ ID NO: 1278847 - RNA, 22 nt, Human
aaucacauauuuuaaaauuugu

SEQ ID NO: 1278848 - RNA, 23 nt, Human
aaucacauauuuuaaaauuuguu

SEQ ID NO: 1278849 - RNA, 20 nt, Human
aaucaauuacugguccaaaa

SEQ ID NO: 1278850 - RNA, 18 nt, Human
aaucaacuugcuuaucaa

SEQ ID NO: 1278851 - RNA, 16 nt, Human
aauauucaauaaagcu

SEQ ID NO: 1278852 - RNA, 15 nt, Human
aauauucaauaaagc

SEQ ID NO: 1278853 - RNA, 14 nt, Human
aauauucaauaaag

SEQ ID NO: 1278854 - RNA, 18 nt, Human
aauauuaugagaugcugg

SEQ ID NO: 1278855 - RNA, 22 nt, Human
aaucaaauuuguaggguuucua

SEQ ID NO: 1278856 - RNA, 16 nt, Human
aauauuauguuaaaac

SEQ ID NO: 1278857 - RNA, 14 nt, Human
aauauuaugagaug

SEQ ID NO: 1278858 - RNA, 16 nt, Human
aauauuaugagaugcu

SEQ ID NO: 1278859 - RNA, 16 nt, Human
aauauuauuccucaaa

SEQ ID NO: 1278860 - RNA, 15 nt, Human
aauauggacugcuca

SEQ ID NO: 1278861 - RNA, 18 nt, Human
aauauggucuuuugguua

SEQ ID NO: 1278862 - RNA, 21 nt, Human
aauaugggggccuuuugggaa

SEQ ID NO: 1278863 - RNA, 12 nt, Human
aauauguaccaa

SEQ ID NO: 1278864 - RNA, 19 nt, Human
aauauguaccaagaaucuu

SEQ ID NO: 1278865 - RNA, 15 nt, Human
aauauguauaacuuu

SEQ ID NO: 1278866 - RNA, 23 nt, Human
aauauguauaacuuuaacuucug

SEQ ID NO: 1278867 - RNA, 15 nt, Human
aauauguaccaagaa

SEQ ID NO: 1278868 - RNA, 22 nt, Human
aauauuaugagaugcuggcuug

SEQ ID NO: 1278869 - RNA, 17 nt, Human
aauauggacacuuaaua

SEQ ID NO: 1278870 - RNA, 21 nt, Human
aauauggacacuuaauacuac

SEQ ID NO: 1278871 - RNA, 15 nt, Human
aauauaauuguuuua

SEQ ID NO: 1278872 - RNA, 17 nt, Human
aauaaacgucuuaaaua

SEQ ID NO: 1278873 - RNA, 19 nt, Human
aauaaaauucaacaaacau

SEQ ID NO: 1278874 - RNA, 18 nt, Human
aauaaacuaauaauugca

SEQ ID NO: 1278875 - RNA, 18 nt, Human
aauaaaauucaacaaaca

SEQ ID NO: 1278876 - RNA, 22 nt, Human
aauaaaauucaacaaacauuug

SEQ ID NO: 1278877 - RNA, 23 nt, Human
aauaaaauuaaagcugaaaacug

SEQ ID NO: 1278878 - RNA, 19 nt, Human
aauaaacuauuuguaaagu

SEQ ID NO: 1278879 - RNA, 16 nt, Human
aauaagugcccucucc

SEQ ID NO: 1278880 - RNA, 17 nt, Human
aauaagugcccucuccc

SEQ ID NO: 1278881 - RNA, 18 nt, Human
aauaagugcccucuccca

SEQ ID NO: 1278882 - RNA, 11 nt, Human
aauaaguuauu

SEQ ID NO: 1278883 - RNA, 20 nt, Human
aaguugugcuugagccagga

SEQ ID NO: 1278884 - RNA, 20 nt, Human
aaguuguuccuuaagucaga

SEQ ID NO: 1278885 - RNA, 18 nt, Human
aaguuguuguaaccugcu

SEQ ID NO: 1278886 - RNA, 21 nt, Human
aagugcuguuuauuaaucuua

SEQ ID NO: 1278887 - RNA, 22 nt, Human
aagugcuguuuauuaaucuuag

SEQ ID NO: 1278888 - RNA, 21 nt, Human
aaguggguuuuuuaguugaau

SEQ ID NO: 1278889 - RNA, 17 nt, Human
aaguggguuuuuuaguu

SEQ ID NO: 1278890 - RNA, 18 nt, Human
aagugguucccucucuua

SEQ ID NO: 1278891 - RNA, 22 nt, Human
aaguguaaaauauuuugaauca

SEQ ID NO: 1278892 - RNA, 21 nt, Human
aauaauccuaaacauaugaau

SEQ ID NO: 1278893 - RNA, 15 nt, Human
aauaauccaugaaag

SEQ ID NO: 1278894 - RNA, 20 nt, Human
aauaaucacgcuuuccugaa

SEQ ID NO: 1278895 - RNA, 21 nt, Human
aauaaucacgcuuuccugaau

SEQ ID NO: 1278896 - RNA, 20 nt, Human
aauaauaaagaauagcuuua

SEQ ID NO: 1278897 - RNA, 13 nt, Human
aauaaguuauugc

SEQ ID NO: 1278898 - RNA, 14 nt, Human
aauaaguuauugca

SEQ ID NO: 1278899 - RNA, 18 nt, Human
aauaaguuauugcaguuu

SEQ ID NO: 1278900 - RNA, 21 nt, Human
aauaaguucaaauucuucuga

SEQ ID NO: 1278901 - RNA, 22 nt, Human
aauaaguucaaauucuucugaa

SEQ ID NO: 1278902 - RNA, 20 nt, Human
aauaaguuuuuguuucacag

SEQ ID NO: 1278903 - RNA, 12 nt, Human
aauaauaaagaa

SEQ ID NO: 1278904 - RNA, 19 nt, Human
aauaauguaagacaaauau

SEQ ID NO: 1278905 - RNA, 12 nt, Human
aauaauguaaga

SEQ ID NO: 1278906 - RNA, 12 nt, Human
aauaaugcuuug

SEQ ID NO: 1278907 - RNA, 13 nt, Human
aauaaugcuuuga

SEQ ID NO: 1278908 - RNA, 15 nt, Human
aauaaugcuuugaaa

SEQ ID NO: 1278909 - RNA, 14 nt, Human
aagugcuguuuauu

SEQ ID NO: 1278910 - RNA, 16 nt, Human
aagugcuguuuauuaa

SEQ ID NO: 1278911 - RNA, 17 nt, Human
aagugcuguuuauuaau

SEQ ID NO: 1278912 - RNA, 18 nt, Human
aagugcuguuuauuaauc

SEQ ID NO: 1278913 - RNA, 20 nt, Human
aagugcuguuuauuaaucuu

SEQ ID NO: 1278914 - RNA, 20 nt, Human
aaguccaguguuucuuuuuu

SEQ ID NO: 1278915 - RNA, 19 nt, Human
aaguccagguccugguggg

SEQ ID NO: 1278916 - RNA, 20 nt, Human
aaguccaguccaguccuauc

SEQ ID NO: 1278917 - RNA, 17 nt, Human
aaguccagguccuggug

SEQ ID NO: 1278918 - RNA, 18 nt, Human
aaguccagguccuggugg

SEQ ID NO: 1278919 - RNA, 21 nt, Human
aaguccagguccugguggggc

SEQ ID NO: 1278920 - RNA, 13 nt, Human
aaguccagguccu

SEQ ID NO: 1278921 - RNA, 15 nt, Human
aaguccagguccugg

SEQ ID NO: 1278922 - RNA, 23 nt, Human
aaguccaggcuuuuuuaucaugu

SEQ ID NO: 1278923 - RNA, 14 nt, Human
aaguauguauuauu

SEQ ID NO: 1278924 - RNA, 21 nt, Human
aaguauguauuauuuacauuu

SEQ ID NO: 1278925 - RNA, 15 nt, Human
aaguacuuuuggcau

SEQ ID NO: 1278926 - RNA, 14 nt, Human
aaguacuuuuggca

SEQ ID NO: 1278927 - RNA, 14 nt, Human
aagguuuaaaugaa

SEQ ID NO: 1278928 - RNA, 16 nt, Human
aagguuuaaaugaaca

SEQ ID NO: 1278929 - RNA, 21 nt, Human
aagguuuaaaugaacaagaga

SEQ ID NO: 1278930 - RNA, 17 nt, Human
aaguacuuguaguucca

SEQ ID NO: 1278931 - RNA, 16 nt, Human
aaguagaaacaaaaua

SEQ ID NO: 1278932 - RNA, 15 nt, Human
aaguagaaaucauag

SEQ ID NO: 1278933 - RNA, 18 nt, Human
aaguagaaacaaaauaca

SEQ ID NO: 1278934 - RNA, 13 nt, Human
aaguagaaaucau

SEQ ID NO: 1278935 - RNA, 19 nt, Human
aaguaucaucaguguagaa

SEQ ID NO: 1278936 - RNA, 18 nt, Human
aaggugcugacggccagg

SEQ ID NO: 1278937 - RNA, 19 nt, Human
aagguggauggccccagca

SEQ ID NO: 1278938 - RNA, 20 nt, Human
aaggugggaggaugugaauu

SEQ ID NO: 1278939 - RNA, 22 nt, Human
aaggugggaggaugugaauugu

SEQ ID NO: 1278940 - RNA, 17 nt, Human
aagguucuuacugcuug

SEQ ID NO: 1278941 - RNA, 16 nt, Human
aagguugggcagggug

SEQ ID NO: 1278942 - RNA, 20 nt, Human
aagguuuaaagagucuagau

SEQ ID NO: 1278943 - RNA, 21 nt, Human
aagguuuaaagagucuagauu

SEQ ID NO: 1278944 - RNA, 19 nt, Human
aagucucuggaauuugaaa

SEQ ID NO: 1278945 - RNA, 15 nt, Human
aagucucuaauucua

SEQ ID NO: 1278946 - RNA, 18 nt, Human
aagucucuaauucuauua

SEQ ID NO: 1278947 - RNA, 14 nt, Human
aaggacuguaaucu

SEQ ID NO: 1278948 - RNA, 15 nt, Human
aaggauuuugcaguu

SEQ ID NO: 1278949 - RNA, 14 nt, Human
aaggauuuugcagu

SEQ ID NO: 1278950 - RNA, 13 nt, Human
aaggcaaaaauag

SEQ ID NO: 1278951 - RNA, 21 nt, Human
aaggcaaaaauaguuuggaua

SEQ ID NO: 1278952 - RNA, 18 nt, Human
aaggacccggaggggccu

SEQ ID NO: 1278953 - RNA, 21 nt, Human
aaggacccggaggggccuggc

SEQ ID NO: 1278954 - RNA, 18 nt, Human
aaggacuaggguccuggg

SEQ ID NO: 1278955 - RNA, 20 nt, Human
aaggacuaggguccugggga

SEQ ID NO: 1278956 - RNA, 21 nt, Human
aaggacuaugaaaagcuagaa

SEQ ID NO: 1278957 - RNA, 16 nt, Human
aaggacuauaagaaua

SEQ ID NO: 1278958 - RNA, 22 nt, Human
aaggacuccuccuuuuuccaug

SEQ ID NO: 1278959 - RNA, 15 nt, Human
aaggacuccugaaaa

SEQ ID NO: 1278960 - RNA, 20 nt, Human
aagcuggagugcaguggcau

SEQ ID NO: 1278961 - RNA, 20 nt, Human
aagcugcucaacuugcaaaa

SEQ ID NO: 1278962 - RNA, 23 nt, Human
aagcugcucaacuugcaaaauca

SEQ ID NO: 1278963 - RNA, 12 nt, Human
aagcugcucaac

SEQ ID NO: 1278964 - RNA, 23 nt, Human
aagcuggcggcuggggucccagc

SEQ ID NO: 1278965 - RNA, 22 nt, Human
aagcgugagcuuaaaauacaag

SEQ ID NO: 1278966 - RNA, 13 nt, Human
aagcuaaaauaaa

SEQ ID NO: 1278967 - RNA, 16 nt, Human
aagcuaaaauaaagaa

SEQ ID NO: 1278968 - RNA, 21 nt, Human
aagcuaaauccuuuacuguua

SEQ ID NO: 1278969 - RNA, 15 nt, Human
aagcuaaaauaaaga

SEQ ID NO: 1278970 - RNA, 20 nt, Human
aagcuaacagggaaggcagg

SEQ ID NO: 1278971 - RNA, 21 nt, Human
aagcuaacagggaaggcaggc

SEQ ID NO: 1278972 - RNA, 22 nt, Human
aagcuaacagggaaggcaggca

SEQ ID NO: 1278973 - RNA, 17 nt, Human
aagcuaagguuuagaua

SEQ ID NO: 1278974 - RNA, 23 nt, Human
aagcuaacagggaaggcaggcag

SEQ ID NO: 1278975 - RNA, 23 nt, Human
aagcugccuccccucuccuuccu

SEQ ID NO: 1278976 - RNA, 15 nt, Human
aagcugccugguaua

SEQ ID NO: 1278977 - RNA, 20 nt, Human
aagcugccugguauauccaa

SEQ ID NO: 1278978 - RNA, 15 nt, Human
aaggcaaaaauguaa

SEQ ID NO: 1278979 - RNA, 14 nt, Human
aaggcaaaaaugua

SEQ ID NO: 1278980 - RNA, 16 nt, Human
aaggcacaugucaccu

SEQ ID NO: 1278981 - RNA, 19 nt, Human
aaggcacccaucugucugc

SEQ ID NO: 1278982 - RNA, 19 nt, Human
aaggcacccccgucaagag

SEQ ID NO: 1278983 - RNA, 22 nt, Human
aaggcacccaucugucugccaa

SEQ ID NO: 1278984 - RNA, 14 nt, Human
aaggcacucuagau

SEQ ID NO: 1278985 - RNA, 23 nt, Human
aagccaggaauuucccaggaccc

SEQ ID NO: 1278986 - RNA, 23 nt, Human
aagccagcuuguuuacaugcuua

SEQ ID NO: 1278987 - RNA, 17 nt, Human
aagccauaugaacagcu

SEQ ID NO: 1278988 - RNA, 16 nt, Human
aagccaucaccucaga

SEQ ID NO: 1278989 - RNA, 20 nt, Human
aagccaucuugaguggucau

SEQ ID NO: 1278990 - RNA, 23 nt, Human
aagccaucaccucagauggcagc

SEQ ID NO: 1278991 - RNA, 22 nt, Human
aagccaugaguuccagaaagua

SEQ ID NO: 1278992 - RNA, 23 nt, Human
aagccaugaguuccagaaaguaa

SEQ ID NO: 1278993 - RNA, 13 nt, Human
aagccaugcugga

SEQ ID NO: 1278994 - RNA, 15 nt, Human
aagccaugcuggaaa

SEQ ID NO: 1278995 - RNA, 21 nt, Human
aagccaugcuggaaaauaaua

SEQ ID NO: 1278996 - RNA, 20 nt, Human
aagccauggagauucucaua

SEQ ID NO: 1278997 - RNA, 18 nt, Human
aagccauggguagccugg

SEQ ID NO: 1278998 - RNA, 21 nt, Human
aagccauggguagccugggug

SEQ ID NO: 1278999 - RNA, 22 nt, Human
aagccauggguagccugggugu

SEQ ID NO: 1279000 - RNA, 22 nt, Human
aagaaauuaugugccagauuua

SEQ ID NO: 1279001 - RNA, 17 nt, Human
aagaaauugaauacuuu

SEQ ID NO: 1279002 - RNA, 18 nt, Human
aagaaauugaauacuuug

SEQ ID NO: 1279003 - RNA, 19 nt, Human
aagaaauugaauacuuuga

SEQ ID NO: 1279004 - RNA, 13 nt, Human
aagaaauuaugug

SEQ ID NO: 1279005 - RNA, 13 nt, Human
aagaaauggugaa

SEQ ID NO: 1279006 - RNA, 22 nt, Human
aagaaauugaauacuuugaaug

SEQ ID NO: 1279007 - RNA, 15 nt, Human
aagaaauuucacaua

SEQ ID NO: 1279008 - RNA, 12 nt, Human
aagaacaaagua

SEQ ID NO: 1279009 - RNA, 19 nt, Human
aagaacacccuauauuuug

SEQ ID NO: 1279010 - RNA, 21 nt, Human
aagaacacccuauauuuugca

SEQ ID NO: 1279011 - RNA, 19 nt, Human
aagauugcuuaauaaauug

SEQ ID NO: 1279012 - RNA, 17 nt, Human
aagauugguguuuuuuu

SEQ ID NO: 1279013 - RNA, 19 nt, Human
aagauugguguuuuuuucu

SEQ ID NO: 1279014 - RNA, 20 nt, Human
aagauugguguuuuuuucua

SEQ ID NO: 1279015 - RNA, 23 nt, Human
aagauugguguuuuuuucuaugg

SEQ ID NO: 1279016 - RNA, 16 nt, Human
aagauugcugaaauuu

SEQ ID NO: 1279017 - RNA, 16 nt, Human
aagauuuaccacuugu

SEQ ID NO: 1279018 - RNA, 21 nt, Human
aagauugguguuuuuuucuau

SEQ ID NO: 1279019 - RNA, 21 nt, Human
aagauugugucccauuccccc

SEQ ID NO: 1279020 - RNA, 15 nt, Human
aagauuguuccugcu

SEQ ID NO: 1279021 - RNA, 12 nt, Human
aagauuuaauau

SEQ ID NO: 1279022 - RNA, 13 nt, Human
aagauuuaauauu

SEQ ID NO: 1279023 - RNA, 16 nt, Human
aagauuuccauauaaa

SEQ ID NO: 1279024 - RNA, 22 nt, Human
aagauuuccuucuuuuuuucuu

SEQ ID NO: 1279025 - RNA, 14 nt, Human
aagauuuguuuuua

SEQ ID NO: 1279026 - RNA, 16 nt, Human
aagauuuguuuuuaaa

SEQ ID NO: 1279027 - RNA, 17 nt, Human
aagauuuguuuuuaaac

SEQ ID NO: 1279028 - RNA, 19 nt, Human
aagauuuguuuuuaaacug

SEQ ID NO: 1279029 - RNA, 20 nt, Human
aagauuuguuuuuaaacugu

SEQ ID NO: 1279030 - RNA, 23 nt, Human
aagauuuguuuuuaaacuguaca

SEQ ID NO: 1279031 - RNA, 13 nt, Human
aagccagauuuuc

SEQ ID NO: 1279032 - RNA, 19 nt, Human
aagccagauuuuccugaaa

SEQ ID NO: 1279033 - RNA, 15 nt, Human
aagccagaggcuggg

SEQ ID NO: 1279034 - RNA, 16 nt, Human
aagccagaggcugggu

SEQ ID NO: 1279035 - RNA, 18 nt, Human
aagccacuuaaaauguuc

SEQ ID NO: 1279036 - RNA, 14 nt, Human
aagccagaggcugg

SEQ ID NO: 1279037 - RNA, 20 nt, Human
aagccagcguccuccucugu

SEQ ID NO: 1279038 - RNA, 19 nt, Human
aagccagcugcccccagag

SEQ ID NO: 1279039 - RNA, 22 nt, Human
aagccagcugcccccagagcca

SEQ ID NO: 1279040 - RNA, 20 nt, Human
aagccagcugcccccagagc

SEQ ID NO: 1279041 - RNA, 21 nt, Human
aagccagcugcccccagagcc

SEQ ID NO: 1279042 - RNA, 11 nt, Human
aagccagcuug

SEQ ID NO: 1279043 - RNA, 12 nt, Human
aagccagcuugu

SEQ ID NO: 1279044 - RNA, 14 nt, Human
aagccagcuuguuu

SEQ ID NO: 1279045 - RNA, 21 nt, Human
aagccagcuuguuuacaugcu

SEQ ID NO: 1279046 - RNA, 12 nt, Human
aagccagcuuuc

SEQ ID NO: 1279047 - RNA, 14 nt, Human
aagccagcuuuccc

SEQ ID NO: 1279048 - RNA, 15 nt, Human
aagccagcuuucccu

SEQ ID NO: 1279049 - RNA, 17 nt, Human
aagccagcuuucccugc

SEQ ID NO: 1279050 - RNA, 23 nt, Human
aagccagcuuucccugccucuca

SEQ ID NO: 1279051 - RNA, 20 nt, Human
aagccaggaauuucccagga

SEQ ID NO: 1279052 - RNA, 21 nt, Human
aagccaggaauuucccaggac

SEQ ID NO: 1279053 - RNA, 22 nt, Human
aagccaggaauuucccaggacc

SEQ ID NO: 1279054 - RNA, 16 nt, Human
aagcagacauuuuaaa

SEQ ID NO: 1279055 - RNA, 22 nt, Human
aagauuuguuuuuaaacuguac

SEQ ID NO: 1279056 - RNA, 12 nt, Human
aagcagacagcu

SEQ ID NO: 1279057 - RNA, 14 nt, Human
aagcagacagcucc

SEQ ID NO: 1279058 - RNA, 15 nt, Human
aagcagacagcucca

SEQ ID NO: 1279059 - RNA, 21 nt, Human
aagcagaccacugauaaaacc

SEQ ID NO: 1279060 - RNA, 19 nt, Human
aagcagagauuuucaacau

SEQ ID NO: 1279061 - RNA, 23 nt, Human
aagcagagauuuucaacauuuca

SEQ ID NO: 1279062 - RNA, 15 nt, Human
aagcagcuuagaguu

SEQ ID NO: 1279063 - RNA, 22 nt, Human
aagcaggaaaugaaaaugucuu

SEQ ID NO: 1279064 - RNA, 22 nt, Human
aaagucucuggaauuugaaaca

SEQ ID NO: 1279065 - RNA, 20 nt, Human
aaagucucuggaauuugaaa

SEQ ID NO: 1279066 - RNA, 12 nt, Human
aaagucucuugu

SEQ ID NO: 1279067 - RNA, 14 nt, Human
aaagucuguccuug

SEQ ID NO: 1279068 - RNA, 19 nt, Human
aaagucuguccuugaagga

SEQ ID NO: 1279069 - RNA, 22 nt, Human
aaagucuguccuugaaggacua

SEQ ID NO: 1279070 - RNA, 18 nt, Human
aaagucuguugauuaaag

SEQ ID NO: 1279071 - RNA, 19 nt, Human
aaagucuguugauuaaaga

SEQ ID NO: 1279072 - RNA, 20 nt, Human
aaagucuguugauuaaagau

SEQ ID NO: 1279073 - RNA, 17 nt, Human
aaagugaaauaaugugu

SEQ ID NO: 1279074 - RNA, 15 nt, Human
aaagugaaauaaugu

SEQ ID NO: 1279075 - RNA, 19 nt, Human
aaagucucuggaauuugaa

SEQ ID NO: 1279076 - RNA, 15 nt, Human
aaagucucuaauucu

SEQ ID NO: 1279077 - RNA, 18 nt, Human
aaagucucuaauucuauu

SEQ ID NO: 1279078 - RNA, 16 nt, Human
aaagggacugagaaau

SEQ ID NO: 1279079 - RNA, 20 nt, Human
aaagggacugagaaauuuau

SEQ ID NO: 1279080 - RNA, 19 nt, Human
aaaggcuguuaaauacagg

SEQ ID NO: 1279081 - RNA, 22 nt, Human
aaaggcuguuaaauacaggaaa

SEQ ID NO: 1279082 - RNA, 20 nt, Human
aaaggcuguuaaauacagga

SEQ ID NO: 1279083 - RNA, 12 nt, Human
aaauaacaauga

SEQ ID NO: 1279084 - RNA, 23 nt, Human
aaauaaaggaugugauuguggaa

SEQ ID NO: 1279085 - RNA, 14 nt, Human
aaauaaagaaugga

SEQ ID NO: 1279086 - RNA, 15 nt, Human
aaauaaagcaucuca

SEQ ID NO: 1279087 - RNA, 20 nt, Human
aaauaaagcuugcaacaaaa

SEQ ID NO: 1279088 - RNA, 22 nt, Human
aaauaaaauuaaagcugaaaac

SEQ ID NO: 1279089 - RNA, 13 nt, Human
aaauaaaaugcua

SEQ ID NO: 1279090 - RNA, 14 nt, Human
aaauaaaaugcuag

SEQ ID NO: 1279091 - RNA, 17 nt, Human
aaauaaaaugcuagguu

SEQ ID NO: 1279092 - RNA, 15 nt, Human
aaauaaaauuuguug

SEQ ID NO: 1279093 - RNA, 16 nt, Human
aaauaaaauuuguugc

SEQ ID NO: 1279094 - RNA, 17 nt, Human
aaauaaaauuuguugca

SEQ ID NO: 1279095 - RNA, 13 nt, Human
aaauaaagaaaua

SEQ ID NO: 1279096 - RNA, 15 nt, Human
aaauaaagaaaagau

SEQ ID NO: 1279097 - RNA, 13 nt, Human
aaauaaagaaugg

SEQ ID NO: 1279098 - RNA, 16 nt, Human
aaauaaagaauggaaa

SEQ ID NO: 1279099 - RNA, 14 nt, Human
aaagugacccuguu

SEQ ID NO: 1279100 - RNA, 19 nt, Human
aaagugacuaauggcauga

SEQ ID NO: 1279101 - RNA, 14 nt, Human
aaagugagagcacg

SEQ ID NO: 1279102 - RNA, 17 nt, Human
aaagugcuaagguucua

SEQ ID NO: 1279103 - RNA, 18 nt, Human
aaagugcuaagguucuaa

SEQ ID NO: 1279104 - RNA, 20 nt, Human
aaagugcuaagguucuaagg

SEQ ID NO: 1279105 - RNA, 21 nt, Human
aaagugcuaagguucuaaggc

SEQ ID NO: 1279106 - RNA, 23 nt, Human
aaagugcuaagguucuaaggccu

SEQ ID NO: 1279107 - RNA, 13 nt, Human
aaagugcugagau

SEQ ID NO: 1279108 - RNA, 18 nt, Human
aaauaaaaggaagccaaa

SEQ ID NO: 1279109 - RNA, 14 nt, Human
aaauaaauuugacu

SEQ ID NO: 1279110 - RNA, 23 nt, Human
aaauaacaaaucucaagcaaaca

SEQ ID NO: 1279111 - RNA, 20 nt, Human
aaauaacaaaugccaaauua

SEQ ID NO: 1279112 - RNA, 14 nt, Human
aaauaacaaugugc

SEQ ID NO: 1279113 - RNA, 17 nt, Human
aaauaacaaugugcucu

SEQ ID NO: 1279114 - RNA, 19 nt, Human
aaauggccauuugcuuuuu

SEQ ID NO: 1279115 - RNA, 22 nt, Human
aaauggccauuugcuuuuucac

SEQ ID NO: 1279116 - RNA, 23 nt, Human
aaauggccauuugcuuuuucacc

SEQ ID NO: 1279117 - RNA, 11 nt, Human
aaauggccuca

SEQ ID NO: 1279118 - RNA, 15 nt, Human
aaauggccucaugug

SEQ ID NO: 1279119 - RNA, 21 nt, Human
aaauggcgucuggaaguccaa

SEQ ID NO: 1279120 - RNA, 21 nt, Human
aaauggccucauguggcugga

SEQ ID NO: 1279121 - RNA, 22 nt, Human
aaauggccucauguggcuggaa

SEQ ID NO: 1279122 - RNA, 18 nt, Human
aaauggcuuccuggcaau

SEQ ID NO: 1279123 - RNA, 17 nt, Human
aaauggaauacucuuau

SEQ ID NO: 1279124 - RNA, 13 nt, Human
aaauggaaacuau

SEQ ID NO: 1279125 - RNA, 20 nt, Human
aaaugcuuuuuauuucugca

SEQ ID NO: 1279126 - RNA, 19 nt, Human
aaaucuugucauguguaua

SEQ ID NO: 1279127 - RNA, 20 nt, Human
aaaucuugucauguguauaa

SEQ ID NO: 1279128 - RNA, 21 nt, Human
aaaucuugucauguguauaaa

SEQ ID NO: 1279129 - RNA, 12 nt, Human
aaaucuuccaau

SEQ ID NO: 1279130 - RNA, 14 nt, Human
aaaucuuccaauuu

SEQ ID NO: 1279131 - RNA, 13 nt, Human
aaaucuugaaauu

SEQ ID NO: 1279132 - RNA, 14 nt, Human
aaaucuugaucagu

SEQ ID NO: 1279133 - RNA, 20 nt, Human
aaaucuugguugaugccaaa

SEQ ID NO: 1279134 - RNA, 22 nt, Human
aaaucuugguugaugccaaaaa

SEQ ID NO: 1279135 - RNA, 14 nt, Human
aaaucuugucaugu

SEQ ID NO: 1279136 - RNA, 16 nt, Human
aaaucuugucaugugu

SEQ ID NO: 1279137 - RNA, 17 nt, Human
aaaucuugucaugugua

SEQ ID NO: 1279138 - RNA, 18 nt, Human
aaaucuugucauguguau

SEQ ID NO: 1279139 - RNA, 20 nt, Human
aaaucaaaugguaucuuuug

SEQ ID NO: 1279140 - RNA, 13 nt, Human
aaaucaaaugaau

SEQ ID NO: 1279141 - RNA, 18 nt, Human
aaaucaacuugcuuauca

SEQ ID NO: 1279142 - RNA, 15 nt, Human
aaauauuuugaauca

SEQ ID NO: 1279143 - RNA, 21 nt, Human
aaauauuuugaaucaauaaua

SEQ ID NO: 1279144 - RNA, 22 nt, Human
aaauauuuugaaucaauaauau

SEQ ID NO: 1279145 - RNA, 16 nt, Human
aaauagaagagagagg

SEQ ID NO: 1279146 - RNA, 17 nt, Human
aaauagaauguaaaugu

SEQ ID NO: 1279147 - RNA, 14 nt, Human
aaauagaauguaaa

SEQ ID NO: 1279148 - RNA, 21 nt, Human
aaauagaauguaaaugucuca

SEQ ID NO: 1279149 - RNA, 19 nt, Human
aaauagaauguaaaugucu

SEQ ID NO: 1279150 - RNA, 15 nt, Human
aaauagacaaauaga

SEQ ID NO: 1279151 - RNA, 17 nt, Human
aaauagacagcaugaga

SEQ ID NO: 1279152 - RNA, 13 nt, Human
aaauaguaaaaau

SEQ ID NO: 1279153 - RNA, 16 nt, Human
aaauaguaaaaauaaa

SEQ ID NO: 1279154 - RNA, 12 nt, Human
aaauaguauuuc

SEQ ID NO: 1279155 - RNA, 19 nt, Human
aaauacuugucuguuuuaa

SEQ ID NO: 1279156 - RNA, 16 nt, Human
aaauacuugucuguuu

SEQ ID NO: 1279157 - RNA, 14 nt, Human
aaauacuugucugu

SEQ ID NO: 1279158 - RNA, 19 nt, Human
aaauacuuuuacucugccu

SEQ ID NO: 1279159 - RNA, 17 nt, Human
aaauacuuuuacucugc

SEQ ID NO: 1279160 - RNA, 14 nt, Human
aaauagaaaauggu

SEQ ID NO: 1279161 - RNA, 15 nt, Human
aaauagaaaaugguc

SEQ ID NO: 1279162 - RNA, 23 nt, Human
aaauauuuuaaagaauuguguca

SEQ ID NO: 1279163 - RNA, 19 nt, Human
aaauauuuuaaagaauugu

SEQ ID NO: 1279164 - RNA, 13 nt, Human
aaauauaaagacg

SEQ ID NO: 1279165 - RNA, 23 nt, Human
aaauagucucuuuaaaaggaaag

SEQ ID NO: 1279166 - RNA, 20 nt, Human
aaauaguuuggauauguaaa

SEQ ID NO: 1279167 - RNA, 21 nt, Human
aaauaguuuggauauguaaaa

SEQ ID NO: 1279168 - RNA, 13 nt, Human
aaauauaaaauau

SEQ ID NO: 1279169 - RNA, 10 nt, Human
aaauauaaag

SEQ ID NO: 1279170 - RNA, 12 nt, Human
aaauauaaagac

SEQ ID NO: 1279171 - RNA, 24 nt, Human
aaauauaaagacguuuuauaagca

SEQ ID NO: 1279172 - RNA, 22 nt, Human
aaauacuguuuuuaacaacuau

SEQ ID NO: 1279173 - RNA, 13 nt, Human
aaacacucuugaa

SEQ ID NO: 1279174 - RNA, 20 nt, Human
aaaauugcugacuguagcuu

SEQ ID NO: 1279175 - RNA, 17 nt, Human
aaacacucuugaaaaau

SEQ ID NO: 1279176 - RNA, 14 nt, Human
aaacacucuugaaa

SEQ ID NO: 1279177 - RNA, 13 nt, Human
aaaacacacaggu

SEQ ID NO: 1279178 - RNA, 18 nt, Human
aaaauucaacaaacauuu

SEQ ID NO: 1279179 - RNA, 13 nt, Human
aaaauucagcaaa

SEQ ID NO: 1279180 - RNA, 14 nt, Human
aaaauucagcaaag

SEQ ID NO: 1279181 - RNA, 19 nt, Human
aaaauucagcaaagugguu

SEQ ID NO: 1279182 - RNA, 12 nt, Human
aaaauucauuuu

SEQ ID NO: 1279183 - RNA, 24 nt, Human
aaacacuugcggauauucuggacu

SEQ ID NO: 1279184 - RNA, 15 nt, Human
aaacacuugcaaccu

SEQ ID NO: 1279185 - RNA, 14 nt, Human
aaacagauguccau

SEQ ID NO: 1279186 - RNA, 16 nt, Human
aaacagauuguuugca

SEQ ID NO: 1279187 - RNA, 22 nt, Human
aaacagauguccaucagaugac

SEQ ID NO: 1279188 - RNA, 17 nt, Human
aaacagauuuggaaaga

SEQ ID NO: 1279189 - RNA, 20 nt, Human
aaagaaaacuuguauuaugu

SEQ ID NO: 1279190 - RNA, 12 nt, Human
aaagaaaacuug

SEQ ID NO: 1279191 - RNA, 11 nt, Human
aaacugccccc

SEQ ID NO: 1279192 - RNA, 13 nt, Human
aaagaaaaacaaa

SEQ ID NO: 1279193 - RNA, 16 nt, Human
aaagaaaagaaaauuu

SEQ ID NO: 1279194 - RNA, 13 nt, Human
aaagaaaaccuuu

SEQ ID NO: 1279195 - RNA, 13 nt, Human
aaagaaaagaugc

SEQ ID NO: 1279196 - RNA, 14 nt, Human
aaagaaaagaugca

SEQ ID NO: 1279197 - RNA, 15 nt, Human
aaagaaaagaugcac

SEQ ID NO: 1279198 - RNA, 17 nt, Human
aaagaaaagaugcacuu

SEQ ID NO: 1279199 - RNA, 20 nt, Human
aaagaaaagaugcacuuugc

SEQ ID NO: 1279200 - RNA, 16 nt, Human
aaacugacucuuaaga

SEQ ID NO: 1279201 - RNA, 17 nt, Human
aaacugacucuuaagaa

SEQ ID NO: 1279202 - RNA, 16 nt, Human
aaacugcaugcccaga

SEQ ID NO: 1279203 - RNA, 11 nt, Human
aaagaacaucc

SEQ ID NO: 1279204 - RNA, 15 nt, Human
aaagaaauauaccua

SEQ ID NO: 1279205 - RNA, 15 nt, Human
aaagaaauuaugugc

SEQ ID NO: 1279206 - RNA, 13 nt, Human
aaagaaauuaugu

SEQ ID NO: 1279207 - RNA, 16 nt, Human
aaagaaaguguauuug

SEQ ID NO: 1279208 - RNA, 10 nt, Human
aaagaaagug

SEQ ID NO: 1279209 - RNA, 12 nt, Human
aaagaaagugua

SEQ ID NO: 1279210 - RNA, 13 nt, Human
aaagaaaguguau

SEQ ID NO: 1279211 - RNA, 12 nt, Human
aaagaguacucu

SEQ ID NO: 1279212 - RNA, 17 nt, Human
aaagaguacucuuguuu

SEQ ID NO: 1279213 - RNA, 13 nt, Human
aaagaguagaauu

SEQ ID NO: 1279214 - RNA, 18 nt, Human
aaagaguagaauugcauu

SEQ ID NO: 1279215 - RNA, 20 nt, Human
aaagauaucucaucucuucu

SEQ ID NO: 1279216 - RNA, 17 nt, Human
aaagaugaaagagcagu

SEQ ID NO: 1279217 - RNA, 15 nt, Human
aacuuugcugagccu

SEQ ID NO: 1279218 - RNA, 15 nt, Human
aacuuugaaguuagc

SEQ ID NO: 1279219 - RNA, 15 nt, Human
aacuuuggaaccaga

SEQ ID NO: 1279220 - RNA, 19 nt, Human
aacuuuggaaccagacucu

SEQ ID NO: 1279221 - RNA, 18 nt, Human
aacuuuggaguccccuca

SEQ ID NO: 1279222 - RNA, 24 nt, Human
aacuuuggaaccagacucuugccu

SEQ ID NO: 1279223 - RNA, 11 nt, Human
aacuuuuaauu

SEQ ID NO: 1279224 - RNA, 11 nt, Human
aacuuuuguaa

SEQ ID NO: 1279225 - RNA, 21 nt, Human
aacuuuuguaagacaaagguu

SEQ ID NO: 1279226 - RNA, 13 nt, Human
aacuuuugugaau

SEQ ID NO: 1279227 - RNA, 19 nt, Human
aacuuuugugaauuaggcu

SEQ ID NO: 1279228 - RNA, 21 nt, Human
aacuuuucuuaaaaaguuaua

SEQ ID NO: 1279229 - RNA, 20 nt, Human
aacuuuuuauugauuuuugg

SEQ ID NO: 1279230 - RNA, 16 nt, Human
aacuuuucuaacagaa

SEQ ID NO: 1279231 - RNA, 19 nt, Human
aacuuuucuaacagaaagc

SEQ ID NO: 1279232 - RNA, 18 nt, Human
aacuuuucuauuaaaagu

SEQ ID NO: 1279233 - RNA, 12 nt, Human
aacuuuguuuua

SEQ ID NO: 1279234 - RNA, 17 nt, Human
aacuuuuaguaaaguca

SEQ ID NO: 1279235 - RNA, 13 nt, Human
aagaaaucuauuu

SEQ ID NO: 1279236 - RNA, 23 nt, Human
aacuuuuuguucugguccuuuuu

SEQ ID NO: 1279237 - RNA, 15 nt, Human
aacuuuuuguucugg

SEQ ID NO: 1279238 - RNA, 23 nt, Human
aacuuuuuuauuuaaaaaacuaa

SEQ ID NO: 1279239 - RNA, 21 nt, Human
aacuuuuuuucuguaccaguu

SEQ ID NO: 1279240 - RNA, 22 nt, Human
aacuuuuuuucuguaccaguua

SEQ ID NO: 1279241 - RNA, 18 nt, Human
aacuuuuuuuuuucuuua

SEQ ID NO: 1279242 - RNA, 23 nt, Human
aacuuuuuuuuuucuuuauaaga

SEQ ID NO: 1279243 - RNA, 17 nt, Human
aacugauccagcaauua

SEQ ID NO: 1279244 - RNA, 14 nt, Human
aacugaccagccuc

SEQ ID NO: 1279245 - RNA, 19 nt, Human
aacugaccagccuccaugc

SEQ ID NO: 1279246 - RNA, 20 nt, Human
aacugacaagcuccauuuaa

SEQ ID NO: 1279247 - RNA, 19 nt, Human
aacugacaagcuccauuua

SEQ ID NO: 1279248 - RNA, 10 nt, Human
aacugacaag

SEQ ID NO: 1279249 - RNA, 16 nt, Human
aacugacaagccaucu

SEQ ID NO: 1279250 - RNA, 17 nt, Human
aacugacaagccaucuu

SEQ ID NO: 1279251 - RNA, 21 nt, Human
aacugauccaguauaagacua

SEQ ID NO: 1279252 - RNA, 17 nt, Human
aacugauucacaucuca

SEQ ID NO: 1279253 - RNA, 19 nt, Human
aacugauucacaucucauu

SEQ ID NO: 1279254 - RNA, 15 nt, Human
aacuguuuuuuaagu

SEQ ID NO: 1279255 - RNA, 13 nt, Human
aacuguuuuuuaa

SEQ ID NO: 1279256 - RNA, 23 nt, Human
aacuuagcauuuucugcaucucc

SEQ ID NO: 1279257 - RNA, 21 nt, Human
aacuuagcauuuucugcaucu

SEQ ID NO: 1279258 - RNA, 21 nt, Human
aacuuagcuuaugaguagcuu

SEQ ID NO: 1279259 - RNA, 16 nt, Human
aacugaacucugacaa

SEQ ID NO: 1279260 - RNA, 23 nt, Human
aacucauacacucguaugauacu

SEQ ID NO: 1279261 - RNA, 19 nt, Human
aacugaacucugacaacag

SEQ ID NO: 1279262 - RNA, 20 nt, Human
aacugaacucugacaacaga

SEQ ID NO: 1279263 - RNA, 23 nt, Human
aacugaacucugacaacagacuu

SEQ ID NO: 1279264 - RNA, 18 nt, Human
aacugaagaguaaucaau

SEQ ID NO: 1279265 - RNA, 18 nt, Human
aacugaagcagccucucc

SEQ ID NO: 1279266 - RNA, 20 nt, Human
aacugaagcagccucucccc

SEQ ID NO: 1279267 - RNA, 16 nt, Human
aacucacuccuuuuaa

SEQ ID NO: 1279268 - RNA, 16 nt, Human
aaccagcuuccuucag

SEQ ID NO: 1279269 - RNA, 17 nt, Human
aaccagcuuccuucaga

SEQ ID NO: 1279270 - RNA, 19 nt, Human
aaccagcuuccuucagaga

SEQ ID NO: 1279271 - RNA, 20 nt, Human
aaccagcuuccuucagagag

SEQ ID NO: 1279272 - RNA, 21 nt, Human
aaccagcuuccuucagagagc

SEQ ID NO: 1279273 - RNA, 22 nt, Human
aaccagcuuccuucagagagca

SEQ ID NO: 1279274 - RNA, 19 nt, Human
aaccacugaaaaaauauau

SEQ ID NO: 1279275 - RNA, 12 nt, Human
aaccacugcuuc

SEQ ID NO: 1279276 - RNA, 13 nt, Human
aaccacugcuucc

SEQ ID NO: 1279277 - RNA, 20 nt, Human
aaccacugcuuccauuuaau

SEQ ID NO: 1279278 - RNA, 23 nt, Human
aaccagcacagcuuagauuucau

SEQ ID NO: 1279279 - RNA, 23 nt, Human
aaccagaucuagucaaucaaguc

SEQ ID NO: 1279280 - RNA, 14 nt, Human
aaccagcucagcac

SEQ ID NO: 1279281 - RNA, 22 nt, Human
aaccagcucagcacugccugcu

SEQ ID NO: 1279282 - RNA, 17 nt, Human
aaccagcucagcacugc

SEQ ID NO: 1279283 - RNA, 13 nt, Human
aaccagcuuccuu

SEQ ID NO: 1279284 - RNA, 18 nt, Human
aaccaguccccccacccu

SEQ ID NO: 1279285 - RNA, 22 nt, Human
aaccaguccccccacccucauu

SEQ ID NO: 1279286 - RNA, 14 nt, Human
aaccagaucauugu

SEQ ID NO: 1279287 - RNA, 22 nt, Human
aaccacuggaaaguuuaugguu

SEQ ID NO: 1279288 - RNA, 13 nt, Human
aaccacugaaaaa

SEQ ID NO: 1279289 - RNA, 15 nt, Human
aaccacugaaaaaau

SEQ ID NO: 1279290 - RNA, 16 nt, Human
aaccacugaaaaaaua

SEQ ID NO: 1279291 - RNA, 20 nt, Human
aaccacugaaaaaauauaug

SEQ ID NO: 1279292 - RNA, 11 nt, Human
aacagcuggug

SEQ ID NO: 1279293 - RNA, 23 nt, Human
aacagcuggacccugaccagcuc

SEQ ID NO: 1279294 - RNA, 13 nt, Human
aacagcucgacuu

SEQ ID NO: 1279295 - RNA, 13 nt, Human
aacaugauuuggg

SEQ ID NO: 1279296 - RNA, 19 nt, Human
aacaucauuacuauaagaa

SEQ ID NO: 1279297 - RNA, 13 nt, Human
aacaucacagccc

SEQ ID NO: 1279298 - RNA, 20 nt, Human
aacaugcagaacaaaugaag

SEQ ID NO: 1279299 - RNA, 19 nt, Human
aacaugcagaacaaaugaa

SEQ ID NO: 1279300 - RNA, 12 nt, Human
aacaugcagaac

SEQ ID NO: 1279301 - RNA, 16 nt, Human
aacaugcacugauguu

SEQ ID NO: 1279302 - RNA, 19 nt, Human
aacaugcacugauguugug

SEQ ID NO: 1279303 - RNA, 21 nt, Human
aacaugaugagguaguaccuu

SEQ ID NO: 1279304 - RNA, 14 nt, Human
aacaugcacugaug

SEQ ID NO: 1279305 - RNA, 17 nt, Human
aacaugaugagguagua

SEQ ID NO: 1279306 - RNA, 22 nt, Human
aacccugucuggauccuauccu

SEQ ID NO: 1279307 - RNA, 17 nt, Human
aacaaagaaauuaugug

SEQ ID NO: 1279308 - RNA, 15 nt, Human
aacaaagaaauuaug

SEQ ID NO: 1279309 - RNA, 14 nt, Human
aacaaaauguaugu

SEQ ID NO: 1279310 - RNA, 17 nt, Human
aacaaaauguaugucug

SEQ ID NO: 1279311 - RNA, 17 nt, Human
aacaaacuguguaacug

SEQ ID NO: 1279312 - RNA, 20 nt, Human
aacaaacuguguaacugccc

SEQ ID NO: 1279313 - RNA, 13 nt, Human
aacaaaaauuguc

SEQ ID NO: 1279314 - RNA, 17 nt, Human
aacaaaacugcauuuca

SEQ ID NO: 1279315 - RNA, 22 nt, Human
aacaaaagaagcccggcuccug

SEQ ID NO: 1279316 - RNA, 18 nt, Human
aaauugcuuuguauugua

SEQ ID NO: 1279317 - RNA, 15 nt, Human
aaauugauuuugaac

SEQ ID NO: 1279318 - RNA, 18 nt, Human
aaauugcauuuccugaca

SEQ ID NO: 1279319 - RNA, 12 nt, Human
aaauuggagaaa

SEQ ID NO: 1279320 - RNA, 16 nt, Human
aaauuggcauggaaau

SEQ ID NO: 1279321 - RNA, 16 nt, Human
aaauuggaaagcaggu

SEQ ID NO: 1279322 - RNA, 20 nt, Human
aaauuggcauggaaauuuaa

SEQ ID NO: 1279323 - RNA, 21 nt, Human
aaauuggcauggaaauuuaaa

SEQ ID NO: 1279324 - RNA, 23 nt, Human
aaauuggcauggaaauuuaaagc

SEQ ID NO: 1279325 - RNA, 14 nt, Human
aaauugauuuugaa

SEQ ID NO: 1279326 - RNA, 13 nt, Human
aaauugcaaaucu

SEQ ID NO: 1279327 - RNA, 14 nt, Human
aaauugcaaaucuu

SEQ ID NO: 1279328 - RNA, 19 nt, Human
aaauugcaaaucuugaaau

SEQ ID NO: 1279329 - RNA, 21 nt, Human
aacaagaagccacagaccuag

SEQ ID NO: 1279330 - RNA, 19 nt, Human
aacaagaagggacugagag

SEQ ID NO: 1279331 - RNA, 12 nt, Human
aacaagaauugg

SEQ ID NO: 1279332 - RNA, 21 nt, Human
aacacauuugcuuuuugugau

SEQ ID NO: 1279333 - RNA, 15 nt, Human
aacaccaacauaaaa

SEQ ID NO: 1279334 - RNA, 14 nt, Human
aacaccaagcacag

SEQ ID NO: 1279335 - RNA, 17 nt, Human
aacaccaagcacagcag

SEQ ID NO: 1279336 - RNA, 18 nt, Human
aacaccaagcacagcagc

SEQ ID NO: 1279337 - RNA, 19 nt, Human
aacaccaagcacagcagcc

SEQ ID NO: 1279338 - RNA, 21 nt, Human
aacaccaagcacagcagccug

SEQ ID NO: 1279339 - RNA, 17 nt, Human
aacaccuuccagcuccu

SEQ ID NO: 1279340 - RNA, 16 nt, Human
aacaaagccacuuuca

SEQ ID NO: 1279341 - RNA, 15 nt, Human
aacaaagcagccacg

SEQ ID NO: 1279342 - RNA, 14 nt, Human
aacaaagcagccac

SEQ ID NO: 1279343 - RNA, 11 nt, Human
aacaaagaaac

SEQ ID NO: 1279344 - RNA, 12 nt, Human
aacaaagacaau

SEQ ID NO: 1279345 - RNA, 17 nt, Human
aacaaagaguucaagaa

SEQ ID NO: 1279346 - RNA, 23 nt, Human
aacaaagaguucaagaaauaagu

SEQ ID NO: 1279347 - RNA, 19 nt, Human
aacaaagaguucaagaaau

SEQ ID NO: 1279348 - RNA, 21 nt, Human
aacaaagaugccacauucaaa

SEQ ID NO: 1279349 - RNA, 19 nt, Human
aacaaagcaauucuuucaa

SEQ ID NO: 1279350 - RNA, 22 nt, Human
aacaaaggccuaauucuaugcc

SEQ ID NO: 1279351 - RNA, 15 nt, Human
aacaacucuuugaga

SEQ ID NO: 1279352 - RNA, 11 nt, Human
aacaagaaaaa

SEQ ID NO: 1279353 - RNA, 19 nt, Human
aacaagaaaaauaaagaaa

SEQ ID NO: 1279354 - RNA, 12 nt, Human
aacaagaaaaau

SEQ ID NO: 1279355 - RNA, 17 nt, Human
aacaagaaaaauaaaga

SEQ ID NO: 1279356 - RNA, 18 nt, Human
aacaagaaaaauaaagaa

SEQ ID NO: 1279357 - RNA, 15 nt, Human
aacacgcaccugccu

SEQ ID NO: 1279358 - RNA, 19 nt, Human
aacacgcaccugccucagg

SEQ ID NO: 1279359 - RNA, 14 nt, Human
aacacgcaccugcc

SEQ ID NO: 1279360 - RNA, 14 nt, Human
acuagcuauggugu

SEQ ID NO: 1279361 - RNA, 15 nt, Human
acuagcccaaugaaa

SEQ ID NO: 1279362 - RNA, 17 nt, Human
acuagcccaaugaaaug

SEQ ID NO: 1279363 - RNA, 18 nt, Human
acuagcccuccuuuuucc

SEQ ID NO: 1279364 - RNA, 17 nt, Human
acuagccaaaccucacc

SEQ ID NO: 1279365 - RNA, 18 nt, Human
acuagccaaaccucacca

SEQ ID NO: 1279366 - RNA, 19 nt, Human
acuagccaaaccucaccaa

SEQ ID NO: 1279367 - RNA, 22 nt, Human
acuagccaaaccucaccaacuc

SEQ ID NO: 1279368 - RNA, 15 nt, Human
acuaggguccugggg

SEQ ID NO: 1279369 - RNA, 16 nt, Human
acuagggccaagccca

SEQ ID NO: 1279370 - RNA, 16 nt, Human
acuaggguccugggga

SEQ ID NO: 1279371 - RNA, 11 nt, Human
acuagcucuug

SEQ ID NO: 1279372 - RNA, 13 nt, Human
acuagcucuuguu

SEQ ID NO: 1279373 - RNA, 24 nt, Human
acuagcucuuguugagccgugggc

SEQ ID NO: 1279374 - RNA, 18 nt, Human
acuaggaaauccauucac

SEQ ID NO: 1279375 - RNA, 18 nt, Human
acuaggagaaccaaaucu

SEQ ID NO: 1279376 - RNA, 21 nt, Human
acuaggagcuuugacucagga

SEQ ID NO: 1279377 - RNA, 23 nt, Human
acuaggagcuuugacucaggagc

SEQ ID NO: 1279378 - RNA, 22 nt, Human
acuaggagcuuugacucaggag

SEQ ID NO: 1279379 - RNA, 18 nt, Human
acuaggcccccacuugcc

SEQ ID NO: 1279380 - RNA, 20 nt, Human
acuaggcccccacuugccuc

SEQ ID NO: 1279381 - RNA, 22 nt, Human
acuaggcccccacuugccucuu

SEQ ID NO: 1279382 - RNA, 19 nt, Human
acuagggaucccucaucug

SEQ ID NO: 1279383 - RNA, 20 nt, Human
acuagggaucccucaucugu

SEQ ID NO: 1279384 - RNA, 12 nt, Human
acuccccuccuu

SEQ ID NO: 1279385 - RNA, 17 nt, Human
acuccccgaagucuuuu

SEQ ID NO: 1279386 - RNA, 14 nt, Human
acuccccgaagucu

SEQ ID NO: 1279387 - RNA, 16 nt, Human
acuccccgaagucuuu

SEQ ID NO: 1279388 - RNA, 20 nt, Human
acuccccacaucccaucguc

SEQ ID NO: 1279389 - RNA, 14 nt, Human
acucaguggggagg

SEQ ID NO: 1279390 - RNA, 20 nt, Human
acucagggaggcuaaaucag

SEQ ID NO: 1279391 - RNA, 21 nt, Human
acucagggaggcuaaaucagu

SEQ ID NO: 1279392 - RNA, 17 nt, Human
acucagggcagcgccag

SEQ ID NO: 1279393 - RNA, 20 nt, Human
acucagggcagcgccaggcu

SEQ ID NO: 1279394 - RNA, 21 nt, Human
acucagggcagcgccaggcug

SEQ ID NO: 1279395 - RNA, 22 nt, Human
acucagggcagcgccaggcuga

SEQ ID NO: 1279396 - RNA, 19 nt, Human
acucagucucucuucucuc

SEQ ID NO: 1279397 - RNA, 23 nt, Human
acucagucucucuucucuccagc

SEQ ID NO: 1279398 - RNA, 11 nt, Human
acucagcucug

SEQ ID NO: 1279399 - RNA, 22 nt, Human
acucaggcccccaccuggcuca

SEQ ID NO: 1279400 - RNA, 23 nt, Human
acucaggccuccaucuucucaug

SEQ ID NO: 1279401 - RNA, 23 nt, Human
acucaggcccccaccuggcucac

SEQ ID NO: 1279402 - RNA, 11 nt, Human
acucagccuuc

SEQ ID NO: 1279403 - RNA, 23 nt, Human
acucagccuucagacagagagga

SEQ ID NO: 1279404 - RNA, 19 nt, Human
acucagcucugacauucug

SEQ ID NO: 1279405 - RNA, 20 nt, Human
acucaaaccaaaucacugaa

SEQ ID NO: 1279406 - RNA, 19 nt, Human
acucaaaccaaaucacuga

SEQ ID NO: 1279407 - RNA, 14 nt, Human
acucaaacugagga

SEQ ID NO: 1279408 - RNA, 21 nt, Human
acucaaacugaggaauuucac

SEQ ID NO: 1279409 - RNA, 17 nt, Human
acucaaaauauuuguac

SEQ ID NO: 1279410 - RNA, 19 nt, Human
acucaaaauauuuguacau

SEQ ID NO: 1279411 - RNA, 20 nt, Human
acucaaaauauuuguacaua

SEQ ID NO: 1279412 - RNA, 20 nt, Human
acuauaagcaagaaggcaaa

SEQ ID NO: 1279413 - RNA, 18 nt, Human
acuauaagaacuuugagc

SEQ ID NO: 1279414 - RNA, 19 nt, Human
acuauaagaacuuugagcu

SEQ ID NO: 1279415 - RNA, 15 nt, Human
acucaaaauauuugu

SEQ ID NO: 1279416 - RNA, 20 nt, Human
acuaguugugucuggcaguu

SEQ ID NO: 1279417 - RNA, 13 nt, Human
acuauaagaacuu

SEQ ID NO: 1279418 - RNA, 14 nt, Human
acuauaagaacuuu

SEQ ID NO: 1279419 - RNA, 23 nt, Human
acucaaacugaggaauuucaccu

SEQ ID NO: 1279420 - RNA, 22 nt, Human
acucaaagcaugggauuauuag

SEQ ID NO: 1279421 - RNA, 17 nt, Human
acucaaaggguggaaua

SEQ ID NO: 1279422 - RNA, 11 nt, Human
acucagaucca

SEQ ID NO: 1279423 - RNA, 12 nt, Human
acucagauccag

SEQ ID NO: 1279424 - RNA, 14 nt, Human
acucagauccaggg

SEQ ID NO: 1279425 - RNA, 16 nt, Human
acucagauccagggac

SEQ ID NO: 1279426 - RNA, 17 nt, Human
acucagauccagggaca

SEQ ID NO: 1279427 - RNA, 19 nt, Human
acucagauccagggacaga

SEQ ID NO: 1279428 - RNA, 16 nt, Human
acucagauccuccuca

SEQ ID NO: 1279429 - RNA, 17 nt, Human
acucagauccuccucau

SEQ ID NO: 1279430 - RNA, 15 nt, Human
acucagcacaaggcc

SEQ ID NO: 1279431 - RNA, 17 nt, Human
acucagcacuuggcccu

SEQ ID NO: 1279432 - RNA, 21 nt, Human
acucuguucauuccuccaggu

SEQ ID NO: 1279433 - RNA, 16 nt, Human
acucugugcuggccag

SEQ ID NO: 1279434 - RNA, 20 nt, Human
acucuguugcaagugcaaua

SEQ ID NO: 1279435 - RNA, 17 nt, Human
acucugugcuggccagc

SEQ ID NO: 1279436 - RNA, 17 nt, Human
acucugugccagagccu

SEQ ID NO: 1279437 - RNA, 18 nt, Human
acucugugccagagccug

SEQ ID NO: 1279438 - RNA, 19 nt, Human
acucugugccagagccugg

SEQ ID NO: 1279439 - RNA, 20 nt, Human
acucugugccagagccuggg

SEQ ID NO: 1279440 - RNA, 21 nt, Human
acucugugccagagccugggg

SEQ ID NO: 1279441 - RNA, 22 nt, Human
acucugugccagagccuggggc

SEQ ID NO: 1279442 - RNA, 23 nt, Human
acucugugccagagccuggggcu

SEQ ID NO: 1279443 - RNA, 15 nt, Human
acucugugcuggcca

SEQ ID NO: 1279444 - RNA, 23 nt, Human
acucuagucaaugacaugaauuu

SEQ ID NO: 1279445 - RNA, 22 nt, Human
acucuagucaaugacaugaauu

SEQ ID NO: 1279446 - RNA, 22 nt, Human
acucuauauagcugaucaguuu

SEQ ID NO: 1279447 - RNA, 16 nt, Human
acucuauauuguucag

SEQ ID NO: 1279448 - RNA, 15 nt, Human
acucugugccagagc

SEQ ID NO: 1279449 - RNA, 16 nt, Human
acucugugccagagcc

SEQ ID NO: 1279450 - RNA, 19 nt, Human
acucuagucaaugacauga

SEQ ID NO: 1279451 - RNA, 20 nt, Human
acucuagucaaugacaugaa

SEQ ID NO: 1279452 - RNA, 13 nt, Human
acucccuuucaac

SEQ ID NO: 1279453 - RNA, 12 nt, Human
acucccuuucaa

SEQ ID NO: 1279454 - RNA, 15 nt, Human
acucccucacaagug

SEQ ID NO: 1279455 - RNA, 18 nt, Human
acucccuccuaaccuaga

SEQ ID NO: 1279456 - RNA, 14 nt, Human
acucccuugggcuc

SEQ ID NO: 1279457 - RNA, 16 nt, Human
acuaagagagaaugag

SEQ ID NO: 1279458 - RNA, 22 nt, Human
acgugauuagugaaaggaagau

SEQ ID NO: 1279459 - RNA, 16 nt, Human
acgccagacuucccac

SEQ ID NO: 1279460 - RNA, 22 nt, Human
acgccagacuucccacggcucc

SEQ ID NO: 1279461 - RNA, 23 nt, Human
acuaagaugugcagcauuucacu

SEQ ID NO: 1279462 - RNA, 19 nt, Human
acuaauaaacuaauaauug

SEQ ID NO: 1279463 - RNA, 11 nt, Human
acuaauaauug

SEQ ID NO: 1279464 - RNA, 13 nt, Human
acuaauaauugca

SEQ ID NO: 1279465 - RNA, 14 nt, Human
acuaauaauugcag

SEQ ID NO: 1279466 - RNA, 17 nt, Human
acuaauacagcugagcu

SEQ ID NO: 1279467 - RNA, 14 nt, Human
acuaauagaaaagu

SEQ ID NO: 1279468 - RNA, 16 nt, Human
acuaauagaauaaagg

SEQ ID NO: 1279469 - RNA, 17 nt, Human
acuaauagaauaaaggc

SEQ ID NO: 1279470 - RNA, 16 nt, Human
acuaauagaaaaguau

SEQ ID NO: 1279471 - RNA, 20 nt, Human
acuaauagaauaaaggcagu

SEQ ID NO: 1279472 - RNA, 14 nt, Human
acgaugacaguguu

SEQ ID NO: 1279473 - RNA, 17 nt, Human
accuguaugucuccagu

SEQ ID NO: 1279474 - RNA, 20 nt, Human
accugccccuccucucugcc

SEQ ID NO: 1279475 - RNA, 22 nt, Human
accugccccuccucucugcccu

SEQ ID NO: 1279476 - RNA, 15 nt, Human
accuguaaugacagg

SEQ ID NO: 1279477 - RNA, 20 nt, Human
accuguaaugacaggccugu

SEQ ID NO: 1279478 - RNA, 21 nt, Human
accuuuauuccuucauuucau

SEQ ID NO: 1279479 - RNA, 23 nt, Human
accuuuauuccuucauuucaucu

SEQ ID NO: 1279480 - RNA, 12 nt, Human
accuuuauucug

SEQ ID NO: 1279481 - RNA, 13 nt, Human
accuuuauucugg

SEQ ID NO: 1279482 - RNA, 17 nt, Human
accuuguuacuucugag

SEQ ID NO: 1279483 - RNA, 15 nt, Human
accuuguuacuucug

SEQ ID NO: 1279484 - RNA, 16 nt, Human
accuuguuacuucuga

SEQ ID NO: 1279485 - RNA, 14 nt, Human
accugccccuccuc

SEQ ID NO: 1279486 - RNA, 18 nt, Human
accugccccuccucucug

SEQ ID NO: 1279487 - RNA, 23 nt, Human
accugccccacuuguccuuagcc

SEQ ID NO: 1279488 - RNA, 16 nt, Human
accugcccccaaucca

SEQ ID NO: 1279489 - RNA, 21 nt, Human
accugcccaaccugcucuccu

SEQ ID NO: 1279490 - RNA, 17 nt, Human
accugccccaacucucc

SEQ ID NO: 1279491 - RNA, 17 nt, Human
accugccccacuugucc

SEQ ID NO: 1279492 - RNA, 19 nt, Human
accugccccacuuguccuu

SEQ ID NO: 1279493 - RNA, 22 nt, Human
accugccccacuuguccuuagc

SEQ ID NO: 1279494 - RNA, 21 nt, Human
accucugcacuacugacaugu

SEQ ID NO: 1279495 - RNA, 15 nt, Human
accucuucagaggcc

SEQ ID NO: 1279496 - RNA, 17 nt, Human
accucuucagaggcccu

SEQ ID NO: 1279497 - RNA, 18 nt, Human
accucuucagaggcccuc

SEQ ID NO: 1279498 - RNA, 20 nt, Human
acuuauuguagcauccugga

SEQ ID NO: 1279499 - RNA, 20 nt, Human
acuuauuggaacucugcuug

SEQ ID NO: 1279500 - RNA, 23 nt, Human
acuuauuguagcauccuggaaua

SEQ ID NO: 1279501 - RNA, 21 nt, Human
acuuauuggaacucugcuuga

SEQ ID NO: 1279502 - RNA, 24 nt, Human
acuguuuucuaguguaucaaaaug

SEQ ID NO: 1279503 - RNA, 23 nt, Human
acuguuuucuaguguaucaaaau

SEQ ID NO: 1279504 - RNA, 21 nt, Human
acuguuuucuaguguaucaaa

SEQ ID NO: 1279505 - RNA, 20 nt, Human
acuguuuucuaguguaucaa

SEQ ID NO: 1279506 - RNA, 19 nt, Human
acuguuuucuaguguauca

SEQ ID NO: 1279507 - RNA, 22 nt, Human
acuguuuucucucggcucccca

SEQ ID NO: 1279508 - RNA, 23 nt, Human
acuguuuucucucggcuccccau

SEQ ID NO: 1279509 - RNA, 15 nt, Human
acuuauuuaaacucu

SEQ ID NO: 1279510 - RNA, 13 nt, Human
acuuauuuaaugc

SEQ ID NO: 1279511 - RNA, 14 nt, Human
acuguuuauacacu

SEQ ID NO: 1279512 - RNA, 17 nt, Human
acuguuuauacacugug

SEQ ID NO: 1279513 - RNA, 19 nt, Human
acuguuuauacacugugua

SEQ ID NO: 1279514 - RNA, 18 nt, Human
acuguuuauacacugugu

SEQ ID NO: 1279515 - RNA, 18 nt, Human
acuguuuucuaguguauc

SEQ ID NO: 1279516 - RNA, 17 nt, Human
acuguuuucuaguguau

SEQ ID NO: 1279517 - RNA, 13 nt, Human
acuguuuucuagu

SEQ ID NO: 1279518 - RNA, 11 nt, Human
acuguuucaaa

SEQ ID NO: 1279519 - RNA, 20 nt, Human
acuguuuguuuacaaaauca

SEQ ID NO: 1279520 - RNA, 19 nt, Human
acuguuuguuuacaaaauc

SEQ ID NO: 1279521 - RNA, 17 nt, Human
acuguuguuaucuguuu

SEQ ID NO: 1279522 - RNA, 20 nt, Human
acuuguaaaggaauuuaaaa

SEQ ID NO: 1279523 - RNA, 19 nt, Human
acuuguaaaggaauuuaaa

SEQ ID NO: 1279524 - RNA, 15 nt, Human
acuuggucugugaga

SEQ ID NO: 1279525 - RNA, 14 nt, Human
acuuggucugugag

SEQ ID NO: 1279526 - RNA, 20 nt, Human
acuucuuuugcucuuagcug

SEQ ID NO: 1279527 - RNA, 22 nt, Human
acuucugccagcauaauacuug

SEQ ID NO: 1279528 - RNA, 12 nt, Human
acuucugagauc

SEQ ID NO: 1279529 - RNA, 20 nt, Human
acuucugagaucuguugauu

SEQ ID NO: 1279530 - RNA, 21 nt, Human
acuuggucugugagaugcuag

SEQ ID NO: 1279531 - RNA, 19 nt, Human
acuucuuuugcucuuagcu

SEQ ID NO: 1279532 - RNA, 12 nt, Human
acuuguaaauau

SEQ ID NO: 1279533 - RNA, 13 nt, Human
acuuguaaauaua

SEQ ID NO: 1279534 - RNA, 14 nt, Human
acuuguaaauauaa

SEQ ID NO: 1279535 - RNA, 15 nt, Human
acuuguaaauauaaa

SEQ ID NO: 1279536 - RNA, 16 nt, Human
acuuguaaauauaaag

SEQ ID NO: 1279537 - RNA, 20 nt, Human
acuuguaaaugugguaaaga

SEQ ID NO: 1279538 - RNA, 18 nt, Human
acuuguaaaugugguaaa

SEQ ID NO: 1279539 - RNA, 17 nt, Human
acuuguaaauauaaaga

SEQ ID NO: 1279540 - RNA, 18 nt, Human
acuuguaaauauaaagac

SEQ ID NO: 1279541 - RNA, 19 nt, Human
acuuguaaauauaaagacg

SEQ ID NO: 1279542 - RNA, 15 nt, Human
acuggguaggaaaga

SEQ ID NO: 1279543 - RNA, 22 nt, Human
acugggugguggccuggucccu

SEQ ID NO: 1279544 - RNA, 18 nt, Human
acugggugguggccuggu

SEQ ID NO: 1279545 - RNA, 17 nt, Human
acuggaacuugaacuga

SEQ ID NO: 1279546 - RNA, 18 nt, Human
acuggaacuugaacugau

SEQ ID NO: 1279547 - RNA, 19 nt, Human
acugcccccucugcccugc

SEQ ID NO: 1279548 - RNA, 18 nt, Human
acugcccccucugcccug

SEQ ID NO: 1279549 - RNA, 20 nt, Human
acugcccccucugcccugcg

SEQ ID NO: 1279550 - RNA, 16 nt, Human
acugcccccugcugcc

SEQ ID NO: 1279551 - RNA, 17 nt, Human
acugcccccugcugcca

SEQ ID NO: 1279552 - RNA, 19 nt, Human
acugcccccugcugccaug

SEQ ID NO: 1279553 - RNA, 18 nt, Human
acugcccccugcugccau

SEQ ID NO: 1279554 - RNA, 20 nt, Human
acugaaguaaaacaaacaau

SEQ ID NO: 1279555 - RNA, 13 nt, Human
acugaagugcuua

SEQ ID NO: 1279556 - RNA, 17 nt, Human
acugaagugcuuagugu

SEQ ID NO: 1279557 - RNA, 13 nt, Human
acugaagcuuuuu

SEQ ID NO: 1279558 - RNA, 14 nt, Human
acugaagcuuuuua

SEQ ID NO: 1279559 - RNA, 16 nt, Human
acugccaagacugcug

SEQ ID NO: 1279560 - RNA, 18 nt, Human
acugccaagacugcugug

SEQ ID NO: 1279561 - RNA, 19 nt, Human
acugccaagacugcugugg

SEQ ID NO: 1279562 - RNA, 20 nt, Human
acugccaagacugcuguggc

SEQ ID NO: 1279563 - RNA, 12 nt, Human
acugccaagcca

SEQ ID NO: 1279564 - RNA, 15 nt, Human
acugccaagccaugg

SEQ ID NO: 1279565 - RNA, 18 nt, Human
acugccaagccaugggua

SEQ ID NO: 1279566 - RNA, 21 nt, Human
acugguggcccgacagccugg

SEQ ID NO: 1279567 - RNA, 22 nt, Human
acugguggcccgacagccuggc

SEQ ID NO: 1279568 - RNA, 23 nt, Human
acugguggcccgacagccuggca

SEQ ID NO: 1279569 - RNA, 22 nt, Human
acugguggggauaggccagccg

SEQ ID NO: 1279570 - RNA, 21 nt, Human
acugguguuaucaccgugggc

SEQ ID NO: 1279571 - RNA, 22 nt, Human
acugguguuaucaccgugggcu

SEQ ID NO: 1279572 - RNA, 17 nt, Human
acuguccugggccugca

SEQ ID NO: 1279573 - RNA, 19 nt, Human
acugucucaagagggcacu

SEQ ID NO: 1279574 - RNA, 13 nt, Human
acugucgcugcuu

SEQ ID NO: 1279575 - RNA, 14 nt, Human
acugucgcugcuuc

SEQ ID NO: 1279576 - RNA, 19 nt, Human
acuguccugggccugcaga

SEQ ID NO: 1279577 - RNA, 17 nt, Human
acugucgcugcuucgug

SEQ ID NO: 1279578 - RNA, 18 nt, Human
acugugcaccaagcagga

SEQ ID NO: 1279579 - RNA, 22 nt, Human
acugugauucagaaaauguucu

SEQ ID NO: 1279580 - RNA, 15 nt, Human
acugugcacaucugu

SEQ ID NO: 1279581 - RNA, 19 nt, Human
acugugcacaucugugucu

SEQ ID NO: 1279582 - RNA, 20 nt, Human
acugugcacaucugugucuu

SEQ ID NO: 1279583 - RNA, 21 nt, Human
acugugcacaucugugucuug

SEQ ID NO: 1279584 - RNA, 19 nt, Human
acugucuggccccccuggu

SEQ ID NO: 1279585 - RNA, 22 nt, Human
acugucuggccccccugguccc

SEQ ID NO: 1279586 - RNA, 22 nt, Human
acugucuggggagcgggucugc

SEQ ID NO: 1279587 - RNA, 20 nt, Human
acugucuggggagcgggucu

SEQ ID NO: 1279588 - RNA, 18 nt, Human
agaaaaguugaauuuuac

SEQ ID NO: 1279589 - RNA, 21 nt, Human
agaaaaguugaauuuuacaug

SEQ ID NO: 1279590 - RNA, 15 nt, Human
agaaaaguauguucu

SEQ ID NO: 1279591 - RNA, 21 nt, Human
agaaaaguauguucuaaccuu

SEQ ID NO: 1279592 - RNA, 17 nt, Human
acuuuucuguaauucag

SEQ ID NO: 1279593 - RNA, 20 nt, Human
acuuuucuguaauucagguu

SEQ ID NO: 1279594 - RNA, 16 nt, Human
acuuuucuuaaaccuu

SEQ ID NO: 1279595 - RNA, 24 nt, Human
acuuuucuuaaaccuucaguuaug

SEQ ID NO: 1279596 - RNA, 17 nt, Human
acuuuucuuaaaaaguu

SEQ ID NO: 1279597 - RNA, 12 nt, Human
acuuuucuucua

SEQ ID NO: 1279598 - RNA, 20 nt, Human
acuuuucuucuauugccucu

SEQ ID NO: 1279599 - RNA, 18 nt, Human
acuuuucuucuauugccu

SEQ ID NO: 1279600 - RNA, 17 nt, Human
agaaaaguauguucuaa

SEQ ID NO: 1279601 - RNA, 17 nt, Human
acuuuucuauuaaaagu

SEQ ID NO: 1279602 - RNA, 11 nt, Human
acuuuucugua

SEQ ID NO: 1279603 - RNA, 18 nt, Human
acuuuuccuuugaauccu

SEQ ID NO: 1279604 - RNA, 19 nt, Human
acuuuuccuuugaauccuc

SEQ ID NO: 1279605 - RNA, 23 nt, Human
acuuuuauacucuuucuguauau

SEQ ID NO: 1279606 - RNA, 17 nt, Human
acuuuuccucccucagu

SEQ ID NO: 1279607 - RNA, 14 nt, Human
acuuuuaaacugug

SEQ ID NO: 1279608 - RNA, 15 nt, Human
acuuuuaaacugugu

SEQ ID NO: 1279609 - RNA, 17 nt, Human
acuuuuaaacuguguac

SEQ ID NO: 1279610 - RNA, 17 nt, Human
acuuuguuuuauuuuca

SEQ ID NO: 1279611 - RNA, 22 nt, Human
agaaaauuuuuguaguagcguu

SEQ ID NO: 1279612 - RNA, 20 nt, Human
agaaaauuuuuguaguagcg

SEQ ID NO: 1279613 - RNA, 16 nt, Human
agaaaauuuuuguagu

SEQ ID NO: 1279614 - RNA, 16 nt, Human
agaaaauucugugccu

SEQ ID NO: 1279615 - RNA, 13 nt, Human
agaaacaaagaug

SEQ ID NO: 1279616 - RNA, 18 nt, Human
agaaacaacaauuucuac

SEQ ID NO: 1279617 - RNA, 16 nt, Human
agaaaauguugagaau

SEQ ID NO: 1279618 - RNA, 17 nt, Human
agaaaauguugagaauc

SEQ ID NO: 1279619 - RNA, 22 nt, Human
agaaaauuaagggccgauuuaa

SEQ ID NO: 1279620 - RNA, 15 nt, Human
agaaaauuagacugu

SEQ ID NO: 1279621 - RNA, 23 nt, Human
agaaaauucugugccuuguuuuu

SEQ ID NO: 1279622 - RNA, 14 nt, Human
agaaaauguucugu

SEQ ID NO: 1279623 - RNA, 18 nt, Human
agaaaauguucuguuugc

SEQ ID NO: 1279624 - RNA, 14 nt, Human
agaaaauaacaaua

SEQ ID NO: 1279625 - RNA, 19 nt, Human
acuuuagggggugggauuc

SEQ ID NO: 1279626 - RNA, 23 nt, Human
acuuuagggaaguacuuuuggca

SEQ ID NO: 1279627 - RNA, 16 nt, Human
acuuuauaacuaacau

SEQ ID NO: 1279628 - RNA, 18 nt, Human
acuuuauaacuaacaugu

SEQ ID NO: 1279629 - RNA, 22 nt, Human
acuuucauauuuuaaacagagg

SEQ ID NO: 1279630 - RNA, 20 nt, Human
acuuucauuccuucagauuu

SEQ ID NO: 1279631 - RNA, 15 nt, Human
acuuucauuccuuca

SEQ ID NO: 1279632 - RNA, 18 nt, Human
acuuucauuccuucagau

SEQ ID NO: 1279633 - RNA, 13 nt, Human
acuuuccauuaca

SEQ ID NO: 1279634 - RNA, 14 nt, Human
acuuuccugcaacu

SEQ ID NO: 1279635 - RNA, 15 nt, Human
acuuucuagauuaag

SEQ ID NO: 1279636 - RNA, 20 nt, Human
acuuuguuucguggggaggu

SEQ ID NO: 1279637 - RNA, 14 nt, Human
acuuuguuuuauuu

SEQ ID NO: 1279638 - RNA, 12 nt, Human
acuuuuaaacag

SEQ ID NO: 1279639 - RNA, 15 nt, Human
acuuuuaaacaguga

SEQ ID NO: 1279640 - RNA, 13 nt, Human
acuuuuaaacugu

SEQ ID NO: 1279641 - RNA, 16 nt, Human
agaaaggauaaaguug

SEQ ID NO: 1279642 - RNA, 19 nt, Human
agaaauaaaaggaagccaa

SEQ ID NO: 1279643 - RNA, 20 nt, Human
agaaauaaaaggaagccaaa

SEQ ID NO: 1279644 - RNA, 17 nt, Human
agaaacaaagauguuau

SEQ ID NO: 1279645 - RNA, 14 nt, Human
agaaacaacacugu

SEQ ID NO: 1279646 - RNA, 15 nt, Human
agaaacaacacugua

SEQ ID NO: 1279647 - RNA, 16 nt, Human
agaaacaacacuguag

SEQ ID NO: 1279648 - RNA, 17 nt, Human
agaaacaacucuuugag

SEQ ID NO: 1279649 - RNA, 19 nt, Human
agaaaggaagcauuguaaa

SEQ ID NO: 1279650 - RNA, 21 nt, Human
agaaaggaagcauuguaaaau

SEQ ID NO: 1279651 - RNA, 22 nt, Human
agaaaggaagcauuguaaaaua

SEQ ID NO: 1279652 - RNA, 19 nt, Human
agaaaggacuccugaaaaa

SEQ ID NO: 1279653 - RNA, 22 nt, Human
accccuaaaagaaacccugcac

SEQ ID NO: 1279654 - RNA, 21 nt, Human
accccuaaaagaaacccugca

SEQ ID NO: 1279655 - RNA, 12 nt, Human
accccuaggacu

SEQ ID NO: 1279656 - RNA, 22 nt, Human
accccuaaagagauacuuugau

SEQ ID NO: 1279657 - RNA, 20 nt, Human
accccggggugcccacaggc

SEQ ID NO: 1279658 - RNA, 21 nt, Human
accccggggugcccacaggcc

SEQ ID NO: 1279659 - RNA, 23 nt, Human
accccggggugcccacaggccgc

SEQ ID NO: 1279660 - RNA, 13 nt, Human
accccggggugag

SEQ ID NO: 1279661 - RNA, 19 nt, Human
accccgccugcccucaugg

SEQ ID NO: 1279662 - RNA, 12 nt, Human
accccgacuuuu

SEQ ID NO: 1279663 - RNA, 15 nt, Human
accccgacuuuuguu

SEQ ID NO: 1279664 - RNA, 18 nt, Human
accccgaccaccugccca

SEQ ID NO: 1279665 - RNA, 15 nt, Human
accccgcagacaccu

SEQ ID NO: 1279666 - RNA, 17 nt, Human
accccgcagacaccuug

SEQ ID NO: 1279667 - RNA, 18 nt, Human
accccgcagacaccuugg

SEQ ID NO: 1279668 - RNA, 20 nt, Human
accccgcagacaccuuggac

SEQ ID NO: 1279669 - RNA, 14 nt, Human
accccgccugcccu

SEQ ID NO: 1279670 - RNA, 15 nt, Human
accccaaagcuuucc

SEQ ID NO: 1279671 - RNA, 17 nt, Human
accccaaagcuuuccug

SEQ ID NO: 1279672 - RNA, 18 nt, Human
accccaaagcuuuccugc

SEQ ID NO: 1279673 - RNA, 13 nt, Human
accccaaccugcu

SEQ ID NO: 1279674 - RNA, 14 nt, Human
accccaaccugcuc

SEQ ID NO: 1279675 - RNA, 15 nt, Human
accccaaccugcucu

SEQ ID NO: 1279676 - RNA, 18 nt, Human
accccaaccugcucuccu

SEQ ID NO: 1279677 - RNA, 23 nt, Human
accccaaaauuagccaguaaucc

SEQ ID NO: 1279678 - RNA, 22 nt, Human
accccaaaauuagccaguaauc

SEQ ID NO: 1279679 - RNA, 17 nt, Human
acccauuuuuccuuuug

SEQ ID NO: 1279680 - RNA, 16 nt, Human
accccaaacaccuucc

SEQ ID NO: 1279681 - RNA, 18 nt, Human
accccaaacaccuuccag

SEQ ID NO: 1279682 - RNA, 20 nt, Human
accccaaacaccuuccagcu

SEQ ID NO: 1279683 - RNA, 23 nt, Human
accccaaacaccuuccagcuccu

SEQ ID NO: 1279684 - RNA, 20 nt, Human
acccaugaguuggggucugg

SEQ ID NO: 1279685 - RNA, 21 nt, Human
acccaugaguuggggucuggc

SEQ ID NO: 1279686 - RNA, 23 nt, Human
acccaaggggauuuuuaugucug

SEQ ID NO: 1279687 - RNA, 18 nt, Human
acccaagguaccauccua

SEQ ID NO: 1279688 - RNA, 15 nt, Human
acccacaagaaauga

SEQ ID NO: 1279689 - RNA, 13 nt, Human
acccaauccaaau

SEQ ID NO: 1279690 - RNA, 14 nt, Human
acccaauccaaaug

SEQ ID NO: 1279691 - RNA, 16 nt, Human
accccuacaugaaaca

SEQ ID NO: 1279692 - RNA, 15 nt, Human
acauaaaaaggacau

SEQ ID NO: 1279693 - RNA, 22 nt, Human
acauaaaaaggacaucagcaaa

SEQ ID NO: 1279694 - RNA, 21 nt, Human
acauaaaaaggacaucagcaa

SEQ ID NO: 1279695 - RNA, 20 nt, Human
acauaaaaaggacaucagca

SEQ ID NO: 1279696 - RNA, 19 nt, Human
acauaaaaaugaucuaaac

SEQ ID NO: 1279697 - RNA, 12 nt, Human
acauaaaggaaa

SEQ ID NO: 1279698 - RNA, 15 nt, Human
acagguuagcugcuc

SEQ ID NO: 1279699 - RNA, 15 nt, Human
acagguuauaacagu

SEQ ID NO: 1279700 - RNA, 18 nt, Human
acagguuauaacaguguu

SEQ ID NO: 1279701 - RNA, 12 nt, Human
acauccagcaga

SEQ ID NO: 1279702 - RNA, 20 nt, Human
acaucccacucacaacagcu

SEQ ID NO: 1279703 - RNA, 14 nt, Human
acaucccacugcca

SEQ ID NO: 1279704 - RNA, 14 nt, Human
acaucggaaaaaua

SEQ ID NO: 1279705 - RNA, 15 nt, Human
acaucggaaaaauaa

SEQ ID NO: 1279706 - RNA, 16 nt, Human
acaucuaaccucaucu

SEQ ID NO: 1279707 - RNA, 17 nt, Human
acaucuaaccucaucuu

SEQ ID NO: 1279708 - RNA, 12 nt, Human
acauaaaguuga

SEQ ID NO: 1279709 - RNA, 15 nt, Human
acauaaaguugauaa

SEQ ID NO: 1279710 - RNA, 14 nt, Human
acauaaaggaaaag

SEQ ID NO: 1279711 - RNA, 16 nt, Human
acauaaaggaaaagac

SEQ ID NO: 1279712 - RNA, 17 nt, Human
acauaaaggaaaagaca

SEQ ID NO: 1279713 - RNA, 18 nt, Human
acauaaaggaaaagacac

SEQ ID NO: 1279714 - RNA, 22 nt, Human
acauaaaggaaaagacacauuu

SEQ ID NO: 1279715 - RNA, 20 nt, Human
acauaaaggaaaagacacau

SEQ ID NO: 1279716 - RNA, 20 nt, Human
acauaaauuuaguauuuugu

SEQ ID NO: 1279717 - RNA, 14 nt, Human
acauguuauuugua

SEQ ID NO: 1279718 - RNA, 20 nt, Human
acauguugggaaacuuggcu

SEQ ID NO: 1279719 - RNA, 20 nt, Human
acauguuguaagcacugacu

SEQ ID NO: 1279720 - RNA, 13 nt, Human
acauguuacaaca

SEQ ID NO: 1279721 - RNA, 11 nt, Human
acauuaaagaa

SEQ ID NO: 1279722 - RNA, 22 nt, Human
acauuaaagaaggguugagcug

SEQ ID NO: 1279723 - RNA, 18 nt, Human
acauuugcucauggaauu

SEQ ID NO: 1279724 - RNA, 22 nt, Human
acauuugcuguuuuaaacauua

SEQ ID NO: 1279725 - RNA, 23 nt, Human
acauuugcuguuuuaaacauuaa

SEQ ID NO: 1279726 - RNA, 23 nt, Human
acauuugcuuuuugugauaugca

SEQ ID NO: 1279727 - RNA, 12 nt, Human
acauuuggaaua

SEQ ID NO: 1279728 - RNA, 14 nt, Human
acauuuguauaaaa

SEQ ID NO: 1279729 - RNA, 17 nt, Human
accaacuccuaguucua

SEQ ID NO: 1279730 - RNA, 23 nt, Human
accaacuccuaguucuagaaaaa

SEQ ID NO: 1279731 - RNA, 22 nt, Human
accaacuccuaguucuagaaaa

SEQ ID NO: 1279732 - RNA, 15 nt, Human
acauuuggaauacuu

SEQ ID NO: 1279733 - RNA, 16 nt, Human
acauuuggaauacuuu

SEQ ID NO: 1279734 - RNA, 17 nt, Human
acauuuggaauacuuuu

SEQ ID NO: 1279735 - RNA, 18 nt, Human
acauuuggaauacuuuuu

SEQ ID NO: 1279736 - RNA, 19 nt, Human
acauuugcuuuuugugaua

SEQ ID NO: 1279737 - RNA, 15 nt, Human
acauuuggaguguuc

SEQ ID NO: 1279738 - RNA, 20 nt, Human
acauuuggaguguuccccuu

SEQ ID NO: 1279739 - RNA, 17 nt, Human
acauuugggagacaugu

SEQ ID NO: 1279740 - RNA, 19 nt, Human
acauuugggagacauguga

SEQ ID NO: 1279741 - RNA, 20 nt, Human
acauuugggagacaugugac

SEQ ID NO: 1279742 - RNA, 21 nt, Human
acauuugggagacaugugaca

SEQ ID NO: 1279743 - RNA, 20 nt, Human
acauuugggaguuuuuauga

SEQ ID NO: 1279744 - RNA, 21 nt, Human
acauuugggaguuuuuaugag

SEQ ID NO: 1279745 - RNA, 20 nt, Human
accacgccuggcuaauuuuu

SEQ ID NO: 1279746 - RNA, 13 nt, Human
accacgccuggcu

SEQ ID NO: 1279747 - RNA, 22 nt, Human
accacgccucuugaccaggcug

SEQ ID NO: 1279748 - RNA, 12 nt, Human
accaagccuuga

SEQ ID NO: 1279749 - RNA, 14 nt, Human
accaagcugaguuu

SEQ ID NO: 1279750 - RNA, 17 nt, Human
accaagcugaguuuccu

SEQ ID NO: 1279751 - RNA, 18 nt, Human
accaagcugaguuuccua

SEQ ID NO: 1279752 - RNA, 14 nt, Human
accaagcugcugug

SEQ ID NO: 1279753 - RNA, 14 nt, Human
accacgcccggcua

SEQ ID NO: 1279754 - RNA, 19 nt, Human
accaagcugaguuuccuau

SEQ ID NO: 1279755 - RNA, 20 nt, Human
accacgcccggcuaauuuuu

SEQ ID NO: 1279756 - RNA, 18 nt, Human
accacgcccguccugccu

SEQ ID NO: 1279757 - RNA, 19 nt, Human
accacgcccguccugccug

SEQ ID NO: 1279758 - RNA, 20 nt, Human
accacgcccguccugccugu

SEQ ID NO: 1279759 - RNA, 21 nt, Human
accacgcccguccugccugug

SEQ ID NO: 1279760 - RNA, 23 nt, Human
accacgcccguccugccuguggc

SEQ ID NO: 1279761 - RNA, 18 nt, Human
accacgccucuugaccag

SEQ ID NO: 1279762 - RNA, 20 nt, Human
acaagucagucauucagaua

SEQ ID NO: 1279763 - RNA, 14 nt, Human
acaaguauuuguua

SEQ ID NO: 1279764 - RNA, 17 nt, Human
acaaguauuuguuaauu

SEQ ID NO: 1279765 - RNA, 20 nt, Human
acaaguauuuguuaauuuag

SEQ ID NO: 1279766 - RNA, 22 nt, Human
acaaguauuuguuaauuuagaa

SEQ ID NO: 1279767 - RNA, 21 nt, Human
acaaguaugaauaaagacacc

SEQ ID NO: 1279768 - RNA, 23 nt, Human
acaaguaugaauaaagacaccua

SEQ ID NO: 1279769 - RNA, 12 nt, Human
acaaguauuuuu

SEQ ID NO: 1279770 - RNA, 15 nt, Human
acaaguauuuuuaau

SEQ ID NO: 1279771 - RNA, 23 nt, Human
acaagucauagguuaauauuuaa

SEQ ID NO: 1279772 - RNA, 23 nt, Human
acaagugaugcuaaaaccugaaa

SEQ ID NO: 1279773 - RNA, 17 nt, Human
acaacuauggaucagaa

SEQ ID NO: 1279774 - RNA, 18 nt, Human
acaaagaguucaagaaau

SEQ ID NO: 1279775 - RNA, 13 nt, Human
acaacuauuuuca

SEQ ID NO: 1279776 - RNA, 15 nt, Human
acaacuauuuucaga

SEQ ID NO: 1279777 - RNA, 20 nt, Human
acaacuauuuucagauguga

SEQ ID NO: 1279778 - RNA, 16 nt, Human
acaacuauuuucagau

SEQ ID NO: 1279779 - RNA, 16 nt, Human
acaacucacuccuuuu

SEQ ID NO: 1279780 - RNA, 17 nt, Human
acaacucacuccuuuua

SEQ ID NO: 1279781 - RNA, 17 nt, Human
acaacuucuaauugcca

SEQ ID NO: 1279782 - RNA, 22 nt, Human
acaacuugucuauuaccuguua

SEQ ID NO: 1279783 - RNA, 13 nt, Human
acaaguaacaaaa

SEQ ID NO: 1279784 - RNA, 14 nt, Human
acaaguaacaaaaa

SEQ ID NO: 1279785 - RNA, 15 nt, Human
acaaguaacaaaaau

SEQ ID NO: 1279786 - RNA, 13 nt, Human
aauuuugaaaaac

SEQ ID NO: 1279787 - RNA, 13 nt, Human
aauuuuaucugcc

SEQ ID NO: 1279788 - RNA, 18 nt, Human
aauuuuaguuuuucauua

SEQ ID NO: 1279789 - RNA, 16 nt, Human
aauuuuaguuuuucau

SEQ ID NO: 1279790 - RNA, 15 nt, Human
aauuuuauaaucugc

SEQ ID NO: 1279791 - RNA, 20 nt, Human
aauuuuauacuuucccuacc

SEQ ID NO: 1279792 - RNA, 21 nt, Human
aauuuuauacuuucccuaccc

SEQ ID NO: 1279793 - RNA, 14 nt, Human
aauuuuaucccuca

SEQ ID NO: 1279794 - RNA, 20 nt, Human
aauuuuaucccucaccugua

SEQ ID NO: 1279795 - RNA, 15 nt, Human
aauuuuagcuuuugu

SEQ ID NO: 1279796 - RNA, 19 nt, Human
aauuuuaguagagacaggg

SEQ ID NO: 1279797 - RNA, 14 nt, Human
aauuuuagcuuuug

SEQ ID NO: 1279798 - RNA, 14 nt, Human
aauuuuaguuuuuc

SEQ ID NO: 1279799 - RNA, 15 nt, Human
aauuuuaguuuuuca

SEQ ID NO: 1279800 - RNA, 24 nt, Human
aauuaguuuuaaaaugauauuguu

SEQ ID NO: 1279801 - RNA, 13 nt, Human
aauuauaaaugac

SEQ ID NO: 1279802 - RNA, 18 nt, Human
aauuauaacuggaaagaa

SEQ ID NO: 1279803 - RNA, 19 nt, Human
aauuauaacuggaaagaag

SEQ ID NO: 1279804 - RNA, 20 nt, Human
aauuauaacuguaaagaugu

SEQ ID NO: 1279805 - RNA, 16 nt, Human
aauuauaauauacuau

SEQ ID NO: 1279806 - RNA, 19 nt, Human
acaaaauggaauacucuua

SEQ ID NO: 1279807 - RNA, 14 nt, Human
aauuuugaugaaca

SEQ ID NO: 1279808 - RNA, 17 nt, Human
aauuuugaguugccaca

SEQ ID NO: 1279809 - RNA, 14 nt, Human
aauuuugaagugcu

SEQ ID NO: 1279810 - RNA, 19 nt, Human
aauuuugaagugcuguuua

SEQ ID NO: 1279811 - RNA, 20 nt, Human
aauuuugaagugcuguuuau

SEQ ID NO: 1279812 - RNA, 20 nt, Human
acaaaauggaauacucuuau

SEQ ID NO: 1279813 - RNA, 14 nt, Human
acaaaccaugcaaa

SEQ ID NO: 1279814 - RNA, 13 nt, Human
acaacuauauugu

SEQ ID NO: 1279815 - RNA, 18 nt, Human
acaacuaugauuuggaaa

SEQ ID NO: 1279816 - RNA, 17 nt, Human
acaaagagacaaagcuu

SEQ ID NO: 1279817 - RNA, 16 nt, Human
acaaagaguucaagaa

SEQ ID NO: 1279818 - RNA, 15 nt, Human
acaaagacccuggcu

SEQ ID NO: 1279819 - RNA, 12 nt, Human
acaaagaaccuu

SEQ ID NO: 1279820 - RNA, 14 nt, Human
acacaaacacacac

SEQ ID NO: 1279821 - RNA, 14 nt, Human
acacaaacuguaaa

SEQ ID NO: 1279822 - RNA, 15 nt, Human
acacaaacuguaaau

SEQ ID NO: 1279823 - RNA, 16 nt, Human
acacaaacuguaaaua

SEQ ID NO: 1279824 - RNA, 19 nt, Human
acacaaacuguaaauaaaa

SEQ ID NO: 1279825 - RNA, 21 nt, Human
acaauuagauaaauguccauu

SEQ ID NO: 1279826 - RNA, 14 nt, Human
acaauuuggcaauu

SEQ ID NO: 1279827 - RNA, 18 nt, Human
acaauuuggcaauuuugu

SEQ ID NO: 1279828 - RNA, 20 nt, Human
acaauuuggcaauuuugugg

SEQ ID NO: 1279829 - RNA, 22 nt, Human
acaauuuggcaauuuugugguu

SEQ ID NO: 1279830 - RNA, 17 nt, Human
acaauguuuaaaccuuu

SEQ ID NO: 1279831 - RNA, 16 nt, Human
acaauuaaagcuguua

SEQ ID NO: 1279832 - RNA, 19 nt, Human
acaauuaaagcuguuauuu

SEQ ID NO: 1279833 - RNA, 14 nt, Human
acaaugugucugag

SEQ ID NO: 1279834 - RNA, 17 nt, Human
acacgcuccuuccucug

SEQ ID NO: 1279835 - RNA, 19 nt, Human
acacgcuccuuccucugag

SEQ ID NO: 1279836 - RNA, 12 nt, Human
acacgcuuuugu

SEQ ID NO: 1279837 - RNA, 14 nt, Human
acacgcuuuuguga

SEQ ID NO: 1279838 - RNA, 17 nt, Human
acacgcuuuugugaugg

SEQ ID NO: 1279839 - RNA, 13 nt, Human
acaccacuagccu

SEQ ID NO: 1279840 - RNA, 13 nt, Human
acaccacucuggc

SEQ ID NO: 1279841 - RNA, 16 nt, Human
acaccacucuggcagc

SEQ ID NO: 1279842 - RNA, 17 nt, Human
acaccacucuggcagcc

SEQ ID NO: 1279843 - RNA, 22 nt, Human
acaccacucuggcagccacacu

SEQ ID NO: 1279844 - RNA, 18 nt, Human
acaccacucuggcagcca

SEQ ID NO: 1279845 - RNA, 20 nt, Human
acaccacucuggcagccaca

SEQ ID NO: 1279846 - RNA, 17 nt, Human
acacagcuacucucccc

SEQ ID NO: 1279847 - RNA, 23 nt, Human
acacagcuacucuccccacgagg

SEQ ID NO: 1279848 - RNA, 14 nt, Human
acacagaaaccaau

SEQ ID NO: 1279849 - RNA, 13 nt, Human
acacagaaaccuu

SEQ ID NO: 1279850 - RNA, 18 nt, Human
acacagaaaccuuuuuaa

SEQ ID NO: 1279851 - RNA, 19 nt, Human
acacagaaaccuuuuuaaa

SEQ ID NO: 1279852 - RNA, 21 nt, Human
acacagaaaccuuuuuaaaaa

SEQ ID NO: 1279853 - RNA, 14 nt, Human
acacagacuauuuu

SEQ ID NO: 1279854 - RNA, 23 nt, Human
acacagacugcgauuugucccag

SEQ ID NO: 1279855 - RNA, 16 nt, Human
acacuaaccaagcuga

SEQ ID NO: 1279856 - RNA, 22 nt, Human
acacuaaccaagcugaguuucc

SEQ ID NO: 1279857 - RNA, 23 nt, Human
acacuaaccaagcugaguuuccu

SEQ ID NO: 1279858 - RNA, 15 nt, Human
acagaagaaacuggg

SEQ ID NO: 1279859 - RNA, 14 nt, Human
acagaagaaacaag

SEQ ID NO: 1279860 - RNA, 13 nt, Human
acagaacacuuau

SEQ ID NO: 1279861 - RNA, 12 nt, Human
acagaacacuua

SEQ ID NO: 1279862 - RNA, 21 nt, Human
acagaacacauaauucaggaa

SEQ ID NO: 1279863 - RNA, 14 nt, Human
acagaaauuguaua

SEQ ID NO: 1279864 - RNA, 15 nt, Human
acagaaauuguauau

SEQ ID NO: 1279865 - RNA, 16 nt, Human
acagaaauuguauauu

SEQ ID NO: 1279866 - RNA, 19 nt, Human
acagaaauuguauauugua

SEQ ID NO: 1279867 - RNA, 12 nt, Human
acagaaauuuaa

SEQ ID NO: 1279868 - RNA, 23 nt, Human
acagaaauuguauauuguaauuu

SEQ ID NO: 1279869 - RNA, 20 nt, Human
acacugugcacaucuguguc

SEQ ID NO: 1279870 - RNA, 21 nt, Human
acacugugcacaucugugucu

SEQ ID NO: 1279871 - RNA, 18 nt, Human
acacugugcacaucugug

SEQ ID NO: 1279872 - RNA, 13 nt, Human
acacugcucuaac

SEQ ID NO: 1279873 - RNA, 14 nt, Human
acacugcucuaaca

SEQ ID NO: 1279874 - RNA, 17 nt, Human
acacugcucuaacagcc

SEQ ID NO: 1279875 - RNA, 19 nt, Human
acacugcucuaacagcccu

SEQ ID NO: 1279876 - RNA, 20 nt, Human
acacugcucuaacagcccuc

SEQ ID NO: 1279877 - RNA, 22 nt, Human
acacugaugcuuagauguucca

SEQ ID NO: 1279878 - RNA, 15 nt, Human
acagcaucucagcuc

SEQ ID NO: 1279879 - RNA, 14 nt, Human
acagcaucucagcu

SEQ ID NO: 1279880 - RNA, 11 nt, Human
acagcaucucc

SEQ ID NO: 1279881 - RNA, 14 nt, Human
acagcaucuccaag

SEQ ID NO: 1279882 - RNA, 24 nt, Human
acagagguagucucacugcuugaa

SEQ ID NO: 1279883 - RNA, 15 nt, Human
acagaaguuugcacu

SEQ ID NO: 1279884 - RNA, 17 nt, Human
acagaaguuugcacuau

SEQ ID NO: 1279885 - RNA, 15 nt, Human
acagcaucuccaagc

SEQ ID NO: 1279886 - RNA, 20 nt, Human
acagcaucuccaagcagcuu

SEQ ID NO: 1279887 - RNA, 22 nt, Human
acagcaucuccaagcagcuuag

SEQ ID NO: 1279888 - RNA, 21 nt, Human
acagcauguacggauuuucag

SEQ ID NO: 1279889 - RNA, 22 nt, Human
acagcauguacggauuuucagu

SEQ ID NO: 1279890 - RNA, 14 nt, Human
acagccaaauuuaa

SEQ ID NO: 1279891 - RNA, 13 nt, Human
acagccagcaccu

SEQ ID NO: 1279892 - RNA, 16 nt, Human
acagccagcaccuggc

SEQ ID NO: 1279893 - RNA, 20 nt, Human
acagcucugcauacucauua

SEQ ID NO: 1279894 - RNA, 13 nt, Human
acagcucuagaca

SEQ ID NO: 1279895 - RNA, 22 nt, Human
acaggugugagccaccacgccc

SEQ ID NO: 1279896 - RNA, 21 nt, Human
acaggugugagccaccacgcc

SEQ ID NO: 1279897 - RNA, 15 nt, Human
acaggucccuccccu

SEQ ID NO: 1279898 - RNA, 13 nt, Human
acaggucuagacu

SEQ ID NO: 1279899 - RNA, 18 nt, Human
acagggucccacagccac

SEQ ID NO: 1279900 - RNA, 22 nt, Human
acagguaaaacagggccacaua

SEQ ID NO: 1279901 - RNA, 18 nt, Human
acagguaaacuaucuugg

SEQ ID NO: 1279902 - RNA, 15 nt, Human
acagguaauauaaaa

SEQ ID NO: 1279903 - RNA, 22 nt, Human
acagguagaauuaucuaauuua

SEQ ID NO: 1279904 - RNA, 16 nt, Human
acagguauauacuuug

SEQ ID NO: 1279905 - RNA, 19 nt, Human
acagguauauacuuugaaa

SEQ ID NO: 1279906 - RNA, 13 nt, Human
acaggucccaaau

SEQ ID NO: 1279907 - RNA, 13 nt, Human
acaggucccuccc

SEQ ID NO: 1279908 - RNA, 21 nt, Human
acagcugcucaauaaaguaca

SEQ ID NO: 1279909 - RNA, 14 nt, Human
acaggggcuugacu

SEQ ID NO: 1279910 - RNA, 22 nt, Human
acaggguaacuaacuaaaacaa

SEQ ID NO: 1279911 - RNA, 21 nt, Human
acaggguaacuaacuaaaaca

SEQ ID NO: 1279912 - RNA, 21 nt, Human
acagggggucuggcugguguu

SEQ ID NO: 1279913 - RNA, 13 nt, Human
acagggggucugg

SEQ ID NO: 1279914 - RNA, 15 nt, Human
acagggggucuggcu

SEQ ID NO: 1279915 - RNA, 16 nt, Human
acagggggucuggcug

SEQ ID NO: 1279916 - RNA, 17 nt, Human
acagggggucuggcugg

SEQ ID NO: 1279917 - RNA, 18 nt, Human
acagggggucuggcuggu

SEQ ID NO: 1279918 - RNA, 19 nt, Human
acagggggucuggcuggug

SEQ ID NO: 1279919 - RNA, 20 nt, Human
acagggggucuggcuggugu

SEQ ID NO: 1279920 - RNA, 20 nt, Human
caaccucugccucccagguu

SEQ ID NO: 1279921 - RNA, 18 nt, Human
caaccguggcccuuccug

SEQ ID NO: 1279922 - RNA, 19 nt, Human
caaccguggcccuuccugg

SEQ ID NO: 1279923 - RNA, 20 nt, Human
caaccguggcccuuccugga

SEQ ID NO: 1279924 - RNA, 21 nt, Human
caaccguggcccuuccuggac

SEQ ID NO: 1279925 - RNA, 23 nt, Human
caaccguggcccuuccuggacag

SEQ ID NO: 1279926 - RNA, 22 nt, Human
caaccguggcccuuccuggaca

SEQ ID NO: 1279927 - RNA, 13 nt, Human
caaccuaaaacuc

SEQ ID NO: 1279928 - RNA, 13 nt, Human
caaccggcuuugu

SEQ ID NO: 1279929 - RNA, 22 nt, Human
caaccggcuuuguggcacuggg

SEQ ID NO: 1279930 - RNA, 15 nt, Human
caaccguggcccuuc

SEQ ID NO: 1279931 - RNA, 13 nt, Human
caacggagucaaa

SEQ ID NO: 1279932 - RNA, 20 nt, Human
caacggaaagugcugucuua

SEQ ID NO: 1279933 - RNA, 19 nt, Human
caaccuucgccaccugggu

SEQ ID NO: 1279934 - RNA, 20 nt, Human
caaccuguucugcuuuccuc

SEQ ID NO: 1279935 - RNA, 17 nt, Human
caaccuuagauguucua

SEQ ID NO: 1279936 - RNA, 18 nt, Human
caaccuuagauguucuaa

SEQ ID NO: 1279937 - RNA, 18 nt, Human
caaccuguagaguggcca

SEQ ID NO: 1279938 - RNA, 20 nt, Human
caaccuguuaccuacuuuga

SEQ ID NO: 1279939 - RNA, 22 nt, Human
caaccuguuaccuacuuugacu

SEQ ID NO: 1279940 - RNA, 23 nt, Human
caaccuguuaccuacuuugacuu

SEQ ID NO: 1279941 - RNA, 15 nt, Human
caacugaccagccuc

SEQ ID NO: 1279942 - RNA, 17 nt, Human
caacugaccagccucca

SEQ ID NO: 1279943 - RNA, 17 nt, Human
caaauuucaugaccagu

SEQ ID NO: 1279944 - RNA, 12 nt, Human
caacacugccag

SEQ ID NO: 1279945 - RNA, 13 nt, Human
caacacugccagc

SEQ ID NO: 1279946 - RNA, 14 nt, Human
caacacugccagca

SEQ ID NO: 1279947 - RNA, 22 nt, Human
caacacuggucugcuguuccag

SEQ ID NO: 1279948 - RNA, 18 nt, Human
caacacuggucugcuguu

SEQ ID NO: 1279949 - RNA, 13 nt, Human
caacccucagagc

SEQ ID NO: 1279950 - RNA, 18 nt, Human
caacccucagagccaccc

SEQ ID NO: 1279951 - RNA, 23 nt, Human
caacccgugccaaguccaggucc

SEQ ID NO: 1279952 - RNA, 16 nt, Human
caacccguggaggcug

SEQ ID NO: 1279953 - RNA, 17 nt, Human
caacccguggaggcugc

SEQ ID NO: 1279954 - RNA, 18 nt, Human
caacccguggaggcugcu

SEQ ID NO: 1279955 - RNA, 21 nt, Human
caacccguggaggcugcucgg

SEQ ID NO: 1279956 - RNA, 22 nt, Human
caacacuguaguaaauaaugcu

SEQ ID NO: 1279957 - RNA, 20 nt, Human
caacccgucuggcccaccag

SEQ ID NO: 1279958 - RNA, 21 nt, Human
caacccgucuggcccaccagg

SEQ ID NO: 1279959 - RNA, 22 nt, Human
caacccgucuggcccaccaggg

SEQ ID NO: 1279960 - RNA, 16 nt, Human
caacccgugccaaguc

SEQ ID NO: 1279961 - RNA, 17 nt, Human
caacccgugccaagucc

SEQ ID NO: 1279962 - RNA, 17 nt, Human
caacccuggcacccagg

SEQ ID NO: 1279963 - RNA, 19 nt, Human
caacccuccuaaaaguuca

SEQ ID NO: 1279964 - RNA, 19 nt, Human
caagacugcacaucaaaau

SEQ ID NO: 1279965 - RNA, 19 nt, Human
caagaagaagggcacccua

SEQ ID NO: 1279966 - RNA, 14 nt, Human
caagacucuagagu

SEQ ID NO: 1279967 - RNA, 17 nt, Human
caagacucuagagucca

SEQ ID NO: 1279968 - RNA, 21 nt, Human
caagacucuagaguccaaggu

SEQ ID NO: 1279969 - RNA, 14 nt, Human
caagagggcacugg

SEQ ID NO: 1279970 - RNA, 15 nt, Human
caagagggcacuggu

SEQ ID NO: 1279971 - RNA, 13 nt, Human
caagagggcacug

SEQ ID NO: 1279972 - RNA, 17 nt, Human
caagagggacgccuggg

SEQ ID NO: 1279973 - RNA, 19 nt, Human
caagagggacgccuggggg

SEQ ID NO: 1279974 - RNA, 22 nt, Human
caagacucuuuaugaucuggcc

SEQ ID NO: 1279975 - RNA, 16 nt, Human
caagacugacgccagg

SEQ ID NO: 1279976 - RNA, 20 nt, Human
caagaacacagcccugcuuc

SEQ ID NO: 1279977 - RNA, 22 nt, Human
caagaaaaauaaagaaaagaug

SEQ ID NO: 1279978 - RNA, 19 nt, Human
caagaaaaauaaagaaaag

SEQ ID NO: 1279979 - RNA, 20 nt, Human
caagaaaaauaaagaaaaga

SEQ ID NO: 1279980 - RNA, 14 nt, Human
caagaaaaauaaag

SEQ ID NO: 1279981 - RNA, 16 nt, Human
caagaaaaauaaagaa

SEQ ID NO: 1279982 - RNA, 17 nt, Human
caagaaaaauaaagaaa

SEQ ID NO: 1279983 - RNA, 18 nt, Human
caagaaaaauaaagaaaa

SEQ ID NO: 1279984 - RNA, 23 nt, Human
caagaaaaauaaagaaaagaugc

SEQ ID NO: 1279985 - RNA, 19 nt, Human
caacugaccagccuccaug

SEQ ID NO: 1279986 - RNA, 20 nt, Human
caacuuuuccuuugaauccu

SEQ ID NO: 1279987 - RNA, 13 nt, Human
caacuuuucuauu

SEQ ID NO: 1279988 - RNA, 21 nt, Human
caagccagauuuuccugaaaa

SEQ ID NO: 1279989 - RNA, 15 nt, Human
caagccagauuuuuu

SEQ ID NO: 1279990 - RNA, 13 nt, Human
caagccagaacuu

SEQ ID NO: 1279991 - RNA, 13 nt, Human
caagccagaggcu

SEQ ID NO: 1279992 - RNA, 15 nt, Human
caagccagaggcugg

SEQ ID NO: 1279993 - RNA, 16 nt, Human
caagccagaggcuggg

SEQ ID NO: 1279994 - RNA, 17 nt, Human
caagagggcacuggugg

SEQ ID NO: 1279995 - RNA, 14 nt, Human
caagccuggcaagg

SEQ ID NO: 1279996 - RNA, 18 nt, Human
caagccguggcuucccgc

SEQ ID NO: 1279997 - RNA, 18 nt, Human
caagccuaagggauccug

SEQ ID NO: 1279998 - RNA, 18 nt, Human
caagccucugcccaggca

SEQ ID NO: 1279999 - RNA, 11 nt, Human
caagccugagg

SEQ ID NO: 1280000 - RNA, 13 nt, Human
caagccugaggga

SEQ ID NO: 1280001 - RNA, 17 nt, Human
caagccugagggaaagg

SEQ ID NO: 1280002 - RNA, 18 nt, Human
caagccugagggaaaggc

SEQ ID NO: 1280003 - RNA, 21 nt, Human
caagccugagggaaaggccag

SEQ ID NO: 1280004 - RNA, 22 nt, Human
caagccugagggaaaggccagc

SEQ ID NO: 1280005 - RNA, 23 nt, Human
caagccugcacaauaaaaauguu

SEQ ID NO: 1280006 - RNA, 16 nt, Human
caaggaaguagaaaca

SEQ ID NO: 1280007 - RNA, 12 nt, Human
caaggaagucaa

SEQ ID NO: 1280008 - RNA, 12 nt, Human
caaggaauuucu

SEQ ID NO: 1280009 - RNA, 15 nt, Human
caaggaauuucuuaa

SEQ ID NO: 1280010 - RNA, 16 nt, Human
caaggaauuucuuaac

SEQ ID NO: 1280011 - RNA, 18 nt, Human
caaggaauuucuuaacuu

SEQ ID NO: 1280012 - RNA, 18 nt, Human
caaggacagccccuccuc

SEQ ID NO: 1280013 - RNA, 15 nt, Human
caaggacugcaggga

SEQ ID NO: 1280014 - RNA, 21 nt, Human
caaggaauuucuuaacuucuu

SEQ ID NO: 1280015 - RNA, 23 nt, Human
caaggaauuucuuaacuucuugc

SEQ ID NO: 1280016 - RNA, 19 nt, Human
caaggaaguagaaacaaaa

SEQ ID NO: 1280017 - RNA, 17 nt, Human
caaggcugauuaaacca

SEQ ID NO: 1280018 - RNA, 16 nt, Human
caaggagucacugaga

SEQ ID NO: 1280019 - RNA, 18 nt, Human
caaggaguaugcagggag

SEQ ID NO: 1280020 - RNA, 18 nt, Human
caaggaggggcuguaaaa

SEQ ID NO: 1280021 - RNA, 22 nt, Human
caaggacugcagggacugccag

SEQ ID NO: 1280022 - RNA, 14 nt, Human
caaggacuuccugu

SEQ ID NO: 1280023 - RNA, 19 nt, Human
caaggacuuccuguccagc

SEQ ID NO: 1280024 - RNA, 21 nt, Human
caaggacuuccuguccagcuc

SEQ ID NO: 1280025 - RNA, 22 nt, Human
caaggacuuccuguccagcucc

SEQ ID NO: 1280026 - RNA, 23 nt, Human
caaggacuuccuguccagcucca

SEQ ID NO: 1280027 - RNA, 15 nt, Human
caaggacuuugcagc

SEQ ID NO: 1280028 - RNA, 16 nt, Human
caaggacuuugcagcc

SEQ ID NO: 1280029 - RNA, 15 nt, Human
caaggacuuuguaca

SEQ ID NO: 1280030 - RNA, 16 nt, Human
caaggacuuuguacau

SEQ ID NO: 1280031 - RNA, 13 nt, Human
caaggucugcuuu

SEQ ID NO: 1280032 - RNA, 19 nt, Human
caaggucguuuuuuucauu

SEQ ID NO: 1280033 - RNA, 20 nt, Human
caagguccucugucagucac

SEQ ID NO: 1280034 - RNA, 21 nt, Human
caagguccucugucagucaca

SEQ ID NO: 1280035 - RNA, 22 nt, Human
caagguccucugucagucacag

SEQ ID NO: 1280036 - RNA, 18 nt, Human
caaggguagggugggccu

SEQ ID NO: 1280037 - RNA, 19 nt, Human
caaggguagggugggccuu

SEQ ID NO: 1280038 - RNA, 16 nt, Human
caaggggccugagcag

SEQ ID NO: 1280039 - RNA, 21 nt, Human
caaggggccugagcaguccuu

SEQ ID NO: 1280040 - RNA, 22 nt, Human
caaggggcuucagguccaggcu

SEQ ID NO: 1280041 - RNA, 20 nt, Human
caaggcuguggaccauggag

SEQ ID NO: 1280042 - RNA, 14 nt, Human
caaggggccugagc

SEQ ID NO: 1280043 - RNA, 15 nt, Human
caaggggccugagca

SEQ ID NO: 1280044 - RNA, 15 nt, Human
caaggcuguggacca

SEQ ID NO: 1280045 - RNA, 18 nt, Human
caaguguaaugaauaccu

SEQ ID NO: 1280046 - RNA, 19 nt, Human
caaguguaaugaauaccuu

SEQ ID NO: 1280047 - RNA, 15 nt, Human
caaguguaaugaaua

SEQ ID NO: 1280048 - RNA, 12 nt, Human
caaguguaauga

SEQ ID NO: 1280049 - RNA, 23 nt, Human
caaguguaaaauauuuugaauca

SEQ ID NO: 1280050 - RNA, 19 nt, Human
caaguggcucccacacccu

SEQ ID NO: 1280051 - RNA, 18 nt, Human
caaguggacucagggcag

SEQ ID NO: 1280052 - RNA, 23 nt, Human
caaguggacucagggcagcgcca

SEQ ID NO: 1280053 - RNA, 18 nt, Human
caagugagucucucuggg

SEQ ID NO: 1280054 - RNA, 19 nt, Human
caagugaucugcccaccuc

SEQ ID NO: 1280055 - RNA, 18 nt, Human
caagugaugcuaaaaccu

SEQ ID NO: 1280056 - RNA, 15 nt, Human
caaguggacucaggg

SEQ ID NO: 1280057 - RNA, 16 nt, Human
caaguggacucagggc

SEQ ID NO: 1280058 - RNA, 19 nt, Human
caagugaggugugucacaa

SEQ ID NO: 1280059 - RNA, 17 nt, Human
caagugauucucaugcc

SEQ ID NO: 1280060 - RNA, 18 nt, Human
caagugauucucaugccu

SEQ ID NO: 1280061 - RNA, 20 nt, Human
caagugauucucaugccuca

SEQ ID NO: 1280062 - RNA, 21 nt, Human
caagugauucucaugccucag

SEQ ID NO: 1280063 - RNA, 14 nt, Human
caauuaauuuuaga

SEQ ID NO: 1280064 - RNA, 15 nt, Human
caauuaauuccuuca

SEQ ID NO: 1280065 - RNA, 18 nt, Human
caauuaauuccuucagca

SEQ ID NO: 1280066 - RNA, 15 nt, Human
caauguuagccucaa

SEQ ID NO: 1280067 - RNA, 13 nt, Human
caauguucaucau

SEQ ID NO: 1280068 - RNA, 22 nt, Human
caauguuagccucaauuucuga

SEQ ID NO: 1280069 - RNA, 19 nt, Human
caauuacaacggagucaaa

SEQ ID NO: 1280070 - RNA, 13 nt, Human
caauucuccugcc

SEQ ID NO: 1280071 - RNA, 14 nt, Human
caauucuccugccu

SEQ ID NO: 1280072 - RNA, 15 nt, Human
caauucuccugccuc

SEQ ID NO: 1280073 - RNA, 16 nt, Human
caauucuccugccuca

SEQ ID NO: 1280074 - RNA, 13 nt, Human
caauuugaugugg

SEQ ID NO: 1280075 - RNA, 21 nt, Human
caauuuggauuuaaaagccug

SEQ ID NO: 1280076 - RNA, 23 nt, Human
caauuuggauuuaaaagccugcu

SEQ ID NO: 1280077 - RNA, 18 nt, Human
caauuuggcaauuuugug

SEQ ID NO: 1280078 - RNA, 19 nt, Human
caauuuggcaauuuugugg

SEQ ID NO: 1280079 - RNA, 14 nt, Human
caaugagcuuucug

SEQ ID NO: 1280080 - RNA, 15 nt, Human
caaugagcuuucuga

SEQ ID NO: 1280081 - RNA, 16 nt, Human
caaugagcuuucugaa

SEQ ID NO: 1280082 - RNA, 17 nt, Human
caaugagcuuucugaac

SEQ ID NO: 1280083 - RNA, 20 nt, Human
caaugagcuuucugaacagc

SEQ ID NO: 1280084 - RNA, 21 nt, Human
caaugagcuuucugaacagcu

SEQ ID NO: 1280085 - RNA, 23 nt, Human
caaugagcuuucugaacagcugg

SEQ ID NO: 1280086 - RNA, 12 nt, Human
caaugagcaugu

SEQ ID NO: 1280087 - RNA, 13 nt, Human
caaugagcauguu

SEQ ID NO: 1280088 - RNA, 14 nt, Human
caaugagcauguuu

SEQ ID NO: 1280089 - RNA, 18 nt, Human
caaugagcauguuuagac

SEQ ID NO: 1280090 - RNA, 20 nt, Human
caaugagcauguuuagacuu

SEQ ID NO: 1280091 - RNA, 12 nt, Human
caaugagcuuuc

SEQ ID NO: 1280092 - RNA, 13 nt, Human
caaugagcuuucu

SEQ ID NO: 1280093 - RNA, 19 nt, Human
caaugggagcugaggccac

SEQ ID NO: 1280094 - RNA, 23 nt, Human
caaugggagcugaggccacacuc

SEQ ID NO: 1280095 - RNA, 17 nt, Human
caauguacccaccgggc

SEQ ID NO: 1280096 - RNA, 19 nt, Human
caauguacccaccgggcca

SEQ ID NO: 1280097 - RNA, 22 nt, Human
caauguacccaccgggccacuc

SEQ ID NO: 1280098 - RNA, 16 nt, Human
caauguagauaagugu

SEQ ID NO: 1280099 - RNA, 20 nt, Human
caauguagauaaguguucug

SEQ ID NO: 1280100 - RNA, 21 nt, Human
caauguagauaaguguucugu

SEQ ID NO: 1280101 - RNA, 21 nt, Human
caaugggagcugaggccacac

SEQ ID NO: 1280102 - RNA, 22 nt, Human
caaugagcuuucugaacagcug

SEQ ID NO: 1280103 - RNA, 15 nt, Human
caauggggccaguca

SEQ ID NO: 1280104 - RNA, 23 nt, Human
caauggguuuuucccuguacagu

SEQ ID NO: 1280105 - RNA, 12 nt, Human
caauguaauuau

SEQ ID NO: 1280106 - RNA, 13 nt, Human
caauguaauuauu

SEQ ID NO: 1280107 - RNA, 14 nt, Human
caauguaauuauuu

SEQ ID NO: 1280108 - RNA, 22 nt, Human
caauguaauuauuuauguaugg

SEQ ID NO: 1280109 - RNA, 23 nt, Human
caauguaauuauuuauguauggu

SEQ ID NO: 1280110 - RNA, 18 nt, Human
caaucuguaaaacuaaga

SEQ ID NO: 1280111 - RNA, 12 nt, Human
caaucuguaaac

SEQ ID NO: 1280112 - RNA, 15 nt, Human
caaucuguaaacugu

SEQ ID NO: 1280113 - RNA, 16 nt, Human
caaucuguaaacugug

SEQ ID NO: 1280114 - RNA, 17 nt, Human
caaucuguaaacugugu

SEQ ID NO: 1280115 - RNA, 14 nt, Human
caaucugucaguuc

SEQ ID NO: 1280116 - RNA, 18 nt, Human
caaucuguaaacugugua

SEQ ID NO: 1280117 - RNA, 16 nt, Human
caauauaagcuuuucu

SEQ ID NO: 1280118 - RNA, 20 nt, Human
caauauacuggaaagcuuuu

SEQ ID NO: 1280119 - RNA, 23 nt, Human
caauacaucccuuaccugggaaa

SEQ ID NO: 1280120 - RNA, 16 nt, Human
caauacagauauauuu

SEQ ID NO: 1280121 - RNA, 21 nt, Human
caauacaaguuucauccagaa

SEQ ID NO: 1280122 - RNA, 16 nt, Human
caauacaaguuucauc

SEQ ID NO: 1280123 - RNA, 21 nt, Human
caauacaaauggauuuuggga

SEQ ID NO: 1280124 - RNA, 13 nt, Human
caauacagauaua

SEQ ID NO: 1280125 - RNA, 15 nt, Human
caauacagauauauu

SEQ ID NO: 1280126 - RNA, 13 nt, Human
caauaauuuucua

SEQ ID NO: 1280127 - RNA, 14 nt, Human
caauaauuuucuac

SEQ ID NO: 1280128 - RNA, 13 nt, Human
caauacaaaugga

SEQ ID NO: 1280129 - RNA, 14 nt, Human
caauacaaauggau

SEQ ID NO: 1280130 - RNA, 15 nt, Human
caauacaaauggauu

SEQ ID NO: 1280131 - RNA, 16 nt, Human
caauacaaauggauuu

SEQ ID NO: 1280132 - RNA, 17 nt, Human
caauagccacuaaccuu

SEQ ID NO: 1280133 - RNA, 18 nt, Human
caauagccacuaaccuug

SEQ ID NO: 1280134 - RNA, 22 nt, Human
caauagccacuaaccuugccug

SEQ ID NO: 1280135 - RNA, 24 nt, Human
caauagccacuaaccuugccuggu

SEQ ID NO: 1280136 - RNA, 12 nt, Human
caaguuaaaugu

SEQ ID NO: 1280137 - RNA, 13 nt, Human
caaguuaaaugua

SEQ ID NO: 1280138 - RNA, 14 nt, Human
caaguuaaauguag

SEQ ID NO: 1280139 - RNA, 16 nt, Human
caaguuagaaaacaua

SEQ ID NO: 1280140 - RNA, 13 nt, Human
caaguuauuaauu

SEQ ID NO: 1280141 - RNA, 13 nt, Human
caauaauauauuu

SEQ ID NO: 1280142 - RNA, 14 nt, Human
caauaauauauuuu

SEQ ID NO: 1280143 - RNA, 16 nt, Human
caauaauauauuuucu

SEQ ID NO: 1280144 - RNA, 17 nt, Human
caauaauauauuuucug

SEQ ID NO: 1280145 - RNA, 20 nt, Human
caauaauauauuuucuguuu

SEQ ID NO: 1280146 - RNA, 18 nt, Human
caauaauauauuuucugu

SEQ ID NO: 1280147 - RNA, 17 nt, Human
caaaaauuaucuauagc

SEQ ID NO: 1280148 - RNA, 21 nt, Human
caaauacgugggcauucaaau

SEQ ID NO: 1280149 - RNA, 22 nt, Human
caaauacgugggcauucaaaug

SEQ ID NO: 1280150 - RNA, 11 nt, Human
caaaguggaac

SEQ ID NO: 1280151 - RNA, 14 nt, Human
caaaguggaacgaa

SEQ ID NO: 1280152 - RNA, 15 nt, Human
caaaguggaacgaaa

SEQ ID NO: 1280153 - RNA, 20 nt, Human
caaauacgugggcauucaaa

SEQ ID NO: 1280154 - RNA, 15 nt, Human
caaauacuaaaaaga

SEQ ID NO: 1280155 - RNA, 16 nt, Human
caaauacuaaaaagaa

SEQ ID NO: 1280156 - RNA, 21 nt, Human
caaauacuaaaaagaagugcu

SEQ ID NO: 1280157 - RNA, 16 nt, Human
caaauacuaaugaaaa

SEQ ID NO: 1280158 - RNA, 17 nt, Human
caaauacuaaugaaaac

SEQ ID NO: 1280159 - RNA, 18 nt, Human
caaauacuguauauucag

SEQ ID NO: 1280160 - RNA, 19 nt, Human
caaagugcugggauuacag

SEQ ID NO: 1280161 - RNA, 13 nt, Human
caaauauguccug

SEQ ID NO: 1280162 - RNA, 14 nt, Human
caaauauguccugg

SEQ ID NO: 1280163 - RNA, 15 nt, Human
caaauauguccuggg

SEQ ID NO: 1280164 - RNA, 17 nt, Human
caaauauguccuggggu

SEQ ID NO: 1280165 - RNA, 14 nt, Human
caaauggggccaga

SEQ ID NO: 1280166 - RNA, 15 nt, Human
caaauggggccagau

SEQ ID NO: 1280167 - RNA, 16 nt, Human
caaauggggccagauc

SEQ ID NO: 1280168 - RNA, 17 nt, Human
caaauggggccagaucc

SEQ ID NO: 1280169 - RNA, 18 nt, Human
caaauggggccagaucca

SEQ ID NO: 1280170 - RNA, 19 nt, Human
caaauggggccagauccag

SEQ ID NO: 1280171 - RNA, 20 nt, Human
caaauggggccagauccagc

SEQ ID NO: 1280172 - RNA, 23 nt, Human
caaauggggccagauccagccug

SEQ ID NO: 1280173 - RNA, 13 nt, Human
caaaugguaggca

SEQ ID NO: 1280174 - RNA, 15 nt, Human
caaaugguaggcauu

SEQ ID NO: 1280175 - RNA, 20 nt, Human
caaaugguaggcauuuccua

SEQ ID NO: 1280176 - RNA, 15 nt, Human
caaaugguaucuuuu

SEQ ID NO: 1280177 - RNA, 15 nt, Human
caaaugucuauaaac

SEQ ID NO: 1280178 - RNA, 18 nt, Human
caaaugucaugcugccuu

SEQ ID NO: 1280179 - RNA, 14 nt, Human
caaaugucuauaaa

SEQ ID NO: 1280180 - RNA, 16 nt, Human
caaaugucaugcugcc

SEQ ID NO: 1280181 - RNA, 17 nt, Human
caaaugucaugcugccu

SEQ ID NO: 1280182 - RNA, 19 nt, Human
caaaugucaugcugccuua

SEQ ID NO: 1280183 - RNA, 13 nt, Human
caaaugguaucuu

SEQ ID NO: 1280184 - RNA, 22 nt, Human
caaauguaguauggccuguguc

SEQ ID NO: 1280185 - RNA, 23 nt, Human
caaauguaguauggccuguguca

SEQ ID NO: 1280186 - RNA, 14 nt, Human
caaauuaucuuaaa

SEQ ID NO: 1280187 - RNA, 15 nt, Human
caaauuauuaaugaa

SEQ ID NO: 1280188 - RNA, 17 nt, Human
caaauuauuaaugaaaa

SEQ ID NO: 1280189 - RNA, 14 nt, Human
caaauucaaauaaa

SEQ ID NO: 1280190 - RNA, 16 nt, Human
caaauucaguuucaua

SEQ ID NO: 1280191 - RNA, 21 nt, Human
caaauuguaagcaugcacaaa

SEQ ID NO: 1280192 - RNA, 12 nt, Human
caaauucaguuu

SEQ ID NO: 1280193 - RNA, 14 nt, Human
caaauucaguuuca

SEQ ID NO: 1280194 - RNA, 15 nt, Human
caaauucaguuucau

SEQ ID NO: 1280195 - RNA, 15 nt, Human
caaauugugugaaag

SEQ ID NO: 1280196 - RNA, 18 nt, Human
caaauugugcaguacuuu

SEQ ID NO: 1280197 - RNA, 21 nt, Human
caaaggcauuauaaaaagaau

SEQ ID NO: 1280198 - RNA, 12 nt, Human
caaagcugccug

SEQ ID NO: 1280199 - RNA, 11 nt, Human
caaagcugccu

SEQ ID NO: 1280200 - RNA, 17 nt, Human
caaaggaagguggaugg

SEQ ID NO: 1280201 - RNA, 23 nt, Human
caaaggccuaauucuaugccugu

SEQ ID NO: 1280202 - RNA, 21 nt, Human
caaagcugccugucccuaccc

SEQ ID NO: 1280203 - RNA, 19 nt, Human
caaacuagggccaagccca

SEQ ID NO: 1280204 - RNA, 20 nt, Human
caaacuacuuugcugcuaau

SEQ ID NO: 1280205 - RNA, 13 nt, Human
caaacuagggcca

SEQ ID NO: 1280206 - RNA, 12 nt, Human
caaacuguaaau

SEQ ID NO: 1280207 - RNA, 14 nt, Human
caaacuguaaauaa

SEQ ID NO: 1280208 - RNA, 20 nt, Human
caaacuguaaauaaaaagaa

SEQ ID NO: 1280209 - RNA, 21 nt, Human
caaacuguaaauaaaaagaaa

SEQ ID NO: 1280210 - RNA, 14 nt, Human
caaacuguaauaca

SEQ ID NO: 1280211 - RNA, 16 nt, Human
caaacuguauaacuug

SEQ ID NO: 1280212 - RNA, 15 nt, Human
caaacuguguaacug

SEQ ID NO: 1280213 - RNA, 20 nt, Human
caaacuguguaacugcccaa

SEQ ID NO: 1280214 - RNA, 15 nt, Human
caaagcccuuuuaua

SEQ ID NO: 1280215 - RNA, 19 nt, Human
caaagccuguucauggcag

SEQ ID NO: 1280216 - RNA, 20 nt, Human
caaagccuguucauggcaga

SEQ ID NO: 1280217 - RNA, 21 nt, Human
caaagccuguucauggcagau

SEQ ID NO: 1280218 - RNA, 22 nt, Human
caaagccuguucauggcagaug

SEQ ID NO: 1280219 - RNA, 18 nt, Human
caaacuguguaacugccc

SEQ ID NO: 1280220 - RNA, 20 nt, Human
caaagccagcguccuccucu

SEQ ID NO: 1280221 - RNA, 21 nt, Human
caaagccagcguccuccucug

SEQ ID NO: 1280222 - RNA, 23 nt, Human
caaagccagcguccuccucugug

SEQ ID NO: 1280223 - RNA, 22 nt, Human
caaagccagcguccuccucugu

SEQ ID NO: 1280224 - RNA, 14 nt, Human
caaagccagguccc

SEQ ID NO: 1280225 - RNA, 17 nt, Human
caaagccaggucccucu

SEQ ID NO: 1280226 - RNA, 18 nt, Human
caaagccaggucccucuc

SEQ ID NO: 1280227 - RNA, 19 nt, Human
caaagccaggucccucuca

SEQ ID NO: 1280228 - RNA, 21 nt, Human
caaagccaggucccucucauu

SEQ ID NO: 1280229 - RNA, 16 nt, Human
caaaauuuuuucucua

SEQ ID NO: 1280230 - RNA, 22 nt, Human
caaaauugcaaaucuugaaauu

SEQ ID NO: 1280231 - RNA, 21 nt, Human
caaaauuuuuucucuaggaaa

SEQ ID NO: 1280232 - RNA, 22 nt, Human
caaaauuuuuucucuaggaaau

SEQ ID NO: 1280233 - RNA, 16 nt, Human
caaacacacacaaaag

SEQ ID NO: 1280234 - RNA, 17 nt, Human
caaacaaugacaaagca

SEQ ID NO: 1280235 - RNA, 19 nt, Human
caaacaaugacaaagcaga

SEQ ID NO: 1280236 - RNA, 18 nt, Human
caaacaauugaagucaau

SEQ ID NO: 1280237 - RNA, 18 nt, Human
caaacaccaacauaaaaa

SEQ ID NO: 1280238 - RNA, 16 nt, Human
caaacaccaacauaaa

SEQ ID NO: 1280239 - RNA, 13 nt, Human
caaaccucaccaa

SEQ ID NO: 1280240 - RNA, 20 nt, Human
caaacgcccuuuccuccuca

SEQ ID NO: 1280241 - RNA, 22 nt, Human
caaacgcccuuuccuccucagg

SEQ ID NO: 1280242 - RNA, 23 nt, Human
caaacgcccuuuccuccucaggc

SEQ ID NO: 1280243 - RNA, 16 nt, Human
caaaauuguuacaaau

SEQ ID NO: 1280244 - RNA, 16 nt, Human
caaaauugcaaaucuu

SEQ ID NO: 1280245 - RNA, 17 nt, Human
caaaauugcaaaucuug

SEQ ID NO: 1280246 - RNA, 23 nt, Human
caaaauuagccaguaauccugua

SEQ ID NO: 1280247 - RNA, 21 nt, Human
caaaauuauagaaguuuagau

SEQ ID NO: 1280248 - RNA, 22 nt, Human
caaaauuagccaguaauccugu

SEQ ID NO: 1280249 - RNA, 21 nt, Human
caaaauuagccaguaauccug

SEQ ID NO: 1280250 - RNA, 20 nt, Human
caaaauuagccaguaauccu

SEQ ID NO: 1280251 - RNA, 13 nt, Human
caaaauuagccag

SEQ ID NO: 1280252 - RNA, 18 nt, Human
caaaauguuauuucccua

SEQ ID NO: 1280253 - RNA, 22 nt, Human
caaaauguugaaauaugauguu

SEQ ID NO: 1280254 - RNA, 17 nt, Human
caaaauguuauuucccu

SEQ ID NO: 1280255 - RNA, 16 nt, Human
caaaauguuauuuccc

SEQ ID NO: 1280256 - RNA, 19 nt, Human
caaaauguuaucuucucaa

SEQ ID NO: 1280257 - RNA, 20 nt, Human
caaaauguuaucuucucaag

SEQ ID NO: 1280258 - RNA, 21 nt, Human
caaaauguuaucuucucaagu

SEQ ID NO: 1280259 - RNA, 22 nt, Human
caaaauguuaucuucucaaguu

SEQ ID NO: 1280260 - RNA, 17 nt, Human
caaaauguuggucauuu

SEQ ID NO: 1280261 - RNA, 18 nt, Human
caaaauguuggucauuuu

SEQ ID NO: 1280262 - RNA, 21 nt, Human
caaaauguuggucauuuuaug

SEQ ID NO: 1280263 - RNA, 22 nt, Human
caaaaugcucuuauuucaucau

SEQ ID NO: 1280264 - RNA, 18 nt, Human
caaaaugcuuuuuauuuc

SEQ ID NO: 1280265 - RNA, 20 nt, Human
caaaaugcuuuuuauuucug

SEQ ID NO: 1280266 - RNA, 23 nt, Human
caaaaugcuuuuuauuucugcau

SEQ ID NO: 1280267 - RNA, 23 nt, Human
caaaauguaggcuuaguuugugu

SEQ ID NO: 1280268 - RNA, 16 nt, Human
caaaauguaugucugg

SEQ ID NO: 1280269 - RNA, 19 nt, Human
caaaaaucucaauauuuca

SEQ ID NO: 1280270 - RNA, 15 nt, Human
caaaaagugaaauaa

SEQ ID NO: 1280271 - RNA, 14 nt, Human
caaaaauagcuaaa

SEQ ID NO: 1280272 - RNA, 12 nt, Human
caaaaauauaaa

SEQ ID NO: 1280273 - RNA, 23 nt, Human
caaaaauauaaaauaugaagaca

SEQ ID NO: 1280274 - RNA, 19 nt, Human
caaaaauuaucuauagcua

SEQ ID NO: 1280275 - RNA, 21 nt, Human
caaaaauuucuguaaaacagg

SEQ ID NO: 1280276 - RNA, 22 nt, Human
caaaaauuucuguaaaacaggu

SEQ ID NO: 1280277 - RNA, 21 nt, Human
caaaacaaagcaauucuuuca

SEQ ID NO: 1280278 - RNA, 22 nt, Human
caaaacaaagcaauucuuucaa

SEQ ID NO: 1280279 - RNA, 12 nt, Human
caaaacaaaggc

SEQ ID NO: 1280280 - RNA, 15 nt, Human
caaaacaaaggccua

SEQ ID NO: 1280281 - RNA, 16 nt, Human
caaaacaaaggccuaa

SEQ ID NO: 1280282 - RNA, 14 nt, Human
caaaagaagaaguu

SEQ ID NO: 1280283 - RNA, 15 nt, Human
caaaagaagaaguuu

SEQ ID NO: 1280284 - RNA, 20 nt, Human
caaaagaagaaguuucauca

SEQ ID NO: 1280285 - RNA, 23 nt, Human
caaaacuucagacauagaauuaa

SEQ ID NO: 1280286 - RNA, 21 nt, Human
caaaacuucguuuaaugaaug

SEQ ID NO: 1280287 - RNA, 12 nt, Human
caaaacugcucc

SEQ ID NO: 1280288 - RNA, 22 nt, Human
caaaacaaaggccuaauucuau

SEQ ID NO: 1280289 - RNA, 14 nt, Human
caaaacaaacucau

SEQ ID NO: 1280290 - RNA, 14 nt, Human
caaaacaauguuua

SEQ ID NO: 1280291 - RNA, 18 nt, Human
caaaacaauguuuaaacc

SEQ ID NO: 1280292 - RNA, 16 nt, Human
caaaacaauguuuaaa

SEQ ID NO: 1280293 - RNA, 16 nt, Human
caaaacacuuguaauu

SEQ ID NO: 1280294 - RNA, 18 nt, Human
caaaacacuuguaauuuu

SEQ ID NO: 1280295 - RNA, 13 nt, Human
caaaacagauugu

SEQ ID NO: 1280296 - RNA, 18 nt, Human
caaaacagauuguuugca

SEQ ID NO: 1280297 - RNA, 21 nt, Human
caaaacaguauugacuuguau

SEQ ID NO: 1280298 - RNA, 16 nt, Human
caaaaccagguccaau

SEQ ID NO: 1280299 - RNA, 22 nt, Human
caaaaccagguccaaugagcuu

SEQ ID NO: 1280300 - RNA, 23 nt, Human
caaaaccagguccaaugagcuuu

SEQ ID NO: 1280301 - RNA, 13 nt, Human
caaaacccagacc

SEQ ID NO: 1280302 - RNA, 15 nt, Human
caaaacccagaccug

SEQ ID NO: 1280303 - RNA, 15 nt, Human
caaaaccccccagau

SEQ ID NO: 1280304 - RNA, 19 nt, Human
caaaaccccccagauauca

SEQ ID NO: 1280305 - RNA, 21 nt, Human
caaaaccccccagauaucauc

SEQ ID NO: 1280306 - RNA, 12 nt, Human
caaaaccgccag

SEQ ID NO: 1280307 - RNA, 14 nt, Human
caaaaccgccagcu

SEQ ID NO: 1280308 - RNA, 17 nt, Human
caaaaccgccagcucug

SEQ ID NO: 1280309 - RNA, 18 nt, Human
caaaaccgccagcucugu

SEQ ID NO: 1280310 - RNA, 20 nt, Human
caaaaccgccagcucuguuc

SEQ ID NO: 1280311 - RNA, 20 nt, Human
caaaaagaaaagaaaauuuu

SEQ ID NO: 1280312 - RNA, 23 nt, Human
caaaaacuuuggaguccccucac

SEQ ID NO: 1280313 - RNA, 16 nt, Human
caaaaacuauuuggga

SEQ ID NO: 1280314 - RNA, 14 nt, Human
caaaaacuauuugg

SEQ ID NO: 1280315 - RNA, 22 nt, Human
caaaaacagguauauacuuuga

SEQ ID NO: 1280316 - RNA, 17 nt, Human
caaaaaccuauuccacu

SEQ ID NO: 1280317 - RNA, 20 nt, Human
caaaaacagguauauacuuu

SEQ ID NO: 1280318 - RNA, 18 nt, Human
caaaaagcuaauaccagu

SEQ ID NO: 1280319 - RNA, 14 nt, Human
caaaaagaaccacu

SEQ ID NO: 1280320 - RNA, 17 nt, Human
caaaaagaaccacuugu

SEQ ID NO: 1280321 - RNA, 14 nt, Human
caaaaacaaaaaga

SEQ ID NO: 1280322 - RNA, 10 nt, Human
auuuuguaaa

SEQ ID NO: 1280323 - RNA, 17 nt, Human
auuuuguaaacucaaaa

SEQ ID NO: 1280324 - RNA, 19 nt, Human
caaaaaauuaaagcauuua

SEQ ID NO: 1280325 - RNA, 15 nt, Human
caaaaaauuaaagca

SEQ ID NO: 1280326 - RNA, 18 nt, Human
caaaaaauuaaagcauuu

SEQ ID NO: 1280327 - RNA, 13 nt, Human
auuuuccugaaaa

SEQ ID NO: 1280328 - RNA, 14 nt, Human
auuuuccugaaaac

SEQ ID NO: 1280329 - RNA, 14 nt, Human
auuuuccuuuucaa

SEQ ID NO: 1280330 - RNA, 14 nt, Human
auuuucuaaaaaag

SEQ ID NO: 1280331 - RNA, 16 nt, Human
auuuucuaagaaacau

SEQ ID NO: 1280332 - RNA, 17 nt, Human
auuuucuaagaaacauu

SEQ ID NO: 1280333 - RNA, 22 nt, Human
auuuuggagaguuuccugaaac

SEQ ID NO: 1280334 - RNA, 21 nt, Human
auuuuggagaguuuccugaaa

SEQ ID NO: 1280335 - RNA, 17 nt, Human
auuuuggauuuugcaag

SEQ ID NO: 1280336 - RNA, 22 nt, Human
auuuucuaagaaacauuuauau

SEQ ID NO: 1280337 - RNA, 21 nt, Human
auuuucuaccuggucucuccu

SEQ ID NO: 1280338 - RNA, 20 nt, Human
auuuuggagaguuuccugaa

SEQ ID NO: 1280339 - RNA, 22 nt, Human
auuuugguaaaauacuucuuga

SEQ ID NO: 1280340 - RNA, 19 nt, Human
auuuuguaaacucaaaaua

SEQ ID NO: 1280341 - RNA, 19 nt, Human
cacagugaucaaguuauuu

SEQ ID NO: 1280342 - RNA, 14 nt, Human
cacagugcaucuca

SEQ ID NO: 1280343 - RNA, 16 nt, Human
cacaggaguguccucu

SEQ ID NO: 1280344 - RNA, 13 nt, Human
cacaguuccccua

SEQ ID NO: 1280345 - RNA, 14 nt, Human
cacaguuccuggga

SEQ ID NO: 1280346 - RNA, 18 nt, Human
cacaguucuuugggccag

SEQ ID NO: 1280347 - RNA, 19 nt, Human
cacaguucuuugggccaga

SEQ ID NO: 1280348 - RNA, 20 nt, Human
cacaguucuuugggccagac

SEQ ID NO: 1280349 - RNA, 17 nt, Human
cacagugcaucucagcc

SEQ ID NO: 1280350 - RNA, 16 nt, Human
cacaguguaugaaggg

SEQ ID NO: 1280351 - RNA, 17 nt, Human
cacagugucaggcacug

SEQ ID NO: 1280352 - RNA, 19 nt, Human
cacaggagggcggccuccu

SEQ ID NO: 1280353 - RNA, 22 nt, Human
cacaggagggcggccuccuucu

SEQ ID NO: 1280354 - RNA, 12 nt, Human
cacaggaggggg

SEQ ID NO: 1280355 - RNA, 22 nt, Human
cacaggagggggucguggagag

SEQ ID NO: 1280356 - RNA, 23 nt, Human
cacaggagggggucguggagagc

SEQ ID NO: 1280357 - RNA, 14 nt, Human
cacaggagggaggg

SEQ ID NO: 1280358 - RNA, 20 nt, Human
cacaggagcuaccugugugg

SEQ ID NO: 1280359 - RNA, 19 nt, Human
cacaggagggagggggaag

SEQ ID NO: 1280360 - RNA, 21 nt, Human
cacaggagggagggggaaggc

SEQ ID NO: 1280361 - RNA, 17 nt, Human
cacagcuuagauuucau

SEQ ID NO: 1280362 - RNA, 14 nt, Human
cacaggagcuaccu

SEQ ID NO: 1280363 - RNA, 15 nt, Human
cacaggagcuaccug

SEQ ID NO: 1280364 - RNA, 16 nt, Human
cacaggagcuaccugu

SEQ ID NO: 1280365 - RNA, 18 nt, Human
cacaggagcuaccugugu

SEQ ID NO: 1280366 - RNA, 17 nt, Human
cacagcuguauagcugc

SEQ ID NO: 1280367 - RNA, 20 nt, Human
cacagcuguauagcugcuuc

SEQ ID NO: 1280368 - RNA, 15 nt, Human
cacagcuuagauuuc

SEQ ID NO: 1280369 - RNA, 16 nt, Human
cacagcuuagauuuca

SEQ ID NO: 1280370 - RNA, 19 nt, Human
cacagcuuagauuucauag

SEQ ID NO: 1280371 - RNA, 21 nt, Human
cacaguucuuugggccagaca

SEQ ID NO: 1280372 - RNA, 21 nt, Human
cacauagugaugguuccccug

SEQ ID NO: 1280373 - RNA, 17 nt, Human
cacauagcccacuuaca

SEQ ID NO: 1280374 - RNA, 19 nt, Human
cacauacccucuucaugga

SEQ ID NO: 1280375 - RNA, 22 nt, Human
cacauacccucuucauggaugg

SEQ ID NO: 1280376 - RNA, 18 nt, Human
cacauacccugaccuggc

SEQ ID NO: 1280377 - RNA, 16 nt, Human
cacauacccugaccug

SEQ ID NO: 1280378 - RNA, 18 nt, Human
cacauacucauuuuucau

SEQ ID NO: 1280379 - RNA, 19 nt, Human
cacauacucauuuuucaug

SEQ ID NO: 1280380 - RNA, 21 nt, Human
cacauagcccacuuacauuua

SEQ ID NO: 1280381 - RNA, 20 nt, Human
cacauagcccacuuacauuu

SEQ ID NO: 1280382 - RNA, 14 nt, Human
uuuucaaaagaaag

SEQ ID NO: 1280383 - RNA, 14 nt, Human
uuuuauuuugccaa

SEQ ID NO: 1280384 - RNA, 19 nt, Human
uuuuaucugaaaucaauua

SEQ ID NO: 1280385 - RNA, 20 nt, Human
uuuuaucugaaaucaauuaa

SEQ ID NO: 1280386 - RNA, 21 nt, Human
uuuuaucugaaaucaauuaaa

SEQ ID NO: 1280387 - RNA, 23 nt, Human
uuuuaucugaauuuuuaaacaag

SEQ ID NO: 1280388 - RNA, 20 nt, Human
uuuuaucugaguuacagaaa

SEQ ID NO: 1280389 - RNA, 19 nt, Human
uuuuaugagaaagccuucu

SEQ ID NO: 1280390 - RNA, 9 nt, Human
uuuuauaua

SEQ ID NO: 1280391 - RNA, 18 nt, Human
uuuuauacuuucccuacc

SEQ ID NO: 1280392 - RNA, 13 nt, Human
uuuuauauuugaa

SEQ ID NO: 1280393 - RNA, 18 nt, Human
uuuuauauuugaaauauu

SEQ ID NO: 1280394 - RNA, 13 nt, Human
uuuuauacucuuu

SEQ ID NO: 1280395 - RNA, 18 nt, Human
uuuuauacucuuucugua

SEQ ID NO: 1280396 - RNA, 19 nt, Human
uuuuauacucuuucuguau

SEQ ID NO: 1280397 - RNA, 21 nt, Human
uuuuaaaguaacccuacaaaa

SEQ ID NO: 1280398 - RNA, 17 nt, Human
uuuuaaacuguacagug

SEQ ID NO: 1280399 - RNA, 20 nt, Human
uuuuaaacuguacagugucu

SEQ ID NO: 1280400 - RNA, 13 nt, Human
uuuuaaacugugu

SEQ ID NO: 1280401 - RNA, 20 nt, Human
uuuuaaacuguguacauaac

SEQ ID NO: 1280402 - RNA, 23 nt, Human
uuuuaaacuguguacauaacuga

SEQ ID NO: 1280403 - RNA, 23 nt, Human
uuuuaaagaaaaaaauugaaaug

SEQ ID NO: 1280404 - RNA, 19 nt, Human
uuuuacaaaaaagaaaaga

SEQ ID NO: 1280405 - RNA, 12 nt, Human
uuuuacaaagcc

SEQ ID NO: 1280406 - RNA, 17 nt, Human
uuuuaaaguuaguaucu

SEQ ID NO: 1280407 - RNA, 17 nt, Human
uuuuacaauaaaaucuu

SEQ ID NO: 1280408 - RNA, 17 nt, Human
uuuuacaaguaacaaaa

SEQ ID NO: 1280409 - RNA, 23 nt, Human
uuuuacaauguaauuauuuaugu

SEQ ID NO: 1280410 - RNA, 12 nt, Human
uuuuacaaaugu

SEQ ID NO: 1280411 - RNA, 22 nt, Human
uuuuacaaauguuaaaaugugu

SEQ ID NO: 1280412 - RNA, 14 nt, Human
uuuuacaaauguua

SEQ ID NO: 1280413 - RNA, 12 nt, Human
uuuuacaaguaa

SEQ ID NO: 1280414 - RNA, 18 nt, Human
uuuuacaaguaacaaaaa

SEQ ID NO: 1280415 - RNA, 19 nt, Human
uuuuacguccaucucuugu

SEQ ID NO: 1280416 - RNA, 14 nt, Human
uuuuaccuuucaua

SEQ ID NO: 1280417 - RNA, 22 nt, Human
uuuuacccuggccccucucccu

SEQ ID NO: 1280418 - RNA, 16 nt, Human
uuuuacaauguaauua

SEQ ID NO: 1280419 - RNA, 23 nt, Human
uuuuauaauuuugugaagcaaaa

SEQ ID NO: 1280420 - RNA, 21 nt, Human
uuuuauaauuuugugaagcaa

SEQ ID NO: 1280421 - RNA, 21 nt, Human
uuuucaaaauuguuacaaauu

SEQ ID NO: 1280422 - RNA, 22 nt, Human
uuuucaaaaccagguccaauga

SEQ ID NO: 1280423 - RNA, 14 nt, Human
uuuucaaaauggag

SEQ ID NO: 1280424 - RNA, 16 nt, Human
uuuucaaacaaagaug

SEQ ID NO: 1280425 - RNA, 20 nt, Human
uuuucaaacaaagaugccac

SEQ ID NO: 1280426 - RNA, 18 nt, Human
uuuucaacagugaagaca

SEQ ID NO: 1280427 - RNA, 22 nt, Human
uuuucaacagugaagacagaag

SEQ ID NO: 1280428 - RNA, 16 nt, Human
uuuucacauuggaaac

SEQ ID NO: 1280429 - RNA, 18 nt, Human
uuuucacauuagaagaca

SEQ ID NO: 1280430 - RNA, 12 nt, Human
uuuucacauuuu

SEQ ID NO: 1280431 - RNA, 19 nt, Human
uuuucaccagauuugcuaa

SEQ ID NO: 1280432 - RNA, 23 nt, Human
uuuucaccuggaagcauuuguuu

SEQ ID NO: 1280433 - RNA, 20 nt, Human
uuuucccauuuaucuaaaua

SEQ ID NO: 1280434 - RNA, 22 nt, Human
uuuucccauuuaucuaaauaug

SEQ ID NO: 1280435 - RNA, 14 nt, Human
uuuuccccagacuu

SEQ ID NO: 1280436 - RNA, 16 nt, Human
uuuucccccuuugugc

SEQ ID NO: 1280437 - RNA, 20 nt, Human
uuuugaaauuaugugacauu

SEQ ID NO: 1280438 - RNA, 17 nt, Human
uuuugaaauuaaccucu

SEQ ID NO: 1280439 - RNA, 13 nt, Human
uuuucuuuauaag

SEQ ID NO: 1280440 - RNA, 19 nt, Human
uuuucuuuauaagaaagcc

SEQ ID NO: 1280441 - RNA, 20 nt, Human
uuuucuugucuauaaagcau

SEQ ID NO: 1280442 - RNA, 14 nt, Human
uuuucuuuaacugc

SEQ ID NO: 1280443 - RNA, 18 nt, Human
uuuucuuuaacugccgua

SEQ ID NO: 1280444 - RNA, 20 nt, Human
uuuucuuuacaaaacaaacu

SEQ ID NO: 1280445 - RNA, 13 nt, Human
uuuucuugucuau

SEQ ID NO: 1280446 - RNA, 13 nt, Human
uuuuccuaaguga

SEQ ID NO: 1280447 - RNA, 20 nt, Human
uuuuccuaagugauuguaug

SEQ ID NO: 1280448 - RNA, 20 nt, Human
uuuuccuaauaaaguucugu

SEQ ID NO: 1280449 - RNA, 22 nt, Human
uuuucccucuuuggcuccccug

SEQ ID NO: 1280450 - RNA, 15 nt, Human
uuuucccuguacagu

SEQ ID NO: 1280451 - RNA, 14 nt, Human
uuuucccuuugccu

SEQ ID NO: 1280452 - RNA, 17 nt, Human
uuuuccuagcccucuca

SEQ ID NO: 1280453 - RNA, 18 nt, Human
uuugcauaacguauaaaa

SEQ ID NO: 1280454 - RNA, 17 nt, Human
uuugcaguaacuguuuu

SEQ ID NO: 1280455 - RNA, 16 nt, Human
uuugcauaacaauucc

SEQ ID NO: 1280456 - RNA, 17 nt, Human
uuugcauaacaauuccu

SEQ ID NO: 1280457 - RNA, 18 nt, Human
uuugcauaacaauuccuc

SEQ ID NO: 1280458 - RNA, 22 nt, Human
uuugcaggguccucuucugggc

SEQ ID NO: 1280459 - RNA, 22 nt, Human
uuugcagguggccaaguuccuc

SEQ ID NO: 1280460 - RNA, 9 nt, Human
uuugcagua

SEQ ID NO: 1280461 - RNA, 10 nt, Human
uuugcaguaa

SEQ ID NO: 1280462 - RNA, 12 nt, Human
uuugcaguaacu

SEQ ID NO: 1280463 - RNA, 14 nt, Human
uuugcaguaacugu

SEQ ID NO: 1280464 - RNA, 20 nt, Human
uuugcauaacaauuccucua

SEQ ID NO: 1280465 - RNA, 22 nt, Human
uuugcauaacaauuccucuacu

SEQ ID NO: 1280466 - RNA, 18 nt, Human
uuugcauuaaauucacaa

SEQ ID NO: 1280467 - RNA, 21 nt, Human
uuugcauuaaauucacaaacu

SEQ ID NO: 1280468 - RNA, 22 nt, Human
uuugcauuaaauucacaaacuu

SEQ ID NO: 1280469 - RNA, 17 nt, Human
uuugcaguucuuuggcu

SEQ ID NO: 1280470 - RNA, 19 nt, Human
uuugcauugaacacaaacu

SEQ ID NO: 1280471 - RNA, 16 nt, Human
uuugcauuuaaaacag

SEQ ID NO: 1280472 - RNA, 17 nt, Human
uuugcauuuaaaacaga

SEQ ID NO: 1280473 - RNA, 19 nt, Human
uuugcauuuaaaacagaca

SEQ ID NO: 1280474 - RNA, 21 nt, Human
uuugcauuuaaaacagacacu

SEQ ID NO: 1280475 - RNA, 13 nt, Human
uuuggacaguuua

SEQ ID NO: 1280476 - RNA, 16 nt, Human
uuuggacaguuuacca

SEQ ID NO: 1280477 - RNA, 23 nt, Human
uuugcauuuaaaacagacacugg

SEQ ID NO: 1280478 - RNA, 16 nt, Human
uuuggaaagacuggac

SEQ ID NO: 1280479 - RNA, 13 nt, Human
uuuggaaaguaca

SEQ ID NO: 1280480 - RNA, 15 nt, Human
uuuggaaaguacacu

SEQ ID NO: 1280481 - RNA, 20 nt, Human
uuuggaaaguacacucugcu

SEQ ID NO: 1280482 - RNA, 21 nt, Human
uuuggaaaguacacucugcug

SEQ ID NO: 1280483 - RNA, 22 nt, Human
uuuggaaaguacacucugcugu

SEQ ID NO: 1280484 - RNA, 15 nt, Human
uuuccacagaagcuc

SEQ ID NO: 1280485 - RNA, 19 nt, Human
uuuccaccacagccagcac

SEQ ID NO: 1280486 - RNA, 17 nt, Human
uuucccuuguagcuccu

SEQ ID NO: 1280487 - RNA, 18 nt, Human
uuucccuuguagcuccuc

SEQ ID NO: 1280488 - RNA, 20 nt, Human
uuuccuaaauauauuuuaag

SEQ ID NO: 1280489 - RNA, 20 nt, Human
uuucccuuguagcuccuccc

SEQ ID NO: 1280490 - RNA, 15 nt, Human
uuucccuuugccuuc

SEQ ID NO: 1280491 - RNA, 22 nt, Human
uuuccguaaaaaugauuucagu

SEQ ID NO: 1280492 - RNA, 13 nt, Human
uuugagugcucug

SEQ ID NO: 1280493 - RNA, 14 nt, Human
uuugagugcucuga

SEQ ID NO: 1280494 - RNA, 16 nt, Human
uuugcaccuuucuagu

SEQ ID NO: 1280495 - RNA, 17 nt, Human
uuugcaccuuucuaguu

SEQ ID NO: 1280496 - RNA, 20 nt, Human
uuugcaccuuucuaguugaa

SEQ ID NO: 1280497 - RNA, 21 nt, Human
uuugcaccuuucuaguugaaa

SEQ ID NO: 1280498 - RNA, 18 nt, Human
uuugcacugauauaucau

SEQ ID NO: 1280499 - RNA, 23 nt, Human
uuuuaaaauccacuuuaucuuga

SEQ ID NO: 1280500 - RNA, 13 nt, Human
uuuuaaacacauu

SEQ ID NO: 1280501 - RNA, 13 nt, Human
uuuuaaacaguga

SEQ ID NO: 1280502 - RNA, 20 nt, Human
uuuuaaacccuauugguaaa

SEQ ID NO: 1280503 - RNA, 19 nt, Human
uuuuaaacagugagccuga

SEQ ID NO: 1280504 - RNA, 18 nt, Human
uuuuaaacacauuaggaa

SEQ ID NO: 1280505 - RNA, 21 nt, Human
uuuuaaacaucaaucuuuaaa

SEQ ID NO: 1280506 - RNA, 23 nt, Human
uuuuaaacauuaauagcagccuu

SEQ ID NO: 1280507 - RNA, 13 nt, Human
uuuuaaacuguac

SEQ ID NO: 1280508 - RNA, 14 nt, Human
uuuuaaacuguaca

SEQ ID NO: 1280509 - RNA, 15 nt, Human
uuuuaaacuguacag

SEQ ID NO: 1280510 - RNA, 16 nt, Human
uuuuaaacuguacagu

SEQ ID NO: 1280511 - RNA, 14 nt, Human
uuuuaaaauccacu

SEQ ID NO: 1280512 - RNA, 21 nt, Human
uuuuaaaauagcguucuugua

SEQ ID NO: 1280513 - RNA, 14 nt, Human
uuuuaaaaucagcu

SEQ ID NO: 1280514 - RNA, 22 nt, Human
uuuuaaaaucagcuauuuugug

SEQ ID NO: 1280515 - RNA, 20 nt, Human
uuuguugguuuuuaaagauu

SEQ ID NO: 1280516 - RNA, 13 nt, Human
uuuguugguuggu

SEQ ID NO: 1280517 - RNA, 18 nt, Human
uuuguuauauaauuuaga

SEQ ID NO: 1280518 - RNA, 17 nt, Human
uuuguguguugucucuu

SEQ ID NO: 1280519 - RNA, 23 nt, Human
uuuguuaauuuagaaaacuuuaa

SEQ ID NO: 1280520 - RNA, 22 nt, Human
uuuguuaauuuagaaaacuuua

SEQ ID NO: 1280521 - RNA, 22 nt, Human
uuuguugcguuccuuucuuuuc

SEQ ID NO: 1280522 - RNA, 14 nt, Human
uuuguugcuguuuu

SEQ ID NO: 1280523 - RNA, 15 nt, Human
uuuguuauuuugcaa

SEQ ID NO: 1280524 - RNA, 18 nt, Human
uuuguugacauucugaau

SEQ ID NO: 1280525 - RNA, 19 nt, Human
uuuguugacauucugaaug

SEQ ID NO: 1280526 - RNA, 20 nt, Human
uuuguugacauucugaaugc

SEQ ID NO: 1280527 - RNA, 14 nt, Human
uuuguauuguauau

SEQ ID NO: 1280528 - RNA, 22 nt, Human
uuuggucgaggaguaacaauac

SEQ ID NO: 1280529 - RNA, 14 nt, Human
uuuguauucucuga

SEQ ID NO: 1280530 - RNA, 16 nt, Human
uuuguauucucugagc

SEQ ID NO: 1280531 - RNA, 17 nt, Human
uuugguccgucauaacc

SEQ ID NO: 1280532 - RNA, 16 nt, Human
uuuggucgaggaguaa

SEQ ID NO: 1280533 - RNA, 18 nt, Human
uuuggucgaggaguaaca

SEQ ID NO: 1280534 - RNA, 19 nt, Human
uuuggucgaggaguaacaa

SEQ ID NO: 1280535 - RNA, 21 nt, Human
uuuguauuguuucaauugcau

SEQ ID NO: 1280536 - RNA, 17 nt, Human
uuuguauuuuguuuaaa

SEQ ID NO: 1280537 - RNA, 14 nt, Human
uuuguauuuuuagu

SEQ ID NO: 1280538 - RNA, 21 nt, Human
uuugugucauguuuaagaaau

SEQ ID NO: 1280539 - RNA, 20 nt, Human
uuugugucucuuauggaugu

SEQ ID NO: 1280540 - RNA, 16 nt, Human
uuugugugcucuccau

SEQ ID NO: 1280541 - RNA, 14 nt, Human
uuuguguguagucu

SEQ ID NO: 1280542 - RNA, 14 nt, Human
uuugugugcucucc

SEQ ID NO: 1280543 - RNA, 16 nt, Human
uuuguguguauuugcu

SEQ ID NO: 1280544 - RNA, 13 nt, Human
uuugugugucuua

SEQ ID NO: 1280545 - RNA, 15 nt, Human
uuuggucaacacuaa

SEQ ID NO: 1280546 - RNA, 21 nt, Human
uuugguccuucaaaggcuugu

SEQ ID NO: 1280547 - RNA, 18 nt, Human
uuuguauaaaauaauuuu

SEQ ID NO: 1280548 - RNA, 19 nt, Human
uuuguauaaaauaauuuuu

SEQ ID NO: 1280549 - RNA, 17 nt, Human
uuuguauaaaauaauuu

SEQ ID NO: 1280550 - RNA, 20 nt, Human
uuuuucauuaaauaaauuug

SEQ ID NO: 1280551 - RNA, 22 nt, Human
uuuuucauuaaauaaauuugac

SEQ ID NO: 1280552 - RNA, 11 nt, Human
uuuuuccaaca

SEQ ID NO: 1280553 - RNA, 21 nt, Human
uuuuuccaacuacuaauagaa

SEQ ID NO: 1280554 - RNA, 23 nt, Human
uuuuuccaacuacuaauagaaua

SEQ ID NO: 1280555 - RNA, 17 nt, Human
uuuuucaguauuauaug

SEQ ID NO: 1280556 - RNA, 18 nt, Human
uuuuucaguauuauaugu

SEQ ID NO: 1280557 - RNA, 11 nt, Human
uuuuucaguug

SEQ ID NO: 1280558 - RNA, 20 nt, Human
uuuuucaguuguucuuuuua

SEQ ID NO: 1280559 - RNA, 16 nt, Human
uuuuucaguuguucuu

SEQ ID NO: 1280560 - RNA, 15 nt, Human
uuuuucaucuucagu

SEQ ID NO: 1280561 - RNA, 16 nt, Human
uuuuucaucuucaguu

SEQ ID NO: 1280562 - RNA, 20 nt, Human
uuuuucaucuucaguugucu

SEQ ID NO: 1280563 - RNA, 23 nt, Human
uuuuucaucuucaguugucucug

SEQ ID NO: 1280564 - RNA, 11 nt, Human
uuuuucaugau

SEQ ID NO: 1280565 - RNA, 18 nt, Human
uuuuucaugauuuugaaa

SEQ ID NO: 1280566 - RNA, 16 nt, Human
uuuuucaugauaauga

SEQ ID NO: 1280567 - RNA, 13 nt, Human
uuuuuaaucuuua

SEQ ID NO: 1280568 - RNA, 16 nt, Human
uuuuuaauaaauuuca

SEQ ID NO: 1280569 - RNA, 14 nt, Human
uuuuuaauaauuua

SEQ ID NO: 1280570 - RNA, 14 nt, Human
uuuuuaauaugcuu

SEQ ID NO: 1280571 - RNA, 19 nt, Human
uuuuuaauccgccaauauu

SEQ ID NO: 1280572 - RNA, 18 nt, Human
uuuuuaauguauaguaaa

SEQ ID NO: 1280573 - RNA, 13 nt, Human
uuuuucacauuuu

SEQ ID NO: 1280574 - RNA, 23 nt, Human
uuuuuaaauguauacuauaguac

SEQ ID NO: 1280575 - RNA, 15 nt, Human
uuuuuaaauguauac

SEQ ID NO: 1280576 - RNA, 11 nt, Human
uuuugagaaag

SEQ ID NO: 1280577 - RNA, 20 nt, Human
uuuuuaaauguaaagauauu

SEQ ID NO: 1280578 - RNA, 24 nt, Human
uuuugacaguguugaaaauguuca

SEQ ID NO: 1280579 - RNA, 15 nt, Human
uuuugacauaaaguu

SEQ ID NO: 1280580 - RNA, 13 nt, Human
uuuugacugcuug

SEQ ID NO: 1280581 - RNA, 13 nt, Human
uuuugaaggcaaa

SEQ ID NO: 1280582 - RNA, 14 nt, Human
uuuugaaggcaaaa

SEQ ID NO: 1280583 - RNA, 14 nt, Human
uuuugaaguauuua

SEQ ID NO: 1280584 - RNA, 19 nt, Human
uuuugacaguguugaaaau

SEQ ID NO: 1280585 - RNA, 23 nt, Human
uuuugacaguguugaaaauguuc

SEQ ID NO: 1280586 - RNA, 12 nt, Human
uuuuuuacauuu

SEQ ID NO: 1280587 - RNA, 11 nt, Human
uuuuuuacauu

SEQ ID NO: 1280588 - RNA, 15 nt, Human
uuuuuuaauaaauuu

SEQ ID NO: 1280589 - RNA, 19 nt, Human
uuuuuuaauccgccaauau

SEQ ID NO: 1280590 - RNA, 12 nt, Human
uuuuuuaauuga

SEQ ID NO: 1280591 - RNA, 12 nt, Human
uuuuuucaguug

SEQ ID NO: 1280592 - RNA, 11 nt, Human
uuuuuucaucu

SEQ ID NO: 1280593 - RNA, 13 nt, Human
uuuuuucaucuuc

SEQ ID NO: 1280594 - RNA, 12 nt, Human
uuuuuuccaaaa

SEQ ID NO: 1280595 - RNA, 14 nt, Human
uuuuuuccaaaauc

SEQ ID NO: 1280596 - RNA, 13 nt, Human
uuuuuccaucuuu

SEQ ID NO: 1280597 - RNA, 17 nt, Human
uuuuuccccagacuugu

SEQ ID NO: 1280598 - RNA, 21 nt, Human
uuuuuccccagacuuguuggc

SEQ ID NO: 1280599 - RNA, 18 nt, Human
uuuuucccuaucacugaa

SEQ ID NO: 1280600 - RNA, 14 nt, Human
uuuuuccguaaaaa

SEQ ID NO: 1280601 - RNA, 16 nt, Human
uuuuuccguaaaaaug

SEQ ID NO: 1280602 - RNA, 15 nt, Human
uuuuuccguaaaaau

SEQ ID NO: 1280603 - RNA, 12 nt, Human
uuuuuuaacauu

SEQ ID NO: 1280604 - RNA, 10 nt, Human
uuuuuuaaga

SEQ ID NO: 1280605 - RNA, 17 nt, Human
uuuuuuaagaauaucug

SEQ ID NO: 1280606 - RNA, 12 nt, Human
uuuuuuuacauu

SEQ ID NO: 1280607 - RNA, 12 nt, Human
uuuuuuucaguu

SEQ ID NO: 1280608 - RNA, 10 nt, Human
uuuuuuuccu

SEQ ID NO: 1280609 - RNA, 12 nt, Human
uuuuuuucuuua

SEQ ID NO: 1280610 - RNA, 14 nt, Human
uuuuuuuguuauua

SEQ ID NO: 1280611 - RNA, 12 nt, Human
uuuuuuugugug

SEQ ID NO: 1280612 - RNA, 11 nt, Human
uuuuuuugcag

SEQ ID NO: 1280613 - RNA, 10 nt, Human
uuuuuuugca

SEQ ID NO: 1280614 - RNA, 15 nt, Human
uuuuuuccugucaua

SEQ ID NO: 1280615 - RNA, 12 nt, Human
uuuuuuccccag

SEQ ID NO: 1280616 - RNA, 13 nt, Human
uuuuuuccacuua

SEQ ID NO: 1280617 - RNA, 13 nt, Human
uuuuuuccaucuu

SEQ ID NO: 1280618 - RNA, 22 nt, Human
uuuuuuccaucuuuacaaaacu

SEQ ID NO: 1280619 - RNA, 10 nt, Human
uuuuuuccuu

SEQ ID NO: 1280620 - RNA, 16 nt, Human
uuuuuuguuuguuugu

SEQ ID NO: 1280621 - RNA, 13 nt, Human
uuuuuuuuccugu

SEQ ID NO: 1280622 - RNA, 14 nt, Human
uuuuuuuuaaacua

SEQ ID NO: 1280623 - RNA, 13 nt, Human
uuuuuuuguuugu

SEQ ID NO: 1280624 - RNA, 11 nt, Human
uuuuuuuugca

SEQ ID NO: 1280625 - RNA, 12 nt, Human
uuuuuuuugcag

SEQ ID NO: 1280626 - RNA, 14 nt, Human
uuuuuuuuguuugu

SEQ ID NO: 1280627 - RNA, 22 nt, Human
uuccugagucccaucccugcgu

SEQ ID NO: 1280628 - RNA, 20 nt, Human
uuccugaccuccgccaucca

SEQ ID NO: 1280629 - RNA, 19 nt, Human
uuccugcaacucaaggacu

SEQ ID NO: 1280630 - RNA, 20 nt, Human
uuccugcaacucaaggacuu

SEQ ID NO: 1280631 - RNA, 21 nt, Human
uuccugcaggcaggaacaaac

SEQ ID NO: 1280632 - RNA, 14 nt, Human
uuccaugcugugcg

SEQ ID NO: 1280633 - RNA, 23 nt, Human
uuccaugcugugcgcccagggcu

SEQ ID NO: 1280634 - RNA, 19 nt, Human
uuccauggcaggaaggcuu

SEQ ID NO: 1280635 - RNA, 17 nt, Human
uuccauggcaggaaggc

SEQ ID NO: 1280636 - RNA, 22 nt, Human
uuccaugggaccacaacuauuu

SEQ ID NO: 1280637 - RNA, 12 nt, Human
uuccaugggaau

SEQ ID NO: 1280638 - RNA, 21 nt, Human
uuccauggugugaucgucuga

SEQ ID NO: 1280639 - RNA, 16 nt, Human
uuccaugucgccucug

SEQ ID NO: 1280640 - RNA, 21 nt, Human
uuccaugucaagauucagcua

SEQ ID NO: 1280641 - RNA, 15 nt, Human
uuccaugucaagauu

SEQ ID NO: 1280642 - RNA, 17 nt, Human
uuccaugucaagauuca

SEQ ID NO: 1280643 - RNA, 13 nt, Human
uuccugaauccaa

SEQ ID NO: 1280644 - RNA, 18 nt, Human
uuccugaauccaaacuaa

SEQ ID NO: 1280645 - RNA, 13 nt, Human
uuccugacacuuu

SEQ ID NO: 1280646 - RNA, 22 nt, Human
uuccugacacuuuaauuaccaa

SEQ ID NO: 1280647 - RNA, 18 nt, Human
uucggugagcuacaaaug

SEQ ID NO: 1280648 - RNA, 18 nt, Human
uuccuuuaacaacauguu

SEQ ID NO: 1280649 - RNA, 19 nt, Human
uuccuuuaacaacauguuu

SEQ ID NO: 1280650 - RNA, 21 nt, Human
uuccuuuaacaacauguuucc

SEQ ID NO: 1280651 - RNA, 13 nt, Human
uucggggcuggga

SEQ ID NO: 1280652 - RNA, 17 nt, Human
uucggggcugggaaguc

SEQ ID NO: 1280653 - RNA, 16 nt, Human
uuccuugucacuggua

SEQ ID NO: 1280654 - RNA, 17 nt, Human
uuccuuuaacaacaugu

SEQ ID NO: 1280655 - RNA, 22 nt, Human
uuccuuuaacaacauguuucca

SEQ ID NO: 1280656 - RNA, 15 nt, Human
uuccugcuuuucccc

SEQ ID NO: 1280657 - RNA, 15 nt, Human
uuccuggacacucag

SEQ ID NO: 1280658 - RNA, 19 nt, Human
uuccuggacacucagaccu

SEQ ID NO: 1280659 - RNA, 13 nt, Human
uuccugcuugcca

SEQ ID NO: 1280660 - RNA, 15 nt, Human
uuccugcauuuguga

SEQ ID NO: 1280661 - RNA, 21 nt, Human
uuccugccuuggccucccaag

SEQ ID NO: 1280662 - RNA, 11 nt, Human
uuccugcugcu

SEQ ID NO: 1280663 - RNA, 12 nt, Human
uuccugcugcug

SEQ ID NO: 1280664 - RNA, 13 nt, Human
uuccugcugcugu

SEQ ID NO: 1280665 - RNA, 14 nt, Human
uuccugcugcuguc

SEQ ID NO: 1280666 - RNA, 15 nt, Human
uuccugcugcugucu

SEQ ID NO: 1280667 - RNA, 17 nt, Human
uuccugcugcugucugg

SEQ ID NO: 1280668 - RNA, 18 nt, Human
uuccugcugcugucuggg

SEQ ID NO: 1280669 - RNA, 20 nt, Human
uuccugcugcugucugggug

SEQ ID NO: 1280670 - RNA, 21 nt, Human
uuccugcugcugucugggugc

SEQ ID NO: 1280671 - RNA, 14 nt, Human
uucuauagcuuuuc

SEQ ID NO: 1280672 - RNA, 14 nt, Human
uucuauagccaaaa

SEQ ID NO: 1280673 - RNA, 15 nt, Human
uucuauagccaaaaa

SEQ ID NO: 1280674 - RNA, 17 nt, Human
uucuauagccaaaaaua

SEQ ID NO: 1280675 - RNA, 21 nt, Human
uucuauagccaaaaauagcua

SEQ ID NO: 1280676 - RNA, 23 nt, Human
uucuauagccaaaaauagcuaaa

SEQ ID NO: 1280677 - RNA, 16 nt, Human
uucuauaguuauuaag

SEQ ID NO: 1280678 - RNA, 14 nt, Human
uucuauaguucuag

SEQ ID NO: 1280679 - RNA, 15 nt, Human
uucuauaguucuaga

SEQ ID NO: 1280680 - RNA, 17 nt, Human
uucuauaguucuagaca

SEQ ID NO: 1280681 - RNA, 16 nt, Human
uucuauaguucuagac

SEQ ID NO: 1280682 - RNA, 13 nt, Human
uucuacugcucuc

SEQ ID NO: 1280683 - RNA, 19 nt, Human
uucuacuuugauaugacug

SEQ ID NO: 1280684 - RNA, 20 nt, Human
uucuacugcucuccuccacc

SEQ ID NO: 1280685 - RNA, 13 nt, Human
uucuacuauuuau

SEQ ID NO: 1280686 - RNA, 19 nt, Human
uucuacucacuuuucccac

SEQ ID NO: 1280687 - RNA, 20 nt, Human
uucuacucacuuuucccacu

SEQ ID NO: 1280688 - RNA, 21 nt, Human
uucuacucacuuuucccacuc

SEQ ID NO: 1280689 - RNA, 15 nt, Human
uucuaccauuucaga

SEQ ID NO: 1280690 - RNA, 18 nt, Human
uucuaccauuucagagag

SEQ ID NO: 1280691 - RNA, 13 nt, Human
uucguuaucuaau

SEQ ID NO: 1280692 - RNA, 23 nt, Human
uucuaaugugugaaucagagcac

SEQ ID NO: 1280693 - RNA, 13 nt, Human
uucguggggaggu

SEQ ID NO: 1280694 - RNA, 16 nt, Human
uucuaauuauguagcu

SEQ ID NO: 1280695 - RNA, 23 nt, Human
uucuaauuauguagcucuuuguc

SEQ ID NO: 1280696 - RNA, 14 nt, Human
uucuaauugccaug

SEQ ID NO: 1280697 - RNA, 15 nt, Human
uucuaauugccaugu

SEQ ID NO: 1280698 - RNA, 13 nt, Human
uucuaauugcuua

SEQ ID NO: 1280699 - RNA, 14 nt, Human
uucuaauugcuuau

SEQ ID NO: 1280700 - RNA, 17 nt, Human
uucuaauuggcaugaag

SEQ ID NO: 1280701 - RNA, 16 nt, Human
uucuaauugcuuauuu

SEQ ID NO: 1280702 - RNA, 13 nt, Human
uucggugugcacc

SEQ ID NO: 1280703 - RNA, 13 nt, Human
uucguaacacagc

SEQ ID NO: 1280704 - RNA, 15 nt, Human
uucguagauauugga

SEQ ID NO: 1280705 - RNA, 19 nt, Human
uucgucuguuuauaaacau

SEQ ID NO: 1280706 - RNA, 12 nt, Human
uucgucuguugu

SEQ ID NO: 1280707 - RNA, 19 nt, Human
uucuaccaaggucuucuua

SEQ ID NO: 1280708 - RNA, 14 nt, Human
uucuaccauuucag

SEQ ID NO: 1280709 - RNA, 15 nt, Human
uucuacauagaugcu

SEQ ID NO: 1280710 - RNA, 18 nt, Human
uucuacaaaauccugaug

SEQ ID NO: 1280711 - RNA, 21 nt, Human
uucuacaacucauacacucgu

SEQ ID NO: 1280712 - RNA, 15 nt, Human
uucuaauuuuuaaga

SEQ ID NO: 1280713 - RNA, 16 nt, Human
uucugauaaugaaaau

SEQ ID NO: 1280714 - RNA, 19 nt, Human
uucugauaaaagauggcca

SEQ ID NO: 1280715 - RNA, 15 nt, Human
uucugaguuuuacca

SEQ ID NO: 1280716 - RNA, 16 nt, Human
uucugaguuuuaccaa

SEQ ID NO: 1280717 - RNA, 14 nt, Human
uucugaguuuugug

SEQ ID NO: 1280718 - RNA, 15 nt, Human
uucugaguuuugugu

SEQ ID NO: 1280719 - RNA, 16 nt, Human
uucugaguuuuguguu

SEQ ID NO: 1280720 - RNA, 19 nt, Human
uucugaguuuuguguuugu

SEQ ID NO: 1280721 - RNA, 21 nt, Human
uucugaguuuuguguuuguug

SEQ ID NO: 1280722 - RNA, 22 nt, Human
uucugaguuuuguguuuguugu

SEQ ID NO: 1280723 - RNA, 23 nt, Human
uucugaguuuuguguuuguugua

SEQ ID NO: 1280724 - RNA, 18 nt, Human
uucugauaaaagauggcc

SEQ ID NO: 1280725 - RNA, 17 nt, Human
uucugagacgucaugag

SEQ ID NO: 1280726 - RNA, 19 nt, Human
uucugagacgucaugagga

SEQ ID NO: 1280727 - RNA, 22 nt, Human
uucugagacgucaugaggagau

SEQ ID NO: 1280728 - RNA, 16 nt, Human
uucugagaucuguuga

SEQ ID NO: 1280729 - RNA, 19 nt, Human
uucugagauggcucccagg

SEQ ID NO: 1280730 - RNA, 23 nt, Human
uucugagauggcucccaggggcu

SEQ ID NO: 1280731 - RNA, 16 nt, Human
uucugaggcuuuauga

SEQ ID NO: 1280732 - RNA, 17 nt, Human
uucugaggugcacuggg

SEQ ID NO: 1280733 - RNA, 13 nt, Human
uucugaguacaga

SEQ ID NO: 1280734 - RNA, 12 nt, Human
uucugaguuccu

SEQ ID NO: 1280735 - RNA, 15 nt, Human
uucugaguuccugca

SEQ ID NO: 1280736 - RNA, 14 nt, Human
uucugaucaaggcc

SEQ ID NO: 1280737 - RNA, 15 nt, Human
uucugaucaaggccu

SEQ ID NO: 1280738 - RNA, 22 nt, Human
uucugaucaaggccuuauugga

SEQ ID NO: 1280739 - RNA, 16 nt, Human
uucugauguacucuaa

SEQ ID NO: 1280740 - RNA, 21 nt, Human
uucugauucgaaugacacugu

SEQ ID NO: 1280741 - RNA, 17 nt, Human
uucugauuuuaggagcu

SEQ ID NO: 1280742 - RNA, 23 nt, Human
uucugauuuuaggagcuaaggcu

SEQ ID NO: 1280743 - RNA, 24 nt, Human
uucugauuuuaggagcuaaggcuc

SEQ ID NO: 1280744 - RNA, 14 nt, Human
uucugccuucucau

SEQ ID NO: 1280745 - RNA, 16 nt, Human
uucugccuucucauga

SEQ ID NO: 1280746 - RNA, 13 nt, Human
uucugccuuugcc

SEQ ID NO: 1280747 - RNA, 14 nt, Human
uucugccuuugcca

SEQ ID NO: 1280748 - RNA, 15 nt, Human
uucugccuuugccag

SEQ ID NO: 1280749 - RNA, 21 nt, Human
uucugccuuugccaggugacu

SEQ ID NO: 1280750 - RNA, 22 nt, Human
uucugccuuuggggacuuuucu

SEQ ID NO: 1280751 - RNA, 21 nt, Human
uucugcuacuuugcugcuaug

SEQ ID NO: 1280752 - RNA, 14 nt, Human
uucugcucagcucu

SEQ ID NO: 1280753 - RNA, 15 nt, Human
uucugcucagcucug

SEQ ID NO: 1280754 - RNA, 20 nt, Human
uucugcucagcucugggcca

SEQ ID NO: 1280755 - RNA, 13 nt, Human
uucugcucaucau

SEQ ID NO: 1280756 - RNA, 14 nt, Human
uucugcucaucauu

SEQ ID NO: 1280757 - RNA, 19 nt, Human
uucugcucaucauucucug

SEQ ID NO: 1280758 - RNA, 20 nt, Human
uucugcucaucauucucugu

SEQ ID NO: 1280759 - RNA, 21 nt, Human
uucugcucaucauucucuguc

SEQ ID NO: 1280760 - RNA, 15 nt, Human
uucugcuccagacag

SEQ ID NO: 1280761 - RNA, 16 nt, Human
uucugcuccagacagg

SEQ ID NO: 1280762 - RNA, 19 nt, Human
uucuccagccucagccucc

SEQ ID NO: 1280763 - RNA, 12 nt, Human
uucuccagcugg

SEQ ID NO: 1280764 - RNA, 14 nt, Human
uucuccagcugggc

SEQ ID NO: 1280765 - RNA, 15 nt, Human
uucuccagcugggcu

SEQ ID NO: 1280766 - RNA, 20 nt, Human
uucuccagcugggcucugca

SEQ ID NO: 1280767 - RNA, 16 nt, Human
uucucugagcugugca

SEQ ID NO: 1280768 - RNA, 17 nt, Human
uucucugagcugugcag

SEQ ID NO: 1280769 - RNA, 18 nt, Human
uucucugagcugugcagg

SEQ ID NO: 1280770 - RNA, 13 nt, Human
uucucugaggaca

SEQ ID NO: 1280771 - RNA, 16 nt, Human
uucucugaggacaaga

SEQ ID NO: 1280772 - RNA, 20 nt, Human
uucucugaggacaagagaaa

SEQ ID NO: 1280773 - RNA, 14 nt, Human
uucuaugaaauauu

SEQ ID NO: 1280774 - RNA, 14 nt, Human
uucuauccucugua

SEQ ID NO: 1280775 - RNA, 15 nt, Human
uucuauccucuguaa

SEQ ID NO: 1280776 - RNA, 21 nt, Human
uucuaugaaauauuauguuaa

SEQ ID NO: 1280777 - RNA, 20 nt, Human
uucucauguugaagccacug

SEQ ID NO: 1280778 - RNA, 20 nt, Human
uucucauuugccaauaauaa

SEQ ID NO: 1280779 - RNA, 21 nt, Human
uucucauuggaaauuuagcau

SEQ ID NO: 1280780 - RNA, 15 nt, Human
uucucauuaaaagaa

SEQ ID NO: 1280781 - RNA, 13 nt, Human
uucucauugcucu

SEQ ID NO: 1280782 - RNA, 18 nt, Human
uucucauuggaaauuuag

SEQ ID NO: 1280783 - RNA, 17 nt, Human
uucucauuuuuuaaaaa

SEQ ID NO: 1280784 - RNA, 23 nt, Human
uucucauuuuuuaaaaaagcuua

SEQ ID NO: 1280785 - RNA, 21 nt, Human
uucuccaccuagacuguaaac

SEQ ID NO: 1280786 - RNA, 12 nt, Human
uucuccacugga

SEQ ID NO: 1280787 - RNA, 22 nt, Human
uucucauuuuuuaaaaaagcuu

SEQ ID NO: 1280788 - RNA, 15 nt, Human
uugaaaagcagacau

SEQ ID NO: 1280789 - RNA, 13 nt, Human
uugaaaagagcug

SEQ ID NO: 1280790 - RNA, 17 nt, Human
uugaaaagcagacauuu

SEQ ID NO: 1280791 - RNA, 21 nt, Human
uugaaaauaagaauagaaaua

SEQ ID NO: 1280792 - RNA, 15 nt, Human
uugaaaaaugcaugu

SEQ ID NO: 1280793 - RNA, 22 nt, Human
uugaaaaaauagagccugaggg

SEQ ID NO: 1280794 - RNA, 13 nt, Human
uucuuucauuucu

SEQ ID NO: 1280795 - RNA, 14 nt, Human
uugaaaaagacauu

SEQ ID NO: 1280796 - RNA, 16 nt, Human
uugaaaaagacauuca

SEQ ID NO: 1280797 - RNA, 13 nt, Human
uugaaaaagcgaa

SEQ ID NO: 1280798 - RNA, 15 nt, Human
uugaaaaaguuuguu

SEQ ID NO: 1280799 - RNA, 18 nt, Human
uucuuuccacagaagcuc

SEQ ID NO: 1280800 - RNA, 14 nt, Human
uucuuucauuucuu

SEQ ID NO: 1280801 - RNA, 13 nt, Human
uugaaaaaaaaua

SEQ ID NO: 1280802 - RNA, 20 nt, Human
uugaaaaaauagagccugag

SEQ ID NO: 1280803 - RNA, 15 nt, Human
uucuuuaaaauuaca

SEQ ID NO: 1280804 - RNA, 20 nt, Human
uucuuuaaaauguaaagcca

SEQ ID NO: 1280805 - RNA, 23 nt, Human
uucuuuaaaaaacaacuauggau

SEQ ID NO: 1280806 - RNA, 14 nt, Human
uucuuccucagcca

SEQ ID NO: 1280807 - RNA, 16 nt, Human
uucuuccucagccagc

SEQ ID NO: 1280808 - RNA, 20 nt, Human
uucuuccucagccagccucg

SEQ ID NO: 1280809 - RNA, 17 nt, Human
uucuuccucagccagcc

SEQ ID NO: 1280810 - RNA, 14 nt, Human
uucuuguuggugca

SEQ ID NO: 1280811 - RNA, 17 nt, Human
uucuuguuggugcacag

SEQ ID NO: 1280812 - RNA, 13 nt, Human
uucuuccaucuga

SEQ ID NO: 1280813 - RNA, 14 nt, Human
uucuuccaucugau

SEQ ID NO: 1280814 - RNA, 15 nt, Human
uucuuccggccccuc

SEQ ID NO: 1280815 - RNA, 18 nt, Human
uucuuccuaccaagucaa

SEQ ID NO: 1280816 - RNA, 12 nt, Human
uucuuccucagc

SEQ ID NO: 1280817 - RNA, 13 nt, Human
uucuuccucagcc

SEQ ID NO: 1280818 - RNA, 20 nt, Human
uucugcuggccucugcgagu

SEQ ID NO: 1280819 - RNA, 16 nt, Human
uucugcuccuucccca

SEQ ID NO: 1280820 - RNA, 17 nt, Human
uucugcucugguuguuu

SEQ ID NO: 1280821 - RNA, 21 nt, Human
uucugcucugguuguuucugu

SEQ ID NO: 1280822 - RNA, 22 nt, Human
uucugcucugguuguuucuguu

SEQ ID NO: 1280823 - RNA, 23 nt, Human
uucugcucugguuguuucuguuc

SEQ ID NO: 1280824 - RNA, 15 nt, Human
uucugcuggccucug

SEQ ID NO: 1280825 - RNA, 18 nt, Human
uucugcuggccucugcga

SEQ ID NO: 1280826 - RNA, 20 nt, Human
uucugcuggggccugggaca

SEQ ID NO: 1280827 - RNA, 21 nt, Human
uucugcuggggccugggacaa

SEQ ID NO: 1280828 - RNA, 18 nt, Human
uucugcuuuccucuuccu

SEQ ID NO: 1280829 - RNA, 14 nt, Human
uucugcuuugcucu

SEQ ID NO: 1280830 - RNA, 15 nt, Human
uucugcuuuaaaaau

SEQ ID NO: 1280831 - RNA, 17 nt, Human
uucuggaauacaugaaa

SEQ ID NO: 1280832 - RNA, 19 nt, Human
uucuggaauacaugaaaua

SEQ ID NO: 1280833 - RNA, 15 nt, Human
uucuggaauguaauc

SEQ ID NO: 1280834 - RNA, 16 nt, Human
uucuggaauguaauca

SEQ ID NO: 1280835 - RNA, 20 nt, Human
uucuggaauguaaucaaugu

SEQ ID NO: 1280836 - RNA, 22 nt, Human
uucuggaauguaaucaauguuu

SEQ ID NO: 1280837 - RNA, 19 nt, Human
uucuggacccguucaacuu

SEQ ID NO: 1280838 - RNA, 15 nt, Human
uucuggaccucuggg

SEQ ID NO: 1280839 - RNA, 18 nt, Human
uucuggaccucuggguug

SEQ ID NO: 1280840 - RNA, 16 nt, Human
uucuggaccucugggu

SEQ ID NO: 1280841 - RNA, 17 nt, Human
uucuggaccucuggguu

SEQ ID NO: 1280842 - RNA, 15 nt, Human
uucuggcagaggagg

SEQ ID NO: 1280843 - RNA, 21 nt, Human
uucuggauuccccaucucagg

SEQ ID NO: 1280844 - RNA, 23 nt, Human
uucuggauggauuuuauaggaaa

SEQ ID NO: 1280845 - RNA, 21 nt, Human
uucugucccuagguguuuugu

SEQ ID NO: 1280846 - RNA, 13 nt, Human
uucugucccuagg

SEQ ID NO: 1280847 - RNA, 17 nt, Human
uucugucuucuacagau

SEQ ID NO: 1280848 - RNA, 18 nt, Human
uucugugguuucauguua

SEQ ID NO: 1280849 - RNA, 22 nt, Human
uucugugguuucauguuaguua

SEQ ID NO: 1280850 - RNA, 12 nt, Human
uucugugucuuu

SEQ ID NO: 1280851 - RNA, 22 nt, Human
uucugugucuuucacagcuccu

SEQ ID NO: 1280852 - RNA, 23 nt, Human
uucugugucuuucacagcuccuc

SEQ ID NO: 1280853 - RNA, 18 nt, Human
uugaauuuugaugaacaa

SEQ ID NO: 1280854 - RNA, 12 nt, Human
uugaauuuuaca

SEQ ID NO: 1280855 - RNA, 17 nt, Human
uugaauuucacugucuu

SEQ ID NO: 1280856 - RNA, 18 nt, Human
uugacaaaggcaagcacu

SEQ ID NO: 1280857 - RNA, 16 nt, Human
uugacaaccaugagac

SEQ ID NO: 1280858 - RNA, 18 nt, Human
uugacaacuggcaggcag

SEQ ID NO: 1280859 - RNA, 21 nt, Human
uugacaaaauguuauuucccu

SEQ ID NO: 1280860 - RNA, 20 nt, Human
uugacaaaauguuauuuccc

SEQ ID NO: 1280861 - RNA, 19 nt, Human
uugacaaaauguuauuucc

SEQ ID NO: 1280862 - RNA, 14 nt, Human
uugacaaaauguua

SEQ ID NO: 1280863 - RNA, 19 nt, Human
uugaauuuuuuuuaacauu

SEQ ID NO: 1280864 - RNA, 22 nt, Human
uugaauuuuuuuuaacauuccu

SEQ ID NO: 1280865 - RNA, 17 nt, Human
uugaacuccugaccuca

SEQ ID NO: 1280866 - RNA, 13 nt, Human
uugaacugauuca

SEQ ID NO: 1280867 - RNA, 17 nt, Human
uugacccacaagaaaug

SEQ ID NO: 1280868 - RNA, 16 nt, Human
uugacccuugcuguga

SEQ ID NO: 1280869 - RNA, 20 nt, Human
uugaccgcgacuaauuucaa

SEQ ID NO: 1280870 - RNA, 13 nt, Human
uugacucaggagc

SEQ ID NO: 1280871 - RNA, 14 nt, Human
uugacucaggagcc

SEQ ID NO: 1280872 - RNA, 20 nt, Human
uugacucaggagccugugac

SEQ ID NO: 1280873 - RNA, 15 nt, Human
uugacucuuuugcca

SEQ ID NO: 1280874 - RNA, 21 nt, Human
uugacucuuuugccauuaaac

SEQ ID NO: 1280875 - RNA, 14 nt, Human
uugaugaagaaguu

SEQ ID NO: 1280876 - RNA, 23 nt, Human
uugaugaagaaguugauaugccu

SEQ ID NO: 1280877 - RNA, 22 nt, Human
uugauauagaaguauaaagaau

SEQ ID NO: 1280878 - RNA, 20 nt, Human
uugauauagaaguauaaaga

SEQ ID NO: 1280879 - RNA, 20 nt, Human
uugaugaccaaaguccuuuu

SEQ ID NO: 1280880 - RNA, 15 nt, Human
uugaggucucagccc

SEQ ID NO: 1280881 - RNA, 18 nt, Human
uugauauagaaguauaaa

SEQ ID NO: 1280882 - RNA, 13 nt, Human
uugaggucucagc

SEQ ID NO: 1280883 - RNA, 17 nt, Human
uugaugacccccaacca

SEQ ID NO: 1280884 - RNA, 12 nt, Human
uugauucugcag

SEQ ID NO: 1280885 - RNA, 20 nt, Human
uugauucugcaguaaaucuu

SEQ ID NO: 1280886 - RNA, 13 nt, Human
uugauugauuuga

SEQ ID NO: 1280887 - RNA, 14 nt, Human
uugauugauuugaa

SEQ ID NO: 1280888 - RNA, 13 nt, Human
uugauuugaagaa

SEQ ID NO: 1280889 - RNA, 14 nt, Human
uugauuugaagaac

SEQ ID NO: 1280890 - RNA, 12 nt, Human
uugcaaaucuug

SEQ ID NO: 1280891 - RNA, 15 nt, Human
uugcaaaucuugaaa

SEQ ID NO: 1280892 - RNA, 16 nt, Human
uugcaaaucuugaaau

SEQ ID NO: 1280893 - RNA, 17 nt, Human
uugcaaaucuugaaauu

SEQ ID NO: 1280894 - RNA, 15 nt, Human
uugcaccuuucuagu

SEQ ID NO: 1280895 - RNA, 18 nt, Human
uugauuugaagaacaugu

SEQ ID NO: 1280896 - RNA, 13 nt, Human
uugauuugcauug

SEQ ID NO: 1280897 - RNA, 14 nt, Human
uugauuugcauuga

SEQ ID NO: 1280898 - RNA, 15 nt, Human
uugauuugcauugaa

SEQ ID NO: 1280899 - RNA, 17 nt, Human
uugauuugcauugaaca

SEQ ID NO: 1280900 - RNA, 19 nt, Human
uugauuugcauugaacaca

SEQ ID NO: 1280901 - RNA, 20 nt, Human
uugauuuuagccuucucugu

SEQ ID NO: 1280902 - RNA, 13 nt, Human
uugcaaagaaaga

SEQ ID NO: 1280903 - RNA, 19 nt, Human
uugcaaagaaagaaaaaaa

SEQ ID NO: 1280904 - RNA, 15 nt, Human
uugcaaagaaagaaa

SEQ ID NO: 1280905 - RNA, 16 nt, Human
uuauauuaugaagcuu

SEQ ID NO: 1280906 - RNA, 17 nt, Human
uuauauuaaccagauau

SEQ ID NO: 1280907 - RNA, 16 nt, Human
uuauauguaccguagg

SEQ ID NO: 1280908 - RNA, 14 nt, Human
uuauauguaccgua

SEQ ID NO: 1280909 - RNA, 19 nt, Human
uuauauguacccucugaaa

SEQ ID NO: 1280910 - RNA, 22 nt, Human
uuauauguacccucugaaauac

SEQ ID NO: 1280911 - RNA, 24 nt, Human
uuauauguacccucugaaauacau

SEQ ID NO: 1280912 - RNA, 14 nt, Human
uuauauggaaauuc

SEQ ID NO: 1280913 - RNA, 13 nt, Human
uuauauggaaauu

SEQ ID NO: 1280914 - RNA, 16 nt, Human
uuauauguacaugaga

SEQ ID NO: 1280915 - RNA, 19 nt, Human
uuauauguacaugagaagg

SEQ ID NO: 1280916 - RNA, 18 nt, Human
uuauauguuguaagcaac

SEQ ID NO: 1280917 - RNA, 18 nt, Human
uuauauguuguaauauuu

SEQ ID NO: 1280918 - RNA, 15 nt, Human
uuauauguuguucuu

SEQ ID NO: 1280919 - RNA, 13 nt, Human
uuauaugcuuacu

SEQ ID NO: 1280920 - RNA, 19 nt, Human
uuauaugcuuacugauaua

SEQ ID NO: 1280921 - RNA, 10 nt, Human
uuauauggaa

SEQ ID NO: 1280922 - RNA, 15 nt, Human
uuauauggaaauaua

SEQ ID NO: 1280923 - RNA, 18 nt, Human
uuauauggaaauauauau

SEQ ID NO: 1280924 - RNA, 19 nt, Human
uuauauggaaauauauauu

SEQ ID NO: 1280925 - RNA, 20 nt, Human
uuauauggaaauauauauua

SEQ ID NO: 1280926 - RNA, 22 nt, Human
uuauauggaaauauauauuaua

SEQ ID NO: 1280927 - RNA, 15 nt, Human
uuauaugaagaaaau

SEQ ID NO: 1280928 - RNA, 19 nt, Human
uuauaugaagaaaaucacu

SEQ ID NO: 1280929 - RNA, 16 nt, Human
uuauaucuggccucug

SEQ ID NO: 1280930 - RNA, 17 nt, Human
uuauauccugacaagau

SEQ ID NO: 1280931 - RNA, 16 nt, Human
uuauaauuuugugaag

SEQ ID NO: 1280932 - RNA, 17 nt, Human
uuauaauuuugugaagc

SEQ ID NO: 1280933 - RNA, 18 nt, Human
uuauaauuuugugaagca

SEQ ID NO: 1280934 - RNA, 14 nt, Human
uuauaauuuuccua

SEQ ID NO: 1280935 - RNA, 16 nt, Human
uuauaauuuuccuaau

SEQ ID NO: 1280936 - RNA, 13 nt, Human
uuauacacugugu

SEQ ID NO: 1280937 - RNA, 20 nt, Human
uuauacacuguguaaauacc

SEQ ID NO: 1280938 - RNA, 19 nt, Human
uuauaucuauauuuuacau

SEQ ID NO: 1280939 - RNA, 23 nt, Human
uuauaucuauauuuuacauaaau

SEQ ID NO: 1280940 - RNA, 16 nt, Human
uuauauauuuaaaagu

SEQ ID NO: 1280941 - RNA, 17 nt, Human
uuauauauuauauggaa

SEQ ID NO: 1280942 - RNA, 13 nt, Human
uuauacagcugua

SEQ ID NO: 1280943 - RNA, 15 nt, Human
uuauacagcuguauu

SEQ ID NO: 1280944 - RNA, 21 nt, Human
uuauacagcuguauugucuga

SEQ ID NO: 1280945 - RNA, 13 nt, Human
uuauauauuauau

SEQ ID NO: 1280946 - RNA, 16 nt, Human
uuauauauuauaugga

SEQ ID NO: 1280947 - RNA, 19 nt, Human
uuauauauuauauggaaau

SEQ ID NO: 1280948 - RNA, 12 nt, Human
uuauaauuuuaa

SEQ ID NO: 1280949 - RNA, 17 nt, Human
uuauaauucucauuaaa

SEQ ID NO: 1280950 - RNA, 14 nt, Human
uuauaauucuuuca

SEQ ID NO: 1280951 - RNA, 21 nt, Human
uuauaauucuuucaauacaga

SEQ ID NO: 1280952 - RNA, 23 nt, Human
uuauaauucuuucaauacagaua

SEQ ID NO: 1280953 - RNA, 12 nt, Human
uuauaauuuaaa

SEQ ID NO: 1280954 - RNA, 21 nt, Human
uuauaauuuuaaauguuuuuu

SEQ ID NO: 1280955 - RNA, 17 nt, Human
uuauaauuuuaaauguu

SEQ ID NO: 1280956 - RNA, 14 nt, Human
uuauaauuuuguga

SEQ ID NO: 1280957 - RNA, 15 nt, Human
uuauaauuuugugaa

SEQ ID NO: 1280958 - RNA, 11 nt, Human
uuauaaucuuu

SEQ ID NO: 1280959 - RNA, 18 nt, Human
uuauaaucuuauaauugu

SEQ ID NO: 1280960 - RNA, 14 nt, Human
uuauaauucucauu

SEQ ID NO: 1280961 - RNA, 21 nt, Human
uuauaauaaaggacuguaauc

SEQ ID NO: 1280962 - RNA, 13 nt, Human
uuauaauauacua

SEQ ID NO: 1280963 - RNA, 18 nt, Human
uuauaauauuuuaaugua

SEQ ID NO: 1280964 - RNA, 19 nt, Human
uuauaauaaaggacuguaa

SEQ ID NO: 1280965 - RNA, 18 nt, Human
uuauaauaaaggacugua

SEQ ID NO: 1280966 - RNA, 18 nt, Human
uuauaagggcaaauugga

SEQ ID NO: 1280967 - RNA, 20 nt, Human
ugucuuuucccauuuaucua

SEQ ID NO: 1280968 - RNA, 19 nt, Human
ugucuuuucccauuuaucu

SEQ ID NO: 1280969 - RNA, 19 nt, Human
uuagugaccucagcuuuga

SEQ ID NO: 1280970 - RNA, 15 nt, Human
uuagugacuaaacca

SEQ ID NO: 1280971 - RNA, 17 nt, Human
uuagugacuaaaccauu

SEQ ID NO: 1280972 - RNA, 23 nt, Human
uuagugacuaaaccauugugcau

SEQ ID NO: 1280973 - RNA, 18 nt, Human
uuagugccacuuaaugua

SEQ ID NO: 1280974 - RNA, 19 nt, Human
uuagugccacuuaauguau

SEQ ID NO: 1280975 - RNA, 22 nt, Human
uuauaagggcaaauuggagaaa

SEQ ID NO: 1280976 - RNA, 22 nt, Human
uuauaagcaucauuauuuaugu

SEQ ID NO: 1280977 - RNA, 21 nt, Human
uuauaagcaucauuauuuaug

SEQ ID NO: 1280978 - RNA, 18 nt, Human
uuauaaguagcaggccaa

SEQ ID NO: 1280979 - RNA, 15 nt, Human
uuauaagaaagccug

SEQ ID NO: 1280980 - RNA, 16 nt, Human
uuauaagaaagccuga

SEQ ID NO: 1280981 - RNA, 12 nt, Human
uuauaagacucu

SEQ ID NO: 1280982 - RNA, 13 nt, Human
uuauaagacucuc

SEQ ID NO: 1280983 - RNA, 20 nt, Human
uuauaagacucucacacuca

SEQ ID NO: 1280984 - RNA, 14 nt, Human
uuauaagacucuca

SEQ ID NO: 1280985 - RNA, 13 nt, Human
uuauaagcaucau

SEQ ID NO: 1280986 - RNA, 17 nt, Human
uuauaagcaucauuauu

SEQ ID NO: 1280987 - RNA, 19 nt, Human
uuauaagcaucauuauuua

SEQ ID NO: 1280988 - RNA, 16 nt, Human
uuaguggcucaacauu

SEQ ID NO: 1280989 - RNA, 20 nt, Human
uuaguggcucaacauugugu

SEQ ID NO: 1280990 - RNA, 23 nt, Human
uuaguggcucaacauuguguucc

SEQ ID NO: 1280991 - RNA, 13 nt, Human
uuaguguauccau

SEQ ID NO: 1280992 - RNA, 18 nt, Human
uuaguguaugauuacugg

SEQ ID NO: 1280993 - RNA, 19 nt, Human
uuauuacaguguuuauccu

SEQ ID NO: 1280994 - RNA, 12 nt, Human
uuauuacagugu

SEQ ID NO: 1280995 - RNA, 13 nt, Human
uuauuacaguguu

SEQ ID NO: 1280996 - RNA, 14 nt, Human
uuauuaauaaacau

SEQ ID NO: 1280997 - RNA, 15 nt, Human
uuauuaauaaacauu

SEQ ID NO: 1280998 - RNA, 20 nt, Human
uuauuaauauauauuaucuu

SEQ ID NO: 1280999 - RNA, 19 nt, Human
uuauuaauauauauuaucu

SEQ ID NO: 1281000 - RNA, 16 nt, Human
uuauuacuguaagaaa

SEQ ID NO: 1281001 - RNA, 23 nt, Human
uuauuacguaugucugguucuca

SEQ ID NO: 1281002 - RNA, 15 nt, Human
uuauuacuuguaaau

SEQ ID NO: 1281003 - RNA, 14 nt, Human
uuauuacuuuugcu

SEQ ID NO: 1281004 - RNA, 16 nt, Human
uuauuacuuguaaaua

SEQ ID NO: 1281005 - RNA, 18 nt, Human
uuauuacuuguaaauaua

SEQ ID NO: 1281006 - RNA, 20 nt, Human
uuauuacuuguaaauauaaa

SEQ ID NO: 1281007 - RNA, 18 nt, Human
uuauuagaaucaaacauu

SEQ ID NO: 1281008 - RNA, 18 nt, Human
uuauuacguaugucuggu

SEQ ID NO: 1281009 - RNA, 21 nt, Human
uuauuacguaugucugguucu

SEQ ID NO: 1281010 - RNA, 22 nt, Human
uuauguuuucgaaaaucaaaug

SEQ ID NO: 1281011 - RNA, 16 nt, Human
uuauuaacaauuaggc

SEQ ID NO: 1281012 - RNA, 19 nt, Human
uuauuaacaauuaggcaga

SEQ ID NO: 1281013 - RNA, 18 nt, Human
uuauuaacauaggugaaa

SEQ ID NO: 1281014 - RNA, 21 nt, Human
uuauuaacgauguccaacccg

SEQ ID NO: 1281015 - RNA, 15 nt, Human
uuauuaacuuuaaug

SEQ ID NO: 1281016 - RNA, 18 nt, Human
uuaugauuuuuuuuucau

SEQ ID NO: 1281017 - RNA, 19 nt, Human
uuaugauuuuuuuuucaua

SEQ ID NO: 1281018 - RNA, 15 nt, Human
uuaugcaaaagcaag

SEQ ID NO: 1281019 - RNA, 21 nt, Human
uuaugcaaaagcaagcugauu

SEQ ID NO: 1281020 - RNA, 17 nt, Human
uuaugcaaaagcaagcu

SEQ ID NO: 1281021 - RNA, 14 nt, Human
uuauggaauugauu

SEQ ID NO: 1281022 - RNA, 19 nt, Human
uuauggaauugauuugcau

SEQ ID NO: 1281023 - RNA, 20 nt, Human
uuauggaauugauuugcauu

SEQ ID NO: 1281024 - RNA, 21 nt, Human
uuauggaauugauuugcauug

SEQ ID NO: 1281025 - RNA, 23 nt, Human
uuauggaauugauuugcauugaa

SEQ ID NO: 1281026 - RNA, 18 nt, Human
uuauggagucauuuuuac

SEQ ID NO: 1281027 - RNA, 19 nt, Human
uuauggagucauuuuuaca

SEQ ID NO: 1281028 - RNA, 17 nt, Human
uuauguugcauagaaua

SEQ ID NO: 1281029 - RNA, 16 nt, Human
uuauauuuacaaaugg

SEQ ID NO: 1281030 - RNA, 17 nt, Human
uuauauuguucacuucu

SEQ ID NO: 1281031 - RNA, 15 nt, Human
uuauauuguucacuu

SEQ ID NO: 1281032 - RNA, 17 nt, Human
uuauauugauaagaucu

SEQ ID NO: 1281033 - RNA, 20 nt, Human
uuauauuuauuacuguaaga

SEQ ID NO: 1281034 - RNA, 13 nt, Human
uuauauuuaacuc

SEQ ID NO: 1281035 - RNA, 12 nt, Human
uuauauuugaaa

SEQ ID NO: 1281036 - RNA, 11 nt, Human
uuauauuucau

SEQ ID NO: 1281037 - RNA, 13 nt, Human
uuauauuugaaau

SEQ ID NO: 1281038 - RNA, 15 nt, Human
uuauauuugaaauau

SEQ ID NO: 1281039 - RNA, 22 nt, Human
uuauauuucuauuuuauuauga

SEQ ID NO: 1281040 - RNA, 16 nt, Human
uuauccuccaccgucu

SEQ ID NO: 1281041 - RNA, 11 nt, Human
uuauccucccu

SEQ ID NO: 1281042 - RNA, 13 nt, Human
uuauccucccugu

SEQ ID NO: 1281043 - RNA, 18 nt, Human
uuauccucccuguaacuu

SEQ ID NO: 1281044 - RNA, 14 nt, Human
uuauccucccugua

SEQ ID NO: 1281045 - RNA, 17 nt, Human
uuauccugaaauuucag

SEQ ID NO: 1281046 - RNA, 16 nt, Human
uuauccugaaauuuca

SEQ ID NO: 1281047 - RNA, 15 nt, Human
uuauccuuucauaua

SEQ ID NO: 1281048 - RNA, 14 nt, Human
uuaucgaaacucau

SEQ ID NO: 1281049 - RNA, 14 nt, Human
uuaucuugaauaau

SEQ ID NO: 1281050 - RNA, 20 nt, Human
uuaucuucaggacacucacu

SEQ ID NO: 1281051 - RNA, 18 nt, Human
uuaucuucucaaguucua

SEQ ID NO: 1281052 - RNA, 22 nt, Human
uuaucuucucaaguucuaagau

SEQ ID NO: 1281053 - RNA, 19 nt, Human
uuaucuucucaaguucuaa

SEQ ID NO: 1281054 - RNA, 16 nt, Human
uuaucuugaauaaugu

SEQ ID NO: 1281055 - RNA, 14 nt, Human
uuaugauuagcuuu

SEQ ID NO: 1281056 - RNA, 20 nt, Human
uuaucuguuugagaaaguca

SEQ ID NO: 1281057 - RNA, 16 nt, Human
uuaucuguuugagaaa

SEQ ID NO: 1281058 - RNA, 16 nt, Human
uuaucuuaaaacuccu

SEQ ID NO: 1281059 - RNA, 18 nt, Human
uuaucuauagcuaaguac

SEQ ID NO: 1281060 - RNA, 19 nt, Human
uuaucuacuuccaaacuaa

SEQ ID NO: 1281061 - RNA, 20 nt, Human
uuaucuacuuccaaacuaau

SEQ ID NO: 1281062 - RNA, 18 nt, Human
uuaucuaaucaugaaacu

SEQ ID NO: 1281063 - RNA, 22 nt, Human
uuaucuaaucaugaaacucccu

SEQ ID NO: 1281064 - RNA, 11 nt, Human
uuaucuaauuu

SEQ ID NO: 1281065 - RNA, 16 nt, Human
uuaucuaauuuauaaa

SEQ ID NO: 1281066 - RNA, 17 nt, Human
uuaucuaauuuauaaaa

SEQ ID NO: 1281067 - RNA, 18 nt, Human
uuaucguuuucuuaaagu

SEQ ID NO: 1281068 - RNA, 16 nt, Human
uuaucguuuucuuaaa

SEQ ID NO: 1281069 - RNA, 21 nt, Human
uuaucuaaguuaauuuaaagu

SEQ ID NO: 1281070 - RNA, 23 nt, Human
uucaaauuguaagcaugcacaaa

SEQ ID NO: 1281071 - RNA, 18 nt, Human
uucaaauguauuacagug

SEQ ID NO: 1281072 - RNA, 16 nt, Human
uucaaauucuucugaa

SEQ ID NO: 1281073 - RNA, 19 nt, Human
uucaaauucuucugaacuc

SEQ ID NO: 1281074 - RNA, 16 nt, Human
uucaacagugaagaca

SEQ ID NO: 1281075 - RNA, 18 nt, Human
uucaacagugaagacaga

SEQ ID NO: 1281076 - RNA, 19 nt, Human
uucaacagugaagacagaa

SEQ ID NO: 1281077 - RNA, 15 nt, Human
uucaaccauucccca

SEQ ID NO: 1281078 - RNA, 17 nt, Human
uucaacauguuauuugu

SEQ ID NO: 1281079 - RNA, 21 nt, Human
uucaacauguuauuuguaaua

SEQ ID NO: 1281080 - RNA, 18 nt, Human
uuauuuucaagaaacuga

SEQ ID NO: 1281081 - RNA, 13 nt, Human
uuauuuucaagaa

SEQ ID NO: 1281082 - RNA, 17 nt, Human
uuauuuucaaaaccagg

SEQ ID NO: 1281083 - RNA, 12 nt, Human
uuauuuugcaac

SEQ ID NO: 1281084 - RNA, 22 nt, Human
uuauuuugccaagggcauaaau

SEQ ID NO: 1281085 - RNA, 22 nt, Human
uuauuuugugaugcaaauaaau

SEQ ID NO: 1281086 - RNA, 19 nt, Human
uuauuuuaauaauguuuca

SEQ ID NO: 1281087 - RNA, 19 nt, Human
uuauuuguugagaguguga

SEQ ID NO: 1281088 - RNA, 12 nt, Human
uuauuuguugag

SEQ ID NO: 1281089 - RNA, 14 nt, Human
uuauuuguugagag

SEQ ID NO: 1281090 - RNA, 22 nt, Human
uuauuuguguuuuaauuuaaac

SEQ ID NO: 1281091 - RNA, 20 nt, Human
uuauuuuaauaauguuucaa

SEQ ID NO: 1281092 - RNA, 20 nt, Human
uuauuugagaagcugcucaa

SEQ ID NO: 1281093 - RNA, 13 nt, Human
uuauuugcaugug

SEQ ID NO: 1281094 - RNA, 11 nt, Human
uuauuugcaua

SEQ ID NO: 1281095 - RNA, 18 nt, Human
uuauuuggaaccuuguuu

SEQ ID NO: 1281096 - RNA, 23 nt, Human
uuauuuggaaccuuguuuuggac

SEQ ID NO: 1281097 - RNA, 12 nt, Human
uuauuuguaaua

SEQ ID NO: 1281098 - RNA, 16 nt, Human
uuauuuguaauagaug

SEQ ID NO: 1281099 - RNA, 17 nt, Human
uuauuuguaauagaugu

SEQ ID NO: 1281100 - RNA, 18 nt, Human
uuauuuguaauagauguu

SEQ ID NO: 1281101 - RNA, 18 nt, Human
uuauuugagaagcugcuc

SEQ ID NO: 1281102 - RNA, 12 nt, Human
uuauuugagaag

SEQ ID NO: 1281103 - RNA, 20 nt, Human
uuauuagaaucaaacauuuu

SEQ ID NO: 1281104 - RNA, 21 nt, Human
uuauuagaaucaaacauuuug

SEQ ID NO: 1281105 - RNA, 21 nt, Human
uuauuagagauuaccuccuga

SEQ ID NO: 1281106 - RNA, 17 nt, Human
uuauuagagugucuuuc

SEQ ID NO: 1281107 - RNA, 19 nt, Human
uucacgccugaggcaauua

SEQ ID NO: 1281108 - RNA, 22 nt, Human
uucacaagacccaaaaggcaga

SEQ ID NO: 1281109 - RNA, 21 nt, Human
uucacaaccuucuguggcuca

SEQ ID NO: 1281110 - RNA, 18 nt, Human
uucaccuaccgaguucaa

SEQ ID NO: 1281111 - RNA, 15 nt, Human
uucaauaagagauua

SEQ ID NO: 1281112 - RNA, 12 nt, Human
uucaauacagau

SEQ ID NO: 1281113 - RNA, 14 nt, Human
uucaauacagauau

SEQ ID NO: 1281114 - RNA, 16 nt, Human
uucaauacagauauau

SEQ ID NO: 1281115 - RNA, 17 nt, Human
uucaauacagauauauu

SEQ ID NO: 1281116 - RNA, 18 nt, Human
uucaauacagauauauuu

SEQ ID NO: 1281117 - RNA, 17 nt, Human
uucaauagcacauaugg

SEQ ID NO: 1281118 - RNA, 14 nt, Human
uucaauagccacua

SEQ ID NO: 1281119 - RNA, 15 nt, Human
uucaauagccacuaa

SEQ ID NO: 1281120 - RNA, 23 nt, Human
uucaauagccacuaaccuugccu

SEQ ID NO: 1281121 - RNA, 17 nt, Human
uucaauagccacuaacc

SEQ ID NO: 1281122 - RNA, 18 nt, Human
uucaauauaagcuuuucu

SEQ ID NO: 1281123 - RNA, 19 nt, Human
uucaauauaagcuuuucuu

SEQ ID NO: 1281124 - RNA, 16 nt, Human
uucacaaacuuuuaua

SEQ ID NO: 1281125 - RNA, 17 nt, Human
uucacaaacuuuuauac

SEQ ID NO: 1281126 - RNA, 22 nt, Human
uucacaaacuuuuauacucuuu

SEQ ID NO: 1281127 - RNA, 22 nt, Human
uucacaacagccugacaacauu

SEQ ID NO: 1281128 - RNA, 16 nt, Human
uucaugcauggaaauu

SEQ ID NO: 1281129 - RNA, 15 nt, Human
uucaugcauggaaau

SEQ ID NO: 1281130 - RNA, 21 nt, Human
uucaugccaauuagcaauuga

SEQ ID NO: 1281131 - RNA, 17 nt, Human
uucaucuucaguugucu

SEQ ID NO: 1281132 - RNA, 14 nt, Human
uucaugcauggaaa

SEQ ID NO: 1281133 - RNA, 17 nt, Human
uucaucuggaaccauca

SEQ ID NO: 1281134 - RNA, 19 nt, Human
uucaucuggcaacaucuuu

SEQ ID NO: 1281135 - RNA, 23 nt, Human
uucaucuggaaccaucagaaaca

SEQ ID NO: 1281136 - RNA, 12 nt, Human
uucaucuggaac

SEQ ID NO: 1281137 - RNA, 20 nt, Human
uucaugcuguucaugaaaga

SEQ ID NO: 1281138 - RNA, 21 nt, Human
uucaugccagcuacuuccucc

SEQ ID NO: 1281139 - RNA, 22 nt, Human
uucaugccagcuacuuccuccu

SEQ ID NO: 1281140 - RNA, 17 nt, Human
uucaugcuaucucugug

SEQ ID NO: 1281141 - RNA, 18 nt, Human
uucaugcuaucucugugu

SEQ ID NO: 1281142 - RNA, 22 nt, Human
uuccaaagaguagaauugcauu

SEQ ID NO: 1281143 - RNA, 22 nt, Human
uuccaaaaauuacuuaguauug

SEQ ID NO: 1281144 - RNA, 14 nt, Human
uuccaaagucucua

SEQ ID NO: 1281145 - RNA, 16 nt, Human
uuccaaagucucuaau

SEQ ID NO: 1281146 - RNA, 17 nt, Human
uuccaaagucucuaauu

SEQ ID NO: 1281147 - RNA, 20 nt, Human
uuccaacaagaagggacuga

SEQ ID NO: 1281148 - RNA, 18 nt, Human
uuccagauccuggaaauc

SEQ ID NO: 1281149 - RNA, 19 nt, Human
uuccagaggcuauuauuuu

SEQ ID NO: 1281150 - RNA, 20 nt, Human
uuccagaggcuauuauuuuc

SEQ ID NO: 1281151 - RNA, 16 nt, Human
uuccagaccugaagaa

SEQ ID NO: 1281152 - RNA, 17 nt, Human
uuccagaccugaagaau

SEQ ID NO: 1281153 - RNA, 23 nt, Human
uuccagacugcuuccaauuuucu

SEQ ID NO: 1281154 - RNA, 18 nt, Human
uuccaacuacuaauagaa

SEQ ID NO: 1281155 - RNA, 20 nt, Human
uuccagaagugugacuggcu

SEQ ID NO: 1281156 - RNA, 14 nt, Human
uuccagaaugcugu

SEQ ID NO: 1281157 - RNA, 15 nt, Human
uuccagaaugcugua

SEQ ID NO: 1281158 - RNA, 16 nt, Human
uuccagaaugcuguac

SEQ ID NO: 1281159 - RNA, 18 nt, Human
uuccagaaugcuguacau

SEQ ID NO: 1281160 - RNA, 19 nt, Human
uuccagaaugcuguacauc

SEQ ID NO: 1281161 - RNA, 14 nt, Human
uuccagaccugaag

SEQ ID NO: 1281162 - RNA, 19 nt, Human
uuccagauccuggaaauca

SEQ ID NO: 1281163 - RNA, 21 nt, Human
uuccauauggauccacuggcu

SEQ ID NO: 1281164 - RNA, 19 nt, Human
uuccauauggauccacugg

SEQ ID NO: 1281165 - RNA, 18 nt, Human
uuccauauggauccacug

SEQ ID NO: 1281166 - RNA, 22 nt, Human
uuccauauggauccacuggcug

SEQ ID NO: 1281167 - RNA, 19 nt, Human
uuccauccaccuuucccaa

SEQ ID NO: 1281168 - RNA, 15 nt, Human
uuccauccauggcca

SEQ ID NO: 1281169 - RNA, 17 nt, Human
uuccauccauggccagc

SEQ ID NO: 1281170 - RNA, 18 nt, Human
uuccauccauggccagca

SEQ ID NO: 1281171 - RNA, 20 nt, Human
uuccauccauggccagcagc

SEQ ID NO: 1281172 - RNA, 18 nt, Human
uuccaugcguguuucuga

SEQ ID NO: 1281173 - RNA, 21 nt, Human
uuccaugcguguuucugacuc

SEQ ID NO: 1281174 - RNA, 20 nt, Human
uucauaaauaaaguuuguug

SEQ ID NO: 1281175 - RNA, 19 nt, Human
uucaguucuaggaaaauaa

SEQ ID NO: 1281176 - RNA, 16 nt, Human
uucaguucuaggaaaa

SEQ ID NO: 1281177 - RNA, 23 nt, Human
uucaguuauuauauuuacaaaug

SEQ ID NO: 1281178 - RNA, 12 nt, Human
uucaguguuaaa

SEQ ID NO: 1281179 - RNA, 18 nt, Human
uucaguguuaaaugugau

SEQ ID NO: 1281180 - RNA, 22 nt, Human
uucaguguuaaaugugaugaau

SEQ ID NO: 1281181 - RNA, 18 nt, Human
uucaucgaaucuacuaau

SEQ ID NO: 1281182 - RNA, 23 nt, Human
uucaucgaaucuacuaauuccac

SEQ ID NO: 1281183 - RNA, 20 nt, Human
uucaucgaaucuacuaauuc

SEQ ID NO: 1281184 - RNA, 14 nt, Human
uucaguggggcagu

SEQ ID NO: 1281185 - RNA, 17 nt, Human
uucagugguuccuucug

SEQ ID NO: 1281186 - RNA, 20 nt, Human
uucaguguauggaaauaaau

SEQ ID NO: 1281187 - RNA, 16 nt, Human
uucagcugucuuuugg

SEQ ID NO: 1281188 - RNA, 20 nt, Human
uucagcugucuuuuggagga

SEQ ID NO: 1281189 - RNA, 22 nt, Human
uucagcuucguuuauuuucaag

SEQ ID NO: 1281190 - RNA, 14 nt, Human
uuucacaaggucuu

SEQ ID NO: 1281191 - RNA, 23 nt, Human
uuucagauaucuuggacaaauca

SEQ ID NO: 1281192 - RNA, 16 nt, Human
uuucacaaccuucugu

SEQ ID NO: 1281193 - RNA, 23 nt, Human
uuucacaacagccugacaacauu

SEQ ID NO: 1281194 - RNA, 22 nt, Human
uuucacaaccuucuguggcuca

SEQ ID NO: 1281195 - RNA, 17 nt, Human
uuucacaaggucuuuaa

SEQ ID NO: 1281196 - RNA, 14 nt, Human
uuucaauagccacu

SEQ ID NO: 1281197 - RNA, 21 nt, Human
uuucaauagccacuaaccuug

SEQ ID NO: 1281198 - RNA, 13 nt, Human
uuucaagguucua

SEQ ID NO: 1281199 - RNA, 14 nt, Human
uuucaagguucuaa

SEQ ID NO: 1281200 - RNA, 16 nt, Human
uuucaagguucuaacc

SEQ ID NO: 1281201 - RNA, 22 nt, Human
uuucaaguuccaaguugcuaau

SEQ ID NO: 1281202 - RNA, 16 nt, Human
uuucaauacagauaua

SEQ ID NO: 1281203 - RNA, 15 nt, Human
uuucaauagcacaua

SEQ ID NO: 1281204 - RNA, 13 nt, Human
uuucaauagccac

SEQ ID NO: 1281205 - RNA, 11 nt, Human
uuucagugagg

SEQ ID NO: 1281206 - RNA, 21 nt, Human
uuucaguggggcagucauuau

SEQ ID NO: 1281207 - RNA, 15 nt, Human
uuucaguucuaggaa

SEQ ID NO: 1281208 - RNA, 23 nt, Human
uuucagcacuagccaaaccucac

SEQ ID NO: 1281209 - RNA, 22 nt, Human
uuucagcacuagccaaaccuca

SEQ ID NO: 1281210 - RNA, 18 nt, Human
uuucagcaagauaaacau

SEQ ID NO: 1281211 - RNA, 12 nt, Human
uuucagcacuag

SEQ ID NO: 1281212 - RNA, 20 nt, Human
uuucagcacuagccaaaccu

SEQ ID NO: 1281213 - RNA, 11 nt, Human
uuucagaugug

SEQ ID NO: 1281214 - RNA, 18 nt, Human
uuucagaugugaaccauu

SEQ ID NO: 1281215 - RNA, 20 nt, Human
uuucagauucccagagcaaa

SEQ ID NO: 1281216 - RNA, 18 nt, Human
uuucaguucuaggaaaau

SEQ ID NO: 1281217 - RNA, 14 nt, Human
uuucauugucugug

SEQ ID NO: 1281218 - RNA, 15 nt, Human
uuucauugucuguga

SEQ ID NO: 1281219 - RNA, 16 nt, Human
uuucauugucugugaa

SEQ ID NO: 1281220 - RNA, 19 nt, Human
uuucauuuagucaugugac

SEQ ID NO: 1281221 - RNA, 14 nt, Human
uuucauuuaucuau

SEQ ID NO: 1281222 - RNA, 19 nt, Human
uuuccaaccggcuuugugg

SEQ ID NO: 1281223 - RNA, 12 nt, Human
uuuccaacuacu

SEQ ID NO: 1281224 - RNA, 17 nt, Human
uuucauuuaucuauaau

SEQ ID NO: 1281225 - RNA, 18 nt, Human
uuuccaacuacuaauaga

SEQ ID NO: 1281226 - RNA, 19 nt, Human
uuuccaacuacuaauagaa

SEQ ID NO: 1281227 - RNA, 22 nt, Human
uuuauaauuuugugaagcaaaa

SEQ ID NO: 1281228 - RNA, 17 nt, Human
uuuauaauucucauuaa

SEQ ID NO: 1281229 - RNA, 17 nt, Human
uuuauaagcaucauuau

SEQ ID NO: 1281230 - RNA, 18 nt, Human
uuuauaagcaucauuauu

SEQ ID NO: 1281231 - RNA, 20 nt, Human
uuuauaagcaucauuauuua

SEQ ID NO: 1281232 - RNA, 21 nt, Human
uuuauaagcaucauuauuuau

SEQ ID NO: 1281233 - RNA, 23 nt, Human
uuuauaagcaucauuauuuaugu

SEQ ID NO: 1281234 - RNA, 22 nt, Human
uuuauaagcaucauuauuuaug

SEQ ID NO: 1281235 - RNA, 20 nt, Human
uuuauaauucucauuaaaag

SEQ ID NO: 1281236 - RNA, 15 nt, Human
uuuauaagaaagccu

SEQ ID NO: 1281237 - RNA, 23 nt, Human
uuuauaagaaagccugaguacuc

SEQ ID NO: 1281238 - RNA, 16 nt, Human
uuuauaagaaagccug

SEQ ID NO: 1281239 - RNA, 12 nt, Human
uuuauaagcauc

SEQ ID NO: 1281240 - RNA, 13 nt, Human
uuuauaagcauca

SEQ ID NO: 1281241 - RNA, 14 nt, Human
uuuauaagcaucau

SEQ ID NO: 1281242 - RNA, 16 nt, Human
uuuauaagcaucauua

SEQ ID NO: 1281243 - RNA, 21 nt, Human
uuuauggcagacauugugcua

SEQ ID NO: 1281244 - RNA, 20 nt, Human
uuuauggcagacauugugcu

SEQ ID NO: 1281245 - RNA, 19 nt, Human
uuuauuuaaugcuguggca

SEQ ID NO: 1281246 - RNA, 22 nt, Human
uuuauuuaacuuuuaguaaagu

SEQ ID NO: 1281247 - RNA, 22 nt, Human
uuuauuuaaaaaacuaaaaacu

SEQ ID NO: 1281248 - RNA, 17 nt, Human
uuuauuaugcauuauau

SEQ ID NO: 1281249 - RNA, 16 nt, Human
uuuauuaugcauuaua

SEQ ID NO: 1281250 - RNA, 14 nt, Human
uuuauucuucuaga

SEQ ID NO: 1281251 - RNA, 15 nt, Human
uuuauucuucuagag

SEQ ID NO: 1281252 - RNA, 16 nt, Human
uuuauucuucuagagu

SEQ ID NO: 1281253 - RNA, 18 nt, Human
uuuauucuucuagaguuc

SEQ ID NO: 1281254 - RNA, 20 nt, Human
uuuauugaauucauuucacu

SEQ ID NO: 1281255 - RNA, 12 nt, Human
uuuauugacaca

SEQ ID NO: 1281256 - RNA, 13 nt, Human
uuuauugacacag

SEQ ID NO: 1281257 - RNA, 14 nt, Human
uuuauugacacaga

SEQ ID NO: 1281258 - RNA, 15 nt, Human
uuuauugacacagaa

SEQ ID NO: 1281259 - RNA, 15 nt, Human
uuucaacgcagcccu

SEQ ID NO: 1281260 - RNA, 16 nt, Human
uuucaacgcagcccug

SEQ ID NO: 1281261 - RNA, 20 nt, Human
uuucaacgcagcccugcuuu

SEQ ID NO: 1281262 - RNA, 21 nt, Human
uuucaacgcagcccugcuuug

SEQ ID NO: 1281263 - RNA, 15 nt, Human
uuucaacggaaagug

SEQ ID NO: 1281264 - RNA, 23 nt, Human
uuucaacggaaagugcugucuua

SEQ ID NO: 1281265 - RNA, 19 nt, Human
uuucaagaaacugaggaau

SEQ ID NO: 1281266 - RNA, 17 nt, Human
uuucaagaaacugagga

SEQ ID NO: 1281267 - RNA, 23 nt, Human
uuucaagaauaaucacgcuuucc

SEQ ID NO: 1281268 - RNA, 23 nt, Human
uuucaagaggagcccccacccug

SEQ ID NO: 1281269 - RNA, 22 nt, Human
uuucaagcagucgugccugugu

SEQ ID NO: 1281270 - RNA, 23 nt, Human
uuucaagcagucgugccuguguc

SEQ ID NO: 1281271 - RNA, 11 nt, Human
uuucaaggaag

SEQ ID NO: 1281272 - RNA, 19 nt, Human
uuucaaggaaguagaaaca

SEQ ID NO: 1281273 - RNA, 15 nt, Human
uuucaaggcacucua

SEQ ID NO: 1281274 - RNA, 17 nt, Human
uuucaaggcacucuaga

SEQ ID NO: 1281275 - RNA, 18 nt, Human
uuucaaggcacucuagau

SEQ ID NO: 1281276 - RNA, 19 nt, Human
uuucaaggcacucuagauu

SEQ ID NO: 1281277 - RNA, 20 nt, Human
uuucaaggcacucuagauuc

SEQ ID NO: 1281278 - RNA, 21 nt, Human
uuucaaggcacucuagauucc

SEQ ID NO: 1281279 - RNA, 22 nt, Human
uuucaaggcacucuagauucca

SEQ ID NO: 1281280 - RNA, 13 nt, Human
uuuaccacuugug

SEQ ID NO: 1281281 - RNA, 23 nt, Human
uuuacauuuuauggugccuagua

SEQ ID NO: 1281282 - RNA, 12 nt, Human
uuuaccaaguuu

SEQ ID NO: 1281283 - RNA, 22 nt, Human
uuuacauuuuauggugccuagu

SEQ ID NO: 1281284 - RNA, 17 nt, Human
uuuacauuuuauggugc

SEQ ID NO: 1281285 - RNA, 13 nt, Human
uuuacauuuuaug

SEQ ID NO: 1281286 - RNA, 16 nt, Human
uuuacauuguugagcu

SEQ ID NO: 1281287 - RNA, 13 nt, Human
uuuacagaauuuu

SEQ ID NO: 1281288 - RNA, 16 nt, Human
uuuacagcugccugca

SEQ ID NO: 1281289 - RNA, 15 nt, Human
uuuacagcugccugc

SEQ ID NO: 1281290 - RNA, 14 nt, Human
uuuacagaauugcu

SEQ ID NO: 1281291 - RNA, 19 nt, Human
uuuacagaauugcuuguuu

SEQ ID NO: 1281292 - RNA, 14 nt, Human
uuuacaggaacuuc

SEQ ID NO: 1281293 - RNA, 18 nt, Human
uuuacaggaacuucauca

SEQ ID NO: 1281294 - RNA, 19 nt, Human
uuuacaggaacuucaucau

SEQ ID NO: 1281295 - RNA, 11 nt, Human
uuuaauaauuu

SEQ ID NO: 1281296 - RNA, 14 nt, Human
uuuaauaauguuuc

SEQ ID NO: 1281297 - RNA, 21 nt, Human
uuuaauagguuuggacaaaau

SEQ ID NO: 1281298 - RNA, 18 nt, Human
uuuaauagcaaagaauug

SEQ ID NO: 1281299 - RNA, 17 nt, Human
uuuaauagcaaagaauu

SEQ ID NO: 1281300 - RNA, 19 nt, Human
uuuacacaauagaauuaua

SEQ ID NO: 1281301 - RNA, 15 nt, Human
uuuacacgcuuuugu

SEQ ID NO: 1281302 - RNA, 17 nt, Human
uuuacacgcuuuuguga

SEQ ID NO: 1281303 - RNA, 16 nt, Human
uuuacacgcuuuugug

SEQ ID NO: 1281304 - RNA, 16 nt, Human
uuuacacucuuuguaa

SEQ ID NO: 1281305 - RNA, 23 nt, Human
uuuauaaaaauaaaaaacacugg

SEQ ID NO: 1281306 - RNA, 21 nt, Human
uuuauaaaaauaaaaaacacu

SEQ ID NO: 1281307 - RNA, 12 nt, Human
uuuaguuuuuca

SEQ ID NO: 1281308 - RNA, 13 nt, Human
uuuaguuuuucau

SEQ ID NO: 1281309 - RNA, 15 nt, Human
uuuaguuuuucauua

SEQ ID NO: 1281310 - RNA, 16 nt, Human
uuuaguuuuucauuaa

SEQ ID NO: 1281311 - RNA, 18 nt, Human
uuuagaaaucauuuugca

SEQ ID NO: 1281312 - RNA, 13 nt, Human
uuuaccagaaagc

SEQ ID NO: 1281313 - RNA, 17 nt, Human
uuuacuuguuucagagu

SEQ ID NO: 1281314 - RNA, 15 nt, Human
uuuacuuguuucaga

SEQ ID NO: 1281315 - RNA, 13 nt, Human
uuuagaaaucauu

SEQ ID NO: 1281316 - RNA, 16 nt, Human
uuuagaaaucauuuug

SEQ ID NO: 1281317 - RNA, 15 nt, Human
uuuagaaagaauauu

SEQ ID NO: 1281318 - RNA, 15 nt, Human
uuuagaaagauaauu

SEQ ID NO: 1281319 - RNA, 21 nt, Human
uuuagaaagauaauucacugu

SEQ ID NO: 1281320 - RNA, 23 nt, Human
uuuaacaacuaugauuuggaaaa

SEQ ID NO: 1281321 - RNA, 14 nt, Human
uuuaacaacauguu

SEQ ID NO: 1281322 - RNA, 18 nt, Human
uuguuuggagacagaguc

SEQ ID NO: 1281323 - RNA, 18 nt, Human
uuuaaauuuuuuuccuua

SEQ ID NO: 1281324 - RNA, 20 nt, Human
uuuaacaacauguuuccagc

SEQ ID NO: 1281325 - RNA, 13 nt, Human
uuuaacagaaauu

SEQ ID NO: 1281326 - RNA, 14 nt, Human
uuuaacagaaauug

SEQ ID NO: 1281327 - RNA, 16 nt, Human
uuuaacagaaauugua

SEQ ID NO: 1281328 - RNA, 19 nt, Human
uuuaacagaaauuguauau

SEQ ID NO: 1281329 - RNA, 21 nt, Human
uuuaacagaaauuguauauug

SEQ ID NO: 1281330 - RNA, 19 nt, Human
uuuaacucuauaauguguu

SEQ ID NO: 1281331 - RNA, 13 nt, Human
uuuaacauaagcu

SEQ ID NO: 1281332 - RNA, 14 nt, Human
uuuaacauaagcua

SEQ ID NO: 1281333 - RNA, 16 nt, Human
uuuaacauaagcuauu

SEQ ID NO: 1281334 - RNA, 17 nt, Human
uuuaacauaagcuauuu

SEQ ID NO: 1281335 - RNA, 19 nt, Human
uuuaacauaagcuauuuuu

SEQ ID NO: 1281336 - RNA, 18 nt, Human
uuuaacauaagcuauuuu

SEQ ID NO: 1281337 - RNA, 16 nt, Human
uuuaaccuuugauaga

SEQ ID NO: 1281338 - RNA, 12 nt, Human
uuuaacauuccu

SEQ ID NO: 1281339 - RNA, 20 nt, Human
uuuaacucccauuaccaugu

SEQ ID NO: 1281340 - RNA, 14 nt, Human
uuuaacugacaagc

SEQ ID NO: 1281341 - RNA, 19 nt, Human
uuuaacugacaagccaucu

SEQ ID NO: 1281342 - RNA, 23 nt, Human
uuuaacugacuauucuugaugua

SEQ ID NO: 1281343 - RNA, 11 nt, Human
uuuaacugacu

SEQ ID NO: 1281344 - RNA, 12 nt, Human
uuuaacugccgu

SEQ ID NO: 1281345 - RNA, 21 nt, Human
uuuaacugccguaauuuaacu

SEQ ID NO: 1281346 - RNA, 12 nt, Human
uuuaacugugga

SEQ ID NO: 1281347 - RNA, 13 nt, Human
uuuaacuguggau

SEQ ID NO: 1281348 - RNA, 15 nt, Human
uuuaacuguggauau

SEQ ID NO: 1281349 - RNA, 20 nt, Human
uuuaagacgaaacauuuguu

SEQ ID NO: 1281350 - RNA, 12 nt, Human
uuuaauaaaaga

SEQ ID NO: 1281351 - RNA, 14 nt, Human
uuuaauaaauuuau

SEQ ID NO: 1281352 - RNA, 13 nt, Human
uuuaauaauguuu

SEQ ID NO: 1281353 - RNA, 14 nt, Human
uuuaagaaauagaa

SEQ ID NO: 1281354 - RNA, 19 nt, Human
uuuaagacauuuuuggaag

SEQ ID NO: 1281355 - RNA, 15 nt, Human
uuuaagaauaucugu

SEQ ID NO: 1281356 - RNA, 21 nt, Human
uuuaagaauaucuguaauggu

SEQ ID NO: 1281357 - RNA, 20 nt, Human
uuuaagaauugaguaauggu

SEQ ID NO: 1281358 - RNA, 15 nt, Human
uuuaagaauugagua

SEQ ID NO: 1281359 - RNA, 12 nt, Human
uuuaacuuuguu

SEQ ID NO: 1281360 - RNA, 17 nt, Human
uuuaacuuuguuuuauu

SEQ ID NO: 1281361 - RNA, 21 nt, Human
uuuaacuuuguuuuauuuuca

SEQ ID NO: 1281362 - RNA, 17 nt, Human
uuuaacuguggauauug

SEQ ID NO: 1281363 - RNA, 18 nt, Human
uuuaacuguggauauugu

SEQ ID NO: 1281364 - RNA, 14 nt, Human
uuuaacuuaaauag

SEQ ID NO: 1281365 - RNA, 13 nt, Human
uuuaacuuaaaua

SEQ ID NO: 1281366 - RNA, 20 nt, Human
uuguguugaagagguuuuaa

SEQ ID NO: 1281367 - RNA, 22 nt, Human
uuguguuuacauuuuauggugc

SEQ ID NO: 1281368 - RNA, 18 nt, Human
uuguguuuacauuuuaug

SEQ ID NO: 1281369 - RNA, 13 nt, Human
uuguguuuacauu

SEQ ID NO: 1281370 - RNA, 12 nt, Human
uuguguuuacau

SEQ ID NO: 1281371 - RNA, 16 nt, Human
uuguggcaagugaauu

SEQ ID NO: 1281372 - RNA, 22 nt, Human
uuguggcaagugaauuugccug

SEQ ID NO: 1281373 - RNA, 20 nt, Human
uuguguucccauuucagcug

SEQ ID NO: 1281374 - RNA, 18 nt, Human
uuguggcaagugaauuug

SEQ ID NO: 1281375 - RNA, 15 nt, Human
uuguguucuguuuug

SEQ ID NO: 1281376 - RNA, 21 nt, Human
uuguggaaaaugaaaauuagg

SEQ ID NO: 1281377 - RNA, 22 nt, Human
uuguggaauggagauucaguuu

SEQ ID NO: 1281378 - RNA, 21 nt, Human
uuguggaauugggagcuuggg

SEQ ID NO: 1281379 - RNA, 22 nt, Human
uugugcccccaaccauuuccuc

SEQ ID NO: 1281380 - RNA, 12 nt, Human
uugugccccugc

SEQ ID NO: 1281381 - RNA, 21 nt, Human
uugugccaugucaaacaaaua

SEQ ID NO: 1281382 - RNA, 16 nt, Human
uugugccagaaugcuu

SEQ ID NO: 1281383 - RNA, 21 nt, Human
uugugccagaaugcuuuagga

SEQ ID NO: 1281384 - RNA, 18 nt, Human
uugugcacauuuauuucc

SEQ ID NO: 1281385 - RNA, 16 nt, Human
uugugcacauuuauuu

SEQ ID NO: 1281386 - RNA, 17 nt, Human
uugugcaauguaaauau

SEQ ID NO: 1281387 - RNA, 18 nt, Human
uugugcaauguaaauauu

SEQ ID NO: 1281388 - RNA, 22 nt, Human
uugugcaauguaaauauuuuaa

SEQ ID NO: 1281389 - RNA, 23 nt, Human
uugugcaauguaaauauuuuaaa

SEQ ID NO: 1281390 - RNA, 19 nt, Human
uugugcaauguguauaaac

SEQ ID NO: 1281391 - RNA, 20 nt, Human
uugugcaauguguauaaaca

SEQ ID NO: 1281392 - RNA, 21 nt, Human
uugugcaauguguauaaacaa

SEQ ID NO: 1281393 - RNA, 11 nt, Human
uugugcagaga

SEQ ID NO: 1281394 - RNA, 14 nt, Human
uugugcauucugga

SEQ ID NO: 1281395 - RNA, 18 nt, Human
uuguuaaucuucaauagu

SEQ ID NO: 1281396 - RNA, 16 nt, Human
uuguuaauaguuccug

SEQ ID NO: 1281397 - RNA, 15 nt, Human
uuguuaaaaauguca

SEQ ID NO: 1281398 - RNA, 12 nt, Human
uuguuaaauuuu

SEQ ID NO: 1281399 - RNA, 18 nt, Human
uuguguuuugcaagccag

SEQ ID NO: 1281400 - RNA, 17 nt, Human
uuguguuuguguauuua

SEQ ID NO: 1281401 - RNA, 16 nt, Human
uuguuacguagccuaa

SEQ ID NO: 1281402 - RNA, 15 nt, Human
uuguuacuucucuaa

SEQ ID NO: 1281403 - RNA, 16 nt, Human
uuguuacuucucuaau

SEQ ID NO: 1281404 - RNA, 20 nt, Human
uuguuacuucucuaauucuu

SEQ ID NO: 1281405 - RNA, 14 nt, Human
uuguuacuucugag

SEQ ID NO: 1281406 - RNA, 19 nt, Human
uuguuaauuuagaaaacuu

SEQ ID NO: 1281407 - RNA, 20 nt, Human
uuguuaauuuagaaaacuuu

SEQ ID NO: 1281408 - RNA, 22 nt, Human
uuguuaauuuagaaaacuuuaa

SEQ ID NO: 1281409 - RNA, 21 nt, Human
uuguuaauuuagaaaacuuua

SEQ ID NO: 1281410 - RNA, 22 nt, Human
uuguuaauuuuuccuauauugc

SEQ ID NO: 1281411 - RNA, 15 nt, Human
uuguuguucuguuaa

SEQ ID NO: 1281412 - RNA, 13 nt, Human
uuguuguucuguu

SEQ ID NO: 1281413 - RNA, 14 nt, Human
uuguuguucuguua

SEQ ID NO: 1281414 - RNA, 21 nt, Human
uuguuguucuguuaacugaau

SEQ ID NO: 1281415 - RNA, 15 nt, Human
uuguuguuucuugcc

SEQ ID NO: 1281416 - RNA, 18 nt, Human
uuguuaugaugugcuuaa

SEQ ID NO: 1281417 - RNA, 17 nt, Human
uuguuaugaugugcuua

SEQ ID NO: 1281418 - RNA, 15 nt, Human
uuguuaugaugugcu

SEQ ID NO: 1281419 - RNA, 13 nt, Human
uuguuaugaugug

SEQ ID NO: 1281420 - RNA, 13 nt, Human
uuguuaucuguuu

SEQ ID NO: 1281421 - RNA, 18 nt, Human
uuguuauguagauaacaa

SEQ ID NO: 1281422 - RNA, 14 nt, Human
uuguugugcuuuua

SEQ ID NO: 1281423 - RNA, 22 nt, Human
uuguuaguuucugaguuuuacc

SEQ ID NO: 1281424 - RNA, 13 nt, Human
uuguuauauaauc

SEQ ID NO: 1281425 - RNA, 16 nt, Human
uuguuauauaaucauu

SEQ ID NO: 1281426 - RNA, 15 nt, Human
uuguuauauaauuua

SEQ ID NO: 1281427 - RNA, 16 nt, Human
uuguuaucagucaaua

SEQ ID NO: 1281428 - RNA, 22 nt, Human
uuguuaucagucaauauuuuua

SEQ ID NO: 1281429 - RNA, 15 nt, Human
uuguuuaaaaaguaa

SEQ ID NO: 1281430 - RNA, 21 nt, Human
uuguuucaaugagguguccaa

SEQ ID NO: 1281431 - RNA, 16 nt, Human
uuguuucaauugcauc

SEQ ID NO: 1281432 - RNA, 23 nt, Human
uuguuucaaugagguguccaacu

SEQ ID NO: 1281433 - RNA, 22 nt, Human
uuguuuccccacaaaacaaagc

SEQ ID NO: 1281434 - RNA, 23 nt, Human
uuguuuccuccccuaucuguauu

SEQ ID NO: 1281435 - RNA, 13 nt, Human
uuguuucgcucuu

SEQ ID NO: 1281436 - RNA, 15 nt, Human
uuguuucgcucuuug

SEQ ID NO: 1281437 - RNA, 18 nt, Human
uuguuucgcucuuugaga

SEQ ID NO: 1281438 - RNA, 19 nt, Human
uuguuucgcucuuugagaa

SEQ ID NO: 1281439 - RNA, 22 nt, Human
uuguuucgcucuuugagaaaua

SEQ ID NO: 1281440 - RNA, 16 nt, Human
uuguuucguggggagg

SEQ ID NO: 1281441 - RNA, 14 nt, Human
uuguuucuacuuug

SEQ ID NO: 1281442 - RNA, 23 nt, Human
uuguuucuacuuugauaugacug

SEQ ID NO: 1281443 - RNA, 14 nt, Human
uuguuucuccccca

SEQ ID NO: 1281444 - RNA, 16 nt, Human
uuguacuauuuaacug

SEQ ID NO: 1281445 - RNA, 19 nt, Human
uuguacuauuuaacugacu

SEQ ID NO: 1281446 - RNA, 22 nt, Human
uuguacuauuuaacugacuauu

SEQ ID NO: 1281447 - RNA, 23 nt, Human
uuguacuaaagccaaacauauau

SEQ ID NO: 1281448 - RNA, 16 nt, Human
uuguacuaaagccaaa

SEQ ID NO: 1281449 - RNA, 13 nt, Human
uuguacuauuuaa

SEQ ID NO: 1281450 - RNA, 18 nt, Human
uuguaaauuggcauggaa

SEQ ID NO: 1281451 - RNA, 16 nt, Human
uuguacauaguuauuu

SEQ ID NO: 1281452 - RNA, 13 nt, Human
uugucuaagaaau

SEQ ID NO: 1281453 - RNA, 19 nt, Human
uugucuaagaaauugaaua

SEQ ID NO: 1281454 - RNA, 21 nt, Human
uugucuaagaaauugaauacu

SEQ ID NO: 1281455 - RNA, 18 nt, Human
uugucuacacacccugca

SEQ ID NO: 1281456 - RNA, 13 nt, Human
uuguaaauauugu

SEQ ID NO: 1281457 - RNA, 17 nt, Human
uuguauuccaagcauau

SEQ ID NO: 1281458 - RNA, 17 nt, Human
uugucguaaagauuugg

SEQ ID NO: 1281459 - RNA, 14 nt, Human
uuguauuacaaauc

SEQ ID NO: 1281460 - RNA, 13 nt, Human
uugugaaauuauu

SEQ ID NO: 1281461 - RNA, 14 nt, Human
uugugaaaugaugg

SEQ ID NO: 1281462 - RNA, 21 nt, Human
uugucuggcaaggacuuugua

SEQ ID NO: 1281463 - RNA, 19 nt, Human
uugucuuuuuagaugccca

SEQ ID NO: 1281464 - RNA, 20 nt, Human
uugucuggcaaggacuuugu

SEQ ID NO: 1281465 - RNA, 13 nt, Human
uugucuuuuuaga

SEQ ID NO: 1281466 - RNA, 13 nt, Human
uugucucagagca

SEQ ID NO: 1281467 - RNA, 15 nt, Human
uugucuagugaaacu

SEQ ID NO: 1281468 - RNA, 15 nt, Human
uugucucaugccagu

SEQ ID NO: 1281469 - RNA, 21 nt, Human
uugucugaagucacugcacag

SEQ ID NO: 1281470 - RNA, 12 nt, Human
uuggguuagacc

SEQ ID NO: 1281471 - RNA, 15 nt, Human
uuggguuagaccuac

SEQ ID NO: 1281472 - RNA, 16 nt, Human
uuggguuagaccuaca

SEQ ID NO: 1281473 - RNA, 18 nt, Human
uuggguuagaccuacagg

SEQ ID NO: 1281474 - RNA, 13 nt, Human
uuggguucacagc

SEQ ID NO: 1281475 - RNA, 15 nt, Human
uugcacguggccucu

SEQ ID NO: 1281476 - RNA, 14 nt, Human
uugcacguguguuu

SEQ ID NO: 1281477 - RNA, 18 nt, Human
uugcacguguguuuuucu

SEQ ID NO: 1281478 - RNA, 20 nt, Human
uugcacguguguuuuucuau

SEQ ID NO: 1281479 - RNA, 21 nt, Human
uugcacguguguuuuucuauu

SEQ ID NO: 1281480 - RNA, 23 nt, Human
uugcacguguguuuuucuauuaa

SEQ ID NO: 1281481 - RNA, 22 nt, Human
uugcacguguguuuuucuauua

SEQ ID NO: 1281482 - RNA, 15 nt, Human
uugcacuaucuuuca

SEQ ID NO: 1281483 - RNA, 15 nt, Human
uugguccaagauucc

SEQ ID NO: 1281484 - RNA, 16 nt, Human
uuggucugugagaugc

SEQ ID NO: 1281485 - RNA, 13 nt, Human
uuguaaaacaggu

SEQ ID NO: 1281486 - RNA, 11 nt, Human
uuguaaauaua

SEQ ID NO: 1281487 - RNA, 12 nt, Human
uuguaaauauaa

SEQ ID NO: 1281488 - RNA, 13 nt, Human
uuguaaauauaaa

SEQ ID NO: 1281489 - RNA, 16 nt, Human
uuguaaaugugguaaa

SEQ ID NO: 1281490 - RNA, 21 nt, Human
uuguaaaugugguaaagaguu

SEQ ID NO: 1281491 - RNA, 17 nt, Human
uuguaaauauaaagacg

SEQ ID NO: 1281492 - RNA, 16 nt, Human
uuguaaauauaaagac

SEQ ID NO: 1281493 - RNA, 15 nt, Human
uuguaaaacagguag

SEQ ID NO: 1281494 - RNA, 14 nt, Human
uuguaaaacaggua

SEQ ID NO: 1281495 - RNA, 17 nt, Human
uuguaaaagcauuuugu

SEQ ID NO: 1281496 - RNA, 18 nt, Human
uuguaaaagcauuuugua

SEQ ID NO: 1281497 - RNA, 19 nt, Human
uuguaaaagcauuuuguaa

SEQ ID NO: 1281498 - RNA, 20 nt, Human
uuguaaaagcauuuuguaau

SEQ ID NO: 1281499 - RNA, 12 nt, Human
uuguaaauuggc

SEQ ID NO: 1281500 - RNA, 13 nt, Human
uuguaaauuggca

SEQ ID NO: 1281501 - RNA, 14 nt, Human
uuguaaauuggcau

SEQ ID NO: 1281502 - RNA, 16 nt, Human
uuguaaauuauuaauu

SEQ ID NO: 1281503 - RNA, 23 nt, Human
uuguaaauuauuaauuuaugcag

SEQ ID NO: 1281504 - RNA, 11 nt, Human
uguaauacaau

SEQ ID NO: 1281505 - RNA, 17 nt, Human
uguaaugaaaaccacau

SEQ ID NO: 1281506 - RNA, 13 nt, Human
uguaaugaaaacc

SEQ ID NO: 1281507 - RNA, 12 nt, Human
uguaaugaaaac

SEQ ID NO: 1281508 - RNA, 19 nt, Human
uguaauaauaaagaauagc

SEQ ID NO: 1281509 - RNA, 18 nt, Human
uguaauacuucuugugug

SEQ ID NO: 1281510 - RNA, 11 nt, Human
uguaaugaaaa

SEQ ID NO: 1281511 - RNA, 16 nt, Human
uguacaagaugaagga

SEQ ID NO: 1281512 - RNA, 18 nt, Human
uguaaauuuguacuauuu

SEQ ID NO: 1281513 - RNA, 14 nt, Human
uguaaauuuguacu

SEQ ID NO: 1281514 - RNA, 14 nt, Human
uguaacaagccaga

SEQ ID NO: 1281515 - RNA, 18 nt, Human
uguaacaagccagauuuu

SEQ ID NO: 1281516 - RNA, 15 nt, Human
uguaacaauugugua

SEQ ID NO: 1281517 - RNA, 16 nt, Human
uguaacaauuguguag

SEQ ID NO: 1281518 - RNA, 19 nt, Human
uguaacaauuguguagccu

SEQ ID NO: 1281519 - RNA, 20 nt, Human
uguaacaauuguguagccuu

SEQ ID NO: 1281520 - RNA, 21 nt, Human
uguaacaauuguguagccuuu

SEQ ID NO: 1281521 - RNA, 22 nt, Human
uguaacaauuguguagccuuuu

SEQ ID NO: 1281522 - RNA, 13 nt, Human
uguaaauuuguac

SEQ ID NO: 1281523 - RNA, 23 nt, Human
uguaaacucaaaauauuuguaca

SEQ ID NO: 1281524 - RNA, 14 nt, Human
uguaaacugugcac

SEQ ID NO: 1281525 - RNA, 15 nt, Human
uguaaacugugcacc

SEQ ID NO: 1281526 - RNA, 13 nt, Human
uguaaacugugua

SEQ ID NO: 1281527 - RNA, 14 nt, Human
uguaaacuguguau

SEQ ID NO: 1281528 - RNA, 18 nt, Human
uguaaacuguguauucca

SEQ ID NO: 1281529 - RNA, 19 nt, Human
uguaaacuguguauuccaa

SEQ ID NO: 1281530 - RNA, 17 nt, Human
uguaacauacuggccug

SEQ ID NO: 1281531 - RNA, 11 nt, Human
uguaacaugua

SEQ ID NO: 1281532 - RNA, 20 nt, Human
ugguuguacauauaagugau

SEQ ID NO: 1281533 - RNA, 17 nt, Human
ugguugguuuucuucuu

SEQ ID NO: 1281534 - RNA, 13 nt, Human
ugguugcauccua

SEQ ID NO: 1281535 - RNA, 14 nt, Human
ugguugaugccaaa

SEQ ID NO: 1281536 - RNA, 18 nt, Human
ugguugaugccaaaaaaa

SEQ ID NO: 1281537 - RNA, 16 nt, Human
ugguugguuuucuucu

SEQ ID NO: 1281538 - RNA, 21 nt, Human
ugguuuucuucuucucguccu

SEQ ID NO: 1281539 - RNA, 18 nt, Human
ugguuuucuuuugccaug

SEQ ID NO: 1281540 - RNA, 19 nt, Human
ugguuuucuuuugccauga

SEQ ID NO: 1281541 - RNA, 18 nt, Human
ugguuuuuacugcucuga

SEQ ID NO: 1281542 - RNA, 21 nt, Human
ugguuuuuacugcucugagaa

SEQ ID NO: 1281543 - RNA, 20 nt, Human
ugguuuuuacugcucugaga

SEQ ID NO: 1281544 - RNA, 12 nt, Human
uguaaaauggug

SEQ ID NO: 1281545 - RNA, 16 nt, Human
uguaaaaugacaauca

SEQ ID NO: 1281546 - RNA, 19 nt, Human
uguaaaaugacaaucaugu

SEQ ID NO: 1281547 - RNA, 21 nt, Human
uguaaaaugacaaucaugugu

SEQ ID NO: 1281548 - RNA, 19 nt, Human
uguaaaccugagucguaca

SEQ ID NO: 1281549 - RNA, 15 nt, Human
uguaaacucaaaaua

SEQ ID NO: 1281550 - RNA, 20 nt, Human
uguaaacucaaaauauuugu

SEQ ID NO: 1281551 - RNA, 11 nt, Human
uguaaaauggu

SEQ ID NO: 1281552 - RNA, 22 nt, Human
uguaaaaucuugucauguguau

SEQ ID NO: 1281553 - RNA, 12 nt, Human
uguaaaaugaca

SEQ ID NO: 1281554 - RNA, 21 nt, Human
uguaaaauauuuugaaucaau

SEQ ID NO: 1281555 - RNA, 12 nt, Human
uguaaaaucuug

SEQ ID NO: 1281556 - RNA, 15 nt, Human
uguaaaaucuuguca

SEQ ID NO: 1281557 - RNA, 16 nt, Human
uguaaaaucuugucau

SEQ ID NO: 1281558 - RNA, 18 nt, Human
uguaaaaucuugucaugu

SEQ ID NO: 1281559 - RNA, 19 nt, Human
uguaaaaucuugucaugug

SEQ ID NO: 1281560 - RNA, 20 nt, Human
uguaaaaucuugucaugugu

SEQ ID NO: 1281561 - RNA, 12 nt, Human
uguaaaacaggu

SEQ ID NO: 1281562 - RNA, 13 nt, Human
uguaaaacaggua

SEQ ID NO: 1281563 - RNA, 14 nt, Human
uguaaaacagguag

SEQ ID NO: 1281564 - RNA, 22 nt, Human
uguaaaacagguagaauuaucu

SEQ ID NO: 1281565 - RNA, 19 nt, Human
uguaaaacauuuauuuuga

SEQ ID NO: 1281566 - RNA, 17 nt, Human
uguaaaagcauuuugua

SEQ ID NO: 1281567 - RNA, 18 nt, Human
uguaaaagcauuuuguaa

SEQ ID NO: 1281568 - RNA, 19 nt, Human
uguaaaagcauuuuguaau

SEQ ID NO: 1281569 - RNA, 12 nt, Human
uguaaaauaauu

SEQ ID NO: 1281570 - RNA, 16 nt, Human
uguaaaauaauucuga

SEQ ID NO: 1281571 - RNA, 19 nt, Human
uguaaaauauuuugaauca

SEQ ID NO: 1281572 - RNA, 20 nt, Human
uguaaaauauuuugaaucaa

SEQ ID NO: 1281573 - RNA, 16 nt, Human
ugguucccuugaugaa

SEQ ID NO: 1281574 - RNA, 23 nt, Human
ugguuccccuguucacucuacuu

SEQ ID NO: 1281575 - RNA, 18 nt, Human
ugguucccguuucuccac

SEQ ID NO: 1281576 - RNA, 20 nt, Human
ugguucccguuucuccaccu

SEQ ID NO: 1281577 - RNA, 17 nt, Human
ugguucccuugaugaag

SEQ ID NO: 1281578 - RNA, 20 nt, Human
ugguucccuugaugaagaag

SEQ ID NO: 1281579 - RNA, 12 nt, Human
ugguuccucccc

SEQ ID NO: 1281580 - RNA, 18 nt, Human
ugguuccuccccuccucc

SEQ ID NO: 1281581 - RNA, 23 nt, Human
ugguuccuccccuccuccuggac

SEQ ID NO: 1281582 - RNA, 16 nt, Human
ugguuccccaguagag

SEQ ID NO: 1281583 - RNA, 17 nt, Human
ugguucuaaggaccuga

SEQ ID NO: 1281584 - RNA, 22 nt, Human
ugguucuaaggaccugaaauuc

SEQ ID NO: 1281585 - RNA, 12 nt, Human
ugguugaggaaa

SEQ ID NO: 1281586 - RNA, 22 nt, Human
ugguucuugaggggaccaggag

SEQ ID NO: 1281587 - RNA, 19 nt, Human
ugguucuuguguuggcugu

SEQ ID NO: 1281588 - RNA, 16 nt, Human
ugguugaaaauaaaaa

SEQ ID NO: 1281589 - RNA, 23 nt, Human
ugguugaacucugguggcacagg

SEQ ID NO: 1281590 - RNA, 16 nt, Human
ugguucucaauuccaa

SEQ ID NO: 1281591 - RNA, 23 nt, Human
ugguucucaauuccaacaguuua

SEQ ID NO: 1281592 - RNA, 18 nt, Human
ugguucucaauuccaaca

SEQ ID NO: 1281593 - RNA, 18 nt, Human
ugguucugagauggcucc

SEQ ID NO: 1281594 - RNA, 22 nt, Human
ugguucugagauggcucccagg

SEQ ID NO: 1281595 - RNA, 17 nt, Human
ugguucuggcuguuuga

SEQ ID NO: 1281596 - RNA, 15 nt, Human
ugguucuugagggga

SEQ ID NO: 1281597 - RNA, 21 nt, Human
ugguucuugaggggaccagga

SEQ ID NO: 1281598 - RNA, 23 nt, Human
ugguucuugaggggaccaggagu

SEQ ID NO: 1281599 - RNA, 22 nt, Human
ugguguagcuacagagaaacca

SEQ ID NO: 1281600 - RNA, 15 nt, Human
ugguguagaacacua

SEQ ID NO: 1281601 - RNA, 21 nt, Human
ugguguagaacacuaauucau

SEQ ID NO: 1281602 - RNA, 17 nt, Human
ugguguagaacacuaau

SEQ ID NO: 1281603 - RNA, 15 nt, Human
ugguguagcuacaga

SEQ ID NO: 1281604 - RNA, 16 nt, Human
ugguguagcuacagag

SEQ ID NO: 1281605 - RNA, 17 nt, Human
ugguguagcuacagaga

SEQ ID NO: 1281606 - RNA, 18 nt, Human
ugguguagcuacagagaa

SEQ ID NO: 1281607 - RNA, 20 nt, Human
ugguguagcuacagagaaac

SEQ ID NO: 1281608 - RNA, 18 nt, Human
uggugucagacccuggag

SEQ ID NO: 1281609 - RNA, 19 nt, Human
uggugucagacccuggagg

SEQ ID NO: 1281610 - RNA, 18 nt, Human
ugguguccagacagagcc

SEQ ID NO: 1281611 - RNA, 21 nt, Human
ugguguccagacagagcccug

SEQ ID NO: 1281612 - RNA, 16 nt, Human
ugguucauuaauucua

SEQ ID NO: 1281613 - RNA, 11 nt, Human
ugguuccccug

SEQ ID NO: 1281614 - RNA, 18 nt, Human
ugguuccccuguucacuc

SEQ ID NO: 1281615 - RNA, 19 nt, Human
ugguuccccuguucacucu

SEQ ID NO: 1281616 - RNA, 20 nt, Human
ugguuccccuguucacucua

SEQ ID NO: 1281617 - RNA, 12 nt, Human
ugguuccagggu

SEQ ID NO: 1281618 - RNA, 21 nt, Human
ugguuccagggucccucugug

SEQ ID NO: 1281619 - RNA, 22 nt, Human
ugguuccagggucccucugugu

SEQ ID NO: 1281620 - RNA, 14 nt, Human
uggugguagagaag

SEQ ID NO: 1281621 - RNA, 23 nt, Human
uggugggugccuaggccugggca

SEQ ID NO: 1281622 - RNA, 16 nt, Human
uggugguauuuucaau

SEQ ID NO: 1281623 - RNA, 14 nt, Human
ugguggucccuggg

SEQ ID NO: 1281624 - RNA, 15 nt, Human
ugguggucccugggu

SEQ ID NO: 1281625 - RNA, 15 nt, Human
ugguggucuguuggc

SEQ ID NO: 1281626 - RNA, 14 nt, Human
ugguggggcagcuc

SEQ ID NO: 1281627 - RNA, 16 nt, Human
ugguggguccaugggc

SEQ ID NO: 1281628 - RNA, 17 nt, Human
ugguggguccaugggca

SEQ ID NO: 1281629 - RNA, 18 nt, Human
ugguggguccaugggcag

SEQ ID NO: 1281630 - RNA, 18 nt, Human
ugguguaagguacuuuca

SEQ ID NO: 1281631 - RNA, 15 nt, Human
ugguggccugguccc

SEQ ID NO: 1281632 - RNA, 21 nt, Human
ugguggcccgacagccuggca

SEQ ID NO: 1281633 - RNA, 20 nt, Human
ugguggccaugcuccucuuc

SEQ ID NO: 1281634 - RNA, 21 nt, Human
ugguggccaugcuccucuucc

SEQ ID NO: 1281635 - RNA, 14 nt, Human
ugguggcccucucc

SEQ ID NO: 1281636 - RNA, 16 nt, Human
ugguggcccucucccc

SEQ ID NO: 1281637 - RNA, 19 nt, Human
ugguggcccucuccccugc

SEQ ID NO: 1281638 - RNA, 21 nt, Human
ugguggcccucuccccugccc

SEQ ID NO: 1281639 - RNA, 23 nt, Human
ugguggcccucuccccugccccc

SEQ ID NO: 1281640 - RNA, 22 nt, Human
ugguggcccucuccccugcccc

SEQ ID NO: 1281641 - RNA, 16 nt, Human
ugguggccuggucccu

SEQ ID NO: 1281642 - RNA, 20 nt, Human
uggugggccaacaaagaaca

SEQ ID NO: 1281643 - RNA, 23 nt, Human
uggugggccaacaaagaacacua

SEQ ID NO: 1281644 - RNA, 14 nt, Human
uggguagacacaca

SEQ ID NO: 1281645 - RNA, 21 nt, Human
uggguagaaagagauacagag

SEQ ID NO: 1281646 - RNA, 19 nt, Human
ugguggcccgacagccugg

SEQ ID NO: 1281647 - RNA, 23 nt, Human
uggugcaaguugaggacuucuug

SEQ ID NO: 1281648 - RNA, 14 nt, Human
ugguggccaugcuc

SEQ ID NO: 1281649 - RNA, 15 nt, Human
ugguggccaugcucc

SEQ ID NO: 1281650 - RNA, 16 nt, Human
uggugcaaguugagga

SEQ ID NO: 1281651 - RNA, 19 nt, Human
uggugcaaguugaggacuu

SEQ ID NO: 1281652 - RNA, 22 nt, Human
uggugcaaguugaggacuucuu

SEQ ID NO: 1281653 - RNA, 17 nt, Human
ugucuacacuaagagag

SEQ ID NO: 1281654 - RNA, 23 nt, Human
ugucuacacagauguucacccaa

SEQ ID NO: 1281655 - RNA, 22 nt, Human
ugucuacacuaagagagaauga

SEQ ID NO: 1281656 - RNA, 13 nt, Human
uguccugguggua

SEQ ID NO: 1281657 - RNA, 18 nt, Human
ugucuaagauucuagauc

SEQ ID NO: 1281658 - RNA, 14 nt, Human
uguccugggccugc

SEQ ID NO: 1281659 - RNA, 15 nt, Human
uguccugggccugca

SEQ ID NO: 1281660 - RNA, 17 nt, Human
uguccugggccugcaga

SEQ ID NO: 1281661 - RNA, 16 nt, Human
uguccugccuguggcc

SEQ ID NO: 1281662 - RNA, 18 nt, Human
uguccugcaccggggccu

SEQ ID NO: 1281663 - RNA, 21 nt, Human
uguccugagccccagggagag

SEQ ID NO: 1281664 - RNA, 12 nt, Human
uguccugagcuc

SEQ ID NO: 1281665 - RNA, 14 nt, Human
uguccugagcucag

SEQ ID NO: 1281666 - RNA, 15 nt, Human
uguccugagcucagc

SEQ ID NO: 1281667 - RNA, 17 nt, Human
uguccugagcucagcgu

SEQ ID NO: 1281668 - RNA, 16 nt, Human
uguccugagcucagcg

SEQ ID NO: 1281669 - RNA, 22 nt, Human
uguccugccuaaggcugaacuu

SEQ ID NO: 1281670 - RNA, 18 nt, Human
uguccugccacccagccc

SEQ ID NO: 1281671 - RNA, 22 nt, Human
uguccugccacccagccccagc

SEQ ID NO: 1281672 - RNA, 17 nt, Human
uguccugccuauuaucu

SEQ ID NO: 1281673 - RNA, 24 nt, Human
uguccugccuauuaucugucagcu

SEQ ID NO: 1281674 - RNA, 24 nt, Human
uguccugccacccagccccagcca

SEQ ID NO: 1281675 - RNA, 12 nt, Human
uguccugccugu

SEQ ID NO: 1281676 - RNA, 13 nt, Human
ugucaucucagcu

SEQ ID NO: 1281677 - RNA, 23 nt, Human
ugucauccucaaagaaaguguau

SEQ ID NO: 1281678 - RNA, 14 nt, Human
ugucauccucacag

SEQ ID NO: 1281679 - RNA, 19 nt, Human
ugucauccucaaagaaagu

SEQ ID NO: 1281680 - RNA, 20 nt, Human
ugucauccucaaagaaagug

SEQ ID NO: 1281681 - RNA, 21 nt, Human
ugucauccucaaagaaagugu

SEQ ID NO: 1281682 - RNA, 22 nt, Human
ugucauccucaaagaaagugua

SEQ ID NO: 1281683 - RNA, 13 nt, Human
uguccccuauccu

SEQ ID NO: 1281684 - RNA, 21 nt, Human
uguccuagcacagauggccag

SEQ ID NO: 1281685 - RNA, 22 nt, Human
uguccuagcacagauggccagc

SEQ ID NO: 1281686 - RNA, 20 nt, Human
uguccuaucuccagcggccc

SEQ ID NO: 1281687 - RNA, 13 nt, Human
uguccucagcccc

SEQ ID NO: 1281688 - RNA, 17 nt, Human
uguccucccgagcuccu

SEQ ID NO: 1281689 - RNA, 21 nt, Human
uguccucccgagcuccucuuc

SEQ ID NO: 1281690 - RNA, 14 nt, Human
uguccugagcccca

SEQ ID NO: 1281691 - RNA, 17 nt, Human
uguccugagccccaggg

SEQ ID NO: 1281692 - RNA, 18 nt, Human
uguccugagccccaggga

SEQ ID NO: 1281693 - RNA, 19 nt, Human
uguccugagccccagggag

SEQ ID NO: 1281694 - RNA, 16 nt, Human
ugucugucugucuguc

SEQ ID NO: 1281695 - RNA, 15 nt, Human
ugucugucugucugu

SEQ ID NO: 1281696 - RNA, 18 nt, Human
ugucugugaagugagacc

SEQ ID NO: 1281697 - RNA, 19 nt, Human
ugucugugaagugagaccu

SEQ ID NO: 1281698 - RNA, 15 nt, Human
ugucugucuguccca

SEQ ID NO: 1281699 - RNA, 14 nt, Human
ugucugucuguccc

SEQ ID NO: 1281700 - RNA, 20 nt, Human
ugucugugacuuuugugaaa

SEQ ID NO: 1281701 - RNA, 19 nt, Human
ugucuguggcaaaaguuua

SEQ ID NO: 1281702 - RNA, 15 nt, Human
ugucuguggauuuuu

SEQ ID NO: 1281703 - RNA, 20 nt, Human
ugucuguguuuugaaagaau

SEQ ID NO: 1281704 - RNA, 13 nt, Human
ugucuguucuaca

SEQ ID NO: 1281705 - RNA, 20 nt, Human
ugucugagacagaaucucag

SEQ ID NO: 1281706 - RNA, 16 nt, Human
ugucucaggucccugc

SEQ ID NO: 1281707 - RNA, 18 nt, Human
ugucucaggcugccugag

SEQ ID NO: 1281708 - RNA, 19 nt, Human
ugucucaggcugccugagu

SEQ ID NO: 1281709 - RNA, 20 nt, Human
ugucucaggcugccugaguc

SEQ ID NO: 1281710 - RNA, 21 nt, Human
ugucugaucguucaaagcaug

SEQ ID NO: 1281711 - RNA, 16 nt, Human
ugucuguuuuaaaaac

SEQ ID NO: 1281712 - RNA, 21 nt, Human
ugucuuaaaaccugcuuuuca

SEQ ID NO: 1281713 - RNA, 18 nt, Human
ugucuuaaacuaaaugug

SEQ ID NO: 1281714 - RNA, 15 nt, Human
ugucuguucuacaua

SEQ ID NO: 1281715 - RNA, 21 nt, Human
ugucuguucuacauagaugcu

SEQ ID NO: 1281716 - RNA, 16 nt, Human
ugucuguuguauucau

SEQ ID NO: 1281717 - RNA, 20 nt, Human
ugucuuaaacuaaaugugca

SEQ ID NO: 1281718 - RNA, 20 nt, Human
ugucuauggauuugccuucu

SEQ ID NO: 1281719 - RNA, 14 nt, Human
ugucuauaaagcau

SEQ ID NO: 1281720 - RNA, 12 nt, Human
ugucuauaaagc

SEQ ID NO: 1281721 - RNA, 20 nt, Human
ugucuacauaugaucugucu

SEQ ID NO: 1281722 - RNA, 20 nt, Human
ugucucacugagcacuguuu

SEQ ID NO: 1281723 - RNA, 13 nt, Human
ugucucaggcugc

SEQ ID NO: 1281724 - RNA, 16 nt, Human
ugucucaggcugccug

SEQ ID NO: 1281725 - RNA, 17 nt, Human
ugucucaggcugccuga

SEQ ID NO: 1281726 - RNA, 19 nt, Human
ugucucaagagggcacugg

SEQ ID NO: 1281727 - RNA, 16 nt, Human
ugucucaccuggacuu

SEQ ID NO: 1281728 - RNA, 14 nt, Human
ugucucacugagca

SEQ ID NO: 1281729 - RNA, 17 nt, Human
ugucucaagagggcacu

SEQ ID NO: 1281730 - RNA, 18 nt, Human
ugucucaagagggcacug

SEQ ID NO: 1281731 - RNA, 18 nt, Human
ugucuauuaccuguuagu

SEQ ID NO: 1281732 - RNA, 13 nt, Human
ugucuauaaagca

SEQ ID NO: 1281733 - RNA, 13 nt, Human
ugucuauucagcu

SEQ ID NO: 1281734 - RNA, 14 nt, Human
ugucuauucagcuu

SEQ ID NO: 1281735 - RNA, 20 nt, Human
ugucuauuuuuaauguuugu

SEQ ID NO: 1281736 - RNA, 18 nt, Human
uguauuuuaaaagaauga

SEQ ID NO: 1281737 - RNA, 19 nt, Human
uguauuuuaaaagaaugau

SEQ ID NO: 1281738 - RNA, 16 nt, Human
ugucaauuuauaauga

SEQ ID NO: 1281739 - RNA, 19 nt, Human
ugucaauuuauaaugauua

SEQ ID NO: 1281740 - RNA, 15 nt, Human
ugucaauuucugugu

SEQ ID NO: 1281741 - RNA, 16 nt, Human
ugucaauuucuguguu

SEQ ID NO: 1281742 - RNA, 13 nt, Human
uguaugcgugugu

SEQ ID NO: 1281743 - RNA, 18 nt, Human
uguauggaaauaaaugua

SEQ ID NO: 1281744 - RNA, 23 nt, Human
uguauggaaauaaauguaucaua

SEQ ID NO: 1281745 - RNA, 20 nt, Human
uguauggguaggguaaauca

SEQ ID NO: 1281746 - RNA, 22 nt, Human
uguauggguaggguaaaucagu

SEQ ID NO: 1281747 - RNA, 21 nt, Human
uguaugguuuuugagauauua

SEQ ID NO: 1281748 - RNA, 22 nt, Human
uguaugguuuuugagauauuaa

SEQ ID NO: 1281749 - RNA, 23 nt, Human
uguaugguuuuugagauauuaau

SEQ ID NO: 1281750 - RNA, 16 nt, Human
ugucacaaugagauug

SEQ ID NO: 1281751 - RNA, 21 nt, Human
ugucacaaugagauugaauuu

SEQ ID NO: 1281752 - RNA, 23 nt, Human
ugucacugguagaccaaaauaaa

SEQ ID NO: 1281753 - RNA, 21 nt, Human
ugucacugguagaccaaaaua

SEQ ID NO: 1281754 - RNA, 17 nt, Human
ugucaucaucauggcca

SEQ ID NO: 1281755 - RNA, 18 nt, Human
ugucaucaucauggccag

SEQ ID NO: 1281756 - RNA, 19 nt, Human
ugucaucaucauggccagc

SEQ ID NO: 1281757 - RNA, 21 nt, Human
ugucaucaucauggccagcug

SEQ ID NO: 1281758 - RNA, 16 nt, Human
ugucauccucaaagaa

SEQ ID NO: 1281759 - RNA, 20 nt, Human
uguaguguuggagaagaacu

SEQ ID NO: 1281760 - RNA, 21 nt, Human
uguaguguuggagaagaacug

SEQ ID NO: 1281761 - RNA, 20 nt, Human
uguaggaagguacuguauga

SEQ ID NO: 1281762 - RNA, 19 nt, Human
uguaggaagguacuguaug

SEQ ID NO: 1281763 - RNA, 18 nt, Human
uguaggaagguacuguau

SEQ ID NO: 1281764 - RNA, 16 nt, Human
uguaggaagguacugu

SEQ ID NO: 1281765 - RNA, 14 nt, Human
uguauaaaauaauu

SEQ ID NO: 1281766 - RNA, 21 nt, Human
uguauaaaagugugaaauaaa

SEQ ID NO: 1281767 - RNA, 13 nt, Human
uguauaaaauaga

SEQ ID NO: 1281768 - RNA, 15 nt, Human
uguauaaaauagaca

SEQ ID NO: 1281769 - RNA, 13 nt, Human
uguauaaaauaau

SEQ ID NO: 1281770 - RNA, 22 nt, Human
uguaguguuggagaagaacuga

SEQ ID NO: 1281771 - RNA, 18 nt, Human
uguauaaaagugugaaau

SEQ ID NO: 1281772 - RNA, 22 nt, Human
uguaggaagguacuguaugauc

SEQ ID NO: 1281773 - RNA, 17 nt, Human
uguacagcuggcucuac

SEQ ID NO: 1281774 - RNA, 22 nt, Human
uguagcugugaccugcugagcu

SEQ ID NO: 1281775 - RNA, 23 nt, Human
uguagcugugaccugcugagcuc

SEQ ID NO: 1281776 - RNA, 12 nt, Human
uguagcuuugcu

SEQ ID NO: 1281777 - RNA, 13 nt, Human
uguagcuuugcuc

SEQ ID NO: 1281778 - RNA, 15 nt, Human
uguagcuuugcucuu

SEQ ID NO: 1281779 - RNA, 23 nt, Human
uguagcuuuggaaguuuagcucu

SEQ ID NO: 1281780 - RNA, 15 nt, Human
uguauagcugcuucc

SEQ ID NO: 1281781 - RNA, 15 nt, Human
uguauaguaaaucac

SEQ ID NO: 1281782 - RNA, 16 nt, Human
uguauaaacaagaaaa

SEQ ID NO: 1281783 - RNA, 17 nt, Human
uguauaaacaagaaaaa

SEQ ID NO: 1281784 - RNA, 23 nt, Human
uguauaaacaagaaaaauaaaga

SEQ ID NO: 1281785 - RNA, 19 nt, Human
uguauaaaugucuuuaaug

SEQ ID NO: 1281786 - RNA, 16 nt, Human
uguauaacuaggagcu

SEQ ID NO: 1281787 - RNA, 15 nt, Human
uguauaacuaggagc

SEQ ID NO: 1281788 - RNA, 13 nt, Human
uguauaacuuuaa

SEQ ID NO: 1281789 - RNA, 18 nt, Human
uguauaacuuuaacuucu

SEQ ID NO: 1281790 - RNA, 17 nt, Human
uguauaagauccuagau

SEQ ID NO: 1281791 - RNA, 22 nt, Human
uguaugaaagauggcugugccu

SEQ ID NO: 1281792 - RNA, 16 nt, Human
uguaugacugcacaug

SEQ ID NO: 1281793 - RNA, 17 nt, Human
uguaugacugcacauga

SEQ ID NO: 1281794 - RNA, 16 nt, Human
ugggaguugucauuaa

SEQ ID NO: 1281795 - RNA, 18 nt, Human
ugggaggagggcaggcau

SEQ ID NO: 1281796 - RNA, 18 nt, Human
ugggaguguugagcaucu

SEQ ID NO: 1281797 - RNA, 22 nt, Human
ugggaguugaucgccuuuccca

SEQ ID NO: 1281798 - RNA, 14 nt, Human
ugggaguuguaguu

SEQ ID NO: 1281799 - RNA, 19 nt, Human
ugggaucacauguggacuu

SEQ ID NO: 1281800 - RNA, 20 nt, Human
ugggaguuuuuaugagaaac

SEQ ID NO: 1281801 - RNA, 14 nt, Human
ugggaggagggcag

SEQ ID NO: 1281802 - RNA, 17 nt, Human
ugggaggagggcaggca

SEQ ID NO: 1281803 - RNA, 14 nt, Human
ugggacagggagga

SEQ ID NO: 1281804 - RNA, 16 nt, Human
ugggacagcaaccugu

SEQ ID NO: 1281805 - RNA, 21 nt, Human
ugggcagcaauuuaaauguua

SEQ ID NO: 1281806 - RNA, 12 nt, Human
ugggcagccaga

SEQ ID NO: 1281807 - RNA, 13 nt, Human
ugggcagccagac

SEQ ID NO: 1281808 - RNA, 21 nt, Human
ugggcagccagaccagcaggc

SEQ ID NO: 1281809 - RNA, 19 nt, Human
ugggcagcaauuuaaaugu

SEQ ID NO: 1281810 - RNA, 18 nt, Human
ugggcagcaauuuaaaug

SEQ ID NO: 1281811 - RNA, 17 nt, Human
ugggcagcaauuuaaau

SEQ ID NO: 1281812 - RNA, 18 nt, Human
ugggaugguggagggcca

SEQ ID NO: 1281813 - RNA, 16 nt, Human
ugggaugguggagggc

SEQ ID NO: 1281814 - RNA, 17 nt, Human
ugggaugguggagggcc

SEQ ID NO: 1281815 - RNA, 14 nt, Human
ugggcccugggcug

SEQ ID NO: 1281816 - RNA, 16 nt, Human
ugggcccugggcugga

SEQ ID NO: 1281817 - RNA, 17 nt, Human
ugggcccugggcuggaa

SEQ ID NO: 1281818 - RNA, 13 nt, Human
ugggcccuggggc

SEQ ID NO: 1281819 - RNA, 14 nt, Human
ugggcccuggggcc

SEQ ID NO: 1281820 - RNA, 16 nt, Human
ugggcccuggggccug

SEQ ID NO: 1281821 - RNA, 19 nt, Human
ugggcccuggggccuguac

SEQ ID NO: 1281822 - RNA, 22 nt, Human
ugggcccuggggccuguacugc

SEQ ID NO: 1281823 - RNA, 13 nt, Human
ugggcccuuugag

SEQ ID NO: 1281824 - RNA, 13 nt, Human
ugggccgcugcca

SEQ ID NO: 1281825 - RNA, 14 nt, Human
ugggccgcugccac

SEQ ID NO: 1281826 - RNA, 21 nt, Human
ugggccggcuucaugccagcu

SEQ ID NO: 1281827 - RNA, 14 nt, Human
ugggccuaggcugc

SEQ ID NO: 1281828 - RNA, 15 nt, Human
ugggccuaggcugca

SEQ ID NO: 1281829 - RNA, 15 nt, Human
ugggccuauggagag

SEQ ID NO: 1281830 - RNA, 17 nt, Human
ugggccuauggagagcc

SEQ ID NO: 1281831 - RNA, 18 nt, Human
ugggccuauggagagccc

SEQ ID NO: 1281832 - RNA, 19 nt, Human
ugggccuauggagagcccu

SEQ ID NO: 1281833 - RNA, 20 nt, Human
ugggccuauggagagcccug

SEQ ID NO: 1281834 - RNA, 22 nt, Human
ugggccuauggagagcccuggg

SEQ ID NO: 1281835 - RNA, 19 nt, Human
ugggguuaucucuguguua

SEQ ID NO: 1281836 - RNA, 13 nt, Human
uggggggggugcu

SEQ ID NO: 1281837 - RNA, 13 nt, Human
uggggugugcugg

SEQ ID NO: 1281838 - RNA, 15 nt, Human
uggggugugcuggga

SEQ ID NO: 1281839 - RNA, 18 nt, Human
ugggguuaucucuguguu

SEQ ID NO: 1281840 - RNA, 20 nt, Human
ugggggccuggcuggcugag

SEQ ID NO: 1281841 - RNA, 17 nt, Human
ugggggccuggcuggcu

SEQ ID NO: 1281842 - RNA, 19 nt, Human
ugggggccuggcuggcuga

SEQ ID NO: 1281843 - RNA, 20 nt, Human
uggggccaggcugggucgcc

SEQ ID NO: 1281844 - RNA, 19 nt, Human
uggggccagauccagccug

SEQ ID NO: 1281845 - RNA, 20 nt, Human
uggggccagauccagccugg

SEQ ID NO: 1281846 - RNA, 17 nt, Human
uggggccaggcuggguc

SEQ ID NO: 1281847 - RNA, 20 nt, Human
uggggcagcuccucugucuc

SEQ ID NO: 1281848 - RNA, 13 nt, Human
uggggccagaucc

SEQ ID NO: 1281849 - RNA, 14 nt, Human
uggggccagaucca

SEQ ID NO: 1281850 - RNA, 15 nt, Human
uggggccagauccag

SEQ ID NO: 1281851 - RNA, 16 nt, Human
uggggccagauccagc

SEQ ID NO: 1281852 - RNA, 18 nt, Human
uggggccagauccagccu

SEQ ID NO: 1281853 - RNA, 11 nt, Human
ugggggccugg

SEQ ID NO: 1281854 - RNA, 12 nt, Human
ugggggccuggc

SEQ ID NO: 1281855 - RNA, 13 nt, Human
ugggggccuggcu

SEQ ID NO: 1281856 - RNA, 15 nt, Human
ugggggccuggcugg

SEQ ID NO: 1281857 - RNA, 18 nt, Human
ugggggcagcacaggagg

SEQ ID NO: 1281858 - RNA, 21 nt, Human
uggggccagauccagccuggg

SEQ ID NO: 1281859 - RNA, 23 nt, Human
ugggccugcugcugagaaccugg

SEQ ID NO: 1281860 - RNA, 21 nt, Human
ugggccuauggagagcccugg

SEQ ID NO: 1281861 - RNA, 13 nt, Human
ugggccugcagaa

SEQ ID NO: 1281862 - RNA, 14 nt, Human
ugggccugcuccag

SEQ ID NO: 1281863 - RNA, 15 nt, Human
ugggccugcuccaga

SEQ ID NO: 1281864 - RNA, 16 nt, Human
ugggccugcuccagac

SEQ ID NO: 1281865 - RNA, 18 nt, Human
ugggccugcuccagaccu

SEQ ID NO: 1281866 - RNA, 19 nt, Human
ugggccugcuccagaccug

SEQ ID NO: 1281867 - RNA, 20 nt, Human
ugggccugcuccagaccuga

SEQ ID NO: 1281868 - RNA, 12 nt, Human
ugggccugcugc

SEQ ID NO: 1281869 - RNA, 13 nt, Human
ugggccugcugcu

SEQ ID NO: 1281870 - RNA, 14 nt, Human
ugggccugcugcug

SEQ ID NO: 1281871 - RNA, 15 nt, Human
ugggccugcugcuga

SEQ ID NO: 1281872 - RNA, 16 nt, Human
ugggccugcugcugag

SEQ ID NO: 1281873 - RNA, 17 nt, Human
ugggccugcugcugaga

SEQ ID NO: 1281874 - RNA, 18 nt, Human
ugggccugcugcugagaa

SEQ ID NO: 1281875 - RNA, 15 nt, Human
uggggcagcuccucu

SEQ ID NO: 1281876 - RNA, 16 nt, Human
uggggcagcuccucug

SEQ ID NO: 1281877 - RNA, 14 nt, Human
ugggaaugaagcaa

SEQ ID NO: 1281878 - RNA, 18 nt, Human
uggcuuuucacugcuggc

SEQ ID NO: 1281879 - RNA, 19 nt, Human
uggcuuuucacugcuggcu

SEQ ID NO: 1281880 - RNA, 21 nt, Human
uggcuuuucacugcuggcugc

SEQ ID NO: 1281881 - RNA, 22 nt, Human
uggcuuuucacugcuggcugcc

SEQ ID NO: 1281882 - RNA, 16 nt, Human
uggcuuuucacugcug

SEQ ID NO: 1281883 - RNA, 16 nt, Human
uggcuugggcagcauc

SEQ ID NO: 1281884 - RNA, 17 nt, Human
uggcuuggccacagcca

SEQ ID NO: 1281885 - RNA, 18 nt, Human
uggcuuggccacagccag

SEQ ID NO: 1281886 - RNA, 19 nt, Human
uggcuuggccacagccagg

SEQ ID NO: 1281887 - RNA, 20 nt, Human
uggcuuggccacagccaggg

SEQ ID NO: 1281888 - RNA, 23 nt, Human
uggcuuggccacagccaggggag

SEQ ID NO: 1281889 - RNA, 22 nt, Human
uggcuuggccacagccagggga

SEQ ID NO: 1281890 - RNA, 18 nt, Human
uggcuugggacuaaaugc

SEQ ID NO: 1281891 - RNA, 23 nt, Human
uggcuugggacuaaaugcccugc

SEQ ID NO: 1281892 - RNA, 22 nt, Human
uggcuucccgcucagcccuccc

SEQ ID NO: 1281893 - RNA, 19 nt, Human
uggcuucccgcucagcccu

SEQ ID NO: 1281894 - RNA, 20 nt, Human
uggcuucccgcucagcccuc

SEQ ID NO: 1281895 - RNA, 21 nt, Human
uggcuucccgcucagcccucc

SEQ ID NO: 1281896 - RNA, 19 nt, Human
uggcuggccucacccaccc

SEQ ID NO: 1281897 - RNA, 15 nt, Human
uggcuggccucaccc

SEQ ID NO: 1281898 - RNA, 12 nt, Human
uggcuggcugag

SEQ ID NO: 1281899 - RNA, 13 nt, Human
uggcuggcugagg

SEQ ID NO: 1281900 - RNA, 14 nt, Human
uggcuggcugaggg

SEQ ID NO: 1281901 - RNA, 15 nt, Human
uggcuggcugagggc

SEQ ID NO: 1281902 - RNA, 18 nt, Human
uggcuggcugagggcagu

SEQ ID NO: 1281903 - RNA, 17 nt, Human
uggcuggcugagggcag

SEQ ID NO: 1281904 - RNA, 15 nt, Human
uggcugggacguggc

SEQ ID NO: 1281905 - RNA, 19 nt, Human
uggcugggacguggcucag

SEQ ID NO: 1281906 - RNA, 23 nt, Human
uggcugggacguggcucagccag

SEQ ID NO: 1281907 - RNA, 22 nt, Human
uggccucucucuaggguacaug

SEQ ID NO: 1281908 - RNA, 23 nt, Human
uggccuucggccuccauccugag

SEQ ID NO: 1281909 - RNA, 22 nt, Human
uggccuucggccuccauccuga

SEQ ID NO: 1281910 - RNA, 17 nt, Human
uggcuccagcuggccgg

SEQ ID NO: 1281911 - RNA, 23 nt, Human
uggcuccagaugcagggcaguca

SEQ ID NO: 1281912 - RNA, 20 nt, Human
uggcuccagaugcagggcag

SEQ ID NO: 1281913 - RNA, 21 nt, Human
uggcuccagaugcagggcagu

SEQ ID NO: 1281914 - RNA, 18 nt, Human
uggccuagaccagcagac

SEQ ID NO: 1281915 - RNA, 21 nt, Human
uggccuagaccagcagacaga

SEQ ID NO: 1281916 - RNA, 15 nt, Human
uggccucacccaccc

SEQ ID NO: 1281917 - RNA, 22 nt, Human
uggccucacccaccccugcaca

SEQ ID NO: 1281918 - RNA, 20 nt, Human
uggccucccaaaugagccau

SEQ ID NO: 1281919 - RNA, 13 nt, Human
uggccuccugccu

SEQ ID NO: 1281920 - RNA, 14 nt, Human
uggccuccugccuc

SEQ ID NO: 1281921 - RNA, 15 nt, Human
uggccuccugccucu

SEQ ID NO: 1281922 - RNA, 16 nt, Human
uggccuccugccucua

SEQ ID NO: 1281923 - RNA, 21 nt, Human
uggccuccugccucuacuggg

SEQ ID NO: 1281924 - RNA, 14 nt, Human
uggccucucuaucc

SEQ ID NO: 1281925 - RNA, 17 nt, Human
uggccucucuauccucu

SEQ ID NO: 1281926 - RNA, 23 nt, Human
uggccucucuauccucucuuccu

SEQ ID NO: 1281927 - RNA, 15 nt, Human
uggccucucucuagg

SEQ ID NO: 1281928 - RNA, 11 nt, Human
uggcagcucug

SEQ ID NO: 1281929 - RNA, 21 nt, Human
uggcagcucuggacagcccca

SEQ ID NO: 1281930 - RNA, 22 nt, Human
uggcagcucuggacagccccac

SEQ ID NO: 1281931 - RNA, 13 nt, Human
uggccccagcaca

SEQ ID NO: 1281932 - RNA, 14 nt, Human
uggccccagcacag

SEQ ID NO: 1281933 - RNA, 17 nt, Human
uggccccagcacagcuu

SEQ ID NO: 1281934 - RNA, 18 nt, Human
uggccccagcacagcuug

SEQ ID NO: 1281935 - RNA, 19 nt, Human
uggccccagcacagcuuga

SEQ ID NO: 1281936 - RNA, 12 nt, Human
uggccccaggac

SEQ ID NO: 1281937 - RNA, 15 nt, Human
uggccccaggaccug

SEQ ID NO: 1281938 - RNA, 20 nt, Human
uggccccaggaccuggcugc

SEQ ID NO: 1281939 - RNA, 19 nt, Human
uggccccucccccugccag

SEQ ID NO: 1281940 - RNA, 10 nt, Human
uggccccucu

SEQ ID NO: 1281941 - RNA, 12 nt, Human
uggccccucuga

SEQ ID NO: 1281942 - RNA, 13 nt, Human
uggccccucugac

SEQ ID NO: 1281943 - RNA, 14 nt, Human
uggccccucugacc

SEQ ID NO: 1281944 - RNA, 16 nt, Human
uggccccucugaccug

SEQ ID NO: 1281945 - RNA, 18 nt, Human
uggccccucugaccugca

SEQ ID NO: 1281946 - RNA, 14 nt, Human
uggccccugaacaa

SEQ ID NO: 1281947 - RNA, 20 nt, Human
uggccccugaacaagaauug

SEQ ID NO: 1281948 - RNA, 23 nt, Human
uggccuaaccugccgagagucca

SEQ ID NO: 1281949 - RNA, 15 nt, Human
uggccccucucccuu

SEQ ID NO: 1281950 - RNA, 21 nt, Human
uggccuaagaggcugcccucc

SEQ ID NO: 1281951 - RNA, 22 nt, Human
uggccuaagaggcugcccuccu

SEQ ID NO: 1281952 - RNA, 17 nt, Human
ugcuuuggaaaacccag

SEQ ID NO: 1281953 - RNA, 13 nt, Human
ugcuuuggaaauc

SEQ ID NO: 1281954 - RNA, 22 nt, Human
ugcuuugcccuucuuucuaccc

SEQ ID NO: 1281955 - RNA, 18 nt, Human
ugcuuucgaacugcuagu

SEQ ID NO: 1281956 - RNA, 15 nt, Human
ugcuuucuccuuuaa

SEQ ID NO: 1281957 - RNA, 20 nt, Human
ugcuuucuccuuuaauugua

SEQ ID NO: 1281958 - RNA, 22 nt, Human
ugcuuucuccuuuaauuguaaa

SEQ ID NO: 1281959 - RNA, 14 nt, Human
ugcuuucugaucaa

SEQ ID NO: 1281960 - RNA, 15 nt, Human
ugcuuugagagagaa

SEQ ID NO: 1281961 - RNA, 17 nt, Human
ugcuuugauauuucaau

SEQ ID NO: 1281962 - RNA, 13 nt, Human
ugcuuugauauuu

SEQ ID NO: 1281963 - RNA, 22 nt, Human
ugcuucuguuuuauaauuuugu

SEQ ID NO: 1281964 - RNA, 14 nt, Human
ugcuuguuaacuga

SEQ ID NO: 1281965 - RNA, 16 nt, Human
ugcuuguuaacugagu

SEQ ID NO: 1281966 - RNA, 20 nt, Human
ugcuuuccauucgugaaaac

SEQ ID NO: 1281967 - RNA, 17 nt, Human
ugcuuucgguuccaguu

SEQ ID NO: 1281968 - RNA, 21 nt, Human
ugcuuuccauucgugaaaaca

SEQ ID NO: 1281969 - RNA, 13 nt, Human
uggaaccuuguuu

SEQ ID NO: 1281970 - RNA, 13 nt, Human
uggaacuugaacu

SEQ ID NO: 1281971 - RNA, 15 nt, Human
uggaacuugaacuga

SEQ ID NO: 1281972 - RNA, 16 nt, Human
uggaacuugaacugau

SEQ ID NO: 1281973 - RNA, 22 nt, Human
uggaacuugccugccuuuccau

SEQ ID NO: 1281974 - RNA, 20 nt, Human
uggaacauaaaaaggacauc

SEQ ID NO: 1281975 - RNA, 18 nt, Human
uggaaccucagccuggcc

SEQ ID NO: 1281976 - RNA, 19 nt, Human
uggaaccucagccuggcca

SEQ ID NO: 1281977 - RNA, 23 nt, Human
uggaaccucagccuggccagaca

SEQ ID NO: 1281978 - RNA, 18 nt, Human
uggaacauaaaaaggaca

SEQ ID NO: 1281979 - RNA, 13 nt, Human
uggaacacuucga

SEQ ID NO: 1281980 - RNA, 22 nt, Human
uggaaaaguauguuagugcaaa

SEQ ID NO: 1281981 - RNA, 16 nt, Human
uggaaaccuuccaccc

SEQ ID NO: 1281982 - RNA, 19 nt, Human
uggaaaccuuccacccagu

SEQ ID NO: 1281983 - RNA, 13 nt, Human
ugcuucuccagcc

SEQ ID NO: 1281984 - RNA, 13 nt, Human
ugcuucucccagg

SEQ ID NO: 1281985 - RNA, 16 nt, Human
ugcuucucccaggcaa

SEQ ID NO: 1281986 - RNA, 17 nt, Human
ugcuucucccaggcaag

SEQ ID NO: 1281987 - RNA, 20 nt, Human
ugcuucucccaggcaaggcu

SEQ ID NO: 1281988 - RNA, 21 nt, Human
ugcuucucccaggcaaggcug

SEQ ID NO: 1281989 - RNA, 22 nt, Human
ugcuucucccaggcaaggcugu

SEQ ID NO: 1281990 - RNA, 12 nt, Human
ugcuucucugac

SEQ ID NO: 1281991 - RNA, 13 nt, Human
ugcuucucugacu

SEQ ID NO: 1281992 - RNA, 17 nt, Human
ugcuucuguuuuauaau

SEQ ID NO: 1281993 - RNA, 22 nt, Human
ugcuucucagauuucugaggaa

SEQ ID NO: 1281994 - RNA, 21 nt, Human
ugcuucucagauuucugagga

SEQ ID NO: 1281995 - RNA, 15 nt, Human
ugcuucgggcccuuc

SEQ ID NO: 1281996 - RNA, 14 nt, Human
ugcuuccuccugga

SEQ ID NO: 1281997 - RNA, 15 nt, Human
ugcuuccuccuggaa

SEQ ID NO: 1281998 - RNA, 22 nt, Human
ugcuuccugucuuauccuccac

SEQ ID NO: 1281999 - RNA, 13 nt, Human
ugcuucgggcccu

SEQ ID NO: 1282000 - RNA, 16 nt, Human
ugcuucccuuuccuga

SEQ ID NO: 1282001 - RNA, 12 nt, Human
ugcuuccuccug

SEQ ID NO: 1282002 - RNA, 13 nt, Human
ugcuuccuccugg

SEQ ID NO: 1282003 - RNA, 14 nt, Human
ugcuuaccucucag

SEQ ID NO: 1282004 - RNA, 22 nt, Human
ugcuuaccucucagccuuagcu

SEQ ID NO: 1282005 - RNA, 12 nt, Human
ugcuuccagugu

SEQ ID NO: 1282006 - RNA, 15 nt, Human
ugcuucccuaaucua

SEQ ID NO: 1282007 - RNA, 20 nt, Human
ugcuuaauucaaauaauaau

SEQ ID NO: 1282008 - RNA, 18 nt, Human
ugcuuaauucaaauaaua

SEQ ID NO: 1282009 - RNA, 17 nt, Human
ugcuuaauucaaauaau

SEQ ID NO: 1282010 - RNA, 16 nt, Human
ugcuuaauucaaauaa

SEQ ID NO: 1282011 - RNA, 22 nt, Human
ugcuuaacagggaacgugauua

SEQ ID NO: 1282012 - RNA, 15 nt, Human
ugcuuaauaaauugu

SEQ ID NO: 1282013 - RNA, 20 nt, Human
ugcuuaaagaauucaaauuu

SEQ ID NO: 1282014 - RNA, 19 nt, Human
ugcuuaaagaauucaaauu

SEQ ID NO: 1282015 - RNA, 18 nt, Human
ugcuuaaagaauucaaau

SEQ ID NO: 1282016 - RNA, 19 nt, Human
ugcuuaaaauaagcaggug

SEQ ID NO: 1282017 - RNA, 12 nt, Human
ugcuguuuuguu

SEQ ID NO: 1282018 - RNA, 13 nt, Human
ugcuguuuuguua

SEQ ID NO: 1282019 - RNA, 16 nt, Human
ugcuguuuuguuauau

SEQ ID NO: 1282020 - RNA, 19 nt, Human
ugcuguuuuguuauauaau

SEQ ID NO: 1282021 - RNA, 18 nt, Human
ugcuguuuuguuauauaa

SEQ ID NO: 1282022 - RNA, 14 nt, Human
ugcuuaaaauaagc

SEQ ID NO: 1282023 - RNA, 15 nt, Human
ugcuuaaaauaagca

SEQ ID NO: 1282024 - RNA, 17 nt, Human
ugcuuaaaauaagcagg

SEQ ID NO: 1282025 - RNA, 16 nt, Human
ugccugucccaccccc

SEQ ID NO: 1282026 - RNA, 19 nt, Human
ugccugucccacccccacc

SEQ ID NO: 1282027 - RNA, 23 nt, Human
ugcuguuuuaaacauuaauagca

SEQ ID NO: 1282028 - RNA, 18 nt, Human
ugcuguuuugauuuguac

SEQ ID NO: 1282029 - RNA, 19 nt, Human
uggaucaaauccagccugc

SEQ ID NO: 1282030 - RNA, 14 nt, Human
uggaucacaaagug

SEQ ID NO: 1282031 - RNA, 15 nt, Human
uggaucacaaagugg

SEQ ID NO: 1282032 - RNA, 16 nt, Human
uggaucacaagaugga

SEQ ID NO: 1282033 - RNA, 17 nt, Human
uggauauaguuuuacuu

SEQ ID NO: 1282034 - RNA, 16 nt, Human
uggauauguaaaacau

SEQ ID NO: 1282035 - RNA, 21 nt, Human
uggauauguaaaacauuuauu

SEQ ID NO: 1282036 - RNA, 17 nt, Human
uggauauguaaaacauu

SEQ ID NO: 1282037 - RNA, 14 nt, Human
uggauauuguuacg

SEQ ID NO: 1282038 - RNA, 11 nt, Human
uggauauuugu

SEQ ID NO: 1282039 - RNA, 13 nt, Human
uggauauuuguau

SEQ ID NO: 1282040 - RNA, 18 nt, Human
uggagaugaggccagacc

SEQ ID NO: 1282041 - RNA, 17 nt, Human
uggagaugaggccagac

SEQ ID NO: 1282042 - RNA, 16 nt, Human
uggagaugaggccaga

SEQ ID NO: 1282043 - RNA, 15 nt, Human
uggagaugaggccag

SEQ ID NO: 1282044 - RNA, 14 nt, Human
uggagaugaggcca

SEQ ID NO: 1282045 - RNA, 20 nt, Human
uggagauccuccugcagacc

SEQ ID NO: 1282046 - RNA, 21 nt, Human
uggagauccuccugcagacca

SEQ ID NO: 1282047 - RNA, 17 nt, Human
uggagaguuuccugaaa

SEQ ID NO: 1282048 - RNA, 23 nt, Human
uggagaucaccaguguguggcuu

SEQ ID NO: 1282049 - RNA, 14 nt, Human
uggagauccuccug

SEQ ID NO: 1282050 - RNA, 16 nt, Human
uggagauccuccugca

SEQ ID NO: 1282051 - RNA, 18 nt, Human
uggagauccuccugcaga

SEQ ID NO: 1282052 - RNA, 21 nt, Human
uggaggggcagagccaggaag

SEQ ID NO: 1282053 - RNA, 18 nt, Human
uggaggggcagagccagg

SEQ ID NO: 1282054 - RNA, 16 nt, Human
uggaggggcagagcca

SEQ ID NO: 1282055 - RNA, 14 nt, Human
uggaggggcagagc

SEQ ID NO: 1282056 - RNA, 13 nt, Human
uggaggggcagag

SEQ ID NO: 1282057 - RNA, 23 nt, Human
uggaggggcagagccaggaagau

SEQ ID NO: 1282058 - RNA, 16 nt, Human
uggaggggcuggggac

SEQ ID NO: 1282059 - RNA, 19 nt, Human
uggagggggaauggcagca

SEQ ID NO: 1282060 - RNA, 13 nt, Human
uggcaaggacuuu

SEQ ID NO: 1282061 - RNA, 19 nt, Human
uggcaaggacuuuguacau

SEQ ID NO: 1282062 - RNA, 20 nt, Human
uggcaaggacuuuguacauu

SEQ ID NO: 1282063 - RNA, 21 nt, Human
uggcaaggacuuuguacauuu

SEQ ID NO: 1282064 - RNA, 16 nt, Human
uggcaaggaaaaacag

SEQ ID NO: 1282065 - RNA, 16 nt, Human
uggauuuaaaagccug

SEQ ID NO: 1282066 - RNA, 18 nt, Human
uggauuuaaaagccugcu

SEQ ID NO: 1282067 - RNA, 20 nt, Human
uggauuuaaaagccugcuca

SEQ ID NO: 1282068 - RNA, 16 nt, Human
uggcaaccagaccauu

SEQ ID NO: 1282069 - RNA, 15 nt, Human
uggaacuugccugcc

SEQ ID NO: 1282070 - RNA, 18 nt, Human
uggaacuugccugccuuu

SEQ ID NO: 1282071 - RNA, 21 nt, Human
uggaacuugccugccuuucca

SEQ ID NO: 1282072 - RNA, 16 nt, Human
uggaagaaggggcagg

SEQ ID NO: 1282073 - RNA, 21 nt, Human
uggacucuggugccuccagag

SEQ ID NO: 1282074 - RNA, 22 nt, Human
uggacucuggugccuccagagg

SEQ ID NO: 1282075 - RNA, 13 nt, Human
uggacucuguccu

SEQ ID NO: 1282076 - RNA, 15 nt, Human
uggacucuguccuga

SEQ ID NO: 1282077 - RNA, 17 nt, Human
uggacucuguccugaag

SEQ ID NO: 1282078 - RNA, 22 nt, Human
uggacucuguccugaaggccug

SEQ ID NO: 1282079 - RNA, 23 nt, Human
uggacucuguccugaaggccuga

SEQ ID NO: 1282080 - RNA, 15 nt, Human
uggacugucauagaa

SEQ ID NO: 1282081 - RNA, 21 nt, Human
uggacugucauagaaauuaca

SEQ ID NO: 1282082 - RNA, 14 nt, Human
uggacugguuuuca

SEQ ID NO: 1282083 - RNA, 17 nt, Human
uggagaccaccagggca

SEQ ID NO: 1282084 - RNA, 13 nt, Human
uggagaccaccag

SEQ ID NO: 1282085 - RNA, 13 nt, Human
uggagagcccugg

SEQ ID NO: 1282086 - RNA, 14 nt, Human
uggagagcccuggg

SEQ ID NO: 1282087 - RNA, 15 nt, Human
uggagagcccuggga

SEQ ID NO: 1282088 - RNA, 16 nt, Human
uggagagcccugggac

SEQ ID NO: 1282089 - RNA, 20 nt, Human
uggagagcccugggaccgcu

SEQ ID NO: 1282090 - RNA, 18 nt, Human
uggagagcccugggaccg

SEQ ID NO: 1282091 - RNA, 14 nt, Human
uggagagcuaggag

SEQ ID NO: 1282092 - RNA, 15 nt, Human
uggagagcuaggagc

SEQ ID NO: 1282093 - RNA, 17 nt, Human
uggagagcuaggagcaa

SEQ ID NO: 1282094 - RNA, 23 nt, Human
uggagagcuaggagcaaagccug

SEQ ID NO: 1282095 - RNA, 22 nt, Human
uggagagcuaggagcaaagccu

SEQ ID NO: 1282096 - RNA, 15 nt, Human
uggagaguuuccuga

SEQ ID NO: 1282097 - RNA, 16 nt, Human
uggagaguuuccugaa

SEQ ID NO: 1282098 - RNA, 13 nt, Human
ugauguacaugua

SEQ ID NO: 1282099 - RNA, 22 nt, Human
ugauguaaucuugaauuguaac

SEQ ID NO: 1282100 - RNA, 21 nt, Human
ugauguaaggaugggcauggu

SEQ ID NO: 1282101 - RNA, 21 nt, Human
ugauguaaaaucuugucaugu

SEQ ID NO: 1282102 - RNA, 11 nt, Human
ugauguaaaau

SEQ ID NO: 1282103 - RNA, 15 nt, Human
ugauguaaaaucuug

SEQ ID NO: 1282104 - RNA, 16 nt, Human
ugauguaaaaucuugu

SEQ ID NO: 1282105 - RNA, 19 nt, Human
ugauguaaaaucuugucau

SEQ ID NO: 1282106 - RNA, 23 nt, Human
ugauguaaaaucuugucaugugu

SEQ ID NO: 1282107 - RNA, 15 nt, Human
ugaugcugccccuca

SEQ ID NO: 1282108 - RNA, 21 nt, Human
ugaucugaugcaagcaagaaa

SEQ ID NO: 1282109 - RNA, 20 nt, Human
ugaucugauaggguuuguga

SEQ ID NO: 1282110 - RNA, 22 nt, Human
ugaucugauaggguuugugaca

SEQ ID NO: 1282111 - RNA, 13 nt, Human
ugaucuggaaccc

SEQ ID NO: 1282112 - RNA, 14 nt, Human
ugaucuggaaccca

SEQ ID NO: 1282113 - RNA, 19 nt, Human
ugaugaaaaauugcugacu

SEQ ID NO: 1282114 - RNA, 21 nt, Human
ugaugaaaaauugcugacugu

SEQ ID NO: 1282115 - RNA, 12 nt, Human
ugaugaaaauaa

SEQ ID NO: 1282116 - RNA, 13 nt, Human
ugaugaaaauaaa

SEQ ID NO: 1282117 - RNA, 14 nt, Human
ugaugccaaaaaaa

SEQ ID NO: 1282118 - RNA, 18 nt, Human
ugaugccaaaaaaaaaua

SEQ ID NO: 1282119 - RNA, 21 nt, Human
ugaugccaaaaaaaaauacau

SEQ ID NO: 1282120 - RNA, 15 nt, Human
ugaugaaaauaaaga

SEQ ID NO: 1282121 - RNA, 16 nt, Human
ugaugaaaauaaagaa

SEQ ID NO: 1282122 - RNA, 17 nt, Human
ugaugaaaauaaagaau

SEQ ID NO: 1282123 - RNA, 19 nt, Human
ugaugaaaauaaagaaugg

SEQ ID NO: 1282124 - RNA, 23 nt, Human
ugauauaaguguguguuuuucau

SEQ ID NO: 1282125 - RNA, 17 nt, Human
ugauauaaguguguguu

SEQ ID NO: 1282126 - RNA, 24 nt, Human
ugauaguuguaccgcaaugugacu

SEQ ID NO: 1282127 - RNA, 19 nt, Human
ugauauaaaucagauucuu

SEQ ID NO: 1282128 - RNA, 16 nt, Human
ugauauagaaguauaa

SEQ ID NO: 1282129 - RNA, 21 nt, Human
ugauauagaaguauaaagaau

SEQ ID NO: 1282130 - RNA, 18 nt, Human
ugauauauaaguguacau

SEQ ID NO: 1282131 - RNA, 19 nt, Human
ugauauauaaguguacaua

SEQ ID NO: 1282132 - RNA, 22 nt, Human
ugauauauaaguguacauaugu

SEQ ID NO: 1282133 - RNA, 13 nt, Human
ugauauauuuuac

SEQ ID NO: 1282134 - RNA, 14 nt, Human
ugauauauuuuaca

SEQ ID NO: 1282135 - RNA, 18 nt, Human
ugaucagaccauaauguu

SEQ ID NO: 1282136 - RNA, 21 nt, Human
ugaucagagccgugguccuuu

SEQ ID NO: 1282137 - RNA, 22 nt, Human
ugaucagagccgugguccuuug

SEQ ID NO: 1282138 - RNA, 23 nt, Human
ugaucagagccgugguccuuugg

SEQ ID NO: 1282139 - RNA, 15 nt, Human
ugauauauuuuacaa

SEQ ID NO: 1282140 - RNA, 23 nt, Human
ugauaugcacaauguagauaagu

SEQ ID NO: 1282141 - RNA, 15 nt, Human
ugauaugcacaaugu

SEQ ID NO: 1282142 - RNA, 18 nt, Human
ugauaugcauauuuguuu

SEQ ID NO: 1282143 - RNA, 19 nt, Human
ugauaugcauauuuguuua

SEQ ID NO: 1282144 - RNA, 18 nt, Human
ugaucucagcucacugca

SEQ ID NO: 1282145 - RNA, 19 nt, Human
ugaucucagcucacugcaa

SEQ ID NO: 1282146 - RNA, 20 nt, Human
ugaucugaugcaagcaagaa

SEQ ID NO: 1282147 - RNA, 16 nt, Human
ugaucagccccacccu

SEQ ID NO: 1282148 - RNA, 20 nt, Human
ugaucaguuaagaaauuuca

SEQ ID NO: 1282149 - RNA, 21 nt, Human
ugaucaguuuuuucaccugga

SEQ ID NO: 1282150 - RNA, 22 nt, Human
ugagguuuuauuucauuuuuca

SEQ ID NO: 1282151 - RNA, 17 nt, Human
ugaguccuggaugauac

SEQ ID NO: 1282152 - RNA, 19 nt, Human
ugaguccuggaugauacua

SEQ ID NO: 1282153 - RNA, 21 nt, Human
ugaguccuggaugauacuaau

SEQ ID NO: 1282154 - RNA, 15 nt, Human
ugaggugugucacaa

SEQ ID NO: 1282155 - RNA, 14 nt, Human
ugagguuacuggaa

SEQ ID NO: 1282156 - RNA, 17 nt, Human
ugagguuacuggaaauu

SEQ ID NO: 1282157 - RNA, 13 nt, Human
ugaggucuguucc

SEQ ID NO: 1282158 - RNA, 14 nt, Human
ugaggucuguuccu

SEQ ID NO: 1282159 - RNA, 16 nt, Human
ugaggucuguuccuuu

SEQ ID NO: 1282160 - RNA, 18 nt, Human
ugaggcuguccuguacau

SEQ ID NO: 1282161 - RNA, 11 nt, Human
ugaggcugugg

SEQ ID NO: 1282162 - RNA, 21 nt, Human
ugaggcuguggucacagcgga

SEQ ID NO: 1282163 - RNA, 19 nt, Human
ugaggagcagcaggagggg

SEQ ID NO: 1282164 - RNA, 14 nt, Human
ugaggcuuuccaug

SEQ ID NO: 1282165 - RNA, 13 nt, Human
ugaggcuuuggau

SEQ ID NO: 1282166 - RNA, 18 nt, Human
ugaggcuuuggauuugac

SEQ ID NO: 1282167 - RNA, 23 nt, Human
ugaggcuuuggauuugacauugc

SEQ ID NO: 1282168 - RNA, 17 nt, Human
ugagggaaaagaaaaag

SEQ ID NO: 1282169 - RNA, 19 nt, Human
ugaggcuuuccaugggacc

SEQ ID NO: 1282170 - RNA, 14 nt, Human
ugaggcuggcacag

SEQ ID NO: 1282171 - RNA, 15 nt, Human
ugaggcuggcacagg

SEQ ID NO: 1282172 - RNA, 17 nt, Human
ugaggcuggcacaggac

SEQ ID NO: 1282173 - RNA, 11 nt, Human
ugaggcuggca

SEQ ID NO: 1282174 - RNA, 23 nt, Human
ugaggacuuaaaauauuccugca

SEQ ID NO: 1282175 - RNA, 17 nt, Human
ugaggaccguaaggccu

SEQ ID NO: 1282176 - RNA, 17 nt, Human
ugaggacugauuucaga

SEQ ID NO: 1282177 - RNA, 19 nt, Human
ugaggagacacaccugagg

SEQ ID NO: 1282178 - RNA, 15 nt, Human
ugaggagacacaccu

SEQ ID NO: 1282179 - RNA, 18 nt, Human
ugaggagauucugccuuu

SEQ ID NO: 1282180 - RNA, 22 nt, Human
ugaggagcagcaggagggggga

SEQ ID NO: 1282181 - RNA, 11 nt, Human
ugaggagcccc

SEQ ID NO: 1282182 - RNA, 14 nt, Human
ugaggagccccagc

SEQ ID NO: 1282183 - RNA, 16 nt, Human
ugaggagccccagcua

SEQ ID NO: 1282184 - RNA, 18 nt, Human
ugauagguauaaguggug

SEQ ID NO: 1282185 - RNA, 22 nt, Human
ugauaggaagaggggaagcaga

SEQ ID NO: 1282186 - RNA, 19 nt, Human
ugauaggguuugugacagg

SEQ ID NO: 1282187 - RNA, 22 nt, Human
ugauagguuauuuugauguaaa

SEQ ID NO: 1282188 - RNA, 16 nt, Human
ugauagucuuuugcuu

SEQ ID NO: 1282189 - RNA, 17 nt, Human
ugauagucuuuugcuuu

SEQ ID NO: 1282190 - RNA, 20 nt, Human
ugauaaaucauuuuauguca

SEQ ID NO: 1282191 - RNA, 15 nt, Human
ugauaaaucauuuua

SEQ ID NO: 1282192 - RNA, 14 nt, Human
ugauaaaucauuuu

SEQ ID NO: 1282193 - RNA, 22 nt, Human
ugaguuggcuuaccuggcccau

SEQ ID NO: 1282194 - RNA, 17 nt, Human
ugaguuggggucuggca

SEQ ID NO: 1282195 - RNA, 19 nt, Human
ugaguuggggucuggcagc

SEQ ID NO: 1282196 - RNA, 21 nt, Human
ugaguuggggucuggcagccu

SEQ ID NO: 1282197 - RNA, 16 nt, Human
ugaguuuaccuuguau

SEQ ID NO: 1282198 - RNA, 23 nt, Human
ugaguuuaccuuguauacuguag

SEQ ID NO: 1282199 - RNA, 11 nt, Human
ugaguuuccua

SEQ ID NO: 1282200 - RNA, 16 nt, Human
ugauaaaaccauguag

SEQ ID NO: 1282201 - RNA, 15 nt, Human
ugauaaagagacagu

SEQ ID NO: 1282202 - RNA, 18 nt, Human
ugauaaagauuuuuuaau

SEQ ID NO: 1282203 - RNA, 19 nt, Human
ugauaaagauuuuuuaaua

SEQ ID NO: 1282204 - RNA, 20 nt, Human
ugauaaagauuuuuuaauaa

SEQ ID NO: 1282205 - RNA, 13 nt, Human
ugauaaagccuca

SEQ ID NO: 1282206 - RNA, 20 nt, Human
ugauaaagccucaagguuuu

SEQ ID NO: 1282207 - RNA, 17 nt, Human
ugauaaaggccagauua

SEQ ID NO: 1282208 - RNA, 17 nt, Human
ugagcagucaggaaaga

SEQ ID NO: 1282209 - RNA, 20 nt, Human
ugagcagucaggaaagagaa

SEQ ID NO: 1282210 - RNA, 20 nt, Human
ugagaugcuagaacucccuu

SEQ ID NO: 1282211 - RNA, 16 nt, Human
ugagaugcuagaacuc

SEQ ID NO: 1282212 - RNA, 14 nt, Human
ugagaugcuagaac

SEQ ID NO: 1282213 - RNA, 14 nt, Human
ugagcaguccuugg

SEQ ID NO: 1282214 - RNA, 16 nt, Human
ugagcaguccuuggcc

SEQ ID NO: 1282215 - RNA, 17 nt, Human
ugagcaguccuuggccu

SEQ ID NO: 1282216 - RNA, 13 nt, Human
ugagccccaaaag

SEQ ID NO: 1282217 - RNA, 14 nt, Human
ugagcccagggagg

SEQ ID NO: 1282218 - RNA, 15 nt, Human
ugagcccagggaggc

SEQ ID NO: 1282219 - RNA, 17 nt, Human
ugagcccagggaggccg

SEQ ID NO: 1282220 - RNA, 17 nt, Human
ugagcccagcuggguca

SEQ ID NO: 1282221 - RNA, 21 nt, Human
ugagcccagcugggucaggca

SEQ ID NO: 1282222 - RNA, 11 nt, Human
ugagcccaggg

SEQ ID NO: 1282223 - RNA, 12 nt, Human
ugagcccaggga

SEQ ID NO: 1282224 - RNA, 13 nt, Human
ugagcccagggag

SEQ ID NO: 1282225 - RNA, 15 nt, Human
ugagcucccacaagc

SEQ ID NO: 1282226 - RNA, 18 nt, Human
ugagcucccacaagccug

SEQ ID NO: 1282227 - RNA, 19 nt, Human
ugagcucccacaagccuga

SEQ ID NO: 1282228 - RNA, 20 nt, Human
ugagcucccacaagccugag

SEQ ID NO: 1282229 - RNA, 21 nt, Human
ugagcucccacaagccugagg

SEQ ID NO: 1282230 - RNA, 12 nt, Human
ugagcucucugu

SEQ ID NO: 1282231 - RNA, 13 nt, Human
ugagcucucugcc

SEQ ID NO: 1282232 - RNA, 12 nt, Human
ugagcucugaga

SEQ ID NO: 1282233 - RNA, 15 nt, Human
ugagcucugagaggc

SEQ ID NO: 1282234 - RNA, 17 nt, Human
ugagcucugagaggccc

SEQ ID NO: 1282235 - RNA, 18 nt, Human
ugagcucugagaggcccu

SEQ ID NO: 1282236 - RNA, 19 nt, Human
ugagcucugagaggcccug

SEQ ID NO: 1282237 - RNA, 20 nt, Human
ugagcucugagaggcccugg

SEQ ID NO: 1282238 - RNA, 21 nt, Human
ugagcucugagaggcccugga

SEQ ID NO: 1282239 - RNA, 23 nt, Human
ugagcucugagaggcccuggauc

SEQ ID NO: 1282240 - RNA, 22 nt, Human
ugagcucugagaggcccuggau

SEQ ID NO: 1282241 - RNA, 12 nt, Human
ugagcucuucau

SEQ ID NO: 1282242 - RNA, 15 nt, Human
ugagcucuucauguu

SEQ ID NO: 1282243 - RNA, 16 nt, Human
ugagcucuucauguuu

SEQ ID NO: 1282244 - RNA, 18 nt, Human
ugagcucuucauguuuca

SEQ ID NO: 1282245 - RNA, 19 nt, Human
ugagaggcugggaauggag

SEQ ID NO: 1282246 - RNA, 13 nt, Human
ugagaggcccugg

SEQ ID NO: 1282247 - RNA, 14 nt, Human
ugagaggcccugga

SEQ ID NO: 1282248 - RNA, 16 nt, Human
ugagaggcccuggauc

SEQ ID NO: 1282249 - RNA, 17 nt, Human
ugagaggcccuggauca

SEQ ID NO: 1282250 - RNA, 23 nt, Human
ugagaggcccuggaucagcgugg

SEQ ID NO: 1282251 - RNA, 14 nt, Human
ugagagguuugacu

SEQ ID NO: 1282252 - RNA, 22 nt, Human
ugagagguuugacuagaugaug

SEQ ID NO: 1282253 - RNA, 20 nt, Human
ugagaugauacauccaaagc

SEQ ID NO: 1282254 - RNA, 18 nt, Human
ugagaccuaaucucugua

SEQ ID NO: 1282255 - RNA, 19 nt, Human
ugagaccuaaucucuguaa

SEQ ID NO: 1282256 - RNA, 20 nt, Human
ugagaccuaaucucuguaaa

SEQ ID NO: 1282257 - RNA, 12 nt, Human
ugagaggcccug

SEQ ID NO: 1282258 - RNA, 17 nt, Human
ugagaaaucuaaaaaac

SEQ ID NO: 1282259 - RNA, 17 nt, Human
ugacuguagcuuuggaa

SEQ ID NO: 1282260 - RNA, 16 nt, Human
ugacuguacuccuccc

SEQ ID NO: 1282261 - RNA, 17 nt, Human
ugacuguacuccuccca

SEQ ID NO: 1282262 - RNA, 18 nt, Human
ugacuguacuccucccag

SEQ ID NO: 1282263 - RNA, 22 nt, Human
ugacuguacuccucccaggcgc

SEQ ID NO: 1282264 - RNA, 18 nt, Human
ugagaaauuuaaacuaua

SEQ ID NO: 1282265 - RNA, 16 nt, Human
ugagacagcucugcau

SEQ ID NO: 1282266 - RNA, 14 nt, Human
ugagacagcucugc

SEQ ID NO: 1282267 - RNA, 13 nt, Human
ugagaaauuuaaa

SEQ ID NO: 1282268 - RNA, 14 nt, Human
ugagaaauuuaaac

SEQ ID NO: 1282269 - RNA, 15 nt, Human
ugagaaauuuaaacu

SEQ ID NO: 1282270 - RNA, 17 nt, Human
ugagaaauuuaaacuau

SEQ ID NO: 1282271 - RNA, 14 nt, Human
ugacugccaagacu

SEQ ID NO: 1282272 - RNA, 21 nt, Human
ugacugccaagacugcugugg

SEQ ID NO: 1282273 - RNA, 22 nt, Human
ugacugccaagacugcuguggc

SEQ ID NO: 1282274 - RNA, 13 nt, Human
ugacugccaagcc

SEQ ID NO: 1282275 - RNA, 14 nt, Human
ugacugccaagcca

SEQ ID NO: 1282276 - RNA, 16 nt, Human
ugacugccaagccaug

SEQ ID NO: 1282277 - RNA, 17 nt, Human
ugacugccaagccaugg

SEQ ID NO: 1282278 - RNA, 23 nt, Human
ugacugguguuaucaccgugggc

SEQ ID NO: 1282279 - RNA, 13 nt, Human
ugacucuuaagaa

SEQ ID NO: 1282280 - RNA, 20 nt, Human
ugacugagggugaguuggcu

SEQ ID NO: 1282281 - RNA, 12 nt, Human
ugacucuuaaga

SEQ ID NO: 1282282 - RNA, 14 nt, Human
ugacgucugggugg

SEQ ID NO: 1282283 - RNA, 15 nt, Human
ugacgucuggguggc

SEQ ID NO: 1282284 - RNA, 17 nt, Human
ugacgugaccggacuuu

SEQ ID NO: 1282285 - RNA, 22 nt, Human
ugacgugaccggacuuuucugc

SEQ ID NO: 1282286 - RNA, 24 nt, Human
ugacgugaccggacuuuucugcaa

SEQ ID NO: 1282287 - RNA, 18 nt, Human
ugacgucuggguggcccu

SEQ ID NO: 1282288 - RNA, 17 nt, Human
ugaccuuuuauguagua

SEQ ID NO: 1282289 - RNA, 18 nt, Human
ugaccuuuuauguaguaa

SEQ ID NO: 1282290 - RNA, 23 nt, Human
ugaccuuuuauguaguaauugac

SEQ ID NO: 1282291 - RNA, 15 nt, Human
ugacgacaagugcug

SEQ ID NO: 1282292 - RNA, 20 nt, Human
ugacgacaagugcugaacag

SEQ ID NO: 1282293 - RNA, 23 nt, Human
ugacgccaggguaugaagagugu

SEQ ID NO: 1282294 - RNA, 19 nt, Human
ugacggccagggagaagcu

SEQ ID NO: 1282295 - RNA, 16 nt, Human
ucuugaauaauguaag

SEQ ID NO: 1282296 - RNA, 13 nt, Human
ucuugaaggugcu

SEQ ID NO: 1282297 - RNA, 20 nt, Human
ugaccucaagugaucugccc

SEQ ID NO: 1282298 - RNA, 17 nt, Human
ugaccuaguuuuccaug

SEQ ID NO: 1282299 - RNA, 22 nt, Human
ugaccuaguuuuccaugcgugu

SEQ ID NO: 1282300 - RNA, 17 nt, Human
ugaccuauaccuguguu

SEQ ID NO: 1282301 - RNA, 23 nt, Human
ugaccuauaccuguguuucuugc

SEQ ID NO: 1282302 - RNA, 21 nt, Human
ugaccguguuggucuguacug

SEQ ID NO: 1282303 - RNA, 17 nt, Human
ugaccuaaauuauuuac

SEQ ID NO: 1282304 - RNA, 20 nt, Human
ugaccguguuggucuguacu

SEQ ID NO: 1282305 - RNA, 19 nt, Human
ugaccguguuggucuguac

SEQ ID NO: 1282306 - RNA, 12 nt, Human
ugacccugccuc

SEQ ID NO: 1282307 - RNA, 13 nt, Human
ugacccugccucu

SEQ ID NO: 1282308 - RNA, 18 nt, Human
ugacccugccucucccag

SEQ ID NO: 1282309 - RNA, 19 nt, Human
ugacccugccucucccagg

SEQ ID NO: 1282310 - RNA, 22 nt, Human
ugacccugccucucccaggcag

SEQ ID NO: 1282311 - RNA, 23 nt, Human
ugacccuccaccgcagaaggaag

SEQ ID NO: 1282312 - RNA, 14 nt, Human
ugacccuccccaaa

SEQ ID NO: 1282313 - RNA, 22 nt, Human
ugacccuccaccgcagaaggaa

SEQ ID NO: 1282314 - RNA, 17 nt, Human
ugacccugagcugacca

SEQ ID NO: 1282315 - RNA, 15 nt, Human
ugacccugaagugag

SEQ ID NO: 1282316 - RNA, 14 nt, Human
ugacccugagcuga

SEQ ID NO: 1282317 - RNA, 18 nt, Human
ugaccucgugauccaccc

SEQ ID NO: 1282318 - RNA, 19 nt, Human
ugaccuccgccauccaccc

SEQ ID NO: 1282319 - RNA, 16 nt, Human
ugaccucagcuuugau

SEQ ID NO: 1282320 - RNA, 13 nt, Human
ugaccuccagcuu

SEQ ID NO: 1282321 - RNA, 22 nt, Human
ugaccuccaugacugcacagua

SEQ ID NO: 1282322 - RNA, 18 nt, Human
ugaccuccagcuuuccug

SEQ ID NO: 1282323 - RNA, 17 nt, Human
ugaccuccgccauccac

SEQ ID NO: 1282324 - RNA, 14 nt, Human
ugcauuauauuuau

SEQ ID NO: 1282325 - RNA, 21 nt, Human
ugcauguugucuaagaaauug

SEQ ID NO: 1282326 - RNA, 15 nt, Human
ugcauuacugcaugc

SEQ ID NO: 1282327 - RNA, 17 nt, Human
ugcauuacugcaugcac

SEQ ID NO: 1282328 - RNA, 18 nt, Human
ugcauuacugcaugcacu

SEQ ID NO: 1282329 - RNA, 15 nt, Human
ugccaccacgcccgg

SEQ ID NO: 1282330 - RNA, 23 nt, Human
ugcauuuuggagaguuuccugaa

SEQ ID NO: 1282331 - RNA, 19 nt, Human
ugcauuagggaugccuccu

SEQ ID NO: 1282332 - RNA, 22 nt, Human
ugcauuagggaugccuccuuuc

SEQ ID NO: 1282333 - RNA, 22 nt, Human
ugcauuauaucaaaucuaccac

SEQ ID NO: 1282334 - RNA, 13 nt, Human
ugcauuuguuuau

SEQ ID NO: 1282335 - RNA, 18 nt, Human
ugcauuuguuuauguaau

SEQ ID NO: 1282336 - RNA, 19 nt, Human
ugcauuuguuuauguaauu

SEQ ID NO: 1282337 - RNA, 20 nt, Human
ugcauuuguuuauguaauuu

SEQ ID NO: 1282338 - RNA, 21 nt, Human
ugcauuuguuuauguaauuuc

SEQ ID NO: 1282339 - RNA, 22 nt, Human
ugcauuuguuuauguaauuuca

SEQ ID NO: 1282340 - RNA, 21 nt, Human
ugcauuuguuuuguuuacaga

SEQ ID NO: 1282341 - RNA, 18 nt, Human
ugcauguugucuaagaaa

SEQ ID NO: 1282342 - RNA, 19 nt, Human
ugcauguugucuaagaaau

SEQ ID NO: 1282343 - RNA, 20 nt, Human
ugcauguugucuaagaaauu

SEQ ID NO: 1282344 - RNA, 17 nt, Human
ugcauguaguaacacua

SEQ ID NO: 1282345 - RNA, 14 nt, Human
ugcauguaguaaca

SEQ ID NO: 1282346 - RNA, 15 nt, Human
ugcauccuccgccuc

SEQ ID NO: 1282347 - RNA, 14 nt, Human
ugcaugguuucagc

SEQ ID NO: 1282348 - RNA, 15 nt, Human
ugcaugguuucagca

SEQ ID NO: 1282349 - RNA, 16 nt, Human
ugcaugguuucagcac

SEQ ID NO: 1282350 - RNA, 17 nt, Human
ugcaugguuucagcacu

SEQ ID NO: 1282351 - RNA, 22 nt, Human
ugcaugguuucagcacuagcca

SEQ ID NO: 1282352 - RNA, 23 nt, Human
ugcauguaacgcaaguucccagu

SEQ ID NO: 1282353 - RNA, 18 nt, Human
ugcaugguuucagcacua

SEQ ID NO: 1282354 - RNA, 17 nt, Human
ugcauguacuguauauu

SEQ ID NO: 1282355 - RNA, 12 nt, Human
ugcauguaguaa

SEQ ID NO: 1282356 - RNA, 19 nt, Human
ugcagauaaacaguaguga

SEQ ID NO: 1282357 - RNA, 14 nt, Human
ugcauccuccgccu

SEQ ID NO: 1282358 - RNA, 14 nt, Human
ugcaucccuggcug

SEQ ID NO: 1282359 - RNA, 18 nt, Human
ugcagauggugagagaua

SEQ ID NO: 1282360 - RNA, 18 nt, Human
ugcauccauucuccugag

SEQ ID NO: 1282361 - RNA, 19 nt, Human
ugcauccauucuccugagg

SEQ ID NO: 1282362 - RNA, 22 nt, Human
ugcaucccaaaccacgccucuu

SEQ ID NO: 1282363 - RNA, 23 nt, Human
ugcaucccaaaccacgccucuug

SEQ ID NO: 1282364 - RNA, 20 nt, Human
ugccaugacaacuucuaauu

SEQ ID NO: 1282365 - RNA, 16 nt, Human
ugccaugaugccucug

SEQ ID NO: 1282366 - RNA, 20 nt, Human
ugccaugaugccucugucuu

SEQ ID NO: 1282367 - RNA, 18 nt, Human
ugccauguacaguauguu

SEQ ID NO: 1282368 - RNA, 17 nt, Human
ugccaugaugccucugu

SEQ ID NO: 1282369 - RNA, 19 nt, Human
ugccaugaugccucugucu

SEQ ID NO: 1282370 - RNA, 20 nt, Human
ugccauguaggguucccuua

SEQ ID NO: 1282371 - RNA, 18 nt, Human
ugccaugucaaacaaaua

SEQ ID NO: 1282372 - RNA, 17 nt, Human
ugccaugucaaacaaau

SEQ ID NO: 1282373 - RNA, 19 nt, Human
ugcccacggagucgugggg

SEQ ID NO: 1282374 - RNA, 13 nt, Human
ugccacucacuag

SEQ ID NO: 1282375 - RNA, 14 nt, Human
ugccacucacuagg

SEQ ID NO: 1282376 - RNA, 15 nt, Human
ugccacucacuaggc

SEQ ID NO: 1282377 - RNA, 17 nt, Human
ugccacucacuaggccc

SEQ ID NO: 1282378 - RNA, 18 nt, Human
ugccacucacuaggcccc

SEQ ID NO: 1282379 - RNA, 19 nt, Human
ugccacucacuaggccccc

SEQ ID NO: 1282380 - RNA, 20 nt, Human
ugccacucacuaggccccca

SEQ ID NO: 1282381 - RNA, 21 nt, Human
ugccacucacuaggcccccac

SEQ ID NO: 1282382 - RNA, 22 nt, Human
ugccacucacuaggcccccacu

SEQ ID NO: 1282383 - RNA, 22 nt, Human
ugccacugaggggggauccagu

SEQ ID NO: 1282384 - RNA, 17 nt, Human
ugccaggugaggucagc

SEQ ID NO: 1282385 - RNA, 15 nt, Human
ugccagggcagggcc

SEQ ID NO: 1282386 - RNA, 16 nt, Human
ugccagggcagggccc

SEQ ID NO: 1282387 - RNA, 17 nt, Human
ugccagggccccucucc

SEQ ID NO: 1282388 - RNA, 18 nt, Human
ugccagggccccucuccc

SEQ ID NO: 1282389 - RNA, 21 nt, Human
ugccagggccccucuccccag

SEQ ID NO: 1282390 - RNA, 23 nt, Human
ugccagggccccucuccccaggg

SEQ ID NO: 1282391 - RNA, 18 nt, Human
ugcccugcccugccaccu

SEQ ID NO: 1282392 - RNA, 15 nt, Human
ugcccugcccugcca

SEQ ID NO: 1282393 - RNA, 14 nt, Human
ugcccugcccugcc

SEQ ID NO: 1282394 - RNA, 19 nt, Human
ugcccugcgggucacagga

SEQ ID NO: 1282395 - RNA, 18 nt, Human
ugcccugcugagucccag

SEQ ID NO: 1282396 - RNA, 22 nt, Human
ugcccugcugagucccaggcug

SEQ ID NO: 1282397 - RNA, 23 nt, Human
ugcccugcugagucccaggcuga

SEQ ID NO: 1282398 - RNA, 18 nt, Human
ugcccgggagcucaggaa

SEQ ID NO: 1282399 - RNA, 18 nt, Human
ugcccggggaaaggcaag

SEQ ID NO: 1282400 - RNA, 17 nt, Human
ugcccgggagcucagga

SEQ ID NO: 1282401 - RNA, 17 nt, Human
ugcccagaauaaguuau

SEQ ID NO: 1282402 - RNA, 19 nt, Human
ugcccagaauaaguuauug

SEQ ID NO: 1282403 - RNA, 21 nt, Human
ugcccagaauaaguuauugca

SEQ ID NO: 1282404 - RNA, 21 nt, Human
ugcccggggaaaggcaagguc

SEQ ID NO: 1282405 - RNA, 16 nt, Human
ugcccugcugcccucc

SEQ ID NO: 1282406 - RNA, 14 nt, Human
ugcccugcugcccu

SEQ ID NO: 1282407 - RNA, 17 nt, Human
ugcccugcugcccuccc

SEQ ID NO: 1282408 - RNA, 18 nt, Human
ugcccuggauccaucagg

SEQ ID NO: 1282409 - RNA, 20 nt, Human
ugcccuggugcugccacacu

SEQ ID NO: 1282410 - RNA, 18 nt, Human
ugcccuggugcugccaca

SEQ ID NO: 1282411 - RNA, 21 nt, Human
ugcccuggugcugccacacuu

SEQ ID NO: 1282412 - RNA, 16 nt, Human
ugcccugguggcccuc

SEQ ID NO: 1282413 - RNA, 21 nt, Human
ugcccugguggcccucucccc

SEQ ID NO: 1282414 - RNA, 22 nt, Human
ugcccugguggcccucuccccu

SEQ ID NO: 1282415 - RNA, 15 nt, Human
ugcccugguuuccug

SEQ ID NO: 1282416 - RNA, 14 nt, Human
ugccguaauuuaac

SEQ ID NO: 1282417 - RNA, 19 nt, Human
ugccgucagugcugugcug

SEQ ID NO: 1282418 - RNA, 20 nt, Human
ugccguggauugcacguggc

SEQ ID NO: 1282419 - RNA, 22 nt, Human
ugccguggauugcacguggccu

SEQ ID NO: 1282420 - RNA, 23 nt, Human
ugccguggggccgccgccucuuu

SEQ ID NO: 1282421 - RNA, 14 nt, Human
ugccucuucccucu

SEQ ID NO: 1282422 - RNA, 14 nt, Human
ugccucuucauucu

SEQ ID NO: 1282423 - RNA, 13 nt, Human
ugccucuuccucc

SEQ ID NO: 1282424 - RNA, 21 nt, Human
ugccucuuccagucuuccuga

SEQ ID NO: 1282425 - RNA, 23 nt, Human
ugccucuuccagucuuccugaca

SEQ ID NO: 1282426 - RNA, 17 nt, Human
ugccucuuccuugaaga

SEQ ID NO: 1282427 - RNA, 13 nt, Human
ugccucuucuggg

SEQ ID NO: 1282428 - RNA, 16 nt, Human
ugccugccagcugcac

SEQ ID NO: 1282429 - RNA, 23 nt, Human
ugccugcauaggaguuuggagga

SEQ ID NO: 1282430 - RNA, 15 nt, Human
ugccugccagcugca

SEQ ID NO: 1282431 - RNA, 19 nt, Human
ugccugccagcugcacuga

SEQ ID NO: 1282432 - RNA, 14 nt, Human
ugccugguacagua

SEQ ID NO: 1282433 - RNA, 15 nt, Human
ugccugguacaguau

SEQ ID NO: 1282434 - RNA, 20 nt, Human
ugccugguauauccaaaagc

SEQ ID NO: 1282435 - RNA, 23 nt, Human
ugccugguauauccaaaagcuuu

SEQ ID NO: 1282436 - RNA, 16 nt, Human
ugccucccuucaugca

SEQ ID NO: 1282437 - RNA, 13 nt, Human
ugccucccugagc

SEQ ID NO: 1282438 - RNA, 19 nt, Human
ugccucccuuguggcagca

SEQ ID NO: 1282439 - RNA, 19 nt, Human
ugccuccguccccugccca

SEQ ID NO: 1282440 - RNA, 23 nt, Human
ugccuccguccccugcccaugcu

SEQ ID NO: 1282441 - RNA, 12 nt, Human
ugccuccucacc

SEQ ID NO: 1282442 - RNA, 22 nt, Human
ugccucccucucguaagauuuc

SEQ ID NO: 1282443 - RNA, 23 nt, Human
ugccucccucucguaagauuucc

SEQ ID NO: 1282444 - RNA, 14 nt, Human
ugccucccugagcu

SEQ ID NO: 1282445 - RNA, 18 nt, Human
ugccuaagaauaaacauu

SEQ ID NO: 1282446 - RNA, 19 nt, Human
ugccuaagaauaaacauuu

SEQ ID NO: 1282447 - RNA, 21 nt, Human
ugccucugugcugugugugac

SEQ ID NO: 1282448 - RNA, 13 nt, Human
ugccucugccugu

SEQ ID NO: 1282449 - RNA, 14 nt, Human
ugccucugccuguc

SEQ ID NO: 1282450 - RNA, 18 nt, Human
ugccucugccugucuccc

SEQ ID NO: 1282451 - RNA, 21 nt, Human
ugccucgaaacacagaaaccu

SEQ ID NO: 1282452 - RNA, 19 nt, Human
ugccuccucacccccagcu

SEQ ID NO: 1282453 - RNA, 24 nt, Human
ugccuccucacccccagcuuugcu

SEQ ID NO: 1282454 - RNA, 13 nt, Human
ugccucgaaacac

SEQ ID NO: 1282455 - RNA, 17 nt, Human
ugccucgaaacacagaa

SEQ ID NO: 1282456 - RNA, 14 nt, Human
ugcaaaaaggguca

SEQ ID NO: 1282457 - RNA, 19 nt, Human
ugcaaaaacuacaaccaau

SEQ ID NO: 1282458 - RNA, 21 nt, Human
ugcaaaaacucuuugagaggg

SEQ ID NO: 1282459 - RNA, 19 nt, Human
ugcaaaaggacucucagga

SEQ ID NO: 1282460 - RNA, 16 nt, Human
ugauuuuuuuuuuuca

SEQ ID NO: 1282461 - RNA, 18 nt, Human
ugauuuuuuuuucauaca

SEQ ID NO: 1282462 - RNA, 22 nt, Human
ugauuuuuuuuucauacacuua

SEQ ID NO: 1282463 - RNA, 22 nt, Human
ugauuuuuuuuuuuuuccuguc

SEQ ID NO: 1282464 - RNA, 20 nt, Human
ugauuuuuuuuuuuuuuucc

SEQ ID NO: 1282465 - RNA, 21 nt, Human
ugauuuuuuuuuuuuuuuccu

SEQ ID NO: 1282466 - RNA, 18 nt, Human
ugauuuuuaugccaccug

SEQ ID NO: 1282467 - RNA, 23 nt, Human
ugauuuuuauaaauacugcaaau

SEQ ID NO: 1282468 - RNA, 15 nt, Human
ugauuuuucuuuaca

SEQ ID NO: 1282469 - RNA, 14 nt, Human
ugauuuuucuuuac

SEQ ID NO: 1282470 - RNA, 21 nt, Human
ugauuuuugccucuuccaguc

SEQ ID NO: 1282471 - RNA, 22 nt, Human
ugauuuuugccucuuccagucu

SEQ ID NO: 1282472 - RNA, 17 nt, Human
ugauuuuuuuuaauuac

SEQ ID NO: 1282473 - RNA, 16 nt, Human
ugauuuuuuuuccuuu

SEQ ID NO: 1282474 - RNA, 22 nt, Human
ugauuuuaggagcuaaggcucu

SEQ ID NO: 1282475 - RNA, 20 nt, Human
ugauuuucaaagcuuuuucc

SEQ ID NO: 1282476 - RNA, 13 nt, Human
ugauuuucuggau

SEQ ID NO: 1282477 - RNA, 15 nt, Human
ugauuuugaaaccau

SEQ ID NO: 1282478 - RNA, 15 nt, Human
ugauuuugaaaucau

SEQ ID NO: 1282479 - RNA, 11 nt, Human
ugauuuugaac

SEQ ID NO: 1282480 - RNA, 23 nt, Human
ugauuuugaaccugaugaaaaua

SEQ ID NO: 1282481 - RNA, 17 nt, Human
ugaugugcuuaacaggg

SEQ ID NO: 1282482 - RNA, 19 nt, Human
ugauuuuaagaauccaaac

SEQ ID NO: 1282483 - RNA, 19 nt, Human
ugauuuuaaguuucucugc

SEQ ID NO: 1282484 - RNA, 22 nt, Human
ugauuuuaaguuucucugcaga

SEQ ID NO: 1282485 - RNA, 16 nt, Human
ugauuuuaauaauaua

SEQ ID NO: 1282486 - RNA, 15 nt, Human
ugauuuuagccuucu

SEQ ID NO: 1282487 - RNA, 19 nt, Human
ugauuuuagccuucucugu

SEQ ID NO: 1282488 - RNA, 20 nt, Human
ugauuuuaggagcuaaggcu

SEQ ID NO: 1282489 - RNA, 13 nt, Human
ugaugugcuuaac

SEQ ID NO: 1282490 - RNA, 19 nt, Human
ugaugugcacguaaaguac

SEQ ID NO: 1282491 - RNA, 12 nt, Human
ugaugucuccua

SEQ ID NO: 1282492 - RNA, 16 nt, Human
ugaugucuccuaagca

SEQ ID NO: 1282493 - RNA, 23 nt, Human
ugaugucuuuguuaagacugcug

SEQ ID NO: 1282494 - RNA, 20 nt, Human
ugaugucuccuaagcaccug

SEQ ID NO: 1282495 - RNA, 22 nt, Human
ugaugugaagccaauucagaca

SEQ ID NO: 1282496 - RNA, 14 nt, Human
ugaugugaagccaa

SEQ ID NO: 1282497 - RNA, 18 nt, Human
ugcaacuuuguauaaaag

SEQ ID NO: 1282498 - RNA, 18 nt, Human
ugcaacuuguaaaugugg

SEQ ID NO: 1282499 - RNA, 16 nt, Human
ugcaacuuguaaaugu

SEQ ID NO: 1282500 - RNA, 22 nt, Human
ugcaacucugaaggguaauuau

SEQ ID NO: 1282501 - RNA, 14 nt, Human
ugcaaccuucaccu

SEQ ID NO: 1282502 - RNA, 16 nt, Human
ugcaacucaaggacuu

SEQ ID NO: 1282503 - RNA, 17 nt, Human
ugcaacucaaggacuuu

SEQ ID NO: 1282504 - RNA, 18 nt, Human
ugcaaccuucgccaccug

SEQ ID NO: 1282505 - RNA, 21 nt, Human
ugcaaccuucgccaccugggu

SEQ ID NO: 1282506 - RNA, 14 nt, Human
ugcaaccucugccu

SEQ ID NO: 1282507 - RNA, 22 nt, Human
ugcaaccucgcuggacucucag

SEQ ID NO: 1282508 - RNA, 18 nt, Human
ugcaaccucuuggccuga

SEQ ID NO: 1282509 - RNA, 14 nt, Human
ugcaaccucgcugg

SEQ ID NO: 1282510 - RNA, 19 nt, Human
ugcaaccucgcuggacucu

SEQ ID NO: 1282511 - RNA, 20 nt, Human
ugcaaccucgcuggacucuc

SEQ ID NO: 1282512 - RNA, 15 nt, Human
ugcaaccuccaccuc

SEQ ID NO: 1282513 - RNA, 18 nt, Human
ugcaaccuccaccuccug

SEQ ID NO: 1282514 - RNA, 19 nt, Human
ugcaaccuccaccuccugg

SEQ ID NO: 1282515 - RNA, 20 nt, Human
ugcaaccuccaccuccuggg

SEQ ID NO: 1282516 - RNA, 21 nt, Human
ugcaaccuccaccuccugggu

SEQ ID NO: 1282517 - RNA, 13 nt, Human
ugcaaccuccacc

SEQ ID NO: 1282518 - RNA, 16 nt, Human
ugcaaccgucuguuau

SEQ ID NO: 1282519 - RNA, 20 nt, Human
ugcaaccaggaacagcaaau

SEQ ID NO: 1282520 - RNA, 16 nt, Human
ugcaaccauuugaaac

SEQ ID NO: 1282521 - RNA, 24 nt, Human
ugcaacaggguauggacuaucugu

SEQ ID NO: 1282522 - RNA, 15 nt, Human
ugcaacaugaugagg

SEQ ID NO: 1282523 - RNA, 12 nt, Human
ugcaaccaggaa

SEQ ID NO: 1282524 - RNA, 17 nt, Human
ugcaaccaggaacagca

SEQ ID NO: 1282525 - RNA, 20 nt, Human
ugcaaaaucaguuuuccucu

SEQ ID NO: 1282526 - RNA, 15 nt, Human
ugcaaaaucaguuuu

SEQ ID NO: 1282527 - RNA, 14 nt, Human
ugcaaaaucaguuu

SEQ ID NO: 1282528 - RNA, 22 nt, Human
ugcaaaaggacucucaggacca

SEQ ID NO: 1282529 - RNA, 14 nt, Human
ugcacaguaaaaau

SEQ ID NO: 1282530 - RNA, 16 nt, Human
ugcacaguauuuguaa

SEQ ID NO: 1282531 - RNA, 21 nt, Human
ugcacaaauauuuauuuucuu

SEQ ID NO: 1282532 - RNA, 15 nt, Human
ugcacagugcaucuc

SEQ ID NO: 1282533 - RNA, 17 nt, Human
ugcacagugacuucuga

SEQ ID NO: 1282534 - RNA, 19 nt, Human
ugcacagugacuucugaga

SEQ ID NO: 1282535 - RNA, 21 nt, Human
ugcacagugacuucugagauc

SEQ ID NO: 1282536 - RNA, 17 nt, Human
ugcacaguauuuguaau

SEQ ID NO: 1282537 - RNA, 18 nt, Human
ugcacaguauuuguaauu

SEQ ID NO: 1282538 - RNA, 19 nt, Human
ugcacaguauuuguaauua

SEQ ID NO: 1282539 - RNA, 20 nt, Human
ugcacaguauuuguaauuaa

SEQ ID NO: 1282540 - RNA, 23 nt, Human
ugcacaguauuuguaauuaaaag

SEQ ID NO: 1282541 - RNA, 17 nt, Human
ugcacagucacugcucu

SEQ ID NO: 1282542 - RNA, 15 nt, Human
ugcacagugacuucu

SEQ ID NO: 1282543 - RNA, 16 nt, Human
ugcacagugacuucug

SEQ ID NO: 1282544 - RNA, 16 nt, Human
ugcacagugcaucuca

SEQ ID NO: 1282545 - RNA, 17 nt, Human
ugcacagugcaucucag

SEQ ID NO: 1282546 - RNA, 20 nt, Human
ugcacagugacuucugagau

SEQ ID NO: 1282547 - RNA, 14 nt, Human
ugcaccuuucuagu

SEQ ID NO: 1282548 - RNA, 18 nt, Human
ugcacgaccgccccaguu

SEQ ID NO: 1282549 - RNA, 22 nt, Human
ugcacuuauuuaugaaccugcc

SEQ ID NO: 1282550 - RNA, 14 nt, Human
ugcacuucuuacaa

SEQ ID NO: 1282551 - RNA, 15 nt, Human
ugcacuucaaauuca

SEQ ID NO: 1282552 - RNA, 19 nt, Human
ugcagagguccacaacaca

SEQ ID NO: 1282553 - RNA, 18 nt, Human
ugcacugugaaggacccu

SEQ ID NO: 1282554 - RNA, 13 nt, Human
ugcacuguucccc

SEQ ID NO: 1282555 - RNA, 14 nt, Human
ugcacuguuccccc

SEQ ID NO: 1282556 - RNA, 19 nt, Human
ugcacuguucccccugugc

SEQ ID NO: 1282557 - RNA, 20 nt, Human
ugcacuguucccccugugca

SEQ ID NO: 1282558 - RNA, 21 nt, Human
ugcacuguucccccugugcag

SEQ ID NO: 1282559 - RNA, 23 nt, Human
ugcacuguucccccugugcagcc

SEQ ID NO: 1282560 - RNA, 15 nt, Human
ugcacuuacuugcuu

SEQ ID NO: 1282561 - RNA, 16 nt, Human
ugcacuuacuugcuua

SEQ ID NO: 1282562 - RNA, 18 nt, Human
ugcacuuacuugcuuauu

SEQ ID NO: 1282563 - RNA, 18 nt, Human
ugcaccuuucuaguugaa

SEQ ID NO: 1282564 - RNA, 15 nt, Human
ugcacugugaaggac

SEQ ID NO: 1282565 - RNA, 15 nt, Human
ugcacaaagcccuuc

SEQ ID NO: 1282566 - RNA, 17 nt, Human
ugcacaaagcccuucca

SEQ ID NO: 1282567 - RNA, 18 nt, Human
ugcacaaaacccagaccu

SEQ ID NO: 1282568 - RNA, 19 nt, Human
ugcacaaaacccagaccug

SEQ ID NO: 1282569 - RNA, 19 nt, Human
ugcaauguguguauaugga

SEQ ID NO: 1282570 - RNA, 14 nt, Human
ugcaauucaaaagu

SEQ ID NO: 1282571 - RNA, 16 nt, Human
ugcaauucaaaaguuc

SEQ ID NO: 1282572 - RNA, 17 nt, Human
ugcaauucaaaaguucc

SEQ ID NO: 1282573 - RNA, 18 nt, Human
ugcaauucaaaaguucca

SEQ ID NO: 1282574 - RNA, 19 nt, Human
ugcaauucaaaaguuccaa

SEQ ID NO: 1282575 - RNA, 21 nt, Human
ugcaauucaaaaguuccaaga

SEQ ID NO: 1282576 - RNA, 13 nt, Human
ugcaauuccccuc

SEQ ID NO: 1282577 - RNA, 14 nt, Human
ugcaauuccccucu

SEQ ID NO: 1282578 - RNA, 18 nt, Human
ugcaauuccccucugcug

SEQ ID NO: 1282579 - RNA, 21 nt, Human
ugcaauugccuuuuuucugua

SEQ ID NO: 1282580 - RNA, 23 nt, Human
ugcaauuggcaccgaagcccaga

SEQ ID NO: 1282581 - RNA, 22 nt, Human
ugcaauuggcaccgaagcccag

SEQ ID NO: 1282582 - RNA, 12 nt, Human
ugcaauuucaag

SEQ ID NO: 1282583 - RNA, 13 nt, Human
ugcaauuucaagg

SEQ ID NO: 1282584 - RNA, 17 nt, Human
ugcaauuucaagguucu

SEQ ID NO: 1282585 - RNA, 18 nt, Human
ugcaauuucaagguucua

SEQ ID NO: 1282586 - RNA, 19 nt, Human
ugcaauuucaagguucuaa

SEQ ID NO: 1282587 - RNA, 20 nt, Human
ugcaauuucaagguucuaac

SEQ ID NO: 1282588 - RNA, 22 nt, Human
ugcaagaaguggggcagcagca

SEQ ID NO: 1282589 - RNA, 22 nt, Human
ugcaauguaaauauuuuaaaga

SEQ ID NO: 1282590 - RNA, 13 nt, Human
ugcaauguguaua

SEQ ID NO: 1282591 - RNA, 14 nt, Human
ugcaauguguauaa

SEQ ID NO: 1282592 - RNA, 15 nt, Human
ugcaauguguauaaa

SEQ ID NO: 1282593 - RNA, 16 nt, Human
ugcaauguguauaaac

SEQ ID NO: 1282594 - RNA, 18 nt, Human
ugcaauguguauaaacaa

SEQ ID NO: 1282595 - RNA, 20 nt, Human
ugcaauguguauaaacaaga

SEQ ID NO: 1282596 - RNA, 21 nt, Human
ugcaauguguauaaacaagaa

SEQ ID NO: 1282597 - RNA, 20 nt, Human
ugcaauguguguauauggac

SEQ ID NO: 1282598 - RNA, 22 nt, Human
ucugucucuggauuauauuaug

SEQ ID NO: 1282599 - RNA, 18 nt, Human
ucuguccuugaaggacua

SEQ ID NO: 1282600 - RNA, 22 nt, Human
ucugucucgagcgcccugcaga

SEQ ID NO: 1282601 - RNA, 21 nt, Human
ucugucucgagcgcccugcag

SEQ ID NO: 1282602 - RNA, 15 nt, Human
ucuguccuugaagga

SEQ ID NO: 1282603 - RNA, 11 nt, Human
ucugguucuaa

SEQ ID NO: 1282604 - RNA, 13 nt, Human
ucugguucuaaca

SEQ ID NO: 1282605 - RNA, 13 nt, Human
ucugguuccuccc

SEQ ID NO: 1282606 - RNA, 21 nt, Human
ucugguuccagggucccucug

SEQ ID NO: 1282607 - RNA, 23 nt, Human
ucugguuccagggucccucugug

SEQ ID NO: 1282608 - RNA, 12 nt, Human
ucugguuccagg

SEQ ID NO: 1282609 - RNA, 13 nt, Human
ucugguuccaggg

SEQ ID NO: 1282610 - RNA, 14 nt, Human
ucugguuccagggu

SEQ ID NO: 1282611 - RNA, 20 nt, Human
ucugguuccuccccuccucc

SEQ ID NO: 1282612 - RNA, 21 nt, Human
ucugguuccuccccuccuccu

SEQ ID NO: 1282613 - RNA, 14 nt, Human
ucugguucucaauu

SEQ ID NO: 1282614 - RNA, 17 nt, Human
ucuggugagucaccacu

SEQ ID NO: 1282615 - RNA, 20 nt, Human
ucuggugagucaccacuuca

SEQ ID NO: 1282616 - RNA, 13 nt, Human
ucuggugccucca

SEQ ID NO: 1282617 - RNA, 15 nt, Human
ucuggugccuccaga

SEQ ID NO: 1282618 - RNA, 16 nt, Human
ucuggugccuccagag

SEQ ID NO: 1282619 - RNA, 12 nt, Human
ucugguggcccc

SEQ ID NO: 1282620 - RNA, 14 nt, Human
ucugguggccccgu

SEQ ID NO: 1282621 - RNA, 16 nt, Human
ucugguggucuguugg

SEQ ID NO: 1282622 - RNA, 21 nt, Human
ucugguguuggacaagcuucu

SEQ ID NO: 1282623 - RNA, 15 nt, Human
ucuggcuccagcugg

SEQ ID NO: 1282624 - RNA, 12 nt, Human
ucuggcucuaau

SEQ ID NO: 1282625 - RNA, 15 nt, Human
ucuggcucuaauuca

SEQ ID NO: 1282626 - RNA, 23 nt, Human
ucuggccuucggccuccauccug

SEQ ID NO: 1282627 - RNA, 18 nt, Human
ucuggccuucggccucca

SEQ ID NO: 1282628 - RNA, 17 nt, Human
ucuggccuucggccucc

SEQ ID NO: 1282629 - RNA, 20 nt, Human
ucuggcucuaauucacagug

SEQ ID NO: 1282630 - RNA, 16 nt, Human
ucuggcucuaauucac

SEQ ID NO: 1282631 - RNA, 13 nt, Human
ucugggaccucag

SEQ ID NO: 1282632 - RNA, 16 nt, Human
ucugggaccucaguuu

SEQ ID NO: 1282633 - RNA, 22 nt, Human
ucugcugauccucccaggcuuc

SEQ ID NO: 1282634 - RNA, 15 nt, Human
ucugcugaccugcug

SEQ ID NO: 1282635 - RNA, 18 nt, Human
ucugcugaccugcugacc

SEQ ID NO: 1282636 - RNA, 20 nt, Human
ucugcugaccugcugaccug

SEQ ID NO: 1282637 - RNA, 19 nt, Human
ucugcugaccugcugaccu

SEQ ID NO: 1282638 - RNA, 13 nt, Human
ucugcuggccucu

SEQ ID NO: 1282639 - RNA, 14 nt, Human
ucugcuggccucug

SEQ ID NO: 1282640 - RNA, 16 nt, Human
ucugcuggccucugcg

SEQ ID NO: 1282641 - RNA, 17 nt, Human
ucugcuggccucugcga

SEQ ID NO: 1282642 - RNA, 19 nt, Human
ucugcuggccucugcgagu

SEQ ID NO: 1282643 - RNA, 23 nt, Human
ucugcuggggccugggacaacug

SEQ ID NO: 1282644 - RNA, 14 nt, Human
ucuggaauacauga

SEQ ID NO: 1282645 - RNA, 22 nt, Human
ucuggaauacaugaaauauaga

SEQ ID NO: 1282646 - RNA, 16 nt, Human
ucugcuggggccuggg

SEQ ID NO: 1282647 - RNA, 19 nt, Human
ucugcuggggccugggaca

SEQ ID NO: 1282648 - RNA, 23 nt, Human
ucugccagugacagacaggcucu

SEQ ID NO: 1282649 - RNA, 17 nt, Human
ucugccaguccuguccu

SEQ ID NO: 1282650 - RNA, 19 nt, Human
ucugcucccaaggggccug

SEQ ID NO: 1282651 - RNA, 20 nt, Human
ucugcucccaaggggccuga

SEQ ID NO: 1282652 - RNA, 22 nt, Human
ucugcucccaaggggccugagc

SEQ ID NO: 1282653 - RNA, 23 nt, Human
ucugcucccaaggggccugagca

SEQ ID NO: 1282654 - RNA, 22 nt, Human
ucugcuccccuaaagccucaaa

SEQ ID NO: 1282655 - RNA, 19 nt, Human
ucugccagugacagacagg

SEQ ID NO: 1282656 - RNA, 21 nt, Human
ucugccagugacagacaggcu

SEQ ID NO: 1282657 - RNA, 19 nt, Human
ucugccagggccccucucc

SEQ ID NO: 1282658 - RNA, 20 nt, Human
ucugccagggccccucuccc

SEQ ID NO: 1282659 - RNA, 22 nt, Human
ucugccagggccccucucccca

SEQ ID NO: 1282660 - RNA, 23 nt, Human
ucugccagggccccucuccccag

SEQ ID NO: 1282661 - RNA, 24 nt, Human
ucugccagggccccucuccccagg

SEQ ID NO: 1282662 - RNA, 14 nt, Human
ucugccaguccugu

SEQ ID NO: 1282663 - RNA, 13 nt, Human
ucugccagugaca

SEQ ID NO: 1282664 - RNA, 15 nt, Human
ucugccaggagacag

SEQ ID NO: 1282665 - RNA, 22 nt, Human
ucuuaaccagaucauugugaaa

SEQ ID NO: 1282666 - RNA, 12 nt, Human
ucuuaacuucuu

SEQ ID NO: 1282667 - RNA, 12 nt, Human
ucuuaagaagac

SEQ ID NO: 1282668 - RNA, 16 nt, Human
ucuuaacuucuugcuu

SEQ ID NO: 1282669 - RNA, 23 nt, Human
ucuuaacuucuugcuucuuucua

SEQ ID NO: 1282670 - RNA, 18 nt, Human
ucuuaagaagacugcauu

SEQ ID NO: 1282671 - RNA, 15 nt, Human
ucuuagcugucugcu

SEQ ID NO: 1282672 - RNA, 18 nt, Human
ucuuagcugucugcucag

SEQ ID NO: 1282673 - RNA, 23 nt, Human
ucuuagcugucugcucagacaga

SEQ ID NO: 1282674 - RNA, 15 nt, Human
ucuuaaauaaaccuu

SEQ ID NO: 1282675 - RNA, 21 nt, Human
ucuuaaagugccaguauuuua

SEQ ID NO: 1282676 - RNA, 15 nt, Human
ucuuaaauaagaaac

SEQ ID NO: 1282677 - RNA, 16 nt, Human
ucuuaaauaagaaacu

SEQ ID NO: 1282678 - RNA, 18 nt, Human
ucuuaaauaagaaacuuu

SEQ ID NO: 1282679 - RNA, 19 nt, Human
ucuuaaauaagaaacuuuu

SEQ ID NO: 1282680 - RNA, 17 nt, Human
ucuuaaccagaucauug

SEQ ID NO: 1282681 - RNA, 16 nt, Human
ucuuaaccagaucauu

SEQ ID NO: 1282682 - RNA, 18 nt, Human
ucugucugucugucccaa

SEQ ID NO: 1282683 - RNA, 15 nt, Human
ucugucugucugucc

SEQ ID NO: 1282684 - RNA, 16 nt, Human
ucugucugucccaaag

SEQ ID NO: 1282685 - RNA, 15 nt, Human
ucugucugucccaaa

SEQ ID NO: 1282686 - RNA, 14 nt, Human
ucugucugucccaa

SEQ ID NO: 1282687 - RNA, 16 nt, Human
ucugucugguggcccc

SEQ ID NO: 1282688 - RNA, 17 nt, Human
ucugucugguggccccg

SEQ ID NO: 1282689 - RNA, 18 nt, Human
ucugucugccaaccuaaa

SEQ ID NO: 1282690 - RNA, 21 nt, Human
ucugucugccaaccuaaaacu

SEQ ID NO: 1282691 - RNA, 19 nt, Human
ucugucuggaagaugggga

SEQ ID NO: 1282692 - RNA, 14 nt, Human
ucugucuggcaaug

SEQ ID NO: 1282693 - RNA, 13 nt, Human
ucugucugguggc

SEQ ID NO: 1282694 - RNA, 14 nt, Human
ucugucuucuggac

SEQ ID NO: 1282695 - RNA, 12 nt, Human
ucugucuugaag

SEQ ID NO: 1282696 - RNA, 23 nt, Human
ucuguuuucuuucuaaugagaua

SEQ ID NO: 1282697 - RNA, 17 nt, Human
ucuguuuugaaggcaaa

SEQ ID NO: 1282698 - RNA, 22 nt, Human
ucuuaaaguauucuucucuucc

SEQ ID NO: 1282699 - RNA, 19 nt, Human
ucuuaaagugccaguauuu

SEQ ID NO: 1282700 - RNA, 18 nt, Human
ucuuaaaguauucuucuc

SEQ ID NO: 1282701 - RNA, 16 nt, Human
ucuuaaacacuugcaa

SEQ ID NO: 1282702 - RNA, 16 nt, Human
ucuuaaaccuucaguu

SEQ ID NO: 1282703 - RNA, 12 nt, Human
ucuuaaacuaaa

SEQ ID NO: 1282704 - RNA, 19 nt, Human
ucuguuuuguuucgcucuu

SEQ ID NO: 1282705 - RNA, 21 nt, Human
ucuguuuuguuucgcucuuug

SEQ ID NO: 1282706 - RNA, 18 nt, Human
ucuguuuuucuaacuggg

SEQ ID NO: 1282707 - RNA, 17 nt, Human
ucuuccuucccugcugu

SEQ ID NO: 1282708 - RNA, 21 nt, Human
ucuuccuugaagaacugcagg

SEQ ID NO: 1282709 - RNA, 15 nt, Human
ucuuccuucccugcu

SEQ ID NO: 1282710 - RNA, 14 nt, Human
ucuuccuucccugc

SEQ ID NO: 1282711 - RNA, 20 nt, Human
ucuuccuuacuuuuuauaua

SEQ ID NO: 1282712 - RNA, 22 nt, Human
ucuuccuugaagaacugcaggc

SEQ ID NO: 1282713 - RNA, 23 nt, Human
ucuuccuuacuuuuuauauauau

SEQ ID NO: 1282714 - RNA, 12 nt, Human
ucuucuccacug

SEQ ID NO: 1282715 - RNA, 16 nt, Human
ucuucucccaauucau

SEQ ID NO: 1282716 - RNA, 19 nt, Human
ucuucuccauccuaccaca

SEQ ID NO: 1282717 - RNA, 13 nt, Human
ucuugaaaaaugc

SEQ ID NO: 1282718 - RNA, 17 nt, Human
ucuugaacuccugaccu

SEQ ID NO: 1282719 - RNA, 19 nt, Human
ucuugaacuccugaccuca

SEQ ID NO: 1282720 - RNA, 13 nt, Human
ucuucuccuuuca

SEQ ID NO: 1282721 - RNA, 15 nt, Human
ucuucucccuggaau

SEQ ID NO: 1282722 - RNA, 14 nt, Human
ucuucuccuuucac

SEQ ID NO: 1282723 - RNA, 23 nt, Human
ucuucucguccucguuuguguuc

SEQ ID NO: 1282724 - RNA, 16 nt, Human
ucuucuuuuuuuguga

SEQ ID NO: 1282725 - RNA, 17 nt, Human
ucuucuuuuuuugugau

SEQ ID NO: 1282726 - RNA, 18 nt, Human
ucuucuuuuuuugugaug

SEQ ID NO: 1282727 - RNA, 22 nt, Human
ucuuaggguuaugauuaaguaa

SEQ ID NO: 1282728 - RNA, 17 nt, Human
ucuuccuggauuauuca

SEQ ID NO: 1282729 - RNA, 22 nt, Human
ucuuccuggccgccugggucca

SEQ ID NO: 1282730 - RNA, 15 nt, Human
ucuucaucccacucc

SEQ ID NO: 1282731 - RNA, 23 nt, Human
ucucugaggggcuaccaggaaag

SEQ ID NO: 1282732 - RNA, 16 nt, Human
ucucugaugcagcuua

SEQ ID NO: 1282733 - RNA, 15 nt, Human
ucucugaugcagcuu

SEQ ID NO: 1282734 - RNA, 18 nt, Human
ucucugcaggucccuaau

SEQ ID NO: 1282735 - RNA, 16 nt, Human
ucucugcaggucccua

SEQ ID NO: 1282736 - RNA, 15 nt, Human
ucucugcaggucccu

SEQ ID NO: 1282737 - RNA, 19 nt, Human
ucucuggcuguaaggcucu

SEQ ID NO: 1282738 - RNA, 20 nt, Human
ucucuggcuguaaggcucua

SEQ ID NO: 1282739 - RNA, 22 nt, Human
ucucuggcuguaaggcucuaga

SEQ ID NO: 1282740 - RNA, 23 nt, Human
ucucuggcuguaaggcucuagau

SEQ ID NO: 1282741 - RNA, 12 nt, Human
ucucugggcugg

SEQ ID NO: 1282742 - RNA, 13 nt, Human
ucucugggcugga

SEQ ID NO: 1282743 - RNA, 15 nt, Human
ucucugggcuggaug

SEQ ID NO: 1282744 - RNA, 22 nt, Human
ucucugggcuggaugagcuccc

SEQ ID NO: 1282745 - RNA, 16 nt, Human
ucucugggcuggauga

SEQ ID NO: 1282746 - RNA, 17 nt, Human
ucucugggcuggaugag

SEQ ID NO: 1282747 - RNA, 20 nt, Human
ucucugggcuggaugagcuc

SEQ ID NO: 1282748 - RNA, 16 nt, Human
ucucugggggcugagg

SEQ ID NO: 1282749 - RNA, 18 nt, Human
ucucugggggcugaggag

SEQ ID NO: 1282750 - RNA, 17 nt, Human
ucucugguaauauugac

SEQ ID NO: 1282751 - RNA, 15 nt, Human
ucucuguccgagugu

SEQ ID NO: 1282752 - RNA, 12 nt, Human
ucucugucucau

SEQ ID NO: 1282753 - RNA, 14 nt, Human
ucucugucucaucc

SEQ ID NO: 1282754 - RNA, 15 nt, Human
ucucugucucaucca

SEQ ID NO: 1282755 - RNA, 16 nt, Human
ucucugucucauccau

SEQ ID NO: 1282756 - RNA, 21 nt, Human
ucucugggggcugaggagcag

SEQ ID NO: 1282757 - RNA, 12 nt, Human
ucucuguaaagc

SEQ ID NO: 1282758 - RNA, 14 nt, Human
ucucuguaaagcua

SEQ ID NO: 1282759 - RNA, 21 nt, Human
ucucugucucauccaucauca

SEQ ID NO: 1282760 - RNA, 23 nt, Human
ucucugucucauccaucaucaug

SEQ ID NO: 1282761 - RNA, 12 nt, Human
ucucugugccuu

SEQ ID NO: 1282762 - RNA, 17 nt, Human
ucucugugccuucgucu

SEQ ID NO: 1282763 - RNA, 11 nt, Human
ucucugugcuu

SEQ ID NO: 1282764 - RNA, 14 nt, Human
ucucugcagguccc

SEQ ID NO: 1282765 - RNA, 13 nt, Human
ucucugcaggucc

SEQ ID NO: 1282766 - RNA, 22 nt, Human
ucucugaggggcuaccaggaaa

SEQ ID NO: 1282767 - RNA, 21 nt, Human
ucucugaggggcuaccaggaa

SEQ ID NO: 1282768 - RNA, 15 nt, Human
ucucugauacagaaa

SEQ ID NO: 1282769 - RNA, 13 nt, Human
ucucugaagccac

SEQ ID NO: 1282770 - RNA, 13 nt, Human
ucucugacuucug

SEQ ID NO: 1282771 - RNA, 17 nt, Human
ucucuaguuccacgccu

SEQ ID NO: 1282772 - RNA, 13 nt, Human
ucucucucuacaa

SEQ ID NO: 1282773 - RNA, 14 nt, Human
ucucucucuacaaa

SEQ ID NO: 1282774 - RNA, 12 nt, Human
ucucucugccca

SEQ ID NO: 1282775 - RNA, 14 nt, Human
ucucucugcccaac

SEQ ID NO: 1282776 - RNA, 16 nt, Human
ucucucugcccaaccc

SEQ ID NO: 1282777 - RNA, 20 nt, Human
ucucaauauucaauaaagcu

SEQ ID NO: 1282778 - RNA, 17 nt, Human
ucucaauauucaauaaa

SEQ ID NO: 1282779 - RNA, 23 nt, Human
ucucaauaaaauuauagcucuaa

SEQ ID NO: 1282780 - RNA, 21 nt, Human
ucucaauaaaauuauagcucu

SEQ ID NO: 1282781 - RNA, 21 nt, Human
ucucaaguucuaagauucuaa

SEQ ID NO: 1282782 - RNA, 22 nt, Human
ucucaaguucuaagauucuaau

SEQ ID NO: 1282783 - RNA, 16 nt, Human
ucucaaguucuaagau

SEQ ID NO: 1282784 - RNA, 17 nt, Human
ucucaaguucuaagauu

SEQ ID NO: 1282785 - RNA, 18 nt, Human
ucucaaguucuaagauuc

SEQ ID NO: 1282786 - RNA, 20 nt, Human
ucucaaguucuaagauucua

SEQ ID NO: 1282787 - RNA, 18 nt, Human
ucucaauauucaauaaag

SEQ ID NO: 1282788 - RNA, 22 nt, Human
ucucaauaaaauuauagcucua

SEQ ID NO: 1282789 - RNA, 17 nt, Human
ucucaagagggcacugg

SEQ ID NO: 1282790 - RNA, 18 nt, Human
ucucaagagggcacuggu

SEQ ID NO: 1282791 - RNA, 15 nt, Human
ucucaagagcccugu

SEQ ID NO: 1282792 - RNA, 19 nt, Human
ucucaagagggcacuggug

SEQ ID NO: 1282793 - RNA, 15 nt, Human
ucucaagcucuuccu

SEQ ID NO: 1282794 - RNA, 12 nt, Human
ucucaaguucua

SEQ ID NO: 1282795 - RNA, 13 nt, Human
ucucaaguucuaa

SEQ ID NO: 1282796 - RNA, 14 nt, Human
ucucaaguucuaag

SEQ ID NO: 1282797 - RNA, 15 nt, Human
ucucaaguucuaaga

SEQ ID NO: 1282798 - RNA, 21 nt, Human
ucuccuggaagugcuaauuuu

SEQ ID NO: 1282799 - RNA, 11 nt, Human
ucuccuggagg

SEQ ID NO: 1282800 - RNA, 12 nt, Human
ucuccuggcuuc

SEQ ID NO: 1282801 - RNA, 19 nt, Human
ucuccugccucagccuccc

SEQ ID NO: 1282802 - RNA, 14 nt, Human
ucuccugcugcucc

SEQ ID NO: 1282803 - RNA, 17 nt, Human
ucuccugcugcucccuc

SEQ ID NO: 1282804 - RNA, 18 nt, Human
ucuccugcugcucccuca

SEQ ID NO: 1282805 - RNA, 19 nt, Human
ucuccugcugcucccucag

SEQ ID NO: 1282806 - RNA, 20 nt, Human
ucuccugcugcucccucaga

SEQ ID NO: 1282807 - RNA, 21 nt, Human
ucuccugcugcucccucagac

SEQ ID NO: 1282808 - RNA, 17 nt, Human
ucuccugccucagccuc

SEQ ID NO: 1282809 - RNA, 22 nt, Human
ucuccuggcuucccauccccag

SEQ ID NO: 1282810 - RNA, 13 nt, Human
ucuccuggcuucc

SEQ ID NO: 1282811 - RNA, 15 nt, Human
ucuccuggcuuccca

SEQ ID NO: 1282812 - RNA, 21 nt, Human
ucucggcuccccauguguccu

SEQ ID NO: 1282813 - RNA, 18 nt, Human
ucuccuggcuucccaucc

SEQ ID NO: 1282814 - RNA, 19 nt, Human
ucucguccucguuuguguu

SEQ ID NO: 1282815 - RNA, 14 nt, Human
ucucgucucuuuua

SEQ ID NO: 1282816 - RNA, 21 nt, Human
ucucguccucguuuguguucu

SEQ ID NO: 1282817 - RNA, 20 nt, Human
ucucuaacaguggacaaagu

SEQ ID NO: 1282818 - RNA, 14 nt, Human
ucucuaacagugga

SEQ ID NO: 1282819 - RNA, 18 nt, Human
ucucuaaucugugcuguu

SEQ ID NO: 1282820 - RNA, 20 nt, Human
ucucuaaucugugcuguuuc

SEQ ID NO: 1282821 - RNA, 22 nt, Human
ucucuaggaccaugguuaagag

SEQ ID NO: 1282822 - RNA, 14 nt, Human
ucugcaacucugaa

SEQ ID NO: 1282823 - RNA, 15 nt, Human
ucugcaacucugaag

SEQ ID NO: 1282824 - RNA, 11 nt, Human
ucugaggcuga

SEQ ID NO: 1282825 - RNA, 23 nt, Human
ucugaggcugaaauucagaauau

SEQ ID NO: 1282826 - RNA, 19 nt, Human
ucugaggccagccuggccu

SEQ ID NO: 1282827 - RNA, 21 nt, Human
ucugaggcgccccaacccgug

SEQ ID NO: 1282828 - RNA, 14 nt, Human
ucugcacacagcac

SEQ ID NO: 1282829 - RNA, 22 nt, Human
ucugcacacccuccagagacaa

SEQ ID NO: 1282830 - RNA, 22 nt, Human
ucugcacaucuguaaaucuaca

SEQ ID NO: 1282831 - RNA, 12 nt, Human
ucugaggccagc

SEQ ID NO: 1282832 - RNA, 13 nt, Human
ucugaggccagcc

SEQ ID NO: 1282833 - RNA, 14 nt, Human
ucugaggccagccu

SEQ ID NO: 1282834 - RNA, 15 nt, Human
ucugaggccagccug

SEQ ID NO: 1282835 - RNA, 16 nt, Human
ucugaggccagccugg

SEQ ID NO: 1282836 - RNA, 17 nt, Human
ucugaggccagccuggc

SEQ ID NO: 1282837 - RNA, 18 nt, Human
ucugaggccagccuggcc

SEQ ID NO: 1282838 - RNA, 20 nt, Human
ucugaggccagccuggccuc

SEQ ID NO: 1282839 - RNA, 17 nt, Human
ucugcauucaggaucaa

SEQ ID NO: 1282840 - RNA, 16 nt, Human
ucugcauucuaguacu

SEQ ID NO: 1282841 - RNA, 20 nt, Human
ucugcauuuuucagagaaua

SEQ ID NO: 1282842 - RNA, 19 nt, Human
ucugccaaaggaugugaua

SEQ ID NO: 1282843 - RNA, 14 nt, Human
ucugccaaccuaaa

SEQ ID NO: 1282844 - RNA, 18 nt, Human
ucugccaaccuaaaacuc

SEQ ID NO: 1282845 - RNA, 17 nt, Human
ucugccaaccuaaaacu

SEQ ID NO: 1282846 - RNA, 13 nt, Human
ucugccacccagg

SEQ ID NO: 1282847 - RNA, 15 nt, Human
ucugccacccaggau

SEQ ID NO: 1282848 - RNA, 11 nt, Human
ucugcaucucc

SEQ ID NO: 1282849 - RNA, 13 nt, Human
ucugcaucuccac

SEQ ID NO: 1282850 - RNA, 19 nt, Human
ucugcauccucuggagcca

SEQ ID NO: 1282851 - RNA, 14 nt, Human
ucugcauccucugg

SEQ ID NO: 1282852 - RNA, 21 nt, Human
ucugcauccucuggagccagc

SEQ ID NO: 1282853 - RNA, 17 nt, Human
ucugaaauuuccuggga

SEQ ID NO: 1282854 - RNA, 18 nt, Human
ucugaaauuuccugggag

SEQ ID NO: 1282855 - RNA, 20 nt, Human
ucugaaauuuccugggagcu

SEQ ID NO: 1282856 - RNA, 14 nt, Human
ucugaaauuuuucu

SEQ ID NO: 1282857 - RNA, 15 nt, Human
ucugaaauuuuucuu

SEQ ID NO: 1282858 - RNA, 17 nt, Human
ucugaaauuuuucuucu

SEQ ID NO: 1282859 - RNA, 20 nt, Human
ucugaaauuuuucuucuuga

SEQ ID NO: 1282860 - RNA, 12 nt, Human
ucugaacacauu

SEQ ID NO: 1282861 - RNA, 13 nt, Human
ucugaacacauug

SEQ ID NO: 1282862 - RNA, 15 nt, Human
ucugaacacgaagcu

SEQ ID NO: 1282863 - RNA, 12 nt, Human
ucugaacagcug

SEQ ID NO: 1282864 - RNA, 14 nt, Human
ucugaacagcuggu

SEQ ID NO: 1282865 - RNA, 15 nt, Human
ucugaacagcuggug

SEQ ID NO: 1282866 - RNA, 16 nt, Human
ucugaacagcuggugu

SEQ ID NO: 1282867 - RNA, 17 nt, Human
ucugaacagcuggugua

SEQ ID NO: 1282868 - RNA, 21 nt, Human
ucugaacagcugguguagcua

SEQ ID NO: 1282869 - RNA, 20 nt, Human
ucugaacagcugguguagcu

SEQ ID NO: 1282870 - RNA, 13 nt, Human
ucugaacuaaagu

SEQ ID NO: 1282871 - RNA, 23 nt, Human
ucugacauaauccaguaaaauaa

SEQ ID NO: 1282872 - RNA, 19 nt, Human
ucugacauaauccaguaaa

SEQ ID NO: 1282873 - RNA, 13 nt, Human
ucugacauaaucc

SEQ ID NO: 1282874 - RNA, 14 nt, Human
ucugacagccucag

SEQ ID NO: 1282875 - RNA, 15 nt, Human
ucugacauaaguauu

SEQ ID NO: 1282876 - RNA, 13 nt, Human
ucugacagcagca

SEQ ID NO: 1282877 - RNA, 14 nt, Human
ucugacagcagcau

SEQ ID NO: 1282878 - RNA, 17 nt, Human
ucugacagcagcaucuc

SEQ ID NO: 1282879 - RNA, 22 nt, Human
ucugacagcagcaucucuaccu

SEQ ID NO: 1282880 - RNA, 12 nt, Human
ucugacagccuc

SEQ ID NO: 1282881 - RNA, 13 nt, Human
ucugacagccuca

SEQ ID NO: 1282882 - RNA, 22 nt, Human
ucugaaaauugaugggauuugg

SEQ ID NO: 1282883 - RNA, 18 nt, Human
ucugaaaauauaaccagc

SEQ ID NO: 1282884 - RNA, 15 nt, Human
ucugaaaccaguguu

SEQ ID NO: 1282885 - RNA, 20 nt, Human
ucugaaaccaguguuaggga

SEQ ID NO: 1282886 - RNA, 12 nt, Human
ucugaaagagaa

SEQ ID NO: 1282887 - RNA, 14 nt, Human
ucugaaaauugaug

SEQ ID NO: 1282888 - RNA, 18 nt, Human
ucugaaaagugaagacag

SEQ ID NO: 1282889 - RNA, 19 nt, Human
ucugaaaagugaagacaga

SEQ ID NO: 1282890 - RNA, 20 nt, Human
ucugaaaagugaagacagaa

SEQ ID NO: 1282891 - RNA, 13 nt, Human
ucugaaaauauaa

SEQ ID NO: 1282892 - RNA, 14 nt, Human
ucugaaaauauaac

SEQ ID NO: 1282893 - RNA, 15 nt, Human
ucucugugucuaaga

SEQ ID NO: 1282894 - RNA, 16 nt, Human
ucucugugucuaagau

SEQ ID NO: 1282895 - RNA, 17 nt, Human
ucucugugucuaagauu

SEQ ID NO: 1282896 - RNA, 20 nt, Human
ucucugugucuaagauucua

SEQ ID NO: 1282897 - RNA, 21 nt, Human
ucucugugucuaagauucuag

SEQ ID NO: 1282898 - RNA, 22 nt, Human
ucucugugucuaagauucuaga

SEQ ID NO: 1282899 - RNA, 18 nt, Human
ucucugugugcacaaaua

SEQ ID NO: 1282900 - RNA, 10 nt, Human
ucucuguguu

SEQ ID NO: 1282901 - RNA, 23 nt, Human
ucucugugucuaagauucuagau

SEQ ID NO: 1282902 - RNA, 13 nt, Human
ucucuguucauuu

SEQ ID NO: 1282903 - RNA, 14 nt, Human
ucucuguucauuuc

SEQ ID NO: 1282904 - RNA, 16 nt, Human
ucucuguucauuuccu

SEQ ID NO: 1282905 - RNA, 17 nt, Human
ucucuguucauuuccuc

SEQ ID NO: 1282906 - RNA, 18 nt, Human
ucucuguucauuuccuca

SEQ ID NO: 1282907 - RNA, 18 nt, Human
ucucuguugucguaaaga

SEQ ID NO: 1282908 - RNA, 13 nt, Human
ucucuguugucgu

SEQ ID NO: 1282909 - RNA, 16 nt, Human
ucucuuauggaugucc

SEQ ID NO: 1282910 - RNA, 21 nt, Human
ucguguguuucuauuuuuuga

SEQ ID NO: 1282911 - RNA, 13 nt, Human
ucguuaauuugua

SEQ ID NO: 1282912 - RNA, 14 nt, Human
ucgugucuggcaca

SEQ ID NO: 1282913 - RNA, 21 nt, Human
ucgugucuggcacagccuggc

SEQ ID NO: 1282914 - RNA, 12 nt, Human
ucguggggaggu

SEQ ID NO: 1282915 - RNA, 15 nt, Human
ucguggggugugcug

SEQ ID NO: 1282916 - RNA, 18 nt, Human
ucguggggugugcuggga

SEQ ID NO: 1282917 - RNA, 15 nt, Human
ucuaaauaaaaugcu

SEQ ID NO: 1282918 - RNA, 17 nt, Human
ucuaaauaaaaugcuag

SEQ ID NO: 1282919 - RNA, 16 nt, Human
ucuaaauauggacugc

SEQ ID NO: 1282920 - RNA, 22 nt, Human
ucuaauagggcaauuaauuccu

SEQ ID NO: 1282921 - RNA, 16 nt, Human
ucuaauagggcaauua

SEQ ID NO: 1282922 - RNA, 14 nt, Human
ucuaauaguauaaa

SEQ ID NO: 1282923 - RNA, 17 nt, Human
ucuaauaguauaaaccc

SEQ ID NO: 1282924 - RNA, 12 nt, Human
ucuaauaguaua

SEQ ID NO: 1282925 - RNA, 20 nt, Human
ucuaauaucccagaaaaagu

SEQ ID NO: 1282926 - RNA, 14 nt, Human
ucuaauauggccac

SEQ ID NO: 1282927 - RNA, 23 nt, Human
ucuaacaagucauagguuaauau

SEQ ID NO: 1282928 - RNA, 13 nt, Human
ucuaacaaugaca

SEQ ID NO: 1282929 - RNA, 13 nt, Human
ucuaacagauuag

SEQ ID NO: 1282930 - RNA, 13 nt, Human
ucuaacagcacca

SEQ ID NO: 1282931 - RNA, 14 nt, Human
ucuaacagcaccaa

SEQ ID NO: 1282932 - RNA, 22 nt, Human
ucuaacagcaccaaaucaaaau

SEQ ID NO: 1282933 - RNA, 12 nt, Human
ucuaacagcccu

SEQ ID NO: 1282934 - RNA, 13 nt, Human
ucuaacagcccuc

SEQ ID NO: 1282935 - RNA, 20 nt, Human
ucuaacagcccuccucugca

SEQ ID NO: 1282936 - RNA, 21 nt, Human
ucuaacagcccuccucugcac

SEQ ID NO: 1282937 - RNA, 22 nt, Human
ucuaacagcccuccucugcacu

SEQ ID NO: 1282938 - RNA, 23 nt, Human
ucuaacagcccuccucugcacuc

SEQ ID NO: 1282939 - RNA, 21 nt, Human
ucguggaacaguuaccucugc

SEQ ID NO: 1282940 - RNA, 17 nt, Human
ucguggacacacacaga

SEQ ID NO: 1282941 - RNA, 22 nt, Human
ucgugggacagucaccucaugg

SEQ ID NO: 1282942 - RNA, 12 nt, Human
ucgugccugugu

SEQ ID NO: 1282943 - RNA, 13 nt, Human
ucgugccuguguc

SEQ ID NO: 1282944 - RNA, 14 nt, Human
ucgugccugugucc

SEQ ID NO: 1282945 - RNA, 15 nt, Human
ucgugccugugucca

SEQ ID NO: 1282946 - RNA, 21 nt, Human
ucgugccuguguccaugcgcu

SEQ ID NO: 1282947 - RNA, 16 nt, Human
ucggccugcccccacc

SEQ ID NO: 1282948 - RNA, 22 nt, Human
ucggccucccaaagugcuggga

SEQ ID NO: 1282949 - RNA, 20 nt, Human
ucgaggggugggcugguauc

SEQ ID NO: 1282950 - RNA, 19 nt, Human
ucggccucccaaagugcug

SEQ ID NO: 1282951 - RNA, 14 nt, Human
ucggccugccccca

SEQ ID NO: 1282952 - RNA, 15 nt, Human
ucggccugcccccac

SEQ ID NO: 1282953 - RNA, 18 nt, Human
ucggccuccauccugagg

SEQ ID NO: 1282954 - RNA, 23 nt, Human
ucuaggacugaauuaugaaacuu

SEQ ID NO: 1282955 - RNA, 16 nt, Human
ucuaggacugaauuau

SEQ ID NO: 1282956 - RNA, 23 nt, Human
ucuaggaccaugguuaagagucc

SEQ ID NO: 1282957 - RNA, 19 nt, Human
ucuagaaagagaaacaguu

SEQ ID NO: 1282958 - RNA, 13 nt, Human
ucuagaacacagg

SEQ ID NO: 1282959 - RNA, 15 nt, Human
ucuagaacacaggca

SEQ ID NO: 1282960 - RNA, 16 nt, Human
ucuagaacacaggcaa

SEQ ID NO: 1282961 - RNA, 17 nt, Human
ucuagaacacaggcaaa

SEQ ID NO: 1282962 - RNA, 13 nt, Human
ucuaggacacagu

SEQ ID NO: 1282963 - RNA, 21 nt, Human
ucuaggacacaguuccuggga

SEQ ID NO: 1282964 - RNA, 23 nt, Human
ucuaggacacaguuccugggaac

SEQ ID NO: 1282965 - RNA, 22 nt, Human
ucuagugagcagucaggaaaga

SEQ ID NO: 1282966 - RNA, 19 nt, Human
ucuaggagggagacacugg

SEQ ID NO: 1282967 - RNA, 19 nt, Human
ucuagugagcagucaggaa

SEQ ID NO: 1282968 - RNA, 14 nt, Human
ucuaaugugugaau

SEQ ID NO: 1282969 - RNA, 13 nt, Human
ucuaauguuugca

SEQ ID NO: 1282970 - RNA, 18 nt, Human
ucuaauguuugcauauaa

SEQ ID NO: 1282971 - RNA, 19 nt, Human
ucuaauguuugcauauaag

SEQ ID NO: 1282972 - RNA, 17 nt, Human
ucuaauguuugcauaua

SEQ ID NO: 1282973 - RNA, 16 nt, Human
ucuaauguuugcauau

SEQ ID NO: 1282974 - RNA, 15 nt, Human
ucuaauguuugcaua

SEQ ID NO: 1282975 - RNA, 14 nt, Human
ucuaauguuugcau

SEQ ID NO: 1282976 - RNA, 15 nt, Human
ucuaauuaauuguaa

SEQ ID NO: 1282977 - RNA, 17 nt, Human
ucuaauuaauuguaauc

SEQ ID NO: 1282978 - RNA, 18 nt, Human
ucuaauuauguagcucuu

SEQ ID NO: 1282979 - RNA, 19 nt, Human
ucuaauuauguagcucuuu

SEQ ID NO: 1282980 - RNA, 16 nt, Human
ucuaauucacagugcu

SEQ ID NO: 1282981 - RNA, 21 nt, Human
ucuaauuauguagcucuuugu

SEQ ID NO: 1282982 - RNA, 19 nt, Human
ucuaauucuauuaaagugc

SEQ ID NO: 1282983 - RNA, 12 nt, Human
ucuacuuugaag

SEQ ID NO: 1282984 - RNA, 20 nt, Human
ucuacuuugaagucauacca

SEQ ID NO: 1282985 - RNA, 15 nt, Human
ucuacuuuuacucau

SEQ ID NO: 1282986 - RNA, 16 nt, Human
ucuagaaaaacaggca

SEQ ID NO: 1282987 - RNA, 17 nt, Human
ucuagaaaaacaggcac

SEQ ID NO: 1282988 - RNA, 18 nt, Human
ucuagaaaaacaggcacu

SEQ ID NO: 1282989 - RNA, 22 nt, Human
ucuagaaaaacaggcacuuggc

SEQ ID NO: 1282990 - RNA, 13 nt, Human
ucuaugccugucu

SEQ ID NO: 1282991 - RNA, 21 nt, Human
ucuaucaaccccagacacugg

SEQ ID NO: 1282992 - RNA, 14 nt, Human
ucuaugcauuuucu

SEQ ID NO: 1282993 - RNA, 15 nt, Human
ucuaugcauuuucug

SEQ ID NO: 1282994 - RNA, 16 nt, Human
ucucaaaggagcgagc

SEQ ID NO: 1282995 - RNA, 17 nt, Human
ucucaaaguguggucuc

SEQ ID NO: 1282996 - RNA, 14 nt, Human
ucuaugaaauauua

SEQ ID NO: 1282997 - RNA, 17 nt, Human
ucuaugaaauauuaugu

SEQ ID NO: 1282998 - RNA, 18 nt, Human
ucuaugaaauauuauguu

SEQ ID NO: 1282999 - RNA, 22 nt, Human
ucuaucaaccccagacacuggu

SEQ ID NO: 1283000 - RNA, 18 nt, Human
ucuaugagucuagauguu

SEQ ID NO: 1283001 - RNA, 19 nt, Human
ucuaucaaccccagacacu

SEQ ID NO: 1283002 - RNA, 20 nt, Human
ucuaucaaccccagacacug

SEQ ID NO: 1283003 - RNA, 16 nt, Human
uccuuggccaugcaga

SEQ ID NO: 1283004 - RNA, 13 nt, Human
uccuuuguuacuu

SEQ ID NO: 1283005 - RNA, 10 nt, Human
uccuuuguuc

SEQ ID NO: 1283006 - RNA, 23 nt, Human
uccuuggcaggcugauuucuagg

SEQ ID NO: 1283007 - RNA, 21 nt, Human
uccuuggcaggcugauuucua

SEQ ID NO: 1283008 - RNA, 12 nt, Human
uccuuuuaaaga

SEQ ID NO: 1283009 - RNA, 13 nt, Human
uccuuuuaaagaa

SEQ ID NO: 1283010 - RNA, 23 nt, Human
uccuuuuaaagaaaaaaauugaa

SEQ ID NO: 1283011 - RNA, 17 nt, Human
uccuuuuaauuuuccug

SEQ ID NO: 1283012 - RNA, 14 nt, Human
uccuuuuaaagaaa

SEQ ID NO: 1283013 - RNA, 19 nt, Human
uccuuuuaaaacacuucca

SEQ ID NO: 1283014 - RNA, 16 nt, Human
uccuuuguucuuaccu

SEQ ID NO: 1283015 - RNA, 24 nt, Human
uccuuuguucuuaccuguaugucu

SEQ ID NO: 1283016 - RNA, 15 nt, Human
ucgaacuccugaccu

SEQ ID NO: 1283017 - RNA, 15 nt, Human
ucgaaccguuuugaa

SEQ ID NO: 1283018 - RNA, 18 nt, Human
ucgaaccguuuugaagcu

SEQ ID NO: 1283019 - RNA, 19 nt, Human
ucgaaagcucuagaaucug

SEQ ID NO: 1283020 - RNA, 15 nt, Human
uccuuuuccucucuc

SEQ ID NO: 1283021 - RNA, 18 nt, Human
ucgaaacacagaaaccuu

SEQ ID NO: 1283022 - RNA, 14 nt, Human
ucgaaagcucuaga

SEQ ID NO: 1283023 - RNA, 16 nt, Human
ucgaaagcucuagaau

SEQ ID NO: 1283024 - RNA, 12 nt, Human
uccuuuucacug

SEQ ID NO: 1283025 - RNA, 14 nt, Human
uccuuuucauaggu

SEQ ID NO: 1283026 - RNA, 20 nt, Human
uccuuuucauaggucugaaa

SEQ ID NO: 1283027 - RNA, 21 nt, Human
uccuuuucauaggucugaaau

SEQ ID NO: 1283028 - RNA, 22 nt, Human
uccugucgauuagacuggacag

SEQ ID NO: 1283029 - RNA, 13 nt, Human
uccuucacugcuc

SEQ ID NO: 1283030 - RNA, 21 nt, Human
uccuugaagaacugcaggccc

SEQ ID NO: 1283031 - RNA, 23 nt, Human
uccuugaagaacugcaggcccug

SEQ ID NO: 1283032 - RNA, 17 nt, Human
uccuugaagguauaucu

SEQ ID NO: 1283033 - RNA, 13 nt, Human
uccuugaagguau

SEQ ID NO: 1283034 - RNA, 21 nt, Human
uccuugaaggacuaauagaaa

SEQ ID NO: 1283035 - RNA, 17 nt, Human
uccuugcuuccugucuu

SEQ ID NO: 1283036 - RNA, 17 nt, Human
uccugccucagccuccc

SEQ ID NO: 1283037 - RNA, 20 nt, Human
uccugagcacugccaggagg

SEQ ID NO: 1283038 - RNA, 21 nt, Human
uccugagcacugccaggaggg

SEQ ID NO: 1283039 - RNA, 22 nt, Human
uccugagcacugccaggaggga

SEQ ID NO: 1283040 - RNA, 23 nt, Human
uccugagcacugccaggagggac

SEQ ID NO: 1283041 - RNA, 14 nt, Human
uccugccucagccu

SEQ ID NO: 1283042 - RNA, 20 nt, Human
uccugccuaagugcagcccc

SEQ ID NO: 1283043 - RNA, 12 nt, Human
uccugagcacug

SEQ ID NO: 1283044 - RNA, 13 nt, Human
uccugagcacugc

SEQ ID NO: 1283045 - RNA, 14 nt, Human
uccugagcacugcc

SEQ ID NO: 1283046 - RNA, 15 nt, Human
uccugagcacugcca

SEQ ID NO: 1283047 - RNA, 16 nt, Human
uccugagcacugccag

SEQ ID NO: 1283048 - RNA, 17 nt, Human
uccugagcacugccagg

SEQ ID NO: 1283049 - RNA, 18 nt, Human
uccugagcacugccagga

SEQ ID NO: 1283050 - RNA, 19 nt, Human
uccugagcacugccaggag

SEQ ID NO: 1283051 - RNA, 13 nt, Human
uccucuucugggc

SEQ ID NO: 1283052 - RNA, 17 nt, Human
uccucuucugggccuga

SEQ ID NO: 1283053 - RNA, 19 nt, Human
uccugccuauuaucuguca

SEQ ID NO: 1283054 - RNA, 20 nt, Human
uccuguacauugugggaugu

SEQ ID NO: 1283055 - RNA, 14 nt, Human
uccuguacauugug

SEQ ID NO: 1283056 - RNA, 15 nt, Human
uccuguccucuuuca

SEQ ID NO: 1283057 - RNA, 17 nt, Human
uccuguccucuuucagc

SEQ ID NO: 1283058 - RNA, 18 nt, Human
uccuguccucuuucagcu

SEQ ID NO: 1283059 - RNA, 19 nt, Human
uccuguccucuuucagcuc

SEQ ID NO: 1283060 - RNA, 21 nt, Human
uccuguccucuuucagcuccu

SEQ ID NO: 1283061 - RNA, 20 nt, Human
uccuguccucuuucagcucc

SEQ ID NO: 1283062 - RNA, 19 nt, Human
uccuguccuuuaccaaaga

SEQ ID NO: 1283063 - RNA, 22 nt, Human
uccuguccuuuaccaaagauga

SEQ ID NO: 1283064 - RNA, 17 nt, Human
uccugucgauuagacug

SEQ ID NO: 1283065 - RNA, 21 nt, Human
uccugucgauuagacuggaca

SEQ ID NO: 1283066 - RNA, 19 nt, Human
ucccuccugggaaugaagc

SEQ ID NO: 1283067 - RNA, 11 nt, Human
ucccuccuggg

SEQ ID NO: 1283068 - RNA, 16 nt, Human
ucccuccucugcccgg

SEQ ID NO: 1283069 - RNA, 17 nt, Human
ucccucucccaggcccc

SEQ ID NO: 1283070 - RNA, 20 nt, Human
ucccucucccaggccccaug

SEQ ID NO: 1283071 - RNA, 21 nt, Human
ucccucucccaggccccauga

SEQ ID NO: 1283072 - RNA, 21 nt, Human
ucccucuacagagcuucccug

SEQ ID NO: 1283073 - RNA, 22 nt, Human
ucccucuacagagcuucccuga

SEQ ID NO: 1283074 - RNA, 14 nt, Human
ucccuccuguuggg

SEQ ID NO: 1283075 - RNA, 11 nt, Human
ucccuccuugg

SEQ ID NO: 1283076 - RNA, 12 nt, Human
ucccuccuuggu

SEQ ID NO: 1283077 - RNA, 16 nt, Human
ucccuaauaaagcugu

SEQ ID NO: 1283078 - RNA, 16 nt, Human
ucccuaaucuaugguc

SEQ ID NO: 1283079 - RNA, 23 nt, Human
ucccuaaucuauggucgggagac

SEQ ID NO: 1283080 - RNA, 16 nt, Human
ucccuacauuaaacau

SEQ ID NO: 1283081 - RNA, 14 nt, Human
ucccuaauguguuu

SEQ ID NO: 1283082 - RNA, 13 nt, Human
ucccuacauguau

SEQ ID NO: 1283083 - RNA, 24 nt, Human
ucccuacauguauugcacauugua

SEQ ID NO: 1283084 - RNA, 23 nt, Human
ucccuagguguuuuguucaccau

SEQ ID NO: 1283085 - RNA, 19 nt, Human
ucccuaucuuugccacccu

SEQ ID NO: 1283086 - RNA, 20 nt, Human
ucccuaucacugaagcuuuu

SEQ ID NO: 1283087 - RNA, 21 nt, Human
ucccuaucacugaagcuuuuu

SEQ ID NO: 1283088 - RNA, 14 nt, Human
ucccuauggaaaga

SEQ ID NO: 1283089 - RNA, 16 nt, Human
ucccuauccaaucaau

SEQ ID NO: 1283090 - RNA, 13 nt, Human
ucccuacauuaaa

SEQ ID NO: 1283091 - RNA, 14 nt, Human
ucccuauacugcuu

SEQ ID NO: 1283092 - RNA, 15 nt, Human
ucccuauacugcuug

SEQ ID NO: 1283093 - RNA, 17 nt, Human
ucccuauacugcuugga

SEQ ID NO: 1283094 - RNA, 15 nt, Human
ucccuaauaaagcug

SEQ ID NO: 1283095 - RNA, 15 nt, Human
ucccguguucuccuu

SEQ ID NO: 1283096 - RNA, 20 nt, Human
ucccguuucuccaccuagac

SEQ ID NO: 1283097 - RNA, 21 nt, Human
ucccggggccagcacuuccau

SEQ ID NO: 1283098 - RNA, 16 nt, Human
ucccggggccagcacu

SEQ ID NO: 1283099 - RNA, 20 nt, Human
ucccgucaccccuguuucug

SEQ ID NO: 1283100 - RNA, 18 nt, Human
uccagguguuacuguaau

SEQ ID NO: 1283101 - RNA, 17 nt, Human
uccagguucccucccag

SEQ ID NO: 1283102 - RNA, 18 nt, Human
uccagguucccucccaga

SEQ ID NO: 1283103 - RNA, 20 nt, Human
uccagguucccucccagagg

SEQ ID NO: 1283104 - RNA, 13 nt, Human
uccccuuauccuc

SEQ ID NO: 1283105 - RNA, 17 nt, Human
uccccuuauccucccug

SEQ ID NO: 1283106 - RNA, 18 nt, Human
uccccuuauccucccugu

SEQ ID NO: 1283107 - RNA, 19 nt, Human
uccccuuauccucccugua

SEQ ID NO: 1283108 - RNA, 23 nt, Human
uccccuuauccucccuguaacuu

SEQ ID NO: 1283109 - RNA, 20 nt, Human
uccccuuauccucccuguaa

SEQ ID NO: 1283110 - RNA, 22 nt, Human
uccccuuauccucccuguaacu

SEQ ID NO: 1283111 - RNA, 15 nt, Human
ucccuugaugaagaa

SEQ ID NO: 1283112 - RNA, 19 nt, Human
ucccuuccugccagccccu

SEQ ID NO: 1283113 - RNA, 16 nt, Human
ucccuugaugaagaag

SEQ ID NO: 1283114 - RNA, 18 nt, Human
ucccuucaugcauggaaa

SEQ ID NO: 1283115 - RNA, 17 nt, Human
ucccuucaugcauggaa

SEQ ID NO: 1283116 - RNA, 21 nt, Human
ucccuucaucuggaaccauca

SEQ ID NO: 1283117 - RNA, 19 nt, Human
ucccuggauuuuuaccagu

SEQ ID NO: 1283118 - RNA, 18 nt, Human
ucccuggcccccucccug

SEQ ID NO: 1283119 - RNA, 20 nt, Human
ucccuggcccccucccugga

SEQ ID NO: 1283120 - RNA, 19 nt, Human
ucccugcuuuuuguguuuu

SEQ ID NO: 1283121 - RNA, 20 nt, Human
ucccuggaaugaguugaggc

SEQ ID NO: 1283122 - RNA, 18 nt, Human
ucccuggaugacauuaaa

SEQ ID NO: 1283123 - RNA, 20 nt, Human
ucccuggaugacauuaaaga

SEQ ID NO: 1283124 - RNA, 17 nt, Human
ucccuggauuuuuacca

SEQ ID NO: 1283125 - RNA, 18 nt, Human
ucccuggauuuuuaccag

SEQ ID NO: 1283126 - RNA, 20 nt, Human
ucccuggauuuuuaccaguc

SEQ ID NO: 1283127 - RNA, 16 nt, Human
ucccuuccuuccucuc

SEQ ID NO: 1283128 - RNA, 19 nt, Human
ucccuuccuuccucuccug

SEQ ID NO: 1283129 - RNA, 23 nt, Human
ucccuggaaaccuuccacccagu

SEQ ID NO: 1283130 - RNA, 18 nt, Human
ucccuggaaggacaucca

SEQ ID NO: 1283131 - RNA, 22 nt, Human
ucccuggaaugaguugaggcca

SEQ ID NO: 1283132 - RNA, 22 nt, Human
ucccuggaaaccuuccacccag

SEQ ID NO: 1283133 - RNA, 20 nt, Human
ucccuggaaaccuuccaccc

SEQ ID NO: 1283134 - RNA, 13 nt, Human
ucccugccuggac

SEQ ID NO: 1283135 - RNA, 17 nt, Human
ucccugccucucaucaa

SEQ ID NO: 1283136 - RNA, 23 nt, Human
ucccugccucucaucaacugaau

SEQ ID NO: 1283137 - RNA, 20 nt, Human
ucccugccccucccuucaac

SEQ ID NO: 1283138 - RNA, 13 nt, Human
ucccugccuccug

SEQ ID NO: 1283139 - RNA, 16 nt, Human
ucccugccuccugccg

SEQ ID NO: 1283140 - RNA, 18 nt, Human
ucccugccuccugccggc

SEQ ID NO: 1283141 - RNA, 16 nt, Human
ucccucucucauaccc

SEQ ID NO: 1283142 - RNA, 14 nt, Human
ucccucucguaaga

SEQ ID NO: 1283143 - RNA, 15 nt, Human
ucccucucucacucc

SEQ ID NO: 1283144 - RNA, 17 nt, Human
ucccugcacagugacuu

SEQ ID NO: 1283145 - RNA, 20 nt, Human
ucccugcacagugacuucug

SEQ ID NO: 1283146 - RNA, 22 nt, Human
ucccugcacagugacuucugag

SEQ ID NO: 1283147 - RNA, 23 nt, Human
ucccugcacagugacuucugaga

SEQ ID NO: 1283148 - RNA, 21 nt, Human
uccucuuccugaauuuuauuu

SEQ ID NO: 1283149 - RNA, 20 nt, Human
uccucuucuacucacuuuuc

SEQ ID NO: 1283150 - RNA, 22 nt, Human
uccucuucuacucacuuuuccc

SEQ ID NO: 1283151 - RNA, 19 nt, Human
uccucuucuauuuuguaaa

SEQ ID NO: 1283152 - RNA, 23 nt, Human
uccucuucuacucacuuuuccca

SEQ ID NO: 1283153 - RNA, 12 nt, Human
uccucuucccca

SEQ ID NO: 1283154 - RNA, 13 nt, Human
uccucuuccccag

SEQ ID NO: 1283155 - RNA, 14 nt, Human
uccucuuccccaga

SEQ ID NO: 1283156 - RNA, 17 nt, Human
uccucuucccccaagau

SEQ ID NO: 1283157 - RNA, 18 nt, Human
uccucuuccccagacgcc

SEQ ID NO: 1283158 - RNA, 18 nt, Human
uccucuucccucucugca

SEQ ID NO: 1283159 - RNA, 14 nt, Human
uccucuucccucuc

SEQ ID NO: 1283160 - RNA, 15 nt, Human
uccucuagcuguggg

SEQ ID NO: 1283161 - RNA, 21 nt, Human
uccucuagcugugggggugag

SEQ ID NO: 1283162 - RNA, 13 nt, Human
uccucgccugaca

SEQ ID NO: 1283163 - RNA, 15 nt, Human
uccucgccugacaac

SEQ ID NO: 1283164 - RNA, 24 nt, Human
uccucgccugacaaccacuggucu

SEQ ID NO: 1283165 - RNA, 19 nt, Human
uccucuacuaacaaucagc

SEQ ID NO: 1283166 - RNA, 13 nt, Human
uccucguuugugu

SEQ ID NO: 1283167 - RNA, 14 nt, Human
uccucguuuguguu

SEQ ID NO: 1283168 - RNA, 15 nt, Human
uccucguuuguguuc

SEQ ID NO: 1283169 - RNA, 16 nt, Human
uccucguuuguguucu

SEQ ID NO: 1283170 - RNA, 16 nt, Human
uccucuaacuuggcuc

SEQ ID NO: 1283171 - RNA, 17 nt, Human
uccucuacuaacaauca

SEQ ID NO: 1283172 - RNA, 18 nt, Human
uccucuacuaacaaucag

SEQ ID NO: 1283173 - RNA, 21 nt, Human
uccucaugaauguaaauuugu

SEQ ID NO: 1283174 - RNA, 21 nt, Human
uccuccacguucugcucauca

SEQ ID NO: 1283175 - RNA, 22 nt, Human
uccuccacguucugcucaucau

SEQ ID NO: 1283176 - RNA, 23 nt, Human
uccuccacguucugcucaucauu

SEQ ID NO: 1283177 - RNA, 20 nt, Human
uccucaugaauguaaauuug

SEQ ID NO: 1283178 - RNA, 20 nt, Human
uccuccugggcccucucugc

SEQ ID NO: 1283179 - RNA, 22 nt, Human
uccuccugggcccucucugcuc

SEQ ID NO: 1283180 - RNA, 16 nt, Human
uccuccuguauuccug

SEQ ID NO: 1283181 - RNA, 20 nt, Human
uccuccuuccggggaaggau

SEQ ID NO: 1283182 - RNA, 22 nt, Human
uccuccuuccggggaaggauuu

SEQ ID NO: 1283183 - RNA, 13 nt, Human
uccuccuucuuca

SEQ ID NO: 1283184 - RNA, 18 nt, Human
uccuauacgcagcgugcu

SEQ ID NO: 1283185 - RNA, 19 nt, Human
uccuauacgcagcgugcuu

SEQ ID NO: 1283186 - RNA, 19 nt, Human
uccuaguucuagaaaaaca

SEQ ID NO: 1283187 - RNA, 20 nt, Human
uccuaguuuucuccucccag

SEQ ID NO: 1283188 - RNA, 13 nt, Human
uccuaguuuucuc

SEQ ID NO: 1283189 - RNA, 13 nt, Human
uccuaguucuaga

SEQ ID NO: 1283190 - RNA, 15 nt, Human
uccuaguucuagaaa

SEQ ID NO: 1283191 - RNA, 16 nt, Human
uccuaguucuagaaaa

SEQ ID NO: 1283192 - RNA, 17 nt, Human
uccuaguucuagaaaaa

SEQ ID NO: 1283193 - RNA, 18 nt, Human
uccuaguucuagaaaaac

SEQ ID NO: 1283194 - RNA, 22 nt, Human
uccuaguucuagaaaaacaggc

SEQ ID NO: 1283195 - RNA, 16 nt, Human
uccuaguucuucaucc

SEQ ID NO: 1283196 - RNA, 18 nt, Human
uccuauguuuuuguucaa

SEQ ID NO: 1283197 - RNA, 19 nt, Human
uccuauguuuuuguucaaa

SEQ ID NO: 1283198 - RNA, 11 nt, Human
uccuauguuug

SEQ ID NO: 1283199 - RNA, 14 nt, Human
uccucaugaaugua

SEQ ID NO: 1283200 - RNA, 15 nt, Human
uccucaugaauguaa

SEQ ID NO: 1283201 - RNA, 17 nt, Human
uccucaugaauguaaau

SEQ ID NO: 1283202 - RNA, 14 nt, Human
uccucaucccgugu

SEQ ID NO: 1283203 - RNA, 22 nt, Human
uccucaucccguguucuccuuu

SEQ ID NO: 1283204 - RNA, 15 nt, Human
uccuacaagacacag

SEQ ID NO: 1283205 - RNA, 16 nt, Human
uccuaauuuugagaaa

SEQ ID NO: 1283206 - RNA, 14 nt, Human
uccuaccaagucaa

SEQ ID NO: 1283207 - RNA, 22 nt, Human
uccuaaugaaugcauaaaaugu

SEQ ID NO: 1283208 - RNA, 15 nt, Human
uccuaauuccacagc

SEQ ID NO: 1283209 - RNA, 16 nt, Human
uccuaauuccacagcu

SEQ ID NO: 1283210 - RNA, 17 nt, Human
uccuaauuccacagcug

SEQ ID NO: 1283211 - RNA, 18 nt, Human
uccuaauuccacagcugc

SEQ ID NO: 1283212 - RNA, 14 nt, Human
uccuaauacuguca

SEQ ID NO: 1283213 - RNA, 15 nt, Human
uccuaauacugucau

SEQ ID NO: 1283214 - RNA, 18 nt, Human
uccuaauaaaguucugua

SEQ ID NO: 1283215 - RNA, 19 nt, Human
uccuaauaauaucccacug

SEQ ID NO: 1283216 - RNA, 22 nt, Human
uccuaauaauaucccacuggga

SEQ ID NO: 1283217 - RNA, 17 nt, Human
uauucguuaucuaauag

SEQ ID NO: 1283218 - RNA, 23 nt, Human
uauucuaacuuuuauuuuuauca

SEQ ID NO: 1283219 - RNA, 11 nt, Human
uauucuaagac

SEQ ID NO: 1283220 - RNA, 12 nt, Human
uauucuaagacu

SEQ ID NO: 1283221 - RNA, 13 nt, Human
uauucuaagacuu

SEQ ID NO: 1283222 - RNA, 21 nt, Human
uauucuaagacuuacucuaag

SEQ ID NO: 1283223 - RNA, 22 nt, Human
uauucuaagacuuacucuaaga

SEQ ID NO: 1283224 - RNA, 23 nt, Human
uauucuaagacuuacucuaagau

SEQ ID NO: 1283225 - RNA, 21 nt, Human
uauucuagccugcauugagcu

SEQ ID NO: 1283226 - RNA, 16 nt, Human
uauucuagccugcauu

SEQ ID NO: 1283227 - RNA, 10 nt, Human
uauucuaguc

SEQ ID NO: 1283228 - RNA, 20 nt, Human
uauucuauuacauuuucagu

SEQ ID NO: 1283229 - RNA, 17 nt, Human
uauuccugcauuuguga

SEQ ID NO: 1283230 - RNA, 19 nt, Human
uauuccugcauuugugaaa

SEQ ID NO: 1283231 - RNA, 20 nt, Human
uauuccugcauuugugaaau

SEQ ID NO: 1283232 - RNA, 21 nt, Human
uauuccugcauuugugaaaug

SEQ ID NO: 1283233 - RNA, 21 nt, Human
uauucccuagaaacuuccaaa

SEQ ID NO: 1283234 - RNA, 14 nt, Human
uauuccuauugugc

SEQ ID NO: 1283235 - RNA, 16 nt, Human
uauuccucaaaaaauu

SEQ ID NO: 1283236 - RNA, 18 nt, Human
uauuccuccugcucauau

SEQ ID NO: 1283237 - RNA, 22 nt, Human
uauuccugaccuccgccaucca

SEQ ID NO: 1283238 - RNA, 22 nt, Human
uauuccuguggauguaaaguga

SEQ ID NO: 1283239 - RNA, 22 nt, Human
uauuccuuuguuacuucucuaa

SEQ ID NO: 1283240 - RNA, 22 nt, Human
uauucgauacugcgacuuucug

SEQ ID NO: 1283241 - RNA, 19 nt, Human
uauucgccacacaguauuu

SEQ ID NO: 1283242 - RNA, 20 nt, Human
uauucgccacacaguauuuu

SEQ ID NO: 1283243 - RNA, 17 nt, Human
uauuacagauaaaaugu

SEQ ID NO: 1283244 - RNA, 19 nt, Human
uauuacagauaaaauguaa

SEQ ID NO: 1283245 - RNA, 17 nt, Human
uauuauuaacauaccua

SEQ ID NO: 1283246 - RNA, 19 nt, Human
uauuauuacuuauuuuuga

SEQ ID NO: 1283247 - RNA, 14 nt, Human
uauuauuacuugua

SEQ ID NO: 1283248 - RNA, 18 nt, Human
uauuauuacuuguaaaua

SEQ ID NO: 1283249 - RNA, 17 nt, Human
uauuauuacuuguaaau

SEQ ID NO: 1283250 - RNA, 12 nt, Human
uauuauuagggc

SEQ ID NO: 1283251 - RNA, 19 nt, Human
uauuauuaguuuugauuua

SEQ ID NO: 1283252 - RNA, 22 nt, Human
uauuauuauaaucuuauaauug

SEQ ID NO: 1283253 - RNA, 15 nt, Human
uauuauuauaaucuu

SEQ ID NO: 1283254 - RNA, 15 nt, Human
uauuacaaugaucac

SEQ ID NO: 1283255 - RNA, 16 nt, Human
uauuacacucuguaau

SEQ ID NO: 1283256 - RNA, 19 nt, Human
uauuacacucuguaauuga

SEQ ID NO: 1283257 - RNA, 14 nt, Human
uauuacaaugauca

SEQ ID NO: 1283258 - RNA, 17 nt, Human
uauuaauuuaugcagaa

SEQ ID NO: 1283259 - RNA, 14 nt, Human
uauuaauuuuaguu

SEQ ID NO: 1283260 - RNA, 21 nt, Human
uauuaauuuuaguuuuucauu

SEQ ID NO: 1283261 - RNA, 23 nt, Human
uauuccaugacugcuugcccuaa

SEQ ID NO: 1283262 - RNA, 16 nt, Human
uauuccaugacugcuu

SEQ ID NO: 1283263 - RNA, 17 nt, Human
uauuccccauucuuccu

SEQ ID NO: 1283264 - RNA, 12 nt, Human
uauuccaugacu

SEQ ID NO: 1283265 - RNA, 14 nt, Human
uauuccaugacugc

SEQ ID NO: 1283266 - RNA, 15 nt, Human
uauuccaugacugcu

SEQ ID NO: 1283267 - RNA, 19 nt, Human
uauuccaagacaugucugu

SEQ ID NO: 1283268 - RNA, 16 nt, Human
uauuccagaaugcugu

SEQ ID NO: 1283269 - RNA, 17 nt, Human
uauuccagaaugcugua

SEQ ID NO: 1283270 - RNA, 20 nt, Human
uauuccagaaugcuguacau

SEQ ID NO: 1283271 - RNA, 21 nt, Human
uauuccagaaugcuguacauc

SEQ ID NO: 1283272 - RNA, 23 nt, Human
uauuccagaaugcuguacaucua

SEQ ID NO: 1283273 - RNA, 17 nt, Human
uauuccagcuguccccc

SEQ ID NO: 1283274 - RNA, 22 nt, Human
uauuccagcuguccccccacuc

SEQ ID NO: 1283275 - RNA, 22 nt, Human
uauuuaguuguaaaccaaguga

SEQ ID NO: 1283276 - RNA, 19 nt, Human
uauuuaaaccgcuaaaaga

SEQ ID NO: 1283277 - RNA, 16 nt, Human
uauuuauaaauauauu

SEQ ID NO: 1283278 - RNA, 17 nt, Human
uauuuauaaauauauuu

SEQ ID NO: 1283279 - RNA, 19 nt, Human
uauuuauaaauauauuuaa

SEQ ID NO: 1283280 - RNA, 24 nt, Human
uauuuauaaaaauaaaaaacacug

SEQ ID NO: 1283281 - RNA, 21 nt, Human
uauuuaaaccgcuaaaagaaa

SEQ ID NO: 1283282 - RNA, 24 nt, Human
uauuuaaacucuguugcaagugca

SEQ ID NO: 1283283 - RNA, 14 nt, Human
uauuuaaaaaacua

SEQ ID NO: 1283284 - RNA, 16 nt, Human
uauuuaaaaaacuaaa

SEQ ID NO: 1283285 - RNA, 21 nt, Human
uauuuaaaaaacuaaaaacua

SEQ ID NO: 1283286 - RNA, 20 nt, Human
uauuuaaaaaacuaaaaacu

SEQ ID NO: 1283287 - RNA, 13 nt, Human
uauuuaaaaauaa

SEQ ID NO: 1283288 - RNA, 17 nt, Human
uauuuaaaaauaaguca

SEQ ID NO: 1283289 - RNA, 23 nt, Human
uauuuaaaaauaagucaacagua

SEQ ID NO: 1283290 - RNA, 12 nt, Human
uauuuaaaacuu

SEQ ID NO: 1283291 - RNA, 13 nt, Human
uauuuaaaacuug

SEQ ID NO: 1283292 - RNA, 15 nt, Human
uauuuaaaaguguca

SEQ ID NO: 1283293 - RNA, 14 nt, Human
uauuuaaaauagca

SEQ ID NO: 1283294 - RNA, 15 nt, Human
uauuuaaaauagcaa

SEQ ID NO: 1283295 - RNA, 23 nt, Human
uauuuaaaauagcaaaagaagaa

SEQ ID NO: 1283296 - RNA, 21 nt, Human
uauuuaaaauagcaaaagaag

SEQ ID NO: 1283297 - RNA, 22 nt, Human
uauuguuuuacaauaguucugu

SEQ ID NO: 1283298 - RNA, 20 nt, Human
uauuguuuuacaauaguucu

SEQ ID NO: 1283299 - RNA, 17 nt, Human
uauuguuuuacaauagu

SEQ ID NO: 1283300 - RNA, 15 nt, Human
uauuguuuuacaaua

SEQ ID NO: 1283301 - RNA, 14 nt, Human
uauuguuuuacaau

SEQ ID NO: 1283302 - RNA, 22 nt, Human
uauuguuacguagccuaaggcu

SEQ ID NO: 1283303 - RNA, 17 nt, Human
uauuguucagcaugcaa

SEQ ID NO: 1283304 - RNA, 17 nt, Human
uauugcugaaugcaaga

SEQ ID NO: 1283305 - RNA, 15 nt, Human
uauugcuagagcucc

SEQ ID NO: 1283306 - RNA, 16 nt, Human
uauugcuagagcuccu

SEQ ID NO: 1283307 - RNA, 20 nt, Human
uauugcuagagcuccucccu

SEQ ID NO: 1283308 - RNA, 16 nt, Human
uauuggaauauaauug

SEQ ID NO: 1283309 - RNA, 15 nt, Human
uauuggaacuugcga

SEQ ID NO: 1283310 - RNA, 17 nt, Human
uauuggacaaagaaccu

SEQ ID NO: 1283311 - RNA, 19 nt, Human
uauuggccaaggaaaggca

SEQ ID NO: 1283312 - RNA, 16 nt, Human
uauuguguuuguguau

SEQ ID NO: 1283313 - RNA, 16 nt, Human
uauucuccuauguuug

SEQ ID NO: 1283314 - RNA, 16 nt, Human
uauucuccuccucccu

SEQ ID NO: 1283315 - RNA, 20 nt, Human
uauugccuaagaauaaacau

SEQ ID NO: 1283316 - RNA, 22 nt, Human
uauugccuaagaauaaacauuu

SEQ ID NO: 1283317 - RNA, 13 nt, Human
uauugccucacuu

SEQ ID NO: 1283318 - RNA, 15 nt, Human
uauugccucugagag

SEQ ID NO: 1283319 - RNA, 14 nt, Human
uauugcuagagcuc

SEQ ID NO: 1283320 - RNA, 13 nt, Human
uauguacuucaug

SEQ ID NO: 1283321 - RNA, 17 nt, Human
uauguacuucaugcugu

SEQ ID NO: 1283322 - RNA, 16 nt, Human
uauguaccauguacau

SEQ ID NO: 1283323 - RNA, 10 nt, Human
uauguaccaa

SEQ ID NO: 1283324 - RNA, 16 nt, Human
uauguacccucugaaa

SEQ ID NO: 1283325 - RNA, 18 nt, Human
uauguacccucugaaaua

SEQ ID NO: 1283326 - RNA, 19 nt, Human
uauguacccucugaaauac

SEQ ID NO: 1283327 - RNA, 20 nt, Human
uauguacccucugaaauaca

SEQ ID NO: 1283328 - RNA, 11 nt, Human
uauguaacaug

SEQ ID NO: 1283329 - RNA, 12 nt, Human
uauguaacaugu

SEQ ID NO: 1283330 - RNA, 12 nt, Human
uauguacaguua

SEQ ID NO: 1283331 - RNA, 15 nt, Human
uauguacaugagaag

SEQ ID NO: 1283332 - RNA, 14 nt, Human
uauguaccaagaau

SEQ ID NO: 1283333 - RNA, 23 nt, Human
uauguagaaaaaaguaaauguga

SEQ ID NO: 1283334 - RNA, 14 nt, Human
uauguagauaacaa

SEQ ID NO: 1283335 - RNA, 15 nt, Human
uauguagcaaaauac

SEQ ID NO: 1283336 - RNA, 15 nt, Human
uauguagcucuuugu

SEQ ID NO: 1283337 - RNA, 14 nt, Human
uauguaguaauuga

SEQ ID NO: 1283338 - RNA, 17 nt, Human
uauguaguaauugacau

SEQ ID NO: 1283339 - RNA, 20 nt, Human
uauguaguaauugacaugug

SEQ ID NO: 1283340 - RNA, 18 nt, Human
uauguauaacuuuaacuu

SEQ ID NO: 1283341 - RNA, 19 nt, Human
uauguaucaaauguaacuu

SEQ ID NO: 1283342 - RNA, 22 nt, Human
uauguauggguaggguaaauca

SEQ ID NO: 1283343 - RNA, 23 nt, Human
uauguauggguaggguaaaucag

SEQ ID NO: 1283344 - RNA, 17 nt, Human
uauguauggugcaaugu

SEQ ID NO: 1283345 - RNA, 20 nt, Human
uauguaaaugguaugucauu

SEQ ID NO: 1283346 - RNA, 21 nt, Human
uauguaaaugguaugucauuc

SEQ ID NO: 1283347 - RNA, 15 nt, Human
uauguaaauuaugua

SEQ ID NO: 1283348 - RNA, 15 nt, Human
uauguaaaacauuua

SEQ ID NO: 1283349 - RNA, 23 nt, Human
uauggauccacuggcuggacaaa

SEQ ID NO: 1283350 - RNA, 16 nt, Human
uauggauguccccagc

SEQ ID NO: 1283351 - RNA, 15 nt, Human
uauggauguccccag

SEQ ID NO: 1283352 - RNA, 13 nt, Human
uauggauucuaaa

SEQ ID NO: 1283353 - RNA, 14 nt, Human
uauggauucuaaaa

SEQ ID NO: 1283354 - RNA, 15 nt, Human
uauggauucuaaaau

SEQ ID NO: 1283355 - RNA, 22 nt, Human
uauggugccuaguauugacaaa

SEQ ID NO: 1283356 - RNA, 15 nt, Human
uauggugcucugucu

SEQ ID NO: 1283357 - RNA, 23 nt, Human
uauggugcucugucuacuugcuc

SEQ ID NO: 1283358 - RNA, 17 nt, Human
uaugguggauccaaacu

SEQ ID NO: 1283359 - RNA, 22 nt, Human
uaugguuuuugagauauuaaug

SEQ ID NO: 1283360 - RNA, 13 nt, Human
uauguaaaacauu

SEQ ID NO: 1283361 - RNA, 16 nt, Human
uauggauucuaaaaug

SEQ ID NO: 1283362 - RNA, 20 nt, Human
uauggcaaccauuauaaccu

SEQ ID NO: 1283363 - RNA, 12 nt, Human
uauguugcauag

SEQ ID NO: 1283364 - RNA, 14 nt, Human
uauguugauaaaag

SEQ ID NO: 1283365 - RNA, 23 nt, Human
uaugucaagggcagcuuugcuca

SEQ ID NO: 1283366 - RNA, 15 nt, Human
uaugucaucacucua

SEQ ID NO: 1283367 - RNA, 16 nt, Human
uaugucauuucauuuc

SEQ ID NO: 1283368 - RNA, 16 nt, Human
uaugucaagggcagcu

SEQ ID NO: 1283369 - RNA, 12 nt, Human
uauguauuuaua

SEQ ID NO: 1283370 - RNA, 15 nt, Human
uauguauugugcaau

SEQ ID NO: 1283371 - RNA, 17 nt, Human
uauguauugugcaaugu

SEQ ID NO: 1283372 - RNA, 20 nt, Human
uauguauugugcaaugugua

SEQ ID NO: 1283373 - RNA, 21 nt, Human
uauguauugugcaauguguau

SEQ ID NO: 1283374 - RNA, 19 nt, Human
uauguauuauuuacauuua

SEQ ID NO: 1283375 - RNA, 21 nt, Human
uauguauuauuuacauuuaau

SEQ ID NO: 1283376 - RNA, 16 nt, Human
uauguugcauagaaua

SEQ ID NO: 1283377 - RNA, 20 nt, Human
uauuaaauuuuuuaaaaagc

SEQ ID NO: 1283378 - RNA, 22 nt, Human
uauuaaauuuuuuaaaaagcaa

SEQ ID NO: 1283379 - RNA, 19 nt, Human
uauuaaauuuuuuguugac

SEQ ID NO: 1283380 - RNA, 20 nt, Human
uauuaaauuuuuuguugaca

SEQ ID NO: 1283381 - RNA, 12 nt, Human
uauuaagaauga

SEQ ID NO: 1283382 - RNA, 20 nt, Human
uauuaagaaaggaagcauug

SEQ ID NO: 1283383 - RNA, 21 nt, Human
uauuaagaaaggaagcauugu

SEQ ID NO: 1283384 - RNA, 23 nt, Human
uauuaagaaaggaagcauuguaa

SEQ ID NO: 1283385 - RNA, 24 nt, Human
uauuaagaaaggaagcauuguaaa

SEQ ID NO: 1283386 - RNA, 23 nt, Human
uauuaaauuuuuuguugacauua

SEQ ID NO: 1283387 - RNA, 12 nt, Human
uauuaagaaagg

SEQ ID NO: 1283388 - RNA, 13 nt, Human
uauuaagaaagga

SEQ ID NO: 1283389 - RNA, 14 nt, Human
uauuaagaaaggaa

SEQ ID NO: 1283390 - RNA, 18 nt, Human
uauuaauauauauuaucu

SEQ ID NO: 1283391 - RNA, 23 nt, Human
uauuaauauauauuaucuuuuca

SEQ ID NO: 1283392 - RNA, 22 nt, Human
uauuaauauauauuaucuuuuc

SEQ ID NO: 1283393 - RNA, 14 nt, Human
uauuaaucuuagug

SEQ ID NO: 1283394 - RNA, 17 nt, Human
uauuaaucuuaguguau

SEQ ID NO: 1283395 - RNA, 18 nt, Human
uauuaaucuuaguguaug

SEQ ID NO: 1283396 - RNA, 13 nt, Human
uauuaaugaaaau

SEQ ID NO: 1283397 - RNA, 12 nt, Human
uauuaaugcacu

SEQ ID NO: 1283398 - RNA, 13 nt, Human
uauuaaugcacuu

SEQ ID NO: 1283399 - RNA, 14 nt, Human
uauuaaugcacuuu

SEQ ID NO: 1283400 - RNA, 17 nt, Human
uauuaaugcacuuucua

SEQ ID NO: 1283401 - RNA, 20 nt, Human
uauuaaugcacuuucuaucc

SEQ ID NO: 1283402 - RNA, 15 nt, Human
uauuaaugcccagac

SEQ ID NO: 1283403 - RNA, 20 nt, Human
ucaaaucaaucuguaaaacu

SEQ ID NO: 1283404 - RNA, 23 nt, Human
ucaaauauauucagccuggcuuc

SEQ ID NO: 1283405 - RNA, 22 nt, Human
ucaaauauauucagccuggcuu

SEQ ID NO: 1283406 - RNA, 14 nt, Human
ucaaagaaggcauu

SEQ ID NO: 1283407 - RNA, 23 nt, Human
ucaaaaauuaaaccggaccaucu

SEQ ID NO: 1283408 - RNA, 20 nt, Human
ucaaaaauuaucuauagcua

SEQ ID NO: 1283409 - RNA, 12 nt, Human
ucaaaaauuaaa

SEQ ID NO: 1283410 - RNA, 16 nt, Human
ucaaaacaaaggccua

SEQ ID NO: 1283411 - RNA, 14 nt, Human
ucaaaacacuugua

SEQ ID NO: 1283412 - RNA, 17 nt, Human
ucaaaacacuuguaauu

SEQ ID NO: 1283413 - RNA, 24 nt, Human
ucaaaacacuuguaauuuuguauc

SEQ ID NO: 1283414 - RNA, 14 nt, Human
ucaaaacagauugu

SEQ ID NO: 1283415 - RNA, 16 nt, Human
ucaaaacagauuguuu

SEQ ID NO: 1283416 - RNA, 19 nt, Human
ucaaaacagauuguuugca

SEQ ID NO: 1283417 - RNA, 15 nt, Human
ucaaauccuugaaga

SEQ ID NO: 1283418 - RNA, 16 nt, Human
ucaaaugaguaacauu

SEQ ID NO: 1283419 - RNA, 22 nt, Human
ucaaaugaguaacauuugcugu

SEQ ID NO: 1283420 - RNA, 18 nt, Human
ucaaauggggccagaucc

SEQ ID NO: 1283421 - RNA, 19 nt, Human
ucaaauggggccagaucca

SEQ ID NO: 1283422 - RNA, 21 nt, Human
ucaaauguuuaaucauauaaa

SEQ ID NO: 1283423 - RNA, 13 nt, Human
ucaaauucaaaua

SEQ ID NO: 1283424 - RNA, 14 nt, Human
ucaaauucuucuga

SEQ ID NO: 1283425 - RNA, 15 nt, Human
ucaaauucuucugaa

SEQ ID NO: 1283426 - RNA, 20 nt, Human
ucaaauuguaagcaugcaca

SEQ ID NO: 1283427 - RNA, 17 nt, Human
ucaaauuguaagcaugc

SEQ ID NO: 1283428 - RNA, 14 nt, Human
ucaaauugugugaa

SEQ ID NO: 1283429 - RNA, 16 nt, Human
ucaaauucuucugaac

SEQ ID NO: 1283430 - RNA, 21 nt, Human
ucaaauucuucugaacucaaa

SEQ ID NO: 1283431 - RNA, 15 nt, Human
ucaaauugugugaaa

SEQ ID NO: 1283432 - RNA, 22 nt, Human
ucaaauugugcaguacuuugug

SEQ ID NO: 1283433 - RNA, 13 nt, Human
uauuuuuugaaaa

SEQ ID NO: 1283434 - RNA, 14 nt, Human
uauuuuuuguauaa

SEQ ID NO: 1283435 - RNA, 16 nt, Human
uauuuuuuguauaauu

SEQ ID NO: 1283436 - RNA, 17 nt, Human
uauuuuuuguauaauug

SEQ ID NO: 1283437 - RNA, 21 nt, Human
uauuuucugugccugaauauu

SEQ ID NO: 1283438 - RNA, 16 nt, Human
uauuuuuucaguauua

SEQ ID NO: 1283439 - RNA, 19 nt, Human
uauuuuuucuuuucuuuac

SEQ ID NO: 1283440 - RNA, 21 nt, Human
uauuuuccuauauuacgguuu

SEQ ID NO: 1283441 - RNA, 22 nt, Human
uauuuucugguaaaaagaaaaa

SEQ ID NO: 1283442 - RNA, 17 nt, Human
uauuuuuuuuaaguauu

SEQ ID NO: 1283443 - RNA, 18 nt, Human
uauuuuuuuuuaagcucu

SEQ ID NO: 1283444 - RNA, 13 nt, Human
uauuuuauuauga

SEQ ID NO: 1283445 - RNA, 16 nt, Human
uauuuauauauguauu

SEQ ID NO: 1283446 - RNA, 23 nt, Human
uauuuauauauguauuuauaaau

SEQ ID NO: 1283447 - RNA, 17 nt, Human
uauuuuauguugcauag

SEQ ID NO: 1283448 - RNA, 16 nt, Human
uauuuucaaaaccagg

SEQ ID NO: 1283449 - RNA, 19 nt, Human
uauuuucaacgcagcccug

SEQ ID NO: 1283450 - RNA, 14 nt, Human
uauuuucaaaacca

SEQ ID NO: 1283451 - RNA, 17 nt, Human
uauuuucaaaaccaggu

SEQ ID NO: 1283452 - RNA, 13 nt, Human
uauuuuccaggcu

SEQ ID NO: 1283453 - RNA, 17 nt, Human
uauuuuauuaugaagaa

SEQ ID NO: 1283454 - RNA, 17 nt, Human
ucaaugccccugaauuu

SEQ ID NO: 1283455 - RNA, 15 nt, Human
ucaaugcaguugucu

SEQ ID NO: 1283456 - RNA, 17 nt, Human
ucaaugcaguugucucu

SEQ ID NO: 1283457 - RNA, 18 nt, Human
ucaaugcaguugucucug

SEQ ID NO: 1283458 - RNA, 19 nt, Human
ucaaugcaguugucucugu

SEQ ID NO: 1283459 - RNA, 18 nt, Human
ucaaugccccugaauuua

SEQ ID NO: 1283460 - RNA, 20 nt, Human
ucaaugccccugaauuuaaa

SEQ ID NO: 1283461 - RNA, 22 nt, Human
ucaaugccccugaauuuaaaua

SEQ ID NO: 1283462 - RNA, 22 nt, Human
ucaauaagccucagcuuucuaa

SEQ ID NO: 1283463 - RNA, 15 nt, Human
ucaauaauauauuuu

SEQ ID NO: 1283464 - RNA, 18 nt, Human
ucaauaauauauuuucug

SEQ ID NO: 1283465 - RNA, 19 nt, Human
ucaauaauauauuuucugu

SEQ ID NO: 1283466 - RNA, 20 nt, Human
ucaauaauauauuuucuguu

SEQ ID NO: 1283467 - RNA, 16 nt, Human
ucaauaauccaugaaa

SEQ ID NO: 1283468 - RNA, 21 nt, Human
ucaauaaaauccauacauuug

SEQ ID NO: 1283469 - RNA, 13 nt, Human
ucaaguugugcca

SEQ ID NO: 1283470 - RNA, 16 nt, Human
ucaaguugauuagaaa

SEQ ID NO: 1283471 - RNA, 23 nt, Human
ucaaguuguuccuuaagucagaa

SEQ ID NO: 1283472 - RNA, 13 nt, Human
ucaaguucuaaga

SEQ ID NO: 1283473 - RNA, 14 nt, Human
ucaaguucuaagau

SEQ ID NO: 1283474 - RNA, 15 nt, Human
ucaaguucuaagauu

SEQ ID NO: 1283475 - RNA, 16 nt, Human
ucaaguucuaagauuc

SEQ ID NO: 1283476 - RNA, 17 nt, Human
ucaaguucuaagauucu

SEQ ID NO: 1283477 - RNA, 18 nt, Human
ucaaguucuaagauucua

SEQ ID NO: 1283478 - RNA, 19 nt, Human
ucaaguucuaagauucuaa

SEQ ID NO: 1283479 - RNA, 15 nt, Human
ucaaguugaggggcu

SEQ ID NO: 1283480 - RNA, 17 nt, Human
ucaaguugaggggcuuc

SEQ ID NO: 1283481 - RNA, 21 nt, Human
ucaaguugauuagaaagacca

SEQ ID NO: 1283482 - RNA, 19 nt, Human
ucaauaaaauuauagcucu

SEQ ID NO: 1283483 - RNA, 17 nt, Human
ucaauaaaauuauagcu

SEQ ID NO: 1283484 - RNA, 15 nt, Human
ucaauaaaauuauag

SEQ ID NO: 1283485 - RNA, 14 nt, Human
ucaauaaaauuaua

SEQ ID NO: 1283486 - RNA, 14 nt, Human
ucaacgcagcccug

SEQ ID NO: 1283487 - RNA, 15 nt, Human
ucaacgcagcccugc

SEQ ID NO: 1283488 - RNA, 18 nt, Human
ucaacgcagcccugcuuu

SEQ ID NO: 1283489 - RNA, 18 nt, Human
ucaaccugggcaaagccu

SEQ ID NO: 1283490 - RNA, 19 nt, Human
ucaaccuguucaucuugaa

SEQ ID NO: 1283491 - RNA, 15 nt, Human
ucaaccuuaagaccu

SEQ ID NO: 1283492 - RNA, 23 nt, Human
ucaaccuuaagaccuacuguucu

SEQ ID NO: 1283493 - RNA, 16 nt, Human
ucacagucacauucca

SEQ ID NO: 1283494 - RNA, 18 nt, Human
ucacaagacccaaaaggc

SEQ ID NO: 1283495 - RNA, 17 nt, Human
ucacaagacccaaaagg

SEQ ID NO: 1283496 - RNA, 13 nt, Human
ucacaagacccaa

SEQ ID NO: 1283497 - RNA, 13 nt, Human
ucaauuaccacac

SEQ ID NO: 1283498 - RNA, 15 nt, Human
ucaauuacucuauaa

SEQ ID NO: 1283499 - RNA, 16 nt, Human
ucaauuacucuauaau

SEQ ID NO: 1283500 - RNA, 13 nt, Human
ucaauuacugguc

SEQ ID NO: 1283501 - RNA, 16 nt, Human
ucaauuacugguccaa

SEQ ID NO: 1283502 - RNA, 20 nt, Human
ucaauuacugguccaaaaga

SEQ ID NO: 1283503 - RNA, 22 nt, Human
ucacacccaacuugguuuugcu

SEQ ID NO: 1283504 - RNA, 20 nt, Human
ucacaccugaacugaacacc

SEQ ID NO: 1283505 - RNA, 18 nt, Human
ucacagugcucuuuucuc

SEQ ID NO: 1283506 - RNA, 20 nt, Human
ucacagugcucuuuucuccu

SEQ ID NO: 1283507 - RNA, 16 nt, Human
ucacagugcuuuuaag

SEQ ID NO: 1283508 - RNA, 18 nt, Human
ucacagugcuuuuaagug

SEQ ID NO: 1283509 - RNA, 16 nt, Human
ucacagugaacacuca

SEQ ID NO: 1283510 - RNA, 17 nt, Human
ucacagugcucuuuucu

SEQ ID NO: 1283511 - RNA, 11 nt, Human
ucacauuuucc

SEQ ID NO: 1283512 - RNA, 14 nt, Human
ucacauuuuccuuu

SEQ ID NO: 1283513 - RNA, 16 nt, Human
ucacauuuuccuuuuc

SEQ ID NO: 1283514 - RNA, 17 nt, Human
ucacauuuuccuuuuca

SEQ ID NO: 1283515 - RNA, 18 nt, Human
ucacauuuuccuuuucaa

SEQ ID NO: 1283516 - RNA, 14 nt, Human
ucaccaaggcugau

SEQ ID NO: 1283517 - RNA, 18 nt, Human
ucaccagaucugauuugu

SEQ ID NO: 1283518 - RNA, 15 nt, Human
ucaccagauuugcua

SEQ ID NO: 1283519 - RNA, 21 nt, Human
ucaccagauuugcuaauuuau

SEQ ID NO: 1283520 - RNA, 15 nt, Human
ucaccaauguaccca

SEQ ID NO: 1283521 - RNA, 23 nt, Human
ucaccaauguacccaccgggcca

SEQ ID NO: 1283522 - RNA, 12 nt, Human
ucaccacaaacu

SEQ ID NO: 1283523 - RNA, 22 nt, Human
ucaccacaaacuguaauacaau

SEQ ID NO: 1283524 - RNA, 15 nt, Human
ucauuccauucugga

SEQ ID NO: 1283525 - RNA, 14 nt, Human
ucauuccauucugg

SEQ ID NO: 1283526 - RNA, 17 nt, Human
ucauuccaugugcccag

SEQ ID NO: 1283527 - RNA, 18 nt, Human
ucauuccaugugcccagu

SEQ ID NO: 1283528 - RNA, 19 nt, Human
ucauuccaugugcccaguu

SEQ ID NO: 1283529 - RNA, 20 nt, Human
ucauuccaugugcccaguua

SEQ ID NO: 1283530 - RNA, 16 nt, Human
ucauuccaugugccca

SEQ ID NO: 1283531 - RNA, 23 nt, Human
ucauuccaccuucccaugcccug

SEQ ID NO: 1283532 - RNA, 14 nt, Human
ucauucauuuuugu

SEQ ID NO: 1283533 - RNA, 22 nt, Human
ucauucacaucgcagauucucc

SEQ ID NO: 1283534 - RNA, 20 nt, Human
ucauucacaucgcagauucu

SEQ ID NO: 1283535 - RNA, 17 nt, Human
ucauuauuuauguauug

SEQ ID NO: 1283536 - RNA, 16 nt, Human
ucauuauuuauguauu

SEQ ID NO: 1283537 - RNA, 14 nt, Human
ucauuauuuaugua

SEQ ID NO: 1283538 - RNA, 22 nt, Human
ucauucaaguguaaaauauuuu

SEQ ID NO: 1283539 - RNA, 12 nt, Human
ucaugcugccuu

SEQ ID NO: 1283540 - RNA, 14 nt, Human
ucaugcugggauuu

SEQ ID NO: 1283541 - RNA, 20 nt, Human
ucaugcugggauuuccaacu

SEQ ID NO: 1283542 - RNA, 22 nt, Human
ucauuagucauguuuaucugcu

SEQ ID NO: 1283543 - RNA, 18 nt, Human
ucaugcugggauuuccaa

SEQ ID NO: 1283544 - RNA, 19 nt, Human
ucauuagucauguuuaucu

SEQ ID NO: 1283545 - RNA, 22 nt, Human
ucauuaugcacuugggagaaaa

SEQ ID NO: 1283546 - RNA, 19 nt, Human
ucauuauuacuuuugcugu

SEQ ID NO: 1283547 - RNA, 23 nt, Human
ucauuauucguagauauuggaca

SEQ ID NO: 1283548 - RNA, 12 nt, Human
ucauuucaggau

SEQ ID NO: 1283549 - RNA, 12 nt, Human
ucauuucaucua

SEQ ID NO: 1283550 - RNA, 13 nt, Human
ucauuucacugua

SEQ ID NO: 1283551 - RNA, 21 nt, Human
ucauuucacuguagcucuaaa

SEQ ID NO: 1283552 - RNA, 13 nt, Human
ucauuucagaagu

SEQ ID NO: 1283553 - RNA, 21 nt, Human
ucauuucagaaguuaguuugu

SEQ ID NO: 1283554 - RNA, 19 nt, Human
ucauuccauucuggaagug

SEQ ID NO: 1283555 - RNA, 16 nt, Human
ucauuccauucuggaa

SEQ ID NO: 1283556 - RNA, 20 nt, Human
ucauuguguuaccuguagau

SEQ ID NO: 1283557 - RNA, 18 nt, Human
ucauugugaaauuauuca

SEQ ID NO: 1283558 - RNA, 17 nt, Human
ucauugugaaauuauuc

SEQ ID NO: 1283559 - RNA, 15 nt, Human
ucauugugaaauuau

SEQ ID NO: 1283560 - RNA, 12 nt, Human
ucauugugaaau

SEQ ID NO: 1283561 - RNA, 13 nt, Human
ucauuuccaagca

SEQ ID NO: 1283562 - RNA, 16 nt, Human
ucauuuccaagcaagu

SEQ ID NO: 1283563 - RNA, 15 nt, Human
ucauuucauuuccua

SEQ ID NO: 1283564 - RNA, 13 nt, Human
ucauuuccucaaa

SEQ ID NO: 1283565 - RNA, 13 nt, Human
ucauuucuauuuc

SEQ ID NO: 1283566 - RNA, 14 nt, Human
ucauagcuaaaaaa

SEQ ID NO: 1283567 - RNA, 22 nt, Human
ucauagcccaguagaccuuguu

SEQ ID NO: 1283568 - RNA, 21 nt, Human
ucauagcccucacccuggggc

SEQ ID NO: 1283569 - RNA, 14 nt, Human
ucauagcccaguag

SEQ ID NO: 1283570 - RNA, 14 nt, Human
ucagggcuccuggg

SEQ ID NO: 1283571 - RNA, 13 nt, Human
ucaucuucacugc

SEQ ID NO: 1283572 - RNA, 18 nt, Human
ucaucuucaguugucucu

SEQ ID NO: 1283573 - RNA, 20 nt, Human
ucaucuucaguugucucuga

SEQ ID NO: 1283574 - RNA, 15 nt, Human
ucaucuuauucagca

SEQ ID NO: 1283575 - RNA, 16 nt, Human
ucaucuuauucagcac

SEQ ID NO: 1283576 - RNA, 16 nt, Human
ucaucuucuucaccau

SEQ ID NO: 1283577 - RNA, 15 nt, Human
ucaucaggaacguuu

SEQ ID NO: 1283578 - RNA, 16 nt, Human
ucaucagaaaggaaaa

SEQ ID NO: 1283579 - RNA, 14 nt, Human
ucaucacacugggu

SEQ ID NO: 1283580 - RNA, 21 nt, Human
ucaucacuuugaccuaaauua

SEQ ID NO: 1283581 - RNA, 19 nt, Human
ucaucagaaaggaaaaaca

SEQ ID NO: 1283582 - RNA, 20 nt, Human
uccaggguggcagcaacaau

SEQ ID NO: 1283583 - RNA, 18 nt, Human
uccaggguggcagcaaca

SEQ ID NO: 1283584 - RNA, 15 nt, Human
uccaggguggcagca

SEQ ID NO: 1283585 - RNA, 14 nt, Human
uccaggguggcagc

SEQ ID NO: 1283586 - RNA, 21 nt, Human
uccagcuuuguucuucuuaaa

SEQ ID NO: 1283587 - RNA, 16 nt, Human
uccagggucccucugu

SEQ ID NO: 1283588 - RNA, 17 nt, Human
uccagggucccucugug

SEQ ID NO: 1283589 - RNA, 18 nt, Human
uccagggucccucugugu

SEQ ID NO: 1283590 - RNA, 17 nt, Human
uccagcuuuccuguauu

SEQ ID NO: 1283591 - RNA, 16 nt, Human
uccagguguuacugua

SEQ ID NO: 1283592 - RNA, 11 nt, Human
uccaggguggu

SEQ ID NO: 1283593 - RNA, 17 nt, Human
uccagggugugugcucg

SEQ ID NO: 1283594 - RNA, 14 nt, Human
uccagccccucugg

SEQ ID NO: 1283595 - RNA, 15 nt, Human
uccagccaucaccuu

SEQ ID NO: 1283596 - RNA, 14 nt, Human
uccagcuguccccc

SEQ ID NO: 1283597 - RNA, 16 nt, Human
uccagcugucccccca

SEQ ID NO: 1283598 - RNA, 17 nt, Human
uccagcuguccccccac

SEQ ID NO: 1283599 - RNA, 21 nt, Human
uccagcuguccccccacuccc

SEQ ID NO: 1283600 - RNA, 20 nt, Human
uccagcuguugagccccucc

SEQ ID NO: 1283601 - RNA, 19 nt, Human
uccagccaucaagagacug

SEQ ID NO: 1283602 - RNA, 20 nt, Human
uccagccaucaagagacuga

SEQ ID NO: 1283603 - RNA, 21 nt, Human
uccagccaucaagagacugag

SEQ ID NO: 1283604 - RNA, 24 nt, Human
uccagccaucaagagacugaguca

SEQ ID NO: 1283605 - RNA, 17 nt, Human
uccacuuggucugugag

SEQ ID NO: 1283606 - RNA, 12 nt, Human
uccaccuuccca

SEQ ID NO: 1283607 - RNA, 15 nt, Human
uccaccuucccacuu

SEQ ID NO: 1283608 - RNA, 16 nt, Human
uccacuuggucuguga

SEQ ID NO: 1283609 - RNA, 15 nt, Human
uccacuuggucugug

SEQ ID NO: 1283610 - RNA, 15 nt, Human
uccaccuucccaugc

SEQ ID NO: 1283611 - RNA, 19 nt, Human
uccacagaagcuccaggua

SEQ ID NO: 1283612 - RNA, 14 nt, Human
uccacacugcacaa

SEQ ID NO: 1283613 - RNA, 10 nt, Human
uccacagacg

SEQ ID NO: 1283614 - RNA, 23 nt, Human
uccacagacggaaggguaaacaa

SEQ ID NO: 1283615 - RNA, 22 nt, Human
uccacagacggaaggguaaaca

SEQ ID NO: 1283616 - RNA, 15 nt, Human
uccacagaggacaca

SEQ ID NO: 1283617 - RNA, 17 nt, Human
uccacagaggacacaga

SEQ ID NO: 1283618 - RNA, 19 nt, Human
uccacagaggacacagaga

SEQ ID NO: 1283619 - RNA, 17 nt, Human
uccacagcaaccccagg

SEQ ID NO: 1283620 - RNA, 21 nt, Human
uccaccccuuucuagaccaau

SEQ ID NO: 1283621 - RNA, 22 nt, Human
uccaccccuuucuagaccaaua

SEQ ID NO: 1283622 - RNA, 20 nt, Human
uccaccugguacucccucuc

SEQ ID NO: 1283623 - RNA, 21 nt, Human
uccaccugguacucccucuca

SEQ ID NO: 1283624 - RNA, 23 nt, Human
uccaccugguacucccucucagg

SEQ ID NO: 1283625 - RNA, 18 nt, Human
uccaauuuaguuguugua

SEQ ID NO: 1283626 - RNA, 16 nt, Human
uccaaaaugugccuau

SEQ ID NO: 1283627 - RNA, 14 nt, Human
uccaauuuucugga

SEQ ID NO: 1283628 - RNA, 18 nt, Human
uccaauuuucuggaauac

SEQ ID NO: 1283629 - RNA, 17 nt, Human
ucauuucuauuucuccu

SEQ ID NO: 1283630 - RNA, 21 nt, Human
ucauuucuauuucuccuccau

SEQ ID NO: 1283631 - RNA, 18 nt, Human
uccaaaaucuugaucagu

SEQ ID NO: 1283632 - RNA, 15 nt, Human
uccaaaaugugccua

SEQ ID NO: 1283633 - RNA, 22 nt, Human
uccaaaauguuggucauuuuau

SEQ ID NO: 1283634 - RNA, 13 nt, Human
uccacacugcaca

SEQ ID NO: 1283635 - RNA, 15 nt, Human
uccacacugcacaau

SEQ ID NO: 1283636 - RNA, 22 nt, Human
ucagaguaauccaagcaaaugu

SEQ ID NO: 1283637 - RNA, 21 nt, Human
ucagaguaauccaagcaaaug

SEQ ID NO: 1283638 - RNA, 19 nt, Human
ucagaggguguccugcacc

SEQ ID NO: 1283639 - RNA, 12 nt, Human
ucagagaauuuc

SEQ ID NO: 1283640 - RNA, 13 nt, Human
ucagacuggggca

SEQ ID NO: 1283641 - RNA, 14 nt, Human
ucagagaaggaaca

SEQ ID NO: 1283642 - RNA, 13 nt, Human
ucagagaauuucu

SEQ ID NO: 1283643 - RNA, 17 nt, Human
ucagacagagaggacug

SEQ ID NO: 1283644 - RNA, 22 nt, Human
ucagacagagaggacuguaggg

SEQ ID NO: 1283645 - RNA, 23 nt, Human
ucagaccauaauguuacauuauu

SEQ ID NO: 1283646 - RNA, 14 nt, Human
ucagacccuggagg

SEQ ID NO: 1283647 - RNA, 12 nt, Human
ucagacccugga

SEQ ID NO: 1283648 - RNA, 17 nt, Human
ucagacgccugaggaac

SEQ ID NO: 1283649 - RNA, 16 nt, Human
ucagacgccugaggaa

SEQ ID NO: 1283650 - RNA, 14 nt, Human
ucagacuguuuagu

SEQ ID NO: 1283651 - RNA, 22 nt, Human
ucagaaacacccucacacuggg

SEQ ID NO: 1283652 - RNA, 21 nt, Human
ucagaaacacccucacacugg

SEQ ID NO: 1283653 - RNA, 19 nt, Human
ucagaaacacccucacacu

SEQ ID NO: 1283654 - RNA, 20 nt, Human
ucacuuguuuuauuuaaccu

SEQ ID NO: 1283655 - RNA, 21 nt, Human
ucacuuuacacaauagaauua

SEQ ID NO: 1283656 - RNA, 15 nt, Human
ucagaaaccagacuc

SEQ ID NO: 1283657 - RNA, 13 nt, Human
ucagaaagacuug

SEQ ID NO: 1283658 - RNA, 14 nt, Human
ucagaauuuagugu

SEQ ID NO: 1283659 - RNA, 21 nt, Human
ucagaauuuaguguauccaua

SEQ ID NO: 1283660 - RNA, 20 nt, Human
ucagaauuuuauacuuuccc

SEQ ID NO: 1283661 - RNA, 21 nt, Human
ucagaauuuuauacuuucccu

SEQ ID NO: 1283662 - RNA, 22 nt, Human
ucagaauuuuauacuuucccua

SEQ ID NO: 1283663 - RNA, 23 nt, Human
ucagaauuuuauacuuucccuac

SEQ ID NO: 1283664 - RNA, 18 nt, Human
ucagacagaaccccuaca

SEQ ID NO: 1283665 - RNA, 22 nt, Human
ucacucuguucauuccuccagg

SEQ ID NO: 1283666 - RNA, 15 nt, Human
ucacucuuaugcugu

SEQ ID NO: 1283667 - RNA, 18 nt, Human
ucacugcauccuccgccu

SEQ ID NO: 1283668 - RNA, 19 nt, Human
ucacugcauccuccgccuc

SEQ ID NO: 1283669 - RNA, 20 nt, Human
ucacucuuaugcuguaccca

SEQ ID NO: 1283670 - RNA, 21 nt, Human
ucacucuguucauuccuccag

SEQ ID NO: 1283671 - RNA, 20 nt, Human
ucacucuguucauuccucca

SEQ ID NO: 1283672 - RNA, 23 nt, Human
ucaccccuaaaagaaacccugca

SEQ ID NO: 1283673 - RNA, 19 nt, Human
ucacugcuugaacuaggcu

SEQ ID NO: 1283674 - RNA, 17 nt, Human
ucacugcuggcugccuu

SEQ ID NO: 1283675 - RNA, 18 nt, Human
ucacugcuggcugccuua

SEQ ID NO: 1283676 - RNA, 22 nt, Human
ucacugcuggcugccuuagaac

SEQ ID NO: 1283677 - RNA, 12 nt, Human
ucacugcuggcu

SEQ ID NO: 1283678 - RNA, 14 nt, Human
ucacugcucacacu

SEQ ID NO: 1283679 - RNA, 13 nt, Human
ucacugcuggcug

SEQ ID NO: 1283680 - RNA, 14 nt, Human
ucacugcuggcugc

SEQ ID NO: 1283681 - RNA, 15 nt, Human
ucacugcuggcugcc

SEQ ID NO: 1283682 - RNA, 16 nt, Human
ucacugcuggcugccu

SEQ ID NO: 1283683 - RNA, 22 nt, Human
ucacugcuguuauauuucauca

SEQ ID NO: 1283684 - RNA, 23 nt, Human
ucacugcuguuauauuucaucau

SEQ ID NO: 1283685 - RNA, 18 nt, Human
ucacuggaccacugggca

SEQ ID NO: 1283686 - RNA, 11 nt, Human
ucacuggagca

SEQ ID NO: 1283687 - RNA, 13 nt, Human
ucacuggagcaca

SEQ ID NO: 1283688 - RNA, 14 nt, Human
ucacuggagcacaa

SEQ ID NO: 1283689 - RNA, 15 nt, Human
ucacuggagcacaau

SEQ ID NO: 1283690 - RNA, 16 nt, Human
ucacuggagcacaaua

SEQ ID NO: 1283691 - RNA, 18 nt, Human
ucacugguagaccaaaau

SEQ ID NO: 1283692 - RNA, 19 nt, Human
ucacugguagaccaaaaua

SEQ ID NO: 1283693 - RNA, 20 nt, Human
ucacugguagaccaaaauaa

SEQ ID NO: 1283694 - RNA, 20 nt, Human
ucacuguagaaugauuucau

SEQ ID NO: 1283695 - RNA, 15 nt, Human
ucagauaugauucaa

SEQ ID NO: 1283696 - RNA, 16 nt, Human
ucagauaugauucaaa

SEQ ID NO: 1283697 - RNA, 23 nt, Human
ucagauaucuuggacaaaucaca

SEQ ID NO: 1283698 - RNA, 14 nt, Human
ucagcaugaauuug

SEQ ID NO: 1283699 - RNA, 15 nt, Human
ucagcaugaauuugu

SEQ ID NO: 1283700 - RNA, 17 nt, Human
ucagcaugaauuuguaa

SEQ ID NO: 1283701 - RNA, 18 nt, Human
ucagcaugaauuuguaau

SEQ ID NO: 1283702 - RNA, 19 nt, Human
ucagcaugaauuuguaaug

SEQ ID NO: 1283703 - RNA, 15 nt, Human
ucagcaugcaauaca

SEQ ID NO: 1283704 - RNA, 12 nt, Human
ucagcaugucua

SEQ ID NO: 1283705 - RNA, 17 nt, Human
ucagcauucucacuccu

SEQ ID NO: 1283706 - RNA, 20 nt, Human
ucagcauucucacuccuacc

SEQ ID NO: 1283707 - RNA, 16 nt, Human
ucagcaugucuauuca

SEQ ID NO: 1283708 - RNA, 19 nt, Human
ucagcaugucuauucagcu

SEQ ID NO: 1283709 - RNA, 21 nt, Human
ucagcaugucuauucagcuuc

SEQ ID NO: 1283710 - RNA, 21 nt, Human
ucagauaucuuggacaaauca

SEQ ID NO: 1283711 - RNA, 22 nt, Human
ucagauaucuuggacaaaucac

SEQ ID NO: 1283712 - RNA, 20 nt, Human
ucagccucccgaguagcugg

SEQ ID NO: 1283713 - RNA, 23 nt, Human
ucagcauucucacuccuaccugg

SEQ ID NO: 1283714 - RNA, 20 nt, Human
ucagccuccugaguagcugg

SEQ ID NO: 1283715 - RNA, 16 nt, Human
ucagccucccaaagug

SEQ ID NO: 1283716 - RNA, 22 nt, Human
ucagccuccugaguagcuggga

SEQ ID NO: 1283717 - RNA, 12 nt, Human
ucagccuggcca

SEQ ID NO: 1283718 - RNA, 14 nt, Human
ucagccuggccaga

SEQ ID NO: 1283719 - RNA, 15 nt, Human
ucagccuggccagac

SEQ ID NO: 1283720 - RNA, 16 nt, Human
ucagccuggccagaca

SEQ ID NO: 1283721 - RNA, 17 nt, Human
ucagccuggccagacac

SEQ ID NO: 1283722 - RNA, 18 nt, Human
ucagccuggccagacaca

SEQ ID NO: 1283723 - RNA, 19 nt, Human
ucagccuggccagacacag

SEQ ID NO: 1283724 - RNA, 23 nt, Human
ucaggagcccugggaggcucugg

SEQ ID NO: 1283725 - RNA, 20 nt, Human
ucaggagcccugggaggcuc

SEQ ID NO: 1283726 - RNA, 20 nt, Human
ucagcugcauuccgcagccc

SEQ ID NO: 1283727 - RNA, 14 nt, Human
ucaggagccuguga

SEQ ID NO: 1283728 - RNA, 13 nt, Human
ucaggauugcgag

SEQ ID NO: 1283729 - RNA, 15 nt, Human
ucaggauugcgagag

SEQ ID NO: 1283730 - RNA, 19 nt, Human
ucaggagcccugggaggcu

SEQ ID NO: 1283731 - RNA, 20 nt, Human
ucagcugcaagguacucugg

SEQ ID NO: 1283732 - RNA, 21 nt, Human
ucagcugcaagguacucuggu

SEQ ID NO: 1283733 - RNA, 22 nt, Human
ucagcugcaagguacucuggug

SEQ ID NO: 1283734 - RNA, 18 nt, Human
ucagcugcauuccgcagc

SEQ ID NO: 1283735 - RNA, 12 nt, Human
ucagcugccagu

SEQ ID NO: 1283736 - RNA, 17 nt, Human
ucaggcuagauguaugu

SEQ ID NO: 1283737 - RNA, 19 nt, Human
ucaggcacugggcaugagg

SEQ ID NO: 1283738 - RNA, 18 nt, Human
ucaggauugcgagagaug

SEQ ID NO: 1283739 - RNA, 20 nt, Human
ucaggauugcgagagaugug

SEQ ID NO: 1283740 - RNA, 21 nt, Human
ucaggauugcgagagaugugu

SEQ ID NO: 1283741 - RNA, 22 nt, Human
ucaggauugcgagagaugugug

SEQ ID NO: 1283742 - RNA, 23 nt, Human
ucaggauugcgagagaugugugu

SEQ ID NO: 1283743 - RNA, 13 nt, Human
ucaggcacacagc

SEQ ID NO: 1283744 - RNA, 14 nt, Human
ucaggcacacagcu

SEQ ID NO: 1283745 - RNA, 18 nt, Human
ucaggcacugggcaugag

SEQ ID NO: 1283746 - RNA, 18 nt, Human
ucagggccaugcugaggc

SEQ ID NO: 1283747 - RNA, 19 nt, Human
ucagggccaugcugaggcc

SEQ ID NO: 1283748 - RNA, 21 nt, Human
ucagggccaugcugaggccug

SEQ ID NO: 1283749 - RNA, 23 nt, Human
ucagggccaugcugaggccuggg

SEQ ID NO: 1283750 - RNA, 18 nt, Human
ucagggaaagugggacag

SEQ ID NO: 1283751 - RNA, 23 nt, Human
ucagggacucaucuuucccuccu

SEQ ID NO: 1283752 - RNA, 15 nt, Human
ucagggaggcccugu

SEQ ID NO: 1283753 - RNA, 15 nt, Human
ucagggaggucauuu

SEQ ID NO: 1283754 - RNA, 19 nt, Human
ucagggaggcccugugccc

SEQ ID NO: 1283755 - RNA, 22 nt, Human
ucagggaggcccugugccccuu

SEQ ID NO: 1283756 - RNA, 19 nt, Human
ucagggaguguucccuauc

SEQ ID NO: 1283757 - RNA, 15 nt, Human
ucagggcaaagccag

SEQ ID NO: 1283758 - RNA, 16 nt, Human
ucagggcaaagccagg

SEQ ID NO: 1283759 - RNA, 20 nt, Human
ucagggcaaagccagguccc

SEQ ID NO: 1283760 - RNA, 21 nt, Human
ucagggcaaagccaggucccu

SEQ ID NO: 1283761 - RNA, 22 nt, Human
ucagggcaaagccaggucccuc

SEQ ID NO: 1283762 - RNA, 15 nt, Human
ucagggcagcgccag

SEQ ID NO: 1283763 - RNA, 19 nt, Human
ucagggcagcgccaggcug

SEQ ID NO: 1283764 - RNA, 13 nt, Human
ucagggccaggcc

SEQ ID NO: 1283765 - RNA, 17 nt, Human
ucagggccaggccucuc

SEQ ID NO: 1283766 - RNA, 13 nt, Human
ucagggccaugcu

SEQ ID NO: 1283767 - RNA, 14 nt, Human
ucagggccaugcug

SEQ ID NO: 1283768 - RNA, 17 nt, Human
ucagggccaugcugagg

SEQ ID NO: 1283769 - RNA, 15 nt, Human
gggaggaggcagaga

SEQ ID NO: 1283770 - RNA, 14 nt, Human
gggaggagaaugag

SEQ ID NO: 1283771 - RNA, 12 nt, Human
gggaggagggca

SEQ ID NO: 1283772 - RNA, 20 nt, Human
gggaggacgcucucuggccu

SEQ ID NO: 1283773 - RNA, 17 nt, Human
gggaggacgcucucugg

SEQ ID NO: 1283774 - RNA, 16 nt, Human
gggaggagggcaggca

SEQ ID NO: 1283775 - RNA, 11 nt, Human
gggaggcagag

SEQ ID NO: 1283776 - RNA, 14 nt, Human
gggagucugccagg

SEQ ID NO: 1283777 - RNA, 17 nt, Human
gggagucugccagggcc

SEQ ID NO: 1283778 - RNA, 12 nt, Human
gggagcugaggc

SEQ ID NO: 1283779 - RNA, 12 nt, Human
gggagcugccaa

SEQ ID NO: 1283780 - RNA, 14 nt, Human
gggagcugggccug

SEQ ID NO: 1283781 - RNA, 15 nt, Human
gggagcugggccugg

SEQ ID NO: 1283782 - RNA, 16 nt, Human
gggagcugggccuggu

SEQ ID NO: 1283783 - RNA, 17 nt, Human
gggagcugggccugguc

SEQ ID NO: 1283784 - RNA, 18 nt, Human
gggagcugggccuggucu

SEQ ID NO: 1283785 - RNA, 14 nt, Human
gggagcugggcuuc

SEQ ID NO: 1283786 - RNA, 19 nt, Human
gggagcugguuagaaaugc

SEQ ID NO: 1283787 - RNA, 13 nt, Human
gggagccgggagc

SEQ ID NO: 1283788 - RNA, 16 nt, Human
gggagcccccagccug

SEQ ID NO: 1283789 - RNA, 17 nt, Human
gggagcccccagccugu

SEQ ID NO: 1283790 - RNA, 21 nt, Human
gggagcccccagccugucaga

SEQ ID NO: 1283791 - RNA, 19 nt, Human
gggagccccuucugcucag

SEQ ID NO: 1283792 - RNA, 21 nt, Human
gggagccugaucaccugcccu

SEQ ID NO: 1283793 - RNA, 21 nt, Human
gggagccucgcaacccgugcc

SEQ ID NO: 1283794 - RNA, 23 nt, Human
gggagcucaggaaccgaggcagg

SEQ ID NO: 1283795 - RNA, 19 nt, Human
gggagcuccacucugcuuc

SEQ ID NO: 1283796 - RNA, 12 nt, Human
gggagcucugca

SEQ ID NO: 1283797 - RNA, 23 nt, Human
gggagcuccacucugcuucucug

SEQ ID NO: 1283798 - RNA, 12 nt, Human
gggagcucagga

SEQ ID NO: 1283799 - RNA, 22 nt, Human
gggagcucaggaaccgaggcag

SEQ ID NO: 1283800 - RNA, 22 nt, Human
gggagcgggucugcucccaagg

SEQ ID NO: 1283801 - RNA, 12 nt, Human
ggcuuuggauuu

SEQ ID NO: 1283802 - RNA, 17 nt, Human
ggcuugggccuaggcug

SEQ ID NO: 1283803 - RNA, 16 nt, Human
ggcuuugauguuccuu

SEQ ID NO: 1283804 - RNA, 13 nt, Human
ggcuuuucacugc

SEQ ID NO: 1283805 - RNA, 20 nt, Human
ggcuuuuauuaaugcacuuu

SEQ ID NO: 1283806 - RNA, 19 nt, Human
ggcuuuuauuaaugcacuu

SEQ ID NO: 1283807 - RNA, 22 nt, Human
gggaauaugagugcguggugcg

SEQ ID NO: 1283808 - RNA, 14 nt, Human
gggaaucagaacuc

SEQ ID NO: 1283809 - RNA, 11 nt, Human
gggaaugugaa

SEQ ID NO: 1283810 - RNA, 14 nt, Human
gggaauugaggaca

SEQ ID NO: 1283811 - RNA, 22 nt, Human
gggacaaguggacucagggcag

SEQ ID NO: 1283812 - RNA, 14 nt, Human
gggacaccuaggcu

SEQ ID NO: 1283813 - RNA, 19 nt, Human
gggaccaggaguggguggg

SEQ ID NO: 1283814 - RNA, 14 nt, Human
gggaccaggcacca

SEQ ID NO: 1283815 - RNA, 21 nt, Human
gggacgccugggggugccagg

SEQ ID NO: 1283816 - RNA, 22 nt, Human
gggacgccugggggugccagga

SEQ ID NO: 1283817 - RNA, 17 nt, Human
gggacggugcccaagcc

SEQ ID NO: 1283818 - RNA, 18 nt, Human
gggaccugguacccuccu

SEQ ID NO: 1283819 - RNA, 21 nt, Human
gggaccugguacccuccuggc

SEQ ID NO: 1283820 - RNA, 13 nt, Human
gggaccuggaagg

SEQ ID NO: 1283821 - RNA, 23 nt, Human
gggaccaggaguggguggggagu

SEQ ID NO: 1283822 - RNA, 21 nt, Human
gggacugaggggaggggagca

SEQ ID NO: 1283823 - RNA, 14 nt, Human
gggacguggcucag

SEQ ID NO: 1283824 - RNA, 18 nt, Human
gggacguggcucagccag

SEQ ID NO: 1283825 - RNA, 19 nt, Human
gggacguggcucagccagc

SEQ ID NO: 1283826 - RNA, 11 nt, Human
gggacugagag

SEQ ID NO: 1283827 - RNA, 23 nt, Human
gggacugccagucccccugcccc

SEQ ID NO: 1283828 - RNA, 19 nt, Human
gggagcccacuguccuggg

SEQ ID NO: 1283829 - RNA, 23 nt, Human
gggacugagagaugcagaaauau

SEQ ID NO: 1283830 - RNA, 12 nt, Human
gggacugagaga

SEQ ID NO: 1283831 - RNA, 20 nt, Human
gggagcccacuguccugggc

SEQ ID NO: 1283832 - RNA, 21 nt, Human
gggagcccacuguccugggcc

SEQ ID NO: 1283833 - RNA, 13 nt, Human
gggagcccccagc

SEQ ID NO: 1283834 - RNA, 15 nt, Human
gggagcccccagccu

SEQ ID NO: 1283835 - RNA, 15 nt, Human
ggcuugccacacccc

SEQ ID NO: 1283836 - RNA, 13 nt, Human
ggcuugccugcag

SEQ ID NO: 1283837 - RNA, 14 nt, Human
ggcuugccacaccc

SEQ ID NO: 1283838 - RNA, 15 nt, Human
ggcuugcuauucugu

SEQ ID NO: 1283839 - RNA, 11 nt, Human
ggcuugcugcc

SEQ ID NO: 1283840 - RNA, 14 nt, Human
ggcuugccugcagg

SEQ ID NO: 1283841 - RNA, 15 nt, Human
ggcuugccugcaggc

SEQ ID NO: 1283842 - RNA, 17 nt, Human
ggcuuggccacagccag

SEQ ID NO: 1283843 - RNA, 19 nt, Human
ggcuuggccacagccaggg

SEQ ID NO: 1283844 - RNA, 18 nt, Human
ggcuuggccacagccagg

SEQ ID NO: 1283845 - RNA, 12 nt, Human
ggcuugggauuu

SEQ ID NO: 1283846 - RNA, 17 nt, Human
ggcuugggauuugcugu

SEQ ID NO: 1283847 - RNA, 13 nt, Human
ggcuugggccuag

SEQ ID NO: 1283848 - RNA, 16 nt, Human
ggcuugggccuaggcu

SEQ ID NO: 1283849 - RNA, 18 nt, Human
ggcuugggccuaggcugc

SEQ ID NO: 1283850 - RNA, 20 nt, Human
ggcuguguaagauuuguuuu

SEQ ID NO: 1283851 - RNA, 22 nt, Human
ggcuguguaagauuuguuuuua

SEQ ID NO: 1283852 - RNA, 11 nt, Human
ggcugugugug

SEQ ID NO: 1283853 - RNA, 18 nt, Human
ggcuguguuuccaucuca

SEQ ID NO: 1283854 - RNA, 21 nt, Human
ggcuguggcauccagaguccc

SEQ ID NO: 1283855 - RNA, 23 nt, Human
ggcuguggcauccagagucccug

SEQ ID NO: 1283856 - RNA, 14 nt, Human
ggcugugggcaagc

SEQ ID NO: 1283857 - RNA, 15 nt, Human
ggcuguggucacagc

SEQ ID NO: 1283858 - RNA, 17 nt, Human
ggcuguggaccauggag

SEQ ID NO: 1283859 - RNA, 23 nt, Human
ggcuguggaccauggaguggcag

SEQ ID NO: 1283860 - RNA, 13 nt, Human
ggcugugccucug

SEQ ID NO: 1283861 - RNA, 16 nt, Human
ggcugugccucugccu

SEQ ID NO: 1283862 - RNA, 17 nt, Human
ggcugucuguuguauuc

SEQ ID NO: 1283863 - RNA, 14 nt, Human
ggcugucugaggcu

SEQ ID NO: 1283864 - RNA, 15 nt, Human
ggcugucccggaggc

SEQ ID NO: 1283865 - RNA, 13 nt, Human
ggcuguccuguac

SEQ ID NO: 1283866 - RNA, 22 nt, Human
ggcuguccuguacauuguggga

SEQ ID NO: 1283867 - RNA, 17 nt, Human
ggcugucccggaggcgg

SEQ ID NO: 1283868 - RNA, 20 nt, Human
ggcuggagugcaguggcgcg

SEQ ID NO: 1283869 - RNA, 20 nt, Human
ggcuggagugcaguggugug

SEQ ID NO: 1283870 - RNA, 23 nt, Human
ggcuggaguuagggacugaccag

SEQ ID NO: 1283871 - RNA, 20 nt, Human
ggcuggagugcaguggugca

SEQ ID NO: 1283872 - RNA, 13 nt, Human
ggcugggaggagg

SEQ ID NO: 1283873 - RNA, 15 nt, Human
ggcugggagcucugc

SEQ ID NO: 1283874 - RNA, 20 nt, Human
ggcugggaggagggcaggca

SEQ ID NO: 1283875 - RNA, 21 nt, Human
ggcugggaggagggcaggcau

SEQ ID NO: 1283876 - RNA, 23 nt, Human
ggcugggaguaguugucuuuccu

SEQ ID NO: 1283877 - RNA, 18 nt, Human
ggcuggagcuagaauuug

SEQ ID NO: 1283878 - RNA, 11 nt, Human
ggcuggaggag

SEQ ID NO: 1283879 - RNA, 14 nt, Human
ggcuggaggagccc

SEQ ID NO: 1283880 - RNA, 15 nt, Human
ggcuggaggagccca

SEQ ID NO: 1283881 - RNA, 17 nt, Human
ggcuggaggagcccagg

SEQ ID NO: 1283882 - RNA, 16 nt, Human
ggcuggaggagcccag

SEQ ID NO: 1283883 - RNA, 13 nt, Human
ggcuggaggccca

SEQ ID NO: 1283884 - RNA, 14 nt, Human
ggcuggaggcccag

SEQ ID NO: 1283885 - RNA, 15 nt, Human
ggcuggaggcccagg

SEQ ID NO: 1283886 - RNA, 19 nt, Human
ggcuggaggcccaggcugg

SEQ ID NO: 1283887 - RNA, 15 nt, Human
ggcugagggagccug

SEQ ID NO: 1283888 - RNA, 13 nt, Human
ggcugaggccacc

SEQ ID NO: 1283889 - RNA, 23 nt, Human
ggcucuggagcccacuguacuug

SEQ ID NO: 1283890 - RNA, 14 nt, Human
ggcucuguccccag

SEQ ID NO: 1283891 - RNA, 16 nt, Human
ggcucuguccccagcc

SEQ ID NO: 1283892 - RNA, 17 nt, Human
ggcucuguccccagccu

SEQ ID NO: 1283893 - RNA, 13 nt, Human
ggcugaggagcag

SEQ ID NO: 1283894 - RNA, 14 nt, Human
ggcugaggccugga

SEQ ID NO: 1283895 - RNA, 16 nt, Human
ggcugaggccuggacu

SEQ ID NO: 1283896 - RNA, 14 nt, Human
ggcugaggcuggca

SEQ ID NO: 1283897 - RNA, 17 nt, Human
ggcugaggcuggcacag

SEQ ID NO: 1283898 - RNA, 18 nt, Human
ggcugaggcuggcacagg

SEQ ID NO: 1283899 - RNA, 19 nt, Human
ggccggcuugccacacccc

SEQ ID NO: 1283900 - RNA, 15 nt, Human
ggccgggagccugau

SEQ ID NO: 1283901 - RNA, 18 nt, Human
ggccggggaacuggccaa

SEQ ID NO: 1283902 - RNA, 19 nt, Human
ggccggggaacuggccaag

SEQ ID NO: 1283903 - RNA, 20 nt, Human
ggccggggaacuggccaagc

SEQ ID NO: 1283904 - RNA, 21 nt, Human
ggccggggaacuggccaagcu

SEQ ID NO: 1283905 - RNA, 22 nt, Human
ggccggcuucaugccagcuacu

SEQ ID NO: 1283906 - RNA, 15 nt, Human
ggccuaaccugccga

SEQ ID NO: 1283907 - RNA, 16 nt, Human
ggccuaaccugccgag

SEQ ID NO: 1283908 - RNA, 21 nt, Human
ggccuaaccugccgagagucc

SEQ ID NO: 1283909 - RNA, 13 nt, Human
ggccguggcugcu

SEQ ID NO: 1283910 - RNA, 14 nt, Human
ggccguggcugcug

SEQ ID NO: 1283911 - RNA, 15 nt, Human
ggccguggcugcugu

SEQ ID NO: 1283912 - RNA, 18 nt, Human
ggcccagagcccagcucc

SEQ ID NO: 1283913 - RNA, 19 nt, Human
ggcccagagcccagcucca

SEQ ID NO: 1283914 - RNA, 12 nt, Human
ggcccagagccc

SEQ ID NO: 1283915 - RNA, 13 nt, Human
ggcccagagccca

SEQ ID NO: 1283916 - RNA, 14 nt, Human
ggcccagagcccag

SEQ ID NO: 1283917 - RNA, 15 nt, Human
ggcccagagcccagc

SEQ ID NO: 1283918 - RNA, 16 nt, Human
ggcccagagcccagcu

SEQ ID NO: 1283919 - RNA, 17 nt, Human
ggcccagagcccagcuc

SEQ ID NO: 1283920 - RNA, 13 nt, Human
ggccuagaccagc

SEQ ID NO: 1283921 - RNA, 14 nt, Human
ggccuagaccagca

SEQ ID NO: 1283922 - RNA, 13 nt, Human
ggccuagacucug

SEQ ID NO: 1283923 - RNA, 18 nt, Human
ggccuagacucugucuac

SEQ ID NO: 1283924 - RNA, 14 nt, Human
ggccuagaggccug

SEQ ID NO: 1283925 - RNA, 13 nt, Human
ggccuagaggccu

SEQ ID NO: 1283926 - RNA, 13 nt, Human
ggccuccugccuc

SEQ ID NO: 1283927 - RNA, 14 nt, Human
ggccuccugccucu

SEQ ID NO: 1283928 - RNA, 15 nt, Human
ggccuccugccucua

SEQ ID NO: 1283929 - RNA, 17 nt, Human
ggccucggacuuagcug

SEQ ID NO: 1283930 - RNA, 22 nt, Human
ggccuccuucugagcuccuguc

SEQ ID NO: 1283931 - RNA, 14 nt, Human
ggccuccuucugag

SEQ ID NO: 1283932 - RNA, 23 nt, Human
ggccucucccuccuccaggaagc

SEQ ID NO: 1283933 - RNA, 20 nt, Human
ggccucucccuccuccagga

SEQ ID NO: 1283934 - RNA, 13 nt, Human
ggccucucuaucc

SEQ ID NO: 1283935 - RNA, 22 nt, Human
ggccucucuauccucucuuccu

SEQ ID NO: 1283936 - RNA, 14 nt, Human
ggccucucucuagg

SEQ ID NO: 1283937 - RNA, 23 nt, Human
ggccucucuauccucucuuccuc

SEQ ID NO: 1283938 - RNA, 11 nt, Human
ggcgcaggagg

SEQ ID NO: 1283939 - RNA, 14 nt, Human
ggcgcaggccguga

SEQ ID NO: 1283940 - RNA, 11 nt, Human
ggccuggggug

SEQ ID NO: 1283941 - RNA, 15 nt, Human
ggccuggggugaccc

SEQ ID NO: 1283942 - RNA, 18 nt, Human
ggccuggggugacccggc

SEQ ID NO: 1283943 - RNA, 19 nt, Human
ggccuggggugacccggca

SEQ ID NO: 1283944 - RNA, 21 nt, Human
ggccuggggugacccggcacc

SEQ ID NO: 1283945 - RNA, 11 nt, Human
ggccugguccc

SEQ ID NO: 1283946 - RNA, 14 nt, Human
ggccuggucccugu

SEQ ID NO: 1283947 - RNA, 19 nt, Human
ggccuggucucacccugga

SEQ ID NO: 1283948 - RNA, 23 nt, Human
ggccuggucucacccuggaggca

SEQ ID NO: 1283949 - RNA, 21 nt, Human
ggccugguuaaauaaggcagg

SEQ ID NO: 1283950 - RNA, 22 nt, Human
ggccugguuaaauaaggcaggg

SEQ ID NO: 1283951 - RNA, 23 nt, Human
ggccugguuaaauaaggcagggu

SEQ ID NO: 1283952 - RNA, 14 nt, Human
ggccuguacugccu

SEQ ID NO: 1283953 - RNA, 16 nt, Human
ggccuguacugccugc

SEQ ID NO: 1283954 - RNA, 15 nt, Human
ggccuguacugccug

SEQ ID NO: 1283955 - RNA, 12 nt, Human
ggcgcacuguga

SEQ ID NO: 1283956 - RNA, 16 nt, Human
ggccugggcuccugga

SEQ ID NO: 1283957 - RNA, 14 nt, Human
ggccugggcuccug

SEQ ID NO: 1283958 - RNA, 19 nt, Human
ggccugggcaggagggagg

SEQ ID NO: 1283959 - RNA, 11 nt, Human
ggccugggccc

SEQ ID NO: 1283960 - RNA, 18 nt, Human
ggccugggcaguggaugg

SEQ ID NO: 1283961 - RNA, 15 nt, Human
ggccugggccgcugc

SEQ ID NO: 1283962 - RNA, 17 nt, Human
ggccugagcaguccuug

SEQ ID NO: 1283963 - RNA, 15 nt, Human
ggccugggcaggagg

SEQ ID NO: 1283964 - RNA, 17 nt, Human
ggccugggcaggaggga

SEQ ID NO: 1283965 - RNA, 19 nt, Human
ggccugagcaguccuuggc

SEQ ID NO: 1283966 - RNA, 20 nt, Human
ggccugaccaaacagccaac

SEQ ID NO: 1283967 - RNA, 16 nt, Human
ggccugacugccaagc

SEQ ID NO: 1283968 - RNA, 17 nt, Human
ggccugacugccaagcc

SEQ ID NO: 1283969 - RNA, 20 nt, Human
ggccugacugccaagccaug

SEQ ID NO: 1283970 - RNA, 18 nt, Human
ggccugacugccaagcca

SEQ ID NO: 1283971 - RNA, 19 nt, Human
ggccugacugccaagccau

SEQ ID NO: 1283972 - RNA, 20 nt, Human
ggccucugcgagugguuucu

SEQ ID NO: 1283973 - RNA, 19 nt, Human
ggcucuggagcccacugua

SEQ ID NO: 1283974 - RNA, 17 nt, Human
ggcucuggagcccacug

SEQ ID NO: 1283975 - RNA, 16 nt, Human
ggcucuggagcccacu

SEQ ID NO: 1283976 - RNA, 19 nt, Human
ggcucugcaauuccccucu

SEQ ID NO: 1283977 - RNA, 20 nt, Human
ggcucugcaauuccccucug

SEQ ID NO: 1283978 - RNA, 12 nt, Human
ggcucugccagu

SEQ ID NO: 1283979 - RNA, 16 nt, Human
ggcucugccaguccug

SEQ ID NO: 1283980 - RNA, 17 nt, Human
ggcucugccaguccugu

SEQ ID NO: 1283981 - RNA, 20 nt, Human
ggcucugccaguccuguccu

SEQ ID NO: 1283982 - RNA, 15 nt, Human
ggcucugagagucua

SEQ ID NO: 1283983 - RNA, 18 nt, Human
ggcucugagagucuagau

SEQ ID NO: 1283984 - RNA, 20 nt, Human
ggcucugagagucuagauuc

SEQ ID NO: 1283985 - RNA, 22 nt, Human
ggcucugagagucuagauucuc

SEQ ID NO: 1283986 - RNA, 14 nt, Human
ggcucugagcgccu

SEQ ID NO: 1283987 - RNA, 15 nt, Human
ggcucugagcgccuc

SEQ ID NO: 1283988 - RNA, 12 nt, Human
ggcucugaggcg

SEQ ID NO: 1283989 - RNA, 14 nt, Human
ggcucugaggcgcc

SEQ ID NO: 1283990 - RNA, 17 nt, Human
ggcucugaggugccugu

SEQ ID NO: 1283991 - RNA, 19 nt, Human
ggcucugaggugccugucc

SEQ ID NO: 1283992 - RNA, 20 nt, Human
ggcucugaggugccuguccc

SEQ ID NO: 1283993 - RNA, 23 nt, Human
ggcucugaggugccugucccacc

SEQ ID NO: 1283994 - RNA, 22 nt, Human
ggcucugaugaaaaauugcuga

SEQ ID NO: 1283995 - RNA, 16 nt, Human
ggcuccagagggcacu

SEQ ID NO: 1283996 - RNA, 17 nt, Human
ggcucccagggacaccu

SEQ ID NO: 1283997 - RNA, 13 nt, Human
ggcucccaggggc

SEQ ID NO: 1283998 - RNA, 23 nt, Human
ggcucccaggggcucccuccgcc

SEQ ID NO: 1283999 - RNA, 22 nt, Human
ggcucccaggggcucccuccgc

SEQ ID NO: 1284000 - RNA, 17 nt, Human
ggcuccccauguguccu

SEQ ID NO: 1284001 - RNA, 21 nt, Human
ggcuccccauguguccugguu

SEQ ID NO: 1284002 - RNA, 22 nt, Human
ggcuccccauguguccugguuc

SEQ ID NO: 1284003 - RNA, 16 nt, Human
ggcucccccaggggcu

SEQ ID NO: 1284004 - RNA, 12 nt, Human
ggcucuccuggc

SEQ ID NO: 1284005 - RNA, 14 nt, Human
ggcucuccuggccc

SEQ ID NO: 1284006 - RNA, 13 nt, Human
ggcucuccuggcu

SEQ ID NO: 1284007 - RNA, 16 nt, Human
ggcucuccuggcuucc

SEQ ID NO: 1284008 - RNA, 17 nt, Human
ggcucuccuggcuuccc

SEQ ID NO: 1284009 - RNA, 19 nt, Human
ggcggcuggggucccagca

SEQ ID NO: 1284010 - RNA, 20 nt, Human
ggcggcuggggucccagcag

SEQ ID NO: 1284011 - RNA, 24 nt, Human
ggcggcuggggucccagcagcugc

SEQ ID NO: 1284012 - RNA, 16 nt, Human
ggcgccccaacccgug

SEQ ID NO: 1284013 - RNA, 18 nt, Human
ggcgccccaacccgugga

SEQ ID NO: 1284014 - RNA, 23 nt, Human
ggcgccccaacccguggaggcug

SEQ ID NO: 1284015 - RNA, 19 nt, Human
ggcgccccaacccguggag

SEQ ID NO: 1284016 - RNA, 23 nt, Human
ggcuagugacuugugucccauga

SEQ ID NO: 1284017 - RNA, 20 nt, Human
ggcuagugacuuguguccca

SEQ ID NO: 1284018 - RNA, 20 nt, Human
ggcuaguaucaaaagaaaga

SEQ ID NO: 1284019 - RNA, 19 nt, Human
ggcuagguggguugaaagc

SEQ ID NO: 1284020 - RNA, 18 nt, Human
ggcgggcagagggcugga

SEQ ID NO: 1284021 - RNA, 17 nt, Human
ggcgggcagagggcugg

SEQ ID NO: 1284022 - RNA, 16 nt, Human
ggcggggaggaggaaa

SEQ ID NO: 1284023 - RNA, 12 nt, Human
ggcggggguggc

SEQ ID NO: 1284024 - RNA, 14 nt, Human
ggcggggguggcgg

SEQ ID NO: 1284025 - RNA, 19 nt, Human
ggcggggguggcggcggcc

SEQ ID NO: 1284026 - RNA, 13 nt, Human
ggcuagguacaca

SEQ ID NO: 1284027 - RNA, 17 nt, Human
ggcucacccccuucucc

SEQ ID NO: 1284028 - RNA, 22 nt, Human
ggcucacccccuucuccaucca

SEQ ID NO: 1284029 - RNA, 18 nt, Human
ggcucaccuugugcuggg

SEQ ID NO: 1284030 - RNA, 17 nt, Human
ggcucacgccuguaauc

SEQ ID NO: 1284031 - RNA, 13 nt, Human
ggcuccagagggc

SEQ ID NO: 1284032 - RNA, 22 nt, Human
ggcuccagagggcacucugcuu

SEQ ID NO: 1284033 - RNA, 14 nt, Human
ggagcuagaauuug

SEQ ID NO: 1284034 - RNA, 19 nt, Human
ggagcuaccuguguggaca

SEQ ID NO: 1284035 - RNA, 22 nt, Human
ggagcuaccuguguggacagga

SEQ ID NO: 1284036 - RNA, 23 nt, Human
ggagcuaccuguguggacaggac

SEQ ID NO: 1284037 - RNA, 21 nt, Human
ggagcucaggaaccgaggcag

SEQ ID NO: 1284038 - RNA, 17 nt, Human
ggagcuccacucugcuu

SEQ ID NO: 1284039 - RNA, 12 nt, Human
ggagcuauuuuc

SEQ ID NO: 1284040 - RNA, 15 nt, Human
ggagcggcagauggg

SEQ ID NO: 1284041 - RNA, 20 nt, Human
ggagcggccggccagccccu

SEQ ID NO: 1284042 - RNA, 14 nt, Human
ggagcgggucugcu

SEQ ID NO: 1284043 - RNA, 20 nt, Human
ggagcgggucugcucccaag

SEQ ID NO: 1284044 - RNA, 18 nt, Human
ggagcgggucugcuccca

SEQ ID NO: 1284045 - RNA, 12 nt, Human
ggagcuaaggcu

SEQ ID NO: 1284046 - RNA, 15 nt, Human
ggagcuaaggcucua

SEQ ID NO: 1284047 - RNA, 20 nt, Human
ggagcuaaggcucuaugagu

SEQ ID NO: 1284048 - RNA, 14 nt, Human
ggagcuaccugugu

SEQ ID NO: 1284049 - RNA, 22 nt, Human
ggagccucgcaacccgugccaa

SEQ ID NO: 1284050 - RNA, 18 nt, Human
ggagccucgcaacccgug

SEQ ID NO: 1284051 - RNA, 10 nt, Human
ggagccuguc

SEQ ID NO: 1284052 - RNA, 11 nt, Human
ggagccugucc

SEQ ID NO: 1284053 - RNA, 13 nt, Human
ggagccuguccug

SEQ ID NO: 1284054 - RNA, 14 nt, Human
ggagccuguccugc

SEQ ID NO: 1284055 - RNA, 16 nt, Human
ggagccuguccugccu

SEQ ID NO: 1284056 - RNA, 20 nt, Human
ggagccuguccugccugugg

SEQ ID NO: 1284057 - RNA, 14 nt, Human
ggagccugugaacc

SEQ ID NO: 1284058 - RNA, 17 nt, Human
ggagccugugaacccag

SEQ ID NO: 1284059 - RNA, 18 nt, Human
ggagccugugaacccagg

SEQ ID NO: 1284060 - RNA, 19 nt, Human
ggagccugugaacccagga

SEQ ID NO: 1284061 - RNA, 20 nt, Human
ggagccugugaacccaggac

SEQ ID NO: 1284062 - RNA, 22 nt, Human
ggagccugugaacccaggacaa

SEQ ID NO: 1284063 - RNA, 21 nt, Human
ggagccugugaacccaggaca

SEQ ID NO: 1284064 - RNA, 23 nt, Human
ggagccuucccaaguugugcuug

SEQ ID NO: 1284065 - RNA, 13 nt, Human
ggagccuucccaa

SEQ ID NO: 1284066 - RNA, 21 nt, Human
ggagccuucccaaguugugcu

SEQ ID NO: 1284067 - RNA, 22 nt, Human
ggagccuucccaaguugugcuu

SEQ ID NO: 1284068 - RNA, 22 nt, Human
ggagcgagcaugucguggacac

SEQ ID NO: 1284069 - RNA, 20 nt, Human
ggagcccugggaggcucugg

SEQ ID NO: 1284070 - RNA, 23 nt, Human
ggagcacggcucuguccccagcc

SEQ ID NO: 1284071 - RNA, 22 nt, Human
ggagcacggcucuguccccagc

SEQ ID NO: 1284072 - RNA, 18 nt, Human
ggagccgggucugccucu

SEQ ID NO: 1284073 - RNA, 17 nt, Human
ggagccgggucugccuc

SEQ ID NO: 1284074 - RNA, 19 nt, Human
ggagcccugggaggcucug

SEQ ID NO: 1284075 - RNA, 16 nt, Human
ggagcccugggaggcu

SEQ ID NO: 1284076 - RNA, 18 nt, Human
ggagcacaaagacccugg

SEQ ID NO: 1284077 - RNA, 20 nt, Human
ggagcacaaagacccuggcu

SEQ ID NO: 1284078 - RNA, 21 nt, Human
ggagcacaaagacccuggcuu

SEQ ID NO: 1284079 - RNA, 22 nt, Human
ggagcacaaagacccuggcuuu

SEQ ID NO: 1284080 - RNA, 21 nt, Human
ggagcacaauaaauggcugua

SEQ ID NO: 1284081 - RNA, 17 nt, Human
ggagcacaaagacccug

SEQ ID NO: 1284082 - RNA, 22 nt, Human
ggagacauaaccacugcuucca

SEQ ID NO: 1284083 - RNA, 14 nt, Human
ggagacaugugaca

SEQ ID NO: 1284084 - RNA, 15 nt, Human
ggagacaugugacau

SEQ ID NO: 1284085 - RNA, 19 nt, Human
ggagacaugugacauuuau

SEQ ID NO: 1284086 - RNA, 12 nt, Human
ggagaccaccag

SEQ ID NO: 1284087 - RNA, 19 nt, Human
ggaggcagagaagaaagaa

SEQ ID NO: 1284088 - RNA, 13 nt, Human
ggaggcaggggcu

SEQ ID NO: 1284089 - RNA, 17 nt, Human
ggaggcaggggcuuccu

SEQ ID NO: 1284090 - RNA, 18 nt, Human
ggaggcaggggcuuccug

SEQ ID NO: 1284091 - RNA, 17 nt, Human
ggaggcaggaguuucgu

SEQ ID NO: 1284092 - RNA, 15 nt, Human
ggaggcagagaagaa

SEQ ID NO: 1284093 - RNA, 14 nt, Human
ggaggcagagaaga

SEQ ID NO: 1284094 - RNA, 17 nt, Human
ggagggauucugguucc

SEQ ID NO: 1284095 - RNA, 22 nt, Human
ggagggauucugguuccagggu

SEQ ID NO: 1284096 - RNA, 16 nt, Human
ggaggacccaggacag

SEQ ID NO: 1284097 - RNA, 15 nt, Human
ggaggacccagggcu

SEQ ID NO: 1284098 - RNA, 16 nt, Human
ggaggacccagggcuc

SEQ ID NO: 1284099 - RNA, 15 nt, Human
ggaggacccaggaca

SEQ ID NO: 1284100 - RNA, 19 nt, Human
ggaggacccagggcucugu

SEQ ID NO: 1284101 - RNA, 18 nt, Human
ggaggacccagggcucug

SEQ ID NO: 1284102 - RNA, 13 nt, Human
ggaggaccugagc

SEQ ID NO: 1284103 - RNA, 14 nt, Human
ggaggaccugagcc

SEQ ID NO: 1284104 - RNA, 15 nt, Human
ggaggaccugagccu

SEQ ID NO: 1284105 - RNA, 16 nt, Human
ggaggaccugagccug

SEQ ID NO: 1284106 - RNA, 17 nt, Human
ggaggaccugagccugc

SEQ ID NO: 1284107 - RNA, 19 nt, Human
ggaggacgcucucuggccu

SEQ ID NO: 1284108 - RNA, 18 nt, Human
ggaggaccugagccugcc

SEQ ID NO: 1284109 - RNA, 19 nt, Human
ggaggaccugagccugccg

SEQ ID NO: 1284110 - RNA, 22 nt, Human
ggaggaccugagccugccgagc

SEQ ID NO: 1284111 - RNA, 16 nt, Human
ggaggacgcucucugg

SEQ ID NO: 1284112 - RNA, 16 nt, Human
ggaggggcagagccag

SEQ ID NO: 1284113 - RNA, 15 nt, Human
ggaggggcagagcca

SEQ ID NO: 1284114 - RNA, 13 nt, Human
ggaggggcagagc

SEQ ID NO: 1284115 - RNA, 12 nt, Human
ggaggggcagag

SEQ ID NO: 1284116 - RNA, 13 nt, Human
ggaggggaggggg

SEQ ID NO: 1284117 - RNA, 13 nt, Human
ggaggggccuggc

SEQ ID NO: 1284118 - RNA, 13 nt, Human
ggagggccugggc

SEQ ID NO: 1284119 - RNA, 19 nt, Human
ggagggccacaugggaggc

SEQ ID NO: 1284120 - RNA, 23 nt, Human
ggagggccacaugggaggcucac

SEQ ID NO: 1284121 - RNA, 20 nt, Human
ggagggcggcaggggccugg

SEQ ID NO: 1284122 - RNA, 21 nt, Human
ggagggcggcaggggccugga

SEQ ID NO: 1284123 - RNA, 16 nt, Human
ggagucaaaaauuaaa

SEQ ID NO: 1284124 - RNA, 13 nt, Human
ggagucacacagu

SEQ ID NO: 1284125 - RNA, 21 nt, Human
ggagucacacaguguuggagg

SEQ ID NO: 1284126 - RNA, 14 nt, Human
ggaguagcugagcu

SEQ ID NO: 1284127 - RNA, 15 nt, Human
ggaguagcugagcuc

SEQ ID NO: 1284128 - RNA, 17 nt, Human
ggaguagcugagcucac

SEQ ID NO: 1284129 - RNA, 16 nt, Human
ggaguagcugagcuca

SEQ ID NO: 1284130 - RNA, 15 nt, Human
ggagucacugagacc

SEQ ID NO: 1284131 - RNA, 14 nt, Human
ggaggggccuggca

SEQ ID NO: 1284132 - RNA, 18 nt, Human
ggaggggccuggcagccg

SEQ ID NO: 1284133 - RNA, 21 nt, Human
ggaggggccuggcagccgugc

SEQ ID NO: 1284134 - RNA, 18 nt, Human
ggaggggcuccuuuccau

SEQ ID NO: 1284135 - RNA, 19 nt, Human
ggagggggaauggcagcag

SEQ ID NO: 1284136 - RNA, 14 nt, Human
ggagggggaauggc

SEQ ID NO: 1284137 - RNA, 15 nt, Human
ggagguugggugggc

SEQ ID NO: 1284138 - RNA, 22 nt, Human
ggaguaacaauacaaauggauu

SEQ ID NO: 1284139 - RNA, 18 nt, Human
ggacugagaaauuuauaa

SEQ ID NO: 1284140 - RNA, 15 nt, Human
ggacugagugggaag

SEQ ID NO: 1284141 - RNA, 20 nt, Human
ggagaagaaagaggugaccc

SEQ ID NO: 1284142 - RNA, 11 nt, Human
ggagaagaacu

SEQ ID NO: 1284143 - RNA, 14 nt, Human
ggagaagaacugaa

SEQ ID NO: 1284144 - RNA, 23 nt, Human
ggagaagaaagaggugaccccag

SEQ ID NO: 1284145 - RNA, 12 nt, Human
ggagaaggaagg

SEQ ID NO: 1284146 - RNA, 19 nt, Human
ggagaagcuccucucccca

SEQ ID NO: 1284147 - RNA, 19 nt, Human
ggagacagguuagcugcuc

SEQ ID NO: 1284148 - RNA, 22 nt, Human
ggagaagucucagcuaagcuca

SEQ ID NO: 1284149 - RNA, 18 nt, Human
ggagaagugacauugcau

SEQ ID NO: 1284150 - RNA, 13 nt, Human
ggagaagucucag

SEQ ID NO: 1284151 - RNA, 14 nt, Human
ggacugagaaauuu

SEQ ID NO: 1284152 - RNA, 14 nt, Human
ggacugaccagcag

SEQ ID NO: 1284153 - RNA, 15 nt, Human
ggacugaccagcagc

SEQ ID NO: 1284154 - RNA, 17 nt, Human
ggacugaauuaugaaac

SEQ ID NO: 1284155 - RNA, 19 nt, Human
ggacugaauuaugaaacuu

SEQ ID NO: 1284156 - RNA, 19 nt, Human
ggacgcucucuggccuucg

SEQ ID NO: 1284157 - RNA, 16 nt, Human
ggacgcucucuggccu

SEQ ID NO: 1284158 - RNA, 18 nt, Human
ggaccuuuccaccacagc

SEQ ID NO: 1284159 - RNA, 19 nt, Human
ggaccuuuccaccacagcc

SEQ ID NO: 1284160 - RNA, 22 nt, Human
ggaccuuuccaccacagccagc

SEQ ID NO: 1284161 - RNA, 20 nt, Human
ggaccuuuccaccacagcca

SEQ ID NO: 1284162 - RNA, 23 nt, Human
ggacgacacggucggggcaucug

SEQ ID NO: 1284163 - RNA, 14 nt, Human
ggacgcacugagca

SEQ ID NO: 1284164 - RNA, 16 nt, Human
ggaccagcucaggaca

SEQ ID NO: 1284165 - RNA, 16 nt, Human
ggaccagccuggccca

SEQ ID NO: 1284166 - RNA, 15 nt, Human
ggaccaggcuguagg

SEQ ID NO: 1284167 - RNA, 18 nt, Human
ggaccaggcaccaggcag

SEQ ID NO: 1284168 - RNA, 19 nt, Human
ggaccagucaaccugggca

SEQ ID NO: 1284169 - RNA, 16 nt, Human
ggaccagucccagagc

SEQ ID NO: 1284170 - RNA, 17 nt, Human
ggaccagucccagagca

SEQ ID NO: 1284171 - RNA, 18 nt, Human
ggaccagucccagagcag

SEQ ID NO: 1284172 - RNA, 21 nt, Human
ggaccauggaguggcagccca

SEQ ID NO: 1284173 - RNA, 22 nt, Human
ggaccauggaguggcagcccag

SEQ ID NO: 1284174 - RNA, 17 nt, Human
ggacauuugcucaugga

SEQ ID NO: 1284175 - RNA, 17 nt, Human
ggacagccccacccugg

SEQ ID NO: 1284176 - RNA, 16 nt, Human
ggacagccgccuggag

SEQ ID NO: 1284177 - RNA, 20 nt, Human
ggacauuugcucauggaauu

SEQ ID NO: 1284178 - RNA, 12 nt, Human
ggaccagccucu

SEQ ID NO: 1284179 - RNA, 19 nt, Human
ggaccagcagccccacacc

SEQ ID NO: 1284180 - RNA, 12 nt, Human
ggaccagccugg

SEQ ID NO: 1284181 - RNA, 13 nt, Human
ggaccagccuggc

SEQ ID NO: 1284182 - RNA, 15 nt, Human
ggaccagccuggccc

SEQ ID NO: 1284183 - RNA, 22 nt, Human
ggaccagccuggcccaccccac

SEQ ID NO: 1284184 - RNA, 13 nt, Human
ggaccagcucagg

SEQ ID NO: 1284185 - RNA, 15 nt, Human
ggacagccccuccuc

SEQ ID NO: 1284186 - RNA, 16 nt, Human
ggacagccccuccucc

SEQ ID NO: 1284187 - RNA, 14 nt, Human
ggacagccccaccc

SEQ ID NO: 1284188 - RNA, 15 nt, Human
ggacagccccacccu

SEQ ID NO: 1284189 - RNA, 16 nt, Human
ggacagccccacccug

SEQ ID NO: 1284190 - RNA, 21 nt, Human
gcuuuuaugugaaacauguuu

SEQ ID NO: 1284191 - RNA, 15 nt, Human
gcuuuuauuaaugca

SEQ ID NO: 1284192 - RNA, 18 nt, Human
gcuuuuauuaaugcacuu

SEQ ID NO: 1284193 - RNA, 20 nt, Human
gcuuuuaugugaaacauguu

SEQ ID NO: 1284194 - RNA, 19 nt, Human
gcuuuuaugugaaacaugu

SEQ ID NO: 1284195 - RNA, 12 nt, Human
gcuuuucacugc

SEQ ID NO: 1284196 - RNA, 19 nt, Human
gcuuuuauuaaugcacuuu

SEQ ID NO: 1284197 - RNA, 22 nt, Human
gcuuuuauuaaugcacuuucua

SEQ ID NO: 1284198 - RNA, 13 nt, Human
gcuuuucaaacaa

SEQ ID NO: 1284199 - RNA, 14 nt, Human
gcuuuucaaacaaa

SEQ ID NO: 1284200 - RNA, 14 nt, Human
ggacacucagaccu

SEQ ID NO: 1284201 - RNA, 16 nt, Human
ggacacuuaauacuac

SEQ ID NO: 1284202 - RNA, 20 nt, Human
ggacagaggccccagccucc

SEQ ID NO: 1284203 - RNA, 23 nt, Human
ggacagaggccccagccucccug

SEQ ID NO: 1284204 - RNA, 14 nt, Human
ggacagaggcccca

SEQ ID NO: 1284205 - RNA, 15 nt, Human
ggacagaggccccag

SEQ ID NO: 1284206 - RNA, 16 nt, Human
ggacagaggccccagc

SEQ ID NO: 1284207 - RNA, 17 nt, Human
ggacagaggccccagcc

SEQ ID NO: 1284208 - RNA, 18 nt, Human
ggacagaggccccagccu

SEQ ID NO: 1284209 - RNA, 22 nt, Human
ggauuccacucguguguuucua

SEQ ID NO: 1284210 - RNA, 18 nt, Human
ggauuccccaucucaggc

SEQ ID NO: 1284211 - RNA, 18 nt, Human
ggauucugcuggccucug

SEQ ID NO: 1284212 - RNA, 19 nt, Human
ggauucaggaaaaggccug

SEQ ID NO: 1284213 - RNA, 21 nt, Human
ggauucaggaaaaggccuggg

SEQ ID NO: 1284214 - RNA, 20 nt, Human
ggauucaggaaaaggccugg

SEQ ID NO: 1284215 - RNA, 12 nt, Human
ggauuauauuau

SEQ ID NO: 1284216 - RNA, 19 nt, Human
ggauuaugggucacaggaa

SEQ ID NO: 1284217 - RNA, 19 nt, Human
ggauuauuagaaucaaaca

SEQ ID NO: 1284218 - RNA, 11 nt, Human
ggaugccuccu

SEQ ID NO: 1284219 - RNA, 18 nt, Human
ggaugaugacuauggaaa

SEQ ID NO: 1284220 - RNA, 16 nt, Human
ggaugauccccacgcc

SEQ ID NO: 1284221 - RNA, 20 nt, Human
ggaugauccccacgccacag

SEQ ID NO: 1284222 - RNA, 21 nt, Human
ggaugauccccacgccacagc

SEQ ID NO: 1284223 - RNA, 22 nt, Human
ggaugauccccacgccacagcc

SEQ ID NO: 1284224 - RNA, 17 nt, Human
ggaugccccgucccccu

SEQ ID NO: 1284225 - RNA, 14 nt, Human
ggagucacugagac

SEQ ID NO: 1284226 - RNA, 13 nt, Human
ggaguccccucac

SEQ ID NO: 1284227 - RNA, 15 nt, Human
ggaguccccucaccu

SEQ ID NO: 1284228 - RNA, 14 nt, Human
ggaugagcucccac

SEQ ID NO: 1284229 - RNA, 21 nt, Human
ggaugagcucccacaagccug

SEQ ID NO: 1284230 - RNA, 22 nt, Human
ggaugagcucccacaagccuga

SEQ ID NO: 1284231 - RNA, 23 nt, Human
ggaugagcucccacaagccugag

SEQ ID NO: 1284232 - RNA, 20 nt, Human
ggaugagggaaaagaaaaag

SEQ ID NO: 1284233 - RNA, 17 nt, Human
ggcagagccaggaagau

SEQ ID NO: 1284234 - RNA, 16 nt, Human
ggcagagccaggaaga

SEQ ID NO: 1284235 - RNA, 12 nt, Human
ggcagagcccaa

SEQ ID NO: 1284236 - RNA, 16 nt, Human
ggcagagcccaaggga

SEQ ID NO: 1284237 - RNA, 14 nt, Human
ggcagagccaggaa

SEQ ID NO: 1284238 - RNA, 13 nt, Human
ggcagagccagga

SEQ ID NO: 1284239 - RNA, 12 nt, Human
ggcagagccagg

SEQ ID NO: 1284240 - RNA, 21 nt, Human
ggcagagguugcagugagccg

SEQ ID NO: 1284241 - RNA, 14 nt, Human
ggcagagggcugga

SEQ ID NO: 1284242 - RNA, 20 nt, Human
ggcagagggcuggaggccca

SEQ ID NO: 1284243 - RNA, 21 nt, Human
ggcagagggcuggaggcccag

SEQ ID NO: 1284244 - RNA, 16 nt, Human
ggcagagcuggcucug

SEQ ID NO: 1284245 - RNA, 17 nt, Human
ggcagagcuggcucuga

SEQ ID NO: 1284246 - RNA, 19 nt, Human
ggcagagcuggcucugagc

SEQ ID NO: 1284247 - RNA, 11 nt, Human
ggcagagcugg

SEQ ID NO: 1284248 - RNA, 12 nt, Human
ggcagagggcug

SEQ ID NO: 1284249 - RNA, 13 nt, Human
ggcagagggcugg

SEQ ID NO: 1284250 - RNA, 14 nt, Human
ggauucugguucca

SEQ ID NO: 1284251 - RNA, 18 nt, Human
ggauucugguuccagggu

SEQ ID NO: 1284252 - RNA, 19 nt, Human
ggauucugguuccaggguc

SEQ ID NO: 1284253 - RNA, 23 nt, Human
ggauucuguacaugcauugagcu

SEQ ID NO: 1284254 - RNA, 14 nt, Human
ggauucuuuccauu

SEQ ID NO: 1284255 - RNA, 18 nt, Human
ggcaagauugugucccau

SEQ ID NO: 1284256 - RNA, 19 nt, Human
ggauugaaaauguccagga

SEQ ID NO: 1284257 - RNA, 12 nt, Human
ggauucuuuaaa

SEQ ID NO: 1284258 - RNA, 13 nt, Human
ggauugagucugu

SEQ ID NO: 1284259 - RNA, 18 nt, Human
ggcaaggacuuuguacau

SEQ ID NO: 1284260 - RNA, 14 nt, Human
ggcaccaggaagcc

SEQ ID NO: 1284261 - RNA, 15 nt, Human
ggcaccaggaagccg

SEQ ID NO: 1284262 - RNA, 17 nt, Human
ggcaccagggguuucuc

SEQ ID NO: 1284263 - RNA, 16 nt, Human
ggcaugguguucuccu

SEQ ID NO: 1284264 - RNA, 22 nt, Human
ggcaugguguucuccugcugcu

SEQ ID NO: 1284265 - RNA, 24 nt, Human
ggcaugucaacagcguuccuagag

SEQ ID NO: 1284266 - RNA, 13 nt, Human
ggcaugagaaaua

SEQ ID NO: 1284267 - RNA, 20 nt, Human
ggcaugagggguuccucccc

SEQ ID NO: 1284268 - RNA, 23 nt, Human
ggcaugagggguuccuccccucc

SEQ ID NO: 1284269 - RNA, 15 nt, Human
ggcauggucugcccu

SEQ ID NO: 1284270 - RNA, 21 nt, Human
ggcagugggacagggcauggc

SEQ ID NO: 1284271 - RNA, 13 nt, Human
ggcagugggaaaa

SEQ ID NO: 1284272 - RNA, 15 nt, Human
ggcagugggaaaaau

SEQ ID NO: 1284273 - RNA, 16 nt, Human
ggcaguaccugagggu

SEQ ID NO: 1284274 - RNA, 20 nt, Human
ggcaguaccugagggucugu

SEQ ID NO: 1284275 - RNA, 17 nt, Human
ggcaguaccugggcaag

SEQ ID NO: 1284276 - RNA, 23 nt, Human
ggcaguaccugggcaagcuggcg

SEQ ID NO: 1284277 - RNA, 22 nt, Human
ggcaguauccuguuugaggaaa

SEQ ID NO: 1284278 - RNA, 20 nt, Human
ggcagucauuggcugucucc

SEQ ID NO: 1284279 - RNA, 15 nt, Human
ggcaguccgugggac

SEQ ID NO: 1284280 - RNA, 19 nt, Human
ggcagucgauagagcugua

SEQ ID NO: 1284281 - RNA, 16 nt, Human
ggcaguccgugggacg

SEQ ID NO: 1284282 - RNA, 13 nt, Human
ggcagaguuacag

SEQ ID NO: 1284283 - RNA, 18 nt, Human
ggcagaguuacaguucug

SEQ ID NO: 1284284 - RNA, 19 nt, Human
ggcagaguuacaguucugu

SEQ ID NO: 1284285 - RNA, 17 nt, Human
ggcagggguuagagcag

SEQ ID NO: 1284286 - RNA, 14 nt, Human
ggcaguaauaaaaa

SEQ ID NO: 1284287 - RNA, 13 nt, Human
ggcaguaccugag

SEQ ID NO: 1284288 - RNA, 23 nt, Human
ggcauguguuuacuuuauguuac

SEQ ID NO: 1284289 - RNA, 16 nt, Human
ggccacacucagcaca

SEQ ID NO: 1284290 - RNA, 23 nt, Human
ggcauguuagcccuuccuccaau

SEQ ID NO: 1284291 - RNA, 21 nt, Human
ggccacacucagcacaaggcc

SEQ ID NO: 1284292 - RNA, 17 nt, Human
ggccacacuucaaacua

SEQ ID NO: 1284293 - RNA, 20 nt, Human
ggccacacuucaaacuacuu

SEQ ID NO: 1284294 - RNA, 12 nt, Human
ggccacagccag

SEQ ID NO: 1284295 - RNA, 11 nt, Human
ggccacagcca

SEQ ID NO: 1284296 - RNA, 13 nt, Human
ggccacagccagg

SEQ ID NO: 1284297 - RNA, 20 nt, Human
ggccacaguagucuugauga

SEQ ID NO: 1284298 - RNA, 16 nt, Human
ggccacaucaaagagg

SEQ ID NO: 1284299 - RNA, 19 nt, Human
ggccacaucaaagaggcug

SEQ ID NO: 1284300 - RNA, 16 nt, Human
ggccacauagaugcug

SEQ ID NO: 1284301 - RNA, 13 nt, Human
ggccaccucccca

SEQ ID NO: 1284302 - RNA, 16 nt, Human
ggccaccuccccagca

SEQ ID NO: 1284303 - RNA, 17 nt, Human
ggccaccuccccagcau

SEQ ID NO: 1284304 - RNA, 16 nt, Human
ggccacuguguuccuu

SEQ ID NO: 1284305 - RNA, 20 nt, Human
ggccacuguuuggaaauaaa

SEQ ID NO: 1284306 - RNA, 16 nt, Human
ggccagaaguaccaga

SEQ ID NO: 1284307 - RNA, 12 nt, Human
ggccagaaguac

SEQ ID NO: 1284308 - RNA, 16 nt, Human
ggccagacacaggccc

SEQ ID NO: 1284309 - RNA, 17 nt, Human
ggccagacacaggcccu

SEQ ID NO: 1284310 - RNA, 18 nt, Human
ggccagacacaggcccuc

SEQ ID NO: 1284311 - RNA, 15 nt, Human
ggccagacaugccac

SEQ ID NO: 1284312 - RNA, 18 nt, Human
ggccagacaugccacaag

SEQ ID NO: 1284313 - RNA, 14 nt, Human
ggccaggacucugc

SEQ ID NO: 1284314 - RNA, 15 nt, Human
ggccaggacucugca

SEQ ID NO: 1284315 - RNA, 16 nt, Human
ggccaggacucugcag

SEQ ID NO: 1284316 - RNA, 18 nt, Human
ggccaggacucugcagcc

SEQ ID NO: 1284317 - RNA, 20 nt, Human
ggccaggacucugcagccuc

SEQ ID NO: 1284318 - RNA, 21 nt, Human
ggccaggacucugcagccuca

SEQ ID NO: 1284319 - RNA, 13 nt, Human
ggccaugcuccuc

SEQ ID NO: 1284320 - RNA, 15 nt, Human
ggccaugcuccucuu

SEQ ID NO: 1284321 - RNA, 17 nt, Human
ggccaugcuccucuucc

SEQ ID NO: 1284322 - RNA, 18 nt, Human
ggccaugcuccucuuccc

SEQ ID NO: 1284323 - RNA, 22 nt, Human
ggccaugcuccucuuccccaga

SEQ ID NO: 1284324 - RNA, 21 nt, Human
ggccaugcuccucuuccccag

SEQ ID NO: 1284325 - RNA, 13 nt, Human
ggccaugcugagg

SEQ ID NO: 1284326 - RNA, 14 nt, Human
ggccaugcugaggc

SEQ ID NO: 1284327 - RNA, 15 nt, Human
ggccaugcugaggcc

SEQ ID NO: 1284328 - RNA, 18 nt, Human
ggccaugcugaggccugg

SEQ ID NO: 1284329 - RNA, 19 nt, Human
ggccaugcugaggccuggg

SEQ ID NO: 1284330 - RNA, 22 nt, Human
ggccaugcugaggccugggccg

SEQ ID NO: 1284331 - RNA, 14 nt, Human
ggccauggacucug

SEQ ID NO: 1284332 - RNA, 17 nt, Human
ggccauggacucugucc

SEQ ID NO: 1284333 - RNA, 18 nt, Human
ggccauggacucuguccu

SEQ ID NO: 1284334 - RNA, 21 nt, Human
ggccauggacucuguccugaa

SEQ ID NO: 1284335 - RNA, 22 nt, Human
ggccauggacucuguccugaag

SEQ ID NO: 1284336 - RNA, 15 nt, Human
ggccauggagaaagc

SEQ ID NO: 1284337 - RNA, 16 nt, Human
ggccauggagaaagcu

SEQ ID NO: 1284338 - RNA, 18 nt, Human
ggccauggagaaagcuga

SEQ ID NO: 1284339 - RNA, 21 nt, Human
ggccauggagaaagcugacuu

SEQ ID NO: 1284340 - RNA, 16 nt, Human
ggcccacauuggaaga

SEQ ID NO: 1284341 - RNA, 18 nt, Human
ggcccacauuggaagagc

SEQ ID NO: 1284342 - RNA, 14 nt, Human
ggcccaccaggguc

SEQ ID NO: 1284343 - RNA, 15 nt, Human
ggcccaccagggucc

SEQ ID NO: 1284344 - RNA, 18 nt, Human
ggcccaccccacccacuu

SEQ ID NO: 1284345 - RNA, 19 nt, Human
ggcccaccccacccacuuc

SEQ ID NO: 1284346 - RNA, 23 nt, Human
ggcccaccccacccacuucugca

SEQ ID NO: 1284347 - RNA, 22 nt, Human
ggcccaccccacccacuucugc

SEQ ID NO: 1284348 - RNA, 19 nt, Human
gcucuugaugccuggcggg

SEQ ID NO: 1284349 - RNA, 17 nt, Human
gcucuugauaccccccu

SEQ ID NO: 1284350 - RNA, 19 nt, Human
gcucuugauaccccccucu

SEQ ID NO: 1284351 - RNA, 20 nt, Human
gcucuugauaccccccucug

SEQ ID NO: 1284352 - RNA, 19 nt, Human
gcucuuggcagguacucag

SEQ ID NO: 1284353 - RNA, 17 nt, Human
gcucuuggagcugugag

SEQ ID NO: 1284354 - RNA, 13 nt, Human
gcucuuggcugga

SEQ ID NO: 1284355 - RNA, 14 nt, Human
gcucuuggcuggac

SEQ ID NO: 1284356 - RNA, 15 nt, Human
gcucuuggcuggacc

SEQ ID NO: 1284357 - RNA, 18 nt, Human
gcucuuggcuggacccag

SEQ ID NO: 1284358 - RNA, 20 nt, Human
gcucuuggcuggacccagcc

SEQ ID NO: 1284359 - RNA, 23 nt, Human
gcucuuggcuggacccagccagg

SEQ ID NO: 1284360 - RNA, 21 nt, Human
gcucuuggcuggacccagcca

SEQ ID NO: 1284361 - RNA, 18 nt, Human
gcucuuucucugccagug

SEQ ID NO: 1284362 - RNA, 21 nt, Human
gcucuuucucugccagugaca

SEQ ID NO: 1284363 - RNA, 13 nt, Human
gcucuuugagaaa

SEQ ID NO: 1284364 - RNA, 22 nt, Human
gcucuccaaaccacuuuuugca

SEQ ID NO: 1284365 - RNA, 12 nt, Human
gcucuucuuaaa

SEQ ID NO: 1284366 - RNA, 14 nt, Human
gcucuugaacuccu

SEQ ID NO: 1284367 - RNA, 16 nt, Human
gcucuugaacuccuga

SEQ ID NO: 1284368 - RNA, 19 nt, Human
gcucuugaacuccugaccu

SEQ ID NO: 1284369 - RNA, 21 nt, Human
gcucuugaacuccugaccuca

SEQ ID NO: 1284370 - RNA, 17 nt, Human
gcucuccaaaccacuuu

SEQ ID NO: 1284371 - RNA, 16 nt, Human
gcucuccaaaccacuu

SEQ ID NO: 1284372 - RNA, 12 nt, Human
gcucucaguucu

SEQ ID NO: 1284373 - RNA, 20 nt, Human
gcucgauguggucacagcug

SEQ ID NO: 1284374 - RNA, 22 nt, Human
gcucgauguggucacagcugua

SEQ ID NO: 1284375 - RNA, 13 nt, Human
gcucuuugguaga

SEQ ID NO: 1284376 - RNA, 18 nt, Human
gcucuuugguagaaaagg

SEQ ID NO: 1284377 - RNA, 21 nt, Human
gcucuuuguuuugugucucuu

SEQ ID NO: 1284378 - RNA, 22 nt, Human
gcucuuugguagaaaaggcuag

SEQ ID NO: 1284379 - RNA, 15 nt, Human
gcucuuugucaggga

SEQ ID NO: 1284380 - RNA, 16 nt, Human
gcucuuugucagggag

SEQ ID NO: 1284381 - RNA, 18 nt, Human
gcucuuugucagggagug

SEQ ID NO: 1284382 - RNA, 17 nt, Human
gcugacaugaagcuguu

SEQ ID NO: 1284383 - RNA, 21 nt, Human
gcugacaugaagcuguugugu

SEQ ID NO: 1284384 - RNA, 16 nt, Human
gcugacauucaccugc

SEQ ID NO: 1284385 - RNA, 17 nt, Human
gcugacauucaccugcc

SEQ ID NO: 1284386 - RNA, 13 nt, Human
gcugaccacagca

SEQ ID NO: 1284387 - RNA, 13 nt, Human
gcugacggccagg

SEQ ID NO: 1284388 - RNA, 15 nt, Human
gcugacggccaggga

SEQ ID NO: 1284389 - RNA, 19 nt, Human
gcugacgggacccacaugc

SEQ ID NO: 1284390 - RNA, 20 nt, Human
gcugacuaaacuuuuuuucu

SEQ ID NO: 1284391 - RNA, 19 nt, Human
gcugacuucaucucccacc

SEQ ID NO: 1284392 - RNA, 24 nt, Human
gcugacuucaucucccaccuagca

SEQ ID NO: 1284393 - RNA, 14 nt, Human
gcugacuuggcugg

SEQ ID NO: 1284394 - RNA, 15 nt, Human
gcugacuuggcuggu

SEQ ID NO: 1284395 - RNA, 16 nt, Human
gcugacuuggcuggug

SEQ ID NO: 1284396 - RNA, 17 nt, Human
gcugacuuggcuggugu

SEQ ID NO: 1284397 - RNA, 18 nt, Human
gcugacuuggcuggugug

SEQ ID NO: 1284398 - RNA, 14 nt, Human
gcugaccacagcac

SEQ ID NO: 1284399 - RNA, 16 nt, Human
gcugaccacagcacag

SEQ ID NO: 1284400 - RNA, 17 nt, Human
gcugaccacagcacagc

SEQ ID NO: 1284401 - RNA, 19 nt, Human
gcugaccacagcacagcca

SEQ ID NO: 1284402 - RNA, 12 nt, Human
gcugaccagaca

SEQ ID NO: 1284403 - RNA, 21 nt, Human
gcugaccagccgugagcaugu

SEQ ID NO: 1284404 - RNA, 12 nt, Human
gcugaccugcug

SEQ ID NO: 1284405 - RNA, 13 nt, Human
gcugaccugcuga

SEQ ID NO: 1284406 - RNA, 17 nt, Human
gcugaccugcugaccug

SEQ ID NO: 1284407 - RNA, 23 nt, Human
gcugcccuccugugcucagcccu

SEQ ID NO: 1284408 - RNA, 22 nt, Human
gcugcccuccugugcucagccc

SEQ ID NO: 1284409 - RNA, 15 nt, Human
gcugccacacuucag

SEQ ID NO: 1284410 - RNA, 17 nt, Human
gcugccacacuucaggc

SEQ ID NO: 1284411 - RNA, 18 nt, Human
gcugccacacuucaggcu

SEQ ID NO: 1284412 - RNA, 21 nt, Human
gcugccacacuucaggcucuu

SEQ ID NO: 1284413 - RNA, 22 nt, Human
gcugccacacuucaggcucuuc

SEQ ID NO: 1284414 - RNA, 23 nt, Human
gcugccacacuucaggcucuucu

SEQ ID NO: 1284415 - RNA, 11 nt, Human
gcugauuuuuu

SEQ ID NO: 1284416 - RNA, 18 nt, Human
gcugcaguaugaaaauaa

SEQ ID NO: 1284417 - RNA, 17 nt, Human
gcugcaguucgacucug

SEQ ID NO: 1284418 - RNA, 18 nt, Human
gcugcaguucgacucugu

SEQ ID NO: 1284419 - RNA, 20 nt, Human
gcugccaagagugaagggaa

SEQ ID NO: 1284420 - RNA, 23 nt, Human
gcugauuucuagguaggaaaugu

SEQ ID NO: 1284421 - RNA, 13 nt, Human
gcugauuucuagg

SEQ ID NO: 1284422 - RNA, 15 nt, Human
gcugauuaaaugaca

SEQ ID NO: 1284423 - RNA, 21 nt, Human
gcugauuaaaccaaggcuaga

SEQ ID NO: 1284424 - RNA, 16 nt, Human
gcugaucgccuucccc

SEQ ID NO: 1284425 - RNA, 17 nt, Human
gcugaucgccuucccca

SEQ ID NO: 1284426 - RNA, 19 nt, Human
gcugaucgccuuccccacc

SEQ ID NO: 1284427 - RNA, 16 nt, Human
gcugagaggagagaga

SEQ ID NO: 1284428 - RNA, 12 nt, Human
gcugauaauuuu

SEQ ID NO: 1284429 - RNA, 19 nt, Human
gcugauaauuuuaaauucu

SEQ ID NO: 1284430 - RNA, 13 nt, Human
gcugauaauuuua

SEQ ID NO: 1284431 - RNA, 14 nt, Human
gcugauaauuuuaa

SEQ ID NO: 1284432 - RNA, 16 nt, Human
gcugaucagugggccu

SEQ ID NO: 1284433 - RNA, 15 nt, Human
gcugauaauuuuaaa

SEQ ID NO: 1284434 - RNA, 17 nt, Human
gcugauauuuucucuag

SEQ ID NO: 1284435 - RNA, 15 nt, Human
gcugaucgccuuccc

SEQ ID NO: 1284436 - RNA, 23 nt, Human
gcugacuuggcuggugugguaca

SEQ ID NO: 1284437 - RNA, 22 nt, Human
gcugacuuggcuggugugguac

SEQ ID NO: 1284438 - RNA, 13 nt, Human
gcugagaaccugg

SEQ ID NO: 1284439 - RNA, 14 nt, Human
gcugagaaccuggc

SEQ ID NO: 1284440 - RNA, 15 nt, Human
gcugagaaccuggcc

SEQ ID NO: 1284441 - RNA, 16 nt, Human
gcugagaaccuggccu

SEQ ID NO: 1284442 - RNA, 17 nt, Human
gcugagaaccuggccuu

SEQ ID NO: 1284443 - RNA, 21 nt, Human
gcugagaaccuggccuucagu

SEQ ID NO: 1284444 - RNA, 18 nt, Human
gcugagaaccuggccuuc

SEQ ID NO: 1284445 - RNA, 9 nt, Human
gcugagacu

SEQ ID NO: 1284446 - RNA, 15 nt, Human
gcugagagaaaauaa

SEQ ID NO: 1284447 - RNA, 16 nt, Human
gcuggcauuacaggug

SEQ ID NO: 1284448 - RNA, 17 nt, Human
gcuggcaguccuggaag

SEQ ID NO: 1284449 - RNA, 17 nt, Human
gcuggaccucaccaagc

SEQ ID NO: 1284450 - RNA, 21 nt, Human
gcuggacccugaccagcuccc

SEQ ID NO: 1284451 - RNA, 22 nt, Human
gcuggacccugaccagcucccc

SEQ ID NO: 1284452 - RNA, 23 nt, Human
gcuggacccugaccagcuccccc

SEQ ID NO: 1284453 - RNA, 14 nt, Human
gcuggacaaacugc

SEQ ID NO: 1284454 - RNA, 19 nt, Human
gcuggacaaacugcaccag

SEQ ID NO: 1284455 - RNA, 12 nt, Human
gcuggacccagc

SEQ ID NO: 1284456 - RNA, 13 nt, Human
gcuggacccagcc

SEQ ID NO: 1284457 - RNA, 14 nt, Human
gcuggacccagcca

SEQ ID NO: 1284458 - RNA, 15 nt, Human
gcuggacccagccag

SEQ ID NO: 1284459 - RNA, 20 nt, Human
gcuggacccagccaggccca

SEQ ID NO: 1284460 - RNA, 21 nt, Human
gcuggacccagccaggcccag

SEQ ID NO: 1284461 - RNA, 14 nt, Human
gcuggacccugacc

SEQ ID NO: 1284462 - RNA, 15 nt, Human
gcuggacccugacca

SEQ ID NO: 1284463 - RNA, 20 nt, Human
gcuggacccugaccagcucc

SEQ ID NO: 1284464 - RNA, 14 nt, Human
gcuggcccugcccu

SEQ ID NO: 1284465 - RNA, 15 nt, Human
gcuggcccugcccug

SEQ ID NO: 1284466 - RNA, 16 nt, Human
gcuggcccugcccugg

SEQ ID NO: 1284467 - RNA, 19 nt, Human
gcuggcccuggcucccaca

SEQ ID NO: 1284468 - RNA, 18 nt, Human
gcuggccgcccccagccc

SEQ ID NO: 1284469 - RNA, 16 nt, Human
gcuggccagcgagcgc

SEQ ID NO: 1284470 - RNA, 14 nt, Human
gcuggccaguccag

SEQ ID NO: 1284471 - RNA, 15 nt, Human
gcuggccaguccagg

SEQ ID NO: 1284472 - RNA, 16 nt, Human
gcuggccaguccaggc

SEQ ID NO: 1284473 - RNA, 17 nt, Human
gcuggccaguccaggcu

SEQ ID NO: 1284474 - RNA, 15 nt, Human
gcuggccauggagaa

SEQ ID NO: 1284475 - RNA, 16 nt, Human
gcuggccauggagaaa

SEQ ID NO: 1284476 - RNA, 17 nt, Human
gcuggccauggagaaag

SEQ ID NO: 1284477 - RNA, 18 nt, Human
gcuggccauggagaaagc

SEQ ID NO: 1284478 - RNA, 20 nt, Human
gcuggccauggagaaagcug

SEQ ID NO: 1284479 - RNA, 19 nt, Human
gcuggccauggagaaagcu

SEQ ID NO: 1284480 - RNA, 21 nt, Human
gcuggaaaaguauguuagugc

SEQ ID NO: 1284481 - RNA, 23 nt, Human
gcuggaaaaguauguuagugcaa

SEQ ID NO: 1284482 - RNA, 17 nt, Human
gcuggaaaauaauacug

SEQ ID NO: 1284483 - RNA, 22 nt, Human
gcuggaaaauaauacugcugag

SEQ ID NO: 1284484 - RNA, 23 nt, Human
gcuggaaugauuucagcucacug

SEQ ID NO: 1284485 - RNA, 18 nt, Human
gcuggaagauagcuguga

SEQ ID NO: 1284486 - RNA, 16 nt, Human
gcuggaagcugggagg

SEQ ID NO: 1284487 - RNA, 17 nt, Human
gcuggaagcugggaggu

SEQ ID NO: 1284488 - RNA, 21 nt, Human
gcuggaagacgcaagggccug

SEQ ID NO: 1284489 - RNA, 23 nt, Human
gcuggaagacgcaagggccugau

SEQ ID NO: 1284490 - RNA, 17 nt, Human
gcuggaagauagcugug

SEQ ID NO: 1284491 - RNA, 14 nt, Human
gcuggaagauccug

SEQ ID NO: 1284492 - RNA, 15 nt, Human
gcuggaagauccugc

SEQ ID NO: 1284493 - RNA, 17 nt, Human
gcuggaagauccugcgg

SEQ ID NO: 1284494 - RNA, 18 nt, Human
gcuggaagauccugcggg

SEQ ID NO: 1284495 - RNA, 14 nt, Human
gcugcuacuuauau

SEQ ID NO: 1284496 - RNA, 18 nt, Human
gcugcuaauauuuuccuc

SEQ ID NO: 1284497 - RNA, 21 nt, Human
gcugcuaauauuuuccuccug

SEQ ID NO: 1284498 - RNA, 22 nt, Human
gcugcuaauauuuuccuccuga

SEQ ID NO: 1284499 - RNA, 24 nt, Human
gcugcuaauauuuuccuccugagu

SEQ ID NO: 1284500 - RNA, 23 nt, Human
gcugcuaauauuuuccuccugag

SEQ ID NO: 1284501 - RNA, 18 nt, Human
gcugcccuggugcugcca

SEQ ID NO: 1284502 - RNA, 12 nt, Human
gcugcccuggug

SEQ ID NO: 1284503 - RNA, 13 nt, Human
gcugcccuggugc

SEQ ID NO: 1284504 - RNA, 14 nt, Human
gcugcccuggugcu

SEQ ID NO: 1284505 - RNA, 15 nt, Human
gcugcccuggugcug

SEQ ID NO: 1284506 - RNA, 17 nt, Human
gcugcccuggugcugcc

SEQ ID NO: 1284507 - RNA, 15 nt, Human
gcugccuuagaaccu

SEQ ID NO: 1284508 - RNA, 20 nt, Human
gcugccuuagaaccuuucuu

SEQ ID NO: 1284509 - RNA, 19 nt, Human
gcugccuuauucagggaag

SEQ ID NO: 1284510 - RNA, 21 nt, Human
gcugccuuauucagggaagga

SEQ ID NO: 1284511 - RNA, 16 nt, Human
gcuguguggcagucug

SEQ ID NO: 1284512 - RNA, 18 nt, Human
gcugugugaauaccugcu

SEQ ID NO: 1284513 - RNA, 20 nt, Human
gcugugugaauaccugcuca

SEQ ID NO: 1284514 - RNA, 18 nt, Human
gcugugggcaagccuaag

SEQ ID NO: 1284515 - RNA, 19 nt, Human
gcuguggccuaaccugccg

SEQ ID NO: 1284516 - RNA, 20 nt, Human
gcuguggccuaaccugccga

SEQ ID NO: 1284517 - RNA, 15 nt, Human
gcugugggaaauggu

SEQ ID NO: 1284518 - RNA, 15 nt, Human
gcuguggccaggagg

SEQ ID NO: 1284519 - RNA, 16 nt, Human
gcuguggccaggaggu

SEQ ID NO: 1284520 - RNA, 20 nt, Human
gcuguggccaggaggugcca

SEQ ID NO: 1284521 - RNA, 18 nt, Human
gcuguggccaggaggugc

SEQ ID NO: 1284522 - RNA, 18 nt, Human
gcugugugcuuuuuuugu

SEQ ID NO: 1284523 - RNA, 23 nt, Human
gcuguguuuggcuuucagggagg

SEQ ID NO: 1284524 - RNA, 13 nt, Human
gcuguuaaauaca

SEQ ID NO: 1284525 - RNA, 15 nt, Human
gcuguuaaauacagg

SEQ ID NO: 1284526 - RNA, 16 nt, Human
gcuguuaaauacagga

SEQ ID NO: 1284527 - RNA, 22 nt, Human
gcuguuaaauacaggaaacagu

SEQ ID NO: 1284528 - RNA, 23 nt, Human
gcuguuaaauacaggaaacaguu

SEQ ID NO: 1284529 - RNA, 23 nt, Human
gcuguuagggguuauugguguaa

SEQ ID NO: 1284530 - RNA, 23 nt, Human
gcuguuauuuagguauuuuucuu

SEQ ID NO: 1284531 - RNA, 19 nt, Human
gcugguguagcuacagaga

SEQ ID NO: 1284532 - RNA, 20 nt, Human
gcugguguagcuacagagaa

SEQ ID NO: 1284533 - RNA, 21 nt, Human
gcugguguagcuacagagaaa

SEQ ID NO: 1284534 - RNA, 22 nt, Human
gcugguguagcuacagagaaac

SEQ ID NO: 1284535 - RNA, 12 nt, Human
gcugguguagcu

SEQ ID NO: 1284536 - RNA, 15 nt, Human
gcugguguagcuaca

SEQ ID NO: 1284537 - RNA, 17 nt, Human
gcugguguagcuacaga

SEQ ID NO: 1284538 - RNA, 18 nt, Human
gcugguguagcuacagag

SEQ ID NO: 1284539 - RNA, 23 nt, Human
gcugguguagcuacagagaaacc

SEQ ID NO: 1284540 - RNA, 18 nt, Human
gcugucaggauugcgaga

SEQ ID NO: 1284541 - RNA, 22 nt, Human
gcugucaggauugcgagagaug

SEQ ID NO: 1284542 - RNA, 13 nt, Human
gcugucaucucag

SEQ ID NO: 1284543 - RNA, 24 nt, Human
gcugucaggauugcgagagaugug

SEQ ID NO: 1284544 - RNA, 23 nt, Human
gcugucaggauugcgagagaugu

SEQ ID NO: 1284545 - RNA, 18 nt, Human
gcugucaucaauuaaagg

SEQ ID NO: 1284546 - RNA, 14 nt, Human
gcugucaucugugc

SEQ ID NO: 1284547 - RNA, 15 nt, Human
gcugucaucugugca

SEQ ID NO: 1284548 - RNA, 16 nt, Human
gcugucaucugugcac

SEQ ID NO: 1284549 - RNA, 14 nt, Human
gcugucccggaggc

SEQ ID NO: 1284550 - RNA, 22 nt, Human
gcugucaucugugcacugccca

SEQ ID NO: 1284551 - RNA, 18 nt, Human
gcuguccagaaagguuug

SEQ ID NO: 1284552 - RNA, 14 nt, Human
gcuguccccccacu

SEQ ID NO: 1284553 - RNA, 21 nt, Human
gcuguccccccacucccucac

SEQ ID NO: 1284554 - RNA, 15 nt, Human
gcuguccccccacuc

SEQ ID NO: 1284555 - RNA, 21 nt, Human
gcugggaggagggcaggcauc

SEQ ID NO: 1284556 - RNA, 18 nt, Human
gcugggaguaguugucuu

SEQ ID NO: 1284557 - RNA, 18 nt, Human
gcugggauagagggguca

SEQ ID NO: 1284558 - RNA, 13 nt, Human
gcugggcucugca

SEQ ID NO: 1284559 - RNA, 23 nt, Human
gcuggggaaaucaaaagggccaa

SEQ ID NO: 1284560 - RNA, 14 nt, Human
gcuggggaagacag

SEQ ID NO: 1284561 - RNA, 15 nt, Human
gcuggggaagacagu

SEQ ID NO: 1284562 - RNA, 16 nt, Human
gcuggggaagacagug

SEQ ID NO: 1284563 - RNA, 14 nt, Human
gcugguccagggcu

SEQ ID NO: 1284564 - RNA, 19 nt, Human
gcugguccagggcuaguga

SEQ ID NO: 1284565 - RNA, 15 nt, Human
gcugguccgugggac

SEQ ID NO: 1284566 - RNA, 16 nt, Human
gcugguccgugggacg

SEQ ID NO: 1284567 - RNA, 19 nt, Human
gcugguccuauggccucau

SEQ ID NO: 1284568 - RNA, 17 nt, Human
gcugguccuuucuuccg

SEQ ID NO: 1284569 - RNA, 18 nt, Human
gcuggucuagucacgcau

SEQ ID NO: 1284570 - RNA, 20 nt, Human
gcuggucucaaacuccugac

SEQ ID NO: 1284571 - RNA, 19 nt, Human
gcuggucucgaacuccuga

SEQ ID NO: 1284572 - RNA, 22 nt, Human
gcuggucucgaacuccugaccu

SEQ ID NO: 1284573 - RNA, 23 nt, Human
gcuggucucgaacuccugaccuu

SEQ ID NO: 1284574 - RNA, 20 nt, Human
gcugguccuauggccucaug

SEQ ID NO: 1284575 - RNA, 16 nt, Human
gcugguaucucagaaa

SEQ ID NO: 1284576 - RNA, 18 nt, Human
gcugguaucucagaaagu

SEQ ID NO: 1284577 - RNA, 24 nt, Human
gcugguaucucagaaagugccuga

SEQ ID NO: 1284578 - RNA, 21 nt, Human
gcuggggaagacaguggcccc

SEQ ID NO: 1284579 - RNA, 18 nt, Human
gcuggggacagguccuca

SEQ ID NO: 1284580 - RNA, 16 nt, Human
gcuggggaccugguac

SEQ ID NO: 1284581 - RNA, 23 nt, Human
gcuggggaccugguacccuccug

SEQ ID NO: 1284582 - RNA, 15 nt, Human
gcuuuuaugugaaac

SEQ ID NO: 1284583 - RNA, 13 nt, Human
gcuuuuaugugaa

SEQ ID NO: 1284584 - RNA, 17 nt, Human
gcuuuggucucuugcuu

SEQ ID NO: 1284585 - RNA, 21 nt, Human
gcuuuuaguauuuuagugaac

SEQ ID NO: 1284586 - RNA, 19 nt, Human
gcuuuccauucgugaaaac

SEQ ID NO: 1284587 - RNA, 15 nt, Human
gcuuugggcuugggc

SEQ ID NO: 1284588 - RNA, 17 nt, Human
gcuuuggugagaaccug

SEQ ID NO: 1284589 - RNA, 16 nt, Human
gcuuugguuuaaaaga

SEQ ID NO: 1284590 - RNA, 19 nt, Human
gcuuugggcugcccuggug

SEQ ID NO: 1284591 - RNA, 15 nt, Human
gcuuuccaugggacc

SEQ ID NO: 1284592 - RNA, 21 nt, Human
gcuuucauuuucucucaggug

SEQ ID NO: 1284593 - RNA, 19 nt, Human
gcuuucauuuucucucagg

SEQ ID NO: 1284594 - RNA, 15 nt, Human
gcuuucauguaaacu

SEQ ID NO: 1284595 - RNA, 20 nt, Human
gcuuucauguaaacugugca

SEQ ID NO: 1284596 - RNA, 21 nt, Human
gcuuucauguaaacugugcac

SEQ ID NO: 1284597 - RNA, 17 nt, Human
gcuuucauuuucucuca

SEQ ID NO: 1284598 - RNA, 18 nt, Human
gcuuucauuuucucucag

SEQ ID NO: 1284599 - RNA, 18 nt, Human
gcuuuaacuuaaauagua

SEQ ID NO: 1284600 - RNA, 18 nt, Human
gcuuucagggaggcccug

SEQ ID NO: 1284601 - RNA, 12 nt, Human
gcuuucauguaa

SEQ ID NO: 1284602 - RNA, 13 nt, Human
gcuuguugugcuu

SEQ ID NO: 1284603 - RNA, 16 nt, Human
gcuuguugugcuuuua

SEQ ID NO: 1284604 - RNA, 11 nt, Human
gcuuguuuaca

SEQ ID NO: 1284605 - RNA, 15 nt, Human
gcuuguuuacaugcu

SEQ ID NO: 1284606 - RNA, 19 nt, Human
gcuuguuuacaugcuuauu

SEQ ID NO: 1284607 - RNA, 16 nt, Human
gcuuguuuacaugcuu

SEQ ID NO: 1284608 - RNA, 13 nt, Human
gcuugccugcagg

SEQ ID NO: 1284609 - RNA, 14 nt, Human
gcuugccugcaggc

SEQ ID NO: 1284610 - RNA, 16 nt, Human
gcuugccugccugcuc

SEQ ID NO: 1284611 - RNA, 16 nt, Human
gcuugcuaauuauuuu

SEQ ID NO: 1284612 - RNA, 14 nt, Human
gcuugcuauucugu

SEQ ID NO: 1284613 - RNA, 18 nt, Human
gcuugcuauucugucccu

SEQ ID NO: 1284614 - RNA, 20 nt, Human
gcuugcuauucugucccuag

SEQ ID NO: 1284615 - RNA, 14 nt, Human
gcuugcuuuucaug

SEQ ID NO: 1284616 - RNA, 23 nt, Human
gcuugcuuuucaugcaaacucuu

SEQ ID NO: 1284617 - RNA, 21 nt, Human
gcuugcuuuucaugcaaacuc

SEQ ID NO: 1284618 - RNA, 14 nt, Human
gcuuggagcagagg

SEQ ID NO: 1284619 - RNA, 16 nt, Human
gcuuggagcagagggg

SEQ ID NO: 1284620 - RNA, 18 nt, Human
gcuuguggcaagugaauu

SEQ ID NO: 1284621 - RNA, 13 nt, Human
gcuuguggggccu

SEQ ID NO: 1284622 - RNA, 16 nt, Human
gcuuguggggccuggg

SEQ ID NO: 1284623 - RNA, 17 nt, Human
gcuuguggggccuggga

SEQ ID NO: 1284624 - RNA, 18 nt, Human
gcuuguggggccugggag

SEQ ID NO: 1284625 - RNA, 19 nt, Human
gcuuguggggccugggagg

SEQ ID NO: 1284626 - RNA, 14 nt, Human
gcuuguuaaauuuu

SEQ ID NO: 1284627 - RNA, 19 nt, Human
gcuucuguuuuauaauuuu

SEQ ID NO: 1284628 - RNA, 19 nt, Human
gcuucuguugcugccucau

SEQ ID NO: 1284629 - RNA, 14 nt, Human
gcuucuggccagga

SEQ ID NO: 1284630 - RNA, 17 nt, Human
gcuucuguugcugccuc

SEQ ID NO: 1284631 - RNA, 18 nt, Human
gcuucuguugcugccuca

SEQ ID NO: 1284632 - RNA, 17 nt, Human
gcuucucauccugcagg

SEQ ID NO: 1284633 - RNA, 18 nt, Human
gcuucucauccugcaggc

SEQ ID NO: 1284634 - RNA, 15 nt, Human
gcuucugcuggggcc

SEQ ID NO: 1284635 - RNA, 16 nt, Human
gcuucugcuggggccu

SEQ ID NO: 1284636 - RNA, 18 nt, Human
gcuucugcuggggccugg

SEQ ID NO: 1284637 - RNA, 20 nt, Human
gcuucugcuggggccuggga

SEQ ID NO: 1284638 - RNA, 21 nt, Human
gcuucugcuggggccugggac

SEQ ID NO: 1284639 - RNA, 22 nt, Human
gcuucugcuggggccugggaca

SEQ ID NO: 1284640 - RNA, 22 nt, Human
gcuucucagauuucugaggaaa

SEQ ID NO: 1284641 - RNA, 16 nt, Human
gcuucucauccugcag

SEQ ID NO: 1284642 - RNA, 21 nt, Human
gcuucucagauuucugaggaa

SEQ ID NO: 1284643 - RNA, 22 nt, Human
gcuuccagauugacgacaagug

SEQ ID NO: 1284644 - RNA, 23 nt, Human
gcuuccagauugacgacaagugc

SEQ ID NO: 1284645 - RNA, 22 nt, Human
gcuucauucaagucagcucuuc

SEQ ID NO: 1284646 - RNA, 12 nt, Human
gcuuccaauuuu

SEQ ID NO: 1284647 - RNA, 21 nt, Human
gcuuccacguacugcagccuc

SEQ ID NO: 1284648 - RNA, 18 nt, Human
gcuuaucaacuaaugauu

SEQ ID NO: 1284649 - RNA, 14 nt, Human
gcuucaucuggcaa

SEQ ID NO: 1284650 - RNA, 14 nt, Human
gcuucaugccagcu

SEQ ID NO: 1284651 - RNA, 17 nt, Human
gcuucauggcagaaggc

SEQ ID NO: 1284652 - RNA, 14 nt, Human
gcuucauguguccc

SEQ ID NO: 1284653 - RNA, 15 nt, Human
gcuucauguguccca

SEQ ID NO: 1284654 - RNA, 16 nt, Human
gcuucaugugucccag

SEQ ID NO: 1284655 - RNA, 17 nt, Human
gcuucaugugucccaga

SEQ ID NO: 1284656 - RNA, 18 nt, Human
gcuucaugugucccagaa

SEQ ID NO: 1284657 - RNA, 15 nt, Human
gcuuauauuguucac

SEQ ID NO: 1284658 - RNA, 15 nt, Human
gcuuauaucuggccu

SEQ ID NO: 1284659 - RNA, 17 nt, Human
gcuuauaucuggccucu

SEQ ID NO: 1284660 - RNA, 20 nt, Human
gcuuauaucuggccucugcu

SEQ ID NO: 1284661 - RNA, 17 nt, Human
gcuuauacgaaauaauu

SEQ ID NO: 1284662 - RNA, 18 nt, Human
gcuuauacgaaauaauug

SEQ ID NO: 1284663 - RNA, 19 nt, Human
gcuuauacgaaauaauugu

SEQ ID NO: 1284664 - RNA, 22 nt, Human
gcuuauacgaaauaauuguugu

SEQ ID NO: 1284665 - RNA, 23 nt, Human
gcuuauacgaaauaauuguuguu

SEQ ID NO: 1284666 - RNA, 11 nt, Human
gcuuauaucug

SEQ ID NO: 1284667 - RNA, 12 nt, Human
gcuuaccuggcc

SEQ ID NO: 1284668 - RNA, 22 nt, Human
gcuuaccuggcccaucagggua

SEQ ID NO: 1284669 - RNA, 17 nt, Human
gcuuacugauauauuuu

SEQ ID NO: 1284670 - RNA, 21 nt, Human
gcuuacugauauauuuuacaa

SEQ ID NO: 1284671 - RNA, 22 nt, Human
gcuccuccaggguggcagcaac

SEQ ID NO: 1284672 - RNA, 21 nt, Human
gcuccuccaggguggcagcaa

SEQ ID NO: 1284673 - RNA, 11 nt, Human
gcuccucccac

SEQ ID NO: 1284674 - RNA, 20 nt, Human
gcuccuccagggugugugcu

SEQ ID NO: 1284675 - RNA, 15 nt, Human
gcuccuccccuggag

SEQ ID NO: 1284676 - RNA, 23 nt, Human
gcuccuggggguucuuucuuccu

SEQ ID NO: 1284677 - RNA, 14 nt, Human
gcuccucccggugc

SEQ ID NO: 1284678 - RNA, 16 nt, Human
gcuccucccggugccc

SEQ ID NO: 1284679 - RNA, 21 nt, Human
gcuccuggucaccuaggaagc

SEQ ID NO: 1284680 - RNA, 14 nt, Human
gcuccuguccccug

SEQ ID NO: 1284681 - RNA, 19 nt, Human
gcuccuguccccugcuaca

SEQ ID NO: 1284682 - RNA, 17 nt, Human
gcuccuguccccugcua

SEQ ID NO: 1284683 - RNA, 13 nt, Human
gcuccuguggccc

SEQ ID NO: 1284684 - RNA, 15 nt, Human
gcuccuguggcccca

SEQ ID NO: 1284685 - RNA, 20 nt, Human
gcuccuguggccccacccug

SEQ ID NO: 1284686 - RNA, 21 nt, Human
gcuccuguggccccacccugg

SEQ ID NO: 1284687 - RNA, 21 nt, Human
gcuccuauucaacacacacau

SEQ ID NO: 1284688 - RNA, 21 nt, Human
gcuccucaaccccuccccucc

SEQ ID NO: 1284689 - RNA, 22 nt, Human
gcuccucaaccccuccccucca

SEQ ID NO: 1284690 - RNA, 18 nt, Human
gcuccucagggacucagg

SEQ ID NO: 1284691 - RNA, 19 nt, Human
gcuccucagggacucaggu

SEQ ID NO: 1284692 - RNA, 20 nt, Human
gcuccucagggacucaggug

SEQ ID NO: 1284693 - RNA, 23 nt, Human
gcuccgugugggagaccggccug

SEQ ID NO: 1284694 - RNA, 22 nt, Human
gcuccgugugggagaccggccu

SEQ ID NO: 1284695 - RNA, 17 nt, Human
gcuccgccuggccuggc

SEQ ID NO: 1284696 - RNA, 15 nt, Human
gcuccgccuggccug

SEQ ID NO: 1284697 - RNA, 23 nt, Human
gcuccggaggacucaccacugcc

SEQ ID NO: 1284698 - RNA, 22 nt, Human
gcuccguccaggagccugugcc

SEQ ID NO: 1284699 - RNA, 23 nt, Human
gcuccguccaggagccugugccu

SEQ ID NO: 1284700 - RNA, 14 nt, Human
gcuccuugggcccu

SEQ ID NO: 1284701 - RNA, 17 nt, Human
gcuccuugggcccuuug

SEQ ID NO: 1284702 - RNA, 19 nt, Human
gcuccuugggcccuuugag

SEQ ID NO: 1284703 - RNA, 15 nt, Human
gcuccuugugccaga

SEQ ID NO: 1284704 - RNA, 15 nt, Human
gcuccuugugggccu

SEQ ID NO: 1284705 - RNA, 16 nt, Human
gcuccuugugggccug

SEQ ID NO: 1284706 - RNA, 17 nt, Human
gcuccuugugggccugg

SEQ ID NO: 1284707 - RNA, 18 nt, Human
gcuccuugugggccuggg

SEQ ID NO: 1284708 - RNA, 20 nt, Human
gcuccuugugggccugggcu

SEQ ID NO: 1284709 - RNA, 22 nt, Human
gcuccuugugggccugggcucc

SEQ ID NO: 1284710 - RNA, 21 nt, Human
gcuccuugugggccugggcuc

SEQ ID NO: 1284711 - RNA, 16 nt, Human
gcucgaggggugggcu

SEQ ID NO: 1284712 - RNA, 15 nt, Human
gcuccuuaaggcucu

SEQ ID NO: 1284713 - RNA, 17 nt, Human
gcuccuuaaggcucuuu

SEQ ID NO: 1284714 - RNA, 21 nt, Human
gcuccuuaaggcucuuuugua

SEQ ID NO: 1284715 - RNA, 22 nt, Human
gcuccuguuuugcacagccaaa

SEQ ID NO: 1284716 - RNA, 18 nt, Human
gcuccuuccucugaggcu

SEQ ID NO: 1284717 - RNA, 18 nt, Human
gcuccuucccaucgcugu

SEQ ID NO: 1284718 - RNA, 13 nt, Human
gcuccuucccauc

SEQ ID NO: 1284719 - RNA, 20 nt, Human
gcuccuuccucugaggcuga

SEQ ID NO: 1284720 - RNA, 22 nt, Human
gcuccuuccucugaggcugaaa

SEQ ID NO: 1284721 - RNA, 14 nt, Human
gcuccuuccuggag

SEQ ID NO: 1284722 - RNA, 23 nt, Human
gcuccuuccuggagacugcccag

SEQ ID NO: 1284723 - RNA, 14 nt, Human
gcucauuucaggau

SEQ ID NO: 1284724 - RNA, 14 nt, Human
gcucauuuuggacu

SEQ ID NO: 1284725 - RNA, 17 nt, Human
gcucaugugugcaacag

SEQ ID NO: 1284726 - RNA, 22 nt, Human
gcucaugugugcaacaggguau

SEQ ID NO: 1284727 - RNA, 19 nt, Human
gcucccacagaacacagca

SEQ ID NO: 1284728 - RNA, 21 nt, Human
gcucccuucuacagccucaga

SEQ ID NO: 1284729 - RNA, 14 nt, Human
gcucccuucuuccc

SEQ ID NO: 1284730 - RNA, 15 nt, Human
gcuccgaggacccag

SEQ ID NO: 1284731 - RNA, 16 nt, Human
gcuccgaggacccagg

SEQ ID NO: 1284732 - RNA, 15 nt, Human
gcucccacaggcccu

SEQ ID NO: 1284733 - RNA, 23 nt, Human
gcucccacaagccucugcccagg

SEQ ID NO: 1284734 - RNA, 15 nt, Human
gcucccacaagccug

SEQ ID NO: 1284735 - RNA, 16 nt, Human
gcucccacaagccuga

SEQ ID NO: 1284736 - RNA, 17 nt, Human
gcucccacaagccugag

SEQ ID NO: 1284737 - RNA, 18 nt, Human
gcucccacaagccugagg

SEQ ID NO: 1284738 - RNA, 19 nt, Human
gcucccacaagccugaggg

SEQ ID NO: 1284739 - RNA, 13 nt, Human
gcucccacagaac

SEQ ID NO: 1284740 - RNA, 15 nt, Human
gcuccaguguccuga

SEQ ID NO: 1284741 - RNA, 16 nt, Human
gcuccaguguccugag

SEQ ID NO: 1284742 - RNA, 17 nt, Human
gcuccaguguccugagc

SEQ ID NO: 1284743 - RNA, 19 nt, Human
gcuccaguguccugagcuc

SEQ ID NO: 1284744 - RNA, 15 nt, Human
gcucccaaggggccu

SEQ ID NO: 1284745 - RNA, 16 nt, Human
gcucccaaggggccug

SEQ ID NO: 1284746 - RNA, 17 nt, Human
gcucccaaggggccuga

SEQ ID NO: 1284747 - RNA, 19 nt, Human
gcucccaaggggccugagc

SEQ ID NO: 1284748 - RNA, 20 nt, Human
gcucccaaggggccugagca

SEQ ID NO: 1284749 - RNA, 21 nt, Human
gcucccaaggggccugagcag

SEQ ID NO: 1284750 - RNA, 15 nt, Human
gcucccacaagccuc

SEQ ID NO: 1284751 - RNA, 15 nt, Human
gcuccagguggcucu

SEQ ID NO: 1284752 - RNA, 16 nt, Human
gcuccagguggcucug

SEQ ID NO: 1284753 - RNA, 18 nt, Human
gcuccagguggcucugag

SEQ ID NO: 1284754 - RNA, 21 nt, Human
gcuccagguggcucugaggug

SEQ ID NO: 1284755 - RNA, 20 nt, Human
gcuccaguguccugagcuca

SEQ ID NO: 1284756 - RNA, 18 nt, Human
gcucauggacuucugcca

SEQ ID NO: 1284757 - RNA, 16 nt, Human
gcucaucugcuggucc

SEQ ID NO: 1284758 - RNA, 21 nt, Human
gcucaucugcugguccguggg

SEQ ID NO: 1284759 - RNA, 23 nt, Human
gcucaucugcugguccgugggac

SEQ ID NO: 1284760 - RNA, 16 nt, Human
gcucaucauucucugu

SEQ ID NO: 1284761 - RNA, 18 nt, Human
gcucaucauucucugucu

SEQ ID NO: 1284762 - RNA, 19 nt, Human
gcucaucauucucugucuc

SEQ ID NO: 1284763 - RNA, 20 nt, Human
gcucaucauucucugucuca

SEQ ID NO: 1284764 - RNA, 13 nt, Human
gcucaucugcugg

SEQ ID NO: 1284765 - RNA, 14 nt, Human
gcucaucugcuggu

SEQ ID NO: 1284766 - RNA, 15 nt, Human
gcucaucugcugguc

SEQ ID NO: 1284767 - RNA, 15 nt, Human
gcucauauuucccau

SEQ ID NO: 1284768 - RNA, 19 nt, Human
gcucagcugucaaggcuca

SEQ ID NO: 1284769 - RNA, 16 nt, Human
gcucagcccugcacca

SEQ ID NO: 1284770 - RNA, 18 nt, Human
gcucagcucauccaugcc

SEQ ID NO: 1284771 - RNA, 16 nt, Human
gcucagcucugggcca

SEQ ID NO: 1284772 - RNA, 17 nt, Human
gcucagcucugggccau

SEQ ID NO: 1284773 - RNA, 12 nt, Human
gcucagcugcau

SEQ ID NO: 1284774 - RNA, 19 nt, Human
gcucagcugcauuccgcag

SEQ ID NO: 1284775 - RNA, 17 nt, Human
gcucagcccucccugcc

SEQ ID NO: 1284776 - RNA, 18 nt, Human
gcucagcccucccugccc

SEQ ID NO: 1284777 - RNA, 19 nt, Human
gcucagcccucccugcccc

SEQ ID NO: 1284778 - RNA, 21 nt, Human
gcucagcccucccugccccuc

SEQ ID NO: 1284779 - RNA, 12 nt, Human
gcucagcccuga

SEQ ID NO: 1284780 - RNA, 15 nt, Human
gcucagcccugagga

SEQ ID NO: 1284781 - RNA, 12 nt, Human
gcucagcccugc

SEQ ID NO: 1284782 - RNA, 22 nt, Human
gcucacagaacccuuggagcca

SEQ ID NO: 1284783 - RNA, 12 nt, Human
gcucagcccucc

SEQ ID NO: 1284784 - RNA, 22 nt, Human
gcucagccccaccccagggcag

SEQ ID NO: 1284785 - RNA, 15 nt, Human
gcucagcccucccug

SEQ ID NO: 1284786 - RNA, 16 nt, Human
gcucagcccucccugc

SEQ ID NO: 1284787 - RNA, 21 nt, Human
gcucagccaucccgucuucuc

SEQ ID NO: 1284788 - RNA, 15 nt, Human
gcucagccccacccc

SEQ ID NO: 1284789 - RNA, 20 nt, Human
gcucagccccaccccagggc

SEQ ID NO: 1284790 - RNA, 21 nt, Human
gcucagccccaccccagggca

SEQ ID NO: 1284791 - RNA, 16 nt, Human
gcuaucguaaaauuaa

SEQ ID NO: 1284792 - RNA, 15 nt, Human
gcuaucguaaaauua

SEQ ID NO: 1284793 - RNA, 17 nt, Human
gcuaucguaaaauuaag

SEQ ID NO: 1284794 - RNA, 18 nt, Human
gcucaagcgauucuccug

SEQ ID NO: 1284795 - RNA, 14 nt, Human
gcucaaggccagcu

SEQ ID NO: 1284796 - RNA, 16 nt, Human
gcucaaucccugagga

SEQ ID NO: 1284797 - RNA, 20 nt, Human
gcucaaucccugaggacuga

SEQ ID NO: 1284798 - RNA, 13 nt, Human
gcucaaugagcau

SEQ ID NO: 1284799 - RNA, 14 nt, Human
gcucaaugagcaug

SEQ ID NO: 1284800 - RNA, 19 nt, Human
gcucaaugagcauguuuag

SEQ ID NO: 1284801 - RNA, 20 nt, Human
gcucaaugagcauguuuaga

SEQ ID NO: 1284802 - RNA, 17 nt, Human
gcucaauggacuggaag

SEQ ID NO: 1284803 - RNA, 14 nt, Human
gcucacaaaccaug

SEQ ID NO: 1284804 - RNA, 13 nt, Human
gcucacaaggcag

SEQ ID NO: 1284805 - RNA, 14 nt, Human
gcucacaaggcagc

SEQ ID NO: 1284806 - RNA, 15 nt, Human
gcucacaaggcagca

SEQ ID NO: 1284807 - RNA, 19 nt, Human
gcucacaaggcagcaaggc

SEQ ID NO: 1284808 - RNA, 20 nt, Human
gcucacaaggcagcaaggcc

SEQ ID NO: 1284809 - RNA, 21 nt, Human
gcucacaaggcagcaaggccc

SEQ ID NO: 1284810 - RNA, 22 nt, Human
gcucacaaggcagcaaggcccg

SEQ ID NO: 1284811 - RNA, 13 nt, Human
gcucacacaccug

SEQ ID NO: 1284812 - RNA, 12 nt, Human
gcuauccaccaa

SEQ ID NO: 1284813 - RNA, 17 nt, Human
gcuauauaagacaagaa

SEQ ID NO: 1284814 - RNA, 20 nt, Human
gcuauaacuauguugauaaa

SEQ ID NO: 1284815 - RNA, 21 nt, Human
gcuauacugcauacuuuuuaa

SEQ ID NO: 1284816 - RNA, 14 nt, Human
gcuagauguaugua

SEQ ID NO: 1284817 - RNA, 16 nt, Human
gcuagauguauguacu

SEQ ID NO: 1284818 - RNA, 19 nt, Human
gcuauaaagcaguauuuuu

SEQ ID NO: 1284819 - RNA, 21 nt, Human
gcuauaaagcaguauuuuucu

SEQ ID NO: 1284820 - RNA, 13 nt, Human
gcuagauguaugu

SEQ ID NO: 1284821 - RNA, 22 nt, Human
gcgcccuuaacugcauccagcc

SEQ ID NO: 1284822 - RNA, 12 nt, Human
gcgcccugcaga

SEQ ID NO: 1284823 - RNA, 13 nt, Human
gcgcccugcagac

SEQ ID NO: 1284824 - RNA, 14 nt, Human
gcgcccugcagacc

SEQ ID NO: 1284825 - RNA, 16 nt, Human
gcgcccugcagacccu

SEQ ID NO: 1284826 - RNA, 18 nt, Human
gcgcccugcagacccugc

SEQ ID NO: 1284827 - RNA, 21 nt, Human
gcgccucgccggaucugaggg

SEQ ID NO: 1284828 - RNA, 15 nt, Human
gcgccugugguucug

SEQ ID NO: 1284829 - RNA, 18 nt, Human
gcgccccaacccguggag

SEQ ID NO: 1284830 - RNA, 21 nt, Human
gcgccccaacccguggaggcu

SEQ ID NO: 1284831 - RNA, 22 nt, Human
gcgccccaacccguggaggcug

SEQ ID NO: 1284832 - RNA, 13 nt, Human
gcgccccuucccc

SEQ ID NO: 1284833 - RNA, 21 nt, Human
gcgcccccuccgcccugccac

SEQ ID NO: 1284834 - RNA, 22 nt, Human
gcgcccccuccgcccugccacu

SEQ ID NO: 1284835 - RNA, 18 nt, Human
gcgcaguguggaggccac

SEQ ID NO: 1284836 - RNA, 22 nt, Human
gcgcaguuuuuuuuuucuuguc

SEQ ID NO: 1284837 - RNA, 13 nt, Human
gcgcaucagacug

SEQ ID NO: 1284838 - RNA, 17 nt, Human
gcggaccacccucacug

SEQ ID NO: 1284839 - RNA, 15 nt, Human
gcgguagccagcaca

SEQ ID NO: 1284840 - RNA, 21 nt, Human
gcgguagccagcacacagggc

SEQ ID NO: 1284841 - RNA, 22 nt, Human
gcgguagccagcacacagggca

SEQ ID NO: 1284842 - RNA, 23 nt, Human
gcgguagccagcacacagggcag

SEQ ID NO: 1284843 - RNA, 18 nt, Human
gcgcaggcuggcccugcc

SEQ ID NO: 1284844 - RNA, 19 nt, Human
gcgcaggcuggcccugccc

SEQ ID NO: 1284845 - RNA, 17 nt, Human
gcgcaggcuggcccugc

SEQ ID NO: 1284846 - RNA, 20 nt, Human
gcgcaggcuggcccugcccu

SEQ ID NO: 1284847 - RNA, 21 nt, Human
gcgcaggcuggcccugcccug

SEQ ID NO: 1284848 - RNA, 22 nt, Human
gcgcaggcuggcccugcccugg

SEQ ID NO: 1284849 - RNA, 17 nt, Human
gcgaagcguuguccuca

SEQ ID NO: 1284850 - RNA, 17 nt, Human
gccuuucuucucuccag

SEQ ID NO: 1284851 - RNA, 16 nt, Human
gccuuguuuuuuucua

SEQ ID NO: 1284852 - RNA, 18 nt, Human
gccuuucaggaucuauuu

SEQ ID NO: 1284853 - RNA, 15 nt, Human
gccuuuccauccaug

SEQ ID NO: 1284854 - RNA, 19 nt, Human
gccuuuccauccauggcca

SEQ ID NO: 1284855 - RNA, 21 nt, Human
gccuuuccauccauggccagc

SEQ ID NO: 1284856 - RNA, 18 nt, Human
gccuuucccuaagccagc

SEQ ID NO: 1284857 - RNA, 20 nt, Human
gccuuuccauccauggccag

SEQ ID NO: 1284858 - RNA, 16 nt, Human
gccugucuuaauuuuc

SEQ ID NO: 1284859 - RNA, 17 nt, Human
gccugucuuaauuuucu

SEQ ID NO: 1284860 - RNA, 14 nt, Human
gccugugaacccag

SEQ ID NO: 1284861 - RNA, 15 nt, Human
gccugugaacccagg

SEQ ID NO: 1284862 - RNA, 16 nt, Human
gccugugaacccagga

SEQ ID NO: 1284863 - RNA, 17 nt, Human
gccugugaacccaggac

SEQ ID NO: 1284864 - RNA, 18 nt, Human
gccugugaacccaggaca

SEQ ID NO: 1284865 - RNA, 13 nt, Human
gccuuccuccugg

SEQ ID NO: 1284866 - RNA, 14 nt, Human
gccuuccuccuggg

SEQ ID NO: 1284867 - RNA, 16 nt, Human
gccuuccuccugggcc

SEQ ID NO: 1284868 - RNA, 17 nt, Human
gccuuccuccugggccc

SEQ ID NO: 1284869 - RNA, 22 nt, Human
gccuuccuccugggcccucucu

SEQ ID NO: 1284870 - RNA, 15 nt, Human
gccuugucacgccag

SEQ ID NO: 1284871 - RNA, 16 nt, Human
gccuugucacgccaga

SEQ ID NO: 1284872 - RNA, 17 nt, Human
gccuugucacgccagac

SEQ ID NO: 1284873 - RNA, 21 nt, Human
gccuugugaugucauacagag

SEQ ID NO: 1284874 - RNA, 22 nt, Human
gccuugugaugucauacagaga

SEQ ID NO: 1284875 - RNA, 23 nt, Human
gccuugugaugucauacagagaa

SEQ ID NO: 1284876 - RNA, 16 nt, Human
gccuuguucugucacc

SEQ ID NO: 1284877 - RNA, 12 nt, Human
gccuuguucugu

SEQ ID NO: 1284878 - RNA, 15 nt, Human
gccuuguuuuuuucu

SEQ ID NO: 1284879 - RNA, 17 nt, Human
gccuugguuuuuacugc

SEQ ID NO: 1284880 - RNA, 22 nt, Human
gccuugguuuuuacugcucuga

SEQ ID NO: 1284881 - RNA, 23 nt, Human
gccuugguuuuuacugcucugag

SEQ ID NO: 1284882 - RNA, 17 nt, Human
gccuuguaauucuaaau

SEQ ID NO: 1284883 - RNA, 20 nt, Human
gccuuguaauucuaaaugaa

SEQ ID NO: 1284884 - RNA, 20 nt, Human
gccugagcgacagugagacu

SEQ ID NO: 1284885 - RNA, 17 nt, Human
gccugagcgacagugag

SEQ ID NO: 1284886 - RNA, 10 nt, Human
gccugaggga

SEQ ID NO: 1284887 - RNA, 14 nt, Human
gccugagggaaagg

SEQ ID NO: 1284888 - RNA, 15 nt, Human
gccugagggaaaggc

SEQ ID NO: 1284889 - RNA, 17 nt, Human
gccugagggaaaggcca

SEQ ID NO: 1284890 - RNA, 24 nt, Human
gccugcaggaucucaccaggcagc

SEQ ID NO: 1284891 - RNA, 13 nt, Human
gccugcaggaucu

SEQ ID NO: 1284892 - RNA, 16 nt, Human
gccugcaggaucucac

SEQ ID NO: 1284893 - RNA, 23 nt, Human
gccugcaggaucucaccaggcag

SEQ ID NO: 1284894 - RNA, 13 nt, Human
gccuggcacaggg

SEQ ID NO: 1284895 - RNA, 14 nt, Human
gccuggcacagggc

SEQ ID NO: 1284896 - RNA, 16 nt, Human
gccuggaccagccucu

SEQ ID NO: 1284897 - RNA, 17 nt, Human
gccuggaccagccucuc

SEQ ID NO: 1284898 - RNA, 23 nt, Human
gccuggacccguucaugggggag

SEQ ID NO: 1284899 - RNA, 17 nt, Human
gccugcaguccuggaag

SEQ ID NO: 1284900 - RNA, 22 nt, Human
gccugcauaggaguuuggagga

SEQ ID NO: 1284901 - RNA, 23 nt, Human
gccugcauaggaguuuggaggaa

SEQ ID NO: 1284902 - RNA, 22 nt, Human
gccugcauccauucuccugagg

SEQ ID NO: 1284903 - RNA, 21 nt, Human
gccugcauccauucuccugag

SEQ ID NO: 1284904 - RNA, 16 nt, Human
gccugcauugagcuug

SEQ ID NO: 1284905 - RNA, 21 nt, Human
gccugcauugagcuugcaugc

SEQ ID NO: 1284906 - RNA, 13 nt, Human
gccugccaccucc

SEQ ID NO: 1284907 - RNA, 21 nt, Human
gccugcucccauccugugugu

SEQ ID NO: 1284908 - RNA, 12 nt, Human
gccugcugcuga

SEQ ID NO: 1284909 - RNA, 13 nt, Human
gccugcugcugag

SEQ ID NO: 1284910 - RNA, 14 nt, Human
gccugcugcugaga

SEQ ID NO: 1284911 - RNA, 15 nt, Human
gccugcugcugagaa

SEQ ID NO: 1284912 - RNA, 17 nt, Human
gccugcugcugagaacc

SEQ ID NO: 1284913 - RNA, 18 nt, Human
gccugcugcugagaaccu

SEQ ID NO: 1284914 - RNA, 19 nt, Human
gccugcugcugagaaccug

SEQ ID NO: 1284915 - RNA, 20 nt, Human
gccugcugcugagaaccugg

SEQ ID NO: 1284916 - RNA, 21 nt, Human
gccugcugcugagaaccuggc

SEQ ID NO: 1284917 - RNA, 22 nt, Human
gccugcugcugagaaccuggcc

SEQ ID NO: 1284918 - RNA, 15 nt, Human
gccuggaagagcagc

SEQ ID NO: 1284919 - RNA, 17 nt, Human
gccuggaagagcagccc

SEQ ID NO: 1284920 - RNA, 19 nt, Human
gccuggguuugguguaugg

SEQ ID NO: 1284921 - RNA, 11 nt, Human
gccuguacugc

SEQ ID NO: 1284922 - RNA, 13 nt, Human
gccuguacugccu

SEQ ID NO: 1284923 - RNA, 14 nt, Human
gccuguacugccug

SEQ ID NO: 1284924 - RNA, 15 nt, Human
gccuguacugccugc

SEQ ID NO: 1284925 - RNA, 16 nt, Human
gccuguacugccugcu

SEQ ID NO: 1284926 - RNA, 19 nt, Human
gccuguccugccuguggcc

SEQ ID NO: 1284927 - RNA, 12 nt, Human
gccugucucaag

SEQ ID NO: 1284928 - RNA, 20 nt, Human
gccuggguuugguguauggu

SEQ ID NO: 1284929 - RNA, 20 nt, Human
gccugguauauccaaaagcu

SEQ ID NO: 1284930 - RNA, 15 nt, Human
gccugggcugggaaa

SEQ ID NO: 1284931 - RNA, 16 nt, Human
gccugggcuccuggac

SEQ ID NO: 1284932 - RNA, 19 nt, Human
gccuggguguaaaaccugg

SEQ ID NO: 1284933 - RNA, 22 nt, Human
gccuggguguaaaaccuggaga

SEQ ID NO: 1284934 - RNA, 17 nt, Human
gccugggccgcugccac

SEQ ID NO: 1284935 - RNA, 18 nt, Human
gccugggccgcugccacg

SEQ ID NO: 1284936 - RNA, 14 nt, Human
gccugggccuaugg

SEQ ID NO: 1284937 - RNA, 18 nt, Human
gccugggccuauggagag

SEQ ID NO: 1284938 - RNA, 19 nt, Human
gccugggccuauggagagc

SEQ ID NO: 1284939 - RNA, 20 nt, Human
gccugggccuauggagagcc

SEQ ID NO: 1284940 - RNA, 21 nt, Human
gccugggccuauggagagccc

SEQ ID NO: 1284941 - RNA, 22 nt, Human
gccugggccuauggagagcccu

SEQ ID NO: 1284942 - RNA, 23 nt, Human
gccugggccuauggagagcccug

SEQ ID NO: 1284943 - RNA, 17 nt, Human
gccugggcgcugguccu

SEQ ID NO: 1284944 - RNA, 20 nt, Human
gccugggcgcugguccuuuc

SEQ ID NO: 1284945 - RNA, 10 nt, Human
gccugggcuc

SEQ ID NO: 1284946 - RNA, 21 nt, Human
gccugggcgcugguccuuucu

SEQ ID NO: 1284947 - RNA, 13 nt, Human
gccugggcuccug

SEQ ID NO: 1284948 - RNA, 14 nt, Human
gccugggcuccugg

SEQ ID NO: 1284949 - RNA, 15 nt, Human
gccugggcuccugga

SEQ ID NO: 1284950 - RNA, 17 nt, Human
gccugggcuccuggacc

SEQ ID NO: 1284951 - RNA, 22 nt, Human
gccuggcagccgugccuucagc

SEQ ID NO: 1284952 - RNA, 18 nt, Human
gccuggcacagggcagug

SEQ ID NO: 1284953 - RNA, 19 nt, Human
gccuggcacagggcagugg

SEQ ID NO: 1284954 - RNA, 12 nt, Human
gccuggcagccg

SEQ ID NO: 1284955 - RNA, 20 nt, Human
gccuggcagccgugccuuca

SEQ ID NO: 1284956 - RNA, 21 nt, Human
gccuggcagccgugccuucag

SEQ ID NO: 1284957 - RNA, 18 nt, Human
gccuggcccaccccaccc

SEQ ID NO: 1284958 - RNA, 16 nt, Human
gccuggccccaugguc

SEQ ID NO: 1284959 - RNA, 16 nt, Human
gccugggcaggaggga

SEQ ID NO: 1284960 - RNA, 13 nt, Human
gccugggcagugg

SEQ ID NO: 1284961 - RNA, 14 nt, Human
gccugggcagugga

SEQ ID NO: 1284962 - RNA, 16 nt, Human
gccugggccgcugcca

SEQ ID NO: 1284963 - RNA, 13 nt, Human
gccaccugucugu

SEQ ID NO: 1284964 - RNA, 12 nt, Human
gccaccugucug

SEQ ID NO: 1284965 - RNA, 10 nt, Human
gccaccuguc

SEQ ID NO: 1284966 - RNA, 15 nt, Human
gccaccugucugucu

SEQ ID NO: 1284967 - RNA, 14 nt, Human
gccaccugucuguc

SEQ ID NO: 1284968 - RNA, 11 nt, Human
gccaccugggu

SEQ ID NO: 1284969 - RNA, 18 nt, Human
gccaccuggaccccugca

SEQ ID NO: 1284970 - RNA, 13 nt, Human
gccaccuggaccc

SEQ ID NO: 1284971 - RNA, 14 nt, Human
gccaccuggacccc

SEQ ID NO: 1284972 - RNA, 15 nt, Human
gccaccuggaccccu

SEQ ID NO: 1284973 - RNA, 16 nt, Human
gccaccuggaccccug

SEQ ID NO: 1284974 - RNA, 19 nt, Human
gccaccuggaccccugcau

SEQ ID NO: 1284975 - RNA, 20 nt, Human
gccaccuggcucucaccucu

SEQ ID NO: 1284976 - RNA, 12 nt, Human
gccaccuggacc

SEQ ID NO: 1284977 - RNA, 18 nt, Human
gccacggggacucagccc

SEQ ID NO: 1284978 - RNA, 23 nt, Human
gccacgggugccagaagcuacug

SEQ ID NO: 1284979 - RNA, 16 nt, Human
gccacgcuccagcugc

SEQ ID NO: 1284980 - RNA, 20 nt, Human
gccacgcccaacuaauuuuu

SEQ ID NO: 1284981 - RNA, 13 nt, Human
gccacgcuccagc

SEQ ID NO: 1284982 - RNA, 14 nt, Human
gccacgcuccagcu

SEQ ID NO: 1284983 - RNA, 15 nt, Human
gccacgcuccagcug

SEQ ID NO: 1284984 - RNA, 17 nt, Human
gccacgcuccagcugcc

SEQ ID NO: 1284985 - RNA, 16 nt, Human
gccaccugaauaaaga

SEQ ID NO: 1284986 - RNA, 17 nt, Human
gccaccucuaacagcac

SEQ ID NO: 1284987 - RNA, 18 nt, Human
gccaccucuaacagcacc

SEQ ID NO: 1284988 - RNA, 19 nt, Human
gccaccucuaacagcacca

SEQ ID NO: 1284989 - RNA, 21 nt, Human
gccaccucuaacagcaccaaa

SEQ ID NO: 1284990 - RNA, 17 nt, Human
gccaccgugccuggcca

SEQ ID NO: 1284991 - RNA, 22 nt, Human
gccaccgugccuggccacgccc

SEQ ID NO: 1284992 - RNA, 23 nt, Human
gccaccucagaccccggggugag

SEQ ID NO: 1284993 - RNA, 18 nt, Human
gccacaguagucuugaug

SEQ ID NO: 1284994 - RNA, 14 nt, Human
gccacaguuccccu

SEQ ID NO: 1284995 - RNA, 15 nt, Human
gccacaguuccccua

SEQ ID NO: 1284996 - RNA, 15 nt, Human
gccacaucaaagagg

SEQ ID NO: 1284997 - RNA, 23 nt, Human
gccacuccucugacucagggcuc

SEQ ID NO: 1284998 - RNA, 13 nt, Human
gccacuccuuccu

SEQ ID NO: 1284999 - RNA, 14 nt, Human
gccacuccuuccug

SEQ ID NO: 1285000 - RNA, 15 nt, Human
gccacuccuuccugc

SEQ ID NO: 1285001 - RNA, 17 nt, Human
gccacuccuuccugccc

SEQ ID NO: 1285002 - RNA, 18 nt, Human
gccacuccuuccugcccc

SEQ ID NO: 1285003 - RNA, 21 nt, Human
gccagacuucccacggcuccu

SEQ ID NO: 1285004 - RNA, 12 nt, Human
gcauuugugaaa

SEQ ID NO: 1285005 - RNA, 18 nt, Human
gccaagggaaccuguguc

SEQ ID NO: 1285006 - RNA, 19 nt, Human
gccaagggaaccugugucc

SEQ ID NO: 1285007 - RNA, 21 nt, Human
gccaagggauggacaucuugu

SEQ ID NO: 1285008 - RNA, 22 nt, Human
gccaagggcaacagaucaguaa

SEQ ID NO: 1285009 - RNA, 19 nt, Human
gccaagggcauaaauuauu

SEQ ID NO: 1285010 - RNA, 16 nt, Human
gccaagggcuuuguuu

SEQ ID NO: 1285011 - RNA, 18 nt, Human
gccaaggggcuucagguc

SEQ ID NO: 1285012 - RNA, 21 nt, Human
gccaagggccgacuaagagaa

SEQ ID NO: 1285013 - RNA, 13 nt, Human
gccaagguguccu

SEQ ID NO: 1285014 - RNA, 14 nt, Human
gccaagguguccua

SEQ ID NO: 1285015 - RNA, 16 nt, Human
gccaagguguccuaca

SEQ ID NO: 1285016 - RNA, 18 nt, Human
gccaagguguccuacaga

SEQ ID NO: 1285017 - RNA, 19 nt, Human
gccaagguguccuacagaa

SEQ ID NO: 1285018 - RNA, 20 nt, Human
gccaagguguccuacagaaa

SEQ ID NO: 1285019 - RNA, 21 nt, Human
gccaagguguccuacagaaaa

SEQ ID NO: 1285020 - RNA, 20 nt, Human
gccaagguuuuauaaggcug

SEQ ID NO: 1285021 - RNA, 20 nt, Human
gccaauaauaauaccucccu

SEQ ID NO: 1285022 - RNA, 16 nt, Human
gccaauagugucaucc

SEQ ID NO: 1285023 - RNA, 23 nt, Human
gccaagguguccuacagaaaaac

SEQ ID NO: 1285024 - RNA, 15 nt, Human
gccaaguccaggucc

SEQ ID NO: 1285025 - RNA, 16 nt, Human
gccaaguccagguccu

SEQ ID NO: 1285026 - RNA, 17 nt, Human
gccaaguccagguccug

SEQ ID NO: 1285027 - RNA, 18 nt, Human
gccaaguccagguccugg

SEQ ID NO: 1285028 - RNA, 19 nt, Human
gccaaguccagguccuggu

SEQ ID NO: 1285029 - RNA, 21 nt, Human
gccaaguccagguccuggugg

SEQ ID NO: 1285030 - RNA, 22 nt, Human
gccaaguccagguccugguggg

SEQ ID NO: 1285031 - RNA, 12 nt, Human
gccaaguuccuc

SEQ ID NO: 1285032 - RNA, 16 nt, Human
gccaaguuccucuaac

SEQ ID NO: 1285033 - RNA, 16 nt, Human
gccaauggagacuguc

SEQ ID NO: 1285034 - RNA, 19 nt, Human
gccaauggagacugucuca

SEQ ID NO: 1285035 - RNA, 21 nt, Human
gccaauggagacugucucaag

SEQ ID NO: 1285036 - RNA, 21 nt, Human
gccaaucccucaccuucugag

SEQ ID NO: 1285037 - RNA, 22 nt, Human
gccaaucccucaccuucugagu

SEQ ID NO: 1285038 - RNA, 21 nt, Human
gccaaugcaccuaaagaaaaa

SEQ ID NO: 1285039 - RNA, 19 nt, Human
gccaaugcaccuaaagaaa

SEQ ID NO: 1285040 - RNA, 18 nt, Human
gccaauauuaaaucugcu

SEQ ID NO: 1285041 - RNA, 22 nt, Human
gccaauauuaguaggauuuuug

SEQ ID NO: 1285042 - RNA, 23 nt, Human
gccacacuucaggcucuucuccu

SEQ ID NO: 1285043 - RNA, 19 nt, Human
gccacacuucaaacuacuu

SEQ ID NO: 1285044 - RNA, 16 nt, Human
gccacacuucucagga

SEQ ID NO: 1285045 - RNA, 17 nt, Human
gccacacuucucaggac

SEQ ID NO: 1285046 - RNA, 19 nt, Human
gccacacuucucaggacac

SEQ ID NO: 1285047 - RNA, 20 nt, Human
gccacacuucaggcucuucu

SEQ ID NO: 1285048 - RNA, 22 nt, Human
gccacacuucaggcucuucucc

SEQ ID NO: 1285049 - RNA, 19 nt, Human
gccacacucagcacaaggc

SEQ ID NO: 1285050 - RNA, 17 nt, Human
gccacacgagaaccuga

SEQ ID NO: 1285051 - RNA, 13 nt, Human
gccacaccaggau

SEQ ID NO: 1285052 - RNA, 16 nt, Human
gccacaccaggauaga

SEQ ID NO: 1285053 - RNA, 13 nt, Human
gccacacucagca

SEQ ID NO: 1285054 - RNA, 16 nt, Human
gccacacucagcacaa

SEQ ID NO: 1285055 - RNA, 17 nt, Human
gccacacucagcacaag

SEQ ID NO: 1285056 - RNA, 22 nt, Human
gccacacuucucaggacacagg

SEQ ID NO: 1285057 - RNA, 23 nt, Human
gccacacuucucaggacacaggc

SEQ ID NO: 1285058 - RNA, 12 nt, Human
gccacagccagg

SEQ ID NO: 1285059 - RNA, 14 nt, Human
gccacagccagggg

SEQ ID NO: 1285060 - RNA, 14 nt, Human
gccacagcccuguc

SEQ ID NO: 1285061 - RNA, 15 nt, Human
gccacagcccuguca

SEQ ID NO: 1285062 - RNA, 21 nt, Human
gccacagcccugucagcauga

SEQ ID NO: 1285063 - RNA, 13 nt, Human
gccacagcccuuu

SEQ ID NO: 1285064 - RNA, 21 nt, Human
gccacagccuccccugccagg

SEQ ID NO: 1285065 - RNA, 16 nt, Human
gccacagccuccccug

SEQ ID NO: 1285066 - RNA, 20 nt, Human
gccacagcccuuuugucucu

SEQ ID NO: 1285067 - RNA, 10 nt, Human
gccacagcuu

SEQ ID NO: 1285068 - RNA, 12 nt, Human
gccacagcuuuu

SEQ ID NO: 1285069 - RNA, 13 nt, Human
gccacagcuuuug

SEQ ID NO: 1285070 - RNA, 15 nt, Human
gccacagcuuuugca

SEQ ID NO: 1285071 - RNA, 18 nt, Human
gccacagcuuuugcaacu

SEQ ID NO: 1285072 - RNA, 16 nt, Human
gccacagcuuuugcaa

SEQ ID NO: 1285073 - RNA, 15 nt, Human
gccacaaaaacaggu

SEQ ID NO: 1285074 - RNA, 15 nt, Human
gccaauucagacagg

SEQ ID NO: 1285075 - RNA, 17 nt, Human
gccaauucagacaggca

SEQ ID NO: 1285076 - RNA, 18 nt, Human
gccaauucagacaggcaa

SEQ ID NO: 1285077 - RNA, 13 nt, Human
gccaauuccuaua

SEQ ID NO: 1285078 - RNA, 20 nt, Human
gccaauuucaaguuccaagu

SEQ ID NO: 1285079 - RNA, 13 nt, Human
gccacacagcugc

SEQ ID NO: 1285080 - RNA, 14 nt, Human
gccacacagcugcc

SEQ ID NO: 1285081 - RNA, 15 nt, Human
gccacacaguauuuu

SEQ ID NO: 1285082 - RNA, 15 nt, Human
gccacacagcugccg

SEQ ID NO: 1285083 - RNA, 21 nt, Human
gccacaccaggauagagacug

SEQ ID NO: 1285084 - RNA, 21 nt, Human
gccacaaggacuuccugucca

SEQ ID NO: 1285085 - RNA, 21 nt, Human
gccacaaugaacaucccuuuu

SEQ ID NO: 1285086 - RNA, 14 nt, Human
gccacaaggacuuc

SEQ ID NO: 1285087 - RNA, 17 nt, Human
gccacaaggacuuccug

SEQ ID NO: 1285088 - RNA, 18 nt, Human
gccacaaggacuuccugu

SEQ ID NO: 1285089 - RNA, 19 nt, Human
gccacaaggacuuccuguc

SEQ ID NO: 1285090 - RNA, 19 nt, Human
gccaugggcacugugggua

SEQ ID NO: 1285091 - RNA, 15 nt, Human
gccaugggaggccuu

SEQ ID NO: 1285092 - RNA, 14 nt, Human
gccaugggaggccu

SEQ ID NO: 1285093 - RNA, 23 nt, Human
gccaugggacagggaggacgcuc

SEQ ID NO: 1285094 - RNA, 16 nt, Human
gccauggacucugucc

SEQ ID NO: 1285095 - RNA, 17 nt, Human
gccauggacucuguccu

SEQ ID NO: 1285096 - RNA, 18 nt, Human
gccauggacucuguccug

SEQ ID NO: 1285097 - RNA, 12 nt, Human
gccaugggaggc

SEQ ID NO: 1285098 - RNA, 13 nt, Human
gccaugcugaggc

SEQ ID NO: 1285099 - RNA, 14 nt, Human
gccaugcugaggcc

SEQ ID NO: 1285100 - RNA, 17 nt, Human
gccaugcugaggccugg

SEQ ID NO: 1285101 - RNA, 18 nt, Human
gccaugcugaggccuggg

SEQ ID NO: 1285102 - RNA, 19 nt, Human
gccaugcugaggccugggc

SEQ ID NO: 1285103 - RNA, 20 nt, Human
gccaugcugaggccugggcc

SEQ ID NO: 1285104 - RNA, 21 nt, Human
gccaugcugaggccugggccg

SEQ ID NO: 1285105 - RNA, 19 nt, Human
gccauggacucuguccuga

SEQ ID NO: 1285106 - RNA, 13 nt, Human
gccauuuuuacau

SEQ ID NO: 1285107 - RNA, 15 nt, Human
gccauuuuuacaucu

SEQ ID NO: 1285108 - RNA, 14 nt, Human
gcccaaccugcucu

SEQ ID NO: 1285109 - RNA, 19 nt, Human
gcccaaguucaugcagcug

SEQ ID NO: 1285110 - RNA, 20 nt, Human
gcccaaguucaugcagcugu

SEQ ID NO: 1285111 - RNA, 16 nt, Human
gcccaacccuucccuc

SEQ ID NO: 1285112 - RNA, 12 nt, Human
gccaucugcucc

SEQ ID NO: 1285113 - RNA, 22 nt, Human
gccaugacccugccucucccag

SEQ ID NO: 1285114 - RNA, 23 nt, Human
gccaugacccugccucucccagg

SEQ ID NO: 1285115 - RNA, 23 nt, Human
gccaugagaugauacauccaaag

SEQ ID NO: 1285116 - RNA, 21 nt, Human
gccaucugcgugacaauaaaa

SEQ ID NO: 1285117 - RNA, 17 nt, Human
gccaguauuuuaaaaua

SEQ ID NO: 1285118 - RNA, 13 nt, Human
gccagugcccuga

SEQ ID NO: 1285119 - RNA, 14 nt, Human
gccagugcccugag

SEQ ID NO: 1285120 - RNA, 15 nt, Human
gccagugcccugagc

SEQ ID NO: 1285121 - RNA, 18 nt, Human
gccagugcccugauccca

SEQ ID NO: 1285122 - RNA, 16 nt, Human
gccagugcccugagcc

SEQ ID NO: 1285123 - RNA, 17 nt, Human
gccagugcccugagcca

SEQ ID NO: 1285124 - RNA, 18 nt, Human
gccagugcccugagccag

SEQ ID NO: 1285125 - RNA, 14 nt, Human
gccagggagcgagu

SEQ ID NO: 1285126 - RNA, 19 nt, Human
gccagggagagcccaggag

SEQ ID NO: 1285127 - RNA, 20 nt, Human
gccagggagagcccaggagc

SEQ ID NO: 1285128 - RNA, 21 nt, Human
gccagggagagcccaggagcu

SEQ ID NO: 1285129 - RNA, 22 nt, Human
gccagggagagcccaggagcuc

SEQ ID NO: 1285130 - RNA, 13 nt, Human
gccagggagagcc

SEQ ID NO: 1285131 - RNA, 15 nt, Human
gccagggagagccca

SEQ ID NO: 1285132 - RNA, 16 nt, Human
gccagggagagcccag

SEQ ID NO: 1285133 - RNA, 17 nt, Human
gccagggagagcccagg

SEQ ID NO: 1285134 - RNA, 20 nt, Human
gccagggcaaugaugaauga

SEQ ID NO: 1285135 - RNA, 15 nt, Human
gccagggcagaguga

SEQ ID NO: 1285136 - RNA, 16 nt, Human
gccagggcagagugag

SEQ ID NO: 1285137 - RNA, 21 nt, Human
gccagggcagagugagaccca

SEQ ID NO: 1285138 - RNA, 14 nt, Human
gccagggcagggcc

SEQ ID NO: 1285139 - RNA, 19 nt, Human
gccagggcagggccccagg

SEQ ID NO: 1285140 - RNA, 15 nt, Human
gccagggccacgcuc

SEQ ID NO: 1285141 - RNA, 19 nt, Human
gccagggccacgcuccagc

SEQ ID NO: 1285142 - RNA, 22 nt, Human
gccagggccacgcuccagcugc

SEQ ID NO: 1285143 - RNA, 20 nt, Human
gccagggccacgcuccagcu

SEQ ID NO: 1285144 - RNA, 13 nt, Human
gccagggccccuc

SEQ ID NO: 1285145 - RNA, 22 nt, Human
gccagggccccucacccugccu

SEQ ID NO: 1285146 - RNA, 14 nt, Human
gccagggccccucu

SEQ ID NO: 1285147 - RNA, 15 nt, Human
gccagggccccucuc

SEQ ID NO: 1285148 - RNA, 14 nt, Human
gccaggggagcaga

SEQ ID NO: 1285149 - RNA, 21 nt, Human
gccaggggagcagaggggcag

SEQ ID NO: 1285150 - RNA, 20 nt, Human
gccaggggagcagaggggca

SEQ ID NO: 1285151 - RNA, 20 nt, Human
gccagggggagcugggccug

SEQ ID NO: 1285152 - RNA, 19 nt, Human
gccaggggggugaggagcu

SEQ ID NO: 1285153 - RNA, 20 nt, Human
gccaggggggugaggagcug

SEQ ID NO: 1285154 - RNA, 21 nt, Human
gccaggggggugaggagcugg

SEQ ID NO: 1285155 - RNA, 22 nt, Human
gccaggggggugaggagcuggg

SEQ ID NO: 1285156 - RNA, 22 nt, Human
gccagggggagcugggccuggu

SEQ ID NO: 1285157 - RNA, 19 nt, Human
gccagggucuccagaaagc

SEQ ID NO: 1285158 - RNA, 15 nt, Human
gccagggucuccaga

SEQ ID NO: 1285159 - RNA, 23 nt, Human
gccagguucuccguuagcuccug

SEQ ID NO: 1285160 - RNA, 15 nt, Human
gccaguauuuuaaaa

SEQ ID NO: 1285161 - RNA, 19 nt, Human
gccaggcuggagugcagug

SEQ ID NO: 1285162 - RNA, 18 nt, Human
gccaggcuggagugcagu

SEQ ID NO: 1285163 - RNA, 22 nt, Human
gccaggcuggucucgaacuccu

SEQ ID NO: 1285164 - RNA, 14 nt, Human
gccagggagaagcu

SEQ ID NO: 1285165 - RNA, 15 nt, Human
gccagggagaagcuc

SEQ ID NO: 1285166 - RNA, 16 nt, Human
gccagggagaagcucc

SEQ ID NO: 1285167 - RNA, 20 nt, Human
gccagggagaagcuccucuc

SEQ ID NO: 1285168 - RNA, 13 nt, Human
gccaggcuggguc

SEQ ID NO: 1285169 - RNA, 16 nt, Human
gccaggcuggagugca

SEQ ID NO: 1285170 - RNA, 22 nt, Human
gccaggcugcucuugaacuccu

SEQ ID NO: 1285171 - RNA, 19 nt, Human
gccagauuuuccugaaaac

SEQ ID NO: 1285172 - RNA, 13 nt, Human
gccaggcugcucu

SEQ ID NO: 1285173 - RNA, 14 nt, Human
gccaggcugcucuu

SEQ ID NO: 1285174 - RNA, 14 nt, Human
gccagauccagccu

SEQ ID NO: 1285175 - RNA, 11 nt, Human
gccagauccag

SEQ ID NO: 1285176 - RNA, 16 nt, Human
gcccagcccuaaacau

SEQ ID NO: 1285177 - RNA, 21 nt, Human
gcccagcuugaaaccuucacu

SEQ ID NO: 1285178 - RNA, 19 nt, Human
gcccagcugggucaggcag

SEQ ID NO: 1285179 - RNA, 20 nt, Human
gcccagcugggucaggcagg

SEQ ID NO: 1285180 - RNA, 13 nt, Human
gcccagcuggguc

SEQ ID NO: 1285181 - RNA, 14 nt, Human
gcccagcuggguca

SEQ ID NO: 1285182 - RNA, 15 nt, Human
gcccagcugggucag

SEQ ID NO: 1285183 - RNA, 18 nt, Human
gcccagcugggucaggca

SEQ ID NO: 1285184 - RNA, 21 nt, Human
gcccagcggcuugccugccug

SEQ ID NO: 1285185 - RNA, 19 nt, Human
gcccagccgacccccucuc

SEQ ID NO: 1285186 - RNA, 13 nt, Human
gcccagccgaccc

SEQ ID NO: 1285187 - RNA, 23 nt, Human
gcccagccuuuguuccccacugg

SEQ ID NO: 1285188 - RNA, 17 nt, Human
gcccagccuuuguuccc

SEQ ID NO: 1285189 - RNA, 15 nt, Human
gcccaggcugggaac

SEQ ID NO: 1285190 - RNA, 16 nt, Human
gcccaggcugguuucg

SEQ ID NO: 1285191 - RNA, 13 nt, Human
gcccaggcuggga

SEQ ID NO: 1285192 - RNA, 14 nt, Human
gcccaaugaaauga

SEQ ID NO: 1285193 - RNA, 16 nt, Human
gcccagagacccagcg

SEQ ID NO: 1285194 - RNA, 14 nt, Human
gcccagagcccagc

SEQ ID NO: 1285195 - RNA, 15 nt, Human
gcccagagcccagcu

SEQ ID NO: 1285196 - RNA, 16 nt, Human
gcccagagcccagcuc

SEQ ID NO: 1285197 - RNA, 10 nt, Human
gcccagagac

SEQ ID NO: 1285198 - RNA, 20 nt, Human
gcccagagacauacuugaag

SEQ ID NO: 1285199 - RNA, 19 nt, Human
gcccagagacccaagcugc

SEQ ID NO: 1285200 - RNA, 23 nt, Human
gcccagagacauacuugaagggc

SEQ ID NO: 1285201 - RNA, 23 nt, Human
gcccagagacccagcggacacac

SEQ ID NO: 1285202 - RNA, 17 nt, Human
gcccagagcccagcucc

SEQ ID NO: 1285203 - RNA, 18 nt, Human
gcccagagcccagcucca

SEQ ID NO: 1285204 - RNA, 14 nt, Human
gcccagagggucug

SEQ ID NO: 1285205 - RNA, 15 nt, Human
gcccagagggucugg

SEQ ID NO: 1285206 - RNA, 19 nt, Human
gcccagagggucugggggc

SEQ ID NO: 1285207 - RNA, 18 nt, Human
gcccagagggucuggggg

SEQ ID NO: 1285208 - RNA, 19 nt, Human
gcccagcacaugugcugcc

SEQ ID NO: 1285209 - RNA, 20 nt, Human
gcccagcacugcuugaggaa

SEQ ID NO: 1285210 - RNA, 21 nt, Human
gcccagcacugcuugaggaaa

SEQ ID NO: 1285211 - RNA, 12 nt, Human
gcccagccagcg

SEQ ID NO: 1285212 - RNA, 13 nt, Human
gcccagccagcgu

SEQ ID NO: 1285213 - RNA, 14 nt, Human
gcccagccagcguc

SEQ ID NO: 1285214 - RNA, 22 nt, Human
gcccagccagcgucggucugug

SEQ ID NO: 1285215 - RNA, 16 nt, Human
gcccagcccauggaga

SEQ ID NO: 1285216 - RNA, 17 nt, Human
gcccagccccacuccuc

SEQ ID NO: 1285217 - RNA, 23 nt, Human
gcccagccccacuccucugcuga

SEQ ID NO: 1285218 - RNA, 18 nt, Human
gcccagccccacuccucu

SEQ ID NO: 1285219 - RNA, 15 nt, Human
gcaggucccuaauaa

SEQ ID NO: 1285220 - RNA, 14 nt, Human
gcaggucccuaaua

SEQ ID NO: 1285221 - RNA, 19 nt, Human
gcagggguuggggaaacag

SEQ ID NO: 1285222 - RNA, 18 nt, Human
gcagggcucuccuggcuu

SEQ ID NO: 1285223 - RNA, 19 nt, Human
gcaggccgugacgucuggg

SEQ ID NO: 1285224 - RNA, 20 nt, Human
gcaggccgugacgucugggu

SEQ ID NO: 1285225 - RNA, 13 nt, Human
gcagggauguggg

SEQ ID NO: 1285226 - RNA, 22 nt, Human
gcagggauguggguuccacaga

SEQ ID NO: 1285227 - RNA, 19 nt, Human
gcagggauuaaccucugca

SEQ ID NO: 1285228 - RNA, 22 nt, Human
gcagggauuaaccucugcacua

SEQ ID NO: 1285229 - RNA, 23 nt, Human
gcagggauguggguuccacagac

SEQ ID NO: 1285230 - RNA, 12 nt, Human
gcagggcucucc

SEQ ID NO: 1285231 - RNA, 14 nt, Human
gcagggcucuccug

SEQ ID NO: 1285232 - RNA, 15 nt, Human
gcagggcucuccugg

SEQ ID NO: 1285233 - RNA, 16 nt, Human
gcagggcucuccuggc

SEQ ID NO: 1285234 - RNA, 13 nt, Human
gcaggacugaugu

SEQ ID NO: 1285235 - RNA, 14 nt, Human
gcaggacugauguc

SEQ ID NO: 1285236 - RNA, 18 nt, Human
gcaggacugaugucuccu

SEQ ID NO: 1285237 - RNA, 19 nt, Human
gcaggacugaugucuccua

SEQ ID NO: 1285238 - RNA, 23 nt, Human
gcaggacugaugucuccuaagca

SEQ ID NO: 1285239 - RNA, 21 nt, Human
gcaggcaucggggagccggga

SEQ ID NO: 1285240 - RNA, 22 nt, Human
gcaggcaucggggagccgggag

SEQ ID NO: 1285241 - RNA, 15 nt, Human
gcaggcagggcucuc

SEQ ID NO: 1285242 - RNA, 16 nt, Human
gcaggcagggcucucc

SEQ ID NO: 1285243 - RNA, 19 nt, Human
gcaggcagggcucuccugg

SEQ ID NO: 1285244 - RNA, 20 nt, Human
gcaggcagggcucuccuggc

SEQ ID NO: 1285245 - RNA, 22 nt, Human
gcaggcagggcucuccuggcuu

SEQ ID NO: 1285246 - RNA, 18 nt, Human
gcaggcaggaacaaacag

SEQ ID NO: 1285247 - RNA, 22 nt, Human
gcaggcaggaacaaacagggcu

SEQ ID NO: 1285248 - RNA, 15 nt, Human
gcaggcaggcuccca

SEQ ID NO: 1285249 - RNA, 18 nt, Human
gcaggcaggcucccaggg

SEQ ID NO: 1285250 - RNA, 17 nt, Human
gcaggcaggcucccagg

SEQ ID NO: 1285251 - RNA, 12 nt, Human
gcaggcagggcu

SEQ ID NO: 1285252 - RNA, 13 nt, Human
gcaggcagggcuc

SEQ ID NO: 1285253 - RNA, 14 nt, Human
gcaggcagggcucu

SEQ ID NO: 1285254 - RNA, 23 nt, Human
gcaggcaucggggagccgggagc

SEQ ID NO: 1285255 - RNA, 20 nt, Human
gcaggccaagucaggcccuu

SEQ ID NO: 1285256 - RNA, 20 nt, Human
gcaggccacacuucaaacua

SEQ ID NO: 1285257 - RNA, 21 nt, Human
gcaggccacacuucaaacuac

SEQ ID NO: 1285258 - RNA, 23 nt, Human
gcaggccacacuucaaacuacuu

SEQ ID NO: 1285259 - RNA, 17 nt, Human
gcaggccaccuggcucu

SEQ ID NO: 1285260 - RNA, 18 nt, Human
gcaggccaccuggcucuc

SEQ ID NO: 1285261 - RNA, 21 nt, Human
gcaggccaccuggcucucacc

SEQ ID NO: 1285262 - RNA, 22 nt, Human
gcaggccaccuggcucucaccu

SEQ ID NO: 1285263 - RNA, 22 nt, Human
gcaggccagcugugguuuucuu

SEQ ID NO: 1285264 - RNA, 12 nt, Human
gcaggcccuggc

SEQ ID NO: 1285265 - RNA, 14 nt, Human
gcaggcccuggccu

SEQ ID NO: 1285266 - RNA, 15 nt, Human
gcaggcccuggccuc

SEQ ID NO: 1285267 - RNA, 16 nt, Human
gcaggcccuggccucc

SEQ ID NO: 1285268 - RNA, 19 nt, Human
gcaggucccuaauaaagcu

SEQ ID NO: 1285269 - RNA, 18 nt, Human
gcaggucccuaauaaagc

SEQ ID NO: 1285270 - RNA, 17 nt, Human
gcaggucccuaauaaag

SEQ ID NO: 1285271 - RNA, 16 nt, Human
gcaggucccuaauaaa

SEQ ID NO: 1285272 - RNA, 21 nt, Human
gcaggucccuaauaaagcugu

SEQ ID NO: 1285273 - RNA, 20 nt, Human
gcaggucccuaauaaagcug

SEQ ID NO: 1285274 - RNA, 23 nt, Human
gcaggucccuaauaaagcugugu

SEQ ID NO: 1285275 - RNA, 21 nt, Human
gcaggguccucuucugggccu

SEQ ID NO: 1285276 - RNA, 17 nt, Human
gcagugggaaaaaugua

SEQ ID NO: 1285277 - RNA, 19 nt, Human
gcagugggaaaaauguagg

SEQ ID NO: 1285278 - RNA, 21 nt, Human
gcagugggacagggcauggcc

SEQ ID NO: 1285279 - RNA, 20 nt, Human
gcaguggcugguccagggcu

SEQ ID NO: 1285280 - RNA, 17 nt, Human
gcagggucuagaaggcu

SEQ ID NO: 1285281 - RNA, 14 nt, Human
gcagugggaaaaau

SEQ ID NO: 1285282 - RNA, 14 nt, Human
gcaguggcuggucc

SEQ ID NO: 1285283 - RNA, 15 nt, Human
gcaguggcuggucca

SEQ ID NO: 1285284 - RNA, 18 nt, Human
gcaguggcugguccaggg

SEQ ID NO: 1285285 - RNA, 19 nt, Human
gcaguggcugguccagggc

SEQ ID NO: 1285286 - RNA, 19 nt, Human
gcaguucccacauuaaaga

SEQ ID NO: 1285287 - RNA, 21 nt, Human
gcaguucccacauuaaagaag

SEQ ID NO: 1285288 - RNA, 22 nt, Human
gcaguucccacauuaaagaaga

SEQ ID NO: 1285289 - RNA, 15 nt, Human
gcaucaucucagcuc

SEQ ID NO: 1285290 - RNA, 23 nt, Human
gcaucagugcccuccaggauaga

SEQ ID NO: 1285291 - RNA, 12 nt, Human
gcaucaugccuc

SEQ ID NO: 1285292 - RNA, 13 nt, Human
gcaucaugccucu

SEQ ID NO: 1285293 - RNA, 14 nt, Human
gcaucaugccucug

SEQ ID NO: 1285294 - RNA, 15 nt, Human
gcaucaugccucuga

SEQ ID NO: 1285295 - RNA, 16 nt, Human
gcaucaugccucugag

SEQ ID NO: 1285296 - RNA, 17 nt, Human
gcaucaugccucugagg

SEQ ID NO: 1285297 - RNA, 18 nt, Human
gcaucaugccucugaggc

SEQ ID NO: 1285298 - RNA, 20 nt, Human
gcaucaugccucugaggcca

SEQ ID NO: 1285299 - RNA, 21 nt, Human
gcaucaugccucugaggccag

SEQ ID NO: 1285300 - RNA, 13 nt, Human
gcaucauggcuau

SEQ ID NO: 1285301 - RNA, 17 nt, Human
gcaucauuauuuaugua

SEQ ID NO: 1285302 - RNA, 19 nt, Human
gcaucauuauuuauguauu

SEQ ID NO: 1285303 - RNA, 20 nt, Human
gcaucauuauuuauguauug

SEQ ID NO: 1285304 - RNA, 12 nt, Human
gcaucucagccc

SEQ ID NO: 1285305 - RNA, 20 nt, Human
gcaucuaguuccccuguuua

SEQ ID NO: 1285306 - RNA, 13 nt, Human
gcaucucagccca

SEQ ID NO: 1285307 - RNA, 14 nt, Human
gcaucucagcccac

SEQ ID NO: 1285308 - RNA, 22 nt, Human
gcaucuaguuccccuguuuauu

SEQ ID NO: 1285309 - RNA, 15 nt, Human
gcaucagugcccucc

SEQ ID NO: 1285310 - RNA, 19 nt, Human
gcaucaggccuagaggccu

SEQ ID NO: 1285311 - RNA, 12 nt, Human
gcaucaggguua

SEQ ID NO: 1285312 - RNA, 22 nt, Human
gcaucugggccuuggccuggag

SEQ ID NO: 1285313 - RNA, 21 nt, Human
gcaucugggccuuggccugga

SEQ ID NO: 1285314 - RNA, 16 nt, Human
gcaucugucccccuuu

SEQ ID NO: 1285315 - RNA, 15 nt, Human
gcaucucagcccaca

SEQ ID NO: 1285316 - RNA, 22 nt, Human
gcaucucagcucaucuucacug

SEQ ID NO: 1285317 - RNA, 17 nt, Human
gcaucucaguaugaauu

SEQ ID NO: 1285318 - RNA, 14 nt, Human
gcaucucagcucau

SEQ ID NO: 1285319 - RNA, 17 nt, Human
gcaucuccaagcagcuu

SEQ ID NO: 1285320 - RNA, 19 nt, Human
gcaucuccaagcagcuuag

SEQ ID NO: 1285321 - RNA, 20 nt, Human
gcaucuccaagcagcuuaga

SEQ ID NO: 1285322 - RNA, 12 nt, Human
gcaucucccaga

SEQ ID NO: 1285323 - RNA, 13 nt, Human
gcaucucccagau

SEQ ID NO: 1285324 - RNA, 21 nt, Human
gcaucucccagauaaugugaa

SEQ ID NO: 1285325 - RNA, 18 nt, Human
gcaucucuaccuucuccc

SEQ ID NO: 1285326 - RNA, 22 nt, Human
gcaucucuaccuucuccccagc

SEQ ID NO: 1285327 - RNA, 13 nt, Human
gcaucucugggcu

SEQ ID NO: 1285328 - RNA, 14 nt, Human
gcaucucugggcug

SEQ ID NO: 1285329 - RNA, 16 nt, Human
gcaucucugggcugga

SEQ ID NO: 1285330 - RNA, 20 nt, Human
gcaucucugggcuggaugag

SEQ ID NO: 1285331 - RNA, 23 nt, Human
gcaucucugggcuggaugagcuc

SEQ ID NO: 1285332 - RNA, 15 nt, Human
gcaucuggagagaac

SEQ ID NO: 1285333 - RNA, 16 nt, Human
gcaucuggagagaaca

SEQ ID NO: 1285334 - RNA, 15 nt, Human
gcaucuggccuggcc

SEQ ID NO: 1285335 - RNA, 16 nt, Human
gcaucuggccuggcca

SEQ ID NO: 1285336 - RNA, 17 nt, Human
gcaucuggccuggccag

SEQ ID NO: 1285337 - RNA, 18 nt, Human
gcaucuggccuggccagu

SEQ ID NO: 1285338 - RNA, 19 nt, Human
gcaucuggccuggccagug

SEQ ID NO: 1285339 - RNA, 12 nt, Human
gcaucugggccu

SEQ ID NO: 1285340 - RNA, 14 nt, Human
gcaucugggccuug

SEQ ID NO: 1285341 - RNA, 12 nt, Human
gcaucucacucc

SEQ ID NO: 1285342 - RNA, 13 nt, Human
gcauuaugcaauu

SEQ ID NO: 1285343 - RNA, 18 nt, Human
gcauuaugcaauuuuuau

SEQ ID NO: 1285344 - RNA, 19 nt, Human
gcauuaugcaauuuuuaua

SEQ ID NO: 1285345 - RNA, 20 nt, Human
gcauuaugcaauuuuuauau

SEQ ID NO: 1285346 - RNA, 14 nt, Human
gcauuaaauuacag

SEQ ID NO: 1285347 - RNA, 22 nt, Human
gcauuaaauucacaaacuuuua

SEQ ID NO: 1285348 - RNA, 18 nt, Human
gcauuaaauucacaaacu

SEQ ID NO: 1285349 - RNA, 23 nt, Human
gcauuaaauuuuagcaaagauau

SEQ ID NO: 1285350 - RNA, 15 nt, Human
gcauuaaauuacaga

SEQ ID NO: 1285351 - RNA, 21 nt, Human
gcauugaacacaaacuguaaa

SEQ ID NO: 1285352 - RNA, 22 nt, Human
gcauugaacacaaacuguaaau

SEQ ID NO: 1285353 - RNA, 23 nt, Human
gcauugaacacaaacuguaaaua

SEQ ID NO: 1285354 - RNA, 21 nt, Human
gcauugaauggcuauguuuuu

SEQ ID NO: 1285355 - RNA, 16 nt, Human
gcauugacuuucccca

SEQ ID NO: 1285356 - RNA, 16 nt, Human
gcauugagcuugcaug

SEQ ID NO: 1285357 - RNA, 22 nt, Human
gcauugaccgcgacuaauuuca

SEQ ID NO: 1285358 - RNA, 23 nt, Human
gcauugaccgcgacuaauuucaa

SEQ ID NO: 1285359 - RNA, 12 nt, Human
gcauugacuuuc

SEQ ID NO: 1285360 - RNA, 19 nt, Human
gcauugaauggcuauguuu

SEQ ID NO: 1285361 - RNA, 15 nt, Human
gcauugacuuucccc

SEQ ID NO: 1285362 - RNA, 17 nt, Human
gcauugacuuuccccac

SEQ ID NO: 1285363 - RNA, 15 nt, Human
gcacagccucuuaga

SEQ ID NO: 1285364 - RNA, 18 nt, Human
gcacagcaucucagcuca

SEQ ID NO: 1285365 - RNA, 13 nt, Human
gcacagcaucuca

SEQ ID NO: 1285366 - RNA, 22 nt, Human
gcacagccaacacgcaccugcc

SEQ ID NO: 1285367 - RNA, 17 nt, Human
gcacagccaaauuuaaa

SEQ ID NO: 1285368 - RNA, 15 nt, Human
gcacagcagccuggg

SEQ ID NO: 1285369 - RNA, 17 nt, Human
gauugugucccauuccc

SEQ ID NO: 1285370 - RNA, 18 nt, Human
gauugugucccauucccc

SEQ ID NO: 1285371 - RNA, 19 nt, Human
gauugugucccauuccccc

SEQ ID NO: 1285372 - RNA, 20 nt, Human
gauugugucccauuccccca

SEQ ID NO: 1285373 - RNA, 23 nt, Human
gcacagauggauuuguuuggacc

SEQ ID NO: 1285374 - RNA, 14 nt, Human
gcacagauggccag

SEQ ID NO: 1285375 - RNA, 19 nt, Human
gcacagauggccagccccu

SEQ ID NO: 1285376 - RNA, 23 nt, Human
gcacagauggccagccccuuaga

SEQ ID NO: 1285377 - RNA, 22 nt, Human
gcacagcacaaauuaguuauau

SEQ ID NO: 1285378 - RNA, 22 nt, Human
gcacagcagccuggggcuggcc

SEQ ID NO: 1285379 - RNA, 18 nt, Human
gcacagccucuuagaugc

SEQ ID NO: 1285380 - RNA, 11 nt, Human
gcacagcccuu

SEQ ID NO: 1285381 - RNA, 14 nt, Human
gcacagcuugaccu

SEQ ID NO: 1285382 - RNA, 16 nt, Human
gcacagggcaguggga

SEQ ID NO: 1285383 - RNA, 22 nt, Human
gcacagggagugcacauaucca

SEQ ID NO: 1285384 - RNA, 18 nt, Human
gcacagcuugaccugagg

SEQ ID NO: 1285385 - RNA, 19 nt, Human
gcacagcuugaccugaggc

SEQ ID NO: 1285386 - RNA, 20 nt, Human
gcacagcuugaccugaggcu

SEQ ID NO: 1285387 - RNA, 21 nt, Human
gcacagcuugaccugaggcug

SEQ ID NO: 1285388 - RNA, 22 nt, Human
gcacagcuugaccugaggcugu

SEQ ID NO: 1285389 - RNA, 14 nt, Human
gcacaggacaugcg

SEQ ID NO: 1285390 - RNA, 17 nt, Human
gcacagggagugcacau

SEQ ID NO: 1285391 - RNA, 21 nt, Human
gcaccagacacccaggacuua

SEQ ID NO: 1285392 - RNA, 20 nt, Human
gcaccaucucugauuuucaa

SEQ ID NO: 1285393 - RNA, 13 nt, Human
gcacccccugcag

SEQ ID NO: 1285394 - RNA, 14 nt, Human
gcacccccugcagc

SEQ ID NO: 1285395 - RNA, 15 nt, Human
gcacccccugcagcu

SEQ ID NO: 1285396 - RNA, 24 nt, Human
gcacccccugcagcuuguagccag

SEQ ID NO: 1285397 - RNA, 19 nt, Human
gcacccccugcagcuugua

SEQ ID NO: 1285398 - RNA, 22 nt, Human
gcaccaagugcggguccggcag

SEQ ID NO: 1285399 - RNA, 13 nt, Human
gcaccaccaagcc

SEQ ID NO: 1285400 - RNA, 15 nt, Human
gcaccaagcaggaaa

SEQ ID NO: 1285401 - RNA, 14 nt, Human
gcaccaccaagcca

SEQ ID NO: 1285402 - RNA, 17 nt, Human
gcaccaccaagccaagg

SEQ ID NO: 1285403 - RNA, 15 nt, Human
gcaccagacacccag

SEQ ID NO: 1285404 - RNA, 16 nt, Human
gcaccagacacccagg

SEQ ID NO: 1285405 - RNA, 17 nt, Human
gcaccagacacccagga

SEQ ID NO: 1285406 - RNA, 18 nt, Human
gcaccagacacccaggac

SEQ ID NO: 1285407 - RNA, 19 nt, Human
gcaccagacacccaggacu

SEQ ID NO: 1285408 - RNA, 20 nt, Human
gcaccagacacccaggacuu

SEQ ID NO: 1285409 - RNA, 12 nt, Human
gcacagggucug

SEQ ID NO: 1285410 - RNA, 17 nt, Human
gcacagggucugcucuu

SEQ ID NO: 1285411 - RNA, 18 nt, Human
gcacagggucugcucuuu

SEQ ID NO: 1285412 - RNA, 23 nt, Human
gcacagggucugcucuuucucug

SEQ ID NO: 1285413 - RNA, 20 nt, Human
gcaccaaaucaaaaucucuc

SEQ ID NO: 1285414 - RNA, 21 nt, Human
gcaccaaaucaaaaucucucc

SEQ ID NO: 1285415 - RNA, 22 nt, Human
gcaccaaaucaaaaucucucca

SEQ ID NO: 1285416 - RNA, 23 nt, Human
gcaccaaaucaaaaucucuccac

SEQ ID NO: 1285417 - RNA, 16 nt, Human
gcacuggcgaggagag

SEQ ID NO: 1285418 - RNA, 15 nt, Human
gcacuggcgaggaga

SEQ ID NO: 1285419 - RNA, 15 nt, Human
gcacuggccccaccc

SEQ ID NO: 1285420 - RNA, 18 nt, Human
gcacugggaggcuccccu

SEQ ID NO: 1285421 - RNA, 20 nt, Human
gcacugggaggcuccccuuc

SEQ ID NO: 1285422 - RNA, 13 nt, Human
gcacugggcauga

SEQ ID NO: 1285423 - RNA, 15 nt, Human
gcacugggcuccgga

SEQ ID NO: 1285424 - RNA, 22 nt, Human
gcacuguuuucuaguguaucaa

SEQ ID NO: 1285425 - RNA, 21 nt, Human
gcacuguuuucuaguguauca

SEQ ID NO: 1285426 - RNA, 20 nt, Human
gcacuguuuucuaguguauc

SEQ ID NO: 1285427 - RNA, 19 nt, Human
gcacuguuuucuaguguau

SEQ ID NO: 1285428 - RNA, 20 nt, Human
gcacuguucccccugugcag

SEQ ID NO: 1285429 - RNA, 15 nt, Human
gcacuguucccccug

SEQ ID NO: 1285430 - RNA, 18 nt, Human
gcacuguucccccugugc

SEQ ID NO: 1285431 - RNA, 19 nt, Human
gcacuguucccccugugca

SEQ ID NO: 1285432 - RNA, 12 nt, Human
gcacuacauuca

SEQ ID NO: 1285433 - RNA, 16 nt, Human
gcacuacauucauuua

SEQ ID NO: 1285434 - RNA, 17 nt, Human
gcacccucauacacaga

SEQ ID NO: 1285435 - RNA, 20 nt, Human
gcacccucauacacagaaac

SEQ ID NO: 1285436 - RNA, 20 nt, Human
gcacgcggagugaguuuuuu

SEQ ID NO: 1285437 - RNA, 15 nt, Human
gcacgcgugugcagg

SEQ ID NO: 1285438 - RNA, 18 nt, Human
gcacgugguaaaacacuu

SEQ ID NO: 1285439 - RNA, 14 nt, Human
gcacguguguuuuu

SEQ ID NO: 1285440 - RNA, 16 nt, Human
gcacguguguuuuucu

SEQ ID NO: 1285441 - RNA, 18 nt, Human
gcacguguguuuuucuau

SEQ ID NO: 1285442 - RNA, 23 nt, Human
gcacguguguuuuucuauuaaaa

SEQ ID NO: 1285443 - RNA, 19 nt, Human
gcacguguguuuuucuauu

SEQ ID NO: 1285444 - RNA, 18 nt, Human
gcagauguccuugaugcu

SEQ ID NO: 1285445 - RNA, 15 nt, Human
gcagauguaggaggg

SEQ ID NO: 1285446 - RNA, 16 nt, Human
gcagauguaggaggga

SEQ ID NO: 1285447 - RNA, 17 nt, Human
gcagauguaggagggac

SEQ ID NO: 1285448 - RNA, 19 nt, Human
gcagauguaggagggacug

SEQ ID NO: 1285449 - RNA, 13 nt, Human
gcagauguaggag

SEQ ID NO: 1285450 - RNA, 14 nt, Human
gcagauguaggagg

SEQ ID NO: 1285451 - RNA, 23 nt, Human
gcagagguugcagugagccgaga

SEQ ID NO: 1285452 - RNA, 15 nt, Human
gcagauccaggacua

SEQ ID NO: 1285453 - RNA, 18 nt, Human
gcagagguugcagugagc

SEQ ID NO: 1285454 - RNA, 21 nt, Human
gcagagguccacaacacacag

SEQ ID NO: 1285455 - RNA, 23 nt, Human
gcacuguuuucuaguguaucaaa

SEQ ID NO: 1285456 - RNA, 23 nt, Human
gcacuucuuuuucucgcuguccu

SEQ ID NO: 1285457 - RNA, 13 nt, Human
gcagaggggcaga

SEQ ID NO: 1285458 - RNA, 15 nt, Human
gcagaggggcagagg

SEQ ID NO: 1285459 - RNA, 14 nt, Human
gcagaggggcagag

SEQ ID NO: 1285460 - RNA, 20 nt, Human
gcagacucuuuaugcuugca

SEQ ID NO: 1285461 - RNA, 11 nt, Human
gcagacuggcg

SEQ ID NO: 1285462 - RNA, 15 nt, Human
gcagacuucccagcu

SEQ ID NO: 1285463 - RNA, 16 nt, Human
gcagacuucccagcua

SEQ ID NO: 1285464 - RNA, 18 nt, Human
gcagacuucccagcuagg

SEQ ID NO: 1285465 - RNA, 24 nt, Human
gcagcccugcuuugggcugcccug

SEQ ID NO: 1285466 - RNA, 21 nt, Human
gcagcaggaggggggagggaa

SEQ ID NO: 1285467 - RNA, 11 nt, Human
gcagcagccag

SEQ ID NO: 1285468 - RNA, 12 nt, Human
gcagcagccagc

SEQ ID NO: 1285469 - RNA, 13 nt, Human
gcagcagccagcc

SEQ ID NO: 1285470 - RNA, 14 nt, Human
gcagcagccagccc

SEQ ID NO: 1285471 - RNA, 15 nt, Human
gcagcagccagcccu

SEQ ID NO: 1285472 - RNA, 16 nt, Human
gcagcagccagcccug

SEQ ID NO: 1285473 - RNA, 17 nt, Human
gcagcagccagcccugc

SEQ ID NO: 1285474 - RNA, 18 nt, Human
gcagcagccagcccugcc

SEQ ID NO: 1285475 - RNA, 19 nt, Human
gcagcagccagcccugccu

SEQ ID NO: 1285476 - RNA, 20 nt, Human
gcagcagccagcccugccug

SEQ ID NO: 1285477 - RNA, 21 nt, Human
gcagcagccagcccugccugg

SEQ ID NO: 1285478 - RNA, 23 nt, Human
gcagcagccagcccugccuggag

SEQ ID NO: 1285479 - RNA, 22 nt, Human
gcagcagccagcccugccugga

SEQ ID NO: 1285480 - RNA, 22 nt, Human
gcagcagcccccagcucccacc

SEQ ID NO: 1285481 - RNA, 13 nt, Human
gcagcagccccca

SEQ ID NO: 1285482 - RNA, 20 nt, Human
gcagcagccucgccccuggc

SEQ ID NO: 1285483 - RNA, 23 nt, Human
gcagcagccucgccccuggcaga

SEQ ID NO: 1285484 - RNA, 22 nt, Human
gcagcagccucgccccuggcag

SEQ ID NO: 1285485 - RNA, 13 nt, Human
gcagcaggagggg

SEQ ID NO: 1285486 - RNA, 14 nt, Human
gcagcaggaggggg

SEQ ID NO: 1285487 - RNA, 15 nt, Human
gcagcaggagggggg

SEQ ID NO: 1285488 - RNA, 19 nt, Human
gcagcaggaggggggaggg

SEQ ID NO: 1285489 - RNA, 14 nt, Human
gcagccgugccuuc

SEQ ID NO: 1285490 - RNA, 14 nt, Human
gcagcccuuccaaa

SEQ ID NO: 1285491 - RNA, 16 nt, Human
gcagccgcugagcgag

SEQ ID NO: 1285492 - RNA, 17 nt, Human
gcagccgcugagcgagg

SEQ ID NO: 1285493 - RNA, 18 nt, Human
gcagccggcacagggucu

SEQ ID NO: 1285494 - RNA, 19 nt, Human
gcagccggcacagggucug

SEQ ID NO: 1285495 - RNA, 15 nt, Human
gcagccucagagaca

SEQ ID NO: 1285496 - RNA, 23 nt, Human
gcagccucagagacaucagcccu

SEQ ID NO: 1285497 - RNA, 13 nt, Human
gcagccucaggac

SEQ ID NO: 1285498 - RNA, 15 nt, Human
gcagccucaggacug

SEQ ID NO: 1285499 - RNA, 19 nt, Human
gcagccucaggacugggag

SEQ ID NO: 1285500 - RNA, 21 nt, Human
gcagccucaggacugggagcc

SEQ ID NO: 1285501 - RNA, 18 nt, Human
gcagccucccauccaggg

SEQ ID NO: 1285502 - RNA, 20 nt, Human
gcagccucccauccagggcc

SEQ ID NO: 1285503 - RNA, 21 nt, Human
gcagccucccauccagggccc

SEQ ID NO: 1285504 - RNA, 20 nt, Human
gcagccucuccccaggucca

SEQ ID NO: 1285505 - RNA, 20 nt, Human
gcagccucgccccuggcaga

SEQ ID NO: 1285506 - RNA, 14 nt, Human
gcagccucuggggg

SEQ ID NO: 1285507 - RNA, 15 nt, Human
gcagccucugggggg

SEQ ID NO: 1285508 - RNA, 22 nt, Human
gcagccucugggggguggccag

SEQ ID NO: 1285509 - RNA, 16 nt, Human
gcagccucgccccugg

SEQ ID NO: 1285510 - RNA, 19 nt, Human
gcagccucgccccuggcag

SEQ ID NO: 1285511 - RNA, 21 nt, Human
gcagccucgccccuggcagag

SEQ ID NO: 1285512 - RNA, 12 nt, Human
gcagccucuccc

SEQ ID NO: 1285513 - RNA, 16 nt, Human
gcagccucuccccagg

SEQ ID NO: 1285514 - RNA, 23 nt, Human
gcagccucugggggguggccagg

SEQ ID NO: 1285515 - RNA, 16 nt, Human
gcaggaacaaacaggg

SEQ ID NO: 1285516 - RNA, 18 nt, Human
gcaggaacaaacagggcu

SEQ ID NO: 1285517 - RNA, 23 nt, Human
gcaggaaggacuaugaaaagcua

SEQ ID NO: 1285518 - RNA, 21 nt, Human
gcaggaccuucgggcugugcc

SEQ ID NO: 1285519 - RNA, 13 nt, Human
gcaggacuccagg

SEQ ID NO: 1285520 - RNA, 14 nt, Human
gcaggacuccaggc

SEQ ID NO: 1285521 - RNA, 17 nt, Human
gcaggacuccaggccca

SEQ ID NO: 1285522 - RNA, 18 nt, Human
gcaggacuccaggcccaa

SEQ ID NO: 1285523 - RNA, 22 nt, Human
gcaggacuccaggcccaaggcu

SEQ ID NO: 1285524 - RNA, 23 nt, Human
gcaggacuccaggcccaaggcuc

SEQ ID NO: 1285525 - RNA, 21 nt, Human
gauuaacagguaugaaccacc

SEQ ID NO: 1285526 - RNA, 14 nt, Human
gauuaaccucugca

SEQ ID NO: 1285527 - RNA, 17 nt, Human
gauuaaccucugcacua

SEQ ID NO: 1285528 - RNA, 21 nt, Human
gauuaaaugacacucauauaa

SEQ ID NO: 1285529 - RNA, 19 nt, Human
gauguugaaaaaguucugc

SEQ ID NO: 1285530 - RNA, 22 nt, Human
gauguuaaaaaaauaagaagaa

SEQ ID NO: 1285531 - RNA, 18 nt, Human
gauguguuugcuuucuga

SEQ ID NO: 1285532 - RNA, 16 nt, Human
gauggggaccagcagc

SEQ ID NO: 1285533 - RNA, 14 nt, Human
gaugguggagggcc

SEQ ID NO: 1285534 - RNA, 19 nt, Human
gaugugcuuguuaacugag

SEQ ID NO: 1285535 - RNA, 15 nt, Human
gaugguggagggcca

SEQ ID NO: 1285536 - RNA, 21 nt, Human
gauggugucucuucuuuagaa

SEQ ID NO: 1285537 - RNA, 15 nt, Human
gaugggcuucccaag

SEQ ID NO: 1285538 - RNA, 13 nt, Human
gaugggcuuccca

SEQ ID NO: 1285539 - RNA, 20 nt, Human
gaugggcaugguguucuccu

SEQ ID NO: 1285540 - RNA, 22 nt, Human
gaugggcaugguguucuccugc

SEQ ID NO: 1285541 - RNA, 14 nt, Human
gauguguuugcuuu

SEQ ID NO: 1285542 - RNA, 16 nt, Human
gauguguuugcuuucu

SEQ ID NO: 1285543 - RNA, 18 nt, Human
gauguguccugacacugc

SEQ ID NO: 1285544 - RNA, 19 nt, Human
gauguguccugacacugca

SEQ ID NO: 1285545 - RNA, 12 nt, Human
gauguguguuga

SEQ ID NO: 1285546 - RNA, 14 nt, Human
gauguguguugaua

SEQ ID NO: 1285547 - RNA, 17 nt, Human
gauguguguugauacug

SEQ ID NO: 1285548 - RNA, 20 nt, Human
gauguguguugauacuguug

SEQ ID NO: 1285549 - RNA, 21 nt, Human
gauguguguugauacuguugc

SEQ ID NO: 1285550 - RNA, 22 nt, Human
gauguguguugauacuguugca

SEQ ID NO: 1285551 - RNA, 23 nt, Human
gauguguguugauacuguugcac

SEQ ID NO: 1285552 - RNA, 20 nt, Human
gaugugcuuguuaacugagu

SEQ ID NO: 1285553 - RNA, 14 nt, Human
gaugugcuuaacag

SEQ ID NO: 1285554 - RNA, 13 nt, Human
gaugugcuuaaca

SEQ ID NO: 1285555 - RNA, 18 nt, Human
gauguggaacugcugcca

SEQ ID NO: 1285556 - RNA, 21 nt, Human
gauguggaacugcugccacug

SEQ ID NO: 1285557 - RNA, 19 nt, Human
gauguggaacugcugccac

SEQ ID NO: 1285558 - RNA, 11 nt, Human
gauguguccug

SEQ ID NO: 1285559 - RNA, 13 nt, Human
gauguguccugac

SEQ ID NO: 1285560 - RNA, 17 nt, Human
gauguguccugacacug

SEQ ID NO: 1285561 - RNA, 24 nt, Human
gauugaccguguuggucuguacug

SEQ ID NO: 1285562 - RNA, 15 nt, Human
gauuggacaaaauga

SEQ ID NO: 1285563 - RNA, 14 nt, Human
gauuggacaaaaug

SEQ ID NO: 1285564 - RNA, 18 nt, Human
gauucuagaucagaugcu

SEQ ID NO: 1285565 - RNA, 19 nt, Human
gauucuagaucagaugcuc

SEQ ID NO: 1285566 - RNA, 21 nt, Human
gauucuagaucagaugcucca

SEQ ID NO: 1285567 - RNA, 23 nt, Human
gauucuagaucagaugcuccaag

SEQ ID NO: 1285568 - RNA, 15 nt, Human
gauucuauaguucua

SEQ ID NO: 1285569 - RNA, 17 nt, Human
gauucuauaguucuaga

SEQ ID NO: 1285570 - RNA, 18 nt, Human
gauucuauaguucuagac

SEQ ID NO: 1285571 - RNA, 19 nt, Human
gauucuauaguucuagaca

SEQ ID NO: 1285572 - RNA, 18 nt, Human
gauugaaaauguccagga

SEQ ID NO: 1285573 - RNA, 19 nt, Human
gauugaaaauguccaggaa

SEQ ID NO: 1285574 - RNA, 20 nt, Human
gauugaaaauguccaggaaa

SEQ ID NO: 1285575 - RNA, 21 nt, Human
gauugaaguauuuugcuggaa

SEQ ID NO: 1285576 - RNA, 23 nt, Human
gauugaaguauuuugcuggaaua

SEQ ID NO: 1285577 - RNA, 23 nt, Human
gauuguaauauguaaaugguaug

SEQ ID NO: 1285578 - RNA, 11 nt, Human
gauuguaacuc

SEQ ID NO: 1285579 - RNA, 10 nt, Human
gauuguauug

SEQ ID NO: 1285580 - RNA, 20 nt, Human
gauuguauuguugaaaaagu

SEQ ID NO: 1285581 - RNA, 15 nt, Human
gauuguauuguugaa

SEQ ID NO: 1285582 - RNA, 16 nt, Human
gauuguccuuuugcaa

SEQ ID NO: 1285583 - RNA, 13 nt, Human
gauugugccccug

SEQ ID NO: 1285584 - RNA, 17 nt, Human
gauuguccuuuugcaaa

SEQ ID NO: 1285585 - RNA, 18 nt, Human
gauuguccuuuugcaaag

SEQ ID NO: 1285586 - RNA, 15 nt, Human
gauugucuuaauauu

SEQ ID NO: 1285587 - RNA, 21 nt, Human
gauucagaaaauguucuguuu

SEQ ID NO: 1285588 - RNA, 18 nt, Human
gauucagaaaugaggcca

SEQ ID NO: 1285589 - RNA, 23 nt, Human
gauucagaaaauguucuguuugc

SEQ ID NO: 1285590 - RNA, 13 nt, Human
gauucaaagguuc

SEQ ID NO: 1285591 - RNA, 15 nt, Human
gauucaaagguucua

SEQ ID NO: 1285592 - RNA, 18 nt, Human
gauucaaagguucuaggu

SEQ ID NO: 1285593 - RNA, 19 nt, Human
gauucaaagguucuagguu

SEQ ID NO: 1285594 - RNA, 14 nt, Human
gauucaaucuguaa

SEQ ID NO: 1285595 - RNA, 16 nt, Human
gauucaaucuguaaac

SEQ ID NO: 1285596 - RNA, 18 nt, Human
gauucaaucuguaaacug

SEQ ID NO: 1285597 - RNA, 19 nt, Human
gauucaaucuguaaacugu

SEQ ID NO: 1285598 - RNA, 16 nt, Human
gauucacaucucauuu

SEQ ID NO: 1285599 - RNA, 15 nt, Human
gauucacaucucauu

SEQ ID NO: 1285600 - RNA, 16 nt, Human
gauucccacauuuguc

SEQ ID NO: 1285601 - RNA, 13 nt, Human
gauucccagagca

SEQ ID NO: 1285602 - RNA, 19 nt, Human
gauucccagagcaaaauaa

SEQ ID NO: 1285603 - RNA, 17 nt, Human
gauuccccaucucaggc

SEQ ID NO: 1285604 - RNA, 20 nt, Human
gauuccccaucucaggccag

SEQ ID NO: 1285605 - RNA, 14 nt, Human
gauucccucuccca

SEQ ID NO: 1285606 - RNA, 17 nt, Human
gauucccucucccaggc

SEQ ID NO: 1285607 - RNA, 18 nt, Human
gauucccucucccaggcc

SEQ ID NO: 1285608 - RNA, 20 nt, Human
gauucccucucccaggcccc

SEQ ID NO: 1285609 - RNA, 19 nt, Human
gauucccucucccaggccc

SEQ ID NO: 1285610 - RNA, 16 nt, Human
gauuccgcagugagag

SEQ ID NO: 1285611 - RNA, 15 nt, Human
gauuccggauccuaa

SEQ ID NO: 1285612 - RNA, 22 nt, Human
gauuccggauccuaagcaucua

SEQ ID NO: 1285613 - RNA, 18 nt, Human
gauuccggauccuaagca

SEQ ID NO: 1285614 - RNA, 15 nt, Human
gauuccugagccagu

SEQ ID NO: 1285615 - RNA, 18 nt, Human
gauuccuuagacucuuuu

SEQ ID NO: 1285616 - RNA, 16 nt, Human
gauucuaaagauucua

SEQ ID NO: 1285617 - RNA, 17 nt, Human
gauucuaaagauucuau

SEQ ID NO: 1285618 - RNA, 20 nt, Human
gauucuaaagauucuauagu

SEQ ID NO: 1285619 - RNA, 15 nt, Human
gauucuaaaggucca

SEQ ID NO: 1285620 - RNA, 15 nt, Human
gauucuaaugaugau

SEQ ID NO: 1285621 - RNA, 14 nt, Human
gaugacuauggaaa

SEQ ID NO: 1285622 - RNA, 14 nt, Human
gaugaaaauaaaga

SEQ ID NO: 1285623 - RNA, 15 nt, Human
gaugaaaauaaagaa

SEQ ID NO: 1285624 - RNA, 18 nt, Human
gaugaaaauaaagaaugg

SEQ ID NO: 1285625 - RNA, 16 nt, Human
gaugaaaauaaagaau

SEQ ID NO: 1285626 - RNA, 12 nt, Human
gaugacuaaaau

SEQ ID NO: 1285627 - RNA, 15 nt, Human
gaugacuaaaauauu

SEQ ID NO: 1285628 - RNA, 18 nt, Human
gaugacuaaaauauuuau

SEQ ID NO: 1285629 - RNA, 13 nt, Human
gaugcaaugaaca

SEQ ID NO: 1285630 - RNA, 20 nt, Human
gaugcaucagaaagggaggg

SEQ ID NO: 1285631 - RNA, 18 nt, Human
gaugacuuaguacaaagu

SEQ ID NO: 1285632 - RNA, 21 nt, Human
gaugccuggcgggguggggug

SEQ ID NO: 1285633 - RNA, 16 nt, Human
gaugccuccuuccucu

SEQ ID NO: 1285634 - RNA, 15 nt, Human
gaugccuccuuccuc

SEQ ID NO: 1285635 - RNA, 16 nt, Human
gaugcuccaagauucu

SEQ ID NO: 1285636 - RNA, 17 nt, Human
gaugcuccaagauucua

SEQ ID NO: 1285637 - RNA, 19 nt, Human
gaugcuccaagauucuaga

SEQ ID NO: 1285638 - RNA, 20 nt, Human
gaugcuccaagauucuagau

SEQ ID NO: 1285639 - RNA, 22 nt, Human
gaugcuccaagauucuagauga

SEQ ID NO: 1285640 - RNA, 22 nt, Human
gaugggacaauuagauaaaugu

SEQ ID NO: 1285641 - RNA, 22 nt, Human
gaugggacauuccaaagaacag

SEQ ID NO: 1285642 - RNA, 17 nt, Human
gauggcagcuuuuaaaa

SEQ ID NO: 1285643 - RNA, 15 nt, Human
gauggcaacagaucu

SEQ ID NO: 1285644 - RNA, 16 nt, Human
gauggcaacagaucug

SEQ ID NO: 1285645 - RNA, 17 nt, Human
gauggcaacagaucugg

SEQ ID NO: 1285646 - RNA, 21 nt, Human
gauggcaacagaucuggaacc

SEQ ID NO: 1285647 - RNA, 22 nt, Human
gauggcaacagaucuggaaccu

SEQ ID NO: 1285648 - RNA, 18 nt, Human
gauggcaaccagaccauu

SEQ ID NO: 1285649 - RNA, 18 nt, Human
gauggcagcuuuuaaaag

SEQ ID NO: 1285650 - RNA, 20 nt, Human
gauccuguguggagagggaa

SEQ ID NO: 1285651 - RNA, 15 nt, Human
gauccuuuuggaguc

SEQ ID NO: 1285652 - RNA, 17 nt, Human
gauccuuuuggagucag

SEQ ID NO: 1285653 - RNA, 17 nt, Human
gaucgaaccguuuugaa

SEQ ID NO: 1285654 - RNA, 12 nt, Human
gaucgccuuccc

SEQ ID NO: 1285655 - RNA, 20 nt, Human
gaucuguuuugaaggcaaaa

SEQ ID NO: 1285656 - RNA, 14 nt, Human
gaucuuagauucuc

SEQ ID NO: 1285657 - RNA, 13 nt, Human
gaucuuagauucu

SEQ ID NO: 1285658 - RNA, 14 nt, Human
gaucuuuuuuguca

SEQ ID NO: 1285659 - RNA, 18 nt, Human
gaugaaaaauugcugacu

SEQ ID NO: 1285660 - RNA, 20 nt, Human
gaugaaaaauugcugacugu

SEQ ID NO: 1285661 - RNA, 21 nt, Human
gaugaaaaguauauugauaac

SEQ ID NO: 1285662 - RNA, 23 nt, Human
gaugaaaaguauauugauaaccu

SEQ ID NO: 1285663 - RNA, 11 nt, Human
gaugaaaauaa

SEQ ID NO: 1285664 - RNA, 15 nt, Human
gauauauuuucuuuc

SEQ ID NO: 1285665 - RNA, 16 nt, Human
gauauauuuucuuucu

SEQ ID NO: 1285666 - RNA, 18 nt, Human
gauccuauccuccuaccu

SEQ ID NO: 1285667 - RNA, 16 nt, Human
gagucucugaggggcu

SEQ ID NO: 1285668 - RNA, 14 nt, Human
gagucucucugggc

SEQ ID NO: 1285669 - RNA, 18 nt, Human
gagucucuucuccacugg

SEQ ID NO: 1285670 - RNA, 14 nt, Human
gagucucuucucca

SEQ ID NO: 1285671 - RNA, 15 nt, Human
gagucucuucuccac

SEQ ID NO: 1285672 - RNA, 16 nt, Human
gagucucuucuccacu

SEQ ID NO: 1285673 - RNA, 17 nt, Human
gagucucuucuccacug

SEQ ID NO: 1285674 - RNA, 23 nt, Human
gagucucgcuauugucaccaggg

SEQ ID NO: 1285675 - RNA, 12 nt, Human
gagucucuucuc

SEQ ID NO: 1285676 - RNA, 13 nt, Human
gagucucucuggg

SEQ ID NO: 1285677 - RNA, 18 nt, Human
gagucguggggugugcug

SEQ ID NO: 1285678 - RNA, 19 nt, Human
gagucguggggugugcugg

SEQ ID NO: 1285679 - RNA, 20 nt, Human
gagucguggggugugcuggg

SEQ ID NO: 1285680 - RNA, 21 nt, Human
gagucguggggugugcuggga

SEQ ID NO: 1285681 - RNA, 16 nt, Human
gagucccugccuggac

SEQ ID NO: 1285682 - RNA, 19 nt, Human
gagucccugccuggaccag

SEQ ID NO: 1285683 - RNA, 17 nt, Human
gagucguacagaaagcu

SEQ ID NO: 1285684 - RNA, 22 nt, Human
gagucguacagaaagcugccug

SEQ ID NO: 1285685 - RNA, 17 nt, Human
gagucguggggugugcu

SEQ ID NO: 1285686 - RNA, 15 nt, Human
gagucaaaaauuaaa

SEQ ID NO: 1285687 - RNA, 14 nt, Human
gagucaaaaagaac

SEQ ID NO: 1285688 - RNA, 14 nt, Human
gagucaaaacacuu

SEQ ID NO: 1285689 - RNA, 17 nt, Human
gagucaaaacacuugua

SEQ ID NO: 1285690 - RNA, 20 nt, Human
gagucaaaacacuuguaauu

SEQ ID NO: 1285691 - RNA, 19 nt, Human
gagucaaaacuacaaauca

SEQ ID NO: 1285692 - RNA, 19 nt, Human
gagucaaaugguaggcauu

SEQ ID NO: 1285693 - RNA, 19 nt, Human
gaguagcugggacuacagg

SEQ ID NO: 1285694 - RNA, 13 nt, Human
gaguagcugagcu

SEQ ID NO: 1285695 - RNA, 14 nt, Human
gaguagcugagcuc

SEQ ID NO: 1285696 - RNA, 23 nt, Human
gaguauuuucugguaaaaagaaa

SEQ ID NO: 1285697 - RNA, 11 nt, Human
gaguccccuca

SEQ ID NO: 1285698 - RNA, 16 nt, Human
gaguccccucaccucc

SEQ ID NO: 1285699 - RNA, 17 nt, Human
gaguccccucaccuccu

SEQ ID NO: 1285700 - RNA, 18 nt, Human
gagucccaggcugagccu

SEQ ID NO: 1285701 - RNA, 19 nt, Human
gagucccaggcugagccuc

SEQ ID NO: 1285702 - RNA, 18 nt, Human
gagucccagguuggcucu

SEQ ID NO: 1285703 - RNA, 21 nt, Human
gagucccagguuggcucugcc

SEQ ID NO: 1285704 - RNA, 23 nt, Human
gagucccagguuggcucugccag

SEQ ID NO: 1285705 - RNA, 22 nt, Human
gagucccagguuggcucugcca

SEQ ID NO: 1285706 - RNA, 18 nt, Human
gaguccccucaccuccuc

SEQ ID NO: 1285707 - RNA, 19 nt, Human
gaguccccucaccuccucu

SEQ ID NO: 1285708 - RNA, 14 nt, Human
gagucccugccugg

SEQ ID NO: 1285709 - RNA, 15 nt, Human
gagucccugccugga

SEQ ID NO: 1285710 - RNA, 18 nt, Human
gagguccacaacacacag

SEQ ID NO: 1285711 - RNA, 17 nt, Human
gagggggucguggagag

SEQ ID NO: 1285712 - RNA, 18 nt, Human
gagggggucguggagagc

SEQ ID NO: 1285713 - RNA, 19 nt, Human
gagggggucguggagagcu

SEQ ID NO: 1285714 - RNA, 21 nt, Human
gagggggucguggagagcuag

SEQ ID NO: 1285715 - RNA, 20 nt, Human
gagguccugagcacugccag

SEQ ID NO: 1285716 - RNA, 21 nt, Human
gagguccugagcacugccagg

SEQ ID NO: 1285717 - RNA, 23 nt, Human
gagguccugagcacugccaggag

SEQ ID NO: 1285718 - RNA, 22 nt, Human
gagguccugagcacugccagga

SEQ ID NO: 1285719 - RNA, 17 nt, Human
gaggugggccagucugu

SEQ ID NO: 1285720 - RNA, 21 nt, Human
gaggugggccagucuguggau

SEQ ID NO: 1285721 - RNA, 12 nt, Human
gagguccugagc

SEQ ID NO: 1285722 - RNA, 13 nt, Human
gagguccugagca

SEQ ID NO: 1285723 - RNA, 14 nt, Human
gagguccugagcac

SEQ ID NO: 1285724 - RNA, 16 nt, Human
gagguccugagcacug

SEQ ID NO: 1285725 - RNA, 17 nt, Human
gagguccugagcacugc

SEQ ID NO: 1285726 - RNA, 18 nt, Human
gagguccugagcacugcc

SEQ ID NO: 1285727 - RNA, 19 nt, Human
gagguccugagcacugcca

SEQ ID NO: 1285728 - RNA, 22 nt, Human
gaguaccccugcuuugggcuug

SEQ ID NO: 1285729 - RNA, 17 nt, Human
gaguaauuuuggauuuu

SEQ ID NO: 1285730 - RNA, 15 nt, Human
gaguagcugagcuca

SEQ ID NO: 1285731 - RNA, 19 nt, Human
gagguuugcagucccaagc

SEQ ID NO: 1285732 - RNA, 22 nt, Human
gagguuugcagucccaagcggu

SEQ ID NO: 1285733 - RNA, 16 nt, Human
gagguuuuauuucauu

SEQ ID NO: 1285734 - RNA, 21 nt, Human
gagguuuuauuucauuuuuca

SEQ ID NO: 1285735 - RNA, 18 nt, Human
gaguaaagaauuauuuug

SEQ ID NO: 1285736 - RNA, 16 nt, Human
gagguuugcaguccca

SEQ ID NO: 1285737 - RNA, 21 nt, Human
gaguugaaaaucuuauaauuu

SEQ ID NO: 1285738 - RNA, 21 nt, Human
gaguuuuccauggcaggaagg

SEQ ID NO: 1285739 - RNA, 18 nt, Human
gaguuuuccauggcagga

SEQ ID NO: 1285740 - RNA, 12 nt, Human
gaguuccugcau

SEQ ID NO: 1285741 - RNA, 16 nt, Human
gaguuccagaaaguaa

SEQ ID NO: 1285742 - RNA, 15 nt, Human
gaguuccagaaagua

SEQ ID NO: 1285743 - RNA, 14 nt, Human
gaguuccugcaugc

SEQ ID NO: 1285744 - RNA, 17 nt, Human
gaguucuuuuugaagua

SEQ ID NO: 1285745 - RNA, 19 nt, Human
gaguucuuuuugaaguauu

SEQ ID NO: 1285746 - RNA, 21 nt, Human
gaguucuuuuugaaguauuua

SEQ ID NO: 1285747 - RNA, 22 nt, Human
gagugucuuuccacggagccac

SEQ ID NO: 1285748 - RNA, 12 nt, Human
gagugugaccaa

SEQ ID NO: 1285749 - RNA, 21 nt, Human
gagugugaccaaaaguuacau

SEQ ID NO: 1285750 - RNA, 20 nt, Human
gagugugaccaaaaguuaca

SEQ ID NO: 1285751 - RNA, 19 nt, Human
gaguuagggacugaccagc

SEQ ID NO: 1285752 - RNA, 21 nt, Human
gaguuagggacugaccagcag

SEQ ID NO: 1285753 - RNA, 13 nt, Human
gagugucuuucca

SEQ ID NO: 1285754 - RNA, 15 nt, Human
gagugucuuuccacg

SEQ ID NO: 1285755 - RNA, 19 nt, Human
gagugucuuuccacggagc

SEQ ID NO: 1285756 - RNA, 21 nt, Human
gagugucuuuccacggagcca

SEQ ID NO: 1285757 - RNA, 13 nt, Human
gaguggcuccucc

SEQ ID NO: 1285758 - RNA, 15 nt, Human
gaguggcuccucccg

SEQ ID NO: 1285759 - RNA, 13 nt, Human
gaguggcuggggc

SEQ ID NO: 1285760 - RNA, 17 nt, Human
gaguggcuggggcaugg

SEQ ID NO: 1285761 - RNA, 14 nt, Human
gaguggcuggggca

SEQ ID NO: 1285762 - RNA, 11 nt, Human
gagugggaagc

SEQ ID NO: 1285763 - RNA, 12 nt, Human
gagugggaagcc

SEQ ID NO: 1285764 - RNA, 13 nt, Human
gagugggaagccc

SEQ ID NO: 1285765 - RNA, 23 nt, Human
gagugaacaaauuuacagagaca

SEQ ID NO: 1285766 - RNA, 22 nt, Human
gagugaacaaauuuacagagac

SEQ ID NO: 1285767 - RNA, 22 nt, Human
gaguggcccuuucggauccagg

SEQ ID NO: 1285768 - RNA, 19 nt, Human
gagugaacaaauuuacaga

SEQ ID NO: 1285769 - RNA, 16 nt, Human
gagucugccacccagg

SEQ ID NO: 1285770 - RNA, 18 nt, Human
gagucugccacccaggau

SEQ ID NO: 1285771 - RNA, 12 nt, Human
gagucugccagg

SEQ ID NO: 1285772 - RNA, 13 nt, Human
gagucugccaggg

SEQ ID NO: 1285773 - RNA, 20 nt, Human
gagucugccagggccccucu

SEQ ID NO: 1285774 - RNA, 21 nt, Human
gagucugccagggccccucuc

SEQ ID NO: 1285775 - RNA, 13 nt, Human
gagucugaggucc

SEQ ID NO: 1285776 - RNA, 14 nt, Human
gagucugagguccu

SEQ ID NO: 1285777 - RNA, 15 nt, Human
gagucugagguccug

SEQ ID NO: 1285778 - RNA, 16 nt, Human
gagucugagguccuga

SEQ ID NO: 1285779 - RNA, 17 nt, Human
gagucugagguccugag

SEQ ID NO: 1285780 - RNA, 18 nt, Human
gagucugagguccugagc

SEQ ID NO: 1285781 - RNA, 19 nt, Human
gagucugagguccugagca

SEQ ID NO: 1285782 - RNA, 22 nt, Human
gagucugagguccugagcacug

SEQ ID NO: 1285783 - RNA, 23 nt, Human
gagucugagguccugagcacugc

SEQ ID NO: 1285784 - RNA, 23 nt, Human
gauagagacuggaacacuagaca

SEQ ID NO: 1285785 - RNA, 14 nt, Human
gauagaaugacagu

SEQ ID NO: 1285786 - RNA, 13 nt, Human
gaguuuuguguuu

SEQ ID NO: 1285787 - RNA, 15 nt, Human
gaguuuuguguuugu

SEQ ID NO: 1285788 - RNA, 18 nt, Human
gaguuuuguguuuguugu

SEQ ID NO: 1285789 - RNA, 22 nt, Human
gaguuuuguguuuguuguagau

SEQ ID NO: 1285790 - RNA, 17 nt, Human
gaguuuuguuuccucug

SEQ ID NO: 1285791 - RNA, 16 nt, Human
gaguuuuuuguaccaa

SEQ ID NO: 1285792 - RNA, 21 nt, Human
gauaaaacaucuuugaaauua

SEQ ID NO: 1285793 - RNA, 14 nt, Human
gauaaugaacagaa

SEQ ID NO: 1285794 - RNA, 13 nt, Human
gauaaugaacaga

SEQ ID NO: 1285795 - RNA, 21 nt, Human
gauaaugugauauuauacaua

SEQ ID NO: 1285796 - RNA, 21 nt, Human
gauauaaguguguguuuuuca

SEQ ID NO: 1285797 - RNA, 23 nt, Human
gauagauaggucagugcaaauac

SEQ ID NO: 1285798 - RNA, 17 nt, Human
gauauacucuagaugaa

SEQ ID NO: 1285799 - RNA, 19 nt, Human
gauauagaaguauaaagaa

SEQ ID NO: 1285800 - RNA, 14 nt, Human
gauauauuuuacaa

SEQ ID NO: 1285801 - RNA, 23 nt, Human
gauauauuuuacaauuuuuuauc

SEQ ID NO: 1285802 - RNA, 20 nt, Human
gaggaggcagagaagaaaga

SEQ ID NO: 1285803 - RNA, 16 nt, Human
gaggaggcagagaaga

SEQ ID NO: 1285804 - RNA, 19 nt, Human
gaggaggaaaucccuucau

SEQ ID NO: 1285805 - RNA, 18 nt, Human
gaggaggaaaucccuuca

SEQ ID NO: 1285806 - RNA, 16 nt, Human
gaggagccuguccugc

SEQ ID NO: 1285807 - RNA, 18 nt, Human
gaggagccuguccugccu

SEQ ID NO: 1285808 - RNA, 22 nt, Human
gaggagccuguccugccugugg

SEQ ID NO: 1285809 - RNA, 19 nt, Human
gaggagccuguccugccug

SEQ ID NO: 1285810 - RNA, 13 nt, Human
gaggagggcaggc

SEQ ID NO: 1285811 - RNA, 14 nt, Human
gaggagggcaggca

SEQ ID NO: 1285812 - RNA, 15 nt, Human
gaggagggcaggcau

SEQ ID NO: 1285813 - RNA, 18 nt, Human
gaggaggcuccagagggc

SEQ ID NO: 1285814 - RNA, 16 nt, Human
gaggacagaugccucc

SEQ ID NO: 1285815 - RNA, 17 nt, Human
gaggacagaugccuccu

SEQ ID NO: 1285816 - RNA, 20 nt, Human
gaggacagaugccuccuucc

SEQ ID NO: 1285817 - RNA, 21 nt, Human
gaggacagaugccuccuuccu

SEQ ID NO: 1285818 - RNA, 22 nt, Human
gaggacagaugccuccuuccuc

SEQ ID NO: 1285819 - RNA, 16 nt, Human
gaggagccaccaguuc

SEQ ID NO: 1285820 - RNA, 18 nt, Human
gaggagccaccaguucuc

SEQ ID NO: 1285821 - RNA, 23 nt, Human
gaggagcccacgacacugcagcc

SEQ ID NO: 1285822 - RNA, 12 nt, Human
gaggagcccagg

SEQ ID NO: 1285823 - RNA, 13 nt, Human
gaggagcccaggc

SEQ ID NO: 1285824 - RNA, 18 nt, Human
gaggagcccaggccagga

SEQ ID NO: 1285825 - RNA, 20 nt, Human
gaggagcccaggccaggacu

SEQ ID NO: 1285826 - RNA, 21 nt, Human
gaggagcccaggccaggacuc

SEQ ID NO: 1285827 - RNA, 14 nt, Human
gaggagccccagcu

SEQ ID NO: 1285828 - RNA, 15 nt, Human
gaggagccccagcua

SEQ ID NO: 1285829 - RNA, 20 nt, Human
gaggagcccccacccuguuc

SEQ ID NO: 1285830 - RNA, 21 nt, Human
gaggagcccccacccuguucc

SEQ ID NO: 1285831 - RNA, 23 nt, Human
gaggagcccccacccuguuccug

SEQ ID NO: 1285832 - RNA, 12 nt, Human
gaggagccuguc

SEQ ID NO: 1285833 - RNA, 14 nt, Human
gaggagccuguccu

SEQ ID NO: 1285834 - RNA, 14 nt, Human
gaggacacaugucc

SEQ ID NO: 1285835 - RNA, 13 nt, Human
gaggacacauguc

SEQ ID NO: 1285836 - RNA, 12 nt, Human
gaggacacaugu

SEQ ID NO: 1285837 - RNA, 11 nt, Human
gaggacacaug

SEQ ID NO: 1285838 - RNA, 18 nt, Human
gaggacaagagaaaaaag

SEQ ID NO: 1285839 - RNA, 13 nt, Human
gaggacacagaga

SEQ ID NO: 1285840 - RNA, 22 nt, Human
gaggaauuuucuuuguguagcu

SEQ ID NO: 1285841 - RNA, 14 nt, Human
gaggaauuucaccu

SEQ ID NO: 1285842 - RNA, 15 nt, Human
gaggacaaccauucc

SEQ ID NO: 1285843 - RNA, 21 nt, Human
gaggaaucugugggucuggga

SEQ ID NO: 1285844 - RNA, 22 nt, Human
gaggaaucugugggucugggag

SEQ ID NO: 1285845 - RNA, 19 nt, Human
gaggaaucugugggucugg

SEQ ID NO: 1285846 - RNA, 20 nt, Human
gaggaaucugugggucuggg

SEQ ID NO: 1285847 - RNA, 21 nt, Human
gaggaaggaggacccaggaca

SEQ ID NO: 1285848 - RNA, 18 nt, Human
gaggaaggaggacccagg

SEQ ID NO: 1285849 - RNA, 16 nt, Human
gaggaaggaggaccca

SEQ ID NO: 1285850 - RNA, 22 nt, Human
gagcuugaaacccguggcgcuu

SEQ ID NO: 1285851 - RNA, 16 nt, Human
gaggaaggacuucccu

SEQ ID NO: 1285852 - RNA, 21 nt, Human
gagcuucuguugcugccucau

SEQ ID NO: 1285853 - RNA, 19 nt, Human
gaggaaggggccagaggcu

SEQ ID NO: 1285854 - RNA, 21 nt, Human
gaggaauaagcucccagggcc

SEQ ID NO: 1285855 - RNA, 17 nt, Human
gaggaauacugaacauc

SEQ ID NO: 1285856 - RNA, 13 nt, Human
gaggcagcagugu

SEQ ID NO: 1285857 - RNA, 20 nt, Human
gaggcagcagugugaggcca

SEQ ID NO: 1285858 - RNA, 21 nt, Human
gaggcagcagugugaggccag

SEQ ID NO: 1285859 - RNA, 22 nt, Human
gaggcagcagugugaggccagg

SEQ ID NO: 1285860 - RNA, 21 nt, Human
gaggcaauuagacacuuugga

SEQ ID NO: 1285861 - RNA, 17 nt, Human
gaggcacaugucagcaa

SEQ ID NO: 1285862 - RNA, 13 nt, Human
gaggcaccaggaa

SEQ ID NO: 1285863 - RNA, 17 nt, Human
gaggcaccaggaagccg

SEQ ID NO: 1285864 - RNA, 20 nt, Human
gaggcaccugguggccaugc

SEQ ID NO: 1285865 - RNA, 18 nt, Human
gaggcacugaagugcuua

SEQ ID NO: 1285866 - RNA, 12 nt, Human
gaggcagcccag

SEQ ID NO: 1285867 - RNA, 13 nt, Human
gaggcagcccagg

SEQ ID NO: 1285868 - RNA, 16 nt, Human
gaggcagcccaggaag

SEQ ID NO: 1285869 - RNA, 12 nt, Human
gaggcagcccgc

SEQ ID NO: 1285870 - RNA, 18 nt, Human
gaggccagccuggccucc

SEQ ID NO: 1285871 - RNA, 19 nt, Human
gaggccagccuggccuccu

SEQ ID NO: 1285872 - RNA, 20 nt, Human
gaggccagccuggccuccug

SEQ ID NO: 1285873 - RNA, 13 nt, Human
gaggccagggcag

SEQ ID NO: 1285874 - RNA, 15 nt, Human
gaggccagggcagag

SEQ ID NO: 1285875 - RNA, 22 nt, Human
gaggaguaacaauacaaaugga

SEQ ID NO: 1285876 - RNA, 13 nt, Human
gaggagucugagg

SEQ ID NO: 1285877 - RNA, 14 nt, Human
gaggagucugaggu

SEQ ID NO: 1285878 - RNA, 15 nt, Human
gaggagucugagguc

SEQ ID NO: 1285879 - RNA, 18 nt, Human
gaggagucugagguccug

SEQ ID NO: 1285880 - RNA, 19 nt, Human
gaggagucugagguccuga

SEQ ID NO: 1285881 - RNA, 20 nt, Human
gaggagucugagguccugag

SEQ ID NO: 1285882 - RNA, 21 nt, Human
gaggagucugagguccugagc

SEQ ID NO: 1285883 - RNA, 22 nt, Human
gaggagucugagguccugagca

SEQ ID NO: 1285884 - RNA, 23 nt, Human
gaggagucugagguccugagcac

SEQ ID NO: 1285885 - RNA, 20 nt, Human
gaggagggucggugccuuca

SEQ ID NO: 1285886 - RNA, 21 nt, Human
gaggagggucggugccuucaa

SEQ ID NO: 1285887 - RNA, 19 nt, Human
gaggaggugucucaggcug

SEQ ID NO: 1285888 - RNA, 21 nt, Human
gaggaggugucucaggcugcc

SEQ ID NO: 1285889 - RNA, 23 nt, Human
gaggaggugucucaggcugccug

SEQ ID NO: 1285890 - RNA, 22 nt, Human
gaggaggugucucaggcugccu

SEQ ID NO: 1285891 - RNA, 11 nt, Human
gaggaguaaca

SEQ ID NO: 1285892 - RNA, 12 nt, Human
gaggaguaacaa

SEQ ID NO: 1285893 - RNA, 20 nt, Human
gaggaguaacaauacaaaug

SEQ ID NO: 1285894 - RNA, 21 nt, Human
gaggaguaacaauacaaaugg

SEQ ID NO: 1285895 - RNA, 21 nt, Human
gaggauguaaagaucaauaaa

SEQ ID NO: 1285896 - RNA, 13 nt, Human
gaggauacgacag

SEQ ID NO: 1285897 - RNA, 16 nt, Human
gagggagaacaagacc

SEQ ID NO: 1285898 - RNA, 18 nt, Human
gagggacugucgcugcuu

SEQ ID NO: 1285899 - RNA, 23 nt, Human
gagggacugucgcugcuucgugg

SEQ ID NO: 1285900 - RNA, 15 nt, Human
gagggagaaauaguc

SEQ ID NO: 1285901 - RNA, 14 nt, Human
gagggacgccuggg

SEQ ID NO: 1285902 - RNA, 15 nt, Human
gagggacgccugggg

SEQ ID NO: 1285903 - RNA, 16 nt, Human
gagggacgccuggggg

SEQ ID NO: 1285904 - RNA, 23 nt, Human
gagggacgccugggggugccagg

SEQ ID NO: 1285905 - RNA, 15 nt, Human
gagggacugucgcug

SEQ ID NO: 1285906 - RNA, 14 nt, Human
gaggcuugguuccu

SEQ ID NO: 1285907 - RNA, 23 nt, Human
gaggcuuuaugauaauagauucu

SEQ ID NO: 1285908 - RNA, 14 nt, Human
gaggcuuuggauuu

SEQ ID NO: 1285909 - RNA, 16 nt, Human
gaggcuuuggauuuga

SEQ ID NO: 1285910 - RNA, 20 nt, Human
gaggcuuuggauuugacauu

SEQ ID NO: 1285911 - RNA, 14 nt, Human
gaggcuuuccaugg

SEQ ID NO: 1285912 - RNA, 16 nt, Human
gagggaaaggccagca

SEQ ID NO: 1285913 - RNA, 14 nt, Human
gagggaagggagcc

SEQ ID NO: 1285914 - RNA, 15 nt, Human
gagggaagggagcca

SEQ ID NO: 1285915 - RNA, 16 nt, Human
gagggaagggagccaa

SEQ ID NO: 1285916 - RNA, 17 nt, Human
gagggaagggagccaag

SEQ ID NO: 1285917 - RNA, 20 nt, Human
gagggaagggagccaaggga

SEQ ID NO: 1285918 - RNA, 19 nt, Human
gagggaagggagccaaggg

SEQ ID NO: 1285919 - RNA, 14 nt, Human
gagggaaugugaaa

SEQ ID NO: 1285920 - RNA, 16 nt, Human
gagggacaaaggagcc

SEQ ID NO: 1285921 - RNA, 17 nt, Human
gagggacaaaggagccu

SEQ ID NO: 1285922 - RNA, 18 nt, Human
gagggacaaaggagccug

SEQ ID NO: 1285923 - RNA, 19 nt, Human
gagggacaaaggagccugu

SEQ ID NO: 1285924 - RNA, 20 nt, Human
gagggacaaaggagccugug

SEQ ID NO: 1285925 - RNA, 21 nt, Human
gagggacaaaggagccuguga

SEQ ID NO: 1285926 - RNA, 22 nt, Human
gagggacaaaggagccugugaa

SEQ ID NO: 1285927 - RNA, 23 nt, Human
gagggacaugcuuagcagucccc

SEQ ID NO: 1285928 - RNA, 12 nt, Human
gagggcacuggu

SEQ ID NO: 1285929 - RNA, 13 nt, Human
gaggggccugcca

SEQ ID NO: 1285930 - RNA, 15 nt, Human
gaggggccugccacc

SEQ ID NO: 1285931 - RNA, 17 nt, Human
gaggggccugccaccug

SEQ ID NO: 1285932 - RNA, 19 nt, Human
gaggggccugccaccugga

SEQ ID NO: 1285933 - RNA, 20 nt, Human
gaggggccugccaccuggac

SEQ ID NO: 1285934 - RNA, 21 nt, Human
gaggggccugccaccuggacc

SEQ ID NO: 1285935 - RNA, 22 nt, Human
gaggggccugccaccuggaccc

SEQ ID NO: 1285936 - RNA, 13 nt, Human
gaggggccuggca

SEQ ID NO: 1285937 - RNA, 14 nt, Human
gaggggccuggcag

SEQ ID NO: 1285938 - RNA, 18 nt, Human
gaggggccuggcagccgu

SEQ ID NO: 1285939 - RNA, 20 nt, Human
gaggggccuggcagccgugc

SEQ ID NO: 1285940 - RNA, 16 nt, Human
gagggcacugguggcc

SEQ ID NO: 1285941 - RNA, 18 nt, Human
gagggcacugguggcccg

SEQ ID NO: 1285942 - RNA, 14 nt, Human
gagggcagagcugg

SEQ ID NO: 1285943 - RNA, 17 nt, Human
gagggcagagcuggugc

SEQ ID NO: 1285944 - RNA, 16 nt, Human
gagggcagagcuggug

SEQ ID NO: 1285945 - RNA, 13 nt, Human
gagggcagcagcc

SEQ ID NO: 1285946 - RNA, 18 nt, Human
gaggcuacuguaaggcaa

SEQ ID NO: 1285947 - RNA, 14 nt, Human
gaggcuuccuucau

SEQ ID NO: 1285948 - RNA, 19 nt, Human
gaggccuggacuuuccugc

SEQ ID NO: 1285949 - RNA, 20 nt, Human
gaggccuggacuuuccugca

SEQ ID NO: 1285950 - RNA, 14 nt, Human
gaggccugggccgc

SEQ ID NO: 1285951 - RNA, 16 nt, Human
gaggccugggccgcug

SEQ ID NO: 1285952 - RNA, 20 nt, Human
gaggccugggccgcugccac

SEQ ID NO: 1285953 - RNA, 21 nt, Human
gaggccugggccgcugccacg

SEQ ID NO: 1285954 - RNA, 22 nt, Human
gaggccugggccgcugccacgu

SEQ ID NO: 1285955 - RNA, 13 nt, Human
gaggccugggcug

SEQ ID NO: 1285956 - RNA, 18 nt, Human
gaggccugggcugggaaa

SEQ ID NO: 1285957 - RNA, 17 nt, Human
gaggccugggcugggaa

SEQ ID NO: 1285958 - RNA, 19 nt, Human
gaggccuguuuggccucuc

SEQ ID NO: 1285959 - RNA, 21 nt, Human
gaggccuuacuuaaacccagc

SEQ ID NO: 1285960 - RNA, 22 nt, Human
gaggcccugugccccuugacaa

SEQ ID NO: 1285961 - RNA, 18 nt, Human
gaggccgaagcuaacagg

SEQ ID NO: 1285962 - RNA, 14 nt, Human
gaggccguggcugc

SEQ ID NO: 1285963 - RNA, 21 nt, Human
gaggccguggcugcuguggga

SEQ ID NO: 1285964 - RNA, 20 nt, Human
gaggccugacugccaagcca

SEQ ID NO: 1285965 - RNA, 13 nt, Human
gaggccuggacuu

SEQ ID NO: 1285966 - RNA, 18 nt, Human
gaggccuggacuuuccug

SEQ ID NO: 1285967 - RNA, 21 nt, Human
gaggcccccagcccagggcuc

SEQ ID NO: 1285968 - RNA, 19 nt, Human
gaggccagggcagagugag

SEQ ID NO: 1285969 - RNA, 22 nt, Human
gaggccagccuggccuccugcc

SEQ ID NO: 1285970 - RNA, 15 nt, Human
gaggcccccagccca

SEQ ID NO: 1285971 - RNA, 16 nt, Human
gaggcccccagcccag

SEQ ID NO: 1285972 - RNA, 17 nt, Human
gaggcccccagcccagg

SEQ ID NO: 1285973 - RNA, 19 nt, Human
gaggcccccagcccagggc

SEQ ID NO: 1285974 - RNA, 20 nt, Human
gaggcccccagcccagggcu

SEQ ID NO: 1285975 - RNA, 13 nt, Human
gaggcccggccuc

SEQ ID NO: 1285976 - RNA, 12 nt, Human
gaggcccuccac

SEQ ID NO: 1285977 - RNA, 17 nt, Human
gaggcccuccacaccug

SEQ ID NO: 1285978 - RNA, 18 nt, Human
gaggcccuccacaccugc

SEQ ID NO: 1285979 - RNA, 19 nt, Human
gaggcccuccacaccugcg

SEQ ID NO: 1285980 - RNA, 22 nt, Human
gaggcccuccacaccugcggcc

SEQ ID NO: 1285981 - RNA, 17 nt, Human
gaggcccucgcugccag

SEQ ID NO: 1285982 - RNA, 21 nt, Human
gaggcccuccacaccugcggc

SEQ ID NO: 1285983 - RNA, 12 nt, Human
gaggcccuggau

SEQ ID NO: 1285984 - RNA, 13 nt, Human
gaggcccuggauc

SEQ ID NO: 1285985 - RNA, 14 nt, Human
gaggcccuggauca

SEQ ID NO: 1285986 - RNA, 22 nt, Human
gaggcccuggaucagcguggcc

SEQ ID NO: 1285987 - RNA, 23 nt, Human
gaggcccuggaucagcguggccu

SEQ ID NO: 1285988 - RNA, 14 nt, Human
gagcuacaaaugca

SEQ ID NO: 1285989 - RNA, 11 nt, Human
gagcuaaggcu

SEQ ID NO: 1285990 - RNA, 23 nt, Human
gagcucaggaaccgaggcaggga

SEQ ID NO: 1285991 - RNA, 17 nt, Human
gagcuagaacccucugu

SEQ ID NO: 1285992 - RNA, 11 nt, Human
gagcuacugcc

SEQ ID NO: 1285993 - RNA, 20 nt, Human
gagcuacguauuuaauagca

SEQ ID NO: 1285994 - RNA, 11 nt, Human
gagcucaggau

SEQ ID NO: 1285995 - RNA, 14 nt, Human
gagcuaaggcucua

SEQ ID NO: 1285996 - RNA, 13 nt, Human
gagcuaaggcucu

SEQ ID NO: 1285997 - RNA, 15 nt, Human
gagcuacauaauuua

SEQ ID NO: 1285998 - RNA, 14 nt, Human
gagcuaccugugug

SEQ ID NO: 1285999 - RNA, 19 nt, Human
gagcuaccuguguggacag

SEQ ID NO: 1286000 - RNA, 20 nt, Human
gagcuaccuguguggacagg

SEQ ID NO: 1286001 - RNA, 22 nt, Human
gagcuaccuguguggacaggac

SEQ ID NO: 1286002 - RNA, 15 nt, Human
gagcuacguauuuaa

SEQ ID NO: 1286003 - RNA, 20 nt, Human
gagcuccuuaaggcucuuuu

SEQ ID NO: 1286004 - RNA, 19 nt, Human
gagcuccucuuccaugcug

SEQ ID NO: 1286005 - RNA, 17 nt, Human
gagcuccuguccccugc

SEQ ID NO: 1286006 - RNA, 13 nt, Human
gagcuccucuucc

SEQ ID NO: 1286007 - RNA, 14 nt, Human
gagcuccucuucca

SEQ ID NO: 1286008 - RNA, 19 nt, Human
gagcucuauuaugaaugug

SEQ ID NO: 1286009 - RNA, 19 nt, Human
gagcuccuguccccugcua

SEQ ID NO: 1286010 - RNA, 15 nt, Human
gagcucucugcccuu

SEQ ID NO: 1286011 - RNA, 17 nt, Human
gagcucucugcccuuga

SEQ ID NO: 1286012 - RNA, 11 nt, Human
gagcucugaga

SEQ ID NO: 1286013 - RNA, 12 nt, Human
gagcucugagag

SEQ ID NO: 1286014 - RNA, 13 nt, Human
gagcucugagagg

SEQ ID NO: 1286015 - RNA, 14 nt, Human
gagcucugagaggc

SEQ ID NO: 1286016 - RNA, 15 nt, Human
gagcucugagaggcc

SEQ ID NO: 1286017 - RNA, 16 nt, Human
gagcucugagaggccc

SEQ ID NO: 1286018 - RNA, 17 nt, Human
gagcucugagaggcccu

SEQ ID NO: 1286019 - RNA, 18 nt, Human
gagcucugagaggcccug

SEQ ID NO: 1286020 - RNA, 19 nt, Human
gagcucugagaggcccugg

SEQ ID NO: 1286021 - RNA, 20 nt, Human
gagcucugagaggcccugga

SEQ ID NO: 1286022 - RNA, 12 nt, Human
gagcucaggaug

SEQ ID NO: 1286023 - RNA, 13 nt, Human
gagcucaggauga

SEQ ID NO: 1286024 - RNA, 23 nt, Human
gagcucaggaugagggaaaagaa

SEQ ID NO: 1286025 - RNA, 12 nt, Human
gagcuccacucu

SEQ ID NO: 1286026 - RNA, 13 nt, Human
gagcuccacucug

SEQ ID NO: 1286027 - RNA, 16 nt, Human
gagcuccacucugcuu

SEQ ID NO: 1286028 - RNA, 18 nt, Human
gagcuccacucugcuucu

SEQ ID NO: 1286029 - RNA, 21 nt, Human
gagcuccacucugcuucucug

SEQ ID NO: 1286030 - RNA, 22 nt, Human
gagcuccacucugcuucucuga

SEQ ID NO: 1286031 - RNA, 15 nt, Human
gagcuccccucccca

SEQ ID NO: 1286032 - RNA, 17 nt, Human
gagcuccccuccccaac

SEQ ID NO: 1286033 - RNA, 19 nt, Human
gagcuccccuccccaacug

SEQ ID NO: 1286034 - RNA, 18 nt, Human
gagcuccccuccccaacu

SEQ ID NO: 1286035 - RNA, 12 nt, Human
gagcuccucccu

SEQ ID NO: 1286036 - RNA, 23 nt, Human
gagcuccucccucucaacaccca

SEQ ID NO: 1286037 - RNA, 19 nt, Human
gagcugauggagaaggaag

SEQ ID NO: 1286038 - RNA, 18 nt, Human
gagcugauggagaaggaa

SEQ ID NO: 1286039 - RNA, 17 nt, Human
gagcucuucauguuuca

SEQ ID NO: 1286040 - RNA, 16 nt, Human
gagcucugcagagcag

SEQ ID NO: 1286041 - RNA, 21 nt, Human
gagcucugagaggcccuggau

SEQ ID NO: 1286042 - RNA, 22 nt, Human
gagcucugagaggcccuggauc

SEQ ID NO: 1286043 - RNA, 23 nt, Human
gagcucugagaggcccuggauca

SEQ ID NO: 1286044 - RNA, 12 nt, Human
gagcugccaaga

SEQ ID NO: 1286045 - RNA, 15 nt, Human
gagcuuaacagugug

SEQ ID NO: 1286046 - RNA, 15 nt, Human
gagcuuaaaauacaa

SEQ ID NO: 1286047 - RNA, 16 nt, Human
gagcuuaaaauacaag

SEQ ID NO: 1286048 - RNA, 17 nt, Human
gagcuuaaaauacaaga

SEQ ID NO: 1286049 - RNA, 21 nt, Human
gagcuuaaucuuugaaagguu

SEQ ID NO: 1286050 - RNA, 22 nt, Human
gagcuuaaucuuugaaagguua

SEQ ID NO: 1286051 - RNA, 14 nt, Human
gagcuucuggcacu

SEQ ID NO: 1286052 - RNA, 18 nt, Human
gagcuucuguugcugccu

SEQ ID NO: 1286053 - RNA, 16 nt, Human
gagcuucauggcagaa

SEQ ID NO: 1286054 - RNA, 19 nt, Human
gagcuucauggcagaaggc

SEQ ID NO: 1286055 - RNA, 13 nt, Human
gagcuucccugac

SEQ ID NO: 1286056 - RNA, 17 nt, Human
gagcuucccugacucau

SEQ ID NO: 1286057 - RNA, 15 nt, Human
gagccugcaggaucu

SEQ ID NO: 1286058 - RNA, 13 nt, Human
gagccugcaggau

SEQ ID NO: 1286059 - RNA, 18 nt, Human
gagccuccuuucuggcuu

SEQ ID NO: 1286060 - RNA, 18 nt, Human
gagccucagucucccucc

SEQ ID NO: 1286061 - RNA, 13 nt, Human
gagcuacaaaugc

SEQ ID NO: 1286062 - RNA, 12 nt, Human
gagcuacaaaug

SEQ ID NO: 1286063 - RNA, 15 nt, Human
gagccuguaaacuuu

SEQ ID NO: 1286064 - RNA, 11 nt, Human
gagccuguccu

SEQ ID NO: 1286065 - RNA, 12 nt, Human
gagccuguccug

SEQ ID NO: 1286066 - RNA, 15 nt, Human
gagccuguccugccu

SEQ ID NO: 1286067 - RNA, 17 nt, Human
gagccuguccugccugu

SEQ ID NO: 1286068 - RNA, 18 nt, Human
gagccuguccugccugug

SEQ ID NO: 1286069 - RNA, 19 nt, Human
gagccuguccugccugugg

SEQ ID NO: 1286070 - RNA, 21 nt, Human
gagccuguccugccuguggcc

SEQ ID NO: 1286071 - RNA, 16 nt, Human
gagccugugaacccag

SEQ ID NO: 1286072 - RNA, 17 nt, Human
gagccugugaacccagg

SEQ ID NO: 1286073 - RNA, 18 nt, Human
gagccugugaacccagga

SEQ ID NO: 1286074 - RNA, 19 nt, Human
gagccugugaacccaggac

SEQ ID NO: 1286075 - RNA, 20 nt, Human
gagccugugaacccaggaca

SEQ ID NO: 1286076 - RNA, 21 nt, Human
gagccugugaacccaggacaa

SEQ ID NO: 1286077 - RNA, 23 nt, Human
gagccugugaacccaggacaagc

SEQ ID NO: 1286078 - RNA, 23 nt, Human
gagccugugacauacccccuccc

SEQ ID NO: 1286079 - RNA, 16 nt, Human
gagcgugagcugagca

SEQ ID NO: 1286080 - RNA, 17 nt, Human
gagcgugagcugagcag

SEQ ID NO: 1286081 - RNA, 19 nt, Human
gagcgugagcugagcaggc

SEQ ID NO: 1286082 - RNA, 23 nt, Human
gagccuggcuccguccaggagcc

SEQ ID NO: 1286083 - RNA, 11 nt, Human
gagccuggggc

SEQ ID NO: 1286084 - RNA, 13 nt, Human
gagccuggggcuc

SEQ ID NO: 1286085 - RNA, 15 nt, Human
gagccuggggcucua

SEQ ID NO: 1286086 - RNA, 23 nt, Human
gagccuggggcucuaacgccuga

SEQ ID NO: 1286087 - RNA, 20 nt, Human
gagaucaggaagagaaggag

SEQ ID NO: 1286088 - RNA, 13 nt, Human
gagaucaggaaga

SEQ ID NO: 1286089 - RNA, 13 nt, Human
gagauccuccugc

SEQ ID NO: 1286090 - RNA, 14 nt, Human
gagauccuccugca

SEQ ID NO: 1286091 - RNA, 23 nt, Human
gagauccuccugcagaccacgcc

SEQ ID NO: 1286092 - RNA, 17 nt, Human
gagauccuccugcagac

SEQ ID NO: 1286093 - RNA, 15 nt, Human
gagauccuuaucgaa

SEQ ID NO: 1286094 - RNA, 15 nt, Human
gagaucaaagaugaa

SEQ ID NO: 1286095 - RNA, 20 nt, Human
gagaucaaagaugaaaagua

SEQ ID NO: 1286096 - RNA, 19 nt, Human
gagauauuaaugcccagac

SEQ ID NO: 1286097 - RNA, 13 nt, Human
gagaucaaagaug

SEQ ID NO: 1286098 - RNA, 14 nt, Human
gagaucaaagauga

SEQ ID NO: 1286099 - RNA, 11 nt, Human
gagauauuaau

SEQ ID NO: 1286100 - RNA, 18 nt, Human
gagauauuaaugcccaga

SEQ ID NO: 1286101 - RNA, 14 nt, Human
gaaugcuguacauc

SEQ ID NO: 1286102 - RNA, 15 nt, Human
gaaugcuguacaucu

SEQ ID NO: 1286103 - RNA, 17 nt, Human
gaaugcuguacaucuau

SEQ ID NO: 1286104 - RNA, 20 nt, Human
gaaugcuguacaucuauuuu

SEQ ID NO: 1286105 - RNA, 13 nt, Human
gaaugcugggacu

SEQ ID NO: 1286106 - RNA, 14 nt, Human
gaaugcugggacuc

SEQ ID NO: 1286107 - RNA, 16 nt, Human
gaaugcugggacucag

SEQ ID NO: 1286108 - RNA, 17 nt, Human
gaaugcugggacucagc

SEQ ID NO: 1286109 - RNA, 18 nt, Human
gaaugcugggacucagcc

SEQ ID NO: 1286110 - RNA, 19 nt, Human
gaaugcugggacucagccu

SEQ ID NO: 1286111 - RNA, 13 nt, Human
gaaugcuguacau

SEQ ID NO: 1286112 - RNA, 12 nt, Human
gagcaaaauaau

SEQ ID NO: 1286113 - RNA, 19 nt, Human
gagcaaacugcaugcccag

SEQ ID NO: 1286114 - RNA, 20 nt, Human
gagcaaacugcaugcccaga

SEQ ID NO: 1286115 - RNA, 22 nt, Human
gagcaaacugcaugcccagaga

SEQ ID NO: 1286116 - RNA, 23 nt, Human
gagcaaacugcaugcccagagac

SEQ ID NO: 1286117 - RNA, 12 nt, Human
gagcaaagccug

SEQ ID NO: 1286118 - RNA, 23 nt, Human
gagcaaagccuguucauggcaga

SEQ ID NO: 1286119 - RNA, 14 nt, Human
gagcaccugcuguc

SEQ ID NO: 1286120 - RNA, 15 nt, Human
gagcaccugcugucu

SEQ ID NO: 1286121 - RNA, 16 nt, Human
gagcaccugcugucug

SEQ ID NO: 1286122 - RNA, 22 nt, Human
gagcaccgccugugaaauacca

SEQ ID NO: 1286123 - RNA, 14 nt, Human
gagcaccuccacau

SEQ ID NO: 1286124 - RNA, 19 nt, Human
gagcaccuccacauccucc

SEQ ID NO: 1286125 - RNA, 13 nt, Human
gagcaaagccugu

SEQ ID NO: 1286126 - RNA, 14 nt, Human
gagcaaagccuguu

SEQ ID NO: 1286127 - RNA, 22 nt, Human
gagcaaagccuguucauggcag

SEQ ID NO: 1286128 - RNA, 20 nt, Human
gagcacaauaaauggcugua

SEQ ID NO: 1286129 - RNA, 20 nt, Human
gagccaccgugccuggccac

SEQ ID NO: 1286130 - RNA, 14 nt, Human
gagccaccgugccu

SEQ ID NO: 1286131 - RNA, 14 nt, Human
gagccaccaguucu

SEQ ID NO: 1286132 - RNA, 20 nt, Human
gagcaggacugaugucuccu

SEQ ID NO: 1286133 - RNA, 22 nt, Human
gagcagcaggaggggggaggga

SEQ ID NO: 1286134 - RNA, 21 nt, Human
gagcagcaggaggggggaggg

SEQ ID NO: 1286135 - RNA, 21 nt, Human
gagcaggaggccuaggagggu

SEQ ID NO: 1286136 - RNA, 20 nt, Human
gagcaggaggccuaggaggg

SEQ ID NO: 1286137 - RNA, 11 nt, Human
gagcaggcagc

SEQ ID NO: 1286138 - RNA, 16 nt, Human
gagcaggcagccagca

SEQ ID NO: 1286139 - RNA, 17 nt, Human
gagcaggcagccagcau

SEQ ID NO: 1286140 - RNA, 19 nt, Human
gagcaggcagccagcaucu

SEQ ID NO: 1286141 - RNA, 11 nt, Human
gagcagcaccu

SEQ ID NO: 1286142 - RNA, 14 nt, Human
gagcagcaccuccu

SEQ ID NO: 1286143 - RNA, 15 nt, Human
gagcagcaccuccuc

SEQ ID NO: 1286144 - RNA, 19 nt, Human
gagcagcaccuccucagcc

SEQ ID NO: 1286145 - RNA, 20 nt, Human
gagcagcaccuccucagccu

SEQ ID NO: 1286146 - RNA, 21 nt, Human
gagcagcaccuccucagccug

SEQ ID NO: 1286147 - RNA, 22 nt, Human
gagcagcaccuccucagccuga

SEQ ID NO: 1286148 - RNA, 18 nt, Human
gagcagcaggagggggga

SEQ ID NO: 1286149 - RNA, 22 nt, Human
gagcagaccaccccgccugccc

SEQ ID NO: 1286150 - RNA, 14 nt, Human
gagcagaggucucc

SEQ ID NO: 1286151 - RNA, 14 nt, Human
gagcacuguuuucu

SEQ ID NO: 1286152 - RNA, 22 nt, Human
gagcacuguuuucuaguguauc

SEQ ID NO: 1286153 - RNA, 17 nt, Human
gagcaccugcugucugg

SEQ ID NO: 1286154 - RNA, 13 nt, Human
gagcacugcucca

SEQ ID NO: 1286155 - RNA, 22 nt, Human
gagcagaaaacccuugggccag

SEQ ID NO: 1286156 - RNA, 23 nt, Human
gagcagaaaacccuugggccaga

SEQ ID NO: 1286157 - RNA, 12 nt, Human
gagcagaagcag

SEQ ID NO: 1286158 - RNA, 14 nt, Human
gagcagaagcagca

SEQ ID NO: 1286159 - RNA, 16 nt, Human
gagcagaagcagcaac

SEQ ID NO: 1286160 - RNA, 17 nt, Human
gagcagaaggggagaug

SEQ ID NO: 1286161 - RNA, 18 nt, Human
gagcagaaggggagaugg

SEQ ID NO: 1286162 - RNA, 14 nt, Human
gagccacuccucug

SEQ ID NO: 1286163 - RNA, 15 nt, Human
gagccacuccucuga

SEQ ID NO: 1286164 - RNA, 17 nt, Human
gagccaugcgcccccuc

SEQ ID NO: 1286165 - RNA, 18 nt, Human
gagccaugucuucucccu

SEQ ID NO: 1286166 - RNA, 22 nt, Human
gagccaugucuucucccuggaa

SEQ ID NO: 1286167 - RNA, 12 nt, Human
gagccauguuuc

SEQ ID NO: 1286168 - RNA, 13 nt, Human
gagccauuugaga

SEQ ID NO: 1286169 - RNA, 24 nt, Human
gagcccaggccaggacucugcagc

SEQ ID NO: 1286170 - RNA, 14 nt, Human
gagcccaagggaau

SEQ ID NO: 1286171 - RNA, 11 nt, Human
gagcccaggcu

SEQ ID NO: 1286172 - RNA, 12 nt, Human
gagcccaggcuc

SEQ ID NO: 1286173 - RNA, 21 nt, Human
gagcccaggcucggccugccc

SEQ ID NO: 1286174 - RNA, 22 nt, Human
gagcccaggcucggccugcccc

SEQ ID NO: 1286175 - RNA, 11 nt, Human
gagcccaggga

SEQ ID NO: 1286176 - RNA, 15 nt, Human
gagcccagggaggcc

SEQ ID NO: 1286177 - RNA, 17 nt, Human
gagcccagggaggccga

SEQ ID NO: 1286178 - RNA, 16 nt, Human
gaaccugaugaaaaua

SEQ ID NO: 1286179 - RNA, 16 nt, Human
gaaccuggaacuuggg

SEQ ID NO: 1286180 - RNA, 11 nt, Human
gaaccuggccu

SEQ ID NO: 1286181 - RNA, 12 nt, Human
gaaccuggccuu

SEQ ID NO: 1286182 - RNA, 13 nt, Human
gaaccuggccuuc

SEQ ID NO: 1286183 - RNA, 16 nt, Human
gaaccuggccuucagu

SEQ ID NO: 1286184 - RNA, 14 nt, Human
gaaccuggccuuca

SEQ ID NO: 1286185 - RNA, 21 nt, Human
gaaccuggguugcagacagga

SEQ ID NO: 1286186 - RNA, 12 nt, Human
gaaccugugucc

SEQ ID NO: 1286187 - RNA, 22 nt, Human
gaacuagaguuuagcuggaaaa

SEQ ID NO: 1286188 - RNA, 22 nt, Human
gaacgugauuagugaaaggaag

SEQ ID NO: 1286189 - RNA, 15 nt, Human
gaacgucuuaucuaa

SEQ ID NO: 1286190 - RNA, 20 nt, Human
gaacguuuagcugacaaaau

SEQ ID NO: 1286191 - RNA, 18 nt, Human
gaacuagccaaaccagga

SEQ ID NO: 1286192 - RNA, 15 nt, Human
gaacuaggcugagca

SEQ ID NO: 1286193 - RNA, 17 nt, Human
gaacuaggcugagcaau

SEQ ID NO: 1286194 - RNA, 17 nt, Human
gaaccggagagccagcu

SEQ ID NO: 1286195 - RNA, 16 nt, Human
gaaccggagagccagc

SEQ ID NO: 1286196 - RNA, 11 nt, Human
gaaccugaccc

SEQ ID NO: 1286197 - RNA, 12 nt, Human
gaaccugacccc

SEQ ID NO: 1286198 - RNA, 15 nt, Human
gaaccugaugaaaau

SEQ ID NO: 1286199 - RNA, 20 nt, Human
gaaccugaugaaaauaaaga

SEQ ID NO: 1286200 - RNA, 17 nt, Human
gaaccguuuugaagcua

SEQ ID NO: 1286201 - RNA, 18 nt, Human
gaaccguuuugaagcuac

SEQ ID NO: 1286202 - RNA, 19 nt, Human
gaaccguuuugaagcuacu

SEQ ID NO: 1286203 - RNA, 19 nt, Human
gaaccuaauucaauucaaa

SEQ ID NO: 1286204 - RNA, 18 nt, Human
gaaccuacaguuuuaacu

SEQ ID NO: 1286205 - RNA, 19 nt, Human
gaaccuacaguuuuaacug

SEQ ID NO: 1286206 - RNA, 21 nt, Human
gaaccuacaguuuuaacugug

SEQ ID NO: 1286207 - RNA, 23 nt, Human
gaaccuacaguuuuaacugugga

SEQ ID NO: 1286208 - RNA, 23 nt, Human
gaacagaacauagacagaagaaa

SEQ ID NO: 1286209 - RNA, 21 nt, Human
gaacuugaggacacaugucca

SEQ ID NO: 1286210 - RNA, 19 nt, Human
gaacuugaggacacauguc

SEQ ID NO: 1286211 - RNA, 18 nt, Human
gaacuugaggacacaugu

SEQ ID NO: 1286212 - RNA, 15 nt, Human
gaacuugcauuguga

SEQ ID NO: 1286213 - RNA, 23 nt, Human
gaacuugcauugugauuggccug

SEQ ID NO: 1286214 - RNA, 11 nt, Human
gaacuugccug

SEQ ID NO: 1286215 - RNA, 16 nt, Human
gaacuugccugccuuu

SEQ ID NO: 1286216 - RNA, 17 nt, Human
gaacuugccugccuuuc

SEQ ID NO: 1286217 - RNA, 19 nt, Human
gaacuugccugccuuucca

SEQ ID NO: 1286218 - RNA, 17 nt, Human
gaacuugaggacacaug

SEQ ID NO: 1286219 - RNA, 16 nt, Human
gaacuugaggacacau

SEQ ID NO: 1286220 - RNA, 15 nt, Human
gaacuugaggacaca

SEQ ID NO: 1286221 - RNA, 14 nt, Human
gaacuugaggacac

SEQ ID NO: 1286222 - RNA, 13 nt, Human
gaacuugaggaca

SEQ ID NO: 1286223 - RNA, 15 nt, Human
gaacuugacccugag

SEQ ID NO: 1286224 - RNA, 23 nt, Human
gaacuuccagguguuacuguaau

SEQ ID NO: 1286225 - RNA, 22 nt, Human
gaacuuccagauccuggaaauc

SEQ ID NO: 1286226 - RNA, 16 nt, Human
gaacuuagauuuuaca

SEQ ID NO: 1286227 - RNA, 17 nt, Human
gaacuuagauuuuacau

SEQ ID NO: 1286228 - RNA, 19 nt, Human
gaacuuagauuuuacauga

SEQ ID NO: 1286229 - RNA, 13 nt, Human
gaacuucagaaag

SEQ ID NO: 1286230 - RNA, 14 nt, Human
gaacuucagaaaga

SEQ ID NO: 1286231 - RNA, 18 nt, Human
gaacuucagaaagacuug

SEQ ID NO: 1286232 - RNA, 21 nt, Human
gaacugucucucaugaaccuc

SEQ ID NO: 1286233 - RNA, 18 nt, Human
gaacuuaaggcauuuguu

SEQ ID NO: 1286234 - RNA, 20 nt, Human
gaacuuagauuuuacaugaa

SEQ ID NO: 1286235 - RNA, 15 nt, Human
gaacucccuuucaac

SEQ ID NO: 1286236 - RNA, 17 nt, Human
gaacugucucucaugaa

SEQ ID NO: 1286237 - RNA, 14 nt, Human
gaacucccuuucaa

SEQ ID NO: 1286238 - RNA, 15 nt, Human
gaacucaacuuugac

SEQ ID NO: 1286239 - RNA, 22 nt, Human
gaacuauuuucaaagacuuaag

SEQ ID NO: 1286240 - RNA, 19 nt, Human
gaacuauuuucaaagacuu

SEQ ID NO: 1286241 - RNA, 20 nt, Human
gaacuauuuucaaagacuua

SEQ ID NO: 1286242 - RNA, 16 nt, Human
gaacucaaauggggcc

SEQ ID NO: 1286243 - RNA, 19 nt, Human
gaacucaaauggggccaga

SEQ ID NO: 1286244 - RNA, 20 nt, Human
gaacucaaauggggccagau

SEQ ID NO: 1286245 - RNA, 22 nt, Human
gaacucaaauggggccagaucc

SEQ ID NO: 1286246 - RNA, 23 nt, Human
gaacucaaauggggccagaucca

SEQ ID NO: 1286247 - RNA, 16 nt, Human
gaacucaacuuugaca

SEQ ID NO: 1286248 - RNA, 22 nt, Human
gaacuuguaaaggaauuuaaaa

SEQ ID NO: 1286249 - RNA, 14 nt, Human
gaagaaaaagaagc

SEQ ID NO: 1286250 - RNA, 20 nt, Human
gaagaaagaacggaagaaga

SEQ ID NO: 1286251 - RNA, 19 nt, Human
gaagaaagaacggaagaag

SEQ ID NO: 1286252 - RNA, 16 nt, Human
gaagaaagaacggaag

SEQ ID NO: 1286253 - RNA, 20 nt, Human
gaagaaacaagguuuucagu

SEQ ID NO: 1286254 - RNA, 21 nt, Human
gaagaagcaccaaucaugaau

SEQ ID NO: 1286255 - RNA, 21 nt, Human
gaacuuguaaaggaauuuaaa

SEQ ID NO: 1286256 - RNA, 24 nt, Human
gaacuugcgagaaauucguguguu

SEQ ID NO: 1286257 - RNA, 22 nt, Human
gaacuugccugccuuuccaucc

SEQ ID NO: 1286258 - RNA, 13 nt, Human
gaaauauuauguu

SEQ ID NO: 1286259 - RNA, 16 nt, Human
gaaauauuauguuaaa

SEQ ID NO: 1286260 - RNA, 15 nt, Human
gaaauauucccuaga

SEQ ID NO: 1286261 - RNA, 16 nt, Human
gaaauggcuuugugau

SEQ ID NO: 1286262 - RNA, 21 nt, Human
gaaaugguacuguacagcugg

SEQ ID NO: 1286263 - RNA, 18 nt, Human
gaaaugguacuguacagc

SEQ ID NO: 1286264 - RNA, 21 nt, Human
gaaauguaaggcuguguaaga

SEQ ID NO: 1286265 - RNA, 14 nt, Human
gaaauguaaggcug

SEQ ID NO: 1286266 - RNA, 21 nt, Human
gaaauguuauuuuuuaauuau

SEQ ID NO: 1286267 - RNA, 22 nt, Human
gaaauguuauuuuuuaauuauu

SEQ ID NO: 1286268 - RNA, 19 nt, Human
gaaauguuuuuaauaaaag

SEQ ID NO: 1286269 - RNA, 21 nt, Human
gaaauguuuuuaauaaaagaa

SEQ ID NO: 1286270 - RNA, 22 nt, Human
gaaauguuuuuaauaaaagaaa

SEQ ID NO: 1286271 - RNA, 17 nt, Human
gaaauuaagaaggcaaa

SEQ ID NO: 1286272 - RNA, 18 nt, Human
gaaauuaagaaggcaaaa

SEQ ID NO: 1286273 - RNA, 22 nt, Human
gaaauuaagaaggcaaaaaugu

SEQ ID NO: 1286274 - RNA, 23 nt, Human
gaaauuaagacuuuauguaguuu

SEQ ID NO: 1286275 - RNA, 17 nt, Human
gaaauuacacccaaaga

SEQ ID NO: 1286276 - RNA, 15 nt, Human
gaaauuaccugugga

SEQ ID NO: 1286277 - RNA, 16 nt, Human
gaaauuaccuguggau

SEQ ID NO: 1286278 - RNA, 15 nt, Human
gaaauucguguguuu

SEQ ID NO: 1286279 - RNA, 19 nt, Human
gaaauucguguguuuuuuu

SEQ ID NO: 1286280 - RNA, 14 nt, Human
gaaauucuccugga

SEQ ID NO: 1286281 - RNA, 15 nt, Human
gaaauucuccuggag

SEQ ID NO: 1286282 - RNA, 16 nt, Human
gaaauucuccuggagg

SEQ ID NO: 1286283 - RNA, 16 nt, Human
gaaauuggaagagcac

SEQ ID NO: 1286284 - RNA, 18 nt, Human
gaaauugcuuuguauugu

SEQ ID NO: 1286285 - RNA, 17 nt, Human
gaaauugccugacgaac

SEQ ID NO: 1286286 - RNA, 19 nt, Human
gaaauugcauuuccugaca

SEQ ID NO: 1286287 - RNA, 15 nt, Human
gaaauugauuuugaa

SEQ ID NO: 1286288 - RNA, 17 nt, Human
gaaauucuccuggaggu

SEQ ID NO: 1286289 - RNA, 17 nt, Human
gaaauucguguguuuuu

SEQ ID NO: 1286290 - RNA, 22 nt, Human
gaaauucuuucccagucugucg

SEQ ID NO: 1286291 - RNA, 23 nt, Human
gaaauucuuucccagucugucga

SEQ ID NO: 1286292 - RNA, 14 nt, Human
gaaauugaaccuuu

SEQ ID NO: 1286293 - RNA, 17 nt, Human
gaaauugaaccuuugug

SEQ ID NO: 1286294 - RNA, 21 nt, Human
gaaauugaaccuuugugcccu

SEQ ID NO: 1286295 - RNA, 13 nt, Human
gaaauugaauacu

SEQ ID NO: 1286296 - RNA, 16 nt, Human
gaaauugaauacuuug

SEQ ID NO: 1286297 - RNA, 17 nt, Human
gaaauugaauacuuuga

SEQ ID NO: 1286298 - RNA, 18 nt, Human
gaaauugaauacuuugaa

SEQ ID NO: 1286299 - RNA, 19 nt, Human
gaaauugaauacuuugaau

SEQ ID NO: 1286300 - RNA, 20 nt, Human
gaaauugaauacuuugaaug

SEQ ID NO: 1286301 - RNA, 22 nt, Human
gaaauugaauacuuugaaugug

SEQ ID NO: 1286302 - RNA, 21 nt, Human
gaaauugaauacuuugaaugu

SEQ ID NO: 1286303 - RNA, 22 nt, Human
gaaauuuuaaccuaugauauuu

SEQ ID NO: 1286304 - RNA, 15 nt, Human
gaaauuuuauaugcu

SEQ ID NO: 1286305 - RNA, 19 nt, Human
gaaauuuuauaugcuuacu

SEQ ID NO: 1286306 - RNA, 22 nt, Human
gaaauuuuauaugcuuacugau

SEQ ID NO: 1286307 - RNA, 13 nt, Human
gaacacuggggac

SEQ ID NO: 1286308 - RNA, 22 nt, Human
gaacacuggggacuuggccucu

SEQ ID NO: 1286309 - RNA, 23 nt, Human
gaacacuggggacuuggccucuc

SEQ ID NO: 1286310 - RNA, 13 nt, Human
gaaauuuaaacua

SEQ ID NO: 1286311 - RNA, 14 nt, Human
gaaauuuaaacuau

SEQ ID NO: 1286312 - RNA, 20 nt, Human
gaaauuuaaacuauaagcaa

SEQ ID NO: 1286313 - RNA, 23 nt, Human
gaaauuuaaacuauaagcaagaa

SEQ ID NO: 1286314 - RNA, 13 nt, Human
gaaauuuaaagca

SEQ ID NO: 1286315 - RNA, 14 nt, Human
gaaauuuaaagcag

SEQ ID NO: 1286316 - RNA, 22 nt, Human
gaaauuuaaagcagguucuugu

SEQ ID NO: 1286317 - RNA, 23 nt, Human
gaaauuuaaagcagguucuuguu

SEQ ID NO: 1286318 - RNA, 12 nt, Human
gaaauuuagcau

SEQ ID NO: 1286319 - RNA, 14 nt, Human
gaaauuuagcauug

SEQ ID NO: 1286320 - RNA, 16 nt, Human
gaaauuuagcauugua

SEQ ID NO: 1286321 - RNA, 18 nt, Human
gaaauuuagcauuguagu

SEQ ID NO: 1286322 - RNA, 11 nt, Human
gaaacauuugg

SEQ ID NO: 1286323 - RNA, 13 nt, Human
gaaacauuuauau

SEQ ID NO: 1286324 - RNA, 14 nt, Human
gaaauaaagucaga

SEQ ID NO: 1286325 - RNA, 19 nt, Human
gaaauaaagucagauggaa

SEQ ID NO: 1286326 - RNA, 20 nt, Human
gaaacaugacucguauaugu

SEQ ID NO: 1286327 - RNA, 17 nt, Human
gaaacaguugcauguag

SEQ ID NO: 1286328 - RNA, 19 nt, Human
gaaacaguugcauguagua

SEQ ID NO: 1286329 - RNA, 20 nt, Human
gaaacaguugcauguaguaa

SEQ ID NO: 1286330 - RNA, 23 nt, Human
gaaacaguugcauguaguaacac

SEQ ID NO: 1286331 - RNA, 18 nt, Human
gaaacaguugguaacuuu

SEQ ID NO: 1286332 - RNA, 19 nt, Human
gaaacaguugguaacuuuu

SEQ ID NO: 1286333 - RNA, 20 nt, Human
gaaacaguugguaacuuuug

SEQ ID NO: 1286334 - RNA, 21 nt, Human
gaaacaguugguaacuuuugu

SEQ ID NO: 1286335 - RNA, 23 nt, Human
gaaacaguugguaacuuuuguga

SEQ ID NO: 1286336 - RNA, 21 nt, Human
gaaauaaauguaucauagaaa

SEQ ID NO: 1286337 - RNA, 15 nt, Human
gaaauaagcuauuug

SEQ ID NO: 1286338 - RNA, 18 nt, Human
gaaauaagcuauuugaug

SEQ ID NO: 1286339 - RNA, 19 nt, Human
gaaauaagcuauuugaugu

SEQ ID NO: 1286340 - RNA, 20 nt, Human
gaaauaagcuauuugaugua

SEQ ID NO: 1286341 - RNA, 23 nt, Human
gaaauaagcuauuugauguaaua

SEQ ID NO: 1286342 - RNA, 18 nt, Human
gaaauaagugcccucucc

SEQ ID NO: 1286343 - RNA, 20 nt, Human
gaaauaagugcccucuccca

SEQ ID NO: 1286344 - RNA, 21 nt, Human
gaaauaaguuuuuguuucaca

SEQ ID NO: 1286345 - RNA, 12 nt, Human
gaaauaaugugu

SEQ ID NO: 1286346 - RNA, 13 nt, Human
gaaauaaugugua

SEQ ID NO: 1286347 - RNA, 22 nt, Human
gaaauaauguguaguucaugua

SEQ ID NO: 1286348 - RNA, 13 nt, Human
gaaauaauuguug

SEQ ID NO: 1286349 - RNA, 15 nt, Human
gaaauaauuguuguu

SEQ ID NO: 1286350 - RNA, 19 nt, Human
gaaauaauuguuguucugu

SEQ ID NO: 1286351 - RNA, 20 nt, Human
gaaauaauuguuguucuguu

SEQ ID NO: 1286352 - RNA, 22 nt, Human
gaaauaauuguuguucuguuaa

SEQ ID NO: 1286353 - RNA, 21 nt, Human
gaaauauacuuuuacaaguaa

SEQ ID NO: 1286354 - RNA, 23 nt, Human
gaaauauacuuuuacaaguaaca

SEQ ID NO: 1286355 - RNA, 19 nt, Human
gaaauaucuucacuuguca

SEQ ID NO: 1286356 - RNA, 20 nt, Human
gaaauaugaagaacugagga

SEQ ID NO: 1286357 - RNA, 17 nt, Human
gaaauaugcacaauagc

SEQ ID NO: 1286358 - RNA, 18 nt, Human
gaaauaugcacaauagca

SEQ ID NO: 1286359 - RNA, 13 nt, Human
gaaauauguauaa

SEQ ID NO: 1286360 - RNA, 18 nt, Human
gaaauacaaaaauacuca

SEQ ID NO: 1286361 - RNA, 21 nt, Human
gaaauaauuguuguucuguua

SEQ ID NO: 1286362 - RNA, 13 nt, Human
gaaauacaaaaau

SEQ ID NO: 1286363 - RNA, 14 nt, Human
gaaauacaaaaaua

SEQ ID NO: 1286364 - RNA, 17 nt, Human
gaaauacagacuggaug

SEQ ID NO: 1286365 - RNA, 17 nt, Human
gaaauacaguucugcuc

SEQ ID NO: 1286366 - RNA, 19 nt, Human
gaaauacaguucugcucug

SEQ ID NO: 1286367 - RNA, 17 nt, Human
gaaauacuacuguguaa

SEQ ID NO: 1286368 - RNA, 14 nt, Human
gaaauacuauuuaa

SEQ ID NO: 1286369 - RNA, 15 nt, Human
gaaauacuauuuaaa

SEQ ID NO: 1286370 - RNA, 21 nt, Human
gaaauacuguaugguuuuguu

SEQ ID NO: 1286371 - RNA, 16 nt, Human
gaaauagaauuauaac

SEQ ID NO: 1286372 - RNA, 18 nt, Human
gaaauagacagcaugaga

SEQ ID NO: 1286373 - RNA, 15 nt, Human
gaaauagcuuaugaa

SEQ ID NO: 1286374 - RNA, 18 nt, Human
gaaauagcuuaugaaaag

SEQ ID NO: 1286375 - RNA, 21 nt, Human
gaaauagcuuaugaaaagaau

SEQ ID NO: 1286376 - RNA, 19 nt, Human
gaaauagcuuaugaaaaga

SEQ ID NO: 1286377 - RNA, 14 nt, Human
gaauacuuuauaaa

SEQ ID NO: 1286378 - RNA, 13 nt, Human
gaauacugcuaca

SEQ ID NO: 1286379 - RNA, 16 nt, Human
gaauacuuugaaugug

SEQ ID NO: 1286380 - RNA, 17 nt, Human
gaauacuuugaaugugu

SEQ ID NO: 1286381 - RNA, 18 nt, Human
gaauacuuugaauguguu

SEQ ID NO: 1286382 - RNA, 24 nt, Human
gaauacuuugcagcacagcugaga

SEQ ID NO: 1286383 - RNA, 19 nt, Human
gaauacuuuugcccuuuga

SEQ ID NO: 1286384 - RNA, 14 nt, Human
gaauacuuuuuaca

SEQ ID NO: 1286385 - RNA, 20 nt, Human
gaauacuuuuuacaauuaaa

SEQ ID NO: 1286386 - RNA, 23 nt, Human
gaauagaaauaaaggaugugauu

SEQ ID NO: 1286387 - RNA, 17 nt, Human
gaauagaagcuaagguu

SEQ ID NO: 1286388 - RNA, 20 nt, Human
gaauaaauuguacagccggc

SEQ ID NO: 1286389 - RNA, 18 nt, Human
gaauaagcucccagggcc

SEQ ID NO: 1286390 - RNA, 15 nt, Human
gaauaaauugcuccu

SEQ ID NO: 1286391 - RNA, 16 nt, Human
gaauaaauugauuuuu

SEQ ID NO: 1286392 - RNA, 17 nt, Human
gaauaaauuguacagcc

SEQ ID NO: 1286393 - RNA, 19 nt, Human
gaauaaauuguacagccgg

SEQ ID NO: 1286394 - RNA, 14 nt, Human
gaauaaaugucacu

SEQ ID NO: 1286395 - RNA, 15 nt, Human
gaauaaaugucacuu

SEQ ID NO: 1286396 - RNA, 16 nt, Human
gaauaaaugucacuuu

SEQ ID NO: 1286397 - RNA, 18 nt, Human
gaauaaaugucacuuuuu

SEQ ID NO: 1286398 - RNA, 23 nt, Human
gaauaaaugucacuuuuugaggc

SEQ ID NO: 1286399 - RNA, 17 nt, Human
gaauaagguacaagaag

SEQ ID NO: 1286400 - RNA, 19 nt, Human
gaauaagguacaagaagca

SEQ ID NO: 1286401 - RNA, 20 nt, Human
gaauaagguacaagaagcau

SEQ ID NO: 1286402 - RNA, 23 nt, Human
gaauaagguacaagaagcauuuu

SEQ ID NO: 1286403 - RNA, 12 nt, Human
gaauaaguuauu

SEQ ID NO: 1286404 - RNA, 13 nt, Human
gaauaaguuauug

SEQ ID NO: 1286405 - RNA, 14 nt, Human
gaauaaguuauugc

SEQ ID NO: 1286406 - RNA, 16 nt, Human
gaauaaguuauugcag

SEQ ID NO: 1286407 - RNA, 18 nt, Human
gaauaaguuauugcaguu

SEQ ID NO: 1286408 - RNA, 19 nt, Human
gaauaaguuauugcaguuu

SEQ ID NO: 1286409 - RNA, 13 nt, Human
gaauaaagcaauu

SEQ ID NO: 1286410 - RNA, 11 nt, Human
gaauaaagcaa

SEQ ID NO: 1286411 - RNA, 17 nt, Human
gaauaaagaaugaaugg

SEQ ID NO: 1286412 - RNA, 14 nt, Human
gaauaaagacaccu

SEQ ID NO: 1286413 - RNA, 15 nt, Human
gaauaaacauuuguu

SEQ ID NO: 1286414 - RNA, 16 nt, Human
gaauaaacauuuguua

SEQ ID NO: 1286415 - RNA, 15 nt, Human
gaauaaaggcaguuu

SEQ ID NO: 1286416 - RNA, 16 nt, Human
gaauaaaggcaguuuu

SEQ ID NO: 1286417 - RNA, 17 nt, Human
gaauaaaggcaguuuuc

SEQ ID NO: 1286418 - RNA, 19 nt, Human
gaauaaaggcaguuuucua

SEQ ID NO: 1286419 - RNA, 20 nt, Human
gaauaaaggcaguuuucuaa

SEQ ID NO: 1286420 - RNA, 12 nt, Human
gaauaaaauuuu

SEQ ID NO: 1286421 - RNA, 11 nt, Human
gaaguuucauc

SEQ ID NO: 1286422 - RNA, 17 nt, Human
gaaguuuagcucugaga

SEQ ID NO: 1286423 - RNA, 16 nt, Human
gaaguaaacuuuuugu

SEQ ID NO: 1286424 - RNA, 19 nt, Human
gaaguaaaagcaaaaaaga

SEQ ID NO: 1286425 - RNA, 13 nt, Human
gaaguaaacuuuu

SEQ ID NO: 1286426 - RNA, 20 nt, Human
gaaguaaacuuuuuguucug

SEQ ID NO: 1286427 - RNA, 15 nt, Human
gaauagccacauuug

SEQ ID NO: 1286428 - RNA, 18 nt, Human
gaauagccacauuuggaa

SEQ ID NO: 1286429 - RNA, 23 nt, Human
gaauagccacauuuggaauacuu

SEQ ID NO: 1286430 - RNA, 19 nt, Human
gaauagauaugaaagcuga

SEQ ID NO: 1286431 - RNA, 18 nt, Human
gaauagccauauuuguaa

SEQ ID NO: 1286432 - RNA, 15 nt, Human
gaauagaugcugacu

SEQ ID NO: 1286433 - RNA, 15 nt, Human
gaauagcaugucacu

SEQ ID NO: 1286434 - RNA, 18 nt, Human
gaauagaagcuaagguuu

SEQ ID NO: 1286435 - RNA, 20 nt, Human
gaauacuuugaauguguuuc

SEQ ID NO: 1286436 - RNA, 16 nt, Human
gaauagauaugaaagc

SEQ ID NO: 1286437 - RNA, 23 nt, Human
gaauagccauauuuguaaaauga

SEQ ID NO: 1286438 - RNA, 21 nt, Human
gaaucaauaauauauuuucug

SEQ ID NO: 1286439 - RNA, 20 nt, Human
gaaucacuguuuagaacaca

SEQ ID NO: 1286440 - RNA, 17 nt, Human
gaauccacauuucuaaa

SEQ ID NO: 1286441 - RNA, 18 nt, Human
gaauccacauuucuaaaa

SEQ ID NO: 1286442 - RNA, 16 nt, Human
gaauccacauuucuaa

SEQ ID NO: 1286443 - RNA, 19 nt, Human
gaaucccagcccccugacc

SEQ ID NO: 1286444 - RNA, 22 nt, Human
gaaucccagcccccugaccacu

SEQ ID NO: 1286445 - RNA, 19 nt, Human
gaauccccaacaugcacug

SEQ ID NO: 1286446 - RNA, 16 nt, Human
gaaucccuuaacaguu

SEQ ID NO: 1286447 - RNA, 13 nt, Human
gaaucagaacuca

SEQ ID NO: 1286448 - RNA, 23 nt, Human
gaaucagagaccuuccagaaaua

SEQ ID NO: 1286449 - RNA, 18 nt, Human
gaaucagccuacaggccu

SEQ ID NO: 1286450 - RNA, 20 nt, Human
gaaucauuguauguggucau

SEQ ID NO: 1286451 - RNA, 13 nt, Human
gaaucauuuagca

SEQ ID NO: 1286452 - RNA, 22 nt, Human
gaaucauuucuauuucuccucc

SEQ ID NO: 1286453 - RNA, 24 nt, Human
gaaucauuuagcauguuguugaaa

SEQ ID NO: 1286454 - RNA, 23 nt, Human
gaaucucaguugauuuucuggau

SEQ ID NO: 1286455 - RNA, 19 nt, Human
gaaucugugggucugggag

SEQ ID NO: 1286456 - RNA, 20 nt, Human
gaaucugugggucugggagu

SEQ ID NO: 1286457 - RNA, 14 nt, Human
gaaucugugugaaa

SEQ ID NO: 1286458 - RNA, 21 nt, Human
gaaucuuaagguguagccaca

SEQ ID NO: 1286459 - RNA, 19 nt, Human
gaaucccuuaacaguugua

SEQ ID NO: 1286460 - RNA, 21 nt, Human
gaaucccuuaacaguuguauu

SEQ ID NO: 1286461 - RNA, 20 nt, Human
gaauccuaggcuccacccca

SEQ ID NO: 1286462 - RNA, 14 nt, Human
gaauccugucgauu

SEQ ID NO: 1286463 - RNA, 22 nt, Human
gaaucuuaagguguagccacac

SEQ ID NO: 1286464 - RNA, 15 nt, Human
gaaucuugguuugcc

SEQ ID NO: 1286465 - RNA, 20 nt, Human
gaaucuugguuugccuucca

SEQ ID NO: 1286466 - RNA, 23 nt, Human
gaaucuugguuugccuuccagaa

SEQ ID NO: 1286467 - RNA, 20 nt, Human
gaaggcagggaggaggcaga

SEQ ID NO: 1286468 - RNA, 18 nt, Human
gaaggcagggaggaggca

SEQ ID NO: 1286469 - RNA, 17 nt, Human
gaaggcagggaggaggc

SEQ ID NO: 1286470 - RNA, 14 nt, Human
gaaggcagggaggg

SEQ ID NO: 1286471 - RNA, 16 nt, Human
gaaggcagggaggagg

SEQ ID NO: 1286472 - RNA, 14 nt, Human
gaaggcagggagga

SEQ ID NO: 1286473 - RNA, 13 nt, Human
gaaggcagggagg

SEQ ID NO: 1286474 - RNA, 16 nt, Human
gaaggcaggcagggcu

SEQ ID NO: 1286475 - RNA, 17 nt, Human
gaaggcaggcagggcuc

SEQ ID NO: 1286476 - RNA, 18 nt, Human
gaaggcaggcagggcucu

SEQ ID NO: 1286477 - RNA, 19 nt, Human
gaaggcaggcagggcucuc

SEQ ID NO: 1286478 - RNA, 21 nt, Human
gaaggcaggcagggcucuccu

SEQ ID NO: 1286479 - RNA, 22 nt, Human
gaaggcaggcagggcucuccug

SEQ ID NO: 1286480 - RNA, 23 nt, Human
gaaggcaggcagggcucuccugg

SEQ ID NO: 1286481 - RNA, 11 nt, Human
gaaggcaagau

SEQ ID NO: 1286482 - RNA, 13 nt, Human
gaaggcaggcagg

SEQ ID NO: 1286483 - RNA, 14 nt, Human
gaaggcaggcaggg

SEQ ID NO: 1286484 - RNA, 15 nt, Human
gaaggcaggcagggc

SEQ ID NO: 1286485 - RNA, 17 nt, Human
gaagggguuggauugca

SEQ ID NO: 1286486 - RNA, 13 nt, Human
gaaggguaaacaa

SEQ ID NO: 1286487 - RNA, 17 nt, Human
gaaggguaaacaauaua

SEQ ID NO: 1286488 - RNA, 13 nt, Human
gaagguacuguau

SEQ ID NO: 1286489 - RNA, 22 nt, Human
gaagguaaauaaaaagaaaggc

SEQ ID NO: 1286490 - RNA, 20 nt, Human
gaagguuaucagugcuuccc

SEQ ID NO: 1286491 - RNA, 14 nt, Human
gaaggguaaacaau

SEQ ID NO: 1286492 - RNA, 13 nt, Human
gaagguaaauaaa

SEQ ID NO: 1286493 - RNA, 17 nt, Human
gaagguaaauaaaaaga

SEQ ID NO: 1286494 - RNA, 19 nt, Human
gaaggacuaauagaaaagu

SEQ ID NO: 1286495 - RNA, 21 nt, Human
gaaggacuaugaaaagcuaga

SEQ ID NO: 1286496 - RNA, 20 nt, Human
gaaggacuaauagaaaagua

SEQ ID NO: 1286497 - RNA, 19 nt, Human
gaaggaucccaugagcucc

SEQ ID NO: 1286498 - RNA, 15 nt, Human
gaaggcaaagcacga

SEQ ID NO: 1286499 - RNA, 20 nt, Human
gaaggagccccauuccuggg

SEQ ID NO: 1286500 - RNA, 21 nt, Human
gaaggagccccauuccuggga

SEQ ID NO: 1286501 - RNA, 22 nt, Human
gaaggagccccauuccugggaa

SEQ ID NO: 1286502 - RNA, 12 nt, Human
gaaggagcugcc

SEQ ID NO: 1286503 - RNA, 14 nt, Human
gaaggagcugccug

SEQ ID NO: 1286504 - RNA, 15 nt, Human
gaaggagcugccugg

SEQ ID NO: 1286505 - RNA, 16 nt, Human
gaaggagcugccugga

SEQ ID NO: 1286506 - RNA, 17 nt, Human
gaaggagcugccuggac

SEQ ID NO: 1286507 - RNA, 19 nt, Human
gaaggagcugccuggaccc

SEQ ID NO: 1286508 - RNA, 18 nt, Human
gaaggagcugccuggacc

SEQ ID NO: 1286509 - RNA, 22 nt, Human
gaagccacgguguucugugaua

SEQ ID NO: 1286510 - RNA, 15 nt, Human
gaagacuccuagcug

SEQ ID NO: 1286511 - RNA, 17 nt, Human
gaagacugcauuauauu

SEQ ID NO: 1286512 - RNA, 20 nt, Human
gaagccacgggugccagaag

SEQ ID NO: 1286513 - RNA, 13 nt, Human
gaagccagcuugu

SEQ ID NO: 1286514 - RNA, 18 nt, Human
gaagccagcuuguuuaca

SEQ ID NO: 1286515 - RNA, 22 nt, Human
gaagccagcuuucccugccucu

SEQ ID NO: 1286516 - RNA, 19 nt, Human
gaagccaggaauuucccag

SEQ ID NO: 1286517 - RNA, 21 nt, Human
gaagccaggaauuucccagga

SEQ ID NO: 1286518 - RNA, 23 nt, Human
gaagccaggaauuucccaggacc

SEQ ID NO: 1286519 - RNA, 24 nt, Human
gaagccaggaauuucccaggaccc

SEQ ID NO: 1286520 - RNA, 22 nt, Human
gaagccagcuuguuuacaugcu

SEQ ID NO: 1286521 - RNA, 17 nt, Human
gaagccaucaccucaga

SEQ ID NO: 1286522 - RNA, 18 nt, Human
gaagccaucaccucagau

SEQ ID NO: 1286523 - RNA, 20 nt, Human
gaagccaucaccucagaugg

SEQ ID NO: 1286524 - RNA, 22 nt, Human
gaagccaucaccucagauggca

SEQ ID NO: 1286525 - RNA, 23 nt, Human
gaagccaugaguuccagaaagua

SEQ ID NO: 1286526 - RNA, 19 nt, Human
gaagccuccuuagaaaaaa

SEQ ID NO: 1286527 - RNA, 19 nt, Human
gaagccucagauuccuucc

SEQ ID NO: 1286528 - RNA, 20 nt, Human
gaagccucagauuccuuccc

SEQ ID NO: 1286529 - RNA, 21 nt, Human
gaagccucagauuccuuccca

SEQ ID NO: 1286530 - RNA, 22 nt, Human
gaagccucagauuccuucccau

SEQ ID NO: 1286531 - RNA, 22 nt, Human
gaagccguccuggcgccuggca

SEQ ID NO: 1286532 - RNA, 20 nt, Human
gaagccgugcucgccccagc

SEQ ID NO: 1286533 - RNA, 16 nt, Human
gaagccucagauuccu

SEQ ID NO: 1286534 - RNA, 14 nt, Human
gaagcccagagggu

SEQ ID NO: 1286535 - RNA, 18 nt, Human
gaagcccaauugcuggag

SEQ ID NO: 1286536 - RNA, 13 nt, Human
gaagcccagaggg

SEQ ID NO: 1286537 - RNA, 17 nt, Human
gaagcccagagggucug

SEQ ID NO: 1286538 - RNA, 18 nt, Human
gaagcuuuuaugugaaac

SEQ ID NO: 1286539 - RNA, 20 nt, Human
gaagcuuuggugagaaccug

SEQ ID NO: 1286540 - RNA, 18 nt, Human
gaagcuuggggaagaccc

SEQ ID NO: 1286541 - RNA, 19 nt, Human
gaagcuuggggaagaccca

SEQ ID NO: 1286542 - RNA, 14 nt, Human
gaagcuuuggugag

SEQ ID NO: 1286543 - RNA, 21 nt, Human
gaagccuuggggcugaugcag

SEQ ID NO: 1286544 - RNA, 10 nt, Human
gaagccuuug

SEQ ID NO: 1286545 - RNA, 11 nt, Human
gaagccuuugu

SEQ ID NO: 1286546 - RNA, 13 nt, Human
cuuuccacagaag

SEQ ID NO: 1286547 - RNA, 17 nt, Human
cuuucccaacaccucuu

SEQ ID NO: 1286548 - RNA, 15 nt, Human
cuuuccaccacagcc

SEQ ID NO: 1286549 - RNA, 17 nt, Human
cuuuccaccacagccag

SEQ ID NO: 1286550 - RNA, 21 nt, Human
cuuuccaccacagccagcacc

SEQ ID NO: 1286551 - RNA, 22 nt, Human
cuuuccaccacagccagcaccu

SEQ ID NO: 1286552 - RNA, 23 nt, Human
cuuuccaccacagccagcaccug

SEQ ID NO: 1286553 - RNA, 14 nt, Human
cuuucauuugcuuu

SEQ ID NO: 1286554 - RNA, 18 nt, Human
cuuucauuugcuuuggaa

SEQ ID NO: 1286555 - RNA, 17 nt, Human
cuuucauuuucucucag

SEQ ID NO: 1286556 - RNA, 18 nt, Human
cuuucauuuucucucagg

SEQ ID NO: 1286557 - RNA, 21 nt, Human
cuuucauuuucucucagguga

SEQ ID NO: 1286558 - RNA, 19 nt, Human
cuuucauuuucucucaggu

SEQ ID NO: 1286559 - RNA, 13 nt, Human
cuuucauauaguu

SEQ ID NO: 1286560 - RNA, 16 nt, Human
cuuucauauuuuaaac

SEQ ID NO: 1286561 - RNA, 19 nt, Human
cuuucauauuuuaaacaga

SEQ ID NO: 1286562 - RNA, 23 nt, Human
cuuucauauuuuaaacagaggau

SEQ ID NO: 1286563 - RNA, 23 nt, Human
cuuucauauaguuagcuaauaaa

SEQ ID NO: 1286564 - RNA, 16 nt, Human
cuuucaucacacuggg

SEQ ID NO: 1286565 - RNA, 19 nt, Human
cuuucaucacacugggugg

SEQ ID NO: 1286566 - RNA, 15 nt, Human
cuuucauuucuucua

SEQ ID NO: 1286567 - RNA, 18 nt, Human
cuuucaucacacugggug

SEQ ID NO: 1286568 - RNA, 21 nt, Human
cuuuauuuucuauaauuuaaa

SEQ ID NO: 1286569 - RNA, 22 nt, Human
cuuuauuuguuaauaguuccug

SEQ ID NO: 1286570 - RNA, 22 nt, Human
cuuuauuuuaaccuuugauaga

SEQ ID NO: 1286571 - RNA, 23 nt, Human
cuuuauuccagaaugcuguacau

SEQ ID NO: 1286572 - RNA, 18 nt, Human
cuuuauuccuucauuuca

SEQ ID NO: 1286573 - RNA, 16 nt, Human
cuuuauuggcugagau

SEQ ID NO: 1286574 - RNA, 18 nt, Human
cuuuauuggcugagauau

SEQ ID NO: 1286575 - RNA, 19 nt, Human
cuuuauaagaaagccugag

SEQ ID NO: 1286576 - RNA, 18 nt, Human
cuuuauaacuaacauguc

SEQ ID NO: 1286577 - RNA, 13 nt, Human
cuuuauaaaugua

SEQ ID NO: 1286578 - RNA, 12 nt, Human
cuuuauaagaaa

SEQ ID NO: 1286579 - RNA, 13 nt, Human
cuuuauaagaaag

SEQ ID NO: 1286580 - RNA, 15 nt, Human
cuuuauaagaaagcc

SEQ ID NO: 1286581 - RNA, 16 nt, Human
cuuuauaagaaagccu

SEQ ID NO: 1286582 - RNA, 18 nt, Human
cuuuauaagaaagccuga

SEQ ID NO: 1286583 - RNA, 20 nt, Human
cuuuauucuggcagaggagg

SEQ ID NO: 1286584 - RNA, 20 nt, Human
cuuuauuccagaaugcugua

SEQ ID NO: 1286585 - RNA, 20 nt, Human
cuuuauguuacuacaugcac

SEQ ID NO: 1286586 - RNA, 14 nt, Human
cuuuauuaaaaacu

SEQ ID NO: 1286587 - RNA, 17 nt, Human
cuuuauuaaaaacugag

SEQ ID NO: 1286588 - RNA, 16 nt, Human
cuuuagaauaugccuu

SEQ ID NO: 1286589 - RNA, 14 nt, Human
cuuuagaagccugc

SEQ ID NO: 1286590 - RNA, 15 nt, Human
cuuuagaaucccagc

SEQ ID NO: 1286591 - RNA, 15 nt, Human
cuuuagaagccugca

SEQ ID NO: 1286592 - RNA, 18 nt, Human
cuuuagaaucccagcccc

SEQ ID NO: 1286593 - RNA, 20 nt, Human
cuuuagaaucccagcccccu

SEQ ID NO: 1286594 - RNA, 21 nt, Human
cuuuagaaucccagcccccug

SEQ ID NO: 1286595 - RNA, 14 nt, Human
cuuuacuuuuaaac

SEQ ID NO: 1286596 - RNA, 14 nt, Human
cuuuagaaacagug

SEQ ID NO: 1286597 - RNA, 23 nt, Human
cuuuagaaacagugcaacacugg

SEQ ID NO: 1286598 - RNA, 16 nt, Human
cuuuacuuaaaaauau

SEQ ID NO: 1286599 - RNA, 21 nt, Human
cuuguuuuuuuuuuccacuua

SEQ ID NO: 1286600 - RNA, 23 nt, Human
cuuguuuuuuguuuguuuguugc

SEQ ID NO: 1286601 - RNA, 19 nt, Human
cuuguuuuuuuuuuccacu

SEQ ID NO: 1286602 - RNA, 20 nt, Human
cuuguuuuuuuuuuccacuu

SEQ ID NO: 1286603 - RNA, 14 nt, Human
cuuguuuucuggga

SEQ ID NO: 1286604 - RNA, 14 nt, Human
cuuguuuuggacag

SEQ ID NO: 1286605 - RNA, 13 nt, Human
cuuguuuuggaug

SEQ ID NO: 1286606 - RNA, 14 nt, Human
cuuguuuuggaugc

SEQ ID NO: 1286607 - RNA, 12 nt, Human
cuuguuuuugca

SEQ ID NO: 1286608 - RNA, 16 nt, Human
cuuguuuuugcacaug

SEQ ID NO: 1286609 - RNA, 16 nt, Human
cuuguggcagcaacgg

SEQ ID NO: 1286610 - RNA, 12 nt, Human
cuugugggccug

SEQ ID NO: 1286611 - RNA, 14 nt, Human
cuugugggccuggg

SEQ ID NO: 1286612 - RNA, 15 nt, Human
cuugugggccugggc

SEQ ID NO: 1286613 - RNA, 16 nt, Human
cuugugggccugggcu

SEQ ID NO: 1286614 - RNA, 17 nt, Human
cuugugggccugggcuc

SEQ ID NO: 1286615 - RNA, 19 nt, Human
cuugugggccugggcuccu

SEQ ID NO: 1286616 - RNA, 21 nt, Human
cuugugggccugggcuccugg

SEQ ID NO: 1286617 - RNA, 23 nt, Human
cuugugggccugggcuccuggac

SEQ ID NO: 1286618 - RNA, 12 nt, Human
cuuguggggccu

SEQ ID NO: 1286619 - RNA, 22 nt, Human
cuugugggccugggcuccugga

SEQ ID NO: 1286620 - RNA, 13 nt, Human
cuuguguuggcug

SEQ ID NO: 1286621 - RNA, 14 nt, Human
cuuguguuggcugu

SEQ ID NO: 1286622 - RNA, 17 nt, Human
cuuguguuggcuguggc

SEQ ID NO: 1286623 - RNA, 23 nt, Human
cuuguuggcguaggcuacagaga

SEQ ID NO: 1286624 - RNA, 22 nt, Human
cuuguuggcguaggcuacagag

SEQ ID NO: 1286625 - RNA, 17 nt, Human
cuuguugugcuuuuagu

SEQ ID NO: 1286626 - RNA, 15 nt, Human
cuuguugugcuuuua

SEQ ID NO: 1286627 - RNA, 16 nt, Human
cuuguuguuucuugcc

SEQ ID NO: 1286628 - RNA, 15 nt, Human
cuuguuguuucuugc

SEQ ID NO: 1286629 - RNA, 17 nt, Human
cuuguuuggggcaggag

SEQ ID NO: 1286630 - RNA, 18 nt, Human
cuuguuuggggcaggagu

SEQ ID NO: 1286631 - RNA, 19 nt, Human
cuuguuuggggcaggagua

SEQ ID NO: 1286632 - RNA, 19 nt, Human
cuuguaaaggaauuuaaaa

SEQ ID NO: 1286633 - RNA, 22 nt, Human
cuuggggagaccucuacugccu

SEQ ID NO: 1286634 - RNA, 19 nt, Human
cuuggggaguuaagaccug

SEQ ID NO: 1286635 - RNA, 20 nt, Human
cuuggggaguuaagaccugg

SEQ ID NO: 1286636 - RNA, 21 nt, Human
cuuggggaguuaagaccuggc

SEQ ID NO: 1286637 - RNA, 22 nt, Human
cuugggcagagcuggcucugag

SEQ ID NO: 1286638 - RNA, 23 nt, Human
cuugggcagagcuggcucugagc

SEQ ID NO: 1286639 - RNA, 14 nt, Human
cuugggcagcaucc

SEQ ID NO: 1286640 - RNA, 22 nt, Human
cuuggaguauuggggucugacc

SEQ ID NO: 1286641 - RNA, 14 nt, Human
cuuggcuggaccca

SEQ ID NO: 1286642 - RNA, 15 nt, Human
cuuggcuggacccag

SEQ ID NO: 1286643 - RNA, 16 nt, Human
cuuggcuggacccagc

SEQ ID NO: 1286644 - RNA, 17 nt, Human
cuuggcuggacccagcc

SEQ ID NO: 1286645 - RNA, 18 nt, Human
cuuggcuggacccagcca

SEQ ID NO: 1286646 - RNA, 11 nt, Human
cuuggcuggug

SEQ ID NO: 1286647 - RNA, 20 nt, Human
cuuggcuggacccagccagg

SEQ ID NO: 1286648 - RNA, 22 nt, Human
cuugggaaaggugguguuucug

SEQ ID NO: 1286649 - RNA, 18 nt, Human
cuugggaagacuccuagc

SEQ ID NO: 1286650 - RNA, 20 nt, Human
cuugggaagacuccuagcug

SEQ ID NO: 1286651 - RNA, 21 nt, Human
cuugggaagacuccuagcugu

SEQ ID NO: 1286652 - RNA, 10 nt, Human
cuugggaaug

SEQ ID NO: 1286653 - RNA, 18 nt, Human
cuugggaauggauccugg

SEQ ID NO: 1286654 - RNA, 13 nt, Human
cuugggaauuuua

SEQ ID NO: 1286655 - RNA, 20 nt, Human
cuugggacuaaaugcccugc

SEQ ID NO: 1286656 - RNA, 19 nt, Human
cuugggacuaaaugcccug

SEQ ID NO: 1286657 - RNA, 14 nt, Human
cuugggcagagcug

SEQ ID NO: 1286658 - RNA, 15 nt, Human
cuugggcagagcugg

SEQ ID NO: 1286659 - RNA, 18 nt, Human
cuugggcagagcuggcuc

SEQ ID NO: 1286660 - RNA, 19 nt, Human
cuugggcagagcuggcucu

SEQ ID NO: 1286661 - RNA, 20 nt, Human
cuugggcagagcuggcucug

SEQ ID NO: 1286662 - RNA, 17 nt, Human
cuuggagcugagcaaau

SEQ ID NO: 1286663 - RNA, 14 nt, Human
cuuggagcugagca

SEQ ID NO: 1286664 - RNA, 14 nt, Human
cuuggagcugugag

SEQ ID NO: 1286665 - RNA, 17 nt, Human
cuuggaggagaugggga

SEQ ID NO: 1286666 - RNA, 18 nt, Human
cuuggaguauuggggucu

SEQ ID NO: 1286667 - RNA, 23 nt, Human
cuuggagcugugaguucucccug

SEQ ID NO: 1286668 - RNA, 14 nt, Human
cuugccacugccuc

SEQ ID NO: 1286669 - RNA, 15 nt, Human
cuugccacugccucu

SEQ ID NO: 1286670 - RNA, 11 nt, Human
cuugccagaga

SEQ ID NO: 1286671 - RNA, 12 nt, Human
cuugccagagau

SEQ ID NO: 1286672 - RNA, 16 nt, Human
cuugccagagauccaa

SEQ ID NO: 1286673 - RNA, 23 nt, Human
cuugccagagauccaaaagaagc

SEQ ID NO: 1286674 - RNA, 18 nt, Human
cuugcccuggugccucac

SEQ ID NO: 1286675 - RNA, 17 nt, Human
cuugcccgcucaggcug

SEQ ID NO: 1286676 - RNA, 15 nt, Human
cuugcccuaagcaga

SEQ ID NO: 1286677 - RNA, 16 nt, Human
cuugcccuaagcagaa

SEQ ID NO: 1286678 - RNA, 18 nt, Human
cuugcccuaagcagaaag

SEQ ID NO: 1286679 - RNA, 16 nt, Human
cuugccccccuggccu

SEQ ID NO: 1286680 - RNA, 21 nt, Human
cuugccccccuggccuccccc

SEQ ID NO: 1286681 - RNA, 22 nt, Human
cuugccccccuggccuccccca

SEQ ID NO: 1286682 - RNA, 15 nt, Human
cuugcugugaauuaa

SEQ ID NO: 1286683 - RNA, 19 nt, Human
cuugcuuuucaugcaaacu

SEQ ID NO: 1286684 - RNA, 15 nt, Human
cuugcuuauuugaca

SEQ ID NO: 1286685 - RNA, 15 nt, Human
cuugcuuaccucuca

SEQ ID NO: 1286686 - RNA, 16 nt, Human
cuuggaacauuggaau

SEQ ID NO: 1286687 - RNA, 15 nt, Human
cuuggaacugaaggg

SEQ ID NO: 1286688 - RNA, 11 nt, Human
cuuggaacugc

SEQ ID NO: 1286689 - RNA, 13 nt, Human
cuuggaacugcau

SEQ ID NO: 1286690 - RNA, 15 nt, Human
cuuggaacuugccug

SEQ ID NO: 1286691 - RNA, 19 nt, Human
cuuggaacuugccugccuu

SEQ ID NO: 1286692 - RNA, 22 nt, Human
cuuggaacuugccugccuuucc

SEQ ID NO: 1286693 - RNA, 23 nt, Human
cuuggaacuugccugccuuucca

SEQ ID NO: 1286694 - RNA, 14 nt, Human
cuuuuuucuaaagu

SEQ ID NO: 1286695 - RNA, 20 nt, Human
cuuuuuucucugauacagaa

SEQ ID NO: 1286696 - RNA, 12 nt, Human
cuuuuuucccca

SEQ ID NO: 1286697 - RNA, 15 nt, Human
cuuuuuuccccagac

SEQ ID NO: 1286698 - RNA, 12 nt, Human
cuuuugacacug

SEQ ID NO: 1286699 - RNA, 17 nt, Human
cuuuugacacugcucua

SEQ ID NO: 1286700 - RNA, 18 nt, Human
cuuuugacacugcucuaa

SEQ ID NO: 1286701 - RNA, 22 nt, Human
cuuuuuucucugauacagaaaa

SEQ ID NO: 1286702 - RNA, 16 nt, Human
cuuuuuuggccaucug

SEQ ID NO: 1286703 - RNA, 12 nt, Human
gaaaaaguaacu

SEQ ID NO: 1286704 - RNA, 14 nt, Human
gaaaaaguuuguuu

SEQ ID NO: 1286705 - RNA, 13 nt, Human
gaaaaauaaagaa

SEQ ID NO: 1286706 - RNA, 22 nt, Human
gaaaacaauaacgauaaaagac

SEQ ID NO: 1286707 - RNA, 14 nt, Human
gaaaaauaaagaaa

SEQ ID NO: 1286708 - RNA, 17 nt, Human
gaaaaauaaagaaaaga

SEQ ID NO: 1286709 - RNA, 19 nt, Human
gaaaaauaaagaaaagaug

SEQ ID NO: 1286710 - RNA, 14 nt, Human
gaaaacaugcagaa

SEQ ID NO: 1286711 - RNA, 18 nt, Human
gaaaaccaagccguggcu

SEQ ID NO: 1286712 - RNA, 19 nt, Human
gaaaaccaagccguggcuu

SEQ ID NO: 1286713 - RNA, 21 nt, Human
gaaaaccaagccguggcuucc

SEQ ID NO: 1286714 - RNA, 15 nt, Human
gaaaaccagcucagc

SEQ ID NO: 1286715 - RNA, 20 nt, Human
gaaaaccagcucagcacugc

SEQ ID NO: 1286716 - RNA, 16 nt, Human
gaaaagcuaagagaag

SEQ ID NO: 1286717 - RNA, 23 nt, Human
gaaaagcuagaauugaguguuua

SEQ ID NO: 1286718 - RNA, 19 nt, Human
gaaaauaacgauaaaagac

SEQ ID NO: 1286719 - RNA, 18 nt, Human
gaaaauaagaauagaaau

SEQ ID NO: 1286720 - RNA, 17 nt, Human
gaaaauaagagcucagg

SEQ ID NO: 1286721 - RNA, 19 nt, Human
gaaaauaagagcucaggau

SEQ ID NO: 1286722 - RNA, 13 nt, Human
gaaaauaaggcac

SEQ ID NO: 1286723 - RNA, 21 nt, Human
gaaaauaaggcacccaucugu

SEQ ID NO: 1286724 - RNA, 18 nt, Human
gaaaauaaucauucuuau

SEQ ID NO: 1286725 - RNA, 12 nt, Human
gaaaauaucacu

SEQ ID NO: 1286726 - RNA, 19 nt, Human
gaaaaucuuauaauuuaaa

SEQ ID NO: 1286727 - RNA, 22 nt, Human
gaaacacccucacacugggacu

SEQ ID NO: 1286728 - RNA, 19 nt, Human
gaaacacccucacacuggg

SEQ ID NO: 1286729 - RNA, 18 nt, Human
gaaacacccucacacugg

SEQ ID NO: 1286730 - RNA, 22 nt, Human
gaaacacugggcuucuagaacc

SEQ ID NO: 1286731 - RNA, 20 nt, Human
gaaaaucuuauaauuuaaaa

SEQ ID NO: 1286732 - RNA, 14 nt, Human
gaaacacagaaacc

SEQ ID NO: 1286733 - RNA, 15 nt, Human
gaaaaucaaauggua

SEQ ID NO: 1286734 - RNA, 16 nt, Human
gaaacacuuugcauaa

SEQ ID NO: 1286735 - RNA, 11 nt, Human
gaaacagaaaa

SEQ ID NO: 1286736 - RNA, 22 nt, Human
gaaacagaaaaauauguaccaa

SEQ ID NO: 1286737 - RNA, 14 nt, Human
gaaacagaaacaaa

SEQ ID NO: 1286738 - RNA, 22 nt, Human
gaaacagaaacaaaaacacuaa

SEQ ID NO: 1286739 - RNA, 13 nt, Human
gaaacagcaucuc

SEQ ID NO: 1286740 - RNA, 17 nt, Human
gaaacagcaucuccaag

SEQ ID NO: 1286741 - RNA, 18 nt, Human
gaaacagcaucuccaagc

SEQ ID NO: 1286742 - RNA, 15 nt, Human
gaaacagcucgacuu

SEQ ID NO: 1286743 - RNA, 20 nt, Human
gaaacagcucgacuuuaaaa

SEQ ID NO: 1286744 - RNA, 17 nt, Human
cuuuucuccucacugua

SEQ ID NO: 1286745 - RNA, 17 nt, Human
cuuuucucugguaauau

SEQ ID NO: 1286746 - RNA, 19 nt, Human
cuuuucccccauuaaucag

SEQ ID NO: 1286747 - RNA, 20 nt, Human
cuuuucccucuuuggcuccc

SEQ ID NO: 1286748 - RNA, 22 nt, Human
cuuuucccucuuuggcuccccu

SEQ ID NO: 1286749 - RNA, 14 nt, Human
cuuuucccaaccau

SEQ ID NO: 1286750 - RNA, 13 nt, Human
cuuuucccacucc

SEQ ID NO: 1286751 - RNA, 17 nt, Human
cuuuucccacuccaagc

SEQ ID NO: 1286752 - RNA, 18 nt, Human
cuuuucccacuguuuaag

SEQ ID NO: 1286753 - RNA, 21 nt, Human
cuuuucccauuuaucuaaaua

SEQ ID NO: 1286754 - RNA, 22 nt, Human
cuuuucccacuccaagcccagc

SEQ ID NO: 1286755 - RNA, 23 nt, Human
cuuuucccccauuaaucaguuca

SEQ ID NO: 1286756 - RNA, 18 nt, Human
cuuuucuggaauguaauc

SEQ ID NO: 1286757 - RNA, 19 nt, Human
cuuuucuggaauguaauca

SEQ ID NO: 1286758 - RNA, 16 nt, Human
cuuuucugaccaaaga

SEQ ID NO: 1286759 - RNA, 13 nt, Human
cuuuucuguaauu

SEQ ID NO: 1286760 - RNA, 14 nt, Human
cuuuucuguaauuc

SEQ ID NO: 1286761 - RNA, 15 nt, Human
cuuuucuguaauuca

SEQ ID NO: 1286762 - RNA, 16 nt, Human
cuuuucuguaauucag

SEQ ID NO: 1286763 - RNA, 20 nt, Human
cuuuuacguccaucucuugu

SEQ ID NO: 1286764 - RNA, 16 nt, Human
cuuuuacccuggcccc

SEQ ID NO: 1286765 - RNA, 19 nt, Human
cuuuuacccuggccccucu

SEQ ID NO: 1286766 - RNA, 21 nt, Human
cuuuuacccuggccccucucc

SEQ ID NO: 1286767 - RNA, 22 nt, Human
cuuuuacccuggccccucuccc

SEQ ID NO: 1286768 - RNA, 23 nt, Human
cuuuuacccuggccccucucccu

SEQ ID NO: 1286769 - RNA, 12 nt, Human
cuuuuaauucau

SEQ ID NO: 1286770 - RNA, 13 nt, Human
cuuuuaauucauu

SEQ ID NO: 1286771 - RNA, 14 nt, Human
cuuuuaauuuuccu

SEQ ID NO: 1286772 - RNA, 23 nt, Human
cuuuuacaaguaacaaaaauaaa

SEQ ID NO: 1286773 - RNA, 15 nt, Human
cuuuuacccuggccc

SEQ ID NO: 1286774 - RNA, 17 nt, Human
cuuuguuucguggggag

SEQ ID NO: 1286775 - RNA, 18 nt, Human
cuuuguuucguggggagg

SEQ ID NO: 1286776 - RNA, 14 nt, Human
cuuuguuucucccc

SEQ ID NO: 1286777 - RNA, 15 nt, Human
cuuuguuucuccccc

SEQ ID NO: 1286778 - RNA, 16 nt, Human
cuuuguuucuccccca

SEQ ID NO: 1286779 - RNA, 15 nt, Human
cuuuguuuggcuggg

SEQ ID NO: 1286780 - RNA, 18 nt, Human
cuuuucacugcuguuaua

SEQ ID NO: 1286781 - RNA, 20 nt, Human
cuuuucacugcuguuauauu

SEQ ID NO: 1286782 - RNA, 17 nt, Human
cuuuucacugcuggcug

SEQ ID NO: 1286783 - RNA, 14 nt, Human
cuuuuacucugccu

SEQ ID NO: 1286784 - RNA, 18 nt, Human
cuuuucacugcuggcugc

SEQ ID NO: 1286785 - RNA, 20 nt, Human
cuuuucacugcuggcugccu

SEQ ID NO: 1286786 - RNA, 18 nt, Human
cuuuucauacauuuucua

SEQ ID NO: 1286787 - RNA, 18 nt, Human
cuuuucauaggucugaaa

SEQ ID NO: 1286788 - RNA, 20 nt, Human
cuuuucauaggucugaaauu

SEQ ID NO: 1286789 - RNA, 13 nt, Human
cuuuucaugcaaa

SEQ ID NO: 1286790 - RNA, 14 nt, Human
cuuuucaugcaaac

SEQ ID NO: 1286791 - RNA, 15 nt, Human
cuuuucaugcaaacu

SEQ ID NO: 1286792 - RNA, 17 nt, Human
cuuuucaugcaaacucu

SEQ ID NO: 1286793 - RNA, 19 nt, Human
cuuuucaugcaaacucuuu

SEQ ID NO: 1286794 - RNA, 20 nt, Human
cuuuucaugcaaacucuuug

SEQ ID NO: 1286795 - RNA, 18 nt, Human
cuuuucccaaaauguuga

SEQ ID NO: 1286796 - RNA, 22 nt, Human
cuuuucccaaaauguugaaaua

SEQ ID NO: 1286797 - RNA, 22 nt, Human
cuuuucccaaagcaucccucuu

SEQ ID NO: 1286798 - RNA, 18 nt, Human
cuuugcugagccuguaaa

SEQ ID NO: 1286799 - RNA, 18 nt, Human
cuuugcugacccucccca

SEQ ID NO: 1286800 - RNA, 23 nt, Human
cuuugcugacccuccccaaaggc

SEQ ID NO: 1286801 - RNA, 15 nt, Human
cuuugcugcauggca

SEQ ID NO: 1286802 - RNA, 17 nt, Human
cuuugcugugaggcugu

SEQ ID NO: 1286803 - RNA, 21 nt, Human
cuuugcugugaggcuguccug

SEQ ID NO: 1286804 - RNA, 22 nt, Human
cuuugcugugaggcuguccugu

SEQ ID NO: 1286805 - RNA, 18 nt, Human
cuuuggaaguuuagcucu

SEQ ID NO: 1286806 - RNA, 20 nt, Human
cuuuggaaguuuagcucuga

SEQ ID NO: 1286807 - RNA, 22 nt, Human
cuuuggaaguuuagcucugaga

SEQ ID NO: 1286808 - RNA, 15 nt, Human
cuuucccaccccaac

SEQ ID NO: 1286809 - RNA, 21 nt, Human
cuuucccaccccaaccugcuc

SEQ ID NO: 1286810 - RNA, 22 nt, Human
cuuucccaccccaaccugcucu

SEQ ID NO: 1286811 - RNA, 22 nt, Human
cuuucccaccccacgccuuauc

SEQ ID NO: 1286812 - RNA, 23 nt, Human
cuuucccaccccaaccugcucuc

SEQ ID NO: 1286813 - RNA, 15 nt, Human
cuuucccagucuguc

SEQ ID NO: 1286814 - RNA, 16 nt, Human
cuuucccauggggagg

SEQ ID NO: 1286815 - RNA, 17 nt, Human
cuuucccagucugucga

SEQ ID NO: 1286816 - RNA, 17 nt, Human
cuuugcucuucaagaaa

SEQ ID NO: 1286817 - RNA, 13 nt, Human
cuuugcugacccu

SEQ ID NO: 1286818 - RNA, 14 nt, Human
cuuugcugacccuc

SEQ ID NO: 1286819 - RNA, 20 nt, Human
cuuuggaccuaaauggccuc

SEQ ID NO: 1286820 - RNA, 21 nt, Human
cuuuggaccuaaauggccuca

SEQ ID NO: 1286821 - RNA, 21 nt, Human
cuuuggaaguuuagcucugag

SEQ ID NO: 1286822 - RNA, 18 nt, Human
cuuuggcuuauaauucuu

SEQ ID NO: 1286823 - RNA, 21 nt, Human
cuuuggcuuauaauucuuuca

SEQ ID NO: 1286824 - RNA, 18 nt, Human
cuuuguucauagcccagu

SEQ ID NO: 1286825 - RNA, 12 nt, Human
cuuuguucccca

SEQ ID NO: 1286826 - RNA, 16 nt, Human
cuuuguuccccacugg

SEQ ID NO: 1286827 - RNA, 18 nt, Human
cuuuguuccccacuggag

SEQ ID NO: 1286828 - RNA, 19 nt, Human
cuuuguuccccacuggagc

SEQ ID NO: 1286829 - RNA, 22 nt, Human
cuuuguuccccacuggagcaga

SEQ ID NO: 1286830 - RNA, 22 nt, Human
cuucagucucuauaccaauaaa

SEQ ID NO: 1286831 - RNA, 23 nt, Human
cuucagucucuauaccaauaaag

SEQ ID NO: 1286832 - RNA, 23 nt, Human
cuucauggaugggggaacucaga

SEQ ID NO: 1286833 - RNA, 15 nt, Human
cuucauggcagaagg

SEQ ID NO: 1286834 - RNA, 21 nt, Human
cuucauggcagaaggcaaacc

SEQ ID NO: 1286835 - RNA, 13 nt, Human
cuucauguguccc

SEQ ID NO: 1286836 - RNA, 14 nt, Human
cuucauguguccca

SEQ ID NO: 1286837 - RNA, 15 nt, Human
cuucaugugucccag

SEQ ID NO: 1286838 - RNA, 16 nt, Human
cuucaugugucccaga

SEQ ID NO: 1286839 - RNA, 17 nt, Human
cuucaugugucccagaa

SEQ ID NO: 1286840 - RNA, 20 nt, Human
cuucaugugucccagaagau

SEQ ID NO: 1286841 - RNA, 21 nt, Human
cuucagucucuauaccaauaa

SEQ ID NO: 1286842 - RNA, 17 nt, Human
cuucagucucuauacca

SEQ ID NO: 1286843 - RNA, 13 nt, Human
cuucagucucuau

SEQ ID NO: 1286844 - RNA, 22 nt, Human
cuucaguaaaugugauucaccu

SEQ ID NO: 1286845 - RNA, 18 nt, Human
cuucagguugguuuaauc

SEQ ID NO: 1286846 - RNA, 16 nt, Human
cuuccaaacuaauuuu

SEQ ID NO: 1286847 - RNA, 17 nt, Human
cuuccaaugucuggaga

SEQ ID NO: 1286848 - RNA, 18 nt, Human
cuuccaaugucuggagac

SEQ ID NO: 1286849 - RNA, 24 nt, Human
cuucauuugggaugcuacucuagu

SEQ ID NO: 1286850 - RNA, 19 nt, Human
cuuccaaacaggcucagag

SEQ ID NO: 1286851 - RNA, 14 nt, Human
cuuccaaaaauuac

SEQ ID NO: 1286852 - RNA, 16 nt, Human
cuucagcgguuuauau

SEQ ID NO: 1286853 - RNA, 21 nt, Human
cuucaggcccccgccuuggcc

SEQ ID NO: 1286854 - RNA, 10 nt, Human
cuucaggucc

SEQ ID NO: 1286855 - RNA, 18 nt, Human
cuucagguccaggcugug

SEQ ID NO: 1286856 - RNA, 17 nt, Human
cuucagguccaggcugu

SEQ ID NO: 1286857 - RNA, 14 nt, Human
cuucagcugccagu

SEQ ID NO: 1286858 - RNA, 16 nt, Human
cuucaggacacucacu

SEQ ID NO: 1286859 - RNA, 19 nt, Human
cuucaggacacucacuaca

SEQ ID NO: 1286860 - RNA, 17 nt, Human
cuucaggaucaaguccu

SEQ ID NO: 1286861 - RNA, 22 nt, Human
cuucaggcccccgccuuggccu

SEQ ID NO: 1286862 - RNA, 16 nt, Human
cuucagcacuuuagaa

SEQ ID NO: 1286863 - RNA, 15 nt, Human
cuucagcacuuuaga

SEQ ID NO: 1286864 - RNA, 14 nt, Human
cuucagcacuuuag

SEQ ID NO: 1286865 - RNA, 20 nt, Human
cuucagcaaguuagaacuag

SEQ ID NO: 1286866 - RNA, 15 nt, Human
cuucagccugaaaga

SEQ ID NO: 1286867 - RNA, 19 nt, Human
cuucagagagcagugcuuu

SEQ ID NO: 1286868 - RNA, 20 nt, Human
cuucagagagcagugcuuuu

SEQ ID NO: 1286869 - RNA, 22 nt, Human
cuucagagagcagugcuuuugg

SEQ ID NO: 1286870 - RNA, 21 nt, Human
cuucagaggcccucgcugcca

SEQ ID NO: 1286871 - RNA, 23 nt, Human
cuucagaggcccucgcugccagc

SEQ ID NO: 1286872 - RNA, 14 nt, Human
cuucagagagcagu

SEQ ID NO: 1286873 - RNA, 17 nt, Human
cuucagagagcagugcu

SEQ ID NO: 1286874 - RNA, 18 nt, Human
cuucagagagcagugcuu

SEQ ID NO: 1286875 - RNA, 21 nt, Human
cuucaauuuauaccucaauuu

SEQ ID NO: 1286876 - RNA, 17 nt, Human
cuucaagcucugaggga

SEQ ID NO: 1286877 - RNA, 15 nt, Human
cuucacaaauucuca

SEQ ID NO: 1286878 - RNA, 21 nt, Human
cuucacaaucugucaguucua

SEQ ID NO: 1286879 - RNA, 17 nt, Human
cuucaaauccuugaaga

SEQ ID NO: 1286880 - RNA, 15 nt, Human
cuuagucuagguccu

SEQ ID NO: 1286881 - RNA, 13 nt, Human
cuucaaaugccug

SEQ ID NO: 1286882 - RNA, 16 nt, Human
cuucaaaugccugacu

SEQ ID NO: 1286883 - RNA, 13 nt, Human
cuuaguauugcaa

SEQ ID NO: 1286884 - RNA, 17 nt, Human
cuucaacugaccagccu

SEQ ID NO: 1286885 - RNA, 20 nt, Human
cuucaacaauucuaaaauga

SEQ ID NO: 1286886 - RNA, 20 nt, Human
cuucaacugaccagccucca

SEQ ID NO: 1286887 - RNA, 23 nt, Human
cuucaacugaccagccuccaugc

SEQ ID NO: 1286888 - RNA, 18 nt, Human
cuucaagaucccauuuga

SEQ ID NO: 1286889 - RNA, 22 nt, Human
cuucaagcauggcuauuuuaua

SEQ ID NO: 1286890 - RNA, 12 nt, Human
cuucaagcucug

SEQ ID NO: 1286891 - RNA, 13 nt, Human
cuucaagcucuga

SEQ ID NO: 1286892 - RNA, 14 nt, Human
cuucaagcucugag

SEQ ID NO: 1286893 - RNA, 18 nt, Human
cuucaagcucugagggaa

SEQ ID NO: 1286894 - RNA, 18 nt, Human
cuucaagaaaacaggcac

SEQ ID NO: 1286895 - RNA, 15 nt, Human
cuuccuucccugcug

SEQ ID NO: 1286896 - RNA, 22 nt, Human
cuuccuucagagagcagugcuu

SEQ ID NO: 1286897 - RNA, 23 nt, Human
cuuccuucagagagcagugcuuu

SEQ ID NO: 1286898 - RNA, 13 nt, Human
cuuccuucauuuc

SEQ ID NO: 1286899 - RNA, 15 nt, Human
cuuccuucauuuccu

SEQ ID NO: 1286900 - RNA, 16 nt, Human
cuuccuucauuuccuc

SEQ ID NO: 1286901 - RNA, 15 nt, Human
cuuccugugugucca

SEQ ID NO: 1286902 - RNA, 23 nt, Human
cuuccuguguguccaaaacugcc

SEQ ID NO: 1286903 - RNA, 22 nt, Human
cuuccuguuuaaaaaaccacau

SEQ ID NO: 1286904 - RNA, 16 nt, Human
cuuccuguuuuucaca

SEQ ID NO: 1286905 - RNA, 17 nt, Human
cuuccuguuuuucacau

SEQ ID NO: 1286906 - RNA, 18 nt, Human
cuuccuguuuuucacauu

SEQ ID NO: 1286907 - RNA, 23 nt, Human
cuuccuguuuuucacauuuuccu

SEQ ID NO: 1286908 - RNA, 19 nt, Human
cuuccuuacucccaggcac

SEQ ID NO: 1286909 - RNA, 13 nt, Human
cuuccuucagaga

SEQ ID NO: 1286910 - RNA, 14 nt, Human
cuuccuucagagag

SEQ ID NO: 1286911 - RNA, 15 nt, Human
cuuccuucagagagc

SEQ ID NO: 1286912 - RNA, 16 nt, Human
cuuccuucagagagca

SEQ ID NO: 1286913 - RNA, 21 nt, Human
cuuccuucagagagcagugcu

SEQ ID NO: 1286914 - RNA, 15 nt, Human
cuucgccaccugggu

SEQ ID NO: 1286915 - RNA, 15 nt, Human
cuucgcuucuugccu

SEQ ID NO: 1286916 - RNA, 16 nt, Human
cuucgcuucuugccuc

SEQ ID NO: 1286917 - RNA, 17 nt, Human
cuucgcuucuugccucu

SEQ ID NO: 1286918 - RNA, 18 nt, Human
cuucgcuucuugccucug

SEQ ID NO: 1286919 - RNA, 20 nt, Human
cuucgcuucuugccucugug

SEQ ID NO: 1286920 - RNA, 21 nt, Human
cuucgcuucuugccucugugc

SEQ ID NO: 1286921 - RNA, 21 nt, Human
cuucgauacaccgggccugga

SEQ ID NO: 1286922 - RNA, 15 nt, Human
cuuccuuuguaaaaa

SEQ ID NO: 1286923 - RNA, 20 nt, Human
cuuccuuuuacuuuucuucu

SEQ ID NO: 1286924 - RNA, 17 nt, Human
cuuccuuuuaucaguag

SEQ ID NO: 1286925 - RNA, 14 nt, Human
cuucgccaccuggg

SEQ ID NO: 1286926 - RNA, 12 nt, Human
cuuccuuuucac

SEQ ID NO: 1286927 - RNA, 13 nt, Human
cuuccuuuucacu

SEQ ID NO: 1286928 - RNA, 14 nt, Human
cuuccuuuucacug

SEQ ID NO: 1286929 - RNA, 20 nt, Human
cuucggccuccauccugagg

SEQ ID NO: 1286930 - RNA, 16 nt, Human
cuucgggcugugcccg

SEQ ID NO: 1286931 - RNA, 14 nt, Human
cuucggggcuggga

SEQ ID NO: 1286932 - RNA, 15 nt, Human
cuucggggcugggaa

SEQ ID NO: 1286933 - RNA, 14 nt, Human
cuucgucuuuccca

SEQ ID NO: 1286934 - RNA, 21 nt, Human
cuucgucuuucccauggggag

SEQ ID NO: 1286935 - RNA, 22 nt, Human
cuucgucuuucccauggggagg

SEQ ID NO: 1286936 - RNA, 15 nt, Human
cuucucauccugcag

SEQ ID NO: 1286937 - RNA, 16 nt, Human
cuucucauccugcagg

SEQ ID NO: 1286938 - RNA, 17 nt, Human
cuucucauccugcaggc

SEQ ID NO: 1286939 - RNA, 14 nt, Human
cuucucaugaucca

SEQ ID NO: 1286940 - RNA, 22 nt, Human
cuucccuggaaaccuuccaccc

SEQ ID NO: 1286941 - RNA, 18 nt, Human
cuucccugaagcucccac

SEQ ID NO: 1286942 - RNA, 23 nt, Human
cuucccuggaaaccuuccaccca

SEQ ID NO: 1286943 - RNA, 19 nt, Human
cuucccugcugugaaagaa

SEQ ID NO: 1286944 - RNA, 14 nt, Human
cuucccugacucau

SEQ ID NO: 1286945 - RNA, 23 nt, Human
cuucccuaucuuugccacccuca

SEQ ID NO: 1286946 - RNA, 22 nt, Human
cuucccuaucuuugccacccuc

SEQ ID NO: 1286947 - RNA, 22 nt, Human
cuucccucuuccuucccugcug

SEQ ID NO: 1286948 - RNA, 13 nt, Human
cuucccugaagcu

SEQ ID NO: 1286949 - RNA, 15 nt, Human
cuucccugaagcucc

SEQ ID NO: 1286950 - RNA, 17 nt, Human
cuucccugaagcuccca

SEQ ID NO: 1286951 - RNA, 13 nt, Human
cuucccugacuca

SEQ ID NO: 1286952 - RNA, 20 nt, Human
cuucccugacucauucugaa

SEQ ID NO: 1286953 - RNA, 15 nt, Human
cuuccuaguuuucuc

SEQ ID NO: 1286954 - RNA, 17 nt, Human
cuuccuaguuuucuccu

SEQ ID NO: 1286955 - RNA, 23 nt, Human
cuuccuaguuuucuccucccagg

SEQ ID NO: 1286956 - RNA, 22 nt, Human
cuuccuaguuuucuccucccag

SEQ ID NO: 1286957 - RNA, 13 nt, Human
cuuccugugacuu

SEQ ID NO: 1286958 - RNA, 16 nt, Human
cuuccugugacuucag

SEQ ID NO: 1286959 - RNA, 23 nt, Human
cuuccuggacagcugugccucgc

SEQ ID NO: 1286960 - RNA, 24 nt, Human
cuuccuggacagcugugccucgcu

SEQ ID NO: 1286961 - RNA, 14 nt, Human
cuuccuggagacug

SEQ ID NO: 1286962 - RNA, 22 nt, Human
cuuccuggagacugcccagcua

SEQ ID NO: 1286963 - RNA, 12 nt, Human
cuuccuggagca

SEQ ID NO: 1286964 - RNA, 13 nt, Human
cuuccuggagcag

SEQ ID NO: 1286965 - RNA, 18 nt, Human
cuuccuggagcagaagca

SEQ ID NO: 1286966 - RNA, 19 nt, Human
cuuccuggagcagaagcag

SEQ ID NO: 1286967 - RNA, 18 nt, Human
cuuccuguccagcuccaa

SEQ ID NO: 1286968 - RNA, 21 nt, Human
cuuccuggagcagaagcagca

SEQ ID NO: 1286969 - RNA, 21 nt, Human
cuuccugccccaacuccuucc

SEQ ID NO: 1286970 - RNA, 11 nt, Human
cuuccucagcc

SEQ ID NO: 1286971 - RNA, 12 nt, Human
cuuccucagcca

SEQ ID NO: 1286972 - RNA, 14 nt, Human
cuuccucagccagc

SEQ ID NO: 1286973 - RNA, 12 nt, Human
cuuccugcuugc

SEQ ID NO: 1286974 - RNA, 14 nt, Human
cuuccugcuugcca

SEQ ID NO: 1286975 - RNA, 16 nt, Human
cuuccugcuugccaag

SEQ ID NO: 1286976 - RNA, 13 nt, Human
cuuccuggacagc

SEQ ID NO: 1286977 - RNA, 14 nt, Human
cuuccuggacagcu

SEQ ID NO: 1286978 - RNA, 15 nt, Human
cuuccuggacagcug

SEQ ID NO: 1286979 - RNA, 16 nt, Human
cuuccuggacagcugu

SEQ ID NO: 1286980 - RNA, 17 nt, Human
cuuccuggacagcugug

SEQ ID NO: 1286981 - RNA, 20 nt, Human
cuuccuggacagcugugccu

SEQ ID NO: 1286982 - RNA, 21 nt, Human
cuuccuggacagcugugccuc

SEQ ID NO: 1286983 - RNA, 22 nt, Human
cuuccuggacagcugugccucg

SEQ ID NO: 1286984 - RNA, 18 nt, Human
cuucccuaucuuugccac

SEQ ID NO: 1286985 - RNA, 17 nt, Human
cuucccuaucuuugcca

SEQ ID NO: 1286986 - RNA, 16 nt, Human
cuucccuaucuuugcc

SEQ ID NO: 1286987 - RNA, 15 nt, Human
cuucccccuccaauc

SEQ ID NO: 1286988 - RNA, 12 nt, Human
cuucccccucca

SEQ ID NO: 1286989 - RNA, 16 nt, Human
cuucccccaccaccaa

SEQ ID NO: 1286990 - RNA, 21 nt, Human
cuuccccagacgccuggcugc

SEQ ID NO: 1286991 - RNA, 18 nt, Human
cuuccccagacgccuggc

SEQ ID NO: 1286992 - RNA, 18 nt, Human
cuuccccaucuucuaaac

SEQ ID NO: 1286993 - RNA, 19 nt, Human
cuuccccauggcccugagc

SEQ ID NO: 1286994 - RNA, 21 nt, Human
cuuccccauggcccugagcga

SEQ ID NO: 1286995 - RNA, 13 nt, Human
cuucccccaccac

SEQ ID NO: 1286996 - RNA, 15 nt, Human
cuucccccaccacca

SEQ ID NO: 1286997 - RNA, 19 nt, Human
cuuccagauccuggaaauc

SEQ ID NO: 1286998 - RNA, 20 nt, Human
cuuccccacccaccaacccu

SEQ ID NO: 1286999 - RNA, 23 nt, Human
cuuccccacccaccaacccucag

SEQ ID NO: 1287000 - RNA, 19 nt, Human
cuuccaaugucuggagacc

SEQ ID NO: 1287001 - RNA, 18 nt, Human
cuuccacugagggcaguc

SEQ ID NO: 1287002 - RNA, 13 nt, Human
cuuccagaaauac

SEQ ID NO: 1287003 - RNA, 16 nt, Human
cuuccagaaaacaaaa

SEQ ID NO: 1287004 - RNA, 17 nt, Human
cuuaaccagaucauugu

SEQ ID NO: 1287005 - RNA, 23 nt, Human
cuuaagaagacugcauuauauuu

SEQ ID NO: 1287006 - RNA, 18 nt, Human
cuuaagaauuuugagcag

SEQ ID NO: 1287007 - RNA, 12 nt, Human
cuuaaaaauggu

SEQ ID NO: 1287008 - RNA, 12 nt, Human
cuuaaaaaguua

SEQ ID NO: 1287009 - RNA, 14 nt, Human
cuuaaaaaguuaua

SEQ ID NO: 1287010 - RNA, 19 nt, Human
cuuaacagggaacgugauu

SEQ ID NO: 1287011 - RNA, 16 nt, Human
cuuaacaguuguauuu

SEQ ID NO: 1287012 - RNA, 17 nt, Human
cuuaacaguuguauuua

SEQ ID NO: 1287013 - RNA, 20 nt, Human
cuuaauaaauuguguuuccu

SEQ ID NO: 1287014 - RNA, 14 nt, Human
cuuaagguguagcc

SEQ ID NO: 1287015 - RNA, 17 nt, Human
cuuaagguguagccaca

SEQ ID NO: 1287016 - RNA, 21 nt, Human
cuuaagguguagccacaccag

SEQ ID NO: 1287017 - RNA, 17 nt, Human
cuuaauacacacaguua

SEQ ID NO: 1287018 - RNA, 16 nt, Human
cuuaauacuaccuuga

SEQ ID NO: 1287019 - RNA, 18 nt, Human
cuuaauacuaccuugaaa

SEQ ID NO: 1287020 - RNA, 22 nt, Human
cuuaauacucaaaugaguaaca

SEQ ID NO: 1287021 - RNA, 13 nt, Human
cuuaauacuaagg

SEQ ID NO: 1287022 - RNA, 15 nt, Human
cuuaaggcucuuuug

SEQ ID NO: 1287023 - RNA, 20 nt, Human
cuuaagaccuacuguucuaa

SEQ ID NO: 1287024 - RNA, 22 nt, Human
cuuaagaccuacuguucuaaag

SEQ ID NO: 1287025 - RNA, 23 nt, Human
cuuaagaccuacuguucuaaagc

SEQ ID NO: 1287026 - RNA, 13 nt, Human
cuuaauucaaaua

SEQ ID NO: 1287027 - RNA, 19 nt, Human
cuuaauuauuauuuguguu

SEQ ID NO: 1287028 - RNA, 16 nt, Human
cuuaauugccaccucu

SEQ ID NO: 1287029 - RNA, 20 nt, Human
cuuaauugccaccucuaaca

SEQ ID NO: 1287030 - RNA, 16 nt, Human
cuuaauuuauuauuaa

SEQ ID NO: 1287031 - RNA, 11 nt, Human
cuuaauuauua

SEQ ID NO: 1287032 - RNA, 15 nt, Human
cuuaauuauuauuug

SEQ ID NO: 1287033 - RNA, 18 nt, Human
cuuaauuauuauuugugu

SEQ ID NO: 1287034 - RNA, 19 nt, Human
cuuaauauauauauccaga

SEQ ID NO: 1287035 - RNA, 14 nt, Human
cuuaaucuuugaaa

SEQ ID NO: 1287036 - RNA, 16 nt, Human
cuuagaauacaguuuu

SEQ ID NO: 1287037 - RNA, 18 nt, Human
cuuagaaguuuguuguga

SEQ ID NO: 1287038 - RNA, 19 nt, Human
cuuagacagaggcccucaa

SEQ ID NO: 1287039 - RNA, 20 nt, Human
cuuagacagaggcccucaag

SEQ ID NO: 1287040 - RNA, 15 nt, Human
cuuaguacaaaguuu

SEQ ID NO: 1287041 - RNA, 19 nt, Human
cuuaguacaaaguuucaau

SEQ ID NO: 1287042 - RNA, 21 nt, Human
cuuagacagaggcccucaagu

SEQ ID NO: 1287043 - RNA, 15 nt, Human
cuuagacucuuuucc

SEQ ID NO: 1287044 - RNA, 16 nt, Human
cuuagaaauugcauuu

SEQ ID NO: 1287045 - RNA, 17 nt, Human
cuuacugcgacuaaacu

SEQ ID NO: 1287046 - RNA, 22 nt, Human
cuuacugcgacuaaacuuaauu

SEQ ID NO: 1287047 - RNA, 11 nt, Human
cuuacugcuug

SEQ ID NO: 1287048 - RNA, 11 nt, Human
cuuagaaaacc

SEQ ID NO: 1287049 - RNA, 18 nt, Human
cuuagaaaaccagcucag

SEQ ID NO: 1287050 - RNA, 19 nt, Human
cuuagaaaaccagcucagc

SEQ ID NO: 1287051 - RNA, 20 nt, Human
cuuagaaaaccagcucagca

SEQ ID NO: 1287052 - RNA, 21 nt, Human
cuuagaaaaccagcucagcac

SEQ ID NO: 1287053 - RNA, 24 nt, Human
cuuagaaaaccagcucagcacugc

SEQ ID NO: 1287054 - RNA, 23 nt, Human
cuuagaaaaccagcucagcacug

SEQ ID NO: 1287055 - RNA, 15 nt, Human
cuuaauuuauuauua

SEQ ID NO: 1287056 - RNA, 12 nt, Human
cuuaccuggccc

SEQ ID NO: 1287057 - RNA, 13 nt, Human
cuuaccuggccca

SEQ ID NO: 1287058 - RNA, 18 nt, Human
cuuaccuggcccaucagg

SEQ ID NO: 1287059 - RNA, 19 nt, Human
cuuaccugggcauucuugu

SEQ ID NO: 1287060 - RNA, 20 nt, Human
cuuaccuguaugucuccagu

SEQ ID NO: 1287061 - RNA, 21 nt, Human
cuuaccuggcccaucagggua

SEQ ID NO: 1287062 - RNA, 13 nt, Human
cuuaccuuuuuau

SEQ ID NO: 1287063 - RNA, 20 nt, Human
cuuacuccugugggagccuc

SEQ ID NO: 1287064 - RNA, 12 nt, Human
cuuacucuaaga

SEQ ID NO: 1287065 - RNA, 20 nt, Human
cuuacucuaagaucuuagau

SEQ ID NO: 1287066 - RNA, 15 nt, Human
cuuacucuucuugaa

SEQ ID NO: 1287067 - RNA, 19 nt, Human
cuuacucuucuugaaauuu

SEQ ID NO: 1287068 - RNA, 12 nt, Human
cuuacugauaua

SEQ ID NO: 1287069 - RNA, 15 nt, Human
cuuacugauauauuu

SEQ ID NO: 1287070 - RNA, 19 nt, Human
cuuacugauauauuuuaca

SEQ ID NO: 1287071 - RNA, 21 nt, Human
cuuacugauauauuuuacaau

SEQ ID NO: 1287072 - RNA, 13 nt, Human
cuuacucuaagau

SEQ ID NO: 1287073 - RNA, 21 nt, Human
cuuacugauuuuuaaguuauu

SEQ ID NO: 1287074 - RNA, 21 nt, Human
cuguugccaggcuggagugca

SEQ ID NO: 1287075 - RNA, 18 nt, Human
cuguuugcauuugauaca

SEQ ID NO: 1287076 - RNA, 22 nt, Human
cuguuugcauuugauacauuuu

SEQ ID NO: 1287077 - RNA, 13 nt, Human
cuguuugcugugc

SEQ ID NO: 1287078 - RNA, 23 nt, Human
cuguuuggaaauaaaucuuccua

SEQ ID NO: 1287079 - RNA, 23 nt, Human
cuguuuggaaauugauuuugaac

SEQ ID NO: 1287080 - RNA, 13 nt, Human
cuguuugagaaag

SEQ ID NO: 1287081 - RNA, 12 nt, Human
cuguuugagaaa

SEQ ID NO: 1287082 - RNA, 21 nt, Human
cuguuugaggaaagcaagaau

SEQ ID NO: 1287083 - RNA, 15 nt, Human
cuguuugacaccucu

SEQ ID NO: 1287084 - RNA, 19 nt, Human
cuguuugacaccucuuuuu

SEQ ID NO: 1287085 - RNA, 23 nt, Human
cuguuugacaccucuuuuuucgu

SEQ ID NO: 1287086 - RNA, 12 nt, Human
cuguuucaaaca

SEQ ID NO: 1287087 - RNA, 17 nt, Human
cuguuuaguagcaguga

SEQ ID NO: 1287088 - RNA, 21 nt, Human
cuguuuauucauaugcauauu

SEQ ID NO: 1287089 - RNA, 12 nt, Human
cuguuucaaagu

SEQ ID NO: 1287090 - RNA, 14 nt, Human
cuguuucaaaguuc

SEQ ID NO: 1287091 - RNA, 15 nt, Human
cuguuucaaaguucu

SEQ ID NO: 1287092 - RNA, 11 nt, Human
cuguuucaagg

SEQ ID NO: 1287093 - RNA, 21 nt, Human
cuguuucaaggcacucuagau

SEQ ID NO: 1287094 - RNA, 22 nt, Human
cuguuucaaggcacucuagauu

SEQ ID NO: 1287095 - RNA, 16 nt, Human
cuguuucagaggcuca

SEQ ID NO: 1287096 - RNA, 14 nt, Human
cuguuuuauaauuu

SEQ ID NO: 1287097 - RNA, 22 nt, Human
cuguuuuacaaaaaagaaaaga

SEQ ID NO: 1287098 - RNA, 20 nt, Human
cuguuuguuuacaaaaucag

SEQ ID NO: 1287099 - RNA, 14 nt, Human
cuguuuggccucuc

SEQ ID NO: 1287100 - RNA, 22 nt, Human
cuguuuggaaauugauuuugaa

SEQ ID NO: 1287101 - RNA, 15 nt, Human
cuguuuuauaauuuu

SEQ ID NO: 1287102 - RNA, 14 nt, Human
cuguuuuacaaguu

SEQ ID NO: 1287103 - RNA, 17 nt, Human
cuguuuuacaaguugga

SEQ ID NO: 1287104 - RNA, 21 nt, Human
cuguuuuacaaguuggaguca

SEQ ID NO: 1287105 - RNA, 16 nt, Human
cuguuuucccacgagg

SEQ ID NO: 1287106 - RNA, 12 nt, Human
cuguuuuccccc

SEQ ID NO: 1287107 - RNA, 13 nt, Human
cuguuuucccccc

SEQ ID NO: 1287108 - RNA, 22 nt, Human
cuguuuucuaguguaucaaaau

SEQ ID NO: 1287109 - RNA, 20 nt, Human
cuguuuucuaguguaucaaa

SEQ ID NO: 1287110 - RNA, 21 nt, Human
cuguuuucucucggcucccca

SEQ ID NO: 1287111 - RNA, 18 nt, Human
cuguuuucuaguguauca

SEQ ID NO: 1287112 - RNA, 17 nt, Human
cuguuuucuaguguauc

SEQ ID NO: 1287113 - RNA, 15 nt, Human
cuguuuucuagugua

SEQ ID NO: 1287114 - RNA, 12 nt, Human
cuguuuuucaca

SEQ ID NO: 1287115 - RNA, 13 nt, Human
cuguuuuucacau

SEQ ID NO: 1287116 - RNA, 15 nt, Human
cuguuuuucacauuu

SEQ ID NO: 1287117 - RNA, 23 nt, Human
cuguuaaauacaggaaacaguug

SEQ ID NO: 1287118 - RNA, 12 nt, Human
cuguuaacugaa

SEQ ID NO: 1287119 - RNA, 13 nt, Human
cuguuaacugaau

SEQ ID NO: 1287120 - RNA, 14 nt, Human
cuguuaacugaaua

SEQ ID NO: 1287121 - RNA, 15 nt, Human
cuguuaacugaauac

SEQ ID NO: 1287122 - RNA, 17 nt, Human
cuguuaacugaauacca

SEQ ID NO: 1287123 - RNA, 18 nt, Human
cuguuaacugaauaccac

SEQ ID NO: 1287124 - RNA, 22 nt, Human
cuguuaacugaauaccacucug

SEQ ID NO: 1287125 - RNA, 19 nt, Human
cuguuaacugaauaccacu

SEQ ID NO: 1287126 - RNA, 11 nt, Human
cuguucugugu

SEQ ID NO: 1287127 - RNA, 13 nt, Human
cuguucugugucu

SEQ ID NO: 1287128 - RNA, 14 nt, Human
cuguucugugucuu

SEQ ID NO: 1287129 - RNA, 14 nt, Human
cuguucuguuucaa

SEQ ID NO: 1287130 - RNA, 15 nt, Human
cuguucuguuucaag

SEQ ID NO: 1287131 - RNA, 21 nt, Human
cuguucuguuucaaggcacuc

SEQ ID NO: 1287132 - RNA, 13 nt, Human
cuguucuuagcuc

SEQ ID NO: 1287133 - RNA, 16 nt, Human
cuguucuuagcucaau

SEQ ID NO: 1287134 - RNA, 17 nt, Human
cuguucuuagcucaaug

SEQ ID NO: 1287135 - RNA, 19 nt, Human
cuguucuuagcucaaugag

SEQ ID NO: 1287136 - RNA, 21 nt, Human
cuguucuuagcucaaugagca

SEQ ID NO: 1287137 - RNA, 23 nt, Human
cuguucuuagcucaaugagcaug

SEQ ID NO: 1287138 - RNA, 16 nt, Human
cuguucuuccucagcc

SEQ ID NO: 1287139 - RNA, 17 nt, Human
cuguucuuccucagcca

SEQ ID NO: 1287140 - RNA, 18 nt, Human
cuguucuuccucagccag

SEQ ID NO: 1287141 - RNA, 19 nt, Human
cuguucuuccucagccagc

SEQ ID NO: 1287142 - RNA, 20 nt, Human
cuguucuuccucagccagcc

SEQ ID NO: 1287143 - RNA, 22 nt, Human
cuguucuuccucagccagccuc

SEQ ID NO: 1287144 - RNA, 23 nt, Human
cuguucuuccucagccagccucg

SEQ ID NO: 1287145 - RNA, 17 nt, Human
cuguugaauuucccaca

SEQ ID NO: 1287146 - RNA, 17 nt, Human
cuguugagcaucacaga

SEQ ID NO: 1287147 - RNA, 17 nt, Human
cuguugcacguguguuu

SEQ ID NO: 1287148 - RNA, 18 nt, Human
cuguugcacguguguuuu

SEQ ID NO: 1287149 - RNA, 20 nt, Human
cuguugcacguguguuuuuc

SEQ ID NO: 1287150 - RNA, 22 nt, Human
cuguugcacguguguuuuucua

SEQ ID NO: 1287151 - RNA, 23 nt, Human
cuguugcacguguguuuuucuau

SEQ ID NO: 1287152 - RNA, 15 nt, Human
cuguugcacgugugu

SEQ ID NO: 1287153 - RNA, 16 nt, Human
cugugugcucaggagc

SEQ ID NO: 1287154 - RNA, 15 nt, Human
cuguguguccaaaac

SEQ ID NO: 1287155 - RNA, 19 nt, Human
cuguguguccaaaacugcc

SEQ ID NO: 1287156 - RNA, 21 nt, Human
cuguguguccaaaacugccuc

SEQ ID NO: 1287157 - RNA, 22 nt, Human
cuguguguccaaaacugccuca

SEQ ID NO: 1287158 - RNA, 11 nt, Human
cugugugugcc

SEQ ID NO: 1287159 - RNA, 13 nt, Human
cugugugugcccu

SEQ ID NO: 1287160 - RNA, 16 nt, Human
cugugugugcccucug

SEQ ID NO: 1287161 - RNA, 18 nt, Human
cugugugugcccucuggg

SEQ ID NO: 1287162 - RNA, 19 nt, Human
cugugugugcccucugggc

SEQ ID NO: 1287163 - RNA, 23 nt, Human
cugugugugcccucugggcucug

SEQ ID NO: 1287164 - RNA, 14 nt, Human
cugugugcucagga

SEQ ID NO: 1287165 - RNA, 16 nt, Human
cugugugcacaaauau

SEQ ID NO: 1287166 - RNA, 18 nt, Human
cugugugacucaaaccaa

SEQ ID NO: 1287167 - RNA, 19 nt, Human
cugugugaauaccugcuca

SEQ ID NO: 1287168 - RNA, 18 nt, Human
cugugugaauaccugcuc

SEQ ID NO: 1287169 - RNA, 20 nt, Human
cugugucuuucacagcuccu

SEQ ID NO: 1287170 - RNA, 20 nt, Human
cugugugaaacuuucauucc

SEQ ID NO: 1287171 - RNA, 23 nt, Human
cugugguucugagauggcuccca

SEQ ID NO: 1287172 - RNA, 15 nt, Human
cugugguuucauguu

SEQ ID NO: 1287173 - RNA, 16 nt, Human
cugugguuucauguua

SEQ ID NO: 1287174 - RNA, 17 nt, Human
cugugguuucauguuag

SEQ ID NO: 1287175 - RNA, 18 nt, Human
cugugguuucauguuagu

SEQ ID NO: 1287176 - RNA, 22 nt, Human
cugugguuuucuuuugccauga

SEQ ID NO: 1287177 - RNA, 21 nt, Human
cugugguuuucuuuugccaug

SEQ ID NO: 1287178 - RNA, 20 nt, Human
cugugugugcccucugggcu

SEQ ID NO: 1287179 - RNA, 22 nt, Human
cuguguuacuaaaaaaaagaug

SEQ ID NO: 1287180 - RNA, 23 nt, Human
cuguguuacuaaaaaaaagauga

SEQ ID NO: 1287181 - RNA, 19 nt, Human
cuguguuaugcaaaagcaa

SEQ ID NO: 1287182 - RNA, 17 nt, Human
cuguguuaugcaaaagc

SEQ ID NO: 1287183 - RNA, 21 nt, Human
cuguguuccuuccgcuuggag

SEQ ID NO: 1287184 - RNA, 13 nt, Human
cuguguuccuucc

SEQ ID NO: 1287185 - RNA, 13 nt, Human
cuguguugccaag

SEQ ID NO: 1287186 - RNA, 14 nt, Human
cuguguugccaagc

SEQ ID NO: 1287187 - RNA, 16 nt, Human
cuguguugccaagcuc

SEQ ID NO: 1287188 - RNA, 17 nt, Human
cuguguugccaagcucc

SEQ ID NO: 1287189 - RNA, 19 nt, Human
cuguguugccaagcuccaa

SEQ ID NO: 1287190 - RNA, 21 nt, Human
cuguguugccaagcuccaagc

SEQ ID NO: 1287191 - RNA, 14 nt, Human
cuguguugucucua

SEQ ID NO: 1287192 - RNA, 19 nt, Human
cuguguugucucuagagca

SEQ ID NO: 1287193 - RNA, 22 nt, Human
cuguguugucucuagagcaggg

SEQ ID NO: 1287194 - RNA, 18 nt, Human
cuguguuuugaaagaaua

SEQ ID NO: 1287195 - RNA, 22 nt, Human
cuguguuuugaaagaauagaac

SEQ ID NO: 1287196 - RNA, 11 nt, Human
cuguuaaauac

SEQ ID NO: 1287197 - RNA, 15 nt, Human
cuguuaaauacagga

SEQ ID NO: 1287198 - RNA, 16 nt, Human
cuguuaaauacaggaa

SEQ ID NO: 1287199 - RNA, 17 nt, Human
cuguuaaauacaggaaa

SEQ ID NO: 1287200 - RNA, 19 nt, Human
cuguuaaauacaggaaaca

SEQ ID NO: 1287201 - RNA, 21 nt, Human
cuguggaacauaaaaaggaca

SEQ ID NO: 1287202 - RNA, 18 nt, Human
cuguggaacauaaaaagg

SEQ ID NO: 1287203 - RNA, 16 nt, Human
cugugccucagagacc

SEQ ID NO: 1287204 - RNA, 16 nt, Human
cugugccucugccugu

SEQ ID NO: 1287205 - RNA, 17 nt, Human
cugugccucugccuguc

SEQ ID NO: 1287206 - RNA, 23 nt, Human
cuguggaccauggaguggcagcc

SEQ ID NO: 1287207 - RNA, 12 nt, Human
cugugccucugc

SEQ ID NO: 1287208 - RNA, 13 nt, Human
cugugccucugcc

SEQ ID NO: 1287209 - RNA, 14 nt, Human
cugugccucugccu

SEQ ID NO: 1287210 - RNA, 15 nt, Human
cugugccucugccug

SEQ ID NO: 1287211 - RNA, 22 nt, Human
cugugccccuuccgccacuggg

SEQ ID NO: 1287212 - RNA, 23 nt, Human
cugugccccuuccgccacugggg

SEQ ID NO: 1287213 - RNA, 20 nt, Human
cugugccccuugacaacugg

SEQ ID NO: 1287214 - RNA, 15 nt, Human
cugugccucagagac

SEQ ID NO: 1287215 - RNA, 24 nt, Human
cuguggaucaaauccagccugcug

SEQ ID NO: 1287216 - RNA, 14 nt, Human
cuguggaucaaauc

SEQ ID NO: 1287217 - RNA, 18 nt, Human
cuguggccuaaccugccg

SEQ ID NO: 1287218 - RNA, 21 nt, Human
cuguggccccacccugggccc

SEQ ID NO: 1287219 - RNA, 16 nt, Human
cuguggccccacccug

SEQ ID NO: 1287220 - RNA, 17 nt, Human
cuguggccccacccugg

SEQ ID NO: 1287221 - RNA, 18 nt, Human
cuguggccccacccuggg

SEQ ID NO: 1287222 - RNA, 20 nt, Human
cuguggccccacccugggcc

SEQ ID NO: 1287223 - RNA, 15 nt, Human
cuguggaucagagau

SEQ ID NO: 1287224 - RNA, 13 nt, Human
cuguggccaggag

SEQ ID NO: 1287225 - RNA, 14 nt, Human
cuguggccaggagg

SEQ ID NO: 1287226 - RNA, 15 nt, Human
cuguggccaggaggu

SEQ ID NO: 1287227 - RNA, 20 nt, Human
cuguggccaugacccugccu

SEQ ID NO: 1287228 - RNA, 22 nt, Human
cuguggccaugacccugccucu

SEQ ID NO: 1287229 - RNA, 14 nt, Human
cugugguguguccc

SEQ ID NO: 1287230 - RNA, 15 nt, Human
cuguggugugucccc

SEQ ID NO: 1287231 - RNA, 22 nt, Human
cuguggugugucccccucuguc

SEQ ID NO: 1287232 - RNA, 18 nt, Human
cugugguucugagauggc

SEQ ID NO: 1287233 - RNA, 20 nt, Human
cugugguucugagauggcuc

SEQ ID NO: 1287234 - RNA, 22 nt, Human
cugugguucugagauggcuccc

SEQ ID NO: 1287235 - RNA, 16 nt, Human
cuguggucacagcgga

SEQ ID NO: 1287236 - RNA, 20 nt, Human
cugugggggugugcccccuu

SEQ ID NO: 1287237 - RNA, 15 nt, Human
cuguggguaguauga

SEQ ID NO: 1287238 - RNA, 16 nt, Human
cugugggucugggagu

SEQ ID NO: 1287239 - RNA, 22 nt, Human
cugugggucugggagucacaca

SEQ ID NO: 1287240 - RNA, 19 nt, Human
cugugggggugugcccccu

SEQ ID NO: 1287241 - RNA, 24 nt, Human
cugugggggugagggucccaugug

SEQ ID NO: 1287242 - RNA, 23 nt, Human
cugugggggugagggucccaugu

SEQ ID NO: 1287243 - RNA, 16 nt, Human
cugugggagccucgca

SEQ ID NO: 1287244 - RNA, 14 nt, Human
cugugggaugggau

SEQ ID NO: 1287245 - RNA, 14 nt, Human
cugugggaaauggu

SEQ ID NO: 1287246 - RNA, 24 nt, Human
cugugggaaaugguacuguacagc

SEQ ID NO: 1287247 - RNA, 13 nt, Human
cugugggagccuc

SEQ ID NO: 1287248 - RNA, 14 nt, Human
cugugggagccucg

SEQ ID NO: 1287249 - RNA, 15 nt, Human
cugugggagccucgc

SEQ ID NO: 1287250 - RNA, 21 nt, Human
cugugggagccucgcaacccg

SEQ ID NO: 1287251 - RNA, 13 nt, Human
cugucuucuggac

SEQ ID NO: 1287252 - RNA, 15 nt, Human
cugucuucuggacug

SEQ ID NO: 1287253 - RNA, 14 nt, Human
cugucuucuggacu

SEQ ID NO: 1287254 - RNA, 16 nt, Human
cugucuuuaauucugu

SEQ ID NO: 1287255 - RNA, 21 nt, Human
cugucuuuuuucuaaaguaaa

SEQ ID NO: 1287256 - RNA, 14 nt, Human
cugucuuaauuuuc

SEQ ID NO: 1287257 - RNA, 16 nt, Human
cugucuuauccuccac

SEQ ID NO: 1287258 - RNA, 18 nt, Human
cugucuguuguauucauu

SEQ ID NO: 1287259 - RNA, 19 nt, Human
cugucuguuguauucauug

SEQ ID NO: 1287260 - RNA, 19 nt, Human
cugucuuaaacuaaaugug

SEQ ID NO: 1287261 - RNA, 21 nt, Human
cugucuuaaacuaaaugugca

SEQ ID NO: 1287262 - RNA, 15 nt, Human
cugucugucugucug

SEQ ID NO: 1287263 - RNA, 14 nt, Human
cugucugucugucu

SEQ ID NO: 1287264 - RNA, 17 nt, Human
cugucugucugucccaa

SEQ ID NO: 1287265 - RNA, 16 nt, Human
cugucugucuguccca

SEQ ID NO: 1287266 - RNA, 15 nt, Human
cugucugucuguccc

SEQ ID NO: 1287267 - RNA, 14 nt, Human
cugucugucugucc

SEQ ID NO: 1287268 - RNA, 23 nt, Human
cugucugguggccccguuucugg

SEQ ID NO: 1287269 - RNA, 17 nt, Human
cugucuggguggcucac

SEQ ID NO: 1287270 - RNA, 15 nt, Human
cugucugcucagaca

SEQ ID NO: 1287271 - RNA, 17 nt, Human
cugucuggaagaugggg

SEQ ID NO: 1287272 - RNA, 18 nt, Human
cugucuggaagaugggga

SEQ ID NO: 1287273 - RNA, 16 nt, Human
cugucuggcaaugcca

SEQ ID NO: 1287274 - RNA, 17 nt, Human
cugucuggcaaugccac

SEQ ID NO: 1287275 - RNA, 23 nt, Human
cugucuggcaaugccacagcccu

SEQ ID NO: 1287276 - RNA, 19 nt, Human
cugucuggcaaugccacag

SEQ ID NO: 1287277 - RNA, 16 nt, Human
cugucuggccccccug

SEQ ID NO: 1287278 - RNA, 15 nt, Human
cugucuggccccccu

SEQ ID NO: 1287279 - RNA, 16 nt, Human
cugucugggugcuacu

SEQ ID NO: 1287280 - RNA, 17 nt, Human
cugucugggugcuacug

SEQ ID NO: 1287281 - RNA, 19 nt, Human
cugucugggugcuacuggg

SEQ ID NO: 1287282 - RNA, 21 nt, Human
cugucugggugcuacugggga

SEQ ID NO: 1287283 - RNA, 22 nt, Human
cugucugggugcuacuggggaa

SEQ ID NO: 1287284 - RNA, 23 nt, Human
cugucugggugcuacuggggaaa

SEQ ID NO: 1287285 - RNA, 16 nt, Human
cugucuggguggcuca

SEQ ID NO: 1287286 - RNA, 13 nt, Human
cugucugguggcc

SEQ ID NO: 1287287 - RNA, 15 nt, Human
cugucugguggcccc

SEQ ID NO: 1287288 - RNA, 17 nt, Human
cugucugccaaccuaaa

SEQ ID NO: 1287289 - RNA, 20 nt, Human
cugucugccaaccuaaaacu

SEQ ID NO: 1287290 - RNA, 14 nt, Human
cugucugccccgcc

SEQ ID NO: 1287291 - RNA, 19 nt, Human
cugucugccccgcccucau

SEQ ID NO: 1287292 - RNA, 14 nt, Human
cugugaacccagga

SEQ ID NO: 1287293 - RNA, 15 nt, Human
cugugaacccaggac

SEQ ID NO: 1287294 - RNA, 16 nt, Human
cugugaacccaggaca

SEQ ID NO: 1287295 - RNA, 17 nt, Human
cugugaacccaggacaa

SEQ ID NO: 1287296 - RNA, 19 nt, Human
cugugaacccaggacaagc

SEQ ID NO: 1287297 - RNA, 22 nt, Human
cugugaacccaggacaagcaug

SEQ ID NO: 1287298 - RNA, 17 nt, Human
cugugagcccagcuggg

SEQ ID NO: 1287299 - RNA, 12 nt, Human
cugugaggcugu

SEQ ID NO: 1287300 - RNA, 15 nt, Human
cugugaggcuguccu

SEQ ID NO: 1287301 - RNA, 16 nt, Human
cugugaggcuguccug

SEQ ID NO: 1287302 - RNA, 17 nt, Human
cugugaggcuguccugu

SEQ ID NO: 1287303 - RNA, 13 nt, Human
cugugauucagaa

SEQ ID NO: 1287304 - RNA, 19 nt, Human
cugugccagagccuggggc

SEQ ID NO: 1287305 - RNA, 20 nt, Human
cugugccagagccuggggcu

SEQ ID NO: 1287306 - RNA, 22 nt, Human
cugugccagagccuggggcucu

SEQ ID NO: 1287307 - RNA, 21 nt, Human
cugugccagagccuggggcuc

SEQ ID NO: 1287308 - RNA, 14 nt, Human
cugugccaggugag

SEQ ID NO: 1287309 - RNA, 17 nt, Human
cugugcagguucccacu

SEQ ID NO: 1287310 - RNA, 16 nt, Human
cugugcagguucccac

SEQ ID NO: 1287311 - RNA, 13 nt, Human
cugugccagagcc

SEQ ID NO: 1287312 - RNA, 14 nt, Human
cugugccagagccu

SEQ ID NO: 1287313 - RNA, 15 nt, Human
cugugccagagccug

SEQ ID NO: 1287314 - RNA, 16 nt, Human
cugugccagagccugg

SEQ ID NO: 1287315 - RNA, 17 nt, Human
cugugccagagccuggg

SEQ ID NO: 1287316 - RNA, 18 nt, Human
cugugccagagccugggg

SEQ ID NO: 1287317 - RNA, 16 nt, Human
cugugauucagaaaau

SEQ ID NO: 1287318 - RNA, 21 nt, Human
cugugcaaccucuuggccuga

SEQ ID NO: 1287319 - RNA, 14 nt, Human
cugugcaccaagca

SEQ ID NO: 1287320 - RNA, 14 nt, Human
cugugcacugccca

SEQ ID NO: 1287321 - RNA, 16 nt, Human
cugugcagccgcugag

SEQ ID NO: 1287322 - RNA, 17 nt, Human
cugugcagccgcugagc

SEQ ID NO: 1287323 - RNA, 19 nt, Human
cugugcagccgcugagcga

SEQ ID NO: 1287324 - RNA, 21 nt, Human
cugugcagccgcugagcgagg

SEQ ID NO: 1287325 - RNA, 22 nt, Human
cugugcccccaggguccuggga

SEQ ID NO: 1287326 - RNA, 13 nt, Human
cugugccccuucc

SEQ ID NO: 1287327 - RNA, 17 nt, Human
cugugccccuuccgcca

SEQ ID NO: 1287328 - RNA, 18 nt, Human
cugugccccuuccgccac

SEQ ID NO: 1287329 - RNA, 20 nt, Human
cugugccccuuccgccacug

SEQ ID NO: 1287330 - RNA, 21 nt, Human
cugugccccuuccgccacugg

SEQ ID NO: 1287331 - RNA, 12 nt, Human
cugugcccccag

SEQ ID NO: 1287332 - RNA, 13 nt, Human
cugugcccccagg

SEQ ID NO: 1287333 - RNA, 14 nt, Human
cugugcccccaggg

SEQ ID NO: 1287334 - RNA, 20 nt, Human
cugugcccccaggguccugg

SEQ ID NO: 1287335 - RNA, 23 nt, Human
cugugcccccaggguccugggag

SEQ ID NO: 1287336 - RNA, 19 nt, Human
cugugccaggugaggucag

SEQ ID NO: 1287337 - RNA, 20 nt, Human
cugugccaggugaggucagc

SEQ ID NO: 1287338 - RNA, 15 nt, Human
cugguguagcuacag

SEQ ID NO: 1287339 - RNA, 17 nt, Human
cugguguagcuacagag

SEQ ID NO: 1287340 - RNA, 18 nt, Human
cugguguagcuacagaga

SEQ ID NO: 1287341 - RNA, 19 nt, Human
cugguguagcuacagagaa

SEQ ID NO: 1287342 - RNA, 12 nt, Human
cugguguagcua

SEQ ID NO: 1287343 - RNA, 20 nt, Human
cugguguagcuacagagaaa

SEQ ID NO: 1287344 - RNA, 21 nt, Human
cugguguagcuacagagaaac

SEQ ID NO: 1287345 - RNA, 23 nt, Human
cugguguagcuacagagaaacca

SEQ ID NO: 1287346 - RNA, 14 nt, Human
cuggugguggcucg

SEQ ID NO: 1287347 - RNA, 22 nt, Human
cuggugguggcucgggaggcga

SEQ ID NO: 1287348 - RNA, 23 nt, Human
cugguaugaacuugaggacacau

SEQ ID NO: 1287349 - RNA, 22 nt, Human
cugguauguaaaagaaaaucca

SEQ ID NO: 1287350 - RNA, 15 nt, Human
cugguauuguucuca

SEQ ID NO: 1287351 - RNA, 14 nt, Human
cugguuagaaaugc

SEQ ID NO: 1287352 - RNA, 23 nt, Human
cugguuagaaaugcagaauccua

SEQ ID NO: 1287353 - RNA, 20 nt, Human
cuguaaucccagcaugcuga

SEQ ID NO: 1287354 - RNA, 15 nt, Human
cuguaauucagguuu

SEQ ID NO: 1287355 - RNA, 18 nt, Human
cuguaauugaauauuauu

SEQ ID NO: 1287356 - RNA, 19 nt, Human
cuguaauugaauauuauuc

SEQ ID NO: 1287357 - RNA, 14 nt, Human
cuguaauugcaaaa

SEQ ID NO: 1287358 - RNA, 14 nt, Human
cuguacuccuccca

SEQ ID NO: 1287359 - RNA, 14 nt, Human
cuguacaucuauuu

SEQ ID NO: 1287360 - RNA, 23 nt, Human
cuguaccuuuugaggagccccag

SEQ ID NO: 1287361 - RNA, 15 nt, Human
cuguacuccucccag

SEQ ID NO: 1287362 - RNA, 16 nt, Human
cuguacuccucccagg

SEQ ID NO: 1287363 - RNA, 19 nt, Human
cuguacuccucccaggcgc

SEQ ID NO: 1287364 - RNA, 21 nt, Human
cuguacuccucccaggcgccc

SEQ ID NO: 1287365 - RNA, 13 nt, Human
cuguaguucuaag

SEQ ID NO: 1287366 - RNA, 14 nt, Human
cuguaguucuaaga

SEQ ID NO: 1287367 - RNA, 16 nt, Human
cuguaguucuaagacu

SEQ ID NO: 1287368 - RNA, 19 nt, Human
cuguaguucuaagacucaa

SEQ ID NO: 1287369 - RNA, 16 nt, Human
cuguaauuguguguga

SEQ ID NO: 1287370 - RNA, 12 nt, Human
cuguaauugugu

SEQ ID NO: 1287371 - RNA, 17 nt, Human
cuguauuagucacagag

SEQ ID NO: 1287372 - RNA, 19 nt, Human
cuguauuagucacagagau

SEQ ID NO: 1287373 - RNA, 16 nt, Human
cuguauucagacagau

SEQ ID NO: 1287374 - RNA, 15 nt, Human
cuguauucagacaga

SEQ ID NO: 1287375 - RNA, 20 nt, Human
cuguauuuuguauuguuuca

SEQ ID NO: 1287376 - RNA, 13 nt, Human
cuguauugucuga

SEQ ID NO: 1287377 - RNA, 14 nt, Human
cuguauugucugaa

SEQ ID NO: 1287378 - RNA, 17 nt, Human
cuguauugucugaacuu

SEQ ID NO: 1287379 - RNA, 16 nt, Human
cugggggccucuucug

SEQ ID NO: 1287380 - RNA, 12 nt, Human
cugggggccugg

SEQ ID NO: 1287381 - RNA, 13 nt, Human
cugggggccuggc

SEQ ID NO: 1287382 - RNA, 14 nt, Human
cugggggccuggcu

SEQ ID NO: 1287383 - RNA, 15 nt, Human
cugggggccuggcug

SEQ ID NO: 1287384 - RNA, 22 nt, Human
cugggcuuauaucuggccucug

SEQ ID NO: 1287385 - RNA, 20 nt, Human
cuggggaaaacuccaccuuc

SEQ ID NO: 1287386 - RNA, 17 nt, Human
cuggggaaacuggccau

SEQ ID NO: 1287387 - RNA, 22 nt, Human
cuggggaaacuggccauggccu

SEQ ID NO: 1287388 - RNA, 19 nt, Human
cuggggaaacuggccaugg

SEQ ID NO: 1287389 - RNA, 16 nt, Human
cugggggccuggcugg

SEQ ID NO: 1287390 - RNA, 17 nt, Human
cugggggccuggcuggc

SEQ ID NO: 1287391 - RNA, 18 nt, Human
cugggggccuggcuggcu

SEQ ID NO: 1287392 - RNA, 23 nt, Human
cugggggccuggcuggcugaggg

SEQ ID NO: 1287393 - RNA, 18 nt, Human
cugggggcugaggagcag

SEQ ID NO: 1287394 - RNA, 14 nt, Human
cugggggcugcagu

SEQ ID NO: 1287395 - RNA, 18 nt, Human
cugggggcugcaguucga

SEQ ID NO: 1287396 - RNA, 16 nt, Human
cugggggguggccagg

SEQ ID NO: 1287397 - RNA, 19 nt, Human
cugggggguggccaggccg

SEQ ID NO: 1287398 - RNA, 14 nt, Human
cugggggugccagg

SEQ ID NO: 1287399 - RNA, 15 nt, Human
cugggggugccagga

SEQ ID NO: 1287400 - RNA, 19 nt, Human
cugggggugccaggaccag

SEQ ID NO: 1287401 - RNA, 17 nt, Human
cugggggguggccaggc

SEQ ID NO: 1287402 - RNA, 20 nt, Human
cugggcuuauaucuggccuc

SEQ ID NO: 1287403 - RNA, 16 nt, Human
cugggcuggaugagcu

SEQ ID NO: 1287404 - RNA, 17 nt, Human
cugggcuggaugagcuc

SEQ ID NO: 1287405 - RNA, 18 nt, Human
cugggcuggaugagcucc

SEQ ID NO: 1287406 - RNA, 19 nt, Human
cugggcuggaugagcuccc

SEQ ID NO: 1287407 - RNA, 20 nt, Human
cugggcuggaugagcuccca

SEQ ID NO: 1287408 - RNA, 12 nt, Human
cugggcugggaa

SEQ ID NO: 1287409 - RNA, 15 nt, Human
cugggcugugggcaa

SEQ ID NO: 1287410 - RNA, 22 nt, Human
cugguaugaacuugaggacaca

SEQ ID NO: 1287411 - RNA, 21 nt, Human
cugguaugaacuugaggacac

SEQ ID NO: 1287412 - RNA, 20 nt, Human
cugguaugaacuugaggaca

SEQ ID NO: 1287413 - RNA, 18 nt, Human
cugguaugaacuugagga

SEQ ID NO: 1287414 - RNA, 14 nt, Human
cugguaucucagaa

SEQ ID NO: 1287415 - RNA, 15 nt, Human
cugguaucucagaaa

SEQ ID NO: 1287416 - RNA, 17 nt, Human
cugguaucucagaaagu

SEQ ID NO: 1287417 - RNA, 19 nt, Human
cugguaucucagaaagugc

SEQ ID NO: 1287418 - RNA, 22 nt, Human
cugguaucucagaaagugccug

SEQ ID NO: 1287419 - RNA, 23 nt, Human
cugguaucucagaaagugccuga

SEQ ID NO: 1287420 - RNA, 15 nt, Human
cugguaauauugacu

SEQ ID NO: 1287421 - RNA, 19 nt, Human
cugguaauauugacuugua

SEQ ID NO: 1287422 - RNA, 14 nt, Human
cugguaauagcugu

SEQ ID NO: 1287423 - RNA, 19 nt, Human
cugguauauccaaaagcuu

SEQ ID NO: 1287424 - RNA, 20 nt, Human
cugguauauccaaaagcuuu

SEQ ID NO: 1287425 - RNA, 16 nt, Human
cugggucgcccuggac

SEQ ID NO: 1287426 - RNA, 15 nt, Human
cugggucgcccugga

SEQ ID NO: 1287427 - RNA, 20 nt, Human
cuggguuuuguauucucuga

SEQ ID NO: 1287428 - RNA, 22 nt, Human
cuggguuuuguauucucugagc

SEQ ID NO: 1287429 - RNA, 20 nt, Human
cuggggguucuuucuuccuc

SEQ ID NO: 1287430 - RNA, 23 nt, Human
cuggggguucuuucuuccucugc

SEQ ID NO: 1287431 - RNA, 19 nt, Human
cugggguaaguggucuaag

SEQ ID NO: 1287432 - RNA, 20 nt, Human
cugggguauaaaacuuuccu

SEQ ID NO: 1287433 - RNA, 13 nt, Human
cugggucgcccug

SEQ ID NO: 1287434 - RNA, 20 nt, Human
cuggguccauaucacacaca

SEQ ID NO: 1287435 - RNA, 23 nt, Human
cuggguccaauuguggcacuugg

SEQ ID NO: 1287436 - RNA, 13 nt, Human
cuggguccauauc

SEQ ID NO: 1287437 - RNA, 15 nt, Human
cuggguccauaucac

SEQ ID NO: 1287438 - RNA, 17 nt, Human
cuggguccauaucacac

SEQ ID NO: 1287439 - RNA, 23 nt, Human
cugggccccugccucucugcagg

SEQ ID NO: 1287440 - RNA, 20 nt, Human
cugggccccugccucucugc

SEQ ID NO: 1287441 - RNA, 19 nt, Human
cugggcaaugauggcaauu

SEQ ID NO: 1287442 - RNA, 13 nt, Human
cugggcccucucu

SEQ ID NO: 1287443 - RNA, 14 nt, Human
cugggcccucucug

SEQ ID NO: 1287444 - RNA, 15 nt, Human
cugggcccucucugc

SEQ ID NO: 1287445 - RNA, 18 nt, Human
cugggcccucucugcucu

SEQ ID NO: 1287446 - RNA, 11 nt, Human
cugggauuagg

SEQ ID NO: 1287447 - RNA, 23 nt, Human
cugggauucaggaaaaggccugg

SEQ ID NO: 1287448 - RNA, 22 nt, Human
cugggauucaggaaaaggccug

SEQ ID NO: 1287449 - RNA, 23 nt, Human
cugggauuccuuagacucuuuuc

SEQ ID NO: 1287450 - RNA, 15 nt, Human
cugggcaaagccuag

SEQ ID NO: 1287451 - RNA, 15 nt, Human
cugggcaagcuggcg

SEQ ID NO: 1287452 - RNA, 18 nt, Human
cugggauuacaggcguga

SEQ ID NO: 1287453 - RNA, 11 nt, Human
cugggcccugg

SEQ ID NO: 1287454 - RNA, 13 nt, Human
cugggccugcaga

SEQ ID NO: 1287455 - RNA, 20 nt, Human
cugggccugaccaaacagcc

SEQ ID NO: 1287456 - RNA, 14 nt, Human
cugggccugccuca

SEQ ID NO: 1287457 - RNA, 15 nt, Human
cugggccugccucac

SEQ ID NO: 1287458 - RNA, 16 nt, Human
cugggccugccucacc

SEQ ID NO: 1287459 - RNA, 12 nt, Human
cugggccugcug

SEQ ID NO: 1287460 - RNA, 13 nt, Human
cugggccugcugc

SEQ ID NO: 1287461 - RNA, 14 nt, Human
cugggccugcugcu

SEQ ID NO: 1287462 - RNA, 15 nt, Human
cugggccugcugcug

SEQ ID NO: 1287463 - RNA, 16 nt, Human
cugggccugcugcuga

SEQ ID NO: 1287464 - RNA, 17 nt, Human
cugggccugcugcugag

SEQ ID NO: 1287465 - RNA, 18 nt, Human
cugggccugcugcugaga

SEQ ID NO: 1287466 - RNA, 19 nt, Human
cugggccugcugcugagaa

SEQ ID NO: 1287467 - RNA, 22 nt, Human
cugggccugcugcugagaaccu

SEQ ID NO: 1287468 - RNA, 20 nt, Human
cugggccugcugcugagaac

SEQ ID NO: 1287469 - RNA, 11 nt, Human
cugggccuggu

SEQ ID NO: 1287470 - RNA, 13 nt, Human
cugggccuggucu

SEQ ID NO: 1287471 - RNA, 14 nt, Human
cugggccuggucuc

SEQ ID NO: 1287472 - RNA, 15 nt, Human
cugggccuggucuca

SEQ ID NO: 1287473 - RNA, 16 nt, Human
cugggccuggucucac

SEQ ID NO: 1287474 - RNA, 19 nt, Human
cugggccuggucucacccu

SEQ ID NO: 1287475 - RNA, 23 nt, Human
cugggccuggucucacccuggag

SEQ ID NO: 1287476 - RNA, 14 nt, Human
cugggccuuaggaa

SEQ ID NO: 1287477 - RNA, 18 nt, Human
cugggccuuaggaagagc

SEQ ID NO: 1287478 - RNA, 14 nt, Human
cugggcuccuccag

SEQ ID NO: 1287479 - RNA, 15 nt, Human
cugggcuccuccagg

SEQ ID NO: 1287480 - RNA, 17 nt, Human
cugggcuccuccagggu

SEQ ID NO: 1287481 - RNA, 11 nt, Human
cugggccuugg

SEQ ID NO: 1287482 - RNA, 13 nt, Human
cugggcuccugga

SEQ ID NO: 1287483 - RNA, 15 nt, Human
cugggcuccuggacc

SEQ ID NO: 1287484 - RNA, 14 nt, Human
cugggcuccuggac

SEQ ID NO: 1287485 - RNA, 22 nt, Human
cugggcucugcaauuccccucu

SEQ ID NO: 1287486 - RNA, 23 nt, Human
cugggcucugcaauuccccucug

SEQ ID NO: 1287487 - RNA, 13 nt, Human
cugggcucugagu

SEQ ID NO: 1287488 - RNA, 12 nt, Human
cugggcugaggg

SEQ ID NO: 1287489 - RNA, 13 nt, Human
cugggcugaggga

SEQ ID NO: 1287490 - RNA, 16 nt, Human
cugggcugagggagcc

SEQ ID NO: 1287491 - RNA, 18 nt, Human
cugggcugagggagccug

SEQ ID NO: 1287492 - RNA, 19 nt, Human
cugggcugagggagccugg

SEQ ID NO: 1287493 - RNA, 23 nt, Human
cugggcugagggagccuggcccc

SEQ ID NO: 1287494 - RNA, 12 nt, Human
cugauuucuagg

SEQ ID NO: 1287495 - RNA, 16 nt, Human
cugauuuaggagaagc

SEQ ID NO: 1287496 - RNA, 17 nt, Human
cugauuuaggagaagcc

SEQ ID NO: 1287497 - RNA, 18 nt, Human
cugauuuaggagaagcca

SEQ ID NO: 1287498 - RNA, 20 nt, Human
cugauuuaggagaagccagg

SEQ ID NO: 1287499 - RNA, 22 nt, Human
cugauuuaggagaagccaggaa

SEQ ID NO: 1287500 - RNA, 21 nt, Human
cugauuuaggagaagccagga

SEQ ID NO: 1287501 - RNA, 18 nt, Human
cugauccuggaggcccag

SEQ ID NO: 1287502 - RNA, 19 nt, Human
cugauccuggaggcccagu

SEQ ID NO: 1287503 - RNA, 14 nt, Human
cugcaaaaagaaaa

SEQ ID NO: 1287504 - RNA, 13 nt, Human
cugcaaagcccag

SEQ ID NO: 1287505 - RNA, 15 nt, Human
cugcaaagcccagcu

SEQ ID NO: 1287506 - RNA, 15 nt, Human
cugcaaacugggaac

SEQ ID NO: 1287507 - RNA, 16 nt, Human
cugcaaacugggaacc

SEQ ID NO: 1287508 - RNA, 21 nt, Human
cugcaaacugggaaccccuuu

SEQ ID NO: 1287509 - RNA, 23 nt, Human
cugcaaacugggaaccccuuucc

SEQ ID NO: 1287510 - RNA, 22 nt, Human
cugcaaagaucuguccucagcc

SEQ ID NO: 1287511 - RNA, 23 nt, Human
cugcaaagaucuguccucagccu

SEQ ID NO: 1287512 - RNA, 17 nt, Human
cugcaaaaggacucuca

SEQ ID NO: 1287513 - RNA, 15 nt, Human
cugcaaacugccuuc

SEQ ID NO: 1287514 - RNA, 12 nt, Human
cugcaaacuggg

SEQ ID NO: 1287515 - RNA, 13 nt, Human
cugcaaacuggga

SEQ ID NO: 1287516 - RNA, 14 nt, Human
cugcaaacugggaa

SEQ ID NO: 1287517 - RNA, 18 nt, Human
cugauuuguaacccacug

SEQ ID NO: 1287518 - RNA, 19 nt, Human
cugauuuguaacccacuga

SEQ ID NO: 1287519 - RNA, 21 nt, Human
cugauuuuaggagcuaaggcu

SEQ ID NO: 1287520 - RNA, 22 nt, Human
cugauuuuaggagcuaaggcuc

SEQ ID NO: 1287521 - RNA, 23 nt, Human
cugauuuuaggagcuaaggcucu

SEQ ID NO: 1287522 - RNA, 18 nt, Human
cugauuuucaaagcuuuu

SEQ ID NO: 1287523 - RNA, 21 nt, Human
cugauuuucaaagcuuuuucc

SEQ ID NO: 1287524 - RNA, 15 nt, Human
cugauuuuuuuuccu

SEQ ID NO: 1287525 - RNA, 19 nt, Human
cugauuuuuuuuccuuuua

SEQ ID NO: 1287526 - RNA, 20 nt, Human
cugauuuuuuuuccuuuuaa

SEQ ID NO: 1287527 - RNA, 19 nt, Human
cugcaagugagguguguca

SEQ ID NO: 1287528 - RNA, 22 nt, Human
cugcaagugaggugugucacaa

SEQ ID NO: 1287529 - RNA, 17 nt, Human
cugcaaagcccagcuug

SEQ ID NO: 1287530 - RNA, 18 nt, Human
cugcaaguuaugaaauau

SEQ ID NO: 1287531 - RNA, 18 nt, Human
cugcaauacaaguuucau

SEQ ID NO: 1287532 - RNA, 15 nt, Human
cugcacaauaaaaau

SEQ ID NO: 1287533 - RNA, 18 nt, Human
cugcacaauaaaaauguu

SEQ ID NO: 1287534 - RNA, 13 nt, Human
cugcacacagcac

SEQ ID NO: 1287535 - RNA, 22 nt, Human
cugcacaauaaaaauguuuaac

SEQ ID NO: 1287536 - RNA, 15 nt, Human
cugcacaauaacucc

SEQ ID NO: 1287537 - RNA, 16 nt, Human
cugcacaauaacuccu

SEQ ID NO: 1287538 - RNA, 20 nt, Human
cugcacaauaacuccuccca

SEQ ID NO: 1287539 - RNA, 21 nt, Human
cugcacaauaacuccucccag

SEQ ID NO: 1287540 - RNA, 22 nt, Human
cugcacaauaacuccucccagg

SEQ ID NO: 1287541 - RNA, 23 nt, Human
cugcacaauaacuccucccaggg

SEQ ID NO: 1287542 - RNA, 14 nt, Human
cugcacacagcacg

SEQ ID NO: 1287543 - RNA, 20 nt, Human
cugcacacgcuccuuccucu

SEQ ID NO: 1287544 - RNA, 22 nt, Human
cugcacacgcuccuuccucuga

SEQ ID NO: 1287545 - RNA, 18 nt, Human
cugcacacccuccagaga

SEQ ID NO: 1287546 - RNA, 20 nt, Human
cugcacacccuccagagaca

SEQ ID NO: 1287547 - RNA, 15 nt, Human
cugcacaguugaagg

SEQ ID NO: 1287548 - RNA, 18 nt, Human
cugcacaucuguaaaucu

SEQ ID NO: 1287549 - RNA, 22 nt, Human
cugcacaucuguaaaucuacac

SEQ ID NO: 1287550 - RNA, 22 nt, Human
cugcacaugacucggggguggg

SEQ ID NO: 1287551 - RNA, 23 nt, Human
cugcacaugacucgggggugggg

SEQ ID NO: 1287552 - RNA, 21 nt, Human
cugcacauuaaggagaaaucu

SEQ ID NO: 1287553 - RNA, 15 nt, Human
cugcacugaugcugc

SEQ ID NO: 1287554 - RNA, 17 nt, Human
cugcacugaugcugccc

SEQ ID NO: 1287555 - RNA, 18 nt, Human
cugcacugaugcugcccc

SEQ ID NO: 1287556 - RNA, 19 nt, Human
cugcacugaugcugccccu

SEQ ID NO: 1287557 - RNA, 12 nt, Human
cugaguuuccua

SEQ ID NO: 1287558 - RNA, 19 nt, Human
cugaguuuccuaugggaac

SEQ ID NO: 1287559 - RNA, 20 nt, Human
cugaguuuccuaugggaaca

SEQ ID NO: 1287560 - RNA, 13 nt, Human
cugaguuuuacca

SEQ ID NO: 1287561 - RNA, 16 nt, Human
cugaguuuuccauggc

SEQ ID NO: 1287562 - RNA, 14 nt, Human
cugaguuuuaccaa

SEQ ID NO: 1287563 - RNA, 11 nt, Human
cugaguuuucc

SEQ ID NO: 1287564 - RNA, 19 nt, Human
cugauaagagaaucaacau

SEQ ID NO: 1287565 - RNA, 14 nt, Human
cugaguuccugcau

SEQ ID NO: 1287566 - RNA, 16 nt, Human
cugaguuccugcaugc

SEQ ID NO: 1287567 - RNA, 15 nt, Human
cugaguugcuuuuca

SEQ ID NO: 1287568 - RNA, 16 nt, Human
cugaguugcuuuucag

SEQ ID NO: 1287569 - RNA, 11 nt, Human
cugaguuuccu

SEQ ID NO: 1287570 - RNA, 20 nt, Human
cugagucccaggcugagccu

SEQ ID NO: 1287571 - RNA, 17 nt, Human
cugaguuacagaaauga

SEQ ID NO: 1287572 - RNA, 22 nt, Human
cugauacagaaaaguugaauuu

SEQ ID NO: 1287573 - RNA, 15 nt, Human
cugauaauuuuaaau

SEQ ID NO: 1287574 - RNA, 17 nt, Human
cugauaauuuuaaauuc

SEQ ID NO: 1287575 - RNA, 18 nt, Human
cugauaauuuuaaauucu

SEQ ID NO: 1287576 - RNA, 16 nt, Human
cugauauauuuuacaa

SEQ ID NO: 1287577 - RNA, 18 nt, Human
cugauauauuuuacaauu

SEQ ID NO: 1287578 - RNA, 15 nt, Human
cugaucaccugcccu

SEQ ID NO: 1287579 - RNA, 18 nt, Human
cugauauuuucucuagga

SEQ ID NO: 1287580 - RNA, 16 nt, Human
cugauauuuucucuag

SEQ ID NO: 1287581 - RNA, 12 nt, Human
cugaucaaggcc

SEQ ID NO: 1287582 - RNA, 15 nt, Human
cugaucaaggccuua

SEQ ID NO: 1287583 - RNA, 14 nt, Human
cugauauuuucucu

SEQ ID NO: 1287584 - RNA, 15 nt, Human
cugauauuuucucua

SEQ ID NO: 1287585 - RNA, 17 nt, Human
cugaucagaccacggcu

SEQ ID NO: 1287586 - RNA, 14 nt, Human
cugaucagagccgu

SEQ ID NO: 1287587 - RNA, 20 nt, Human
cugaucagagccgugguccu

SEQ ID NO: 1287588 - RNA, 16 nt, Human
cugaucagaacaaaug

SEQ ID NO: 1287589 - RNA, 15 nt, Human
cugaucccucuacag

SEQ ID NO: 1287590 - RNA, 12 nt, Human
cugauccuggag

SEQ ID NO: 1287591 - RNA, 15 nt, Human
cugauccuggaggcc

SEQ ID NO: 1287592 - RNA, 17 nt, Human
cugauccuggaggccca

SEQ ID NO: 1287593 - RNA, 14 nt, Human
cugaggcugaggca

SEQ ID NO: 1287594 - RNA, 11 nt, Human
cugaggcuggc

SEQ ID NO: 1287595 - RNA, 13 nt, Human
cugaggcuggcac

SEQ ID NO: 1287596 - RNA, 12 nt, Human
cugaggcugagg

SEQ ID NO: 1287597 - RNA, 17 nt, Human
cugaggcuggcacagga

SEQ ID NO: 1287598 - RNA, 18 nt, Human
cugaggcuggcacaggac

SEQ ID NO: 1287599 - RNA, 19 nt, Human
cugaggcuggcacaggaca

SEQ ID NO: 1287600 - RNA, 20 nt, Human
cugaggcuggcacaggacau

SEQ ID NO: 1287601 - RNA, 13 nt, Human
cugaggcuguggu

SEQ ID NO: 1287602 - RNA, 14 nt, Human
cugaggcugugguc

SEQ ID NO: 1287603 - RNA, 17 nt, Human
cugaggcuguggucaca

SEQ ID NO: 1287604 - RNA, 19 nt, Human
cugaggcuguggucacagc

SEQ ID NO: 1287605 - RNA, 20 nt, Human
cugaggcuguggucacagcg

SEQ ID NO: 1287606 - RNA, 14 nt, Human
cugaggcuuuggau

SEQ ID NO: 1287607 - RNA, 12 nt, Human
cugagggagccu

SEQ ID NO: 1287608 - RNA, 13 nt, Human
cugagggagccug

SEQ ID NO: 1287609 - RNA, 17 nt, Human
cugagggagccuggccc

SEQ ID NO: 1287610 - RNA, 15 nt, Human
cugagggaucuuuac

SEQ ID NO: 1287611 - RNA, 22 nt, Human
cugagucacccuaccugugccu

SEQ ID NO: 1287612 - RNA, 23 nt, Human
cugagucacccuaccugugccug

SEQ ID NO: 1287613 - RNA, 14 nt, Human
cugagucagagcca

SEQ ID NO: 1287614 - RNA, 18 nt, Human
cugagucagagccauguc

SEQ ID NO: 1287615 - RNA, 19 nt, Human
cugagucagagccaugucu

SEQ ID NO: 1287616 - RNA, 17 nt, Human
cugagucaggacuugaa

SEQ ID NO: 1287617 - RNA, 21 nt, Human
cugagucagagccaugucuuc

SEQ ID NO: 1287618 - RNA, 21 nt, Human
cugaggcuccacuuggucugu

SEQ ID NO: 1287619 - RNA, 15 nt, Human
cugaggcuccacuug

SEQ ID NO: 1287620 - RNA, 17 nt, Human
cugaggccuagacucug

SEQ ID NO: 1287621 - RNA, 23 nt, Human
cugaggcgccccaacccguggag

SEQ ID NO: 1287622 - RNA, 22 nt, Human
cugaggcgagaagggcugcuuc

SEQ ID NO: 1287623 - RNA, 19 nt, Human
cugaggccuagacucuguc

SEQ ID NO: 1287624 - RNA, 15 nt, Human
cugaggccuagacuc

SEQ ID NO: 1287625 - RNA, 12 nt, Human
cugaggccugga

SEQ ID NO: 1287626 - RNA, 15 nt, Human
cugaggccuggacuu

SEQ ID NO: 1287627 - RNA, 19 nt, Human
cugaggccuggacuuuccu

SEQ ID NO: 1287628 - RNA, 20 nt, Human
cugaggccuggacuuuccug

SEQ ID NO: 1287629 - RNA, 22 nt, Human
cugaggccuggacuuuccugca

SEQ ID NO: 1287630 - RNA, 14 nt, Human
cugaggccugggcc

SEQ ID NO: 1287631 - RNA, 15 nt, Human
cugaggccugggccg

SEQ ID NO: 1287632 - RNA, 19 nt, Human
cugaggccugggccgcugc

SEQ ID NO: 1287633 - RNA, 22 nt, Human
cugaggccugggccgcugccac

SEQ ID NO: 1287634 - RNA, 23 nt, Human
cugaggccugggccgcugccacg

SEQ ID NO: 1287635 - RNA, 19 nt, Human
cugagcccagggaggccga

SEQ ID NO: 1287636 - RNA, 12 nt, Human
cugagccccagg

SEQ ID NO: 1287637 - RNA, 13 nt, Human
cugagccccaggg

SEQ ID NO: 1287638 - RNA, 15 nt, Human
cugagccccagggag

SEQ ID NO: 1287639 - RNA, 18 nt, Human
cugagccccagggagagg

SEQ ID NO: 1287640 - RNA, 20 nt, Human
cugagcccgguaagagcaaa

SEQ ID NO: 1287641 - RNA, 19 nt, Human
cugagcccgguaagagcaa

SEQ ID NO: 1287642 - RNA, 23 nt, Human
cugccuggacuuggccccugcca

SEQ ID NO: 1287643 - RNA, 22 nt, Human
cugccuggacuuggccccugcc

SEQ ID NO: 1287644 - RNA, 12 nt, Human
cugccuggaccc

SEQ ID NO: 1287645 - RNA, 10 nt, Human
cugccuggag

SEQ ID NO: 1287646 - RNA, 22 nt, Human
cugccuggagacuuagggcacc

SEQ ID NO: 1287647 - RNA, 17 nt, Human
cugccuggaccagccuc

SEQ ID NO: 1287648 - RNA, 13 nt, Human
cugccuggacccg

SEQ ID NO: 1287649 - RNA, 11 nt, Human
cugccuggagg

SEQ ID NO: 1287650 - RNA, 12 nt, Human
cugccuggagga

SEQ ID NO: 1287651 - RNA, 15 nt, Human
cugccuggaggaccu

SEQ ID NO: 1287652 - RNA, 16 nt, Human
cugccuggaggaccug

SEQ ID NO: 1287653 - RNA, 17 nt, Human
cugccuggaggaccuga

SEQ ID NO: 1287654 - RNA, 18 nt, Human
cugccuggaggaccugag

SEQ ID NO: 1287655 - RNA, 19 nt, Human
cugccuggaggaccugagc

SEQ ID NO: 1287656 - RNA, 20 nt, Human
cugccuggaggaccugagcc

SEQ ID NO: 1287657 - RNA, 21 nt, Human
cugccuggaggaccugagccu

SEQ ID NO: 1287658 - RNA, 23 nt, Human
cugccuggaggaccugagccugc

SEQ ID NO: 1287659 - RNA, 22 nt, Human
cugccuggaggaccugagccug

SEQ ID NO: 1287660 - RNA, 21 nt, Human
cugccuucgcuucuugccucu

SEQ ID NO: 1287661 - RNA, 23 nt, Human
cugccuucgcuucuugccucugu

SEQ ID NO: 1287662 - RNA, 18 nt, Human
cugccuucuggccuugua

SEQ ID NO: 1287663 - RNA, 14 nt, Human
cugccuucuggccu

SEQ ID NO: 1287664 - RNA, 19 nt, Human
cugccuucuucggaaagaa

SEQ ID NO: 1287665 - RNA, 17 nt, Human
cugccuugaaaaagaca

SEQ ID NO: 1287666 - RNA, 19 nt, Human
cugccucucugcagguccc

SEQ ID NO: 1287667 - RNA, 14 nt, Human
cugccugcccuggu

SEQ ID NO: 1287668 - RNA, 20 nt, Human
cugccuggaagagcagcccu

SEQ ID NO: 1287669 - RNA, 15 nt, Human
cugccugcccuggug

SEQ ID NO: 1287670 - RNA, 11 nt, Human
cugccuggacc

SEQ ID NO: 1287671 - RNA, 23 nt, Human
cugcggaggaaggaggacccagg

SEQ ID NO: 1287672 - RNA, 18 nt, Human
cugcggcccaauccaagg

SEQ ID NO: 1287673 - RNA, 21 nt, Human
cugccuuuuaguuccugugca

SEQ ID NO: 1287674 - RNA, 23 nt, Human
cugccuuuuaguuccugugcaca

SEQ ID NO: 1287675 - RNA, 20 nt, Human
cugccuuuuaguuccugugc

SEQ ID NO: 1287676 - RNA, 19 nt, Human
cugccuuuuaguuccugug

SEQ ID NO: 1287677 - RNA, 17 nt, Human
cugccuuuuaguuccug

SEQ ID NO: 1287678 - RNA, 18 nt, Human
cugccuuugccaggugac

SEQ ID NO: 1287679 - RNA, 17 nt, Human
cugccuuugccagguga

SEQ ID NO: 1287680 - RNA, 15 nt, Human
cugccuuuccaucca

SEQ ID NO: 1287681 - RNA, 20 nt, Human
cugccuuuccauccauggcc

SEQ ID NO: 1287682 - RNA, 22 nt, Human
cugccuuuccauccauggccag

SEQ ID NO: 1287683 - RNA, 21 nt, Human
cugccuuuccauccauggcca

SEQ ID NO: 1287684 - RNA, 14 nt, Human
cugccuuugccagg

SEQ ID NO: 1287685 - RNA, 15 nt, Human
cugccuuugccaggu

SEQ ID NO: 1287686 - RNA, 16 nt, Human
cugccuuugccaggug

SEQ ID NO: 1287687 - RNA, 19 nt, Human
cugcgugacaauaaaacau

SEQ ID NO: 1287688 - RNA, 18 nt, Human
cugccucucugcaggucc

SEQ ID NO: 1287689 - RNA, 17 nt, Human
cugccucucugcagguc

SEQ ID NO: 1287690 - RNA, 16 nt, Human
cugccucucugcaggu

SEQ ID NO: 1287691 - RNA, 15 nt, Human
cugccucucugcagg

SEQ ID NO: 1287692 - RNA, 14 nt, Human
cugccuccagaaug

SEQ ID NO: 1287693 - RNA, 11 nt, Human
cugccucagga

SEQ ID NO: 1287694 - RNA, 22 nt, Human
cugccuccagaauggucuuucu

SEQ ID NO: 1287695 - RNA, 13 nt, Human
cugccuauuuuaa

SEQ ID NO: 1287696 - RNA, 23 nt, Human
cugccuauuaucugucagcugca

SEQ ID NO: 1287697 - RNA, 17 nt, Human
cugccucagccucccga

SEQ ID NO: 1287698 - RNA, 18 nt, Human
cugccucagccucccaag

SEQ ID NO: 1287699 - RNA, 10 nt, Human
cugccucagg

SEQ ID NO: 1287700 - RNA, 16 nt, Human
cugccggcuccuuggu

SEQ ID NO: 1287701 - RNA, 20 nt, Human
cugccuacagaacuucagaa

SEQ ID NO: 1287702 - RNA, 23 nt, Human
cugccuacagaacuucagaaaga

SEQ ID NO: 1287703 - RNA, 14 nt, Human
cugccuagaaacaa

SEQ ID NO: 1287704 - RNA, 15 nt, Human
cugccuagaaacaac

SEQ ID NO: 1287705 - RNA, 18 nt, Human
cugccuagaaacaacacu

SEQ ID NO: 1287706 - RNA, 20 nt, Human
cugccuagaaacaacacugu

SEQ ID NO: 1287707 - RNA, 21 nt, Human
cugccuagaaacaacacugua

SEQ ID NO: 1287708 - RNA, 23 nt, Human
cugccuagaaacaacacuguagu

SEQ ID NO: 1287709 - RNA, 15 nt, Human
cugccuagauucagg

SEQ ID NO: 1287710 - RNA, 23 nt, Human
cugccuagauucagggaaagugg

SEQ ID NO: 1287711 - RNA, 19 nt, Human
cugccuagauucagggaaa

SEQ ID NO: 1287712 - RNA, 17 nt, Human
cugccuauuaucuguca

SEQ ID NO: 1287713 - RNA, 21 nt, Human
cugccccuccucucugcccua

SEQ ID NO: 1287714 - RNA, 12 nt, Human
cugccccaacuc

SEQ ID NO: 1287715 - RNA, 13 nt, Human
cugccccucucac

SEQ ID NO: 1287716 - RNA, 17 nt, Human
cugccccucucaccaaa

SEQ ID NO: 1287717 - RNA, 15 nt, Human
cugccgcgcagugug

SEQ ID NO: 1287718 - RNA, 18 nt, Human
cugccaccugucugucug

SEQ ID NO: 1287719 - RNA, 16 nt, Human
cugccaccugucuguc

SEQ ID NO: 1287720 - RNA, 15 nt, Human
cugccaccugucugu

SEQ ID NO: 1287721 - RNA, 14 nt, Human
cugccaccugucug

SEQ ID NO: 1287722 - RNA, 13 nt, Human
cugccaccugucu

SEQ ID NO: 1287723 - RNA, 12 nt, Human
cugccaccuguc

SEQ ID NO: 1287724 - RNA, 11 nt, Human
cugccaccugu

SEQ ID NO: 1287725 - RNA, 17 nt, Human
cugccaccugucugucu

SEQ ID NO: 1287726 - RNA, 16 nt, Human
cugccacucacuaggc

SEQ ID NO: 1287727 - RNA, 19 nt, Human
cugccacucacuaggcccc

SEQ ID NO: 1287728 - RNA, 14 nt, Human
cugccacugagggg

SEQ ID NO: 1287729 - RNA, 18 nt, Human
cugccacugaggggggau

SEQ ID NO: 1287730 - RNA, 23 nt, Human
cugccacugaggggggauccagu

SEQ ID NO: 1287731 - RNA, 17 nt, Human
cugcccacucccaggac

SEQ ID NO: 1287732 - RNA, 17 nt, Human
cugcccagccuccaagc

SEQ ID NO: 1287733 - RNA, 13 nt, Human
cugcccaguugca

SEQ ID NO: 1287734 - RNA, 16 nt, Human
cugcccauggacaggc

SEQ ID NO: 1287735 - RNA, 18 nt, Human
cugcccauggacaggcug

SEQ ID NO: 1287736 - RNA, 20 nt, Human
cugcccauggacaggcuggc

SEQ ID NO: 1287737 - RNA, 19 nt, Human
cugccaccuccugccucag

SEQ ID NO: 1287738 - RNA, 12 nt, Human
cugccaccugga

SEQ ID NO: 1287739 - RNA, 13 nt, Human
cugccaccuggac

SEQ ID NO: 1287740 - RNA, 14 nt, Human
cugccaccuggacc

SEQ ID NO: 1287741 - RNA, 15 nt, Human
cugccaccuggaccc

SEQ ID NO: 1287742 - RNA, 16 nt, Human
cugccaccuggacccc

SEQ ID NO: 1287743 - RNA, 20 nt, Human
cugccaccuggaccccugca

SEQ ID NO: 1287744 - RNA, 22 nt, Human
cugccaccuggaccccugcauu

SEQ ID NO: 1287745 - RNA, 21 nt, Human
cugccaccuggaccccugcau

SEQ ID NO: 1287746 - RNA, 16 nt, Human
cugccaccuccugccu

SEQ ID NO: 1287747 - RNA, 14 nt, Human
cugccaccuccugc

SEQ ID NO: 1287748 - RNA, 12 nt, Human
cugccacacagg

SEQ ID NO: 1287749 - RNA, 21 nt, Human
cugcauggcagggggcugcug

SEQ ID NO: 1287750 - RNA, 22 nt, Human
cugcauggcagggggcugcugc

SEQ ID NO: 1287751 - RNA, 23 nt, Human
cugcauggcagggggcugcugcu

SEQ ID NO: 1287752 - RNA, 16 nt, Human
cugcauggcauccucc

SEQ ID NO: 1287753 - RNA, 17 nt, Human
cugcauggcauccucca

SEQ ID NO: 1287754 - RNA, 18 nt, Human
cugcauggcauccuccag

SEQ ID NO: 1287755 - RNA, 19 nt, Human
cugcauggcauccuccagc

SEQ ID NO: 1287756 - RNA, 21 nt, Human
cugcauggcauccuccagccc

SEQ ID NO: 1287757 - RNA, 22 nt, Human
cugcauggcauccuccagcccc

SEQ ID NO: 1287758 - RNA, 21 nt, Human
cugcauguacuguauauuaca

SEQ ID NO: 1287759 - RNA, 23 nt, Human
cugcaugcgagugcucauuucag

SEQ ID NO: 1287760 - RNA, 12 nt, Human
cugcaugcccag

SEQ ID NO: 1287761 - RNA, 13 nt, Human
cugcaugcccaga

SEQ ID NO: 1287762 - RNA, 14 nt, Human
cugcaugcccagag

SEQ ID NO: 1287763 - RNA, 16 nt, Human
cugcaugcccagagac

SEQ ID NO: 1287764 - RNA, 17 nt, Human
cugcaugcccagagacc

SEQ ID NO: 1287765 - RNA, 19 nt, Human
cugcaugcccagagaccca

SEQ ID NO: 1287766 - RNA, 20 nt, Human
cugcaugcccagagacccag

SEQ ID NO: 1287767 - RNA, 22 nt, Human
cugcaugcccagagacccagcg

SEQ ID NO: 1287768 - RNA, 21 nt, Human
cugcaugcccagagacccagc

SEQ ID NO: 1287769 - RNA, 13 nt, Human
cugcauggcaggg

SEQ ID NO: 1287770 - RNA, 14 nt, Human
cugcauggcagggg

SEQ ID NO: 1287771 - RNA, 17 nt, Human
cugcauggcagggggcu

SEQ ID NO: 1287772 - RNA, 20 nt, Human
cugcauggcagggggcugcu

SEQ ID NO: 1287773 - RNA, 13 nt, Human
cugcauccagccu

SEQ ID NO: 1287774 - RNA, 19 nt, Human
cugcauccauucuccugag

SEQ ID NO: 1287775 - RNA, 19 nt, Human
cugcauccuccgccucccg

SEQ ID NO: 1287776 - RNA, 20 nt, Human
cugcauccuccgccucccgg

SEQ ID NO: 1287777 - RNA, 15 nt, Human
cugcauccucuggag

SEQ ID NO: 1287778 - RNA, 16 nt, Human
cugcauccucuggagc

SEQ ID NO: 1287779 - RNA, 18 nt, Human
cugcauccucuggagcca

SEQ ID NO: 1287780 - RNA, 20 nt, Human
cugcauccucuggagccagc

SEQ ID NO: 1287781 - RNA, 22 nt, Human
cugcauccucuggagccagccg

SEQ ID NO: 1287782 - RNA, 20 nt, Human
cugcaucuagaggcuuccuu

SEQ ID NO: 1287783 - RNA, 21 nt, Human
cugcaucuagaggcuuccuuc

SEQ ID NO: 1287784 - RNA, 23 nt, Human
cugcacuugcgguuccggcaugg

SEQ ID NO: 1287785 - RNA, 22 nt, Human
cugcacuugcgguuccggcaug

SEQ ID NO: 1287786 - RNA, 16 nt, Human
cugcagaaacuacuga

SEQ ID NO: 1287787 - RNA, 21 nt, Human
cugcauccauucuccugagga

SEQ ID NO: 1287788 - RNA, 16 nt, Human
cugaauuaugaaacuu

SEQ ID NO: 1287789 - RNA, 18 nt, Human
cugaauuaucuauuucau

SEQ ID NO: 1287790 - RNA, 11 nt, Human
cugaauuuuua

SEQ ID NO: 1287791 - RNA, 12 nt, Human
cugaauuuuuaa

SEQ ID NO: 1287792 - RNA, 21 nt, Human
cugaauuuuuaaacaaguauu

SEQ ID NO: 1287793 - RNA, 17 nt, Human
cugaccagccuccaugc

SEQ ID NO: 1287794 - RNA, 18 nt, Human
cugaauuuuuaaacaagu

SEQ ID NO: 1287795 - RNA, 21 nt, Human
cugaccagccuccaugcugcc

SEQ ID NO: 1287796 - RNA, 23 nt, Human
cugaccagccuccaugcugccuc

SEQ ID NO: 1287797 - RNA, 20 nt, Human
cugaccagccgugagcaugu

SEQ ID NO: 1287798 - RNA, 23 nt, Human
cugaccagccgugagcauguuug

SEQ ID NO: 1287799 - RNA, 13 nt, Human
cugaccagcuccc

SEQ ID NO: 1287800 - RNA, 14 nt, Human
cugaccagcucccc

SEQ ID NO: 1287801 - RNA, 20 nt, Human
cugaccagcucccccucccu

SEQ ID NO: 1287802 - RNA, 21 nt, Human
cugaccagcucccccucccuc

SEQ ID NO: 1287803 - RNA, 22 nt, Human
cugaccagcucccccucccucc

SEQ ID NO: 1287804 - RNA, 13 nt, Human
cugaccagcugcu

SEQ ID NO: 1287805 - RNA, 16 nt, Human
cugaccagcugcuccg

SEQ ID NO: 1287806 - RNA, 19 nt, Human
cugaccagcugcuccgagg

SEQ ID NO: 1287807 - RNA, 14 nt, Human
cugacggacucaug

SEQ ID NO: 1287808 - RNA, 15 nt, Human
cugacggccagggag

SEQ ID NO: 1287809 - RNA, 19 nt, Human
cugacggccagggagaagc

SEQ ID NO: 1287810 - RNA, 20 nt, Human
cugacggccagggagaagcu

SEQ ID NO: 1287811 - RNA, 21 nt, Human
cugacggccagggagaagcuc

SEQ ID NO: 1287812 - RNA, 16 nt, Human
cugacggaguccugug

SEQ ID NO: 1287813 - RNA, 17 nt, Human
cugacuguacuccuccc

SEQ ID NO: 1287814 - RNA, 13 nt, Human
cugacuguagcuu

SEQ ID NO: 1287815 - RNA, 18 nt, Human
cugacuguagcuuuggaa

SEQ ID NO: 1287816 - RNA, 14 nt, Human
cugacuuugcuugc

SEQ ID NO: 1287817 - RNA, 15 nt, Human
cugacuuugcuugcu

SEQ ID NO: 1287818 - RNA, 16 nt, Human
cugacuuugcuugcuu

SEQ ID NO: 1287819 - RNA, 17 nt, Human
cugacuuugcuugcuuu

SEQ ID NO: 1287820 - RNA, 18 nt, Human
cugacuuugcuugcuuug

SEQ ID NO: 1287821 - RNA, 19 nt, Human
cugacuuugcuugcuuuga

SEQ ID NO: 1287822 - RNA, 21 nt, Human
cugagaaaagcuuugaacccu

SEQ ID NO: 1287823 - RNA, 14 nt, Human
cugacuaaacuuuu

SEQ ID NO: 1287824 - RNA, 15 nt, Human
cugacuaaacuuuuu

SEQ ID NO: 1287825 - RNA, 19 nt, Human
cugacuaaacuuuuuuucu

SEQ ID NO: 1287826 - RNA, 22 nt, Human
cugacuaaacuuuuuuucugua

SEQ ID NO: 1287827 - RNA, 16 nt, Human
cugacucagggcuccu

SEQ ID NO: 1287828 - RNA, 18 nt, Human
cugacucagggcuccugg

SEQ ID NO: 1287829 - RNA, 19 nt, Human
cugacucagggcuccuggg

SEQ ID NO: 1287830 - RNA, 21 nt, Human
cugacucagggcuccuggguu

SEQ ID NO: 1287831 - RNA, 16 nt, Human
cugacucauucugaag

SEQ ID NO: 1287832 - RNA, 15 nt, Human
cugacucgguuucuc

SEQ ID NO: 1287833 - RNA, 16 nt, Human
cugacucgguuucucc

SEQ ID NO: 1287834 - RNA, 17 nt, Human
cugacucgguuucucca

SEQ ID NO: 1287835 - RNA, 18 nt, Human
cugacucgguuucuccaa

SEQ ID NO: 1287836 - RNA, 14 nt, Human
cugacugccaagcc

SEQ ID NO: 1287837 - RNA, 15 nt, Human
cugacugccaagcca

SEQ ID NO: 1287838 - RNA, 18 nt, Human
cugacugccaagccaugg

SEQ ID NO: 1287839 - RNA, 16 nt, Human
cugacugccaagccau

SEQ ID NO: 1287840 - RNA, 18 nt, Human
cugacugggaccaggcac

SEQ ID NO: 1287841 - RNA, 12 nt, Human
cugacugggagu

SEQ ID NO: 1287842 - RNA, 23 nt, Human
cugagauuauaggcaccuaccac

SEQ ID NO: 1287843 - RNA, 14 nt, Human
cugagauuuauuaa

SEQ ID NO: 1287844 - RNA, 15 nt, Human
cugagauuuauuaaa

SEQ ID NO: 1287845 - RNA, 17 nt, Human
cugagauuuauuaaaga

SEQ ID NO: 1287846 - RNA, 18 nt, Human
cugagauuuauuaaagaa

SEQ ID NO: 1287847 - RNA, 19 nt, Human
cugagauuuauuaaagaaa

SEQ ID NO: 1287848 - RNA, 15 nt, Human
cugagcaaauguggc

SEQ ID NO: 1287849 - RNA, 17 nt, Human
cugagcaaauguggcuc

SEQ ID NO: 1287850 - RNA, 20 nt, Human
cugagcaaauguggcuccug

SEQ ID NO: 1287851 - RNA, 21 nt, Human
cugagcaaauguggcuccugg

SEQ ID NO: 1287852 - RNA, 19 nt, Human
cugagcaacgcuauuccag

SEQ ID NO: 1287853 - RNA, 20 nt, Human
cugagcaacgcuauuccagc

SEQ ID NO: 1287854 - RNA, 23 nt, Human
cugagcaacgcuauuccagcugu

SEQ ID NO: 1287855 - RNA, 20 nt, Human
cugagcaacucuugauuauc

SEQ ID NO: 1287856 - RNA, 12 nt, Human
cugagcccaggg

SEQ ID NO: 1287857 - RNA, 13 nt, Human
cugagcccaggga

SEQ ID NO: 1287858 - RNA, 14 nt, Human
cugagcccagggag

SEQ ID NO: 1287859 - RNA, 15 nt, Human
cugagcccagggagg

SEQ ID NO: 1287860 - RNA, 16 nt, Human
cugagcccagggaggc

SEQ ID NO: 1287861 - RNA, 17 nt, Human
cugagcccagggaggcc

SEQ ID NO: 1287862 - RNA, 22 nt, Human
cugagcccagggaggccgaagc

SEQ ID NO: 1287863 - RNA, 13 nt, Human
cugagcagggccg

SEQ ID NO: 1287864 - RNA, 16 nt, Human
cugagcagggccgggg

SEQ ID NO: 1287865 - RNA, 17 nt, Human
cugagcagggccgggga

SEQ ID NO: 1287866 - RNA, 21 nt, Human
cugagcagggccggggaacug

SEQ ID NO: 1287867 - RNA, 12 nt, Human
cugagcaggcca

SEQ ID NO: 1287868 - RNA, 13 nt, Human
cugagcaggccac

SEQ ID NO: 1287869 - RNA, 23 nt, Human
cugagcaggccacacuucaaacu

SEQ ID NO: 1287870 - RNA, 15 nt, Human
cugagcaggccacac

SEQ ID NO: 1287871 - RNA, 12 nt, Human
cugagcagggcc

SEQ ID NO: 1287872 - RNA, 23 nt, Human
cugagcagggccggggaacuggc

SEQ ID NO: 1287873 - RNA, 15 nt, Human
cugagcaguccuugg

SEQ ID NO: 1287874 - RNA, 17 nt, Human
cugagcaguccuuggcc

SEQ ID NO: 1287875 - RNA, 18 nt, Human
cugagcaguccuuggccu

SEQ ID NO: 1287876 - RNA, 21 nt, Human
cugagcaguccuuggccugcu

SEQ ID NO: 1287877 - RNA, 22 nt, Human
cugagcaguccuuggccugcua

SEQ ID NO: 1287878 - RNA, 20 nt, Human
cugagcagugaaugauucag

SEQ ID NO: 1287879 - RNA, 21 nt, Human
cugagcacuguuuucuagugu

SEQ ID NO: 1287880 - RNA, 23 nt, Human
cugagcacuguuuucuaguguau

SEQ ID NO: 1287881 - RNA, 15 nt, Human
cugagcacuguuuuc

SEQ ID NO: 1287882 - RNA, 14 nt, Human
cugagcacuguuuu

SEQ ID NO: 1287883 - RNA, 16 nt, Human
cugagcacuguuuaua

SEQ ID NO: 1287884 - RNA, 20 nt, Human
cugagcacuguuuauacacu

SEQ ID NO: 1287885 - RNA, 13 nt, Human
cugagcacuguuu

SEQ ID NO: 1287886 - RNA, 19 nt, Human
cugagcacugccaggaggg

SEQ ID NO: 1287887 - RNA, 12 nt, Human
cugagcacuguu

SEQ ID NO: 1287888 - RNA, 17 nt, Human
cugagcacugccaggag

SEQ ID NO: 1287889 - RNA, 18 nt, Human
cugagcacugccaggagg

SEQ ID NO: 1287890 - RNA, 22 nt, Human
cugagcacugccaggagggaca

SEQ ID NO: 1287891 - RNA, 16 nt, Human
cugagcagcgagccug

SEQ ID NO: 1287892 - RNA, 17 nt, Human
cugagcagcgagccugc

SEQ ID NO: 1287893 - RNA, 18 nt, Human
cugagcagcgagccugcu

SEQ ID NO: 1287894 - RNA, 17 nt, Human
cugagcaaucugacccu

SEQ ID NO: 1287895 - RNA, 13 nt, Human
cugagcacugcca

SEQ ID NO: 1287896 - RNA, 14 nt, Human
cugagcacugccag

SEQ ID NO: 1287897 - RNA, 15 nt, Human
cugagcacugccagg

SEQ ID NO: 1287898 - RNA, 16 nt, Human
cugagcacugccagga

SEQ ID NO: 1287899 - RNA, 13 nt, Human
cugaauuaugaaa

SEQ ID NO: 1287900 - RNA, 17 nt, Human
cugaauuaucuauuuca

SEQ ID NO: 1287901 - RNA, 14 nt, Human
cugaauuaugaaac

SEQ ID NO: 1287902 - RNA, 15 nt, Human
cugaauuaugaaacu

SEQ ID NO: 1287903 - RNA, 12 nt, Human
cugaauuauuuu

SEQ ID NO: 1287904 - RNA, 15 nt, Human
cugaauguugggacu

SEQ ID NO: 1287905 - RNA, 16 nt, Human
cugaauguugggacug

SEQ ID NO: 1287906 - RNA, 19 nt, Human
cugaauguugggacugcua

SEQ ID NO: 1287907 - RNA, 14 nt, Human
cugaauguuuuucu

SEQ ID NO: 1287908 - RNA, 15 nt, Human
cugaauguuuuucua

SEQ ID NO: 1287909 - RNA, 16 nt, Human
cugaauguuuuucuaa

SEQ ID NO: 1287910 - RNA, 17 nt, Human
cugaauguuuuucuaaa

SEQ ID NO: 1287911 - RNA, 18 nt, Human
cugaauguuuuucuaaag

SEQ ID NO: 1287912 - RNA, 23 nt, Human
cugaauguuuuucuaaaggaguu

SEQ ID NO: 1287913 - RNA, 20 nt, Human
cugaauguuuuucuaaagga

SEQ ID NO: 1287914 - RNA, 15 nt, Human
cugaauaaagcaauu

SEQ ID NO: 1287915 - RNA, 18 nt, Human
cugaauaaaguguaacaa

SEQ ID NO: 1287916 - RNA, 20 nt, Human
cugaaugaggucagcauguc

SEQ ID NO: 1287917 - RNA, 14 nt, Human
cugaaugcucugua

SEQ ID NO: 1287918 - RNA, 13 nt, Human
cugaaugcuucua

SEQ ID NO: 1287919 - RNA, 14 nt, Human
cugaaugcuucuaa

SEQ ID NO: 1287920 - RNA, 15 nt, Human
cugaaugcuucuaag

SEQ ID NO: 1287921 - RNA, 18 nt, Human
cugaaugcuucuaaguaa

SEQ ID NO: 1287922 - RNA, 20 nt, Human
cugaaugcuucuaaguaaau

SEQ ID NO: 1287923 - RNA, 22 nt, Human
cugaaugucauugaaaaacuaa

SEQ ID NO: 1287924 - RNA, 14 nt, Human
cugaauaaagcaau

SEQ ID NO: 1287925 - RNA, 13 nt, Human
cugaauaaagcaa

SEQ ID NO: 1287926 - RNA, 17 nt, Human
cugaagaacucucugga

SEQ ID NO: 1287927 - RNA, 14 nt, Human
cugaagaagauggu

SEQ ID NO: 1287928 - RNA, 13 nt, Human
cugaagucacugc

SEQ ID NO: 1287929 - RNA, 14 nt, Human
cugaagucacugca

SEQ ID NO: 1287930 - RNA, 15 nt, Human
cugaagucacugcac

SEQ ID NO: 1287931 - RNA, 21 nt, Human
cugaacuuugcugagccugua

SEQ ID NO: 1287932 - RNA, 14 nt, Human
cugaacuuugcuga

SEQ ID NO: 1287933 - RNA, 13 nt, Human
cugaacuuugcug

SEQ ID NO: 1287934 - RNA, 14 nt, Human
cugaagaaccaguc

SEQ ID NO: 1287935 - RNA, 15 nt, Human
cugaagaaccagucc

SEQ ID NO: 1287936 - RNA, 22 nt, Human
cugaagaaccaguccccccacc

SEQ ID NO: 1287937 - RNA, 12 nt, Human
cugaacuuugcu

SEQ ID NO: 1287938 - RNA, 16 nt, Human
cugaaccccagggcug

SEQ ID NO: 1287939 - RNA, 14 nt, Human
cugaaccccagggc

SEQ ID NO: 1287940 - RNA, 15 nt, Human
cugaaccccagggcu

SEQ ID NO: 1287941 - RNA, 11 nt, Human
cugaacaccau

SEQ ID NO: 1287942 - RNA, 15 nt, Human
cugaacaucugaguc

SEQ ID NO: 1287943 - RNA, 19 nt, Human
cugaacaucugaguccugg

SEQ ID NO: 1287944 - RNA, 23 nt, Human
cugaacaucugaguccuggauga

SEQ ID NO: 1287945 - RNA, 20 nt, Human
cugaacaucugaguccugga

SEQ ID NO: 1287946 - RNA, 20 nt, Human
cugaaauaaacgucuuaaau

SEQ ID NO: 1287947 - RNA, 12 nt, Human
cugaaauuccaa

SEQ ID NO: 1287948 - RNA, 13 nt, Human
cugaaauuccaaa

SEQ ID NO: 1287949 - RNA, 14 nt, Human
cugaaauuccaaag

SEQ ID NO: 1287950 - RNA, 15 nt, Human
cugaaauuccaaagu

SEQ ID NO: 1287951 - RNA, 16 nt, Human
cugaaauuccaaaguc

SEQ ID NO: 1287952 - RNA, 17 nt, Human
cugaaauuccaaagucu

SEQ ID NO: 1287953 - RNA, 20 nt, Human
cugaaauuccaaagucucua

SEQ ID NO: 1287954 - RNA, 14 nt, Human
cugaaauucuccug

SEQ ID NO: 1287955 - RNA, 15 nt, Human
cugaaauucuccugg

SEQ ID NO: 1287956 - RNA, 16 nt, Human
cugaaauucuccugga

SEQ ID NO: 1287957 - RNA, 17 nt, Human
cugaaauucuccuggag

SEQ ID NO: 1287958 - RNA, 18 nt, Human
cugaaauucuccuggagg

SEQ ID NO: 1287959 - RNA, 19 nt, Human
cugaaauucuccuggaggu

SEQ ID NO: 1287960 - RNA, 18 nt, Human
cugaaauuccaaagucuc

SEQ ID NO: 1287961 - RNA, 22 nt, Human
cugaaauuuuauaugcuuacug

SEQ ID NO: 1287962 - RNA, 20 nt, Human
cugaaauuuuucuucuugag

SEQ ID NO: 1287963 - RNA, 16 nt, Human
cugaaauuuuucuucu

SEQ ID NO: 1287964 - RNA, 19 nt, Human
cugaaauuuuucuucuuga

SEQ ID NO: 1287965 - RNA, 12 nt, Human
cugaacaagaau

SEQ ID NO: 1287966 - RNA, 13 nt, Human
cugaacaagaauu

SEQ ID NO: 1287967 - RNA, 14 nt, Human
cugaacaagaauug

SEQ ID NO: 1287968 - RNA, 16 nt, Human
cugaacaagaauugga

SEQ ID NO: 1287969 - RNA, 18 nt, Human
cucuuuguuauuugaaaa

SEQ ID NO: 1287970 - RNA, 12 nt, Human
cucuuuguaaga

SEQ ID NO: 1287971 - RNA, 18 nt, Human
cucuuuguuuugugucuc

SEQ ID NO: 1287972 - RNA, 20 nt, Human
cucuuuguuuugugucucuu

SEQ ID NO: 1287973 - RNA, 14 nt, Human
cucuuuuacccugg

SEQ ID NO: 1287974 - RNA, 20 nt, Human
cucuuuuacccuggccccuc

SEQ ID NO: 1287975 - RNA, 23 nt, Human
cucuuuuacccuggccccucucc

SEQ ID NO: 1287976 - RNA, 21 nt, Human
cucuuuuacccuggccccucu

SEQ ID NO: 1287977 - RNA, 20 nt, Human
cucuucugaauaaagcaauu

SEQ ID NO: 1287978 - RNA, 12 nt, Human
cucuucugagcu

SEQ ID NO: 1287979 - RNA, 19 nt, Human
cucuucugaauaaagcaau

SEQ ID NO: 1287980 - RNA, 16 nt, Human
cucuucugaauaaagc

SEQ ID NO: 1287981 - RNA, 10 nt, Human
cucuucugaa

SEQ ID NO: 1287982 - RNA, 15 nt, Human
cucuucugagcuauu

SEQ ID NO: 1287983 - RNA, 18 nt, Human
cucuucugagcuauuuca

SEQ ID NO: 1287984 - RNA, 21 nt, Human
cucuucugagcuauuucaucu

SEQ ID NO: 1287985 - RNA, 22 nt, Human
cucuucugagcuauuucaucua

SEQ ID NO: 1287986 - RNA, 23 nt, Human
cucuucugagcuauuucaucuau

SEQ ID NO: 1287987 - RNA, 15 nt, Human
cucugauacagaaaa

SEQ ID NO: 1287988 - RNA, 12 nt, Human
cucugaguguga

SEQ ID NO: 1287989 - RNA, 17 nt, Human
cucugaguguuuuauga

SEQ ID NO: 1287990 - RNA, 19 nt, Human
cucugaguguuuuaugaga

SEQ ID NO: 1287991 - RNA, 22 nt, Human
cucugaguguuuuaugagaaag

SEQ ID NO: 1287992 - RNA, 14 nt, Human
cucugauaagagaa

SEQ ID NO: 1287993 - RNA, 20 nt, Human
cucugcaggucccuaauaaa

SEQ ID NO: 1287994 - RNA, 19 nt, Human
cucugcaggucccuaauaa

SEQ ID NO: 1287995 - RNA, 22 nt, Human
cucugcaggucccuaauaaagc

SEQ ID NO: 1287996 - RNA, 21 nt, Human
cucugcaggucccuaauaaag

SEQ ID NO: 1287997 - RNA, 17 nt, Human
cucugcauccucuggag

SEQ ID NO: 1287998 - RNA, 18 nt, Human
cucugcauccucuggagc

SEQ ID NO: 1287999 - RNA, 20 nt, Human
cucugcauccucuggagcca

SEQ ID NO: 1288000 - RNA, 14 nt, Human
cucugcauucuagu

SEQ ID NO: 1288001 - RNA, 15 nt, Human
cucugcauucuagua

SEQ ID NO: 1288002 - RNA, 14 nt, Human
cucugccaaaggau

SEQ ID NO: 1288003 - RNA, 19 nt, Human
cucugccaaaggaugugau

SEQ ID NO: 1288004 - RNA, 21 nt, Human
cucugccaaaggaugugauau

SEQ ID NO: 1288005 - RNA, 14 nt, Human
cucugccaguccug

SEQ ID NO: 1288006 - RNA, 15 nt, Human
cucugccaguccugu

SEQ ID NO: 1288007 - RNA, 17 nt, Human
cucugccaguccugucc

SEQ ID NO: 1288008 - RNA, 13 nt, Human
cucugccagugac

SEQ ID NO: 1288009 - RNA, 14 nt, Human
cucugccagugaca

SEQ ID NO: 1288010 - RNA, 15 nt, Human
cucugccagugacag

SEQ ID NO: 1288011 - RNA, 20 nt, Human
cucugccagugacagacagg

SEQ ID NO: 1288012 - RNA, 20 nt, Human
cucugcccgggagcucagga

SEQ ID NO: 1288013 - RNA, 20 nt, Human
cucugcccuaaugcgcaggc

SEQ ID NO: 1288014 - RNA, 22 nt, Human
cucugcccuaaugcgcaggcug

SEQ ID NO: 1288015 - RNA, 14 nt, Human
cucugcccgggagc

SEQ ID NO: 1288016 - RNA, 18 nt, Human
cucugccaguccuguccu

SEQ ID NO: 1288017 - RNA, 14 nt, Human
cucugcccaacccu

SEQ ID NO: 1288018 - RNA, 20 nt, Human
cucugcccaacccuucccuc

SEQ ID NO: 1288019 - RNA, 19 nt, Human
cucugaaggguaauuauau

SEQ ID NO: 1288020 - RNA, 16 nt, Human
cucugacaacagacuu

SEQ ID NO: 1288021 - RNA, 12 nt, Human
cucgcugccagc

SEQ ID NO: 1288022 - RNA, 13 nt, Human
cucgcugccagcu

SEQ ID NO: 1288023 - RNA, 21 nt, Human
cucugacaacagacuucugaa

SEQ ID NO: 1288024 - RNA, 22 nt, Human
cucugacaacagacuucugaaa

SEQ ID NO: 1288025 - RNA, 17 nt, Human
cucugacucagggcucc

SEQ ID NO: 1288026 - RNA, 20 nt, Human
cucugacucagggcuccugg

SEQ ID NO: 1288027 - RNA, 21 nt, Human
cucugacucagggcuccuggg

SEQ ID NO: 1288028 - RNA, 15 nt, Human
cucugaccugcacug

SEQ ID NO: 1288029 - RNA, 14 nt, Human
cucugacucagggc

SEQ ID NO: 1288030 - RNA, 15 nt, Human
cucugacucagggcu

SEQ ID NO: 1288031 - RNA, 16 nt, Human
cucugacucagggcuc

SEQ ID NO: 1288032 - RNA, 12 nt, Human
cucugacagcag

SEQ ID NO: 1288033 - RNA, 13 nt, Human
cucugacagcagc

SEQ ID NO: 1288034 - RNA, 14 nt, Human
cucugacagcagca

SEQ ID NO: 1288035 - RNA, 17 nt, Human
cucugacagcagcaucu

SEQ ID NO: 1288036 - RNA, 18 nt, Human
cucugacagcagcaucuc

SEQ ID NO: 1288037 - RNA, 23 nt, Human
cucugacagcagcaucucuaccu

SEQ ID NO: 1288038 - RNA, 23 nt, Human
cucugacauuaugugguuuuaga

SEQ ID NO: 1288039 - RNA, 12 nt, Human
cucugaccugca

SEQ ID NO: 1288040 - RNA, 14 nt, Human
cucugaccugcacu

SEQ ID NO: 1288041 - RNA, 23 nt, Human
cucugagagcaucaggccuagag

SEQ ID NO: 1288042 - RNA, 13 nt, Human
cucugagaggccc

SEQ ID NO: 1288043 - RNA, 14 nt, Human
cucugagaggcccu

SEQ ID NO: 1288044 - RNA, 15 nt, Human
cucugagaggcccug

SEQ ID NO: 1288045 - RNA, 16 nt, Human
cucugagaggcccugg

SEQ ID NO: 1288046 - RNA, 17 nt, Human
cucugagaggcccugga

SEQ ID NO: 1288047 - RNA, 18 nt, Human
cucugagaggcccuggau

SEQ ID NO: 1288048 - RNA, 13 nt, Human
cucugagagucua

SEQ ID NO: 1288049 - RNA, 15 nt, Human
cucugagagucuaga

SEQ ID NO: 1288050 - RNA, 16 nt, Human
cucugagagucuagau

SEQ ID NO: 1288051 - RNA, 18 nt, Human
cucugagagucuagauuc

SEQ ID NO: 1288052 - RNA, 16 nt, Human
cucugagcugugcagg

SEQ ID NO: 1288053 - RNA, 17 nt, Human
cucugagagucuagauu

SEQ ID NO: 1288054 - RNA, 12 nt, Human
cucugaggacaa

SEQ ID NO: 1288055 - RNA, 15 nt, Human
cucugaggugccugu

SEQ ID NO: 1288056 - RNA, 19 nt, Human
cucugaggugccuguccca

SEQ ID NO: 1288057 - RNA, 22 nt, Human
cucugaggugccugucccaccc

SEQ ID NO: 1288058 - RNA, 19 nt, Human
cucuuaagaagacugcauu

SEQ ID NO: 1288059 - RNA, 20 nt, Human
cucuguuuuacaaguuggag

SEQ ID NO: 1288060 - RNA, 22 nt, Human
cucuguuuuacaaguuggaguc

SEQ ID NO: 1288061 - RNA, 23 nt, Human
cucuguuuuacaaguuggaguca

SEQ ID NO: 1288062 - RNA, 21 nt, Human
cucuguugucguaaagauuug

SEQ ID NO: 1288063 - RNA, 16 nt, Human
cucuguuuuacaaguu

SEQ ID NO: 1288064 - RNA, 15 nt, Human
cucugugucuaagau

SEQ ID NO: 1288065 - RNA, 18 nt, Human
cucugugucuaagauucu

SEQ ID NO: 1288066 - RNA, 19 nt, Human
cucugugucuaagauucua

SEQ ID NO: 1288067 - RNA, 21 nt, Human
cucugugucuaagauucuaga

SEQ ID NO: 1288068 - RNA, 22 nt, Human
cucugugucuaagauucuagau

SEQ ID NO: 1288069 - RNA, 23 nt, Human
cucugugucuaagauucuagauc

SEQ ID NO: 1288070 - RNA, 15 nt, Human
cucugugugcacaaa

SEQ ID NO: 1288071 - RNA, 17 nt, Human
cucugugugcacaaaua

SEQ ID NO: 1288072 - RNA, 21 nt, Human
cucuguugccaggcuggagug

SEQ ID NO: 1288073 - RNA, 14 nt, Human
cucugugaccaaug

SEQ ID NO: 1288074 - RNA, 15 nt, Human
cucugugaccaaugu

SEQ ID NO: 1288075 - RNA, 17 nt, Human
cucugugaccaaugucu

SEQ ID NO: 1288076 - RNA, 18 nt, Human
cucugugaccaaugucuu

SEQ ID NO: 1288077 - RNA, 19 nt, Human
cucugugaccaaugucuug

SEQ ID NO: 1288078 - RNA, 14 nt, Human
cucuucccucuucc

SEQ ID NO: 1288079 - RNA, 13 nt, Human
cucuuccucuucc

SEQ ID NO: 1288080 - RNA, 17 nt, Human
cucuucccccucuccca

SEQ ID NO: 1288081 - RNA, 18 nt, Human
cucuucccccucucccag

SEQ ID NO: 1288082 - RNA, 20 nt, Human
cucuucccccucucccaguu

SEQ ID NO: 1288083 - RNA, 19 nt, Human
cucuucccccucucccagu

SEQ ID NO: 1288084 - RNA, 23 nt, Human
cucuuaauugccaccucuaacag

SEQ ID NO: 1288085 - RNA, 17 nt, Human
cucuuaccaguauuuaa

SEQ ID NO: 1288086 - RNA, 19 nt, Human
cucuuaccaguauuuaacu

SEQ ID NO: 1288087 - RNA, 12 nt, Human
cucuuaauugcc

SEQ ID NO: 1288088 - RNA, 14 nt, Human
cucuuccaugcugu

SEQ ID NO: 1288089 - RNA, 15 nt, Human
cucuuccaugcugug

SEQ ID NO: 1288090 - RNA, 12 nt, Human
cucuuccccaga

SEQ ID NO: 1288091 - RNA, 16 nt, Human
cucuuccaugcugugc

SEQ ID NO: 1288092 - RNA, 14 nt, Human
cucuuccccagacg

SEQ ID NO: 1288093 - RNA, 16 nt, Human
cucuuccccagacgcc

SEQ ID NO: 1288094 - RNA, 21 nt, Human
cucuuccccagacgccuggcu

SEQ ID NO: 1288095 - RNA, 22 nt, Human
cucuuccccagacgccuggcug

SEQ ID NO: 1288096 - RNA, 14 nt, Human
cucuucccccaaga

SEQ ID NO: 1288097 - RNA, 15 nt, Human
cucuucccccaccac

SEQ ID NO: 1288098 - RNA, 15 nt, Human
cucuucccccaagau

SEQ ID NO: 1288099 - RNA, 15 nt, Human
cucuucccccucucc

SEQ ID NO: 1288100 - RNA, 16 nt, Human
cucuucccccucuccc

SEQ ID NO: 1288101 - RNA, 13 nt, Human
cucuuccuuucuu

SEQ ID NO: 1288102 - RNA, 14 nt, Human
cucuucuacucacu

SEQ ID NO: 1288103 - RNA, 18 nt, Human
cucuucuacucacuuuuc

SEQ ID NO: 1288104 - RNA, 22 nt, Human
cucuucuacucacuuuucccac

SEQ ID NO: 1288105 - RNA, 17 nt, Human
cucuucuauuuuguaaa

SEQ ID NO: 1288106 - RNA, 19 nt, Human
cucuucuauuuuguaaacu

SEQ ID NO: 1288107 - RNA, 19 nt, Human
cucuuccuucccugcugug

SEQ ID NO: 1288108 - RNA, 23 nt, Human
cucuuccuugaagaacugcaggc

SEQ ID NO: 1288109 - RNA, 16 nt, Human
cucuuccuuuuaucag

SEQ ID NO: 1288110 - RNA, 15 nt, Human
cucuuccuucccugc

SEQ ID NO: 1288111 - RNA, 21 nt, Human
cucuuccuuacuuuuuauaua

SEQ ID NO: 1288112 - RNA, 12 nt, Human
cucuucuccacu

SEQ ID NO: 1288113 - RNA, 13 nt, Human
cucuucuccacug

SEQ ID NO: 1288114 - RNA, 20 nt, Human
cucuggauuauauuaugaag

SEQ ID NO: 1288115 - RNA, 19 nt, Human
cucuggauuauauuaugaa

SEQ ID NO: 1288116 - RNA, 15 nt, Human
cucugccuacagaac

SEQ ID NO: 1288117 - RNA, 14 nt, Human
cucuggcagccaca

SEQ ID NO: 1288118 - RNA, 15 nt, Human
cucuggcagccacac

SEQ ID NO: 1288119 - RNA, 16 nt, Human
cucuggcagccacacu

SEQ ID NO: 1288120 - RNA, 18 nt, Human
cucuggcauuagaauuau

SEQ ID NO: 1288121 - RNA, 19 nt, Human
cucuggcauuagaauuauu

SEQ ID NO: 1288122 - RNA, 11 nt, Human
cucuggcagcc

SEQ ID NO: 1288123 - RNA, 13 nt, Human
cucuggcagccac

SEQ ID NO: 1288124 - RNA, 17 nt, Human
cucuggcagccacacuu

SEQ ID NO: 1288125 - RNA, 22 nt, Human
cucuggccuucggccuccaucc

SEQ ID NO: 1288126 - RNA, 21 nt, Human
cucuggccuucggccuccauc

SEQ ID NO: 1288127 - RNA, 20 nt, Human
cucuggcauuagaauuauuu

SEQ ID NO: 1288128 - RNA, 23 nt, Human
cucuggcauuagaauuauuuaaa

SEQ ID NO: 1288129 - RNA, 15 nt, Human
cucugucgcccaggc

SEQ ID NO: 1288130 - RNA, 18 nt, Human
cucugucgcccaggcugg

SEQ ID NO: 1288131 - RNA, 22 nt, Human
cucugucgcccaggcuggagug

SEQ ID NO: 1288132 - RNA, 16 nt, Human
cucugggggcugagga

SEQ ID NO: 1288133 - RNA, 20 nt, Human
cucugucgcccaugcuggag

SEQ ID NO: 1288134 - RNA, 18 nt, Human
cucugucgcccaugcugg

SEQ ID NO: 1288135 - RNA, 16 nt, Human
cucugucuaccugguc

SEQ ID NO: 1288136 - RNA, 19 nt, Human
cucugucuacuugcucagg

SEQ ID NO: 1288137 - RNA, 20 nt, Human
cucugucuaccuggucuggu

SEQ ID NO: 1288138 - RNA, 15 nt, Human
cucugucuuguguuu

SEQ ID NO: 1288139 - RNA, 16 nt, Human
cucugucuuguguuuc

SEQ ID NO: 1288140 - RNA, 21 nt, Human
cucugggggcugaggagcagc

SEQ ID NO: 1288141 - RNA, 20 nt, Human
cucugggccauucuccacag

SEQ ID NO: 1288142 - RNA, 11 nt, Human
cucugggcucu

SEQ ID NO: 1288143 - RNA, 15 nt, Human
cucugggcucugagu

SEQ ID NO: 1288144 - RNA, 13 nt, Human
cucugggcucuga

SEQ ID NO: 1288145 - RNA, 15 nt, Human
cucugggcuggauga

SEQ ID NO: 1288146 - RNA, 16 nt, Human
cucugggcuggaugag

SEQ ID NO: 1288147 - RNA, 19 nt, Human
cucugggcuggaugagcuc

SEQ ID NO: 1288148 - RNA, 20 nt, Human
cucugggcuggaugagcucc

SEQ ID NO: 1288149 - RNA, 21 nt, Human
cucugggcuggaugagcuccc

SEQ ID NO: 1288150 - RNA, 22 nt, Human
cucugggcuggaugagcuccca

SEQ ID NO: 1288151 - RNA, 17 nt, Human
cuauuucacuggagcac

SEQ ID NO: 1288152 - RNA, 15 nt, Human
cuauuucauguuuuu

SEQ ID NO: 1288153 - RNA, 17 nt, Human
cuauuucauguuuuuga

SEQ ID NO: 1288154 - RNA, 19 nt, Human
cucaaaucguccagcgacc

SEQ ID NO: 1288155 - RNA, 16 nt, Human
cucaaaugaguaacau

SEQ ID NO: 1288156 - RNA, 20 nt, Human
cucaaaugaguaacauuugc

SEQ ID NO: 1288157 - RNA, 21 nt, Human
cucaaaugaguaacauuugcu

SEQ ID NO: 1288158 - RNA, 22 nt, Human
cucaaaugaguaacauuugcug

SEQ ID NO: 1288159 - RNA, 22 nt, Human
cucaaaugcggggugggggcag

SEQ ID NO: 1288160 - RNA, 16 nt, Human
cucaacaccaugauuc

SEQ ID NO: 1288161 - RNA, 19 nt, Human
cucaacaccaugauuccuu

SEQ ID NO: 1288162 - RNA, 21 nt, Human
cucaacaccaugauuccuuua

SEQ ID NO: 1288163 - RNA, 22 nt, Human
cucaacaccaugauuccuuuaa

SEQ ID NO: 1288164 - RNA, 20 nt, Human
cucaacacccaacugucucg

SEQ ID NO: 1288165 - RNA, 17 nt, Human
cucaaaugaugggaagu

SEQ ID NO: 1288166 - RNA, 23 nt, Human
cucaacaccaugauuccuuuaac

SEQ ID NO: 1288167 - RNA, 13 nt, Human
cucaacacccagu

SEQ ID NO: 1288168 - RNA, 14 nt, Human
cucaacacccaguu

SEQ ID NO: 1288169 - RNA, 14 nt, Human
cucaacaggccuca

SEQ ID NO: 1288170 - RNA, 15 nt, Human
cucaacaggccucag

SEQ ID NO: 1288171 - RNA, 16 nt, Human
cucaacaggccucagg

SEQ ID NO: 1288172 - RNA, 18 nt, Human
cucaacaggccucagggc

SEQ ID NO: 1288173 - RNA, 22 nt, Human
cuauugugcaauguaaauauuu

SEQ ID NO: 1288174 - RNA, 19 nt, Human
cuauugucaccagggcugg

SEQ ID NO: 1288175 - RNA, 22 nt, Human
cuauuuaugugauccuuuugga

SEQ ID NO: 1288176 - RNA, 15 nt, Human
cuauuucacuggagc

SEQ ID NO: 1288177 - RNA, 16 nt, Human
cuauuucacuggagca

SEQ ID NO: 1288178 - RNA, 17 nt, Human
cuauuuauauguacaug

SEQ ID NO: 1288179 - RNA, 16 nt, Human
cuauuccagcuguccc

SEQ ID NO: 1288180 - RNA, 19 nt, Human
cuauuccagcugucccccc

SEQ ID NO: 1288181 - RNA, 17 nt, Human
cuauuccgagcccuuag

SEQ ID NO: 1288182 - RNA, 21 nt, Human
cuauucgccacacaguauuuu

SEQ ID NO: 1288183 - RNA, 15 nt, Human
cuauucuagccugca

SEQ ID NO: 1288184 - RNA, 17 nt, Human
cuauucuagccugcauu

SEQ ID NO: 1288185 - RNA, 23 nt, Human
cuauucuagccugcauugagcuu

SEQ ID NO: 1288186 - RNA, 13 nt, Human
cucaaccucaucc

SEQ ID NO: 1288187 - RNA, 21 nt, Human
cucaagaaauaaaaggaagcc

SEQ ID NO: 1288188 - RNA, 12 nt, Human
cucaaccucauc

SEQ ID NO: 1288189 - RNA, 17 nt, Human
cucaacaggccucaggg

SEQ ID NO: 1288190 - RNA, 22 nt, Human
cucaagaaauaaaaggaagcca

SEQ ID NO: 1288191 - RNA, 23 nt, Human
cucaagaaauaaaaggaagccaa

SEQ ID NO: 1288192 - RNA, 23 nt, Human
cucaagacccuuuuggguuucug

SEQ ID NO: 1288193 - RNA, 19 nt, Human
cucaagagaucccaaguag

SEQ ID NO: 1288194 - RNA, 15 nt, Human
cucaagagaucccaa

SEQ ID NO: 1288195 - RNA, 15 nt, Human
cucaagucuuucucu

SEQ ID NO: 1288196 - RNA, 16 nt, Human
cucaagucuuucucuu

SEQ ID NO: 1288197 - RNA, 21 nt, Human
cucaagucuuucucuuucccu

SEQ ID NO: 1288198 - RNA, 23 nt, Human
cucacaccaggcuugccugcagg

SEQ ID NO: 1288199 - RNA, 17 nt, Human
cucacaccacuagccuc

SEQ ID NO: 1288200 - RNA, 20 nt, Human
cucacaccacuagccucagg

SEQ ID NO: 1288201 - RNA, 21 nt, Human
cucacaccacuagccucaggg

SEQ ID NO: 1288202 - RNA, 16 nt, Human
cucacaggucccaaau

SEQ ID NO: 1288203 - RNA, 15 nt, Human
cucacaggucccaaa

SEQ ID NO: 1288204 - RNA, 22 nt, Human
cucacaguauugcucacccagu

SEQ ID NO: 1288205 - RNA, 12 nt, Human
cucacauuuaug

SEQ ID NO: 1288206 - RNA, 13 nt, Human
cucaccaacuccu

SEQ ID NO: 1288207 - RNA, 16 nt, Human
cucaccacggaccaaa

SEQ ID NO: 1288208 - RNA, 17 nt, Human
cucaccacugcccccug

SEQ ID NO: 1288209 - RNA, 21 nt, Human
cucaccacugcccccugcugc

SEQ ID NO: 1288210 - RNA, 18 nt, Human
cucaccaggcagccucug

SEQ ID NO: 1288211 - RNA, 19 nt, Human
cucaccaggcagccucugg

SEQ ID NO: 1288212 - RNA, 21 nt, Human
cucaccaggcagccucugggg

SEQ ID NO: 1288213 - RNA, 20 nt, Human
cucaccaggcagccucuggg

SEQ ID NO: 1288214 - RNA, 14 nt, Human
cucagcacaaggcc

SEQ ID NO: 1288215 - RNA, 20 nt, Human
cucagcacaaggccaucugg

SEQ ID NO: 1288216 - RNA, 17 nt, Human
cucagauuucugaggaa

SEQ ID NO: 1288217 - RNA, 16 nt, Human
cucagauuucugagga

SEQ ID NO: 1288218 - RNA, 17 nt, Human
cucagauuccuucccau

SEQ ID NO: 1288219 - RNA, 20 nt, Human
cucagauuccuucccaugga

SEQ ID NO: 1288220 - RNA, 21 nt, Human
cucagauuccuucccauggag

SEQ ID NO: 1288221 - RNA, 24 nt, Human
cucagauuccuucccauggaggga

SEQ ID NO: 1288222 - RNA, 15 nt, Human
cucagauuguaauau

SEQ ID NO: 1288223 - RNA, 22 nt, Human
cucagauuguaauauguaaaug

SEQ ID NO: 1288224 - RNA, 14 nt, Human
cucagauuccuucc

SEQ ID NO: 1288225 - RNA, 16 nt, Human
cucagauuccuuccca

SEQ ID NO: 1288226 - RNA, 14 nt, Human
cucagauccuccuc

SEQ ID NO: 1288227 - RNA, 17 nt, Human
cucagcacuuggcccuu

SEQ ID NO: 1288228 - RNA, 13 nt, Human
cucagcacugccu

SEQ ID NO: 1288229 - RNA, 15 nt, Human
cucagcacugccugc

SEQ ID NO: 1288230 - RNA, 16 nt, Human
cucagcacugccugcu

SEQ ID NO: 1288231 - RNA, 17 nt, Human
cucagcacugccugcuc

SEQ ID NO: 1288232 - RNA, 18 nt, Human
cucagcacugccugcucc

SEQ ID NO: 1288233 - RNA, 19 nt, Human
cucagcacugccugcuccc

SEQ ID NO: 1288234 - RNA, 21 nt, Human
cucagcacugccugcucccau

SEQ ID NO: 1288235 - RNA, 13 nt, Human
cucagcacuuggc

SEQ ID NO: 1288236 - RNA, 14 nt, Human
cucagcacuuggcc

SEQ ID NO: 1288237 - RNA, 15 nt, Human
cucagcacuuggccc

SEQ ID NO: 1288238 - RNA, 16 nt, Human
cucagcacuuggcccu

SEQ ID NO: 1288239 - RNA, 18 nt, Human
cucagcacuuggcccuuc

SEQ ID NO: 1288240 - RNA, 23 nt, Human
cucagagaauuucuaccauuuca

SEQ ID NO: 1288241 - RNA, 13 nt, Human
cucagagacaugc

SEQ ID NO: 1288242 - RNA, 16 nt, Human
cucagagacaugcaga

SEQ ID NO: 1288243 - RNA, 17 nt, Human
cucagagacaugcagag

SEQ ID NO: 1288244 - RNA, 19 nt, Human
cucagagacaugcagagau

SEQ ID NO: 1288245 - RNA, 13 nt, Human
cucagagaccagg

SEQ ID NO: 1288246 - RNA, 16 nt, Human
cucagagaccagggcu

SEQ ID NO: 1288247 - RNA, 21 nt, Human
cucagagaccagggcuccagc

SEQ ID NO: 1288248 - RNA, 22 nt, Human
cucagagaccagggcuccagcc

SEQ ID NO: 1288249 - RNA, 21 nt, Human
cucagauaagguaaaaugcca

SEQ ID NO: 1288250 - RNA, 22 nt, Human
cucagauaagguaaaaugccau

SEQ ID NO: 1288251 - RNA, 23 nt, Human
cucagauaagguaaaaugccaug

SEQ ID NO: 1288252 - RNA, 16 nt, Human
cucagauagaaugaca

SEQ ID NO: 1288253 - RNA, 18 nt, Human
cucagauagaaugacagu

SEQ ID NO: 1288254 - RNA, 17 nt, Human
cucagaucaguguacca

SEQ ID NO: 1288255 - RNA, 21 nt, Human
cucagaucaguguaccauuug

SEQ ID NO: 1288256 - RNA, 10 nt, Human
cucagaucca

SEQ ID NO: 1288257 - RNA, 13 nt, Human
cucagauccaggg

SEQ ID NO: 1288258 - RNA, 14 nt, Human
cucagauccaggga

SEQ ID NO: 1288259 - RNA, 15 nt, Human
cucagauccagggac

SEQ ID NO: 1288260 - RNA, 16 nt, Human
cucagauccagggaca

SEQ ID NO: 1288261 - RNA, 17 nt, Human
cucagauccagggacag

SEQ ID NO: 1288262 - RNA, 18 nt, Human
cucagauccagggacaga

SEQ ID NO: 1288263 - RNA, 20 nt, Human
cucagauccagggacagagg

SEQ ID NO: 1288264 - RNA, 22 nt, Human
cucagauccagggacagaggcc

SEQ ID NO: 1288265 - RNA, 16 nt, Human
cucagauccuccucau

SEQ ID NO: 1288266 - RNA, 19 nt, Human
cucacccccagcuuugcua

SEQ ID NO: 1288267 - RNA, 13 nt, Human
cucacuccuaccu

SEQ ID NO: 1288268 - RNA, 15 nt, Human
cucacuccuaccugg

SEQ ID NO: 1288269 - RNA, 18 nt, Human
cucacuccccacauccca

SEQ ID NO: 1288270 - RNA, 14 nt, Human
cucacucagcacuu

SEQ ID NO: 1288271 - RNA, 19 nt, Human
cucacucagcacuuggccc

SEQ ID NO: 1288272 - RNA, 12 nt, Human
cucacucagcca

SEQ ID NO: 1288273 - RNA, 18 nt, Human
cucacucagccacccuga

SEQ ID NO: 1288274 - RNA, 21 nt, Human
cucacucagccacccugaguu

SEQ ID NO: 1288275 - RNA, 22 nt, Human
cucacucagccacccugaguug

SEQ ID NO: 1288276 - RNA, 17 nt, Human
cucacccaccccugcac

SEQ ID NO: 1288277 - RNA, 13 nt, Human
cucacccagugcc

SEQ ID NO: 1288278 - RNA, 12 nt, Human
cucaccauucca

SEQ ID NO: 1288279 - RNA, 20 nt, Human
cucaccauuccaagucucca

SEQ ID NO: 1288280 - RNA, 22 nt, Human
cucaccauuccaagucuccacc

SEQ ID NO: 1288281 - RNA, 17 nt, Human
cucaccauuuggauccu

SEQ ID NO: 1288282 - RNA, 14 nt, Human
cucacccccagcuu

SEQ ID NO: 1288283 - RNA, 17 nt, Human
cucacccccagcuuugc

SEQ ID NO: 1288284 - RNA, 18 nt, Human
cucacccccagcuuugcu

SEQ ID NO: 1288285 - RNA, 13 nt, Human
cucacuccuuuua

SEQ ID NO: 1288286 - RNA, 14 nt, Human
cucacuccuuuuaa

SEQ ID NO: 1288287 - RNA, 16 nt, Human
cucacuccuaccuggu

SEQ ID NO: 1288288 - RNA, 17 nt, Human
cucacuccuaccuggua

SEQ ID NO: 1288289 - RNA, 19 nt, Human
cucacuccuaccugguaau

SEQ ID NO: 1288290 - RNA, 15 nt, Human
cucacuccuuuuaaa

SEQ ID NO: 1288291 - RNA, 18 nt, Human
cucacuccuuuuaaagaa

SEQ ID NO: 1288292 - RNA, 14 nt, Human
cucacucgucuccc

SEQ ID NO: 1288293 - RNA, 19 nt, Human
cucacuccuuuuaaagaaa

SEQ ID NO: 1288294 - RNA, 17 nt, Human
cucacugagcacuguuu

SEQ ID NO: 1288295 - RNA, 18 nt, Human
cucacugcaaccuucacc

SEQ ID NO: 1288296 - RNA, 18 nt, Human
cucacugagcacuguuuu

SEQ ID NO: 1288297 - RNA, 16 nt, Human
cucacugagcacuguu

SEQ ID NO: 1288298 - RNA, 15 nt, Human
cucacugagcacugu

SEQ ID NO: 1288299 - RNA, 15 nt, Human
cucacucuguuuccu

SEQ ID NO: 1288300 - RNA, 13 nt, Human
cuauggccugugg

SEQ ID NO: 1288301 - RNA, 14 nt, Human
cuauggccucaugu

SEQ ID NO: 1288302 - RNA, 13 nt, Human
cuaugggaacaau

SEQ ID NO: 1288303 - RNA, 15 nt, Human
cuauggagagcccug

SEQ ID NO: 1288304 - RNA, 16 nt, Human
cuauggagagcccugg

SEQ ID NO: 1288305 - RNA, 17 nt, Human
cuauggagagcccuggg

SEQ ID NO: 1288306 - RNA, 18 nt, Human
cuauggagagcccuggga

SEQ ID NO: 1288307 - RNA, 21 nt, Human
cuauggagagcccugggaccg

SEQ ID NO: 1288308 - RNA, 19 nt, Human
cuauggagugcaccaaaga

SEQ ID NO: 1288309 - RNA, 19 nt, Human
cuauggagagcccugggac

SEQ ID NO: 1288310 - RNA, 18 nt, Human
cuaugcaugguuucagca

SEQ ID NO: 1288311 - RNA, 15 nt, Human
cuaugcaugguuuca

SEQ ID NO: 1288312 - RNA, 11 nt, Human
cuaugcuuuga

SEQ ID NO: 1288313 - RNA, 15 nt, Human
cuaugcuuugaaaca

SEQ ID NO: 1288314 - RNA, 17 nt, Human
cuaugcuuugaaacaga

SEQ ID NO: 1288315 - RNA, 15 nt, Human
cuauggaaagauggc

SEQ ID NO: 1288316 - RNA, 19 nt, Human
cuaugcuuugaaacagaaa

SEQ ID NO: 1288317 - RNA, 11 nt, Human
cuauggagagc

SEQ ID NO: 1288318 - RNA, 14 nt, Human
cuauggagagcccu

SEQ ID NO: 1288319 - RNA, 13 nt, Human
cuaugagucuaga

SEQ ID NO: 1288320 - RNA, 14 nt, Human
cuaugagucuagau

SEQ ID NO: 1288321 - RNA, 15 nt, Human
cuaugagucuagaug

SEQ ID NO: 1288322 - RNA, 16 nt, Human
cuaugagucuagaugu

SEQ ID NO: 1288323 - RNA, 19 nt, Human
cuaugagucuagauguuua

SEQ ID NO: 1288324 - RNA, 17 nt, Human
cuaugagucuagauguu

SEQ ID NO: 1288325 - RNA, 20 nt, Human
cuaugcagagguccacaaca

SEQ ID NO: 1288326 - RNA, 23 nt, Human
cuaugauauuuucugugccugaa

SEQ ID NO: 1288327 - RNA, 13 nt, Human
cuaugcauggugc

SEQ ID NO: 1288328 - RNA, 19 nt, Human
cuaugcauggugccccagg

SEQ ID NO: 1288329 - RNA, 20 nt, Human
cuaugcauggugccccagga

SEQ ID NO: 1288330 - RNA, 21 nt, Human
cuaugcauggugccccaggac

SEQ ID NO: 1288331 - RNA, 22 nt, Human
cuaugcauggugccccaggacc

SEQ ID NO: 1288332 - RNA, 23 nt, Human
cuaugcauggugccccaggacca

SEQ ID NO: 1288333 - RNA, 13 nt, Human
cuauguaaacuac

SEQ ID NO: 1288334 - RNA, 23 nt, Human
cuauggugcucugucuacuugcu

SEQ ID NO: 1288335 - RNA, 14 nt, Human
cuauggugcucugu

SEQ ID NO: 1288336 - RNA, 16 nt, Human
cuauggugcucugucu

SEQ ID NO: 1288337 - RNA, 17 nt, Human
cuauggugcucugucua

SEQ ID NO: 1288338 - RNA, 19 nt, Human
cuaugggucuaggacacag

SEQ ID NO: 1288339 - RNA, 20 nt, Human
cuauggguguuaucaccuag

SEQ ID NO: 1288340 - RNA, 17 nt, Human
cuauggucgggagacag

SEQ ID NO: 1288341 - RNA, 21 nt, Human
cuauggucgggagacagcauc

SEQ ID NO: 1288342 - RNA, 17 nt, Human
cuauuacauuuucagug

SEQ ID NO: 1288343 - RNA, 21 nt, Human
cuauuaggugcaauuucaagg

SEQ ID NO: 1288344 - RNA, 17 nt, Human
cuauucacaaaauauca

SEQ ID NO: 1288345 - RNA, 14 nt, Human
cuaucugggcuucc

SEQ ID NO: 1288346 - RNA, 15 nt, Human
cuaucugggcuuccu

SEQ ID NO: 1288347 - RNA, 16 nt, Human
cuaucugggcuuccug

SEQ ID NO: 1288348 - RNA, 17 nt, Human
cuaucugggcuuccugg

SEQ ID NO: 1288349 - RNA, 18 nt, Human
cuaucugggcuuccugga

SEQ ID NO: 1288350 - RNA, 19 nt, Human
cuaucugggcuuccuggag

SEQ ID NO: 1288351 - RNA, 20 nt, Human
cuaucugggcuuccuggagc

SEQ ID NO: 1288352 - RNA, 21 nt, Human
cuaucugggcuuccuggagca

SEQ ID NO: 1288353 - RNA, 23 nt, Human
cuaucugggcuuccuggagcaga

SEQ ID NO: 1288354 - RNA, 12 nt, Human
cuaucuguauuc

SEQ ID NO: 1288355 - RNA, 11 nt, Human
cuaucugucug

SEQ ID NO: 1288356 - RNA, 14 nt, Human
cuaucugucuggug

SEQ ID NO: 1288357 - RNA, 16 nt, Human
cuaucugucugguggc

SEQ ID NO: 1288358 - RNA, 17 nt, Human
cuaucugucugguggcc

SEQ ID NO: 1288359 - RNA, 18 nt, Human
cuaucugucugguggccc

SEQ ID NO: 1288360 - RNA, 21 nt, Human
cuaucugucugguggccccgu

SEQ ID NO: 1288361 - RNA, 17 nt, Human
cuaucuguauucccaaa

SEQ ID NO: 1288362 - RNA, 17 nt, Human
cuauauuuuacauaaau

SEQ ID NO: 1288363 - RNA, 12 nt, Human
cuauauuugggc

SEQ ID NO: 1288364 - RNA, 22 nt, Human
cuauauuugggccugcuccaga

SEQ ID NO: 1288365 - RNA, 20 nt, Human
cuauauugcugaaugcaaga

SEQ ID NO: 1288366 - RNA, 16 nt, Human
cuauauuguucagcau

SEQ ID NO: 1288367 - RNA, 16 nt, Human
cuauauuuaacaagau

SEQ ID NO: 1288368 - RNA, 18 nt, Human
cuauauuguuugcuaagc

SEQ ID NO: 1288369 - RNA, 19 nt, Human
cuauauuacgguuugcccc

SEQ ID NO: 1288370 - RNA, 19 nt, Human
cuauagccaaaaauagcua

SEQ ID NO: 1288371 - RNA, 14 nt, Human
cuauagccaaaaau

SEQ ID NO: 1288372 - RNA, 10 nt, Human
cuauauguau

SEQ ID NO: 1288373 - RNA, 14 nt, Human
cuauaccaauaaag

SEQ ID NO: 1288374 - RNA, 13 nt, Human
cuauaccaauaaa

SEQ ID NO: 1288375 - RNA, 14 nt, Human
cuauagaugucuuu

SEQ ID NO: 1288376 - RNA, 15 nt, Human
cuauagaugucuuuu

SEQ ID NO: 1288377 - RNA, 16 nt, Human
cuauagaugucuuuuc

SEQ ID NO: 1288378 - RNA, 22 nt, Human
cuauagaugucuuuucccauuu

SEQ ID NO: 1288379 - RNA, 13 nt, Human
cuauagccaaaaa

SEQ ID NO: 1288380 - RNA, 22 nt, Human
cuauaauuuaccuaagauuaca

SEQ ID NO: 1288381 - RNA, 22 nt, Human
cuauaagcaagaaggcaaaaau

SEQ ID NO: 1288382 - RNA, 21 nt, Human
cuauaaggugcucucuuucug

SEQ ID NO: 1288383 - RNA, 22 nt, Human
cuauaaggugcucucuuucugu

SEQ ID NO: 1288384 - RNA, 23 nt, Human
cuauaaggugcucucuuucuguc

SEQ ID NO: 1288385 - RNA, 19 nt, Human
cuagugacuugugucccau

SEQ ID NO: 1288386 - RNA, 20 nt, Human
cuagugacuugugucccaug

SEQ ID NO: 1288387 - RNA, 18 nt, Human
cuaguggccgaaccagaa

SEQ ID NO: 1288388 - RNA, 14 nt, Human
cuagucaccagaga

SEQ ID NO: 1288389 - RNA, 18 nt, Human
cuagucaaugacaugaau

SEQ ID NO: 1288390 - RNA, 20 nt, Human
cuagucaaugacaugaauuu

SEQ ID NO: 1288391 - RNA, 21 nt, Human
cuagucacgcaugcaguguug

SEQ ID NO: 1288392 - RNA, 17 nt, Human
cuagucacgcaugcagu

SEQ ID NO: 1288393 - RNA, 16 nt, Human
cuagucaaucaagucu

SEQ ID NO: 1288394 - RNA, 20 nt, Human
cuagucaaucaagucuguuu

SEQ ID NO: 1288395 - RNA, 21 nt, Human
cuagucaaucaagucuguuua

SEQ ID NO: 1288396 - RNA, 15 nt, Human
cuagucaaugacaug

SEQ ID NO: 1288397 - RNA, 16 nt, Human
cuaguaauuggaaagg

SEQ ID NO: 1288398 - RNA, 16 nt, Human
cuaguacuaacuccua

SEQ ID NO: 1288399 - RNA, 16 nt, Human
cuagguuuaugacagu

SEQ ID NO: 1288400 - RNA, 12 nt, Human
cuagguuuauga

SEQ ID NO: 1288401 - RNA, 13 nt, Human
cuagguuucaaag

SEQ ID NO: 1288402 - RNA, 18 nt, Human
cuagguggguugaaagcc

SEQ ID NO: 1288403 - RNA, 19 nt, Human
cuagguggguugaaagcca

SEQ ID NO: 1288404 - RNA, 23 nt, Human
cuagguggguugaaagccaagga

SEQ ID NO: 1288405 - RNA, 14 nt, Human
cuagguguuuuguu

SEQ ID NO: 1288406 - RNA, 17 nt, Human
cuagguguuuuguucac

SEQ ID NO: 1288407 - RNA, 13 nt, Human
cuagguucuaaaa

SEQ ID NO: 1288408 - RNA, 20 nt, Human
cuagugaaacucguuaauuu

SEQ ID NO: 1288409 - RNA, 13 nt, Human
cuagucauaaccu

SEQ ID NO: 1288410 - RNA, 21 nt, Human
cuagugagcagucaggaaaga

SEQ ID NO: 1288411 - RNA, 17 nt, Human
cuagugacccacaugcc

SEQ ID NO: 1288412 - RNA, 18 nt, Human
cuagugacccacaugcca

SEQ ID NO: 1288413 - RNA, 19 nt, Human
cuagugacccacaugccau

SEQ ID NO: 1288414 - RNA, 18 nt, Human
cuagugacuuguguccca

SEQ ID NO: 1288415 - RNA, 17 nt, Human
cuagucuuuugcuuuug

SEQ ID NO: 1288416 - RNA, 17 nt, Human
cuagugaaggcuucucu

SEQ ID NO: 1288417 - RNA, 21 nt, Human
cuagugaaggcuucucucugu

SEQ ID NO: 1288418 - RNA, 16 nt, Human
cuagugacccacaugc

SEQ ID NO: 1288419 - RNA, 22 nt, Human
cuagguaaauuacaguuccuag

SEQ ID NO: 1288420 - RNA, 19 nt, Human
cuaggguuaggagguccuu

SEQ ID NO: 1288421 - RNA, 20 nt, Human
cuagguaauuuuuacagaau

SEQ ID NO: 1288422 - RNA, 21 nt, Human
cgccccaacccguggaggcug

SEQ ID NO: 1288423 - RNA, 22 nt, Human
cgccccaacccguggaggcugc

SEQ ID NO: 1288424 - RNA, 14 nt, Human
cuagguacgaugac

SEQ ID NO: 1288425 - RNA, 19 nt, Human
cuagguacgaugacagugu

SEQ ID NO: 1288426 - RNA, 20 nt, Human
cuagguacgaugacaguguu

SEQ ID NO: 1288427 - RNA, 17 nt, Human
cuagguaggaaaugugg

SEQ ID NO: 1288428 - RNA, 21 nt, Human
cuagguccccauacuccuaug

SEQ ID NO: 1288429 - RNA, 18 nt, Human
cuaggugcuauuugucau

SEQ ID NO: 1288430 - RNA, 15 nt, Human
cuagguggaaaagcc

SEQ ID NO: 1288431 - RNA, 12 nt, Human
cuagguggaaaa

SEQ ID NO: 1288432 - RNA, 17 nt, Human
cucgccggaucugaggg

SEQ ID NO: 1288433 - RNA, 20 nt, Human
cucgcccugcgguagauggg

SEQ ID NO: 1288434 - RNA, 18 nt, Human
cucgcauaggaccuuucc

SEQ ID NO: 1288435 - RNA, 19 nt, Human
cucgcauaggaccuuucca

SEQ ID NO: 1288436 - RNA, 18 nt, Human
cucgccggaucugaggga

SEQ ID NO: 1288437 - RNA, 15 nt, Human
cucgccuucaucucc

SEQ ID NO: 1288438 - RNA, 23 nt, Human
cucgccugacaaccacuggucug

SEQ ID NO: 1288439 - RNA, 15 nt, Human
cucgcuccccacucu

SEQ ID NO: 1288440 - RNA, 16 nt, Human
cucgcuccccacucug

SEQ ID NO: 1288441 - RNA, 17 nt, Human
cucgcuccccacucugc

SEQ ID NO: 1288442 - RNA, 21 nt, Human
cucgcuccccacucugcucug

SEQ ID NO: 1288443 - RNA, 23 nt, Human
cucgcuccccacucugcucugau

SEQ ID NO: 1288444 - RNA, 23 nt, Human
cucgcucugucgcccaggcugga

SEQ ID NO: 1288445 - RNA, 12 nt, Human
cucgagcgcccu

SEQ ID NO: 1288446 - RNA, 15 nt, Human
cucgagcgcccugca

SEQ ID NO: 1288447 - RNA, 16 nt, Human
cucgagcgcccugcag

SEQ ID NO: 1288448 - RNA, 17 nt, Human
cucgagcgcccugcaga

SEQ ID NO: 1288449 - RNA, 18 nt, Human
cucgagcgcccugcagac

SEQ ID NO: 1288450 - RNA, 19 nt, Human
cucgagcgcccugcagacc

SEQ ID NO: 1288451 - RNA, 20 nt, Human
cucgagcgcccugcagaccc

SEQ ID NO: 1288452 - RNA, 21 nt, Human
cucgagcgcccugcagacccu

SEQ ID NO: 1288453 - RNA, 23 nt, Human
cucgagcgcccugcagacccugc

SEQ ID NO: 1288454 - RNA, 18 nt, Human
cucgagggcagggaccac

SEQ ID NO: 1288455 - RNA, 23 nt, Human
cucgagggcagggaccacacccu

SEQ ID NO: 1288456 - RNA, 14 nt, Human
cucgaggggugggc

SEQ ID NO: 1288457 - RNA, 16 nt, Human
cucgaggggugggcug

SEQ ID NO: 1288458 - RNA, 17 nt, Human
cucgaggggugggcugg

SEQ ID NO: 1288459 - RNA, 17 nt, Human
cucgaggucgggcagca

SEQ ID NO: 1288460 - RNA, 14 nt, Human
cucgauuucuccag

SEQ ID NO: 1288461 - RNA, 19 nt, Human
cucgaggggugggcuggua

SEQ ID NO: 1288462 - RNA, 12 nt, Human
cucgcaacccgu

SEQ ID NO: 1288463 - RNA, 16 nt, Human
cucgcaacccgugcca

SEQ ID NO: 1288464 - RNA, 21 nt, Human
cucgcaacccgugccaagucc

SEQ ID NO: 1288465 - RNA, 23 nt, Human
cucgcaacccgugccaaguccag

SEQ ID NO: 1288466 - RNA, 22 nt, Human
cucgcaacccgugccaagucca

SEQ ID NO: 1288467 - RNA, 17 nt, Human
cuccuugggcccuuuga

SEQ ID NO: 1288468 - RNA, 18 nt, Human
cuccuugggcccuuugag

SEQ ID NO: 1288469 - RNA, 19 nt, Human
cuccuugggcccuuugagu

SEQ ID NO: 1288470 - RNA, 21 nt, Human
cuccuuggugauuccgcagug

SEQ ID NO: 1288471 - RNA, 15 nt, Human
cuccuuccugugugu

SEQ ID NO: 1288472 - RNA, 12 nt, Human
cuccuugggccc

SEQ ID NO: 1288473 - RNA, 13 nt, Human
cuccuugggcccu

SEQ ID NO: 1288474 - RNA, 16 nt, Human
cuccuugggcccuuug

SEQ ID NO: 1288475 - RNA, 14 nt, Human
cuccuuccggggaa

SEQ ID NO: 1288476 - RNA, 12 nt, Human
cuccuuccuaaa

SEQ ID NO: 1288477 - RNA, 11 nt, Human
cuccuuccugc

SEQ ID NO: 1288478 - RNA, 20 nt, Human
cuccuuccggggaaggauuu

SEQ ID NO: 1288479 - RNA, 13 nt, Human
cuccuuccugccc

SEQ ID NO: 1288480 - RNA, 15 nt, Human
cuccuuccugcccca

SEQ ID NO: 1288481 - RNA, 13 nt, Human
cuccuuccuggag

SEQ ID NO: 1288482 - RNA, 14 nt, Human
cuccuuccuggaga

SEQ ID NO: 1288483 - RNA, 21 nt, Human
cuccuuccugccccaacuccu

SEQ ID NO: 1288484 - RNA, 13 nt, Human
cuccuuccugugu

SEQ ID NO: 1288485 - RNA, 13 nt, Human
cucgagaucccaa

SEQ ID NO: 1288486 - RNA, 21 nt, Human
cuccuugguucuugaggggac

SEQ ID NO: 1288487 - RNA, 21 nt, Human
cucgagaucccaacacugcca

SEQ ID NO: 1288488 - RNA, 22 nt, Human
cucgagaucccaacacugccag

SEQ ID NO: 1288489 - RNA, 23 nt, Human
cucgagaucccaacacugccagc

SEQ ID NO: 1288490 - RNA, 17 nt, Human
cuccugccucagccucc

SEQ ID NO: 1288491 - RNA, 11 nt, Human
cuccugccuca

SEQ ID NO: 1288492 - RNA, 12 nt, Human
cuccugccucag

SEQ ID NO: 1288493 - RNA, 14 nt, Human
cuccucuccccagc

SEQ ID NO: 1288494 - RNA, 15 nt, Human
cuccugccggcuccu

SEQ ID NO: 1288495 - RNA, 19 nt, Human
cuccugccucagccucccg

SEQ ID NO: 1288496 - RNA, 15 nt, Human
cuccugcugcucccu

SEQ ID NO: 1288497 - RNA, 16 nt, Human
cuccugcugcucccuc

SEQ ID NO: 1288498 - RNA, 17 nt, Human
cuccugcugcucccuca

SEQ ID NO: 1288499 - RNA, 18 nt, Human
cuccugcugcucccucag

SEQ ID NO: 1288500 - RNA, 19 nt, Human
cuccugcugcucccucaga

SEQ ID NO: 1288501 - RNA, 20 nt, Human
cuccugcugcucccucagac

SEQ ID NO: 1288502 - RNA, 21 nt, Human
cuccugcugcucccucagacu

SEQ ID NO: 1288503 - RNA, 22 nt, Human
cuccugcugcucccucagacug

SEQ ID NO: 1288504 - RNA, 23 nt, Human
cuccugcugcucccucagacugg

SEQ ID NO: 1288505 - RNA, 11 nt, Human
cuccuggacuc

SEQ ID NO: 1288506 - RNA, 21 nt, Human
cuccuggaccccccuuucaca

SEQ ID NO: 1288507 - RNA, 12 nt, Human
cuccuggacucc

SEQ ID NO: 1288508 - RNA, 17 nt, Human
cuccuuaucaaaggaca

SEQ ID NO: 1288509 - RNA, 22 nt, Human
cuccuuaucaaaggacaccauu

SEQ ID NO: 1288510 - RNA, 22 nt, Human
cuccuggaccccccuuucacag

SEQ ID NO: 1288511 - RNA, 13 nt, Human
cuccuucccaagu

SEQ ID NO: 1288512 - RNA, 14 nt, Human
cuccuucccaagug

SEQ ID NO: 1288513 - RNA, 16 nt, Human
cuccuucccaucgcug

SEQ ID NO: 1288514 - RNA, 17 nt, Human
cuccuucccaucgcugu

SEQ ID NO: 1288515 - RNA, 12 nt, Human
cuccuuccccau

SEQ ID NO: 1288516 - RNA, 13 nt, Human
cuccuucccucuc

SEQ ID NO: 1288517 - RNA, 17 nt, Human
cuccuucccucucugga

SEQ ID NO: 1288518 - RNA, 19 nt, Human
cuccuucccucucuggaga

SEQ ID NO: 1288519 - RNA, 18 nt, Human
cuccuucccucucuggag

SEQ ID NO: 1288520 - RNA, 16 nt, Human
cuccccuuuuuuuccc

SEQ ID NO: 1288521 - RNA, 13 nt, Human
cuccccuugccug

SEQ ID NO: 1288522 - RNA, 18 nt, Human
cuccccuugccugugcca

SEQ ID NO: 1288523 - RNA, 15 nt, Human
cucccggugcccaag

SEQ ID NO: 1288524 - RNA, 21 nt, Human
cucccggugcccaagaauaga

SEQ ID NO: 1288525 - RNA, 17 nt, Human
cucccugccccccagcc

SEQ ID NO: 1288526 - RNA, 23 nt, Human
cucccugccccccagcccuccuu

SEQ ID NO: 1288527 - RNA, 13 nt, Human
cucccugccccuc

SEQ ID NO: 1288528 - RNA, 14 nt, Human
cucccugccccucc

SEQ ID NO: 1288529 - RNA, 14 nt, Human
cucccugcauggca

SEQ ID NO: 1288530 - RNA, 22 nt, Human
cucccugcauggcauccuccag

SEQ ID NO: 1288531 - RNA, 23 nt, Human
cucccugcauggcauccuccagc

SEQ ID NO: 1288532 - RNA, 17 nt, Human
cucccugccccucccuu

SEQ ID NO: 1288533 - RNA, 18 nt, Human
cucccugccccucccuuc

SEQ ID NO: 1288534 - RNA, 20 nt, Human
cucccugccccucccuucaa

SEQ ID NO: 1288535 - RNA, 21 nt, Human
cucccugccccucccuucaac

SEQ ID NO: 1288536 - RNA, 14 nt, Human
cucccugccuccug

SEQ ID NO: 1288537 - RNA, 12 nt, Human
cucccuggugcu

SEQ ID NO: 1288538 - RNA, 13 nt, Human
cucccuggugcuu

SEQ ID NO: 1288539 - RNA, 15 nt, Human
cucccuggugcuuau

SEQ ID NO: 1288540 - RNA, 14 nt, Human
cuccauccugaggc

SEQ ID NO: 1288541 - RNA, 13 nt, Human
cuccaucccuggc

SEQ ID NO: 1288542 - RNA, 14 nt, Human
cuccaucccuggcc

SEQ ID NO: 1288543 - RNA, 15 nt, Human
cuccaucccuggccc

SEQ ID NO: 1288544 - RNA, 16 nt, Human
cuccaucccuggcccc

SEQ ID NO: 1288545 - RNA, 13 nt, Human
cuccauccugagg

SEQ ID NO: 1288546 - RNA, 12 nt, Human
cuccccuccucc

SEQ ID NO: 1288547 - RNA, 20 nt, Human
cuccccuccuccuggacucc

SEQ ID NO: 1288548 - RNA, 19 nt, Human
cuccccagcauuccagccc

SEQ ID NO: 1288549 - RNA, 19 nt, Human
cuccaucccuggcccccuc

SEQ ID NO: 1288550 - RNA, 24 nt, Human
cuccaucccuggcccccucccugg

SEQ ID NO: 1288551 - RNA, 21 nt, Human
cuccccagcauuccagccccu

SEQ ID NO: 1288552 - RNA, 13 nt, Human
cuccccugccccc

SEQ ID NO: 1288553 - RNA, 15 nt, Human
cuccccugcccccug

SEQ ID NO: 1288554 - RNA, 17 nt, Human
cuccccugcccccugca

SEQ ID NO: 1288555 - RNA, 18 nt, Human
cuccccugcccccugcag

SEQ ID NO: 1288556 - RNA, 19 nt, Human
cuccccugcccccugcagg

SEQ ID NO: 1288557 - RNA, 23 nt, Human
cuccccugcccccugcaggaagg

SEQ ID NO: 1288558 - RNA, 20 nt, Human
cuccccugcccccugcagga

SEQ ID NO: 1288559 - RNA, 12 nt, Human
cuccccuucucu

SEQ ID NO: 1288560 - RNA, 15 nt, Human
cuccucaaccccucc

SEQ ID NO: 1288561 - RNA, 21 nt, Human
cuccucaaccccuccccucca

SEQ ID NO: 1288562 - RNA, 16 nt, Human
cuccuaugaucugagu

SEQ ID NO: 1288563 - RNA, 19 nt, Human
cuccuaugaucugagucag

SEQ ID NO: 1288564 - RNA, 23 nt, Human
cuccuaugaucugagucagagcc

SEQ ID NO: 1288565 - RNA, 22 nt, Human
cuccuauggguugucaccaagc

SEQ ID NO: 1288566 - RNA, 18 nt, Human
cuccuauguuuggcugcu

SEQ ID NO: 1288567 - RNA, 13 nt, Human
cuccgagaggugg

SEQ ID NO: 1288568 - RNA, 14 nt, Human
cuccgagagguggg

SEQ ID NO: 1288569 - RNA, 15 nt, Human
cuccgagaggugggc

SEQ ID NO: 1288570 - RNA, 17 nt, Human
cuccgagaggugggcca

SEQ ID NO: 1288571 - RNA, 18 nt, Human
cuccgagaggugggccag

SEQ ID NO: 1288572 - RNA, 22 nt, Human
cuccgagaggugggccagucug

SEQ ID NO: 1288573 - RNA, 15 nt, Human
cuccgaggacccagg

SEQ ID NO: 1288574 - RNA, 17 nt, Human
cuccgaggacccaggaa

SEQ ID NO: 1288575 - RNA, 12 nt, Human
cucccuuucaac

SEQ ID NO: 1288576 - RNA, 23 nt, Human
cucccuugggcucugaugaaaaa

SEQ ID NO: 1288577 - RNA, 19 nt, Human
cucccuuggggccuaugca

SEQ ID NO: 1288578 - RNA, 18 nt, Human
cucccuugggcucugaug

SEQ ID NO: 1288579 - RNA, 19 nt, Human
cucccuugggcucugauga

SEQ ID NO: 1288580 - RNA, 20 nt, Human
cucccuugggcucugaugaa

SEQ ID NO: 1288581 - RNA, 21 nt, Human
cucccuugggcucugaugaaa

SEQ ID NO: 1288582 - RNA, 13 nt, Human
cucccuugggcuc

SEQ ID NO: 1288583 - RNA, 14 nt, Human
cucccuugggcucc

SEQ ID NO: 1288584 - RNA, 18 nt, Human
cucccuugggcucccugu

SEQ ID NO: 1288585 - RNA, 16 nt, Human
cucccuugggcucuga

SEQ ID NO: 1288586 - RNA, 17 nt, Human
cucccuugggcucugau

SEQ ID NO: 1288587 - RNA, 22 nt, Human
cucccuggugcuuaugcucuua

SEQ ID NO: 1288588 - RNA, 19 nt, Human
cucccuguaaccucuucag

SEQ ID NO: 1288589 - RNA, 18 nt, Human
cucccuggugcuuaugcu

SEQ ID NO: 1288590 - RNA, 13 nt, Human
cucccuguaacuu

SEQ ID NO: 1288591 - RNA, 15 nt, Human
cucccuguaacuuga

SEQ ID NO: 1288592 - RNA, 15 nt, Human
cucccuguacagugu

SEQ ID NO: 1288593 - RNA, 18 nt, Human
cucccuguacaguguuac

SEQ ID NO: 1288594 - RNA, 13 nt, Human
cucccugugcccc

SEQ ID NO: 1288595 - RNA, 15 nt, Human
cucccugugccccca

SEQ ID NO: 1288596 - RNA, 19 nt, Human
cucccugugcccccagggu

SEQ ID NO: 1288597 - RNA, 16 nt, Human
cucccuguuccccaga

SEQ ID NO: 1288598 - RNA, 17 nt, Human
cucccuguuccccagag

SEQ ID NO: 1288599 - RNA, 18 nt, Human
cucccuguuccccagaga

SEQ ID NO: 1288600 - RNA, 19 nt, Human
cucccuguuccccagagaa

SEQ ID NO: 1288601 - RNA, 12 nt, Human
cuccucaucccg

SEQ ID NO: 1288602 - RNA, 14 nt, Human
cuccucacccccag

SEQ ID NO: 1288603 - RNA, 20 nt, Human
cuccucaaccccuccccucc

SEQ ID NO: 1288604 - RNA, 15 nt, Human
cuccucacccccagc

SEQ ID NO: 1288605 - RNA, 11 nt, Human
cuccucagccu

SEQ ID NO: 1288606 - RNA, 12 nt, Human
cuccucagccug

SEQ ID NO: 1288607 - RNA, 24 nt, Human
cuccucagccugaaccccagggcu

SEQ ID NO: 1288608 - RNA, 13 nt, Human
cuccucagccuga

SEQ ID NO: 1288609 - RNA, 17 nt, Human
cuccucaggcacacagc

SEQ ID NO: 1288610 - RNA, 18 nt, Human
cuccucaggcacacagcu

SEQ ID NO: 1288611 - RNA, 19 nt, Human
cuccucaggcacacagcua

SEQ ID NO: 1288612 - RNA, 21 nt, Human
cuccucaggcacacagcuacu

SEQ ID NO: 1288613 - RNA, 22 nt, Human
cuccucaggcacacagcuacuc

SEQ ID NO: 1288614 - RNA, 23 nt, Human
cuccucaggcacacagcuacucu

SEQ ID NO: 1288615 - RNA, 17 nt, Human
cuccucagggacucagg

SEQ ID NO: 1288616 - RNA, 11 nt, Human
cuccucaggga

SEQ ID NO: 1288617 - RNA, 12 nt, Human
cuccucccagga

SEQ ID NO: 1288618 - RNA, 11 nt, Human
cuccucccagg

SEQ ID NO: 1288619 - RNA, 22 nt, Human
cuccucccaggcgccccuuccc

SEQ ID NO: 1288620 - RNA, 23 nt, Human
cuccucccaggcgccccuucccc

SEQ ID NO: 1288621 - RNA, 17 nt, Human
cuccucccaggcgcccc

SEQ ID NO: 1288622 - RNA, 20 nt, Human
cuccucccacccggcugcag

SEQ ID NO: 1288623 - RNA, 22 nt, Human
cuccucccacccggcugcagag

SEQ ID NO: 1288624 - RNA, 14 nt, Human
cuccuccuggacuc

SEQ ID NO: 1288625 - RNA, 15 nt, Human
cuccuccuggacucc

SEQ ID NO: 1288626 - RNA, 19 nt, Human
cuccuccuggacuccugca

SEQ ID NO: 1288627 - RNA, 21 nt, Human
cuccaaacugacucuuaagaa

SEQ ID NO: 1288628 - RNA, 19 nt, Human
cuccaaaacuucguuuaau

SEQ ID NO: 1288629 - RNA, 19 nt, Human
cucauuuuuuuccuugcaa

SEQ ID NO: 1288630 - RNA, 12 nt, Human
cucauuagacug

SEQ ID NO: 1288631 - RNA, 17 nt, Human
cucauuaaaagaauauc

SEQ ID NO: 1288632 - RNA, 13 nt, Human
cucauuagacugg

SEQ ID NO: 1288633 - RNA, 15 nt, Human
cucaucucuucuuuu

SEQ ID NO: 1288634 - RNA, 12 nt, Human
cucaucucuucu

SEQ ID NO: 1288635 - RNA, 12 nt, Human
cucaucugcugg

SEQ ID NO: 1288636 - RNA, 13 nt, Human
cucaucugcuggu

SEQ ID NO: 1288637 - RNA, 23 nt, Human
cucauguugaagccacugccuuc

SEQ ID NO: 1288638 - RNA, 14 nt, Human
cuccacccuggccg

SEQ ID NO: 1288639 - RNA, 15 nt, Human
cuccacccuggccga

SEQ ID NO: 1288640 - RNA, 14 nt, Human
cuccacauccucca

SEQ ID NO: 1288641 - RNA, 15 nt, Human
cuccacauccuccac

SEQ ID NO: 1288642 - RNA, 17 nt, Human
cuccacauccuccacgu

SEQ ID NO: 1288643 - RNA, 22 nt, Human
cuccaaucccaccaacccucag

SEQ ID NO: 1288644 - RNA, 15 nt, Human
cuccaauuuuuuaag

SEQ ID NO: 1288645 - RNA, 23 nt, Human
cuccaauuuuuuaagugaaaaua

SEQ ID NO: 1288646 - RNA, 20 nt, Human
cuccacacacauaauggcag

SEQ ID NO: 1288647 - RNA, 20 nt, Human
cuccacacagugcucaaggc

SEQ ID NO: 1288648 - RNA, 12 nt, Human
cuccacaccugc

SEQ ID NO: 1288649 - RNA, 13 nt, Human
cuccagcuuuccu

SEQ ID NO: 1288650 - RNA, 16 nt, Human
cuccagcuuuccugua

SEQ ID NO: 1288651 - RNA, 15 nt, Human
cuccagcuuuccugu

SEQ ID NO: 1288652 - RNA, 19 nt, Human
cuccaggaagccuuccccu

SEQ ID NO: 1288653 - RNA, 12 nt, Human
cuccauccugag

SEQ ID NO: 1288654 - RNA, 20 nt, Human
cuccauccgugccucuuuuu

SEQ ID NO: 1288655 - RNA, 16 nt, Human
cuccauccuaccacaa

SEQ ID NO: 1288656 - RNA, 12 nt, Human
cuccauccaagg

SEQ ID NO: 1288657 - RNA, 13 nt, Human
cuccauccaaggc

SEQ ID NO: 1288658 - RNA, 14 nt, Human
cuccauccaaggcc

SEQ ID NO: 1288659 - RNA, 18 nt, Human
cuccauccaaggccaggu

SEQ ID NO: 1288660 - RNA, 20 nt, Human
cuccauccacaugggagccg

SEQ ID NO: 1288661 - RNA, 11 nt, Human
cuccaucccug

SEQ ID NO: 1288662 - RNA, 12 nt, Human
cuccaucccugg

SEQ ID NO: 1288663 - RNA, 18 nt, Human
cuccacguucugcucauc

SEQ ID NO: 1288664 - RNA, 13 nt, Human
cuccagcggcccu

SEQ ID NO: 1288665 - RNA, 15 nt, Human
cuccagcggcccugu

SEQ ID NO: 1288666 - RNA, 22 nt, Human
cuccagcggcccugucauccag

SEQ ID NO: 1288667 - RNA, 19 nt, Human
cuccagcggcccugucauc

SEQ ID NO: 1288668 - RNA, 14 nt, Human
cuccaccuccuggg

SEQ ID NO: 1288669 - RNA, 12 nt, Human
cuccaccuuccc

SEQ ID NO: 1288670 - RNA, 14 nt, Human
cuccaccuucccac

SEQ ID NO: 1288671 - RNA, 15 nt, Human
cuccacguucugcuc

SEQ ID NO: 1288672 - RNA, 16 nt, Human
cuccacguucugcuca

SEQ ID NO: 1288673 - RNA, 17 nt, Human
cuccacguucugcucau

SEQ ID NO: 1288674 - RNA, 20 nt, Human
cuccacguucugcucaucau

SEQ ID NO: 1288675 - RNA, 16 nt, Human
cucauacccucccucc

SEQ ID NO: 1288676 - RNA, 17 nt, Human
cucauacccucccuccc

SEQ ID NO: 1288677 - RNA, 20 nt, Human
cucauagcccucacccuggg

SEQ ID NO: 1288678 - RNA, 21 nt, Human
cucauagcccucacccugggg

SEQ ID NO: 1288679 - RNA, 13 nt, Human
cucauagcccuca

SEQ ID NO: 1288680 - RNA, 17 nt, Human
cucauagcccucacccu

SEQ ID NO: 1288681 - RNA, 18 nt, Human
cucauagacacugaucug

SEQ ID NO: 1288682 - RNA, 14 nt, Human
cucauagacacuga

SEQ ID NO: 1288683 - RNA, 17 nt, Human
cucagggcuucuaguuu

SEQ ID NO: 1288684 - RNA, 20 nt, Human
cucauauaauuauauguugu

SEQ ID NO: 1288685 - RNA, 21 nt, Human
cucauauccaguauuguuccu

SEQ ID NO: 1288686 - RNA, 17 nt, Human
cucauauaauuauaugu

SEQ ID NO: 1288687 - RNA, 16 nt, Human
cucaucaacugaauga

SEQ ID NO: 1288688 - RNA, 14 nt, Human
cucaucaacugaau

SEQ ID NO: 1288689 - RNA, 18 nt, Human
cucaucaauggggccagu

SEQ ID NO: 1288690 - RNA, 12 nt, Human
cucaucaguagu

SEQ ID NO: 1288691 - RNA, 12 nt, Human
cucauccuccuu

SEQ ID NO: 1288692 - RNA, 13 nt, Human
cucauccuccuuc

SEQ ID NO: 1288693 - RNA, 16 nt, Human
cucauccuccuucuuc

SEQ ID NO: 1288694 - RNA, 14 nt, Human
cucauccuccuucu

SEQ ID NO: 1288695 - RNA, 16 nt, Human
cucaucucucugccca

SEQ ID NO: 1288696 - RNA, 17 nt, Human
cucaucucucugcccaa

SEQ ID NO: 1288697 - RNA, 13 nt, Human
cucaucauucucu

SEQ ID NO: 1288698 - RNA, 14 nt, Human
cucaucauucucug

SEQ ID NO: 1288699 - RNA, 15 nt, Human
cucaucauucucugu

SEQ ID NO: 1288700 - RNA, 17 nt, Human
cucaucauucucugucu

SEQ ID NO: 1288701 - RNA, 18 nt, Human
cucaucauucucugucuc

SEQ ID NO: 1288702 - RNA, 19 nt, Human
cucaucauucucugucuca

SEQ ID NO: 1288703 - RNA, 20 nt, Human
cucaucauucucugucucau

SEQ ID NO: 1288704 - RNA, 22 nt, Human
cucaucauucucugucucaucc

SEQ ID NO: 1288705 - RNA, 22 nt, Human
cucaucccgagcaccuccacau

SEQ ID NO: 1288706 - RNA, 16 nt, Human
cucaucccguguucuc

SEQ ID NO: 1288707 - RNA, 19 nt, Human
cucaucccguguucuccuu

SEQ ID NO: 1288708 - RNA, 19 nt, Human
cucagcccacauagugaug

SEQ ID NO: 1288709 - RNA, 21 nt, Human
cucagcccacauagugauggu

SEQ ID NO: 1288710 - RNA, 14 nt, Human
cucagccagccucg

SEQ ID NO: 1288711 - RNA, 15 nt, Human
cucagccacccugag

SEQ ID NO: 1288712 - RNA, 16 nt, Human
cucagccacccugagu

SEQ ID NO: 1288713 - RNA, 17 nt, Human
cucagccacccugaguu

SEQ ID NO: 1288714 - RNA, 18 nt, Human
cucagccacccugaguug

SEQ ID NO: 1288715 - RNA, 21 nt, Human
cucagccacccugaguugcuu

SEQ ID NO: 1288716 - RNA, 11 nt, Human
cucagccagca

SEQ ID NO: 1288717 - RNA, 13 nt, Human
cucagccagcacu

SEQ ID NO: 1288718 - RNA, 12 nt, Human
cucagccagccu

SEQ ID NO: 1288719 - RNA, 13 nt, Human
cucagccagccuc

SEQ ID NO: 1288720 - RNA, 12 nt, Human
cucaggauccaa

SEQ ID NO: 1288721 - RNA, 18 nt, Human
cucaggauccaagcuaag

SEQ ID NO: 1288722 - RNA, 20 nt, Human
cucaggauccaagcuaagca

SEQ ID NO: 1288723 - RNA, 16 nt, Human
cucaggaugagggaaa

SEQ ID NO: 1288724 - RNA, 20 nt, Human
cucaggaugagggaaaagaa

SEQ ID NO: 1288725 - RNA, 22 nt, Human
cucaggaugagggaaaagaaaa

SEQ ID NO: 1288726 - RNA, 21 nt, Human
cucaggaugagggaaaagaaa

SEQ ID NO: 1288727 - RNA, 13 nt, Human
cucaggcacacag

SEQ ID NO: 1288728 - RNA, 14 nt, Human
cucaggcacacagc

SEQ ID NO: 1288729 - RNA, 15 nt, Human
cucaggcacacagcu

SEQ ID NO: 1288730 - RNA, 16 nt, Human
cucaggcacacagcua

SEQ ID NO: 1288731 - RNA, 18 nt, Human
cucaggcacacagcuacu

SEQ ID NO: 1288732 - RNA, 14 nt, Human
cucaggcagcucaa

SEQ ID NO: 1288733 - RNA, 15 nt, Human
cucaggcagcucaag

SEQ ID NO: 1288734 - RNA, 15 nt, Human
cucaggcaggggccu

SEQ ID NO: 1288735 - RNA, 18 nt, Human
cucaggcaggggccucca

SEQ ID NO: 1288736 - RNA, 16 nt, Human
cucagggaccauggcu

SEQ ID NO: 1288737 - RNA, 17 nt, Human
cucagggaccauggcuu

SEQ ID NO: 1288738 - RNA, 21 nt, Human
cucagggacucaucuuucccu

SEQ ID NO: 1288739 - RNA, 23 nt, Human
cucagggacucaucuuucccucc

SEQ ID NO: 1288740 - RNA, 14 nt, Human
cucagggcaaagcc

SEQ ID NO: 1288741 - RNA, 15 nt, Human
cucagggcaaagcca

SEQ ID NO: 1288742 - RNA, 16 nt, Human
cucagggcaaagccag

SEQ ID NO: 1288743 - RNA, 17 nt, Human
cucagggcaaagccagg

SEQ ID NO: 1288744 - RNA, 18 nt, Human
cucagggcaaagccaggu

SEQ ID NO: 1288745 - RNA, 10 nt, Human
cucagggcag

SEQ ID NO: 1288746 - RNA, 22 nt, Human
cucagggcaaagccaggucccu

SEQ ID NO: 1288747 - RNA, 13 nt, Human
cucagggcuccug

SEQ ID NO: 1288748 - RNA, 14 nt, Human
cucagggcuccugg

SEQ ID NO: 1288749 - RNA, 15 nt, Human
cucagggcuccuggg

SEQ ID NO: 1288750 - RNA, 17 nt, Human
cucagggcuccuggguu

SEQ ID NO: 1288751 - RNA, 14 nt, Human
cucagggcuccuug

SEQ ID NO: 1288752 - RNA, 15 nt, Human
cucagggcuccuugu

SEQ ID NO: 1288753 - RNA, 22 nt, Human
cucagggcuccuugugggccug

SEQ ID NO: 1288754 - RNA, 20 nt, Human
cgagauaccccaccucccuc

SEQ ID NO: 1288755 - RNA, 13 nt, Human
cgagaucccaaca

SEQ ID NO: 1288756 - RNA, 15 nt, Human
cgagaucccaacacu

SEQ ID NO: 1288757 - RNA, 21 nt, Human
cgagaucccaacacugccagc

SEQ ID NO: 1288758 - RNA, 22 nt, Human
cgagaucccaacacugccagca

SEQ ID NO: 1288759 - RNA, 17 nt, Human
cgagaucaguauuuaac

SEQ ID NO: 1288760 - RNA, 19 nt, Human
cgagaucaguauuuaacua

SEQ ID NO: 1288761 - RNA, 21 nt, Human
cgagauuaucguuuucuuaaa

SEQ ID NO: 1288762 - RNA, 23 nt, Human
cgagauuaucguuuucuuaaagu

SEQ ID NO: 1288763 - RNA, 14 nt, Human
cgagcaaccguggc

SEQ ID NO: 1288764 - RNA, 15 nt, Human
cgagcaaccguggcc

SEQ ID NO: 1288765 - RNA, 16 nt, Human
cgagcaaccguggccc

SEQ ID NO: 1288766 - RNA, 22 nt, Human
cgagcaaccguggcccuuccug

SEQ ID NO: 1288767 - RNA, 23 nt, Human
cgagcaaccguggcccuuccugg

SEQ ID NO: 1288768 - RNA, 13 nt, Human
cgagcaccuccac

SEQ ID NO: 1288769 - RNA, 11 nt, Human
cgagcagcuga

SEQ ID NO: 1288770 - RNA, 14 nt, Human
cgagcaggaggccu

SEQ ID NO: 1288771 - RNA, 12 nt, Human
cgagcagcugag

SEQ ID NO: 1288772 - RNA, 13 nt, Human
cgagcagcugagc

SEQ ID NO: 1288773 - RNA, 14 nt, Human
cgagcagcugagca

SEQ ID NO: 1288774 - RNA, 15 nt, Human
cgagcagcugagcag

SEQ ID NO: 1288775 - RNA, 16 nt, Human
cgagcagcugagcagg

SEQ ID NO: 1288776 - RNA, 19 nt, Human
cgagcagcugagcagggcc

SEQ ID NO: 1288777 - RNA, 13 nt, Human
cgagcaggaggcc

SEQ ID NO: 1288778 - RNA, 13 nt, Human
cgagauaccccac

SEQ ID NO: 1288779 - RNA, 22 nt, Human
cgagaggugggccagucugugg

SEQ ID NO: 1288780 - RNA, 23 nt, Human
cgagaggugggccagucugugga

SEQ ID NO: 1288781 - RNA, 16 nt, Human
cgagaagggcugcuuc

SEQ ID NO: 1288782 - RNA, 21 nt, Human
cgagaggggccgaugcccaga

SEQ ID NO: 1288783 - RNA, 22 nt, Human
cgagaggggccgaugcccagag

SEQ ID NO: 1288784 - RNA, 14 nt, Human
cgagaggugggcca

SEQ ID NO: 1288785 - RNA, 15 nt, Human
cgagaggugggccag

SEQ ID NO: 1288786 - RNA, 19 nt, Human
cgagaggugggccagucug

SEQ ID NO: 1288787 - RNA, 20 nt, Human
cgagaggugggccagucugu

SEQ ID NO: 1288788 - RNA, 11 nt, Human
cgacugucucc

SEQ ID NO: 1288789 - RNA, 19 nt, Human
cgaauacuuuugcccuuug

SEQ ID NO: 1288790 - RNA, 11 nt, Human
cgacuguuguu

SEQ ID NO: 1288791 - RNA, 19 nt, Human
cgacuguuguuaucuguuu

SEQ ID NO: 1288792 - RNA, 17 nt, Human
cgagaaagaggcaccag

SEQ ID NO: 1288793 - RNA, 16 nt, Human
cgacuuucugccugga

SEQ ID NO: 1288794 - RNA, 19 nt, Human
cgagaaagaggcaccagga

SEQ ID NO: 1288795 - RNA, 21 nt, Human
cgagaaagaggcaccaggaag

SEQ ID NO: 1288796 - RNA, 21 nt, Human
cgagaaauucguguguuuuuu

SEQ ID NO: 1288797 - RNA, 16 nt, Human
cgacuugccaaauuua

SEQ ID NO: 1288798 - RNA, 19 nt, Human
cgacuuguuuuugcacaug

SEQ ID NO: 1288799 - RNA, 13 nt, Human
cgacuuucugccu

SEQ ID NO: 1288800 - RNA, 14 nt, Human
cgacuuucugccug

SEQ ID NO: 1288801 - RNA, 15 nt, Human
cgacuuucugccugg

SEQ ID NO: 1288802 - RNA, 22 nt, Human
ccuuugaccugccucccuucau

SEQ ID NO: 1288803 - RNA, 21 nt, Human
ccuuugaccugccucccuuca

SEQ ID NO: 1288804 - RNA, 16 nt, Human
ccuuuuaguuccugug

SEQ ID NO: 1288805 - RNA, 16 nt, Human
ccuuuuauaucccauu

SEQ ID NO: 1288806 - RNA, 19 nt, Human
ccuuuuaucccaaaguugu

SEQ ID NO: 1288807 - RNA, 22 nt, Human
ccuuuuauguaguaauugacau

SEQ ID NO: 1288808 - RNA, 22 nt, Human
ccuuuuaguuccugugcacagc

SEQ ID NO: 1288809 - RNA, 15 nt, Human
ccuuuuauugacaca

SEQ ID NO: 1288810 - RNA, 10 nt, Human
ccuuuucaua

SEQ ID NO: 1288811 - RNA, 19 nt, Human
cgaaaacccccaaaccaga

SEQ ID NO: 1288812 - RNA, 22 nt, Human
cgaaaaucauauaaucuuacaa

SEQ ID NO: 1288813 - RNA, 13 nt, Human
cgaaaaucaaaug

SEQ ID NO: 1288814 - RNA, 17 nt, Human
cgaaacacagaaaccuu

SEQ ID NO: 1288815 - RNA, 14 nt, Human
cgaacuccugaccu

SEQ ID NO: 1288816 - RNA, 15 nt, Human
cgaacuccuugauuu

SEQ ID NO: 1288817 - RNA, 13 nt, Human
cgaagacacagac

SEQ ID NO: 1288818 - RNA, 13 nt, Human
cgaaagcucuaga

SEQ ID NO: 1288819 - RNA, 14 nt, Human
cgaaagcucuagaa

SEQ ID NO: 1288820 - RNA, 18 nt, Human
cgaaagcucuagaaucug

SEQ ID NO: 1288821 - RNA, 10 nt, Human
cgcagcccug

SEQ ID NO: 1288822 - RNA, 11 nt, Human
cgcagccaccc

SEQ ID NO: 1288823 - RNA, 12 nt, Human
cgcagccacccu

SEQ ID NO: 1288824 - RNA, 13 nt, Human
cgcagccacccug

SEQ ID NO: 1288825 - RNA, 14 nt, Human
cgcagccacccuga

SEQ ID NO: 1288826 - RNA, 16 nt, Human
cgcagccacccugagg

SEQ ID NO: 1288827 - RNA, 17 nt, Human
cgcagccacccugagga

SEQ ID NO: 1288828 - RNA, 22 nt, Human
cgcagccacccugaggagucug

SEQ ID NO: 1288829 - RNA, 17 nt, Human
cgcaccccccaagcugu

SEQ ID NO: 1288830 - RNA, 23 nt, Human
cgccaggauggaacacggccaca

SEQ ID NO: 1288831 - RNA, 16 nt, Human
cgccaggauggcgcag

SEQ ID NO: 1288832 - RNA, 19 nt, Human
cgccaggauggcgcaggaa

SEQ ID NO: 1288833 - RNA, 23 nt, Human
cgccaggauggcgcaggaacuca

SEQ ID NO: 1288834 - RNA, 16 nt, Human
cgccaggcugaccaca

SEQ ID NO: 1288835 - RNA, 17 nt, Human
cgccaggcugaccacag

SEQ ID NO: 1288836 - RNA, 20 nt, Human
cgccaggcugaccacagcac

SEQ ID NO: 1288837 - RNA, 21 nt, Human
cgccaggcugaccacagcaca

SEQ ID NO: 1288838 - RNA, 23 nt, Human
cgccaggcugaccacagcacagc

SEQ ID NO: 1288839 - RNA, 15 nt, Human
cgagcaugucgugga

SEQ ID NO: 1288840 - RNA, 15 nt, Human
cgauguggaacugcu

SEQ ID NO: 1288841 - RNA, 19 nt, Human
cgauguggaacugcugcca

SEQ ID NO: 1288842 - RNA, 20 nt, Human
cgauguggaacugcugccac

SEQ ID NO: 1288843 - RNA, 21 nt, Human
cgauguggaacugcugccacu

SEQ ID NO: 1288844 - RNA, 17 nt, Human
cgauguggucacagcug

SEQ ID NO: 1288845 - RNA, 18 nt, Human
cgauguggucacagcugu

SEQ ID NO: 1288846 - RNA, 19 nt, Human
cgauguggucacagcugua

SEQ ID NO: 1288847 - RNA, 18 nt, Human
cgauuagacuggacagcu

SEQ ID NO: 1288848 - RNA, 18 nt, Human
cgauucccucucccaggc

SEQ ID NO: 1288849 - RNA, 14 nt, Human
cgauuugucccagg

SEQ ID NO: 1288850 - RNA, 11 nt, Human
cgauuagacug

SEQ ID NO: 1288851 - RNA, 17 nt, Human
cgauucccucucccagg

SEQ ID NO: 1288852 - RNA, 15 nt, Human
cgcaaagagagauuu

SEQ ID NO: 1288853 - RNA, 16 nt, Human
cgcaaagagagauuuu

SEQ ID NO: 1288854 - RNA, 13 nt, Human
cgcaacccgugcc

SEQ ID NO: 1288855 - RNA, 14 nt, Human
cgcaacccgugcca

SEQ ID NO: 1288856 - RNA, 19 nt, Human
cgcaacccgugccaagucc

SEQ ID NO: 1288857 - RNA, 22 nt, Human
cgcaacccgugccaaguccagg

SEQ ID NO: 1288858 - RNA, 14 nt, Human
cgcaccauucugac

SEQ ID NO: 1288859 - RNA, 15 nt, Human
cgcaccauucugacu

SEQ ID NO: 1288860 - RNA, 21 nt, Human
ccuuguuucucuuccuuucuu

SEQ ID NO: 1288861 - RNA, 17 nt, Human
ccuuguuguuucuugcc

SEQ ID NO: 1288862 - RNA, 19 nt, Human
ccuuguuuacacauacccu

SEQ ID NO: 1288863 - RNA, 16 nt, Human
ccuuguuacuucugag

SEQ ID NO: 1288864 - RNA, 18 nt, Human
ccuuguuacuucugaggu

SEQ ID NO: 1288865 - RNA, 19 nt, Human
ccuuguuacuucugaggua

SEQ ID NO: 1288866 - RNA, 21 nt, Human
ccuuguucugauaaugaaaau

SEQ ID NO: 1288867 - RNA, 11 nt, Human
ccuuguucugu

SEQ ID NO: 1288868 - RNA, 15 nt, Human
ccuugucacgccaga

SEQ ID NO: 1288869 - RNA, 18 nt, Human
ccuugucacgccagacuu

SEQ ID NO: 1288870 - RNA, 16 nt, Human
ccuugucacugguaga

SEQ ID NO: 1288871 - RNA, 14 nt, Human
ccuuguccccauga

SEQ ID NO: 1288872 - RNA, 14 nt, Human
ccuuguccuuuccc

SEQ ID NO: 1288873 - RNA, 16 nt, Human
ccuuugaccugccucc

SEQ ID NO: 1288874 - RNA, 17 nt, Human
ccuuucggauccaggga

SEQ ID NO: 1288875 - RNA, 21 nt, Human
ccuuucggauccagggaggcu

SEQ ID NO: 1288876 - RNA, 14 nt, Human
ccuuucuagagcac

SEQ ID NO: 1288877 - RNA, 19 nt, Human
ccuuucuagagcacugcca

SEQ ID NO: 1288878 - RNA, 15 nt, Human
ccuuucuagccuggc

SEQ ID NO: 1288879 - RNA, 15 nt, Human
ccuuucuaguugaaa

SEQ ID NO: 1288880 - RNA, 14 nt, Human
ccuuucuaguugaa

SEQ ID NO: 1288881 - RNA, 18 nt, Human
ccuuucuaucguucucuc

SEQ ID NO: 1288882 - RNA, 19 nt, Human
ccuuggggcugaugcaguu

SEQ ID NO: 1288883 - RNA, 11 nt, Human
ccuuggggguc

SEQ ID NO: 1288884 - RNA, 20 nt, Human
ccuuggggguccuccuccag

SEQ ID NO: 1288885 - RNA, 22 nt, Human
ccuuggggguccuccuccaggg

SEQ ID NO: 1288886 - RNA, 21 nt, Human
ccuuggggguccuccuccagg

SEQ ID NO: 1288887 - RNA, 18 nt, Human
ccuuggguuagaccuaca

SEQ ID NO: 1288888 - RNA, 20 nt, Human
ccuuggguuagaccuacagg

SEQ ID NO: 1288889 - RNA, 23 nt, Human
ccuugggcccacaccuccuuccc

SEQ ID NO: 1288890 - RNA, 12 nt, Human
ccuugggcccuu

SEQ ID NO: 1288891 - RNA, 14 nt, Human
ccuugggcccuuug

SEQ ID NO: 1288892 - RNA, 17 nt, Human
ccuugggcccuuugagu

SEQ ID NO: 1288893 - RNA, 18 nt, Human
ccuuggggauucuuccau

SEQ ID NO: 1288894 - RNA, 22 nt, Human
ccuuggggauucuuccaucuga

SEQ ID NO: 1288895 - RNA, 23 nt, Human
ccuugggccagaaguaccagacu

SEQ ID NO: 1288896 - RNA, 22 nt, Human
ccuuggguuagaccuacagggg

SEQ ID NO: 1288897 - RNA, 20 nt, Human
ccuuggugauuccgcaguga

SEQ ID NO: 1288898 - RNA, 12 nt, Human
ccuugggacccc

SEQ ID NO: 1288899 - RNA, 22 nt, Human
ccuugggccagaaguaccagac

SEQ ID NO: 1288900 - RNA, 14 nt, Human
ccuugagugggguu

SEQ ID NO: 1288901 - RNA, 22 nt, Human
ccuugagugggguuaucucugu

SEQ ID NO: 1288902 - RNA, 23 nt, Human
ccuugagugggguuaucucugug

SEQ ID NO: 1288903 - RNA, 23 nt, Human
ccuugaugauugacaacacccau

SEQ ID NO: 1288904 - RNA, 20 nt, Human
ccuugaguaguuuuuaucug

SEQ ID NO: 1288905 - RNA, 18 nt, Human
ccuugauugguguugcca

SEQ ID NO: 1288906 - RNA, 21 nt, Human
ccuugauuuaucacacaaagc

SEQ ID NO: 1288907 - RNA, 20 nt, Human
ccuugauuuuagccuucucu

SEQ ID NO: 1288908 - RNA, 21 nt, Human
ccuugauuuuagccuucucug

SEQ ID NO: 1288909 - RNA, 22 nt, Human
ccuugauuuuagccuucucugu

SEQ ID NO: 1288910 - RNA, 13 nt, Human
ccuugaacuagga

SEQ ID NO: 1288911 - RNA, 21 nt, Human
ccuugaaaauaagaauagaaa

SEQ ID NO: 1288912 - RNA, 13 nt, Human
ccuucuuucuacc

SEQ ID NO: 1288913 - RNA, 18 nt, Human
ccuugaagaacugcaggc

SEQ ID NO: 1288914 - RNA, 21 nt, Human
ccuugaagaacugcaggcccu

SEQ ID NO: 1288915 - RNA, 22 nt, Human
ccuugaagaacugcaggcccug

SEQ ID NO: 1288916 - RNA, 23 nt, Human
ccuugaagaacugcaggcccugg

SEQ ID NO: 1288917 - RNA, 14 nt, Human
ccuugaagguauau

SEQ ID NO: 1288918 - RNA, 13 nt, Human
ccuugaaggacua

SEQ ID NO: 1288919 - RNA, 18 nt, Human
ccuugaaggacuaauaga

SEQ ID NO: 1288920 - RNA, 17 nt, Human
ccuugaggucucagccc

SEQ ID NO: 1288921 - RNA, 14 nt, Human
ccuugaggucucag

SEQ ID NO: 1288922 - RNA, 19 nt, Human
ccuugaguaguuuuuaucu

SEQ ID NO: 1288923 - RNA, 17 nt, Human
ccuugagggcaagagcc

SEQ ID NO: 1288924 - RNA, 19 nt, Human
ccuucuauacccacccaga

SEQ ID NO: 1288925 - RNA, 20 nt, Human
ccuucuauacccacccagaa

SEQ ID NO: 1288926 - RNA, 18 nt, Human
ccuucuauacccacccag

SEQ ID NO: 1288927 - RNA, 16 nt, Human
ccuucggccuccaucc

SEQ ID NO: 1288928 - RNA, 14 nt, Human
ccuucgggcugugc

SEQ ID NO: 1288929 - RNA, 14 nt, Human
ccuucuguggcuca

SEQ ID NO: 1288930 - RNA, 15 nt, Human
ccuucuauucuagcc

SEQ ID NO: 1288931 - RNA, 15 nt, Human
ccuucuauuggucuc

SEQ ID NO: 1288932 - RNA, 14 nt, Human
ccuucuauuugggg

SEQ ID NO: 1288933 - RNA, 20 nt, Human
ccuucucuacacucuuguaa

SEQ ID NO: 1288934 - RNA, 21 nt, Human
ccuucuguggcucacagaacc

SEQ ID NO: 1288935 - RNA, 20 nt, Human
ccuucagcacuuuagaauau

SEQ ID NO: 1288936 - RNA, 12 nt, Human
ccuucagccuga

SEQ ID NO: 1288937 - RNA, 13 nt, Human
ccuucagagagca

SEQ ID NO: 1288938 - RNA, 15 nt, Human
ccuucagagagcagu

SEQ ID NO: 1288939 - RNA, 16 nt, Human
ccuucagagagcagug

SEQ ID NO: 1288940 - RNA, 19 nt, Human
ccuucagagagcagugcuu

SEQ ID NO: 1288941 - RNA, 20 nt, Human
ccuucagagagcagugcuuu

SEQ ID NO: 1288942 - RNA, 22 nt, Human
ccuucagagagcagugcuuuug

SEQ ID NO: 1288943 - RNA, 23 nt, Human
ccuucagagagcagugcuuuugg

SEQ ID NO: 1288944 - RNA, 14 nt, Human
ccuucacuuaggaa

SEQ ID NO: 1288945 - RNA, 19 nt, Human
ccuucacugucaccacccu

SEQ ID NO: 1288946 - RNA, 22 nt, Human
ccuuagacagaggcccucaagu

SEQ ID NO: 1288947 - RNA, 15 nt, Human
ccuuccucugagccu

SEQ ID NO: 1288948 - RNA, 16 nt, Human
ccuuccucugagccuu

SEQ ID NO: 1288949 - RNA, 21 nt, Human
ccuuccucuccacugccuucg

SEQ ID NO: 1288950 - RNA, 20 nt, Human
ccuuccucugagccuuggga

SEQ ID NO: 1288951 - RNA, 13 nt, Human
ccuuccucugagg

SEQ ID NO: 1288952 - RNA, 14 nt, Human
ccuuccucugaggc

SEQ ID NO: 1288953 - RNA, 20 nt, Human
ccuucggccuccauccugag

SEQ ID NO: 1288954 - RNA, 14 nt, Human
ccuucggccuccau

SEQ ID NO: 1288955 - RNA, 19 nt, Human
ccuucgcuucuugccucug

SEQ ID NO: 1288956 - RNA, 20 nt, Human
ccuucgcuucuugccucugu

SEQ ID NO: 1288957 - RNA, 21 nt, Human
ccuucgcuucuugccucugug

SEQ ID NO: 1288958 - RNA, 23 nt, Human
ccuucgcuucuugccucugugcu

SEQ ID NO: 1288959 - RNA, 15 nt, Human
ccuucgauacaccgg

SEQ ID NO: 1288960 - RNA, 16 nt, Human
ccuucgcuucuugccu

SEQ ID NO: 1288961 - RNA, 17 nt, Human
ccuucgcuucuugccuc

SEQ ID NO: 1288962 - RNA, 18 nt, Human
ccuucgcuucuugccucu

SEQ ID NO: 1288963 - RNA, 19 nt, Human
ccuuccuuuuacuuuucuu

SEQ ID NO: 1288964 - RNA, 17 nt, Human
ccuuaagagucauccag

SEQ ID NO: 1288965 - RNA, 22 nt, Human
ccuuaagaccuacuguucuaaa

SEQ ID NO: 1288966 - RNA, 16 nt, Human
ccuuaacugcauccag

SEQ ID NO: 1288967 - RNA, 13 nt, Human
ccuuaaggcucuu

SEQ ID NO: 1288968 - RNA, 23 nt, Human
ccuuaagaccuacuguucuaaag

SEQ ID NO: 1288969 - RNA, 16 nt, Human
ccuuaaggcucuuuug

SEQ ID NO: 1288970 - RNA, 18 nt, Human
ccuuaaggcucuuuugua

SEQ ID NO: 1288971 - RNA, 12 nt, Human
ccuuaagucaga

SEQ ID NO: 1288972 - RNA, 23 nt, Human
ccuuaaucagguccucagagaau

SEQ ID NO: 1288973 - RNA, 16 nt, Human
ccuuaauuuauuauua

SEQ ID NO: 1288974 - RNA, 14 nt, Human
ccuuaaaggggaga

SEQ ID NO: 1288975 - RNA, 16 nt, Human
ccuuaacaguuguauu

SEQ ID NO: 1288976 - RNA, 17 nt, Human
ccuuaacaguuguauuu

SEQ ID NO: 1288977 - RNA, 20 nt, Human
ccuuaaacaguugcacagca

SEQ ID NO: 1288978 - RNA, 19 nt, Human
ccuuaaacaguugcacagc

SEQ ID NO: 1288979 - RNA, 20 nt, Human
ccuuaaacaaaaauuaaaau

SEQ ID NO: 1288980 - RNA, 13 nt, Human
ccuguuuuucaca

SEQ ID NO: 1288981 - RNA, 16 nt, Human
ccuguuuuucacauuu

SEQ ID NO: 1288982 - RNA, 20 nt, Human
ccuguuuuucacauuuuccu

SEQ ID NO: 1288983 - RNA, 17 nt, Human
ccuuaccacugcucuga

SEQ ID NO: 1288984 - RNA, 22 nt, Human
ccuuacaaguuagaaaacauaa

SEQ ID NO: 1288985 - RNA, 17 nt, Human
ccuuacaguaggagccc

SEQ ID NO: 1288986 - RNA, 21 nt, Human
ccuuacaguaggagcccagcu

SEQ ID NO: 1288987 - RNA, 20 nt, Human
ccuuaccacugcucugauga

SEQ ID NO: 1288988 - RNA, 14 nt, Human
ccuuaccuuuuuau

SEQ ID NO: 1288989 - RNA, 16 nt, Human
ccuuacucccaggcac

SEQ ID NO: 1288990 - RNA, 12 nt, Human
ccuuacuccugu

SEQ ID NO: 1288991 - RNA, 13 nt, Human
ccuuacuccugug

SEQ ID NO: 1288992 - RNA, 14 nt, Human
ccuuacuccugugg

SEQ ID NO: 1288993 - RNA, 15 nt, Human
ccuuacuccuguggg

SEQ ID NO: 1288994 - RNA, 19 nt, Human
ccuuacuccugugggagcc

SEQ ID NO: 1288995 - RNA, 20 nt, Human
ccuuacuccugugggagccu

SEQ ID NO: 1288996 - RNA, 21 nt, Human
ccuuacuccugugggagccuc

SEQ ID NO: 1288997 - RNA, 16 nt, Human
ccuuacucuucuugaa

SEQ ID NO: 1288998 - RNA, 17 nt, Human
ccuuacucuucuugaaa

SEQ ID NO: 1288999 - RNA, 22 nt, Human
ccuuacucuucuugaaauuuua

SEQ ID NO: 1289000 - RNA, 22 nt, Human
ccuuacuccugugggagccucg

SEQ ID NO: 1289001 - RNA, 15 nt, Human
ccuuagacagaggcc

SEQ ID NO: 1289002 - RNA, 17 nt, Human
ccuuagacagaggcccu

SEQ ID NO: 1289003 - RNA, 20 nt, Human
ccuuagacagaggcccucaa

SEQ ID NO: 1289004 - RNA, 21 nt, Human
ccuuagacagaggcccucaag

SEQ ID NO: 1289005 - RNA, 15 nt, Human
ccuguuuaagagaca

SEQ ID NO: 1289006 - RNA, 12 nt, Human
ccuguuuaagag

SEQ ID NO: 1289007 - RNA, 14 nt, Human
ccuguguuucuugc

SEQ ID NO: 1289008 - RNA, 18 nt, Human
ccuguguuucuugccuca

SEQ ID NO: 1289009 - RNA, 16 nt, Human
ccuguguguuaagcuc

SEQ ID NO: 1289010 - RNA, 20 nt, Human
ccuguguguuaagcucugcu

SEQ ID NO: 1289011 - RNA, 17 nt, Human
ccuguguguuaagcucu

SEQ ID NO: 1289012 - RNA, 19 nt, Human
ccuguguucuuccuggccg

SEQ ID NO: 1289013 - RNA, 20 nt, Human
ccuguguucuuccuggccgc

SEQ ID NO: 1289014 - RNA, 16 nt, Human
ccuguguugucucuag

SEQ ID NO: 1289015 - RNA, 20 nt, Human
ccuguguugucucuagagca

SEQ ID NO: 1289016 - RNA, 22 nt, Human
ccuguguugucucuagagcagg

SEQ ID NO: 1289017 - RNA, 19 nt, Human
ccuguguuucuugccucau

SEQ ID NO: 1289018 - RNA, 17 nt, Human
ccuguuucccaggccca

SEQ ID NO: 1289019 - RNA, 15 nt, Human
ccuguuucccaggcc

SEQ ID NO: 1289020 - RNA, 14 nt, Human
ccuguuucuggcac

SEQ ID NO: 1289021 - RNA, 12 nt, Human
ccuguuucuucc

SEQ ID NO: 1289022 - RNA, 21 nt, Human
ccuguuuauucauaugcauau

SEQ ID NO: 1289023 - RNA, 18 nt, Human
ccuguuucagaggcucag

SEQ ID NO: 1289024 - RNA, 14 nt, Human
ccuguuuaaaaaac

SEQ ID NO: 1289025 - RNA, 16 nt, Human
ccuguuuaaaaaacca

SEQ ID NO: 1289026 - RNA, 19 nt, Human
ccuguuugaggaaagcaag

SEQ ID NO: 1289027 - RNA, 15 nt, Human
ccuguuuggccucuc

SEQ ID NO: 1289028 - RNA, 16 nt, Human
ccuguuuggccucucu

SEQ ID NO: 1289029 - RNA, 21 nt, Human
ccuguuuggccucucuauccu

SEQ ID NO: 1289030 - RNA, 20 nt, Human
ccuguuuggccucucuaucc

SEQ ID NO: 1289031 - RNA, 23 nt, Human
ccuguuuucccacgaggaaucug

SEQ ID NO: 1289032 - RNA, 13 nt, Human
ccuguuuuccccc

SEQ ID NO: 1289033 - RNA, 19 nt, Human
ccuguguccaugcgcucag

SEQ ID NO: 1289034 - RNA, 13 nt, Human
ccuguguagcugu

SEQ ID NO: 1289035 - RNA, 14 nt, Human
ccuguguagcugug

SEQ ID NO: 1289036 - RNA, 15 nt, Human
ccuguguagcuguga

SEQ ID NO: 1289037 - RNA, 17 nt, Human
ccuguguagcugugacc

SEQ ID NO: 1289038 - RNA, 19 nt, Human
ccuguguagcugugaccug

SEQ ID NO: 1289039 - RNA, 23 nt, Human
ccuguguagcugugaccugcuga

SEQ ID NO: 1289040 - RNA, 20 nt, Human
ccuguguagcugugaccugc

SEQ ID NO: 1289041 - RNA, 21 nt, Human
ccuguguagcugugaccugcu

SEQ ID NO: 1289042 - RNA, 22 nt, Human
ccuguguagcugugaccugcug

SEQ ID NO: 1289043 - RNA, 13 nt, Human
ccuguguccaugc

SEQ ID NO: 1289044 - RNA, 14 nt, Human
ccuguguggacagg

SEQ ID NO: 1289045 - RNA, 15 nt, Human
ccuguguggacagga

SEQ ID NO: 1289046 - RNA, 17 nt, Human
ccuguguggacaggacu

SEQ ID NO: 1289047 - RNA, 12 nt, Human
ccuguguggaga

SEQ ID NO: 1289048 - RNA, 13 nt, Human
ccuguguggagag

SEQ ID NO: 1289049 - RNA, 14 nt, Human
ccuguguggagagg

SEQ ID NO: 1289050 - RNA, 15 nt, Human
ccuguguggagaggg

SEQ ID NO: 1289051 - RNA, 16 nt, Human
ccuguguggagaggga

SEQ ID NO: 1289052 - RNA, 19 nt, Human
ccuguguggagagggaaug

SEQ ID NO: 1289053 - RNA, 23 nt, Human
ccuguguggagagggaaugugaa

SEQ ID NO: 1289054 - RNA, 21 nt, Human
ccuguguggagagggaaugug

SEQ ID NO: 1289055 - RNA, 22 nt, Human
ccuguguggagagggaauguga

SEQ ID NO: 1289056 - RNA, 20 nt, Human
ccuguguguccaaaacugcc

SEQ ID NO: 1289057 - RNA, 21 nt, Human
ccuguguguccaaaacugccu

SEQ ID NO: 1289058 - RNA, 17 nt, Human
ccugcaagucaguccag

SEQ ID NO: 1289059 - RNA, 17 nt, Human
ccugcaacucaaggacu

SEQ ID NO: 1289060 - RNA, 18 nt, Human
ccugcaacucaaggacuu

SEQ ID NO: 1289061 - RNA, 20 nt, Human
ccugcaacucaaggacuuug

SEQ ID NO: 1289062 - RNA, 15 nt, Human
ccugcagggccaagc

SEQ ID NO: 1289063 - RNA, 18 nt, Human
ccugcaguacuuuaccuc

SEQ ID NO: 1289064 - RNA, 20 nt, Human
ccugcaguacuuuaccuccu

SEQ ID NO: 1289065 - RNA, 17 nt, Human
ccugcacuaacagagug

SEQ ID NO: 1289066 - RNA, 22 nt, Human
ccugcaggcaggaacaaacagg

SEQ ID NO: 1289067 - RNA, 23 nt, Human
ccugcaggcaggaacaaacaggg

SEQ ID NO: 1289068 - RNA, 22 nt, Human
ccugauuuuuuuuccuuuuaau

SEQ ID NO: 1289069 - RNA, 17 nt, Human
ccugcaaaaggacucuc

SEQ ID NO: 1289070 - RNA, 19 nt, Human
ccugcaaaaggacucucag

SEQ ID NO: 1289071 - RNA, 14 nt, Human
ccugccagccccug

SEQ ID NO: 1289072 - RNA, 11 nt, Human
ccugccaggag

SEQ ID NO: 1289073 - RNA, 21 nt, Human
ccugccaggagcuuuggaccu

SEQ ID NO: 1289074 - RNA, 13 nt, Human
ccugccaggagga

SEQ ID NO: 1289075 - RNA, 12 nt, Human
ccugccaggagg

SEQ ID NO: 1289076 - RNA, 13 nt, Human
ccugcccccaccc

SEQ ID NO: 1289077 - RNA, 14 nt, Human
ccugcccccacccc

SEQ ID NO: 1289078 - RNA, 18 nt, Human
ccugcccccaccccauuc

SEQ ID NO: 1289079 - RNA, 19 nt, Human
ccugcccccaccccauucc

SEQ ID NO: 1289080 - RNA, 13 nt, Human
ccugccagccccu

SEQ ID NO: 1289081 - RNA, 16 nt, Human
ccugccagccccugcc

SEQ ID NO: 1289082 - RNA, 12 nt, Human
ccugccagcugc

SEQ ID NO: 1289083 - RNA, 13 nt, Human
ccugccagcugca

SEQ ID NO: 1289084 - RNA, 14 nt, Human
ccugccagcugcac

SEQ ID NO: 1289085 - RNA, 16 nt, Human
ccugccagcugcacug

SEQ ID NO: 1289086 - RNA, 17 nt, Human
ccugccagcugcacuga

SEQ ID NO: 1289087 - RNA, 18 nt, Human
ccugccagcugcacugau

SEQ ID NO: 1289088 - RNA, 23 nt, Human
ccugccagcugcacugaugcugc

SEQ ID NO: 1289089 - RNA, 22 nt, Human
ccugcauggcauccuccagccc

SEQ ID NO: 1289090 - RNA, 22 nt, Human
ccugcauaauguuucuggauuu

SEQ ID NO: 1289091 - RNA, 22 nt, Human
ccugcauccauucuccugagga

SEQ ID NO: 1289092 - RNA, 23 nt, Human
ccugcauccauucuccugaggau

SEQ ID NO: 1289093 - RNA, 15 nt, Human
ccugcauggcauccu

SEQ ID NO: 1289094 - RNA, 16 nt, Human
ccugcauggcauccuc

SEQ ID NO: 1289095 - RNA, 18 nt, Human
ccugcauggcauccucca

SEQ ID NO: 1289096 - RNA, 19 nt, Human
ccugcauggcauccuccag

SEQ ID NO: 1289097 - RNA, 20 nt, Human
ccugcauggcauccuccagc

SEQ ID NO: 1289098 - RNA, 21 nt, Human
ccugcauggcauccuccagcc

SEQ ID NO: 1289099 - RNA, 23 nt, Human
ccugcauggcauccuccagcccc

SEQ ID NO: 1289100 - RNA, 13 nt, Human
ccugagccagggu

SEQ ID NO: 1289101 - RNA, 15 nt, Human
ccugagccagggucu

SEQ ID NO: 1289102 - RNA, 18 nt, Human
ccugagccagggucucca

SEQ ID NO: 1289103 - RNA, 19 nt, Human
ccugagccagggucuccag

SEQ ID NO: 1289104 - RNA, 20 nt, Human
ccugagccagggucuccaga

SEQ ID NO: 1289105 - RNA, 23 nt, Human
ccugagccagggucuccagaaag

SEQ ID NO: 1289106 - RNA, 12 nt, Human
ccugagcacugc

SEQ ID NO: 1289107 - RNA, 14 nt, Human
ccugagcacugcca

SEQ ID NO: 1289108 - RNA, 15 nt, Human
ccugagcacugccag

SEQ ID NO: 1289109 - RNA, 16 nt, Human
ccugagcacugccagg

SEQ ID NO: 1289110 - RNA, 17 nt, Human
ccugagcacugccagga

SEQ ID NO: 1289111 - RNA, 18 nt, Human
ccugagcacugccaggag

SEQ ID NO: 1289112 - RNA, 19 nt, Human
ccugagcacugccaggagg

SEQ ID NO: 1289113 - RNA, 20 nt, Human
ccugagcacugccaggaggg

SEQ ID NO: 1289114 - RNA, 14 nt, Human
ccugagcaguccuu

SEQ ID NO: 1289115 - RNA, 18 nt, Human
ccugagcaguccuuggcc

SEQ ID NO: 1289116 - RNA, 19 nt, Human
ccugagcaguccuuggccu

SEQ ID NO: 1289117 - RNA, 22 nt, Human
ccugagcaguccuuggccugcu

SEQ ID NO: 1289118 - RNA, 15 nt, Human
ccugagcccagggag

SEQ ID NO: 1289119 - RNA, 16 nt, Human
ccugagcccagggagg

SEQ ID NO: 1289120 - RNA, 17 nt, Human
ccugagcccagggaggc

SEQ ID NO: 1289121 - RNA, 18 nt, Human
ccugagcccagggaggcc

SEQ ID NO: 1289122 - RNA, 19 nt, Human
ccugagcccagggaggccg

SEQ ID NO: 1289123 - RNA, 15 nt, Human
ccugagccccaggga

SEQ ID NO: 1289124 - RNA, 17 nt, Human
ccugagccccagggaga

SEQ ID NO: 1289125 - RNA, 11 nt, Human
ccugagcccca

SEQ ID NO: 1289126 - RNA, 21 nt, Human
ccugagccagggucuccagaa

SEQ ID NO: 1289127 - RNA, 12 nt, Human
ccugagcccagg

SEQ ID NO: 1289128 - RNA, 13 nt, Human
ccugagcccaggg

SEQ ID NO: 1289129 - RNA, 14 nt, Human
ccugagcccaggga

SEQ ID NO: 1289130 - RNA, 21 nt, Human
ccugaggagucugagguccug

SEQ ID NO: 1289131 - RNA, 19 nt, Human
ccugaggacugauuucaga

SEQ ID NO: 1289132 - RNA, 23 nt, Human
ccugaggacugauuucagaguga

SEQ ID NO: 1289133 - RNA, 13 nt, Human
ccugaggagucug

SEQ ID NO: 1289134 - RNA, 14 nt, Human
ccugaggagucuga

SEQ ID NO: 1289135 - RNA, 16 nt, Human
ccugaggagucugagg

SEQ ID NO: 1289136 - RNA, 17 nt, Human
ccugaggagucugaggu

SEQ ID NO: 1289137 - RNA, 18 nt, Human
ccugaggagucugagguc

SEQ ID NO: 1289138 - RNA, 19 nt, Human
ccugaggagucugaggucc

SEQ ID NO: 1289139 - RNA, 20 nt, Human
ccugaggagucugagguccu

SEQ ID NO: 1289140 - RNA, 22 nt, Human
ccugaggagucugagguccuga

SEQ ID NO: 1289141 - RNA, 16 nt, Human
ccugagccccagggag

SEQ ID NO: 1289142 - RNA, 18 nt, Human
ccugaggaacccuuacag

SEQ ID NO: 1289143 - RNA, 13 nt, Human
ccugaggaacugu

SEQ ID NO: 1289144 - RNA, 19 nt, Human
ccugaggacagaugccucc

SEQ ID NO: 1289145 - RNA, 16 nt, Human
ccugacagaaggacuc

SEQ ID NO: 1289146 - RNA, 14 nt, Human
ccugacacugcugg

SEQ ID NO: 1289147 - RNA, 15 nt, Human
ccugacacugcugga

SEQ ID NO: 1289148 - RNA, 13 nt, Human
ccugacacuuuaa

SEQ ID NO: 1289149 - RNA, 14 nt, Human
ccugacacuuuaau

SEQ ID NO: 1289150 - RNA, 15 nt, Human
ccugacacuuuaauu

SEQ ID NO: 1289151 - RNA, 18 nt, Human
ccugacacaccaggcgcu

SEQ ID NO: 1289152 - RNA, 14 nt, Human
ccugacacacuaac

SEQ ID NO: 1289153 - RNA, 23 nt, Human
ccugacacacuaaccaagcugag

SEQ ID NO: 1289154 - RNA, 20 nt, Human
ccugacacacuaaccaagcu

SEQ ID NO: 1289155 - RNA, 13 nt, Human
ccugacacccuuc

SEQ ID NO: 1289156 - RNA, 14 nt, Human
ccugacacccuucu

SEQ ID NO: 1289157 - RNA, 18 nt, Human
ccugacacccuucuccca

SEQ ID NO: 1289158 - RNA, 23 nt, Human
ccugacacccuucucccacucuc

SEQ ID NO: 1289159 - RNA, 13 nt, Human
ccugacacucccu

SEQ ID NO: 1289160 - RNA, 12 nt, Human
ccugacacugca

SEQ ID NO: 1289161 - RNA, 18 nt, Human
ccugacauuccuugcuga

SEQ ID NO: 1289162 - RNA, 17 nt, Human
ccugacauuccuugcug

SEQ ID NO: 1289163 - RNA, 17 nt, Human
ccugacauguccuucug

SEQ ID NO: 1289164 - RNA, 14 nt, Human
ccugagcaacucuu

SEQ ID NO: 1289165 - RNA, 15 nt, Human
ccugagcaacucuug

SEQ ID NO: 1289166 - RNA, 18 nt, Human
ccugagcaacucuugauu

SEQ ID NO: 1289167 - RNA, 23 nt, Human
ccugagcaacucuugauuaucca

SEQ ID NO: 1289168 - RNA, 23 nt, Human
ccugaccaaacagccaacuagcc

SEQ ID NO: 1289169 - RNA, 22 nt, Human
ccugacaggugaggucuguucc

SEQ ID NO: 1289170 - RNA, 23 nt, Human
ccugacaggugaggucuguuccu

SEQ ID NO: 1289171 - RNA, 18 nt, Human
ccugacaucaaaaaaggc

SEQ ID NO: 1289172 - RNA, 19 nt, Human
ccugacaucaaaaaaggca

SEQ ID NO: 1289173 - RNA, 21 nt, Human
ccugacaucaaaaaaggcagu

SEQ ID NO: 1289174 - RNA, 13 nt, Human
ccucuccacacag

SEQ ID NO: 1289175 - RNA, 17 nt, Human
ccucuccacacagugcu

SEQ ID NO: 1289176 - RNA, 18 nt, Human
ccucuccacacagugcuc

SEQ ID NO: 1289177 - RNA, 23 nt, Human
ccucuccacacagugcucaaggc

SEQ ID NO: 1289178 - RNA, 22 nt, Human
ccucuccaccaucgucuucuug

SEQ ID NO: 1289179 - RNA, 18 nt, Human
ccugacaaccacuggucu

SEQ ID NO: 1289180 - RNA, 19 nt, Human
ccugacaaccacuggucug

SEQ ID NO: 1289181 - RNA, 14 nt, Human
ccugacacaccagg

SEQ ID NO: 1289182 - RNA, 15 nt, Human
ccugacacaccaggc

SEQ ID NO: 1289183 - RNA, 17 nt, Human
ccugacacaccaggcgc

SEQ ID NO: 1289184 - RNA, 20 nt, Human
ccuggugcacuggccccacc

SEQ ID NO: 1289185 - RNA, 14 nt, Human
ccuggugaucacgu

SEQ ID NO: 1289186 - RNA, 12 nt, Human
ccuggugccacc

SEQ ID NO: 1289187 - RNA, 19 nt, Human
ccuggugcacuggccccac

SEQ ID NO: 1289188 - RNA, 17 nt, Human
ccuggugcacuggcccc

SEQ ID NO: 1289189 - RNA, 13 nt, Human
ccuggugccaccu

SEQ ID NO: 1289190 - RNA, 13 nt, Human
ccugguccccucc

SEQ ID NO: 1289191 - RNA, 15 nt, Human
ccugguccccuccuu

SEQ ID NO: 1289192 - RNA, 23 nt, Human
ccuggugacaucagguuuuuccc

SEQ ID NO: 1289193 - RNA, 18 nt, Human
ccugguccccuccuuccc

SEQ ID NO: 1289194 - RNA, 15 nt, Human
ccuggucaccuagga

SEQ ID NO: 1289195 - RNA, 17 nt, Human
ccuggucaccuaggaag

SEQ ID NO: 1289196 - RNA, 21 nt, Human
ccuggucaccuaggaagccuc

SEQ ID NO: 1289197 - RNA, 21 nt, Human
ccuggucacaggacucugccu

SEQ ID NO: 1289198 - RNA, 18 nt, Human
ccugguauauccaaaagc

SEQ ID NO: 1289199 - RNA, 20 nt, Human
ccugguauauccaaaagcuu

SEQ ID NO: 1289200 - RNA, 22 nt, Human
ccuggucacaggacucugccuc

SEQ ID NO: 1289201 - RNA, 23 nt, Human
ccuggucacaggacucugccucc

SEQ ID NO: 1289202 - RNA, 14 nt, Human
ccuggguggcuacu

SEQ ID NO: 1289203 - RNA, 15 nt, Human
ccuggguggcuacuc

SEQ ID NO: 1289204 - RNA, 17 nt, Human
ccuggguggcuacucug

SEQ ID NO: 1289205 - RNA, 19 nt, Human
ccuggguggcuacucugug

SEQ ID NO: 1289206 - RNA, 20 nt, Human
ccuggguggcuacucugugc

SEQ ID NO: 1289207 - RNA, 21 nt, Human
ccuggguggcuacucugugcc

SEQ ID NO: 1289208 - RNA, 22 nt, Human
ccuggguggcuacucugugcca

SEQ ID NO: 1289209 - RNA, 23 nt, Human
ccuggguggcuacucugugccag

SEQ ID NO: 1289210 - RNA, 17 nt, Human
ccuggguugcagacagg

SEQ ID NO: 1289211 - RNA, 16 nt, Human
ccuggguugcagacag

SEQ ID NO: 1289212 - RNA, 19 nt, Human
ccuggguuugguguauggu

SEQ ID NO: 1289213 - RNA, 19 nt, Human
ccuggguuuuguauucucu

SEQ ID NO: 1289214 - RNA, 20 nt, Human
ccuggguuuuguauucucug

SEQ ID NO: 1289215 - RNA, 21 nt, Human
ccuggguuuuguauucucuga

SEQ ID NO: 1289216 - RNA, 22 nt, Human
ccuggguuuuguauucucugag

SEQ ID NO: 1289217 - RNA, 23 nt, Human
ccuggguuuuguauucucugagc

SEQ ID NO: 1289218 - RNA, 18 nt, Human
ccugguaauagcuguaaa

SEQ ID NO: 1289219 - RNA, 14 nt, Human
ccugguacccuccu

SEQ ID NO: 1289220 - RNA, 15 nt, Human
ccugguacccuccug

SEQ ID NO: 1289221 - RNA, 17 nt, Human
ccugguacccuccuggc

SEQ ID NO: 1289222 - RNA, 13 nt, Human
ccugguacucccu

SEQ ID NO: 1289223 - RNA, 20 nt, Human
ccugguacucccucucagga

SEQ ID NO: 1289224 - RNA, 17 nt, Human
ccugguagaauagauau

SEQ ID NO: 1289225 - RNA, 20 nt, Human
ccugguagaccacugccaua

SEQ ID NO: 1289226 - RNA, 18 nt, Human
ccugguagaccacugcca

SEQ ID NO: 1289227 - RNA, 12 nt, Human
ccugggcaggag

SEQ ID NO: 1289228 - RNA, 23 nt, Human
ccuggcuuuucacugcuggcugc

SEQ ID NO: 1289229 - RNA, 24 nt, Human
ccuggcuuuucacugcuggcugcc

SEQ ID NO: 1289230 - RNA, 20 nt, Human
ccuggcuuuucacugcuggc

SEQ ID NO: 1289231 - RNA, 21 nt, Human
ccuggcuuuucacugcuggcu

SEQ ID NO: 1289232 - RNA, 22 nt, Human
ccuggcuuuucacugcuggcug

SEQ ID NO: 1289233 - RNA, 20 nt, Human
ccuggcugggacguggcuca

SEQ ID NO: 1289234 - RNA, 21 nt, Human
ccuggcugggacguggcucag

SEQ ID NO: 1289235 - RNA, 22 nt, Human
ccuggcugggacguggcucagc

SEQ ID NO: 1289236 - RNA, 24 nt, Human
ccuggcugggacguggcucagcca

SEQ ID NO: 1289237 - RNA, 20 nt, Human
ccuggcuggcugagggcagu

SEQ ID NO: 1289238 - RNA, 16 nt, Human
ccuggcugucugaggc

SEQ ID NO: 1289239 - RNA, 15 nt, Human
ccuggcuucccaucc

SEQ ID NO: 1289240 - RNA, 19 nt, Human
ccuggcuucccauccccag

SEQ ID NO: 1289241 - RNA, 20 nt, Human
ccuggcuucccauccccagc

SEQ ID NO: 1289242 - RNA, 21 nt, Human
ccuggcuucccauccccagcg

SEQ ID NO: 1289243 - RNA, 22 nt, Human
ccuggcuucccauccccagcga

SEQ ID NO: 1289244 - RNA, 23 nt, Human
ccuggcuucccauccccagcgau

SEQ ID NO: 1289245 - RNA, 14 nt, Human
ccugggcaggaggg

SEQ ID NO: 1289246 - RNA, 18 nt, Human
ccuggggguucuuucuuc

SEQ ID NO: 1289247 - RNA, 15 nt, Human
ccugggggugccagg

SEQ ID NO: 1289248 - RNA, 16 nt, Human
ccugggggugccagga

SEQ ID NO: 1289249 - RNA, 14 nt, Human
ccugggggugccag

SEQ ID NO: 1289250 - RNA, 21 nt, Human
ccuggggguucuuucuuccuc

SEQ ID NO: 1289251 - RNA, 22 nt, Human
ccuggggguucuuucuuccucu

SEQ ID NO: 1289252 - RNA, 23 nt, Human
ccuggggguucuuucuuccucug

SEQ ID NO: 1289253 - RNA, 21 nt, Human
ccugggguauaaaacuuuccu

SEQ ID NO: 1289254 - RNA, 22 nt, Human
ccugggucccaggacccuggac

SEQ ID NO: 1289255 - RNA, 15 nt, Human
ccugggucccaggac

SEQ ID NO: 1289256 - RNA, 13 nt, Human
ccugggugacauu

SEQ ID NO: 1289257 - RNA, 14 nt, Human
ccugggugacauuu

SEQ ID NO: 1289258 - RNA, 15 nt, Human
ccugggugacauuug

SEQ ID NO: 1289259 - RNA, 22 nt, Human
ccuggaaggacauccauguucc

SEQ ID NO: 1289260 - RNA, 17 nt, Human
ccuggaagggagguggg

SEQ ID NO: 1289261 - RNA, 20 nt, Human
ccuggaaugaguugaggcca

SEQ ID NO: 1289262 - RNA, 16 nt, Human
ccuggacacucagacc

SEQ ID NO: 1289263 - RNA, 17 nt, Human
ccuggacacucagaccu

SEQ ID NO: 1289264 - RNA, 13 nt, Human
ccuggacagcugu

SEQ ID NO: 1289265 - RNA, 14 nt, Human
ccuggacagcugug

SEQ ID NO: 1289266 - RNA, 15 nt, Human
ccuggacagcugugc

SEQ ID NO: 1289267 - RNA, 16 nt, Human
ccuggacagcugugcc

SEQ ID NO: 1289268 - RNA, 17 nt, Human
ccuggacagcugugccu

SEQ ID NO: 1289269 - RNA, 20 nt, Human
ccuggacagcugugccucgc

SEQ ID NO: 1289270 - RNA, 18 nt, Human
ccuggacagcugugccuc

SEQ ID NO: 1289271 - RNA, 19 nt, Human
ccuggacagcugugccucg

SEQ ID NO: 1289272 - RNA, 18 nt, Human
ccuggagacugcccagcu

SEQ ID NO: 1289273 - RNA, 19 nt, Human
ccuggagacuuagggcacc

SEQ ID NO: 1289274 - RNA, 23 nt, Human
ccuggagacuuagggcaccaggg

SEQ ID NO: 1289275 - RNA, 13 nt, Human
ccuggagauccuc

SEQ ID NO: 1289276 - RNA, 15 nt, Human
ccuggagauccuccu

SEQ ID NO: 1289277 - RNA, 16 nt, Human
ccuggagauccuccug

SEQ ID NO: 1289278 - RNA, 17 nt, Human
ccuggagauccuccugc

SEQ ID NO: 1289279 - RNA, 18 nt, Human
ccuggagauccuccugca

SEQ ID NO: 1289280 - RNA, 19 nt, Human
ccuggagauccuccugcag

SEQ ID NO: 1289281 - RNA, 23 nt, Human
ccuggcacuaacguugagccccu

SEQ ID NO: 1289282 - RNA, 12 nt, Human
ccuggcagagau

SEQ ID NO: 1289283 - RNA, 19 nt, Human
ccuggcagagaugccuccc

SEQ ID NO: 1289284 - RNA, 12 nt, Human
ccuggccagaca

SEQ ID NO: 1289285 - RNA, 13 nt, Human
ccuggccagacac

SEQ ID NO: 1289286 - RNA, 14 nt, Human
ccuggccagacaca

SEQ ID NO: 1289287 - RNA, 15 nt, Human
ccuggccagacacag

SEQ ID NO: 1289288 - RNA, 16 nt, Human
ccuggccagacacagg

SEQ ID NO: 1289289 - RNA, 18 nt, Human
ccuggccagacacaggcc

SEQ ID NO: 1289290 - RNA, 19 nt, Human
ccuggccagacacaggccc

SEQ ID NO: 1289291 - RNA, 23 nt, Human
ccuggccagacacaggcccuccc

SEQ ID NO: 1289292 - RNA, 22 nt, Human
ccuggcagccgugccuucagcu

SEQ ID NO: 1289293 - RNA, 12 nt, Human
ccuggcagcucu

SEQ ID NO: 1289294 - RNA, 13 nt, Human
ccuggcagcucug

SEQ ID NO: 1289295 - RNA, 14 nt, Human
ccuggcagcucugg

SEQ ID NO: 1289296 - RNA, 15 nt, Human
ccuggcagcucugga

SEQ ID NO: 1289297 - RNA, 17 nt, Human
ccuggcagcucuggaca

SEQ ID NO: 1289298 - RNA, 19 nt, Human
ccuggcagcucuggacagc

SEQ ID NO: 1289299 - RNA, 20 nt, Human
ccuggcagcucuggacagcc

SEQ ID NO: 1289300 - RNA, 21 nt, Human
ccuggcagcucuggacagccc

SEQ ID NO: 1289301 - RNA, 23 nt, Human
ccuggcagcucuggacagcccca

SEQ ID NO: 1289302 - RNA, 17 nt, Human
ccuggcucccacaggcc

SEQ ID NO: 1289303 - RNA, 23 nt, Human
ccuggcucccacaggcccuuccu

SEQ ID NO: 1289304 - RNA, 18 nt, Human
ccuggcugcagccugcgc

SEQ ID NO: 1289305 - RNA, 20 nt, Human
ccuggcugcugaucgccuuc

SEQ ID NO: 1289306 - RNA, 21 nt, Human
ccuggcugcugaucgccuucc

SEQ ID NO: 1289307 - RNA, 23 nt, Human
ccuggcugcugaucgccuucccc

SEQ ID NO: 1289308 - RNA, 22 nt, Human
ccuggcugcugaucgccuuccc

SEQ ID NO: 1289309 - RNA, 13 nt, Human
ccuggcuggcuga

SEQ ID NO: 1289310 - RNA, 17 nt, Human
ccuggcuggcugagggc

SEQ ID NO: 1289311 - RNA, 18 nt, Human
ccuggcuggcugagggca

SEQ ID NO: 1289312 - RNA, 19 nt, Human
ccuggcuggcugagggcag

SEQ ID NO: 1289313 - RNA, 19 nt, Human
ccugguccccuccuuccca

SEQ ID NO: 1289314 - RNA, 22 nt, Human
ccugccucaccagcccuggcaa

SEQ ID NO: 1289315 - RNA, 12 nt, Human
ccugccuggagg

SEQ ID NO: 1289316 - RNA, 13 nt, Human
ccugccuggagga

SEQ ID NO: 1289317 - RNA, 19 nt, Human
ccugccuauuaucugucag

SEQ ID NO: 1289318 - RNA, 16 nt, Human
ccugccucaccacgga

SEQ ID NO: 1289319 - RNA, 14 nt, Human
ccugccuggaggac

SEQ ID NO: 1289320 - RNA, 17 nt, Human
ccugccuggaggaccug

SEQ ID NO: 1289321 - RNA, 19 nt, Human
ccugccuggaggaccugag

SEQ ID NO: 1289322 - RNA, 20 nt, Human
ccugccuggaggaccugagc

SEQ ID NO: 1289323 - RNA, 21 nt, Human
ccugccuggaggaccugagcc

SEQ ID NO: 1289324 - RNA, 22 nt, Human
ccugccuggaggaccugagccu

SEQ ID NO: 1289325 - RNA, 24 nt, Human
ccugccuggaggaccugagccugc

SEQ ID NO: 1289326 - RNA, 16 nt, Human
ccugccuuaucuugca

SEQ ID NO: 1289327 - RNA, 23 nt, Human
ccugccuggaggaccugagccug

SEQ ID NO: 1289328 - RNA, 13 nt, Human
ccugccggcuccu

SEQ ID NO: 1289329 - RNA, 14 nt, Human
ccugccccccagcc

SEQ ID NO: 1289330 - RNA, 23 nt, Human
ccugcgggugaacaaagcagcca

SEQ ID NO: 1289331 - RNA, 24 nt, Human
ccugcgggugaacaaagcagccac

SEQ ID NO: 1289332 - RNA, 20 nt, Human
ccugcggguggggcuugggg

SEQ ID NO: 1289333 - RNA, 21 nt, Human
ccugcggguggggcuuggggc

SEQ ID NO: 1289334 - RNA, 24 nt, Human
ccugcggguggggcuuggggcuca

SEQ ID NO: 1289335 - RNA, 23 nt, Human
ccugcgguagaugggagggaggc

SEQ ID NO: 1289336 - RNA, 18 nt, Human
ccugcgggucacaggagg

SEQ ID NO: 1289337 - RNA, 22 nt, Human
ccugcgggucacaggagggagg

SEQ ID NO: 1289338 - RNA, 20 nt, Human
ccugcggcccaauccaaggu

SEQ ID NO: 1289339 - RNA, 22 nt, Human
ccugccuuuuaguuccugugca

SEQ ID NO: 1289340 - RNA, 20 nt, Human
ccugccuuuuaguuccugug

SEQ ID NO: 1289341 - RNA, 13 nt, Human
ccugccuuuccau

SEQ ID NO: 1289342 - RNA, 16 nt, Human
ccugccuuuccaucca

SEQ ID NO: 1289343 - RNA, 15 nt, Human
ccugcgaaaaccccc

SEQ ID NO: 1289344 - RNA, 20 nt, Human
ccugcgccaccgcccagaga

SEQ ID NO: 1289345 - RNA, 14 nt, Human
ccugccuuccuccu

SEQ ID NO: 1289346 - RNA, 16 nt, Human
ccugccuuccuccugg

SEQ ID NO: 1289347 - RNA, 17 nt, Human
ccugccuuccuccuggg

SEQ ID NO: 1289348 - RNA, 22 nt, Human
ccugccuuccuccugggcccuc

SEQ ID NO: 1289349 - RNA, 19 nt, Human
ccugccuugaaaaagacau

SEQ ID NO: 1289350 - RNA, 19 nt, Human
ccugccuuggccucccaag

SEQ ID NO: 1289351 - RNA, 20 nt, Human
ccugcuuuuuauggccugug

SEQ ID NO: 1289352 - RNA, 12 nt, Human
ccugcuuuucaa

SEQ ID NO: 1289353 - RNA, 13 nt, Human
ccugcuuuucaau

SEQ ID NO: 1289354 - RNA, 23 nt, Human
ccuggaaaucaggguuaguauug

SEQ ID NO: 1289355 - RNA, 18 nt, Human
ccuggaacugucucucau

SEQ ID NO: 1289356 - RNA, 20 nt, Human
ccuggaacugucucucauga

SEQ ID NO: 1289357 - RNA, 13 nt, Human
ccuggaacuuggg

SEQ ID NO: 1289358 - RNA, 16 nt, Human
ccuggaacuuggggag

SEQ ID NO: 1289359 - RNA, 17 nt, Human
ccuggaacuuggggagu

SEQ ID NO: 1289360 - RNA, 16 nt, Human
ccuggaagagcagccc

SEQ ID NO: 1289361 - RNA, 17 nt, Human
ccuggaagagcagcccu

SEQ ID NO: 1289362 - RNA, 15 nt, Human
ccuggaagccagcuu

SEQ ID NO: 1289363 - RNA, 17 nt, Human
ccuggaagccagcuuuc

SEQ ID NO: 1289364 - RNA, 23 nt, Human
ccuggaagcauuuguuucuacuu

SEQ ID NO: 1289365 - RNA, 20 nt, Human
ccuggaaggacauccauguu

SEQ ID NO: 1289366 - RNA, 19 nt, Human
ccugcugugaaagaaguaa

SEQ ID NO: 1289367 - RNA, 15 nt, Human
ccugcugagucccag

SEQ ID NO: 1289368 - RNA, 24 nt, Human
ccugcugagcucugagaggcccug

SEQ ID NO: 1289369 - RNA, 22 nt, Human
ccugcugagcucugagaggccc

SEQ ID NO: 1289370 - RNA, 20 nt, Human
ccugcuuugggcugcccugg

SEQ ID NO: 1289371 - RNA, 21 nt, Human
ccugcuuugggcugcccuggu

SEQ ID NO: 1289372 - RNA, 22 nt, Human
ccugcuuugggcugcccuggug

SEQ ID NO: 1289373 - RNA, 23 nt, Human
ccugcuuugggcugcccuggugc

SEQ ID NO: 1289374 - RNA, 18 nt, Human
ccugcuuugggcuugggc

SEQ ID NO: 1289375 - RNA, 18 nt, Human
ccugcucguccccaagug

SEQ ID NO: 1289376 - RNA, 15 nt, Human
ccugcucgcucccug

SEQ ID NO: 1289377 - RNA, 12 nt, Human
ccugcucuccuc

SEQ ID NO: 1289378 - RNA, 15 nt, Human
ccugcucuccucuuc

SEQ ID NO: 1289379 - RNA, 16 nt, Human
ccugcucuccucuucu

SEQ ID NO: 1289380 - RNA, 16 nt, Human
ccugcucuccucuugc

SEQ ID NO: 1289381 - RNA, 18 nt, Human
ccugcucuccucuugcca

SEQ ID NO: 1289382 - RNA, 19 nt, Human
ccugcucuccucuugccac

SEQ ID NO: 1289383 - RNA, 21 nt, Human
ccugcucuccucuugccacug

SEQ ID NO: 1289384 - RNA, 22 nt, Human
ccugcucuccucuugccacugc

SEQ ID NO: 1289385 - RNA, 13 nt, Human
ccugcugaccugu

SEQ ID NO: 1289386 - RNA, 14 nt, Human
ccugcugaccugug

SEQ ID NO: 1289387 - RNA, 15 nt, Human
ccugcugaccugugc

SEQ ID NO: 1289388 - RNA, 16 nt, Human
ccugcugaccugugca

SEQ ID NO: 1289389 - RNA, 18 nt, Human
ccugcugaccugugcaca

SEQ ID NO: 1289390 - RNA, 11 nt, Human
ccugcugagcu

SEQ ID NO: 1289391 - RNA, 12 nt, Human
ccugcugagcuc

SEQ ID NO: 1289392 - RNA, 13 nt, Human
ccugcugagcucu

SEQ ID NO: 1289393 - RNA, 14 nt, Human
ccugcugagcucug

SEQ ID NO: 1289394 - RNA, 15 nt, Human
ccugcugagcucuga

SEQ ID NO: 1289395 - RNA, 16 nt, Human
ccugcugagcucugag

SEQ ID NO: 1289396 - RNA, 17 nt, Human
ccugcugagcucugaga

SEQ ID NO: 1289397 - RNA, 18 nt, Human
ccugcugagcucugagag

SEQ ID NO: 1289398 - RNA, 19 nt, Human
ccugcugagcucugagagg

SEQ ID NO: 1289399 - RNA, 20 nt, Human
ccugcugagcucugagaggc

SEQ ID NO: 1289400 - RNA, 21 nt, Human
ccugcugagcucugagaggcc

SEQ ID NO: 1289401 - RNA, 17 nt, Human
ccugcuaggccagagcc

SEQ ID NO: 1289402 - RNA, 18 nt, Human
ccugcuaggccagagccc

SEQ ID NO: 1289403 - RNA, 21 nt, Human
ccugcuaggccagagcccacu

SEQ ID NO: 1289404 - RNA, 19 nt, Human
ccugcuaggccagagccca

SEQ ID NO: 1289405 - RNA, 15 nt, Human
ccugcuauuugaagu

SEQ ID NO: 1289406 - RNA, 19 nt, Human
ccugcucaaucccugagga

SEQ ID NO: 1289407 - RNA, 19 nt, Human
ccugcucacgucaaaugca

SEQ ID NO: 1289408 - RNA, 16 nt, Human
ccugcucagcccugca

SEQ ID NO: 1289409 - RNA, 19 nt, Human
ccugcucagcccugcacca

SEQ ID NO: 1289410 - RNA, 20 nt, Human
ccugcucagcccugcaccau

SEQ ID NO: 1289411 - RNA, 13 nt, Human
ccugcucauccac

SEQ ID NO: 1289412 - RNA, 17 nt, Human
ccugcucauccacucua

SEQ ID NO: 1289413 - RNA, 11 nt, Human
ccugcuccaga

SEQ ID NO: 1289414 - RNA, 12 nt, Human
ccugcuccagac

SEQ ID NO: 1289415 - RNA, 13 nt, Human
ccugcuccagacc

SEQ ID NO: 1289416 - RNA, 14 nt, Human
ccugcuccagaccu

SEQ ID NO: 1289417 - RNA, 15 nt, Human
ccugcuccagaccug

SEQ ID NO: 1289418 - RNA, 20 nt, Human
ccucucaauauucaauaaag

SEQ ID NO: 1289419 - RNA, 18 nt, Human
ccucucaauauucaauaa

SEQ ID NO: 1289420 - RNA, 15 nt, Human
ccucucaacacccag

SEQ ID NO: 1289421 - RNA, 22 nt, Human
ccucucaauauucaauaaagcu

SEQ ID NO: 1289422 - RNA, 18 nt, Human
ccucucauuuagccuguc

SEQ ID NO: 1289423 - RNA, 19 nt, Human
ccucucauuuagccugucc

SEQ ID NO: 1289424 - RNA, 20 nt, Human
ccucucauuuagccuguccu

SEQ ID NO: 1289425 - RNA, 22 nt, Human
ccucuagcugugggggugaggg

SEQ ID NO: 1289426 - RNA, 15 nt, Human
ccucuagguccccau

SEQ ID NO: 1289427 - RNA, 22 nt, Human
ccucuagguccccauacuccua

SEQ ID NO: 1289428 - RNA, 22 nt, Human
ccucuaguuuuuucuuccuuuu

SEQ ID NO: 1289429 - RNA, 18 nt, Human
ccucuccacucaugugac

SEQ ID NO: 1289430 - RNA, 23 nt, Human
ccuccuuccucuuuuccuuccca

SEQ ID NO: 1289431 - RNA, 13 nt, Human
ccuccuuccucuu

SEQ ID NO: 1289432 - RNA, 14 nt, Human
ccuccugugcucag

SEQ ID NO: 1289433 - RNA, 15 nt, Human
ccuccugugcucagc

SEQ ID NO: 1289434 - RNA, 16 nt, Human
ccuccugugcucagcc

SEQ ID NO: 1289435 - RNA, 17 nt, Human
ccuccugugcucagccc

SEQ ID NO: 1289436 - RNA, 18 nt, Human
ccuccugugcucagcccu

SEQ ID NO: 1289437 - RNA, 19 nt, Human
ccuccugugcucagcccug

SEQ ID NO: 1289438 - RNA, 21 nt, Human
ccuccugugcucagcccugag

SEQ ID NO: 1289439 - RNA, 13 nt, Human
ccuccuucccucu

SEQ ID NO: 1289440 - RNA, 15 nt, Human
ccuccuucccucucu

SEQ ID NO: 1289441 - RNA, 20 nt, Human
ccuccuucccucucuggaga

SEQ ID NO: 1289442 - RNA, 13 nt, Human
ccuccuuccuaaa

SEQ ID NO: 1289443 - RNA, 16 nt, Human
ccucggggaugugucc

SEQ ID NO: 1289444 - RNA, 13 nt, Human
ccucguuuguguu

SEQ ID NO: 1289445 - RNA, 14 nt, Human
ccucguuuguguuc

SEQ ID NO: 1289446 - RNA, 15 nt, Human
ccucguuuguguucu

SEQ ID NO: 1289447 - RNA, 16 nt, Human
ccucuaacagcaccaa

SEQ ID NO: 1289448 - RNA, 14 nt, Human
ccucuaacagcacc

SEQ ID NO: 1289449 - RNA, 15 nt, Human
ccucuaacagcacca

SEQ ID NO: 1289450 - RNA, 22 nt, Human
ccucuagagaaauaagaucuuu

SEQ ID NO: 1289451 - RNA, 14 nt, Human
ccucuagagcagac

SEQ ID NO: 1289452 - RNA, 15 nt, Human
ccucuagagcagacu

SEQ ID NO: 1289453 - RNA, 18 nt, Human
ccucccugccccucccuu

SEQ ID NO: 1289454 - RNA, 21 nt, Human
ccucccugccccucccuucaa

SEQ ID NO: 1289455 - RNA, 22 nt, Human
ccucccugccccucccuucaac

SEQ ID NO: 1289456 - RNA, 24 nt, Human
ccucccugccccucccuucaacca

SEQ ID NO: 1289457 - RNA, 12 nt, Human
ccuccucagccu

SEQ ID NO: 1289458 - RNA, 13 nt, Human
ccuccucagccug

SEQ ID NO: 1289459 - RNA, 14 nt, Human
ccuccucagccuga

SEQ ID NO: 1289460 - RNA, 15 nt, Human
ccuccucagccugaa

SEQ ID NO: 1289461 - RNA, 22 nt, Human
ccuccucagccugaaccccagg

SEQ ID NO: 1289462 - RNA, 17 nt, Human
ccuccucaggcacacag

SEQ ID NO: 1289463 - RNA, 19 nt, Human
ccuccucaggcacacagcu

SEQ ID NO: 1289464 - RNA, 21 nt, Human
ccuccccuugggcccacaccu

SEQ ID NO: 1289465 - RNA, 13 nt, Human
ccucccccacuuu

SEQ ID NO: 1289466 - RNA, 12 nt, Human
ccuccccuggag

SEQ ID NO: 1289467 - RNA, 14 nt, Human
ccuccccuggaggg

SEQ ID NO: 1289468 - RNA, 22 nt, Human
ccuccccuggagggggaauggc

SEQ ID NO: 1289469 - RNA, 18 nt, Human
ccuccccuuaaaggggag

SEQ ID NO: 1289470 - RNA, 13 nt, Human
ccuccccuugccu

SEQ ID NO: 1289471 - RNA, 12 nt, Human
ccuccccuuggg

SEQ ID NO: 1289472 - RNA, 14 nt, Human
ccuccccuugccug

SEQ ID NO: 1289473 - RNA, 24 nt, Human
ccuccccuugggcccacaccuccu

SEQ ID NO: 1289474 - RNA, 15 nt, Human
ccuccugacacccuu

SEQ ID NO: 1289475 - RNA, 18 nt, Human
ccuccugacacccuucuc

SEQ ID NO: 1289476 - RNA, 19 nt, Human
ccuccugacacccuucucc

SEQ ID NO: 1289477 - RNA, 22 nt, Human
ccuccugacacccuucucccac

SEQ ID NO: 1289478 - RNA, 12 nt, Human
ccuccugagaaa

SEQ ID NO: 1289479 - RNA, 12 nt, Human
ccuccugccucu

SEQ ID NO: 1289480 - RNA, 13 nt, Human
ccuccugccucua

SEQ ID NO: 1289481 - RNA, 18 nt, Human
ccuccugccucuacuggg

SEQ ID NO: 1289482 - RNA, 11 nt, Human
ccuccugcuca

SEQ ID NO: 1289483 - RNA, 21 nt, Human
ccuccucaggcacacagcuac

SEQ ID NO: 1289484 - RNA, 13 nt, Human
ccuccucaucccg

SEQ ID NO: 1289485 - RNA, 20 nt, Human
ccuccucaucccguguucuc

SEQ ID NO: 1289486 - RNA, 23 nt, Human
ccuccucaucccguguucuccuu

SEQ ID NO: 1289487 - RNA, 12 nt, Human
ccuccucaugua

SEQ ID NO: 1289488 - RNA, 20 nt, Human
ccuccucauguacauacccu

SEQ ID NO: 1289489 - RNA, 21 nt, Human
ccuccucauguacauacccug

SEQ ID NO: 1289490 - RNA, 22 nt, Human
ccuccucugugaccaaugucuu

SEQ ID NO: 1289491 - RNA, 12 nt, Human
ccuccucuguga

SEQ ID NO: 1289492 - RNA, 12 nt, Human
ccuccaccucaa

SEQ ID NO: 1289493 - RNA, 13 nt, Human
ccuccaccuccug

SEQ ID NO: 1289494 - RNA, 18 nt, Human
ccuccaccgcagaaggaa

SEQ ID NO: 1289495 - RNA, 17 nt, Human
ccuccacguucugcuca

SEQ ID NO: 1289496 - RNA, 18 nt, Human
ccuccacguucugcucau

SEQ ID NO: 1289497 - RNA, 21 nt, Human
ccuccacguucugcucaucau

SEQ ID NO: 1289498 - RNA, 17 nt, Human
ccuccagagacaacagg

SEQ ID NO: 1289499 - RNA, 13 nt, Human
ccuccagccccug

SEQ ID NO: 1289500 - RNA, 12 nt, Human
ccuccagccccu

SEQ ID NO: 1289501 - RNA, 13 nt, Human
ccuccagggacag

SEQ ID NO: 1289502 - RNA, 15 nt, Human
ccuccagggacagca

SEQ ID NO: 1289503 - RNA, 18 nt, Human
ccuccaucuaaacugccc

SEQ ID NO: 1289504 - RNA, 14 nt, Human
ccuccaugcugccu

SEQ ID NO: 1289505 - RNA, 19 nt, Human
ccuccaugacugcacagua

SEQ ID NO: 1289506 - RNA, 15 nt, Human
ccuccaugcugccuc

SEQ ID NO: 1289507 - RNA, 16 nt, Human
ccuccaugcugccucc

SEQ ID NO: 1289508 - RNA, 18 nt, Human
ccucccaaagugcugaga

SEQ ID NO: 1289509 - RNA, 21 nt, Human
ccucaucuccccaucauuggu

SEQ ID NO: 1289510 - RNA, 17 nt, Human
ccucauccuccuucuuc

SEQ ID NO: 1289511 - RNA, 17 nt, Human
ccucaucucucugccca

SEQ ID NO: 1289512 - RNA, 19 nt, Human
ccucaucucucugcccaac

SEQ ID NO: 1289513 - RNA, 16 nt, Human
ccucaucaaggacacg

SEQ ID NO: 1289514 - RNA, 22 nt, Human
ccucauccaccccaucccuccc

SEQ ID NO: 1289515 - RNA, 14 nt, Human
ccucaucccgagca

SEQ ID NO: 1289516 - RNA, 20 nt, Human
ccucaucccgagcaccucca

SEQ ID NO: 1289517 - RNA, 20 nt, Human
ccucaucccguguucuccuu

SEQ ID NO: 1289518 - RNA, 23 nt, Human
ccuccaaucccaccaacccucag

SEQ ID NO: 1289519 - RNA, 17 nt, Human
ccucaucuucuucacca

SEQ ID NO: 1289520 - RNA, 13 nt, Human
ccucaugaaugua

SEQ ID NO: 1289521 - RNA, 13 nt, Human
ccuccacaccugc

SEQ ID NO: 1289522 - RNA, 14 nt, Human
ccuccacaccugcg

SEQ ID NO: 1289523 - RNA, 15 nt, Human
ccuccacaccugcgg

SEQ ID NO: 1289524 - RNA, 20 nt, Human
ccucaucucucugcccaacc

SEQ ID NO: 1289525 - RNA, 15 nt, Human
ccucaucugucccuc

SEQ ID NO: 1289526 - RNA, 17 nt, Human
ccucaucugucccuccg

SEQ ID NO: 1289527 - RNA, 15 nt, Human
ccucaucuucuucac

SEQ ID NO: 1289528 - RNA, 18 nt, Human
ccucaucuucuucaccau

SEQ ID NO: 1289529 - RNA, 17 nt, Human
ccuccacaccugcggcc

SEQ ID NO: 1289530 - RNA, 16 nt, Human
ccuccacaccugcggc

SEQ ID NO: 1289531 - RNA, 14 nt, Human
ccuccacauccucc

SEQ ID NO: 1289532 - RNA, 15 nt, Human
ccuccacauccucca

SEQ ID NO: 1289533 - RNA, 16 nt, Human
ccuccacauccuccac

SEQ ID NO: 1289534 - RNA, 20 nt, Human
ccuccacauccuccacguuc

SEQ ID NO: 1289535 - RNA, 20 nt, Human
ccuaugcaugguuucagcac

SEQ ID NO: 1289536 - RNA, 21 nt, Human
ccuaugcaugguuucagcacu

SEQ ID NO: 1289537 - RNA, 22 nt, Human
ccuaugcaugguuucagcacua

SEQ ID NO: 1289538 - RNA, 13 nt, Human
ccuauggagagcc

SEQ ID NO: 1289539 - RNA, 14 nt, Human
ccuauggagagccc

SEQ ID NO: 1289540 - RNA, 15 nt, Human
ccuauggagagcccu

SEQ ID NO: 1289541 - RNA, 16 nt, Human
ccuauggagagcccug

SEQ ID NO: 1289542 - RNA, 17 nt, Human
ccucagugacccuggcu

SEQ ID NO: 1289543 - RNA, 18 nt, Human
ccucagugacccuggcuc

SEQ ID NO: 1289544 - RNA, 19 nt, Human
ccucagugacccuggcucc

SEQ ID NO: 1289545 - RNA, 20 nt, Human
ccucagugacccuggcuccu

SEQ ID NO: 1289546 - RNA, 21 nt, Human
ccucagugacccuggcuccuu

SEQ ID NO: 1289547 - RNA, 19 nt, Human
ccuaugcagagguccacaa

SEQ ID NO: 1289548 - RNA, 11 nt, Human
ccuaugcaugg

SEQ ID NO: 1289549 - RNA, 14 nt, Human
ccuaugcaugguuu

SEQ ID NO: 1289550 - RNA, 18 nt, Human
ccuaugcaugguuucagc

SEQ ID NO: 1289551 - RNA, 19 nt, Human
ccuaugcaugguuucagca

SEQ ID NO: 1289552 - RNA, 23 nt, Human
ccuaugcaugguuucagcacuag

SEQ ID NO: 1289553 - RNA, 12 nt, Human
ccuaugcuuuga

SEQ ID NO: 1289554 - RNA, 17 nt, Human
ccucauagcccucaccc

SEQ ID NO: 1289555 - RNA, 18 nt, Human
ccucauagcccucacccu

SEQ ID NO: 1289556 - RNA, 21 nt, Human
ccucauagcccucacccuggg

SEQ ID NO: 1289557 - RNA, 22 nt, Human
ccucauagcccucacccugggg

SEQ ID NO: 1289558 - RNA, 17 nt, Human
ccuauggagagcccugg

SEQ ID NO: 1289559 - RNA, 17 nt, Human
ccggcuugccacacccc

SEQ ID NO: 1289560 - RNA, 19 nt, Human
ccgggacaccuaggcuagg

SEQ ID NO: 1289561 - RNA, 20 nt, Human
ccgggacaccuaggcuaggg

SEQ ID NO: 1289562 - RNA, 16 nt, Human
ccggcuuuguggcacu

SEQ ID NO: 1289563 - RNA, 23 nt, Human
ccgcuuggagcuauuuuccaggc

SEQ ID NO: 1289564 - RNA, 21 nt, Human
ccgcuuggcgaugccagccaa

SEQ ID NO: 1289565 - RNA, 20 nt, Human
ccgcuuggcgaugccagcca

SEQ ID NO: 1289566 - RNA, 20 nt, Human
ccgcugccacguuggagaag

SEQ ID NO: 1289567 - RNA, 15 nt, Human
ccgcucagcccuccc

SEQ ID NO: 1289568 - RNA, 19 nt, Human
ccgcucagcccucccugcc

SEQ ID NO: 1289569 - RNA, 21 nt, Human
ccgcucagcccucccugcccc

SEQ ID NO: 1289570 - RNA, 22 nt, Human
ccgcucagcccucccugccccu

SEQ ID NO: 1289571 - RNA, 20 nt, Human
ccgcucaggcugaccacuuu

SEQ ID NO: 1289572 - RNA, 23 nt, Human
ccgcugagcgaggagaugcuccu

SEQ ID NO: 1289573 - RNA, 19 nt, Human
ccgguaagagcaaaagaau

SEQ ID NO: 1289574 - RNA, 16 nt, Human
ccgugcucgccccagc

SEQ ID NO: 1289575 - RNA, 17 nt, Human
ccgugcucgccccagca

SEQ ID NO: 1289576 - RNA, 15 nt, Human
ccggggaaaggcaag

SEQ ID NO: 1289577 - RNA, 14 nt, Human
ccgggucugccucu

SEQ ID NO: 1289578 - RNA, 22 nt, Human
ccggguguccccaacagcgccc

SEQ ID NO: 1289579 - RNA, 23 nt, Human
ccggguguccccaacagcgccca

SEQ ID NO: 1289580 - RNA, 21 nt, Human
ccgggaagugagggcucacuc

SEQ ID NO: 1289581 - RNA, 20 nt, Human
ccgggaccacccugagccgg

SEQ ID NO: 1289582 - RNA, 17 nt, Human
ccgggaccuggugcugc

SEQ ID NO: 1289583 - RNA, 16 nt, Human
ccgggcguggugguga

SEQ ID NO: 1289584 - RNA, 21 nt, Human
ccgggaccacccugagccggc

SEQ ID NO: 1289585 - RNA, 13 nt, Human
ccgggcugggagc

SEQ ID NO: 1289586 - RNA, 18 nt, Human
ccgggcugggagcucugc

SEQ ID NO: 1289587 - RNA, 19 nt, Human
ccgggcugggagcucugca

SEQ ID NO: 1289588 - RNA, 16 nt, Human
ccgcuacaccacucug

SEQ ID NO: 1289589 - RNA, 17 nt, Human
ccgcuacaccacucugg

SEQ ID NO: 1289590 - RNA, 19 nt, Human
ccgcuacaccacucuggca

SEQ ID NO: 1289591 - RNA, 20 nt, Human
ccgcuacaccacucuggcag

SEQ ID NO: 1289592 - RNA, 21 nt, Human
ccgcuacaccacucuggcagc

SEQ ID NO: 1289593 - RNA, 11 nt, Human
ccgcucagccc

SEQ ID NO: 1289594 - RNA, 12 nt, Human
ccgcucagcccu

SEQ ID NO: 1289595 - RNA, 13 nt, Human
ccgcucagcccuc

SEQ ID NO: 1289596 - RNA, 16 nt, Human
ccgcgucuacccuggg

SEQ ID NO: 1289597 - RNA, 22 nt, Human
ccgcgugcggaggggacagagc

SEQ ID NO: 1289598 - RNA, 14 nt, Human
ccgcuaaaagaaac

SEQ ID NO: 1289599 - RNA, 18 nt, Human
ccgcuaaaagaaacuuuc

SEQ ID NO: 1289600 - RNA, 13 nt, Human
ccgcgucuacccu

SEQ ID NO: 1289601 - RNA, 15 nt, Human
ccgcgucuacccugg

SEQ ID NO: 1289602 - RNA, 17 nt, Human
ccgcgucuacccuggga

SEQ ID NO: 1289603 - RNA, 13 nt, Human
ccgcaccccccaa

SEQ ID NO: 1289604 - RNA, 17 nt, Human
ccgccuuggccuguguu

SEQ ID NO: 1289605 - RNA, 22 nt, Human
ccgcgauguggaacugcugcca

SEQ ID NO: 1289606 - RNA, 23 nt, Human
ccgcgauguggaacugcugccac

SEQ ID NO: 1289607 - RNA, 22 nt, Human
ccgaggccuaccccgcagacac

SEQ ID NO: 1289608 - RNA, 19 nt, Human
ccgagucauucguucugug

SEQ ID NO: 1289609 - RNA, 20 nt, Human
ccgagucauucguucugugg

SEQ ID NO: 1289610 - RNA, 12 nt, Human
ccgaguccaagc

SEQ ID NO: 1289611 - RNA, 13 nt, Human
ccgaguccaagcu

SEQ ID NO: 1289612 - RNA, 15 nt, Human
ccgaguccaagcugg

SEQ ID NO: 1289613 - RNA, 13 nt, Human
ccgauuguaacuc

SEQ ID NO: 1289614 - RNA, 16 nt, Human
ccgauuguaacucaaa

SEQ ID NO: 1289615 - RNA, 13 nt, Human
cccuggugacauc

SEQ ID NO: 1289616 - RNA, 16 nt, Human
cccugguuuccugccc

SEQ ID NO: 1289617 - RNA, 17 nt, Human
cccugguuuccugcccu

SEQ ID NO: 1289618 - RNA, 23 nt, Human
ccgaggaggugucucaggcugcc

SEQ ID NO: 1289619 - RNA, 15 nt, Human
ccgaggcagggaagg

SEQ ID NO: 1289620 - RNA, 18 nt, Human
ccgaggaggugucucagg

SEQ ID NO: 1289621 - RNA, 20 nt, Human
ccgaggaggugucucaggcu

SEQ ID NO: 1289622 - RNA, 21 nt, Human
ccgaggaggugucucaggcug

SEQ ID NO: 1289623 - RNA, 18 nt, Human
cccugguuuccugcccug

SEQ ID NO: 1289624 - RNA, 19 nt, Human
cccugguuuccugcccugg

SEQ ID NO: 1289625 - RNA, 19 nt, Human
ccuaaaagaaacccugcac

SEQ ID NO: 1289626 - RNA, 22 nt, Human
ccuaaaagugggcuugauucug

SEQ ID NO: 1289627 - RNA, 14 nt, Human
ccgugguccuuugg

SEQ ID NO: 1289628 - RNA, 12 nt, Human
ccguguccaccc

SEQ ID NO: 1289629 - RNA, 18 nt, Human
ccguguccacccccauac

SEQ ID NO: 1289630 - RNA, 23 nt, Human
ccgugugagaagugaaugcuggg

SEQ ID NO: 1289631 - RNA, 22 nt, Human
ccgugugagaagugaaugcugg

SEQ ID NO: 1289632 - RNA, 15 nt, Human
ccguguccaccccca

SEQ ID NO: 1289633 - RNA, 19 nt, Human
ccuaaauaauaaaaauaaa

SEQ ID NO: 1289634 - RNA, 15 nt, Human
ccuacaagacacagu

SEQ ID NO: 1289635 - RNA, 18 nt, Human
ccuaaauauauuuuaaga

SEQ ID NO: 1289636 - RNA, 16 nt, Human
ccuaaauauauuuuaa

SEQ ID NO: 1289637 - RNA, 20 nt, Human
ccgugugggagaccggccug

SEQ ID NO: 1289638 - RNA, 22 nt, Human
ccuaugauguauacugccacua

SEQ ID NO: 1289639 - RNA, 20 nt, Human
ccuaguuuucuccucccagg

SEQ ID NO: 1289640 - RNA, 18 nt, Human
ccuauaccuguguuucuu

SEQ ID NO: 1289641 - RNA, 22 nt, Human
ccuauacgcagcgugcuuuaaa

SEQ ID NO: 1289642 - RNA, 13 nt, Human
ccuauacugcuug

SEQ ID NO: 1289643 - RNA, 22 nt, Human
ccuauacugcuuggagcugagc

SEQ ID NO: 1289644 - RNA, 23 nt, Human
ccuauacugcuuggagcugagca

SEQ ID NO: 1289645 - RNA, 19 nt, Human
ccuauacuguaguauucuu

SEQ ID NO: 1289646 - RNA, 15 nt, Human
ccuaguucuagaaaa

SEQ ID NO: 1289647 - RNA, 17 nt, Human
ccuaguucuagaaaaac

SEQ ID NO: 1289648 - RNA, 18 nt, Human
ccuaguucuagaaaaaca

SEQ ID NO: 1289649 - RNA, 13 nt, Human
ccuaguucuucau

SEQ ID NO: 1289650 - RNA, 12 nt, Human
ccuaguuuucca

SEQ ID NO: 1289651 - RNA, 13 nt, Human
ccuaguuuuccau

SEQ ID NO: 1289652 - RNA, 15 nt, Human
ccuaguuuuccaugc

SEQ ID NO: 1289653 - RNA, 15 nt, Human
ccuaguuuucuccuc

SEQ ID NO: 1289654 - RNA, 16 nt, Human
ccuaguuuucuccucc

SEQ ID NO: 1289655 - RNA, 18 nt, Human
ccuaguuuucuccuccca

SEQ ID NO: 1289656 - RNA, 19 nt, Human
ccuaguuuucuccucccag

SEQ ID NO: 1289657 - RNA, 22 nt, Human
ccuaccgagucucuucuccacu

SEQ ID NO: 1289658 - RNA, 23 nt, Human
ccuaccgagucucuucuccacug

SEQ ID NO: 1289659 - RNA, 18 nt, Human
ccuacacucaccugcacu

SEQ ID NO: 1289660 - RNA, 13 nt, Human
ccuacagaaaaac

SEQ ID NO: 1289661 - RNA, 14 nt, Human
ccuacagaaaaacc

SEQ ID NO: 1289662 - RNA, 19 nt, Human
ccuacagaaaaaccuuggg

SEQ ID NO: 1289663 - RNA, 17 nt, Human
ccuacagaaaaaccuug

SEQ ID NO: 1289664 - RNA, 13 nt, Human
ccuacuuccugug

SEQ ID NO: 1289665 - RNA, 15 nt, Human
ccuacuuccugugac

SEQ ID NO: 1289666 - RNA, 16 nt, Human
ccuacuucuuuugcuc

SEQ ID NO: 1289667 - RNA, 22 nt, Human
ccuacuucuuuugcucuuagcu

SEQ ID NO: 1289668 - RNA, 14 nt, Human
ccuacuuugacuuu

SEQ ID NO: 1289669 - RNA, 15 nt, Human
ccuacuuugacuuuu

SEQ ID NO: 1289670 - RNA, 21 nt, Human
ccuacuuugacuuuuugcauu

SEQ ID NO: 1289671 - RNA, 16 nt, Human
ccuagaaacaacacug

SEQ ID NO: 1289672 - RNA, 15 nt, Human
ccuaggcuccacccc

SEQ ID NO: 1289673 - RNA, 17 nt, Human
ccuaggcuccaccccau

SEQ ID NO: 1289674 - RNA, 18 nt, Human
ccuaggcuccaccccauc

SEQ ID NO: 1289675 - RNA, 15 nt, Human
ccuagaaacaacacu

SEQ ID NO: 1289676 - RNA, 11 nt, Human
ccuaggcugca

SEQ ID NO: 1289677 - RNA, 23 nt, Human
ccuagggaggcauggucugcccu

SEQ ID NO: 1289678 - RNA, 21 nt, Human
cccaccucccucaaccucauc

SEQ ID NO: 1289679 - RNA, 23 nt, Human
cccaccgggcugggagcucugca

SEQ ID NO: 1289680 - RNA, 18 nt, Human
cccaccgggccacuccuu

SEQ ID NO: 1289681 - RNA, 19 nt, Human
cccaccgggccacuccuuc

SEQ ID NO: 1289682 - RNA, 22 nt, Human
cccaccgggccacuccuuccug

SEQ ID NO: 1289683 - RNA, 23 nt, Human
cccaccgggccacuccuuccugc

SEQ ID NO: 1289684 - RNA, 16 nt, Human
cccaccuccccuuggg

SEQ ID NO: 1289685 - RNA, 15 nt, Human
cccaccuccugacac

SEQ ID NO: 1289686 - RNA, 18 nt, Human
cccaccugacacaccagg

SEQ ID NO: 1289687 - RNA, 13 nt, Human
cccaccagggucc

SEQ ID NO: 1289688 - RNA, 17 nt, Human
cccaccgggccacuccu

SEQ ID NO: 1289689 - RNA, 16 nt, Human
cccaccagaugcugaa

SEQ ID NO: 1289690 - RNA, 16 nt, Human
cccacgacacugcagc

SEQ ID NO: 1289691 - RNA, 13 nt, Human
cccacgagggcug

SEQ ID NO: 1289692 - RNA, 14 nt, Human
cccacgagggcugg

SEQ ID NO: 1289693 - RNA, 13 nt, Human
cccacuugccucu

SEQ ID NO: 1289694 - RNA, 14 nt, Human
cccacuugccucuu

SEQ ID NO: 1289695 - RNA, 15 nt, Human
cccacuugccucuuc

SEQ ID NO: 1289696 - RNA, 21 nt, Human
cccacuugccucuuccuugaa

SEQ ID NO: 1289697 - RNA, 14 nt, Human
cccacuuguccuua

SEQ ID NO: 1289698 - RNA, 18 nt, Human
cccacuuguccuuagccu

SEQ ID NO: 1289699 - RNA, 13 nt, Human
cccacaagaaaug

SEQ ID NO: 1289700 - RNA, 15 nt, Human
cccacaagccugagg

SEQ ID NO: 1289701 - RNA, 20 nt, Human
cccacaagaaaugaaagcag

SEQ ID NO: 1289702 - RNA, 19 nt, Human
cccacaacccaaaagguuu

SEQ ID NO: 1289703 - RNA, 20 nt, Human
cccacaagccucugcccagg

SEQ ID NO: 1289704 - RNA, 13 nt, Human
cccacaagccuga

SEQ ID NO: 1289705 - RNA, 21 nt, Human
cccacaagugcccuccaggcu

SEQ ID NO: 1289706 - RNA, 19 nt, Human
cccacaggacauuucucua

SEQ ID NO: 1289707 - RNA, 20 nt, Human
cccacaggacauuucucuaa

SEQ ID NO: 1289708 - RNA, 14 nt, Human
cccacauuaaagaa

SEQ ID NO: 1289709 - RNA, 22 nt, Human
cccacauuggaagagcagcacc

SEQ ID NO: 1289710 - RNA, 20 nt, Human
cccacauuggaagagcagca

SEQ ID NO: 1289711 - RNA, 16 nt, Human
cccaccaacccucagg

SEQ ID NO: 1289712 - RNA, 17 nt, Human
cccaccaacccucaggg

SEQ ID NO: 1289713 - RNA, 18 nt, Human
cccaccaacccucagggc

SEQ ID NO: 1289714 - RNA, 19 nt, Human
cccaccaacccucagggca

SEQ ID NO: 1289715 - RNA, 20 nt, Human
cccacaggaagccugcaguc

SEQ ID NO: 1289716 - RNA, 22 nt, Human
cccacaggaagccugcaguccu

SEQ ID NO: 1289717 - RNA, 23 nt, Human
cccacaggaagccugcaguccug

SEQ ID NO: 1289718 - RNA, 22 nt, Human
cccacaagccucugcccaggca

SEQ ID NO: 1289719 - RNA, 23 nt, Human
cccgagucauucguucuguggag

SEQ ID NO: 1289720 - RNA, 22 nt, Human
cccucucucauacccucccucc

SEQ ID NO: 1289721 - RNA, 20 nt, Human
cccucucugcagacuuccca

SEQ ID NO: 1289722 - RNA, 14 nt, Human
cccucucugcucug

SEQ ID NO: 1289723 - RNA, 18 nt, Human
cccucucucauacccucc

SEQ ID NO: 1289724 - RNA, 20 nt, Human
cccucccccccaugcacugu

SEQ ID NO: 1289725 - RNA, 15 nt, Human
cccucucugcucugc

SEQ ID NO: 1289726 - RNA, 16 nt, Human
cccucucugcucugcg

SEQ ID NO: 1289727 - RNA, 13 nt, Human
cccucucuggaga

SEQ ID NO: 1289728 - RNA, 14 nt, Human
cccucucuggagaa

SEQ ID NO: 1289729 - RNA, 13 nt, Human
cccucugaaauac

SEQ ID NO: 1289730 - RNA, 14 nt, Human
cccucugaccugca

SEQ ID NO: 1289731 - RNA, 15 nt, Human
cccucugaccugcac

SEQ ID NO: 1289732 - RNA, 16 nt, Human
cccucugaccugcacu

SEQ ID NO: 1289733 - RNA, 17 nt, Human
cccucugaccugcacug

SEQ ID NO: 1289734 - RNA, 19 nt, Human
cccucugaccugcacuggg

SEQ ID NO: 1289735 - RNA, 14 nt, Human
cccucugcugcugu

SEQ ID NO: 1289736 - RNA, 15 nt, Human
cccucugcugcuguc

SEQ ID NO: 1289737 - RNA, 12 nt, Human
cccucuggaggg

SEQ ID NO: 1289738 - RNA, 21 nt, Human
cccucuggagggguguggcuc

SEQ ID NO: 1289739 - RNA, 22 nt, Human
cccucuggagggguguggcucc

SEQ ID NO: 1289740 - RNA, 18 nt, Human
cccuccaccgcagaagga

SEQ ID NO: 1289741 - RNA, 21 nt, Human
cccuccaccgcagaaggaagg

SEQ ID NO: 1289742 - RNA, 23 nt, Human
cccuccacauuucccccuagccu

SEQ ID NO: 1289743 - RNA, 22 nt, Human
cccuauccuacuuccccuuccu

SEQ ID NO: 1289744 - RNA, 16 nt, Human
cccuauccaaucaauc

SEQ ID NO: 1289745 - RNA, 12 nt, Human
cccuagguguuu

SEQ ID NO: 1289746 - RNA, 15 nt, Human
cccuagguguuuugu

SEQ ID NO: 1289747 - RNA, 16 nt, Human
cccuagguguuuuguu

SEQ ID NO: 1289748 - RNA, 22 nt, Human
cccuagguguuuuguucaccau

SEQ ID NO: 1289749 - RNA, 19 nt, Human
cccuaguucuaccucaggc

SEQ ID NO: 1289750 - RNA, 23 nt, Human
cccuauacugcuuggagcugagc

SEQ ID NO: 1289751 - RNA, 19 nt, Human
cccuauacuguaguauucu

SEQ ID NO: 1289752 - RNA, 19 nt, Human
cccuccaccgcagaaggaa

SEQ ID NO: 1289753 - RNA, 13 nt, Human
cccuccagagaca

SEQ ID NO: 1289754 - RNA, 21 nt, Human
cccuccccaacugaccaccuu

SEQ ID NO: 1289755 - RNA, 15 nt, Human
cccucccccccaugc

SEQ ID NO: 1289756 - RNA, 18 nt, Human
cccucccccccaugcacu

SEQ ID NO: 1289757 - RNA, 18 nt, Human
cccugccaccugucuguc

SEQ ID NO: 1289758 - RNA, 13 nt, Human
cccugccacucac

SEQ ID NO: 1289759 - RNA, 18 nt, Human
cccugccacucacuaggc

SEQ ID NO: 1289760 - RNA, 19 nt, Human
cccugccacucacuaggcc

SEQ ID NO: 1289761 - RNA, 17 nt, Human
cccugccaccugucugu

SEQ ID NO: 1289762 - RNA, 16 nt, Human
cccugccaccugucug

SEQ ID NO: 1289763 - RNA, 15 nt, Human
cccugccaccugucu

SEQ ID NO: 1289764 - RNA, 14 nt, Human
cccugccaccuguc

SEQ ID NO: 1289765 - RNA, 13 nt, Human
cccugccaccugu

SEQ ID NO: 1289766 - RNA, 20 nt, Human
cccugccaccuccugccuca

SEQ ID NO: 1289767 - RNA, 23 nt, Human
cccugcaccaugcugcuggggaa

SEQ ID NO: 1289768 - RNA, 16 nt, Human
cccugcacuguaaaau

SEQ ID NO: 1289769 - RNA, 20 nt, Human
cccugcacuguaaaaugugg

SEQ ID NO: 1289770 - RNA, 17 nt, Human
cccugcacuguaaaaug

SEQ ID NO: 1289771 - RNA, 23 nt, Human
cccugcacaaagcccuuccaugu

SEQ ID NO: 1289772 - RNA, 20 nt, Human
cccugcacagugacuucuga

SEQ ID NO: 1289773 - RNA, 22 nt, Human
cccugcacagugacuucugaga

SEQ ID NO: 1289774 - RNA, 13 nt, Human
cccugcacaguug

SEQ ID NO: 1289775 - RNA, 16 nt, Human
cccugcaaagcccagc

SEQ ID NO: 1289776 - RNA, 17 nt, Human
cccugcaaagcccagcu

SEQ ID NO: 1289777 - RNA, 19 nt, Human
cccugcaaagcccagcuug

SEQ ID NO: 1289778 - RNA, 20 nt, Human
cccugcaaagcccagcuuga

SEQ ID NO: 1289779 - RNA, 15 nt, Human
cccugcaaagcccag

SEQ ID NO: 1289780 - RNA, 12 nt, Human
cccugaggccua

SEQ ID NO: 1289781 - RNA, 16 nt, Human
cccugaggccuagacu

SEQ ID NO: 1289782 - RNA, 19 nt, Human
cccugaggccuagacucug

SEQ ID NO: 1289783 - RNA, 18 nt, Human
cccucuggucgcuccugc

SEQ ID NO: 1289784 - RNA, 19 nt, Human
cccucuggucgcuccugcc

SEQ ID NO: 1289785 - RNA, 20 nt, Human
cccucuggucgcuccugccc

SEQ ID NO: 1289786 - RNA, 22 nt, Human
cccucuggucgcuccugcccac

SEQ ID NO: 1289787 - RNA, 20 nt, Human
cccucuguccaggcacugag

SEQ ID NO: 1289788 - RNA, 24 nt, Human
cccucuguccaggcacugagauac

SEQ ID NO: 1289789 - RNA, 18 nt, Human
cccucuguguauuugcuu

SEQ ID NO: 1289790 - RNA, 17 nt, Human
cccugcuuugggcugcc

SEQ ID NO: 1289791 - RNA, 18 nt, Human
cccugcuuugggcugccc

SEQ ID NO: 1289792 - RNA, 19 nt, Human
cccugcuuugggcugcccu

SEQ ID NO: 1289793 - RNA, 20 nt, Human
cccugcuuugggcugcccug

SEQ ID NO: 1289794 - RNA, 22 nt, Human
cccugcuuugggcugcccuggu

SEQ ID NO: 1289795 - RNA, 21 nt, Human
cccuggaaggacauccauguu

SEQ ID NO: 1289796 - RNA, 23 nt, Human
cccuggaaugaguugaggccacu

SEQ ID NO: 1289797 - RNA, 16 nt, Human
cccuggacccagccag

SEQ ID NO: 1289798 - RNA, 18 nt, Human
cccuggacccagccagaa

SEQ ID NO: 1289799 - RNA, 20 nt, Human
cccugccacucacuaggccc

SEQ ID NO: 1289800 - RNA, 15 nt, Human
cccugggaggcucug

SEQ ID NO: 1289801 - RNA, 22 nt, Human
cccugggagaaucgcuccugca

SEQ ID NO: 1289802 - RNA, 24 nt, Human
cccugggagaaucgcuccugcagc

SEQ ID NO: 1289803 - RNA, 13 nt, Human
cccugggcccugg

SEQ ID NO: 1289804 - RNA, 16 nt, Human
cccugggcccugggcu

SEQ ID NO: 1289805 - RNA, 18 nt, Human
cccugggcccugggcugg

SEQ ID NO: 1289806 - RNA, 19 nt, Human
cccugggcccugggcugga

SEQ ID NO: 1289807 - RNA, 11 nt, Human
cccugggccug

SEQ ID NO: 1289808 - RNA, 13 nt, Human
cccugggccugcc

SEQ ID NO: 1289809 - RNA, 19 nt, Human
cccugggccugccucacca

SEQ ID NO: 1289810 - RNA, 13 nt, Human
cccugggccugcu

SEQ ID NO: 1289811 - RNA, 14 nt, Human
cccugggccugcug

SEQ ID NO: 1289812 - RNA, 15 nt, Human
cccugggccugcugc

SEQ ID NO: 1289813 - RNA, 16 nt, Human
cccugggccugcugcu

SEQ ID NO: 1289814 - RNA, 17 nt, Human
cccugggccugcugcug

SEQ ID NO: 1289815 - RNA, 19 nt, Human
cccugggccugcugcugag

SEQ ID NO: 1289816 - RNA, 20 nt, Human
cccugggccugcugcugaga

SEQ ID NO: 1289817 - RNA, 13 nt, Human
cccugggccuugg

SEQ ID NO: 1289818 - RNA, 18 nt, Human
cccugggccuugggcucc

SEQ ID NO: 1289819 - RNA, 15 nt, Human
cccuggacugugugc

SEQ ID NO: 1289820 - RNA, 21 nt, Human
cccuggacugugugcucagga

SEQ ID NO: 1289821 - RNA, 18 nt, Human
cccuggcuuuucacugcu

SEQ ID NO: 1289822 - RNA, 19 nt, Human
cccuggcuuuucacugcug

SEQ ID NO: 1289823 - RNA, 22 nt, Human
cccuggcuuuucacugcuggcu

SEQ ID NO: 1289824 - RNA, 18 nt, Human
cccugggaggcagugaug

SEQ ID NO: 1289825 - RNA, 18 nt, Human
cccuggucccucugcagu

SEQ ID NO: 1289826 - RNA, 14 nt, Human
cccugguccccucc

SEQ ID NO: 1289827 - RNA, 21 nt, Human
cccugguccccuccuucccaa

SEQ ID NO: 1289828 - RNA, 14 nt, Human
cccuggucccuugu

SEQ ID NO: 1289829 - RNA, 16 nt, Human
cccugguaauagcugu

SEQ ID NO: 1289830 - RNA, 19 nt, Human
cccugguaauagcuguaaa

SEQ ID NO: 1289831 - RNA, 14 nt, Human
cccugggccuuggg

SEQ ID NO: 1289832 - RNA, 11 nt, Human
cccuggucccu

SEQ ID NO: 1289833 - RNA, 13 nt, Human
cccgccucagccu

SEQ ID NO: 1289834 - RNA, 12 nt, Human
cccgccugcccu

SEQ ID NO: 1289835 - RNA, 21 nt, Human
cccgagucauucguucugugg

SEQ ID NO: 1289836 - RNA, 20 nt, Human
cccagaaaagaaagcuacag

SEQ ID NO: 1289837 - RNA, 13 nt, Human
cccagaaaagaaa

SEQ ID NO: 1289838 - RNA, 22 nt, Human
cccggggaaaggcaagguccgg

SEQ ID NO: 1289839 - RNA, 18 nt, Human
cccggugcccaagaauag

SEQ ID NO: 1289840 - RNA, 21 nt, Human
cccggggugcccacaggccgc

SEQ ID NO: 1289841 - RNA, 16 nt, Human
cccggggccagcacuu

SEQ ID NO: 1289842 - RNA, 14 nt, Human
cccggggccagcac

SEQ ID NO: 1289843 - RNA, 23 nt, Human
cccggggugagggggggcucccu

SEQ ID NO: 1289844 - RNA, 15 nt, Human
cccgugggguuccuc

SEQ ID NO: 1289845 - RNA, 22 nt, Human
cccgucucugguuccuccccuc

SEQ ID NO: 1289846 - RNA, 17 nt, Human
cccgucuggcccaccag

SEQ ID NO: 1289847 - RNA, 13 nt, Human
cccguccugccug

SEQ ID NO: 1289848 - RNA, 14 nt, Human
cccguccugccugu

SEQ ID NO: 1289849 - RNA, 15 nt, Human
cccguccugccugug

SEQ ID NO: 1289850 - RNA, 16 nt, Human
cccguccugccugugg

SEQ ID NO: 1289851 - RNA, 17 nt, Human
cccguccugccuguggc

SEQ ID NO: 1289852 - RNA, 12 nt, Human
cccgucucagug

SEQ ID NO: 1289853 - RNA, 13 nt, Human
cccgucucagugu

SEQ ID NO: 1289854 - RNA, 23 nt, Human
cccuaaugcgcaggcuggcccug

SEQ ID NO: 1289855 - RNA, 14 nt, Human
cccuacauguauug

SEQ ID NO: 1289856 - RNA, 17 nt, Human
cccuaaugcgcaggcug

SEQ ID NO: 1289857 - RNA, 21 nt, Human
cccuaaugcgcaggcuggccc

SEQ ID NO: 1289858 - RNA, 22 nt, Human
cccuaaugcgcaggcuggcccu

SEQ ID NO: 1289859 - RNA, 22 nt, Human
cccuaaucuauggucgggagac

SEQ ID NO: 1289860 - RNA, 18 nt, Human
cccuaccgagucucuucu

SEQ ID NO: 1289861 - RNA, 11 nt, Human
cccuacccucu

SEQ ID NO: 1289862 - RNA, 13 nt, Human
cccuacccucuag

SEQ ID NO: 1289863 - RNA, 21 nt, Human
cccuaccgagucucuucucca

SEQ ID NO: 1289864 - RNA, 14 nt, Human
cccuacccucuaga

SEQ ID NO: 1289865 - RNA, 15 nt, Human
cccuacccucuagag

SEQ ID NO: 1289866 - RNA, 14 nt, Human
cccuacccuggacu

SEQ ID NO: 1289867 - RNA, 14 nt, Human
cccuaccugcccca

SEQ ID NO: 1289868 - RNA, 14 nt, Human
cccuaccugugccu

SEQ ID NO: 1289869 - RNA, 16 nt, Human
cccuaccugccccacu

SEQ ID NO: 1289870 - RNA, 11 nt, Human
cccuagccuug

SEQ ID NO: 1289871 - RNA, 14 nt, Human
cccuagccuugcuu

SEQ ID NO: 1289872 - RNA, 19 nt, Human
cccuagcgcuaucucccug

SEQ ID NO: 1289873 - RNA, 13 nt, Human
ccauggcccugcc

SEQ ID NO: 1289874 - RNA, 22 nt, Human
ccaucugcgugacaauaaaaca

SEQ ID NO: 1289875 - RNA, 20 nt, Human
ccaucugcgugacaauaaaa

SEQ ID NO: 1289876 - RNA, 21 nt, Human
ccaugggaaaugucaacaagu

SEQ ID NO: 1289877 - RNA, 22 nt, Human
ccauggccugcaaacugggaac

SEQ ID NO: 1289878 - RNA, 16 nt, Human
ccauggccugcaaacu

SEQ ID NO: 1289879 - RNA, 18 nt, Human
ccauggccugcaaacugg

SEQ ID NO: 1289880 - RNA, 21 nt, Human
ccauggccugcaaacugggaa

SEQ ID NO: 1289881 - RNA, 15 nt, Human
ccaucuaaacugccc

SEQ ID NO: 1289882 - RNA, 16 nt, Human
ccaucuaaacugcccc

SEQ ID NO: 1289883 - RNA, 21 nt, Human
ccaucguugcccccauuucug

SEQ ID NO: 1289884 - RNA, 14 nt, Human
ccauauuggccagu

SEQ ID NO: 1289885 - RNA, 18 nt, Human
ccauccuacccccugugc

SEQ ID NO: 1289886 - RNA, 15 nt, Human
ccauauuuaccucag

SEQ ID NO: 1289887 - RNA, 16 nt, Human
ccauauuuaccucagc

SEQ ID NO: 1289888 - RNA, 14 nt, Human
ccauauuguaaaac

SEQ ID NO: 1289889 - RNA, 18 nt, Human
ccauauuguaaaacaggu

SEQ ID NO: 1289890 - RNA, 17 nt, Human
ccauauuuaccucagcc

SEQ ID NO: 1289891 - RNA, 14 nt, Human
ccaucuaaacugcc

SEQ ID NO: 1289892 - RNA, 14 nt, Human
ccaucgucuucuug

SEQ ID NO: 1289893 - RNA, 16 nt, Human
ccauccuaggcugaca

SEQ ID NO: 1289894 - RNA, 17 nt, Human
ccauccuaggcugacac

SEQ ID NO: 1289895 - RNA, 18 nt, Human
ccauucauuccauucugg

SEQ ID NO: 1289896 - RNA, 20 nt, Human
ccauucacuucauaauccag

SEQ ID NO: 1289897 - RNA, 13 nt, Human
ccauguuucaaau

SEQ ID NO: 1289898 - RNA, 13 nt, Human
ccauguuggcuag

SEQ ID NO: 1289899 - RNA, 21 nt, Human
ccaugggaggccuuucccuaa

SEQ ID NO: 1289900 - RNA, 11 nt, Human
ccaugggacca

SEQ ID NO: 1289901 - RNA, 22 nt, Human
ccaugggagcugguuagaaaug

SEQ ID NO: 1289902 - RNA, 19 nt, Human
ccaugggacagggaggacg

SEQ ID NO: 1289903 - RNA, 16 nt, Human
ccaugggacagggagg

SEQ ID NO: 1289904 - RNA, 18 nt, Human
ccauguuggccaggcugg

SEQ ID NO: 1289905 - RNA, 21 nt, Human
ccauguuggccaggcugcucu

SEQ ID NO: 1289906 - RNA, 18 nt, Human
ccauguuggccaggcugc

SEQ ID NO: 1289907 - RNA, 15 nt, Human
ccaugggaccacaac

SEQ ID NO: 1289908 - RNA, 14 nt, Human
ccaugggaggccuu

SEQ ID NO: 1289909 - RNA, 19 nt, Human
ccaugggaggccuuucccu

SEQ ID NO: 1289910 - RNA, 14 nt, Human
ccauucauuccauu

SEQ ID NO: 1289911 - RNA, 13 nt, Human
ccauucauuccau

SEQ ID NO: 1289912 - RNA, 23 nt, Human
ccauuuggauccuguguggagag

SEQ ID NO: 1289913 - RNA, 16 nt, Human
ccauuuggcaucccug

SEQ ID NO: 1289914 - RNA, 13 nt, Human
ccauuuguucaua

SEQ ID NO: 1289915 - RNA, 21 nt, Human
ccauuuguguacacagucagc

SEQ ID NO: 1289916 - RNA, 19 nt, Human
ccauuuggcaucccugggc

SEQ ID NO: 1289917 - RNA, 18 nt, Human
ccauuuggcaucccuggg

SEQ ID NO: 1289918 - RNA, 13 nt, Human
ccauuuguacuga

SEQ ID NO: 1289919 - RNA, 16 nt, Human
cccaaagcuuuccugc

SEQ ID NO: 1289920 - RNA, 17 nt, Human
cccaaagcuuuccugcc

SEQ ID NO: 1289921 - RNA, 20 nt, Human
cccaaagcuuuccugcccca

SEQ ID NO: 1289922 - RNA, 15 nt, Human
cccaaaggacgcacu

SEQ ID NO: 1289923 - RNA, 19 nt, Human
cccaaaggacgcacugagc

SEQ ID NO: 1289924 - RNA, 18 nt, Human
cccaaaggacgcacugag

SEQ ID NO: 1289925 - RNA, 19 nt, Human
cccaaaggcuuugcccugc

SEQ ID NO: 1289926 - RNA, 14 nt, Human
cccaaagcuuuccu

SEQ ID NO: 1289927 - RNA, 15 nt, Human
cccaaagcuuuccug

SEQ ID NO: 1289928 - RNA, 15 nt, Human
cccaaagugcugaga

SEQ ID NO: 1289929 - RNA, 20 nt, Human
cccaaagugcugagauuaca

SEQ ID NO: 1289930 - RNA, 23 nt, Human
cccaaaguuguuguaaccugcug

SEQ ID NO: 1289931 - RNA, 14 nt, Human
cccaaaugagccau

SEQ ID NO: 1289932 - RNA, 18 nt, Human
cccaacccguggaggcug

SEQ ID NO: 1289933 - RNA, 19 nt, Human
cccaacccguggaggcugc

SEQ ID NO: 1289934 - RNA, 20 nt, Human
cccaacccguggaggcugcu

SEQ ID NO: 1289935 - RNA, 21 nt, Human
cccaacccguggaggcugcuc

SEQ ID NO: 1289936 - RNA, 23 nt, Human
cccaacccguggaggcugcucgg

SEQ ID NO: 1289937 - RNA, 22 nt, Human
cccaacccguggaggcugcucg

SEQ ID NO: 1289938 - RNA, 15 nt, Human
cccaacccuggcacc

SEQ ID NO: 1289939 - RNA, 17 nt, Human
cccaacccuucccucac

SEQ ID NO: 1289940 - RNA, 13 nt, Human
cccaaccugcucu

SEQ ID NO: 1289941 - RNA, 17 nt, Human
cccaaggcucugagcaa

SEQ ID NO: 1289942 - RNA, 19 nt, Human
cccaaggcucccggaauuc

SEQ ID NO: 1289943 - RNA, 18 nt, Human
cccaagggaggcugcugc

SEQ ID NO: 1289944 - RNA, 16 nt, Human
cccaagggaggcugcu

SEQ ID NO: 1289945 - RNA, 17 nt, Human
cccaauccucccagaaa

SEQ ID NO: 1289946 - RNA, 18 nt, Human
ccagguuggagugcagug

SEQ ID NO: 1289947 - RNA, 14 nt, Human
ccagguuggcucug

SEQ ID NO: 1289948 - RNA, 16 nt, Human
ccagguuggcucugcc

SEQ ID NO: 1289949 - RNA, 17 nt, Human
ccagguuggcucugcca

SEQ ID NO: 1289950 - RNA, 18 nt, Human
ccagguuggcucugccag

SEQ ID NO: 1289951 - RNA, 15 nt, Human
ccagguuccacagag

SEQ ID NO: 1289952 - RNA, 18 nt, Human
ccagguuccacagaggac

SEQ ID NO: 1289953 - RNA, 21 nt, Human
ccagguucuccguuagcuccu

SEQ ID NO: 1289954 - RNA, 22 nt, Human
ccagguucuccguuagcuccug

SEQ ID NO: 1289955 - RNA, 23 nt, Human
ccagguucuccguuagcuccugu

SEQ ID NO: 1289956 - RNA, 24 nt, Human
ccagguucuccguuagcuccugug

SEQ ID NO: 1289957 - RNA, 12 nt, Human
ccagucugugga

SEQ ID NO: 1289958 - RNA, 13 nt, Human
ccagucuguggau

SEQ ID NO: 1289959 - RNA, 21 nt, Human
ccagucuguggaucagagaug

SEQ ID NO: 1289960 - RNA, 16 nt, Human
ccaggguugaccccag

SEQ ID NO: 1289961 - RNA, 18 nt, Human
ccaggguugaccccagag

SEQ ID NO: 1289962 - RNA, 21 nt, Human
ccaggguugaccccagaggau

SEQ ID NO: 1289963 - RNA, 13 nt, Human
ccaggguuuuaac

SEQ ID NO: 1289964 - RNA, 16 nt, Human
ccaggguuuuaacuuu

SEQ ID NO: 1289965 - RNA, 21 nt, Human
ccagggcuggaaugauuucag

SEQ ID NO: 1289966 - RNA, 20 nt, Human
ccagggcuccugcacuuacu

SEQ ID NO: 1289967 - RNA, 21 nt, Human
ccagggcuccagccccucuug

SEQ ID NO: 1289968 - RNA, 19 nt, Human
ccagggcccagagcccagc

SEQ ID NO: 1289969 - RNA, 21 nt, Human
ccagggcccagagcccagcuc

SEQ ID NO: 1289970 - RNA, 22 nt, Human
ccagggcccagagcccagcucc

SEQ ID NO: 1289971 - RNA, 23 nt, Human
ccagggcccagagcccagcucca

SEQ ID NO: 1289972 - RNA, 19 nt, Human
ccagggcuccagccccucu

SEQ ID NO: 1289973 - RNA, 12 nt, Human
ccagggcuccug

SEQ ID NO: 1289974 - RNA, 13 nt, Human
ccagggcuccugc

SEQ ID NO: 1289975 - RNA, 14 nt, Human
ccagggcuccugca

SEQ ID NO: 1289976 - RNA, 22 nt, Human
ccagggagagggggcugguggg

SEQ ID NO: 1289977 - RNA, 15 nt, Human
ccagggccagccucu

SEQ ID NO: 1289978 - RNA, 14 nt, Human
ccagggccagccuc

SEQ ID NO: 1289979 - RNA, 13 nt, Human
ccagggcccagag

SEQ ID NO: 1289980 - RNA, 14 nt, Human
ccagggcccagagc

SEQ ID NO: 1289981 - RNA, 15 nt, Human
ccagggcccagagcc

SEQ ID NO: 1289982 - RNA, 16 nt, Human
ccagggcccagagccc

SEQ ID NO: 1289983 - RNA, 17 nt, Human
ccagggcccagagccca

SEQ ID NO: 1289984 - RNA, 18 nt, Human
ccagggcccagagcccag

SEQ ID NO: 1289985 - RNA, 23 nt, Human
ccaggcuguguuuggcuuucagg

SEQ ID NO: 1289986 - RNA, 14 nt, Human
ccagggagagccca

SEQ ID NO: 1289987 - RNA, 15 nt, Human
ccagggagagcccag

SEQ ID NO: 1289988 - RNA, 17 nt, Human
ccagggagagcccagga

SEQ ID NO: 1289989 - RNA, 18 nt, Human
ccagggagagcccaggag

SEQ ID NO: 1289990 - RNA, 19 nt, Human
ccagggagagcccaggagc

SEQ ID NO: 1289991 - RNA, 20 nt, Human
ccagggagagcccaggagcu

SEQ ID NO: 1289992 - RNA, 23 nt, Human
ccagggagagcccaggagcuccc

SEQ ID NO: 1289993 - RNA, 21 nt, Human
ccagggagagcccaggagcuc

SEQ ID NO: 1289994 - RNA, 13 nt, Human
ccagggagagggg

SEQ ID NO: 1289995 - RNA, 18 nt, Human
ccagggagagggggcugg

SEQ ID NO: 1289996 - RNA, 24 nt, Human
ccaggcuaauuuuuuuguauuuua

SEQ ID NO: 1289997 - RNA, 18 nt, Human
ccaggcgccccuuccccc

SEQ ID NO: 1289998 - RNA, 19 nt, Human
ccaggcgccccuucccccu

SEQ ID NO: 1289999 - RNA, 16 nt, Human
ccaggcgcuaauucaa

SEQ ID NO: 1290000 - RNA, 21 nt, Human
ccaggccgggaaaaagcccac

SEQ ID NO: 1290001 - RNA, 18 nt, Human
ccaggcccaaggcucccg

SEQ ID NO: 1290002 - RNA, 17 nt, Human
ccaggcccacugugccu

SEQ ID NO: 1290003 - RNA, 18 nt, Human
ccaggcccagccgacccc

SEQ ID NO: 1290004 - RNA, 22 nt, Human
ccaggcccacugugccucagag

SEQ ID NO: 1290005 - RNA, 14 nt, Human
ccaggcccaaggcu

SEQ ID NO: 1290006 - RNA, 15 nt, Human
ccaggcccaaggcuc

SEQ ID NO: 1290007 - RNA, 17 nt, Human
ccaggcccaaggcuccc

SEQ ID NO: 1290008 - RNA, 19 nt, Human
ccaggcccaaggcucccgg

SEQ ID NO: 1290009 - RNA, 18 nt, Human
ccaggagcuccagugucc

SEQ ID NO: 1290010 - RNA, 20 nt, Human
ccaggagcuccaguguccug

SEQ ID NO: 1290011 - RNA, 21 nt, Human
ccaggagcuccaguguccuga

SEQ ID NO: 1290012 - RNA, 23 nt, Human
ccaggagcuccaguguccugagc

SEQ ID NO: 1290013 - RNA, 14 nt, Human
ccaggagcuccccu

SEQ ID NO: 1290014 - RNA, 19 nt, Human
ccaggagcuccccucccca

SEQ ID NO: 1290015 - RNA, 20 nt, Human
ccaggagcuccccuccccaa

SEQ ID NO: 1290016 - RNA, 13 nt, Human
ccaggccaggacu

SEQ ID NO: 1290017 - RNA, 17 nt, Human
ccaggccaggacucugc

SEQ ID NO: 1290018 - RNA, 18 nt, Human
ccaggccaggacucugca

SEQ ID NO: 1290019 - RNA, 19 nt, Human
ccaggccaggacucugcag

SEQ ID NO: 1290020 - RNA, 20 nt, Human
ccaggccaggacucugcagc

SEQ ID NO: 1290021 - RNA, 21 nt, Human
ccaggccaggacucugcagcc

SEQ ID NO: 1290022 - RNA, 22 nt, Human
ccaggccaggacucugcagccu

SEQ ID NO: 1290023 - RNA, 18 nt, Human
ccaggccaggcauguggc

SEQ ID NO: 1290024 - RNA, 23 nt, Human
ccaggccaggacucugcagccuc

SEQ ID NO: 1290025 - RNA, 16 nt, Human
ccaggagccugugccu

SEQ ID NO: 1290026 - RNA, 17 nt, Human
ccaggagccugugccuc

SEQ ID NO: 1290027 - RNA, 12 nt, Human
ccaggagcucca

SEQ ID NO: 1290028 - RNA, 13 nt, Human
ccaggagcuccag

SEQ ID NO: 1290029 - RNA, 14 nt, Human
ccaggagcuccagu

SEQ ID NO: 1290030 - RNA, 17 nt, Human
ccaggagcuccaguguc

SEQ ID NO: 1290031 - RNA, 13 nt, Human
ccaggagacaggu

SEQ ID NO: 1290032 - RNA, 15 nt, Human
ccagccuccaugcug

SEQ ID NO: 1290033 - RNA, 16 nt, Human
ccagccuccaugcugc

SEQ ID NO: 1290034 - RNA, 13 nt, Human
ccagccucccuga

SEQ ID NO: 1290035 - RNA, 15 nt, Human
ccagccucccugaag

SEQ ID NO: 1290036 - RNA, 17 nt, Human
ccagccucccugaagcc

SEQ ID NO: 1290037 - RNA, 21 nt, Human
ccagccucccugaagccuuug

SEQ ID NO: 1290038 - RNA, 17 nt, Human
ccaggagaagcucagcu

SEQ ID NO: 1290039 - RNA, 18 nt, Human
ccaggagaagcucagcug

SEQ ID NO: 1290040 - RNA, 21 nt, Human
ccaggagaagcucagcugcau

SEQ ID NO: 1290041 - RNA, 22 nt, Human
ccaggagaagcucagcugcauu

SEQ ID NO: 1290042 - RNA, 20 nt, Human
ccaggagaaggccaauuccu

SEQ ID NO: 1290043 - RNA, 21 nt, Human
ccauaguaugggacuggccuc

SEQ ID NO: 1290044 - RNA, 12 nt, Human
ccauaggucacc

SEQ ID NO: 1290045 - RNA, 15 nt, Human
ccauagguagaaugu

SEQ ID NO: 1290046 - RNA, 13 nt, Human
ccaguguuuaaaa

SEQ ID NO: 1290047 - RNA, 17 nt, Human
ccaguuaaucuugcuuu

SEQ ID NO: 1290048 - RNA, 16 nt, Human
ccaguuaauuuuucca

SEQ ID NO: 1290049 - RNA, 18 nt, Human
ccaguuaauuuuuccaac

SEQ ID NO: 1290050 - RNA, 19 nt, Human
ccaguuaaucuugcuuucu

SEQ ID NO: 1290051 - RNA, 17 nt, Human
ccaguuagccucugcag

SEQ ID NO: 1290052 - RNA, 22 nt, Human
ccaguuagccucugcaggaugu

SEQ ID NO: 1290053 - RNA, 21 nt, Human
ccaguguguggcuuucagagc

SEQ ID NO: 1290054 - RNA, 22 nt, Human
ccaguguguggcuuucagagcc

SEQ ID NO: 1290055 - RNA, 23 nt, Human
ccaguguguggcuuucagagccu

SEQ ID NO: 1290056 - RNA, 17 nt, Human
ccaguguuagggaaggg

SEQ ID NO: 1290057 - RNA, 20 nt, Human
ccaguguuagggaagggccu

SEQ ID NO: 1290058 - RNA, 17 nt, Human
ccaguuaaaaaaaauuu

SEQ ID NO: 1290059 - RNA, 24 nt, Human
ccagugcccugaucccagagagcc

SEQ ID NO: 1290060 - RNA, 20 nt, Human
ccagugucauuucucaucca

SEQ ID NO: 1290061 - RNA, 19 nt, Human
ccaguguccugagccccag

SEQ ID NO: 1290062 - RNA, 22 nt, Human
ccaguguccugagccccaggga

SEQ ID NO: 1290063 - RNA, 23 nt, Human
ccaguguccugagccccagggag

SEQ ID NO: 1290064 - RNA, 18 nt, Human
ccaguguccugagcucag

SEQ ID NO: 1290065 - RNA, 19 nt, Human
ccaguguccugagcucagc

SEQ ID NO: 1290066 - RNA, 20 nt, Human
ccaguguccugagcucagcg

SEQ ID NO: 1290067 - RNA, 23 nt, Human
ccaguguccugagcucagcgugg

SEQ ID NO: 1290068 - RNA, 22 nt, Human
ccaguguccugagcucagcgug

SEQ ID NO: 1290069 - RNA, 16 nt, Human
ccaguguguggcuuuc

SEQ ID NO: 1290070 - RNA, 18 nt, Human
ccaguguguggcuuucag

SEQ ID NO: 1290071 - RNA, 16 nt, Human
ccagucuguggaucag

SEQ ID NO: 1290072 - RNA, 14 nt, Human
ccagugcccccacu

SEQ ID NO: 1290073 - RNA, 16 nt, Human
ccagugcccccacuga

SEQ ID NO: 1290074 - RNA, 18 nt, Human
ccagugcccccacugacc

SEQ ID NO: 1290075 - RNA, 23 nt, Human
ccagugcccucuccccucagccu

SEQ ID NO: 1290076 - RNA, 14 nt, Human
ccagugcccugagc

SEQ ID NO: 1290077 - RNA, 15 nt, Human
ccagugcccugagcc

SEQ ID NO: 1290078 - RNA, 16 nt, Human
ccagugcccugagcca

SEQ ID NO: 1290079 - RNA, 17 nt, Human
ccagugcccugagccag

SEQ ID NO: 1290080 - RNA, 18 nt, Human
ccagugcccugagccagg

SEQ ID NO: 1290081 - RNA, 21 nt, Human
ccagugcccugagccaggguc

SEQ ID NO: 1290082 - RNA, 16 nt, Human
ccagugcccugauccc

SEQ ID NO: 1290083 - RNA, 17 nt, Human
ccagugcccugauccca

SEQ ID NO: 1290084 - RNA, 18 nt, Human
ccagugcccugaucccag

SEQ ID NO: 1290085 - RNA, 23 nt, Human
ccagcauaauacuugcuuuggaa

SEQ ID NO: 1290086 - RNA, 11 nt, Human
ccagcaucugg

SEQ ID NO: 1290087 - RNA, 12 nt, Human
ccagcaucuggg

SEQ ID NO: 1290088 - RNA, 13 nt, Human
ccagcaucugggc

SEQ ID NO: 1290089 - RNA, 14 nt, Human
ccagcaucugggcc

SEQ ID NO: 1290090 - RNA, 15 nt, Human
ccagcaucugggccu

SEQ ID NO: 1290091 - RNA, 17 nt, Human
ccagcaucugggccuug

SEQ ID NO: 1290092 - RNA, 21 nt, Human
ccagcaucugggccuuggccu

SEQ ID NO: 1290093 - RNA, 14 nt, Human
ccagcauuccagcc

SEQ ID NO: 1290094 - RNA, 15 nt, Human
ccagcauuccagccc

SEQ ID NO: 1290095 - RNA, 16 nt, Human
ccagcauuccagcccc

SEQ ID NO: 1290096 - RNA, 17 nt, Human
ccagcauuccagccccu

SEQ ID NO: 1290097 - RNA, 18 nt, Human
ccagcauuccagccccuc

SEQ ID NO: 1290098 - RNA, 19 nt, Human
ccagcauuccagccccucu

SEQ ID NO: 1290099 - RNA, 20 nt, Human
ccagcauuccagccccucug

SEQ ID NO: 1290100 - RNA, 21 nt, Human
ccagcauuccagccccucugg

SEQ ID NO: 1290101 - RNA, 22 nt, Human
ccagcauuccagccccucuggu

SEQ ID NO: 1290102 - RNA, 14 nt, Human
ccagcauucccagg

SEQ ID NO: 1290103 - RNA, 15 nt, Human
ccagcauucccaggu

SEQ ID NO: 1290104 - RNA, 20 nt, Human
ccagcacucgcuagcagugg

SEQ ID NO: 1290105 - RNA, 12 nt, Human
ccagcacugcuu

SEQ ID NO: 1290106 - RNA, 15 nt, Human
ccagcacugcuugag

SEQ ID NO: 1290107 - RNA, 18 nt, Human
ccagcacugcuugaggaa

SEQ ID NO: 1290108 - RNA, 19 nt, Human
ccagcacugcuugaggaaa

SEQ ID NO: 1290109 - RNA, 22 nt, Human
ccagcacugcuugaggaaaaca

SEQ ID NO: 1290110 - RNA, 15 nt, Human
ccagcaggugcugac

SEQ ID NO: 1290111 - RNA, 18 nt, Human
ccagcaggugcugacuuc

SEQ ID NO: 1290112 - RNA, 14 nt, Human
ccagccaagcucug

SEQ ID NO: 1290113 - RNA, 20 nt, Human
ccagccaagcucugcagucc

SEQ ID NO: 1290114 - RNA, 16 nt, Human
ccagcauuucccuucc

SEQ ID NO: 1290115 - RNA, 21 nt, Human
ccagcauuucccuuccuuccu

SEQ ID NO: 1290116 - RNA, 17 nt, Human
ccagcauucccagguag

SEQ ID NO: 1290117 - RNA, 19 nt, Human
ccagcauucccagguaggc

SEQ ID NO: 1290118 - RNA, 21 nt, Human
ccagcauucccagguaggcca

SEQ ID NO: 1290119 - RNA, 22 nt, Human
ccagccagcgucggucugugcc

SEQ ID NO: 1290120 - RNA, 14 nt, Human
ccagccaggcccag

SEQ ID NO: 1290121 - RNA, 16 nt, Human
ccagccaggcccagcc

SEQ ID NO: 1290122 - RNA, 22 nt, Human
ccagccaggcccagccgacccc

SEQ ID NO: 1290123 - RNA, 18 nt, Human
ccagccaggcccagccga

SEQ ID NO: 1290124 - RNA, 20 nt, Human
ccagccaggcccagccgacc

SEQ ID NO: 1290125 - RNA, 21 nt, Human
ccagccaggcccagccgaccc

SEQ ID NO: 1290126 - RNA, 14 nt, Human
ccagccucagcucu

SEQ ID NO: 1290127 - RNA, 15 nt, Human
ccagccgacccccuc

SEQ ID NO: 1290128 - RNA, 18 nt, Human
ccagccgagcaggaggcc

SEQ ID NO: 1290129 - RNA, 21 nt, Human
ccagccuccaagcuccaucuc

SEQ ID NO: 1290130 - RNA, 14 nt, Human
ccagccgacccccu

SEQ ID NO: 1290131 - RNA, 17 nt, Human
ccagccgacccccucuc

SEQ ID NO: 1290132 - RNA, 21 nt, Human
ccagcccuccuuaucaaagga

SEQ ID NO: 1290133 - RNA, 13 nt, Human
ccagccccagcca

SEQ ID NO: 1290134 - RNA, 15 nt, Human
ccagccccagccagg

SEQ ID NO: 1290135 - RNA, 16 nt, Human
ccagccccagccaggg

SEQ ID NO: 1290136 - RNA, 13 nt, Human
ccagcccucaucc

SEQ ID NO: 1290137 - RNA, 14 nt, Human
ccagcccucauccc

SEQ ID NO: 1290138 - RNA, 19 nt, Human
ccagccagggcucaaucuc

SEQ ID NO: 1290139 - RNA, 15 nt, Human
ccagccagggcucaa

SEQ ID NO: 1290140 - RNA, 19 nt, Human
ccagccccacuccucugcu

SEQ ID NO: 1290141 - RNA, 18 nt, Human
ccagccccacuccucugc

SEQ ID NO: 1290142 - RNA, 23 nt, Human
ccagcaauuacaacggagucaaa

SEQ ID NO: 1290143 - RNA, 16 nt, Human
ccagcaauucuccugc

SEQ ID NO: 1290144 - RNA, 18 nt, Human
ccagcaauucuccugccu

SEQ ID NO: 1290145 - RNA, 19 nt, Human
ccagcaauucuccugccuc

SEQ ID NO: 1290146 - RNA, 20 nt, Human
ccagcaauucuccugccuca

SEQ ID NO: 1290147 - RNA, 21 nt, Human
ccagcaauucuccugccucag

SEQ ID NO: 1290148 - RNA, 17 nt, Human
ccagauuagagccugua

SEQ ID NO: 1290149 - RNA, 20 nt, Human
ccagcaagcggggauguccc

SEQ ID NO: 1290150 - RNA, 22 nt, Human
ccagcaagcggggaugucccug

SEQ ID NO: 1290151 - RNA, 15 nt, Human
ccagaccauggacac

SEQ ID NO: 1290152 - RNA, 18 nt, Human
ccagaccauugucucaga

SEQ ID NO: 1290153 - RNA, 21 nt, Human
ccagaccauugucucagagca

SEQ ID NO: 1290154 - RNA, 19 nt, Human
ccacuguacuugcucuuga

SEQ ID NO: 1290155 - RNA, 18 nt, Human
ccacuguacuugcucuug

SEQ ID NO: 1290156 - RNA, 17 nt, Human
ccacuguacuugcucuu

SEQ ID NO: 1290157 - RNA, 16 nt, Human
ccacuggcuggacaaa

SEQ ID NO: 1290158 - RNA, 11 nt, Human
ccacuggcucc

SEQ ID NO: 1290159 - RNA, 20 nt, Human
ccacuguacuugcucuugau

SEQ ID NO: 1290160 - RNA, 14 nt, Human
ccagacacccagga

SEQ ID NO: 1290161 - RNA, 15 nt, Human
ccagacacccaggac

SEQ ID NO: 1290162 - RNA, 16 nt, Human
ccagacacccaggacu

SEQ ID NO: 1290163 - RNA, 16 nt, Human
ccagagcacugcucca

SEQ ID NO: 1290164 - RNA, 20 nt, Human
ccagagcaccugcugucugg

SEQ ID NO: 1290165 - RNA, 17 nt, Human
ccagagcaccugcuguc

SEQ ID NO: 1290166 - RNA, 18 nt, Human
ccagagcaccugcugucu

SEQ ID NO: 1290167 - RNA, 19 nt, Human
ccagagcaccugcugucug

SEQ ID NO: 1290168 - RNA, 13 nt, Human
ccagagcaaaaua

SEQ ID NO: 1290169 - RNA, 20 nt, Human
ccagagauccaaaagaagcc

SEQ ID NO: 1290170 - RNA, 17 nt, Human
ccagaggaaggggccag

SEQ ID NO: 1290171 - RNA, 19 nt, Human
ccagaggaaggggccagag

SEQ ID NO: 1290172 - RNA, 22 nt, Human
ccagaggaaggggccagaggcu

SEQ ID NO: 1290173 - RNA, 16 nt, Human
ccagaggagccaccag

SEQ ID NO: 1290174 - RNA, 17 nt, Human
ccagaggagccaccagu

SEQ ID NO: 1290175 - RNA, 19 nt, Human
ccagaggagccaccaguuc

SEQ ID NO: 1290176 - RNA, 21 nt, Human
ccagaggagccaccaguucuc

SEQ ID NO: 1290177 - RNA, 21 nt, Human
ccagaggauugcugccccauc

SEQ ID NO: 1290178 - RNA, 15 nt, Human
ccagaggccaaggag

SEQ ID NO: 1290179 - RNA, 14 nt, Human
ccagaggcccccag

SEQ ID NO: 1290180 - RNA, 15 nt, Human
ccagaggcccccagc

SEQ ID NO: 1290181 - RNA, 18 nt, Human
ccagaggcccccagccca

SEQ ID NO: 1290182 - RNA, 19 nt, Human
ccagaggcccccagcccag

SEQ ID NO: 1290183 - RNA, 21 nt, Human
ccagaggcccccagcccaggg

SEQ ID NO: 1290184 - RNA, 22 nt, Human
ccagaggcccccagcccagggc

SEQ ID NO: 1290185 - RNA, 19 nt, Human
ccagaggcuauuauuuuca

SEQ ID NO: 1290186 - RNA, 11 nt, Human
ccagaggcucg

SEQ ID NO: 1290187 - RNA, 19 nt, Human
ccagaggccaaggaggccu

SEQ ID NO: 1290188 - RNA, 12 nt, Human
ccagaggcuggg

SEQ ID NO: 1290189 - RNA, 15 nt, Human
ccagaggcuggguuc

SEQ ID NO: 1290190 - RNA, 22 nt, Human
ccagauuuaugcauauuauuuu

SEQ ID NO: 1290191 - RNA, 13 nt, Human
ccagauuuaugca

SEQ ID NO: 1290192 - RNA, 16 nt, Human
ccagaggcuggguuca

SEQ ID NO: 1290193 - RNA, 16 nt, Human
ccagaugcagcucaag

SEQ ID NO: 1290194 - RNA, 14 nt, Human
ccagaugcagggca

SEQ ID NO: 1290195 - RNA, 15 nt, Human
ccagaugcagggcag

SEQ ID NO: 1290196 - RNA, 18 nt, Human
ccagaugcagggcaguca

SEQ ID NO: 1290197 - RNA, 18 nt, Human
ccagaugccccuuucugg

SEQ ID NO: 1290198 - RNA, 17 nt, Human
ccagaugccccuuucug

SEQ ID NO: 1290199 - RNA, 14 nt, Human
ccagaugcugaaaa

SEQ ID NO: 1290200 - RNA, 14 nt, Human
ccagaugcuuuccu

SEQ ID NO: 1290201 - RNA, 22 nt, Human
ccacugccuuugaccugccucc

SEQ ID NO: 1290202 - RNA, 14 nt, Human
ccacugccuuugac

SEQ ID NO: 1290203 - RNA, 22 nt, Human
ccacugccuucgcuucuugccu

SEQ ID NO: 1290204 - RNA, 23 nt, Human
ccacugccuucgcuucuugccuc

SEQ ID NO: 1290205 - RNA, 11 nt, Human
ccacugccucu

SEQ ID NO: 1290206 - RNA, 15 nt, Human
ccacugccuucgcuu

SEQ ID NO: 1290207 - RNA, 16 nt, Human
ccacugccuucgcuuc

SEQ ID NO: 1290208 - RNA, 18 nt, Human
ccacugccuucgcuucuu

SEQ ID NO: 1290209 - RNA, 11 nt, Human
ccacuggagca

SEQ ID NO: 1290210 - RNA, 23 nt, Human
ccacuggcuggacaaacugcacc

SEQ ID NO: 1290211 - RNA, 18 nt, Human
ccacuggagcagaagggg

SEQ ID NO: 1290212 - RNA, 12 nt, Human
ccacucccucac

SEQ ID NO: 1290213 - RNA, 13 nt, Human
ccacucccucaca

SEQ ID NO: 1290214 - RNA, 14 nt, Human
ccacucccucacaa

SEQ ID NO: 1290215 - RNA, 18 nt, Human
ccacucccuccuaaccua

SEQ ID NO: 1290216 - RNA, 17 nt, Human
ccacugcccccugcugc

SEQ ID NO: 1290217 - RNA, 19 nt, Human
ccacugcccccugcugcca

SEQ ID NO: 1290218 - RNA, 20 nt, Human
ccacugcccccugcugccau

SEQ ID NO: 1290219 - RNA, 14 nt, Human
ccacucacaacagc

SEQ ID NO: 1290220 - RNA, 20 nt, Human
ccacucacaacagcugccug

SEQ ID NO: 1290221 - RNA, 17 nt, Human
ccacuccagaccccugg

SEQ ID NO: 1290222 - RNA, 19 nt, Human
ccacuccagaccccuggcu

SEQ ID NO: 1290223 - RNA, 20 nt, Human
ccacuccagaccccuggcuu

SEQ ID NO: 1290224 - RNA, 18 nt, Human
ccacuccaagcccagccc

SEQ ID NO: 1290225 - RNA, 19 nt, Human
ccacucaugugacucuuuc

SEQ ID NO: 1290226 - RNA, 22 nt, Human
ccacucaugugacucuuuccaa

SEQ ID NO: 1290227 - RNA, 22 nt, Human
ccacucacuaggcccccacuug

SEQ ID NO: 1290228 - RNA, 18 nt, Human
ccacucacuaggccccca

SEQ ID NO: 1290229 - RNA, 23 nt, Human
ccacguucugcucaucauucucu

SEQ ID NO: 1290230 - RNA, 20 nt, Human
ccacguuggagaagcccgug

SEQ ID NO: 1290231 - RNA, 21 nt, Human
ccacguuggagaagcccgugu

SEQ ID NO: 1290232 - RNA, 21 nt, Human
ccacuaaccuugccugguaca

SEQ ID NO: 1290233 - RNA, 17 nt, Human
ccacuaaccuugccugg

SEQ ID NO: 1290234 - RNA, 20 nt, Human
ccaccucccucaaccucauc

SEQ ID NO: 1290235 - RNA, 18 nt, Human
ccaccucccucaaccuca

SEQ ID NO: 1290236 - RNA, 15 nt, Human
ccaccuccccuuggg

SEQ ID NO: 1290237 - RNA, 16 nt, Human
ccaccuccccuugggc

SEQ ID NO: 1290238 - RNA, 20 nt, Human
ccaccugaauaaagaaugaa

SEQ ID NO: 1290239 - RNA, 16 nt, Human
ccaccugacacaccag

SEQ ID NO: 1290240 - RNA, 17 nt, Human
ccaccugacacaccagg

SEQ ID NO: 1290241 - RNA, 20 nt, Human
ccaccugacauuccuugcug

SEQ ID NO: 1290242 - RNA, 20 nt, Human
ccaccugaggaacugucucg

SEQ ID NO: 1290243 - RNA, 20 nt, Human
ccaccugacacaccaggcgc

SEQ ID NO: 1290244 - RNA, 23 nt, Human
ccaccugacacaccaggcgcuaa

SEQ ID NO: 1290245 - RNA, 16 nt, Human
ccaccuccccccacaa

SEQ ID NO: 1290246 - RNA, 14 nt, Human
ccaccugcccaacc

SEQ ID NO: 1290247 - RNA, 19 nt, Human
ccaccugcuagugugaauu

SEQ ID NO: 1290248 - RNA, 22 nt, Human
ccaccugcuagugugaauuaaa

SEQ ID NO: 1290249 - RNA, 22 nt, Human
ccacggaccaaagggagucugc

SEQ ID NO: 1290250 - RNA, 12 nt, Human
ccacggagccac

SEQ ID NO: 1290251 - RNA, 20 nt, Human
ccacggagccacuccucuga

SEQ ID NO: 1290252 - RNA, 21 nt, Human
ccacggagccacuccucugac

SEQ ID NO: 1290253 - RNA, 15 nt, Human
ccacggcaccugggc

SEQ ID NO: 1290254 - RNA, 20 nt, Human
ccacggcaccugggcccugg

SEQ ID NO: 1290255 - RNA, 19 nt, Human
ccacggcaccugggcccug

SEQ ID NO: 1290256 - RNA, 22 nt, Human
ccacccucguggacaccugccc

SEQ ID NO: 1290257 - RNA, 21 nt, Human
ccacccucguggacaccugcc

SEQ ID NO: 1290258 - RNA, 12 nt, Human
ccacccucacug

SEQ ID NO: 1290259 - RNA, 14 nt, Human
ccacccucacuggc

SEQ ID NO: 1290260 - RNA, 17 nt, Human
ccacccucacuggcucu

SEQ ID NO: 1290261 - RNA, 19 nt, Human
ccacccucacuggcucucc

SEQ ID NO: 1290262 - RNA, 21 nt, Human
ccacccucacuggcucuccug

SEQ ID NO: 1290263 - RNA, 23 nt, Human
ccaccccuuucuagaccaauaaa

SEQ ID NO: 1290264 - RNA, 22 nt, Human
ccacccagaaugagacauccag

SEQ ID NO: 1290265 - RNA, 17 nt, Human
ccacccagaggcagcag

SEQ ID NO: 1290266 - RNA, 11 nt, Human
ccacccagagg

SEQ ID NO: 1290267 - RNA, 16 nt, Human
ccaccccgccugcccu

SEQ ID NO: 1290268 - RNA, 22 nt, Human
ccaaaccacuuuuugcagcuuu

SEQ ID NO: 1290269 - RNA, 14 nt, Human
ccaaaccacuuuuu

SEQ ID NO: 1290270 - RNA, 16 nt, Human
ccaaaccaggacccug

SEQ ID NO: 1290271 - RNA, 11 nt, Human
ccaaaccacuu

SEQ ID NO: 1290272 - RNA, 23 nt, Human
ccacacccuguacuguucugugu

SEQ ID NO: 1290273 - RNA, 16 nt, Human
ccacacccacacucag

SEQ ID NO: 1290274 - RNA, 14 nt, Human
ccacacuccagcug

SEQ ID NO: 1290275 - RNA, 17 nt, Human
ccacacuccagcuggga

SEQ ID NO: 1290276 - RNA, 13 nt, Human
ccacacuccagcu

SEQ ID NO: 1290277 - RNA, 11 nt, Human
ccacaccuccu

SEQ ID NO: 1290278 - RNA, 15 nt, Human
ccacaccuccuuccc

SEQ ID NO: 1290279 - RNA, 16 nt, Human
ccacaccuccuucccu

SEQ ID NO: 1290280 - RNA, 19 nt, Human
ccacaccuccuucccucuc

SEQ ID NO: 1290281 - RNA, 22 nt, Human
ccacccaauucaaaacauugug

SEQ ID NO: 1290282 - RNA, 15 nt, Human
ccacccacuucugca

SEQ ID NO: 1290283 - RNA, 17 nt, Human
ccacccacuucugcacu

SEQ ID NO: 1290284 - RNA, 14 nt, Human
ccaccaagccuuga

SEQ ID NO: 1290285 - RNA, 12 nt, Human
ccaccaagccuu

SEQ ID NO: 1290286 - RNA, 13 nt, Human
ccaccaagccuug

SEQ ID NO: 1290287 - RNA, 24 nt, Human
ccacaugauucugauguacucuaa

SEQ ID NO: 1290288 - RNA, 23 nt, Human
ccacauagugaugguuccccugu

SEQ ID NO: 1290289 - RNA, 14 nt, Human
ccacaucaaagagg

SEQ ID NO: 1290290 - RNA, 15 nt, Human
ccacauacccugacc

SEQ ID NO: 1290291 - RNA, 12 nt, Human
ccacacugcaca

SEQ ID NO: 1290292 - RNA, 14 nt, Human
ccacacugcacaau

SEQ ID NO: 1290293 - RNA, 13 nt, Human
ccacaccugcggc

SEQ ID NO: 1290294 - RNA, 19 nt, Human
ccacauagugaugguuccc

SEQ ID NO: 1290295 - RNA, 21 nt, Human
ccacauagugaugguuccccu

SEQ ID NO: 1290296 - RNA, 22 nt, Human
ccacauagugaugguuccccug

SEQ ID NO: 1290297 - RNA, 22 nt, Human
cauuauucguagauauuggaca

SEQ ID NO: 1290298 - RNA, 15 nt, Human
cauuagaaauauuuu

SEQ ID NO: 1290299 - RNA, 18 nt, Human
cauuauuggaauauaauu

SEQ ID NO: 1290300 - RNA, 23 nt, Human
cauuacuauaagaacuuugagcu

SEQ ID NO: 1290301 - RNA, 17 nt, Human
cauuacugaaaacuuca

SEQ ID NO: 1290302 - RNA, 13 nt, Human
cauuacugcaugc

SEQ ID NO: 1290303 - RNA, 16 nt, Human
cauuacugcaugcacu

SEQ ID NO: 1290304 - RNA, 23 nt, Human
cauuacugcaugcacuucuuaca

SEQ ID NO: 1290305 - RNA, 23 nt, Human
cauuacuguacaggguuaucugc

SEQ ID NO: 1290306 - RNA, 17 nt, Human
cauuacuauaagaacuu

SEQ ID NO: 1290307 - RNA, 14 nt, Human
cauuagaaauauuu

SEQ ID NO: 1290308 - RNA, 18 nt, Human
cauuagaaauauuuuaaa

SEQ ID NO: 1290309 - RNA, 19 nt, Human
cauuagaagacaauugaca

SEQ ID NO: 1290310 - RNA, 14 nt, Human
cauuagaauuauuu

SEQ ID NO: 1290311 - RNA, 19 nt, Human
cauuagaauuauuuaaaca

SEQ ID NO: 1290312 - RNA, 20 nt, Human
cauucaaauguauuacagug

SEQ ID NO: 1290313 - RNA, 14 nt, Human
cauuauuuuccaga

SEQ ID NO: 1290314 - RNA, 23 nt, Human
cauucaaaauaggguauauuuuc

SEQ ID NO: 1290315 - RNA, 12 nt, Human
cauucaacaaga

SEQ ID NO: 1290316 - RNA, 18 nt, Human
cauucaacagagacugaa

SEQ ID NO: 1290317 - RNA, 16 nt, Human
cauucaagucagcucu

SEQ ID NO: 1290318 - RNA, 17 nt, Human
cauucaagucagcucuu

SEQ ID NO: 1290319 - RNA, 17 nt, Human
cauucaaguguaaaaua

SEQ ID NO: 1290320 - RNA, 14 nt, Human
cauucaagauuccc

SEQ ID NO: 1290321 - RNA, 22 nt, Human
cauucaaguguaaaauauuuug

SEQ ID NO: 1290322 - RNA, 23 nt, Human
cauucaaguguaaaauauuuuga

SEQ ID NO: 1290323 - RNA, 18 nt, Human
cauucaaguguaaaauau

SEQ ID NO: 1290324 - RNA, 19 nt, Human
cauucaaguguaaaauauu

SEQ ID NO: 1290325 - RNA, 20 nt, Human
cauucaaguguaaaauauuu

SEQ ID NO: 1290326 - RNA, 21 nt, Human
cauucaaguguaaaauauuuu

SEQ ID NO: 1290327 - RNA, 22 nt, Human
cauucacaguucuuugggccag

SEQ ID NO: 1290328 - RNA, 23 nt, Human
cauucacaguucuuugggccaga

SEQ ID NO: 1290329 - RNA, 17 nt, Human
cauucacaucgcagauu

SEQ ID NO: 1290330 - RNA, 13 nt, Human
cauucaccugccc

SEQ ID NO: 1290331 - RNA, 15 nt, Human
cauuaaacaugacuc

SEQ ID NO: 1290332 - RNA, 19 nt, Human
cauuaaaccaucucccugg

SEQ ID NO: 1290333 - RNA, 18 nt, Human
cauuaacucauuagacug

SEQ ID NO: 1290334 - RNA, 15 nt, Human
cauuaacucauuaga

SEQ ID NO: 1290335 - RNA, 17 nt, Human
cauuacaaguauuuuua

SEQ ID NO: 1290336 - RNA, 21 nt, Human
cauucagauaugauucaaaug

SEQ ID NO: 1290337 - RNA, 17 nt, Human
cauucagaagaaaaaga

SEQ ID NO: 1290338 - RNA, 13 nt, Human
cauucaggaauuc

SEQ ID NO: 1290339 - RNA, 19 nt, Human
cauucaggaauucuuggag

SEQ ID NO: 1290340 - RNA, 17 nt, Human
cauucaggacugcuggu

SEQ ID NO: 1290341 - RNA, 20 nt, Human
cauucacuucacugugcugu

SEQ ID NO: 1290342 - RNA, 19 nt, Human
cauucacuucacugugcug

SEQ ID NO: 1290343 - RNA, 14 nt, Human
cauucacuucauaa

SEQ ID NO: 1290344 - RNA, 15 nt, Human
cauucacuucauaau

SEQ ID NO: 1290345 - RNA, 13 nt, Human
cauucagaagaaa

SEQ ID NO: 1290346 - RNA, 18 nt, Human
cauucagaagaaaaagaa

SEQ ID NO: 1290347 - RNA, 18 nt, Human
cauucacuucacugugcu

SEQ ID NO: 1290348 - RNA, 17 nt, Human
cauucacuucacugugc

SEQ ID NO: 1290349 - RNA, 14 nt, Human
cauucacuucacug

SEQ ID NO: 1290350 - RNA, 11 nt, Human
cauucacuuca

SEQ ID NO: 1290351 - RNA, 15 nt, Human
cauucaccugcccca

SEQ ID NO: 1290352 - RNA, 16 nt, Human
cauucaccugccccaa

SEQ ID NO: 1290353 - RNA, 19 nt, Human
cauucaccugccccaacuc

SEQ ID NO: 1290354 - RNA, 19 nt, Human
cauucauuuucuggguguu

SEQ ID NO: 1290355 - RNA, 17 nt, Human
cauucauuuuuguuguu

SEQ ID NO: 1290356 - RNA, 16 nt, Human
cauuccaaagaacagc

SEQ ID NO: 1290357 - RNA, 17 nt, Human
cauucauuccauucugg

SEQ ID NO: 1290358 - RNA, 16 nt, Human
cauucauuccauucug

SEQ ID NO: 1290359 - RNA, 20 nt, Human
cauucauuuagcuaaacgga

SEQ ID NO: 1290360 - RNA, 15 nt, Human
cauucauuccauucu

SEQ ID NO: 1290361 - RNA, 21 nt, Human
cauucauuagucauguuuauc

SEQ ID NO: 1290362 - RNA, 22 nt, Human
cauuccaacuaucucauuucca

SEQ ID NO: 1290363 - RNA, 21 nt, Human
cauuccaacucguauagcaug

SEQ ID NO: 1290364 - RNA, 22 nt, Human
cauuccaccuucccaugcccug

SEQ ID NO: 1290365 - RNA, 17 nt, Human
cauuccaccuucccaug

SEQ ID NO: 1290366 - RNA, 14 nt, Human
cauuccaagacucu

SEQ ID NO: 1290367 - RNA, 17 nt, Human
cauuccaagacucuaga

SEQ ID NO: 1290368 - RNA, 14 nt, Human
cauuccauccuuga

SEQ ID NO: 1290369 - RNA, 12 nt, Human
cauuccauccuu

SEQ ID NO: 1290370 - RNA, 15 nt, Human
cauuccaugugccca

SEQ ID NO: 1290371 - RNA, 16 nt, Human
cauuccaugugcccag

SEQ ID NO: 1290372 - RNA, 17 nt, Human
cauuccaugugcccagu

SEQ ID NO: 1290373 - RNA, 18 nt, Human
cauuccaugugcccaguu

SEQ ID NO: 1290374 - RNA, 22 nt, Human
cauuccagccccucuggucgcu

SEQ ID NO: 1290375 - RNA, 18 nt, Human
cauuccaagacucuagag

SEQ ID NO: 1290376 - RNA, 13 nt, Human
cauuccagccccu

SEQ ID NO: 1290377 - RNA, 15 nt, Human
cauuccagccccucu

SEQ ID NO: 1290378 - RNA, 18 nt, Human
cauuccagccccucuggu

SEQ ID NO: 1290379 - RNA, 19 nt, Human
cauuccagccccucugguc

SEQ ID NO: 1290380 - RNA, 14 nt, Human
cauuccauucugga

SEQ ID NO: 1290381 - RNA, 21 nt, Human
cauuccaugugcccaguuaau

SEQ ID NO: 1290382 - RNA, 15 nt, Human
cauuccauucuggaa

SEQ ID NO: 1290383 - RNA, 13 nt, Human
cauuccccauggg

SEQ ID NO: 1290384 - RNA, 11 nt, Human
cauucccaggu

SEQ ID NO: 1290385 - RNA, 17 nt, Human
cauuccccgucucuggu

SEQ ID NO: 1290386 - RNA, 13 nt, Human
cauucccccagug

SEQ ID NO: 1290387 - RNA, 14 nt, Human
cauucccccagugc

SEQ ID NO: 1290388 - RNA, 15 nt, Human
cauucccccagugcg

SEQ ID NO: 1290389 - RNA, 16 nt, Human
cauucccgcaguggga

SEQ ID NO: 1290390 - RNA, 19 nt, Human
cauucccgcagugggagca

SEQ ID NO: 1290391 - RNA, 20 nt, Human
cauucccgcagugggagcaa

SEQ ID NO: 1290392 - RNA, 22 nt, Human
cauucccgcagugggagcaaac

SEQ ID NO: 1290393 - RNA, 15 nt, Human
cauuccauaaauguc

SEQ ID NO: 1290394 - RNA, 20 nt, Human
cauuccgcagcccccacccc

SEQ ID NO: 1290395 - RNA, 13 nt, Human
cauuccgcagccc

SEQ ID NO: 1290396 - RNA, 13 nt, Human
cauuccuccaggu

SEQ ID NO: 1290397 - RNA, 12 nt, Human
cauuccuccagg

SEQ ID NO: 1290398 - RNA, 19 nt, Human
cauuccucccauucaagau

SEQ ID NO: 1290399 - RNA, 18 nt, Human
cauuccucccauucaaga

SEQ ID NO: 1290400 - RNA, 14 nt, Human
cauuccucugcccu

SEQ ID NO: 1290401 - RNA, 17 nt, Human
cauuccucaugaaugua

SEQ ID NO: 1290402 - RNA, 18 nt, Human
cauuccucaugaauguaa

SEQ ID NO: 1290403 - RNA, 19 nt, Human
cauuccucaugaauguaaa

SEQ ID NO: 1290404 - RNA, 21 nt, Human
cauuccucaugaauguaaauu

SEQ ID NO: 1290405 - RNA, 14 nt, Human
cauuccugaacagg

SEQ ID NO: 1290406 - RNA, 13 nt, Human
cauuccugaagaa

SEQ ID NO: 1290407 - RNA, 16 nt, Human
cauuccugaagaacca

SEQ ID NO: 1290408 - RNA, 17 nt, Human
cauuccugaagaaccag

SEQ ID NO: 1290409 - RNA, 20 nt, Human
cauuccugaagaaccagucc

SEQ ID NO: 1290410 - RNA, 21 nt, Human
cauuccugaagaaccaguccc

SEQ ID NO: 1290411 - RNA, 21 nt, Human
cauuccugggaaauauucccu

SEQ ID NO: 1290412 - RNA, 15 nt, Human
cauucugaaugcuuc

SEQ ID NO: 1290413 - RNA, 16 nt, Human
cauucugaaugcuucu

SEQ ID NO: 1290414 - RNA, 18 nt, Human
cauucugaaugcuucuaa

SEQ ID NO: 1290415 - RNA, 12 nt, Human
cauucugacucg

SEQ ID NO: 1290416 - RNA, 16 nt, Human
cauucugacucgguuu

SEQ ID NO: 1290417 - RNA, 19 nt, Human
cauucugacucgguuucuc

SEQ ID NO: 1290418 - RNA, 21 nt, Human
cauucugacucgguuucucca

SEQ ID NO: 1290419 - RNA, 23 nt, Human
cauucugacucgguuucuccaaa

SEQ ID NO: 1290420 - RNA, 23 nt, Human
cauucugauucgaaugacacugu

SEQ ID NO: 1290421 - RNA, 22 nt, Human
cauucugauucgaaugacacug

SEQ ID NO: 1290422 - RNA, 11 nt, Human
cauucugcaag

SEQ ID NO: 1290423 - RNA, 17 nt, Human
cauucugcaaguauacu

SEQ ID NO: 1290424 - RNA, 17 nt, Human
cauucugccucucuagg

SEQ ID NO: 1290425 - RNA, 18 nt, Human
cauucugccucucuagga

SEQ ID NO: 1290426 - RNA, 16 nt, Human
cauucuggaagugacu

SEQ ID NO: 1290427 - RNA, 14 nt, Human
cauucugcuccuuc

SEQ ID NO: 1290428 - RNA, 16 nt, Human
cauucuggaccucugg

SEQ ID NO: 1290429 - RNA, 12 nt, Human
cauucuggaagu

SEQ ID NO: 1290430 - RNA, 16 nt, Human
cauucugcuccuuccc

SEQ ID NO: 1290431 - RNA, 17 nt, Human
cauucuggaccucuggg

SEQ ID NO: 1290432 - RNA, 13 nt, Human
cauucuggaauaa

SEQ ID NO: 1290433 - RNA, 15 nt, Human
cauucugucuugaag

SEQ ID NO: 1290434 - RNA, 17 nt, Human
cauucuucaagauccca

SEQ ID NO: 1290435 - RNA, 13 nt, Human
cauucuucaagau

SEQ ID NO: 1290436 - RNA, 12 nt, Human
cauucuucaaga

SEQ ID NO: 1290437 - RNA, 21 nt, Human
cauucuuauuucaugaaaauu

SEQ ID NO: 1290438 - RNA, 13 nt, Human
cauucuuccuagu

SEQ ID NO: 1290439 - RNA, 18 nt, Human
cauucuuccuaguuuucu

SEQ ID NO: 1290440 - RNA, 21 nt, Human
cauucuuccuaguuuucuccu

SEQ ID NO: 1290441 - RNA, 16 nt, Human
cauucuucucuguugu

SEQ ID NO: 1290442 - RNA, 18 nt, Human
cauucuucucuguugucg

SEQ ID NO: 1290443 - RNA, 21 nt, Human
cauucuucucuguugucguaa

SEQ ID NO: 1290444 - RNA, 19 nt, Human
cauucuucugagcacuguu

SEQ ID NO: 1290445 - RNA, 18 nt, Human
cauucuucugagcacugu

SEQ ID NO: 1290446 - RNA, 12 nt, Human
cauucuuuccca

SEQ ID NO: 1290447 - RNA, 14 nt, Human
cauucuuucccaac

SEQ ID NO: 1290448 - RNA, 16 nt, Human
cauugaaaagagcuga

SEQ ID NO: 1290449 - RNA, 23 nt, Human
cauuuuaccuuugacaaagguaa

SEQ ID NO: 1290450 - RNA, 15 nt, Human
cauuugcuuuuugug

SEQ ID NO: 1290451 - RNA, 19 nt, Human
cauuugcuuuuugugauau

SEQ ID NO: 1290452 - RNA, 16 nt, Human
cauuugcuuuuucacc

SEQ ID NO: 1290453 - RNA, 17 nt, Human
cauuugcuguuuuaaac

SEQ ID NO: 1290454 - RNA, 18 nt, Human
cauuuuacauuaaauuuu

SEQ ID NO: 1290455 - RNA, 15 nt, Human
cauuucuuuuuggga

SEQ ID NO: 1290456 - RNA, 22 nt, Human
cauuucuuuuugggagagacuu

SEQ ID NO: 1290457 - RNA, 22 nt, Human
cauuugcaagggaaaagucucu

SEQ ID NO: 1290458 - RNA, 14 nt, Human
cauuugcagggucc

SEQ ID NO: 1290459 - RNA, 19 nt, Human
cauuugcaggguccucuuc

SEQ ID NO: 1290460 - RNA, 20 nt, Human
cauuugcaggguccucuucu

SEQ ID NO: 1290461 - RNA, 22 nt, Human
cauuugcaggguccucuucugg

SEQ ID NO: 1290462 - RNA, 14 nt, Human
cauuugcauuuguu

SEQ ID NO: 1290463 - RNA, 13 nt, Human
cauuugcauuugu

SEQ ID NO: 1290464 - RNA, 20 nt, Human
cauuugcugaauagcuacua

SEQ ID NO: 1290465 - RNA, 15 nt, Human
cauuugcuguuuuaa

SEQ ID NO: 1290466 - RNA, 16 nt, Human
cauuugcuguuuuaaa

SEQ ID NO: 1290467 - RNA, 14 nt, Human
cauuugcuuuggaa

SEQ ID NO: 1290468 - RNA, 15 nt, Human
cauuugcuuuggaag

SEQ ID NO: 1290469 - RNA, 16 nt, Human
cauuuuuacaauguaa

SEQ ID NO: 1290470 - RNA, 18 nt, Human
cauuuuuaccaucacuga

SEQ ID NO: 1290471 - RNA, 19 nt, Human
cauuuuuacaauguaauua

SEQ ID NO: 1290472 - RNA, 20 nt, Human
cauuuuuacaauguaauuau

SEQ ID NO: 1290473 - RNA, 20 nt, Human
cauuuuuacuauuguuacau

SEQ ID NO: 1290474 - RNA, 23 nt, Human
ccaaaauguaggcuuaguuugug

SEQ ID NO: 1290475 - RNA, 15 nt, Human
ccaaaaugugccuau

SEQ ID NO: 1290476 - RNA, 17 nt, Human
ccaaaauguugaaauau

SEQ ID NO: 1290477 - RNA, 17 nt, Human
ccaaaauguugcugaaa

SEQ ID NO: 1290478 - RNA, 15 nt, Human
ccaaacaccuuccag

SEQ ID NO: 1290479 - RNA, 19 nt, Human
ccaaacaccuuccagcucc

SEQ ID NO: 1290480 - RNA, 20 nt, Human
ccaaacaccuuccagcuccu

SEQ ID NO: 1290481 - RNA, 23 nt, Human
ccaaaauuagccaguaauccugu

SEQ ID NO: 1290482 - RNA, 20 nt, Human
ccaaaauguuggucauuuua

SEQ ID NO: 1290483 - RNA, 21 nt, Human
ccaaaauguuggucauuuuau

SEQ ID NO: 1290484 - RNA, 17 nt, Human
cauuuucugcaucucca

SEQ ID NO: 1290485 - RNA, 16 nt, Human
cauuuucugcaucucc

SEQ ID NO: 1290486 - RNA, 14 nt, Human
cauuuucugcaucu

SEQ ID NO: 1290487 - RNA, 10 nt, Human
cauuuucugg

SEQ ID NO: 1290488 - RNA, 14 nt, Human
cauuuucuaagaaa

SEQ ID NO: 1290489 - RNA, 17 nt, Human
cauuuucuaagaaacau

SEQ ID NO: 1290490 - RNA, 12 nt, Human
cauuuucucccu

SEQ ID NO: 1290491 - RNA, 13 nt, Human
cauuuucucccug

SEQ ID NO: 1290492 - RNA, 17 nt, Human
cauuuucucccuggauu

SEQ ID NO: 1290493 - RNA, 12 nt, Human
cauuuucucuaa

SEQ ID NO: 1290494 - RNA, 14 nt, Human
cauuuucucucagg

SEQ ID NO: 1290495 - RNA, 23 nt, Human
cauuuucuaagaaacauuuauau

SEQ ID NO: 1290496 - RNA, 21 nt, Human
cauugaauucuugguugagga

SEQ ID NO: 1290497 - RNA, 22 nt, Human
cauugaauucuugguugaggaa

SEQ ID NO: 1290498 - RNA, 23 nt, Human
cauugaauucuugguugaggaaa

SEQ ID NO: 1290499 - RNA, 19 nt, Human
cauugagcuugcaugcuug

SEQ ID NO: 1290500 - RNA, 18 nt, Human
cauugaguugguuacuuc

SEQ ID NO: 1290501 - RNA, 16 nt, Human
cauugaguugguuacu

SEQ ID NO: 1290502 - RNA, 15 nt, Human
cauugaaaagagcug

SEQ ID NO: 1290503 - RNA, 22 nt, Human
cauugaacacaaacuguaaaua

SEQ ID NO: 1290504 - RNA, 13 nt, Human
cauugaaggcuua

SEQ ID NO: 1290505 - RNA, 14 nt, Human
cauugaaggcuuaa

SEQ ID NO: 1290506 - RNA, 22 nt, Human
cauugaauggcuauguuuuuaa

SEQ ID NO: 1290507 - RNA, 21 nt, Human
cauugugggauguucagcacu

SEQ ID NO: 1290508 - RNA, 22 nt, Human
cauugugggauguucagcacug

SEQ ID NO: 1290509 - RNA, 14 nt, Human
cauuguguuaccug

SEQ ID NO: 1290510 - RNA, 14 nt, Human
cauuguuaccucua

SEQ ID NO: 1290511 - RNA, 21 nt, Human
cauuguuauauaaucauuauu

SEQ ID NO: 1290512 - RNA, 13 nt, Human
cauuuaaaacaga

SEQ ID NO: 1290513 - RNA, 17 nt, Human
cauuuaaaacagacacu

SEQ ID NO: 1290514 - RNA, 18 nt, Human
cauuuaaaacagacacug

SEQ ID NO: 1290515 - RNA, 23 nt, Human
cauuuaaaacagacacuggcaug

SEQ ID NO: 1290516 - RNA, 18 nt, Human
cauuguuaccucuauaua

SEQ ID NO: 1290517 - RNA, 17 nt, Human
cauuguuauauaaucau

SEQ ID NO: 1290518 - RNA, 19 nt, Human
cauuuaaaacauuaaaaua

SEQ ID NO: 1290519 - RNA, 20 nt, Human
cauuuaaaacauuaaaauau

SEQ ID NO: 1290520 - RNA, 18 nt, Human
cauuuaaauacagucuuc

SEQ ID NO: 1290521 - RNA, 20 nt, Human
cauuuaaauacagucuucca

SEQ ID NO: 1290522 - RNA, 18 nt, Human
cauuuaaauuuuuuuccu

SEQ ID NO: 1290523 - RNA, 19 nt, Human
cauuuaaccccccuguaca

SEQ ID NO: 1290524 - RNA, 20 nt, Human
cauuuaaccccccuguacac

SEQ ID NO: 1290525 - RNA, 23 nt, Human
cauuuaaccccccuguacacaac

SEQ ID NO: 1290526 - RNA, 15 nt, Human
cauuuacaaacugaa

SEQ ID NO: 1290527 - RNA, 16 nt, Human
cauuuacaaacugaag

SEQ ID NO: 1290528 - RNA, 19 nt, Human
cauuuacaaacugaagagu

SEQ ID NO: 1290529 - RNA, 16 nt, Human
cauuuacauguuuuaa

SEQ ID NO: 1290530 - RNA, 21 nt, Human
cauguuaaccccuccacucuu

SEQ ID NO: 1290531 - RNA, 15 nt, Human
cauguuuauuuuucu

SEQ ID NO: 1290532 - RNA, 18 nt, Human
cauguuuauuuuucuugu

SEQ ID NO: 1290533 - RNA, 19 nt, Human
cauguuuauuuuucuuguc

SEQ ID NO: 1290534 - RNA, 20 nt, Human
cauguuuauuuuucuugucu

SEQ ID NO: 1290535 - RNA, 12 nt, Human
cauguuuccagc

SEQ ID NO: 1290536 - RNA, 13 nt, Human
cauguuuccagca

SEQ ID NO: 1290537 - RNA, 15 nt, Human
cauguuuccagcauu

SEQ ID NO: 1290538 - RNA, 16 nt, Human
cauguuuccagcauuc

SEQ ID NO: 1290539 - RNA, 17 nt, Human
cauguuuccagcauucc

SEQ ID NO: 1290540 - RNA, 20 nt, Human
cauguuuccagcauucccag

SEQ ID NO: 1290541 - RNA, 22 nt, Human
cauguuuccagcauucccaggu

SEQ ID NO: 1290542 - RNA, 13 nt, Human
cauguuuccucua

SEQ ID NO: 1290543 - RNA, 21 nt, Human
cauguuuccucuaguucuuug

SEQ ID NO: 1290544 - RNA, 14 nt, Human
cauguguuuauccu

SEQ ID NO: 1290545 - RNA, 18 nt, Human
cauguguuggcagccucu

SEQ ID NO: 1290546 - RNA, 23 nt, Human
cauguguguuaacccagugcuuu

SEQ ID NO: 1290547 - RNA, 15 nt, Human
cauguguuauguuuu

SEQ ID NO: 1290548 - RNA, 18 nt, Human
cauguguuuacuuuaugu

SEQ ID NO: 1290549 - RNA, 14 nt, Human
caugugucccagaa

SEQ ID NO: 1290550 - RNA, 17 nt, Human
caugugucccagaagau

SEQ ID NO: 1290551 - RNA, 15 nt, Human
cauguguccugguuc

SEQ ID NO: 1290552 - RNA, 21 nt, Human
cauguguccugguucccguuu

SEQ ID NO: 1290553 - RNA, 21 nt, Human
caugugucccagaagaugacu

SEQ ID NO: 1290554 - RNA, 22 nt, Human
cauguguguuaacccagugcuu

SEQ ID NO: 1290555 - RNA, 16 nt, Human
cauguguuaaguauuu

SEQ ID NO: 1290556 - RNA, 16 nt, Human
cauguguuauguuuuc

SEQ ID NO: 1290557 - RNA, 20 nt, Human
caugugcuaguaauuggaaa

SEQ ID NO: 1290558 - RNA, 18 nt, Human
caugugcugcccuacagc

SEQ ID NO: 1290559 - RNA, 13 nt, Human
cauguguauaaaa

SEQ ID NO: 1290560 - RNA, 14 nt, Human
cauguguauaaaaa

SEQ ID NO: 1290561 - RNA, 17 nt, Human
cauguguauaaaaauaa

SEQ ID NO: 1290562 - RNA, 13 nt, Human
caugugucccaga

SEQ ID NO: 1290563 - RNA, 14 nt, Human
caugugcccaguua

SEQ ID NO: 1290564 - RNA, 20 nt, Human
caugugagcaugucacuucc

SEQ ID NO: 1290565 - RNA, 14 nt, Human
caugucucgacuca

SEQ ID NO: 1290566 - RNA, 14 nt, Human
caugugacucuuuc

SEQ ID NO: 1290567 - RNA, 14 nt, Human
caugucuucucccu

SEQ ID NO: 1290568 - RNA, 16 nt, Human
caugugacucuuucca

SEQ ID NO: 1290569 - RNA, 17 nt, Human
caugugacucuuuccaa

SEQ ID NO: 1290570 - RNA, 15 nt, Human
caugucuucucccug

SEQ ID NO: 1290571 - RNA, 14 nt, Human
cauggucacacacu

SEQ ID NO: 1290572 - RNA, 15 nt, Human
cauggucacacacug

SEQ ID NO: 1290573 - RNA, 13 nt, Human
cauggucugcccu

SEQ ID NO: 1290574 - RNA, 16 nt, Human
cauggucugcccucug

SEQ ID NO: 1290575 - RNA, 15 nt, Human
cauggucugcccucu

SEQ ID NO: 1290576 - RNA, 13 nt, Human
cauggugcuagga

SEQ ID NO: 1290577 - RNA, 17 nt, Human
cauggugcuaggaagag

SEQ ID NO: 1290578 - RNA, 22 nt, Human
cauggugcuaggaagaggagug

SEQ ID NO: 1290579 - RNA, 22 nt, Human
cauggugcugggagaggcagcc

SEQ ID NO: 1290580 - RNA, 15 nt, Human
cauggugcugggaga

SEQ ID NO: 1290581 - RNA, 21 nt, Human
caugguggguccaugggcaga

SEQ ID NO: 1290582 - RNA, 22 nt, Human
caugguggguccaugggcagag

SEQ ID NO: 1290583 - RNA, 13 nt, Human
caugguuucagca

SEQ ID NO: 1290584 - RNA, 15 nt, Human
caugguuucagcacu

SEQ ID NO: 1290585 - RNA, 16 nt, Human
caugguuucagcacua

SEQ ID NO: 1290586 - RNA, 23 nt, Human
cauguacugcauuauuugagaag

SEQ ID NO: 1290587 - RNA, 22 nt, Human
cauguacugcauuauuugagaa

SEQ ID NO: 1290588 - RNA, 17 nt, Human
cauguacugcauuauuu

SEQ ID NO: 1290589 - RNA, 16 nt, Human
cauguacugcauuauu

SEQ ID NO: 1290590 - RNA, 15 nt, Human
cauguacugcauuau

SEQ ID NO: 1290591 - RNA, 23 nt, Human
cauguacugagccuuguaauucu

SEQ ID NO: 1290592 - RNA, 19 nt, Human
cauguacugagccuuguaa

SEQ ID NO: 1290593 - RNA, 22 nt, Human
cauguacugagccuuguaauuc

SEQ ID NO: 1290594 - RNA, 21 nt, Human
caugucguggacacacacaga

SEQ ID NO: 1290595 - RNA, 16 nt, Human
caugucuauucagcuu

SEQ ID NO: 1290596 - RNA, 17 nt, Human
caugucuauucagcuuc

SEQ ID NO: 1290597 - RNA, 15 nt, Human
cauguaaacugugca

SEQ ID NO: 1290598 - RNA, 16 nt, Human
cauguaaacugugcac

SEQ ID NO: 1290599 - RNA, 14 nt, Human
cauguaaauaauac

SEQ ID NO: 1290600 - RNA, 20 nt, Human
cauguacaugaagaagcuaa

SEQ ID NO: 1290601 - RNA, 20 nt, Human
cauguuucuuuguaaugaaa

SEQ ID NO: 1290602 - RNA, 20 nt, Human
cauguuugcaccuuucuagu

SEQ ID NO: 1290603 - RNA, 22 nt, Human
cauguuugcaccuuucuaguug

SEQ ID NO: 1290604 - RNA, 21 nt, Human
cauguuugcaccuuucuaguu

SEQ ID NO: 1290605 - RNA, 22 nt, Human
cauguuuggaaggggucuguag

SEQ ID NO: 1290606 - RNA, 23 nt, Human
cauuaaaccaucucccuggugcu

SEQ ID NO: 1290607 - RNA, 22 nt, Human
cauuaaaaaugcauauacuuua

SEQ ID NO: 1290608 - RNA, 13 nt, Human
cauuaaaagaaua

SEQ ID NO: 1290609 - RNA, 11 nt, Human
cauuaaaauau

SEQ ID NO: 1290610 - RNA, 14 nt, Human
cauuaaaauauaau

SEQ ID NO: 1290611 - RNA, 14 nt, Human
caugcagaaagcau

SEQ ID NO: 1290612 - RNA, 17 nt, Human
caugcacuuggcugcau

SEQ ID NO: 1290613 - RNA, 19 nt, Human
caugcagaacaaaugaaga

SEQ ID NO: 1290614 - RNA, 20 nt, Human
caugcagaacaaaugaagac

SEQ ID NO: 1290615 - RNA, 22 nt, Human
caugcacugugaaggacccuug

SEQ ID NO: 1290616 - RNA, 19 nt, Human
caugcacuguucccccugu

SEQ ID NO: 1290617 - RNA, 23 nt, Human
caugcacuguucccccugugcag

SEQ ID NO: 1290618 - RNA, 15 nt, Human
caugcacugauguug

SEQ ID NO: 1290619 - RNA, 20 nt, Human
caugcacugauguuguguuu

SEQ ID NO: 1290620 - RNA, 10 nt, Human
caugcacugu

SEQ ID NO: 1290621 - RNA, 13 nt, Human
caugcacugugaa

SEQ ID NO: 1290622 - RNA, 14 nt, Human
caugcacugugaag

SEQ ID NO: 1290623 - RNA, 16 nt, Human
caugcacugugaagga

SEQ ID NO: 1290624 - RNA, 17 nt, Human
caugcacugugaaggac

SEQ ID NO: 1290625 - RNA, 18 nt, Human
caugcacugugaaggacc

SEQ ID NO: 1290626 - RNA, 20 nt, Human
caugcacugugaaggacccu

SEQ ID NO: 1290627 - RNA, 14 nt, Human
caugcagcaucuaa

SEQ ID NO: 1290628 - RNA, 23 nt, Human
caugcgcucagggccaugcugag

SEQ ID NO: 1290629 - RNA, 21 nt, Human
caugcugugugacucaaacca

SEQ ID NO: 1290630 - RNA, 17 nt, Human
caugcugugugacucaa

SEQ ID NO: 1290631 - RNA, 15 nt, Human
caugcuguucaugaa

SEQ ID NO: 1290632 - RNA, 14 nt, Human
caugcugugugacu

SEQ ID NO: 1290633 - RNA, 21 nt, Human
cauggaaauucccuucaucug

SEQ ID NO: 1290634 - RNA, 15 nt, Human
cauggaaauuuaaag

SEQ ID NO: 1290635 - RNA, 16 nt, Human
cauggaaauuuaaagc

SEQ ID NO: 1290636 - RNA, 17 nt, Human
cauggaaauuuaaagca

SEQ ID NO: 1290637 - RNA, 18 nt, Human
cauggaaauuuaaagcag

SEQ ID NO: 1290638 - RNA, 21 nt, Human
cauggaaauuuaaagcagguu

SEQ ID NO: 1290639 - RNA, 20 nt, Human
cauggaauuggagcucgugg

SEQ ID NO: 1290640 - RNA, 19 nt, Human
cauggaaauuuaaagcagg

SEQ ID NO: 1290641 - RNA, 14 nt, Human
cauggacaauggac

SEQ ID NO: 1290642 - RNA, 15 nt, Human
cauggacaauggacc

SEQ ID NO: 1290643 - RNA, 17 nt, Human
cauggacaauggaccgg

SEQ ID NO: 1290644 - RNA, 18 nt, Human
cauggacaauggaccgga

SEQ ID NO: 1290645 - RNA, 20 nt, Human
cauggacaauggaccggaga

SEQ ID NO: 1290646 - RNA, 16 nt, Human
caugcuguucaugaaa

SEQ ID NO: 1290647 - RNA, 18 nt, Human
caugcuguucaugaaaga

SEQ ID NO: 1290648 - RNA, 22 nt, Human
caugcugugugacucaaaccaa

SEQ ID NO: 1290649 - RNA, 14 nt, Human
caugcuguuauuua

SEQ ID NO: 1290650 - RNA, 20 nt, Human
caugcuguucaugaaagauu

SEQ ID NO: 1290651 - RNA, 23 nt, Human
cauggaaacaagaugaaauucca

SEQ ID NO: 1290652 - RNA, 21 nt, Human
cauggacacuacacccagcaa

SEQ ID NO: 1290653 - RNA, 20 nt, Human
cauggacacuacacccagca

SEQ ID NO: 1290654 - RNA, 19 nt, Human
cauggacacuacacccagc

SEQ ID NO: 1290655 - RNA, 18 nt, Human
cauggacacuacacccag

SEQ ID NO: 1290656 - RNA, 17 nt, Human
cauggacacuacaccca

SEQ ID NO: 1290657 - RNA, 16 nt, Human
cauggacacuacaccc

SEQ ID NO: 1290658 - RNA, 23 nt, Human
cauggacaauggaccggagagug

SEQ ID NO: 1290659 - RNA, 16 nt, Human
cauggacucuguccug

SEQ ID NO: 1290660 - RNA, 17 nt, Human
cauggacucuguccuga

SEQ ID NO: 1290661 - RNA, 23 nt, Human
cauggacucuguccugaaggccu

SEQ ID NO: 1290662 - RNA, 22 nt, Human
cauggacuucugccagcauaau

SEQ ID NO: 1290663 - RNA, 19 nt, Human
cauggacucuguccugaag

SEQ ID NO: 1290664 - RNA, 15 nt, Human
cauggagcugggcua

SEQ ID NO: 1290665 - RNA, 16 nt, Human
caugggauuauuagaa

SEQ ID NO: 1290666 - RNA, 14 nt, Human
caugggaggcucac

SEQ ID NO: 1290667 - RNA, 21 nt, Human
caugggaggccuuucccuaag

SEQ ID NO: 1290668 - RNA, 15 nt, Human
caugggcagagccca

SEQ ID NO: 1290669 - RNA, 17 nt, Human
caugggcagagcccaag

SEQ ID NO: 1290670 - RNA, 18 nt, Human
cauggagggagggagugg

SEQ ID NO: 1290671 - RNA, 22 nt, Human
cauggagggagggagugguuug

SEQ ID NO: 1290672 - RNA, 13 nt, Human
cauggagguucua

SEQ ID NO: 1290673 - RNA, 15 nt, Human
cauggagguucuaag

SEQ ID NO: 1290674 - RNA, 16 nt, Human
cauggagguucuaagg

SEQ ID NO: 1290675 - RNA, 19 nt, Human
cauggcagauguaggaggg

SEQ ID NO: 1290676 - RNA, 20 nt, Human
cauggcagauguaggaggga

SEQ ID NO: 1290677 - RNA, 23 nt, Human
cauggcagauguaggagggacug

SEQ ID NO: 1290678 - RNA, 21 nt, Human
cauggcagauguaggagggac

SEQ ID NO: 1290679 - RNA, 13 nt, Human
cauggcagggggc

SEQ ID NO: 1290680 - RNA, 14 nt, Human
cauggcagggggcu

SEQ ID NO: 1290681 - RNA, 17 nt, Human
cauggcagggggcugcu

SEQ ID NO: 1290682 - RNA, 18 nt, Human
cauggcagggggcugcug

SEQ ID NO: 1290683 - RNA, 19 nt, Human
cauggcagggggcugcugc

SEQ ID NO: 1290684 - RNA, 20 nt, Human
cauggcagggggcugcugcu

SEQ ID NO: 1290685 - RNA, 12 nt, Human
cauggcaguggg

SEQ ID NO: 1290686 - RNA, 23 nt, Human
cauggcagugggaaaaauguagg

SEQ ID NO: 1290687 - RNA, 17 nt, Human
caugggaccacaacuau

SEQ ID NO: 1290688 - RNA, 13 nt, Human
caugggagccggg

SEQ ID NO: 1290689 - RNA, 22 nt, Human
caugggagccgggucugccucu

SEQ ID NO: 1290690 - RNA, 21 nt, Human
caugggagcugguuagaaaug

SEQ ID NO: 1290691 - RNA, 19 nt, Human
caugggaggccuuucccua

SEQ ID NO: 1290692 - RNA, 12 nt, Human
cauggggaggag

SEQ ID NO: 1290693 - RNA, 15 nt, Human
cauggggaggaggag

SEQ ID NO: 1290694 - RNA, 19 nt, Human
cauggggaggaggaggguc

SEQ ID NO: 1290695 - RNA, 18 nt, Human
cauggggaggaggagggu

SEQ ID NO: 1290696 - RNA, 16 nt, Human
cauggguagccugggu

SEQ ID NO: 1290697 - RNA, 20 nt, Human
cauggguauaguucaugucu

SEQ ID NO: 1290698 - RNA, 15 nt, Human
cauggguagccuggg

SEQ ID NO: 1290699 - RNA, 16 nt, Human
cauggucacacacuga

SEQ ID NO: 1290700 - RNA, 13 nt, Human
caugauaaaugau

SEQ ID NO: 1290701 - RNA, 16 nt, Human
caugauaauucagcag

SEQ ID NO: 1290702 - RNA, 21 nt, Human
caugaguuggggucuggcagc

SEQ ID NO: 1290703 - RNA, 23 nt, Human
caugaguuggggucuggcagccu

SEQ ID NO: 1290704 - RNA, 18 nt, Human
caugaguuccagaaagua

SEQ ID NO: 1290705 - RNA, 19 nt, Human
caugaguuccagaaaguaa

SEQ ID NO: 1290706 - RNA, 20 nt, Human
caugaguuccagaaaguaaa

SEQ ID NO: 1290707 - RNA, 21 nt, Human
caugaucccuguguugucucu

SEQ ID NO: 1290708 - RNA, 22 nt, Human
caugaucccuguguugucucua

SEQ ID NO: 1290709 - RNA, 18 nt, Human
caugauaaugaacagaac

SEQ ID NO: 1290710 - RNA, 20 nt, Human
caugaugacuuaguacaaag

SEQ ID NO: 1290711 - RNA, 22 nt, Human
caugaugacuuaguacaaaguu

SEQ ID NO: 1290712 - RNA, 23 nt, Human
caugaugacuuaguacaaaguuu

SEQ ID NO: 1290713 - RNA, 14 nt, Human
caugcacugauguu

SEQ ID NO: 1290714 - RNA, 18 nt, Human
caugagucacuacgccug

SEQ ID NO: 1290715 - RNA, 19 nt, Human
caugagguacugagaguga

SEQ ID NO: 1290716 - RNA, 15 nt, Human
caugagggguuccuc

SEQ ID NO: 1290717 - RNA, 18 nt, Human
caugagggguuccucccc

SEQ ID NO: 1290718 - RNA, 21 nt, Human
caugagggguuccuccccucc

SEQ ID NO: 1290719 - RNA, 22 nt, Human
caugagggguuccuccccucca

SEQ ID NO: 1290720 - RNA, 14 nt, Human
caugagugaauaaa

SEQ ID NO: 1290721 - RNA, 23 nt, Human
caugagcuccuuaaggcucuuuu

SEQ ID NO: 1290722 - RNA, 20 nt, Human
caugaggacucuauucuuua

SEQ ID NO: 1290723 - RNA, 21 nt, Human
caugaggacucuauucuuuaa

SEQ ID NO: 1290724 - RNA, 19 nt, Human
caugaggagauucugccuu

SEQ ID NO: 1290725 - RNA, 20 nt, Human
caugaggagauucugccuuu

SEQ ID NO: 1290726 - RNA, 21 nt, Human
caugaggagauucugccuuug

SEQ ID NO: 1290727 - RNA, 23 nt, Human
caugaggagauucugccuuugcc

SEQ ID NO: 1290728 - RNA, 16 nt, Human
caugagguacugagag

SEQ ID NO: 1290729 - RNA, 18 nt, Human
caugaggccacuggagac

SEQ ID NO: 1290730 - RNA, 22 nt, Human
caugagaugauacauccaaagc

SEQ ID NO: 1290731 - RNA, 19 nt, Human
caugagaccacuguuauca

SEQ ID NO: 1290732 - RNA, 17 nt, Human
caugagaccacuguuau

SEQ ID NO: 1290733 - RNA, 12 nt, Human
caugacugcuug

SEQ ID NO: 1290734 - RNA, 13 nt, Human
caugacugcuugc

SEQ ID NO: 1290735 - RNA, 14 nt, Human
caugacugcuugcc

SEQ ID NO: 1290736 - RNA, 16 nt, Human
caugacugcuugcccu

SEQ ID NO: 1290737 - RNA, 21 nt, Human
caugacugcuugcccuaagca

SEQ ID NO: 1290738 - RNA, 18 nt, Human
caugacugcuugcccuaa

SEQ ID NO: 1290739 - RNA, 13 nt, Human
caugagaaauaca

SEQ ID NO: 1290740 - RNA, 18 nt, Human
caugagaaauacaaaaau

SEQ ID NO: 1290741 - RNA, 22 nt, Human
caugagaaauacaaaaauacuc

SEQ ID NO: 1290742 - RNA, 16 nt, Human
caugagaacaaacaga

SEQ ID NO: 1290743 - RNA, 12 nt, Human
caugagaaucua

SEQ ID NO: 1290744 - RNA, 19 nt, Human
caugagaaucuauauuuaa

SEQ ID NO: 1290745 - RNA, 19 nt, Human
caugaagauguagaggaga

SEQ ID NO: 1290746 - RNA, 17 nt, Human
caugaagauauuuuucc

SEQ ID NO: 1290747 - RNA, 18 nt, Human
caugaagauucuuuccca

SEQ ID NO: 1290748 - RNA, 21 nt, Human
caugaagccacgggugccaga

SEQ ID NO: 1290749 - RNA, 18 nt, Human
caugaagauguagaggag

SEQ ID NO: 1290750 - RNA, 20 nt, Human
caugaagaccuuuuucugca

SEQ ID NO: 1290751 - RNA, 19 nt, Human
caugaagaccuuuuucugc

SEQ ID NO: 1290752 - RNA, 17 nt, Human
caugaagaccuuuuucu

SEQ ID NO: 1290753 - RNA, 18 nt, Human
caugaagagauuuuucau

SEQ ID NO: 1290754 - RNA, 20 nt, Human
caugacucguauaugucuca

SEQ ID NO: 1290755 - RNA, 20 nt, Human
caugacgcaaagagagauuu

SEQ ID NO: 1290756 - RNA, 14 nt, Human
caugacuauggaua

SEQ ID NO: 1290757 - RNA, 17 nt, Human
caugacucggggguggg

SEQ ID NO: 1290758 - RNA, 23 nt, Human
caugacucguauaugucucaggu

SEQ ID NO: 1290759 - RNA, 22 nt, Human
caugaagccacgggugccagaa

SEQ ID NO: 1290760 - RNA, 13 nt, Human
caugaccuccagc

SEQ ID NO: 1290761 - RNA, 14 nt, Human
caugaccuccagcu

SEQ ID NO: 1290762 - RNA, 15 nt, Human
caugaccuccagcuu

SEQ ID NO: 1290763 - RNA, 17 nt, Human
caugaccuccagcuuuc

SEQ ID NO: 1290764 - RNA, 20 nt, Human
caugaccuccagcuuuccug

SEQ ID NO: 1290765 - RNA, 21 nt, Human
caugaccuccagcuuuccugu

SEQ ID NO: 1290766 - RNA, 22 nt, Human
caugaccuccagcuuuccugua

SEQ ID NO: 1290767 - RNA, 14 nt, Human
caugaaagauucaa

SEQ ID NO: 1290768 - RNA, 22 nt, Human
caugaaauauagaucaguuaua

SEQ ID NO: 1290769 - RNA, 19 nt, Human
caugaaacagaaacaaaaa

SEQ ID NO: 1290770 - RNA, 15 nt, Human
caugaaaauucagaa

SEQ ID NO: 1290771 - RNA, 13 nt, Human
caugaaacagaaa

SEQ ID NO: 1290772 - RNA, 15 nt, Human
caugaaacagaaaca

SEQ ID NO: 1290773 - RNA, 20 nt, Human
caugaaccucaagcugcauc

SEQ ID NO: 1290774 - RNA, 17 nt, Human
caugaacuuagauuuua

SEQ ID NO: 1290775 - RNA, 20 nt, Human
caugaacuuagauuuuacau

SEQ ID NO: 1290776 - RNA, 22 nt, Human
caugaagaccuuuuucugcacu

SEQ ID NO: 1290777 - RNA, 15 nt, Human
caugaagaccuuuuu

SEQ ID NO: 1290778 - RNA, 19 nt, Human
caugaaccucaagcugcau

SEQ ID NO: 1290779 - RNA, 19 nt, Human
caucuuuuguauuaagaaa

SEQ ID NO: 1290780 - RNA, 13 nt, Human
caucuuuuguauu

SEQ ID NO: 1290781 - RNA, 14 nt, Human
caucuuuuguauua

SEQ ID NO: 1290782 - RNA, 15 nt, Human
caucuuuuguauuaa

SEQ ID NO: 1290783 - RNA, 18 nt, Human
caucuuuuguauuaagaa

SEQ ID NO: 1290784 - RNA, 22 nt, Human
caucuuuuguauuaagaaagga

SEQ ID NO: 1290785 - RNA, 22 nt, Human
caucuuuacaaaacuacaugag

SEQ ID NO: 1290786 - RNA, 13 nt, Human
caucuuucccucc

SEQ ID NO: 1290787 - RNA, 14 nt, Human
caucuuucccuccu

SEQ ID NO: 1290788 - RNA, 15 nt, Human
caucuuucccuccuu

SEQ ID NO: 1290789 - RNA, 16 nt, Human
caucuuucccuccuug

SEQ ID NO: 1290790 - RNA, 17 nt, Human
caucuuucccuccuugg

SEQ ID NO: 1290791 - RNA, 18 nt, Human
caucuuucccuccuuggu

SEQ ID NO: 1290792 - RNA, 21 nt, Human
caucuuucccuccuuggugau

SEQ ID NO: 1290793 - RNA, 11 nt, Human
caucuuugaaa

SEQ ID NO: 1290794 - RNA, 12 nt, Human
caucuuugaaau

SEQ ID NO: 1290795 - RNA, 18 nt, Human
caucuuugaaauuaugua

SEQ ID NO: 1290796 - RNA, 21 nt, Human
caucuuugaaauuauguaaau

SEQ ID NO: 1290797 - RNA, 22 nt, Human
caucuuugaaauuauguaaauu

SEQ ID NO: 1290798 - RNA, 10 nt, Human
caucuuuaag

SEQ ID NO: 1290799 - RNA, 14 nt, Human
caucuucuucacca

SEQ ID NO: 1290800 - RNA, 19 nt, Human
caucuucuucaccauuugg

SEQ ID NO: 1290801 - RNA, 13 nt, Human
caucucuaccuuc

SEQ ID NO: 1290802 - RNA, 18 nt, Human
caucucuaccuucucccc

SEQ ID NO: 1290803 - RNA, 19 nt, Human
caucucuaccuucucccca

SEQ ID NO: 1290804 - RNA, 21 nt, Human
caucucuaccuucuccccagc

SEQ ID NO: 1290805 - RNA, 20 nt, Human
caucucuaccuucuccccag

SEQ ID NO: 1290806 - RNA, 13 nt, Human
caucucucugccc

SEQ ID NO: 1290807 - RNA, 15 nt, Human
caucucucugcccaa

SEQ ID NO: 1290808 - RNA, 16 nt, Human
caucucucugcccaac

SEQ ID NO: 1290809 - RNA, 18 nt, Human
caucucucugcccaaccc

SEQ ID NO: 1290810 - RNA, 12 nt, Human
caucucugggcu

SEQ ID NO: 1290811 - RNA, 14 nt, Human
caucucugggcugg

SEQ ID NO: 1290812 - RNA, 18 nt, Human
caucucugggcuggauga

SEQ ID NO: 1290813 - RNA, 19 nt, Human
caucucugggcuggaugag

SEQ ID NO: 1290814 - RNA, 22 nt, Human
caucucugggcuggaugagcuc

SEQ ID NO: 1290815 - RNA, 19 nt, Human
caucuccugccuuccuccu

SEQ ID NO: 1290816 - RNA, 22 nt, Human
caucuccugccuuccuccuggg

SEQ ID NO: 1290817 - RNA, 20 nt, Human
caucucccuggugcuuaugc

SEQ ID NO: 1290818 - RNA, 18 nt, Human
cauccuacccccugugcc

SEQ ID NO: 1290819 - RNA, 19 nt, Human
cauccuacccccugugccu

SEQ ID NO: 1290820 - RNA, 23 nt, Human
cauccuaccacaaugcagugccu

SEQ ID NO: 1290821 - RNA, 14 nt, Human
caucucccuggugc

SEQ ID NO: 1290822 - RNA, 15 nt, Human
caucucccuggugcu

SEQ ID NO: 1290823 - RNA, 16 nt, Human
caucucccuggugcuu

SEQ ID NO: 1290824 - RNA, 19 nt, Human
caucucccuggugcuuaug

SEQ ID NO: 1290825 - RNA, 23 nt, Human
caucucccuggugcuuaugcucu

SEQ ID NO: 1290826 - RNA, 17 nt, Human
caucucccuuuuccaug

SEQ ID NO: 1290827 - RNA, 16 nt, Human
caucuccugccuuccu

SEQ ID NO: 1290828 - RNA, 15 nt, Human
cauccuacccccugu

SEQ ID NO: 1290829 - RNA, 21 nt, Human
cauccuaccacaaugcagugc

SEQ ID NO: 1290830 - RNA, 19 nt, Human
cauccuacaagacacagug

SEQ ID NO: 1290831 - RNA, 18 nt, Human
cauccuacaagacacagu

SEQ ID NO: 1290832 - RNA, 20 nt, Human
cauccgcaggugcugguccc

SEQ ID NO: 1290833 - RNA, 15 nt, Human
caucaucucagcuca

SEQ ID NO: 1290834 - RNA, 14 nt, Human
caucaucucagcuc

SEQ ID NO: 1290835 - RNA, 13 nt, Human
caucaucuccugc

SEQ ID NO: 1290836 - RNA, 20 nt, Human
caucaucuccugccuuccuc

SEQ ID NO: 1290837 - RNA, 21 nt, Human
caucaucuccugccuuccucc

SEQ ID NO: 1290838 - RNA, 13 nt, Human
caucaucugggaa

SEQ ID NO: 1290839 - RNA, 22 nt, Human
caucaucugggaacuugucaca

SEQ ID NO: 1290840 - RNA, 23 nt, Human
caucaucugggaacuugucacag

SEQ ID NO: 1290841 - RNA, 13 nt, Human
caucauccucugg

SEQ ID NO: 1290842 - RNA, 14 nt, Human
caucauccucuggc

SEQ ID NO: 1290843 - RNA, 15 nt, Human
caucauccucuggcu

SEQ ID NO: 1290844 - RNA, 15 nt, Human
caucaucauggccag

SEQ ID NO: 1290845 - RNA, 18 nt, Human
caucaucauggccagcug

SEQ ID NO: 1290846 - RNA, 24 nt, Human
caucaucauggccagcuggaggca

SEQ ID NO: 1290847 - RNA, 13 nt, Human
caucauggccagc

SEQ ID NO: 1290848 - RNA, 14 nt, Human
caucauggccagcu

SEQ ID NO: 1290849 - RNA, 15 nt, Human
caucauggccagcug

SEQ ID NO: 1290850 - RNA, 21 nt, Human
caucauggccagcuggaggca

SEQ ID NO: 1290851 - RNA, 15 nt, Human
caucauggcuaucug

SEQ ID NO: 1290852 - RNA, 13 nt, Human
caucaugccucug

SEQ ID NO: 1290853 - RNA, 14 nt, Human
caucaugccucuga

SEQ ID NO: 1290854 - RNA, 15 nt, Human
caucaugccucugag

SEQ ID NO: 1290855 - RNA, 16 nt, Human
caucaugccucugagg

SEQ ID NO: 1290856 - RNA, 17 nt, Human
caucaugccucugaggc

SEQ ID NO: 1290857 - RNA, 18 nt, Human
caucaugccucugaggcc

SEQ ID NO: 1290858 - RNA, 19 nt, Human
caucaugccucugaggcca

SEQ ID NO: 1290859 - RNA, 20 nt, Human
caucaugccucugaggccag

SEQ ID NO: 1290860 - RNA, 22 nt, Human
caucaugccucugaggccagcc

SEQ ID NO: 1290861 - RNA, 23 nt, Human
caucaugccucugaggccagccu

SEQ ID NO: 1290862 - RNA, 13 nt, Human
caucaccacaguu

SEQ ID NO: 1290863 - RNA, 14 nt, Human
caucaccuacucac

SEQ ID NO: 1290864 - RNA, 14 nt, Human
caucaacugaauga

SEQ ID NO: 1290865 - RNA, 20 nt, Human
caucaccuacucacacaggc

SEQ ID NO: 1290866 - RNA, 21 nt, Human
caucaccuacucacacaggca

SEQ ID NO: 1290867 - RNA, 16 nt, Human
caucaccucagauggc

SEQ ID NO: 1290868 - RNA, 17 nt, Human
caucaccucagauggca

SEQ ID NO: 1290869 - RNA, 22 nt, Human
caucaccucagauggcagcuuu

SEQ ID NO: 1290870 - RNA, 20 nt, Human
caucaccucagauggcagcu

SEQ ID NO: 1290871 - RNA, 15 nt, Human
caucaccuuagacca

SEQ ID NO: 1290872 - RNA, 17 nt, Human
caucaccuuagaccacc

SEQ ID NO: 1290873 - RNA, 18 nt, Human
caucaccuuagaccacca

SEQ ID NO: 1290874 - RNA, 23 nt, Human
caucaccuuagaccaccaagccu

SEQ ID NO: 1290875 - RNA, 22 nt, Human
caucaccuuagaccaccaagcc

SEQ ID NO: 1290876 - RNA, 19 nt, Human
caucacguuagcuguccca

SEQ ID NO: 1290877 - RNA, 20 nt, Human
caucacucuagguuuuacag

SEQ ID NO: 1290878 - RNA, 16 nt, Human
caucacugaguuuucc

SEQ ID NO: 1290879 - RNA, 23 nt, Human
caucacugaguuuuccauggcag

SEQ ID NO: 1290880 - RNA, 17 nt, Human
caucacugaguuuucca

SEQ ID NO: 1290881 - RNA, 11 nt, Human
caucaggcuuu

SEQ ID NO: 1290882 - RNA, 15 nt, Human
caucaggcuuucuuu

SEQ ID NO: 1290883 - RNA, 15 nt, Human
caucaggcuuucuua

SEQ ID NO: 1290884 - RNA, 19 nt, Human
caucaggguaggcuggagu

SEQ ID NO: 1290885 - RNA, 15 nt, Human
caucagugcucccuc

SEQ ID NO: 1290886 - RNA, 16 nt, Human
caucagugcucccuca

SEQ ID NO: 1290887 - RNA, 24 nt, Human
caucagugcucccucacaugucag

SEQ ID NO: 1290888 - RNA, 18 nt, Human
caucccuuaccugggaaa

SEQ ID NO: 1290889 - RNA, 22 nt, Human
caucccugggccuugggcuccg

SEQ ID NO: 1290890 - RNA, 16 nt, Human
caucccuuugcccaga

SEQ ID NO: 1290891 - RNA, 15 nt, Human
caucccuuuuucaau

SEQ ID NO: 1290892 - RNA, 13 nt, Human
cauccgcaggugc

SEQ ID NO: 1290893 - RNA, 14 nt, Human
cauccgcaggugcu

SEQ ID NO: 1290894 - RNA, 13 nt, Human
caucccuccuggg

SEQ ID NO: 1290895 - RNA, 15 nt, Human
cauccaugccucaga

SEQ ID NO: 1290896 - RNA, 12 nt, Human
caucccuggccc

SEQ ID NO: 1290897 - RNA, 13 nt, Human
caucccuggcccc

SEQ ID NO: 1290898 - RNA, 20 nt, Human
caucccuggcccccucccug

SEQ ID NO: 1290899 - RNA, 21 nt, Human
caucccuggcccccucccugg

SEQ ID NO: 1290900 - RNA, 22 nt, Human
caucccuggcccccucccugga

SEQ ID NO: 1290901 - RNA, 23 nt, Human
caucccuggcccccucccuggau

SEQ ID NO: 1290902 - RNA, 11 nt, Human
caucccugggc

SEQ ID NO: 1290903 - RNA, 12 nt, Human
caucccugggcc

SEQ ID NO: 1290904 - RNA, 13 nt, Human
caucccugggccu

SEQ ID NO: 1290905 - RNA, 14 nt, Human
caucccugggccug

SEQ ID NO: 1290906 - RNA, 15 nt, Human
caucccugggccugc

SEQ ID NO: 1290907 - RNA, 16 nt, Human
caucccugggccugcu

SEQ ID NO: 1290908 - RNA, 17 nt, Human
caucccugggccugcug

SEQ ID NO: 1290909 - RNA, 18 nt, Human
caucccugggccugcugc

SEQ ID NO: 1290910 - RNA, 19 nt, Human
caucccugggccugcugcu

SEQ ID NO: 1290911 - RNA, 20 nt, Human
caucccugggccugcugcug

SEQ ID NO: 1290912 - RNA, 21 nt, Human
caucccugggccugcugcuga

SEQ ID NO: 1290913 - RNA, 22 nt, Human
caucccugggccugcugcugag

SEQ ID NO: 1290914 - RNA, 23 nt, Human
caucccugggccugcugcugaga

SEQ ID NO: 1290915 - RNA, 17 nt, Human
caucccugggccuuggg

SEQ ID NO: 1290916 - RNA, 21 nt, Human
caucccugggccuugggcucc

SEQ ID NO: 1290917 - RNA, 15 nt, Human
caucauucucugucu

SEQ ID NO: 1290918 - RNA, 16 nt, Human
caucauucucugucuc

SEQ ID NO: 1290919 - RNA, 17 nt, Human
caucauucucugucuca

SEQ ID NO: 1290920 - RNA, 19 nt, Human
caucauucacuucacugug

SEQ ID NO: 1290921 - RNA, 12 nt, Human
caucauucucug

SEQ ID NO: 1290922 - RNA, 14 nt, Human
caucauucucuguc

SEQ ID NO: 1290923 - RNA, 20 nt, Human
caucauucacuucacugugc

SEQ ID NO: 1290924 - RNA, 18 nt, Human
caucauucacuucacugu

SEQ ID NO: 1290925 - RNA, 17 nt, Human
caucauucacuucacug

SEQ ID NO: 1290926 - RNA, 16 nt, Human
caucauucacuucacu

SEQ ID NO: 1290927 - RNA, 15 nt, Human
caucauuauuuaugu

SEQ ID NO: 1290928 - RNA, 19 nt, Human
caucauuauuuauguauug

SEQ ID NO: 1290929 - RNA, 14 nt, Human
caucauuauuuaug

SEQ ID NO: 1290930 - RNA, 21 nt, Human
cauccagagucccugccugga

SEQ ID NO: 1290931 - RNA, 14 nt, Human
cauccagucuauuc

SEQ ID NO: 1290932 - RNA, 13 nt, Human
cauccaguucaug

SEQ ID NO: 1290933 - RNA, 12 nt, Human
cauccauccagg

SEQ ID NO: 1290934 - RNA, 13 nt, Human
cauccaucaucau

SEQ ID NO: 1290935 - RNA, 14 nt, Human
cauccaucaucaug

SEQ ID NO: 1290936 - RNA, 14 nt, Human
cauccaugccucag

SEQ ID NO: 1290937 - RNA, 17 nt, Human
cauccaugccucagaag

SEQ ID NO: 1290938 - RNA, 13 nt, Human
cauccagaguccc

SEQ ID NO: 1290939 - RNA, 17 nt, Human
cauccagagucccugcc

SEQ ID NO: 1290940 - RNA, 18 nt, Human
cauccagagucccugccu

SEQ ID NO: 1290941 - RNA, 20 nt, Human
cauccagagucccugccugg

SEQ ID NO: 1290942 - RNA, 19 nt, Human
cauauuguuacugguacca

SEQ ID NO: 1290943 - RNA, 19 nt, Human
cauauuguugcauugcuuu

SEQ ID NO: 1290944 - RNA, 13 nt, Human
cauauuguuacug

SEQ ID NO: 1290945 - RNA, 14 nt, Human
cauauuguguguaa

SEQ ID NO: 1290946 - RNA, 13 nt, Human
cauauuguugaaa

SEQ ID NO: 1290947 - RNA, 16 nt, Human
cauauuguugaaaggu

SEQ ID NO: 1290948 - RNA, 16 nt, Human
cauauuuaccucagcc

SEQ ID NO: 1290949 - RNA, 13 nt, Human
cauauuuguaaaa

SEQ ID NO: 1290950 - RNA, 14 nt, Human
cauauuuguaaaau

SEQ ID NO: 1290951 - RNA, 15 nt, Human
cauauuuguaaaaug

SEQ ID NO: 1290952 - RNA, 16 nt, Human
cauauuuguaaaauga

SEQ ID NO: 1290953 - RNA, 18 nt, Human
cauauuuguaaaaugaca

SEQ ID NO: 1290954 - RNA, 19 nt, Human
cauauuuguaaaaugacaa

SEQ ID NO: 1290955 - RNA, 21 nt, Human
cauaugaacagcuguucaguu

SEQ ID NO: 1290956 - RNA, 13 nt, Human
cauauuguaaaac

SEQ ID NO: 1290957 - RNA, 16 nt, Human
cauauuguaaaacagg

SEQ ID NO: 1290958 - RNA, 17 nt, Human
cauauuguaaaacaggu

SEQ ID NO: 1290959 - RNA, 19 nt, Human
cauauuguaaaacagguag

SEQ ID NO: 1290960 - RNA, 18 nt, Human
cauauugugauucugccu

SEQ ID NO: 1290961 - RNA, 20 nt, Human
cauauugugauucugccuuu

SEQ ID NO: 1290962 - RNA, 23 nt, Human
cauauaagggaaguaguuaucau

SEQ ID NO: 1290963 - RNA, 17 nt, Human
cauauaugaggacuugu

SEQ ID NO: 1290964 - RNA, 15 nt, Human
cauauauaacaaugc

SEQ ID NO: 1290965 - RNA, 20 nt, Human
cauauauaacaaugcuguau

SEQ ID NO: 1290966 - RNA, 18 nt, Human
cauagugaugguuccccu

SEQ ID NO: 1290967 - RNA, 19 nt, Human
cauagugaugguuccccug

SEQ ID NO: 1290968 - RNA, 22 nt, Human
cauagugaugguuccccuguuc

SEQ ID NO: 1290969 - RNA, 17 nt, Human
cauauaaauagaaugua

SEQ ID NO: 1290970 - RNA, 22 nt, Human
cauauaaauagaauguaaaugu

SEQ ID NO: 1290971 - RNA, 21 nt, Human
cauauaaauagaauguaaaug

SEQ ID NO: 1290972 - RNA, 20 nt, Human
cauauaaauagaauguaaau

SEQ ID NO: 1290973 - RNA, 13 nt, Human
cauauauaacaau

SEQ ID NO: 1290974 - RNA, 19 nt, Human
cauauaagggaaguaguua

SEQ ID NO: 1290975 - RNA, 16 nt, Human
cauauaagugauugcu

SEQ ID NO: 1290976 - RNA, 22 nt, Human
cauaguaccaaucauuuuaauu

SEQ ID NO: 1290977 - RNA, 21 nt, Human
cauaguaacuucuuauggaau

SEQ ID NO: 1290978 - RNA, 22 nt, Human
cauaguaacuucuuauggaauu

SEQ ID NO: 1290979 - RNA, 23 nt, Human
cauaguaacuucuuauggaauug

SEQ ID NO: 1290980 - RNA, 24 nt, Human
cauaguaacuucuuauggaauuga

SEQ ID NO: 1290981 - RNA, 16 nt, Human
cauaguaccaaucauu

SEQ ID NO: 1290982 - RNA, 18 nt, Human
cauaguaccaaucauuuu

SEQ ID NO: 1290983 - RNA, 16 nt, Human
cauaguagaacgcuau

SEQ ID NO: 1290984 - RNA, 18 nt, Human
cauaguauucaugacuau

SEQ ID NO: 1290985 - RNA, 23 nt, Human
cauagucauguaagcugaaaaua

SEQ ID NO: 1290986 - RNA, 14 nt, Human
cagugcucuuuucu

SEQ ID NO: 1290987 - RNA, 23 nt, Human
cagugcucuuuucuccucacugu

SEQ ID NO: 1290988 - RNA, 23 nt, Human
cagugcugaccagacagccuccc

SEQ ID NO: 1290989 - RNA, 19 nt, Human
cagugcugauguagcaugc

SEQ ID NO: 1290990 - RNA, 12 nt, Human
cagugcugugcu

SEQ ID NO: 1290991 - RNA, 16 nt, Human
cagugcugugcugugc

SEQ ID NO: 1290992 - RNA, 19 nt, Human
cagugcugugcugugcuau

SEQ ID NO: 1290993 - RNA, 22 nt, Human
cagugcugugcugugcuauggu

SEQ ID NO: 1290994 - RNA, 15 nt, Human
cagugcuucccgagu

SEQ ID NO: 1290995 - RNA, 10 nt, Human
caucaacuga

SEQ ID NO: 1290996 - RNA, 12 nt, Human
caucaacugaau

SEQ ID NO: 1290997 - RNA, 23 nt, Human
cauauuuguuuaugguaaaaaau

SEQ ID NO: 1290998 - RNA, 13 nt, Human
cauauuuuaaaau

SEQ ID NO: 1290999 - RNA, 19 nt, Human
cauauuuuaaaauuuguuc

SEQ ID NO: 1291000 - RNA, 16 nt, Human
cauauuuuaaacagag

SEQ ID NO: 1291001 - RNA, 17 nt, Human
cauauuuuaaacagagg

SEQ ID NO: 1291002 - RNA, 13 nt, Human
caucaacaaaaau

SEQ ID NO: 1291003 - RNA, 15 nt, Human
caucaacaaaaauug

SEQ ID NO: 1291004 - RNA, 18 nt, Human
cauauuuuaaacagagga

SEQ ID NO: 1291005 - RNA, 18 nt, Human
caggucccuaauaaagcu

SEQ ID NO: 1291006 - RNA, 17 nt, Human
caggucccuaauaaagc

SEQ ID NO: 1291007 - RNA, 16 nt, Human
caggucccuaauaaag

SEQ ID NO: 1291008 - RNA, 15 nt, Human
caggucccuaauaaa

SEQ ID NO: 1291009 - RNA, 14 nt, Human
caggucccuaauaa

SEQ ID NO: 1291010 - RNA, 13 nt, Human
caggucccuaaua

SEQ ID NO: 1291011 - RNA, 12 nt, Human
caggucccuaau

SEQ ID NO: 1291012 - RNA, 11 nt, Human
caggucccuaa

SEQ ID NO: 1291013 - RNA, 23 nt, Human
cagguccagcucuggaggggagg

SEQ ID NO: 1291014 - RNA, 13 nt, Human
cagguccaggcug

SEQ ID NO: 1291015 - RNA, 17 nt, Human
cagguccaaugagcuuu

SEQ ID NO: 1291016 - RNA, 18 nt, Human
cagguccaaugagcuuuc

SEQ ID NO: 1291017 - RNA, 19 nt, Human
cagguccaaugagcuuucu

SEQ ID NO: 1291018 - RNA, 21 nt, Human
cagguccaaugagcuuucuga

SEQ ID NO: 1291019 - RNA, 22 nt, Human
cagguccaaugagcuuucugaa

SEQ ID NO: 1291020 - RNA, 13 nt, Human
cagguccagcucu

SEQ ID NO: 1291021 - RNA, 14 nt, Human
cagguccagcucug

SEQ ID NO: 1291022 - RNA, 16 nt, Human
cagguccagcucugga

SEQ ID NO: 1291023 - RNA, 17 nt, Human
cagguccagcucuggag

SEQ ID NO: 1291024 - RNA, 19 nt, Human
cagguccagcucuggaggg

SEQ ID NO: 1291025 - RNA, 16 nt, Human
caggucagccacuguu

SEQ ID NO: 1291026 - RNA, 15 nt, Human
caggucagccacugu

SEQ ID NO: 1291027 - RNA, 14 nt, Human
cagguccaaugagc

SEQ ID NO: 1291028 - RNA, 17 nt, Human
cagguaaucgaccugcc

SEQ ID NO: 1291029 - RNA, 18 nt, Human
cagguaaucgaccugccu

SEQ ID NO: 1291030 - RNA, 19 nt, Human
cagguaaucgaccugccuc

SEQ ID NO: 1291031 - RNA, 20 nt, Human
cagguaaucgaccugccucg

SEQ ID NO: 1291032 - RNA, 20 nt, Human
cagguaaaacagggccacau

SEQ ID NO: 1291033 - RNA, 15 nt, Human
cagguaauacaaacu

SEQ ID NO: 1291034 - RNA, 21 nt, Human
cagguacuuguaaauuauuaa

SEQ ID NO: 1291035 - RNA, 20 nt, Human
cagguagaauuaucuaauuu

SEQ ID NO: 1291036 - RNA, 22 nt, Human
cagguagaauuaucuaauuuau

SEQ ID NO: 1291037 - RNA, 23 nt, Human
cagguagaauuaucuaauuuaua

SEQ ID NO: 1291038 - RNA, 18 nt, Human
cagguagcugaaagggga

SEQ ID NO: 1291039 - RNA, 14 nt, Human
cagguaggaggcaa

SEQ ID NO: 1291040 - RNA, 23 nt, Human
cagguaggaggcaaauaucuuga

SEQ ID NO: 1291041 - RNA, 14 nt, Human
cagguaggccaagg

SEQ ID NO: 1291042 - RNA, 22 nt, Human
cagguaggccaagguguccuac

SEQ ID NO: 1291043 - RNA, 18 nt, Human
cagguaggggccccucuc

SEQ ID NO: 1291044 - RNA, 19 nt, Human
cagguaggggccccucuca

SEQ ID NO: 1291045 - RNA, 22 nt, Human
cagguaggggccccucucagcc

SEQ ID NO: 1291046 - RNA, 23 nt, Human
cagguaggggccccucucagccc

SEQ ID NO: 1291047 - RNA, 14 nt, Human
cagguauaccucac

SEQ ID NO: 1291048 - RNA, 15 nt, Human
cagguauaccucacu

SEQ ID NO: 1291049 - RNA, 17 nt, Human
cagguauagacuccuga

SEQ ID NO: 1291050 - RNA, 16 nt, Human
cagguauaccucacuu

SEQ ID NO: 1291051 - RNA, 15 nt, Human
cagguauauacuuug

SEQ ID NO: 1291052 - RNA, 18 nt, Human
cagguauauacuuugaaa

SEQ ID NO: 1291053 - RNA, 22 nt, Human
cagguauauacuuugaaaggag

SEQ ID NO: 1291054 - RNA, 15 nt, Human
cagguauccaaaaau

SEQ ID NO: 1291055 - RNA, 22 nt, Human
caggucccuaauaaagcugugu

SEQ ID NO: 1291056 - RNA, 21 nt, Human
caggucccuaauaaagcugug

SEQ ID NO: 1291057 - RNA, 20 nt, Human
caggucccuaauaaagcugu

SEQ ID NO: 1291058 - RNA, 19 nt, Human
caggucccuaauaaagcug

SEQ ID NO: 1291059 - RNA, 21 nt, Human
caggucccaaauggcccuggg

SEQ ID NO: 1291060 - RNA, 16 nt, Human
cagguccaggcugugu

SEQ ID NO: 1291061 - RNA, 16 nt, Human
caggucccuccccuuc

SEQ ID NO: 1291062 - RNA, 14 nt, Human
caggucccucucau

SEQ ID NO: 1291063 - RNA, 16 nt, Human
caggucccucucauuu

SEQ ID NO: 1291064 - RNA, 15 nt, Human
cagguccucagagaa

SEQ ID NO: 1291065 - RNA, 20 nt, Human
cagguccucagagaauuucu

SEQ ID NO: 1291066 - RNA, 20 nt, Human
cagguccucaguguccucag

SEQ ID NO: 1291067 - RNA, 13 nt, Human
cagguccuggugg

SEQ ID NO: 1291068 - RNA, 14 nt, Human
cagguccugguggg

SEQ ID NO: 1291069 - RNA, 18 nt, Human
cagguccugguggggcag

SEQ ID NO: 1291070 - RNA, 19 nt, Human
cagguccugguggggcagc

SEQ ID NO: 1291071 - RNA, 20 nt, Human
cagguccugguggggcagcu

SEQ ID NO: 1291072 - RNA, 21 nt, Human
cagguccugguggggcagcuc

SEQ ID NO: 1291073 - RNA, 23 nt, Human
cagguccugguggggcagcuccu

SEQ ID NO: 1291074 - RNA, 12 nt, Human
caggucuagacu

SEQ ID NO: 1291075 - RNA, 21 nt, Human
caggucugaagcucaacucuc

SEQ ID NO: 1291076 - RNA, 19 nt, Human
caggugacugucuggggag

SEQ ID NO: 1291077 - RNA, 18 nt, Human
caggugaggucagcacau

SEQ ID NO: 1291078 - RNA, 20 nt, Human
caggucuucaucgaaucuac

SEQ ID NO: 1291079 - RNA, 17 nt, Human
caggugaaaggaaauua

SEQ ID NO: 1291080 - RNA, 15 nt, Human
cagguggccacucca

SEQ ID NO: 1291081 - RNA, 17 nt, Human
cagguggccaaguuccu

SEQ ID NO: 1291082 - RNA, 22 nt, Human
cagguggaucuauuucauguuu

SEQ ID NO: 1291083 - RNA, 13 nt, Human
caggugcuggggc

SEQ ID NO: 1291084 - RNA, 17 nt, Human
caggugcuggggccugg

SEQ ID NO: 1291085 - RNA, 18 nt, Human
caggugcuggggccuggu

SEQ ID NO: 1291086 - RNA, 14 nt, Human
caggugcugguccc

SEQ ID NO: 1291087 - RNA, 15 nt, Human
caggugcuggucccg

SEQ ID NO: 1291088 - RNA, 16 nt, Human
cagguggccacuccag

SEQ ID NO: 1291089 - RNA, 19 nt, Human
cagguggccacuccagacc

SEQ ID NO: 1291090 - RNA, 21 nt, Human
cagguggccacuccagacccc

SEQ ID NO: 1291091 - RNA, 18 nt, Human
cagguggccaaguuccuc

SEQ ID NO: 1291092 - RNA, 19 nt, Human
cagguggccaaguuccucu

SEQ ID NO: 1291093 - RNA, 20 nt, Human
cagguggccaaguuccucua

SEQ ID NO: 1291094 - RNA, 22 nt, Human
cagguggcucugaggugccugu

SEQ ID NO: 1291095 - RNA, 15 nt, Human
cagguggcccuacug

SEQ ID NO: 1291096 - RNA, 16 nt, Human
caggguaggcuggagu

SEQ ID NO: 1291097 - RNA, 13 nt, Human
caggguaugaaga

SEQ ID NO: 1291098 - RNA, 17 nt, Human
caggguaugaagagugu

SEQ ID NO: 1291099 - RNA, 18 nt, Human
caggguauggacuaucug

SEQ ID NO: 1291100 - RNA, 23 nt, Human
caggguauggacuaucugucugg

SEQ ID NO: 1291101 - RNA, 21 nt, Human
cagggucaaaguguuuucucu

SEQ ID NO: 1291102 - RNA, 23 nt, Human
cagggucaaaguguuuucucuga

SEQ ID NO: 1291103 - RNA, 21 nt, Human
caggguaacuaacuaaaacaa

SEQ ID NO: 1291104 - RNA, 22 nt, Human
caggguaacuaacuaaaacaaa

SEQ ID NO: 1291105 - RNA, 19 nt, Human
caggguaacuaacuaaaac

SEQ ID NO: 1291106 - RNA, 12 nt, Human
caggguaacuaa

SEQ ID NO: 1291107 - RNA, 15 nt, Human
cagggguuagagcag

SEQ ID NO: 1291108 - RNA, 13 nt, Human
cagggguuucucg

SEQ ID NO: 1291109 - RNA, 21 nt, Human
caggguccaacauagagccgg

SEQ ID NO: 1291110 - RNA, 13 nt, Human
cagggucccacag

SEQ ID NO: 1291111 - RNA, 17 nt, Human
cagggucccacagccac

SEQ ID NO: 1291112 - RNA, 18 nt, Human
cagggucccacagccacg

SEQ ID NO: 1291113 - RNA, 19 nt, Human
cagggucccacagccacgu

SEQ ID NO: 1291114 - RNA, 13 nt, Human
cagggucccucug

SEQ ID NO: 1291115 - RNA, 15 nt, Human
cagggucccucugug

SEQ ID NO: 1291116 - RNA, 16 nt, Human
cagggucccucugugu

SEQ ID NO: 1291117 - RNA, 20 nt, Human
caggguccucuucugggccu

SEQ ID NO: 1291118 - RNA, 13 nt, Human
caggguccuggga

SEQ ID NO: 1291119 - RNA, 14 nt, Human
caggguccuuuuga

SEQ ID NO: 1291120 - RNA, 19 nt, Human
caggguccuuuugacacug

SEQ ID NO: 1291121 - RNA, 21 nt, Human
caggguccuuuugacacugcu

SEQ ID NO: 1291122 - RNA, 22 nt, Human
caggguccuuuugacacugcuc

SEQ ID NO: 1291123 - RNA, 23 nt, Human
caggguccuuuugacacugcucu

SEQ ID NO: 1291124 - RNA, 17 nt, Human
caggguuuuaacuuugu

SEQ ID NO: 1291125 - RNA, 14 nt, Human
caggguccugggag

SEQ ID NO: 1291126 - RNA, 14 nt, Human
cagguaaaacaggg

SEQ ID NO: 1291127 - RNA, 15 nt, Human
cagguaaaacagggc

SEQ ID NO: 1291128 - RNA, 23 nt, Human
cagguaaaacagggccacauaga

SEQ ID NO: 1291129 - RNA, 16 nt, Human
cagggggugugucugc

SEQ ID NO: 1291130 - RNA, 20 nt, Human
cagggggucuggcugguguu

SEQ ID NO: 1291131 - RNA, 23 nt, Human
caggggucugagcuccagcuccu

SEQ ID NO: 1291132 - RNA, 19 nt, Human
caggggucugagcuccagc

SEQ ID NO: 1291133 - RNA, 21 nt, Human
caggggucugagcuccagcuc

SEQ ID NO: 1291134 - RNA, 19 nt, Human
cagguggggagacugggcu

SEQ ID NO: 1291135 - RNA, 20 nt, Human
cagguggggagacugggcug

SEQ ID NO: 1291136 - RNA, 22 nt, Human
cagguggggagacugggcugag

SEQ ID NO: 1291137 - RNA, 23 nt, Human
cagguggggagacugggcugagg

SEQ ID NO: 1291138 - RNA, 20 nt, Human
caguaauuguguuuacauuu

SEQ ID NO: 1291139 - RNA, 18 nt, Human
caguaauuguguuuacau

SEQ ID NO: 1291140 - RNA, 17 nt, Human
caguaauuguguuuaca

SEQ ID NO: 1291141 - RNA, 17 nt, Human
caguaauuugaggacaa

SEQ ID NO: 1291142 - RNA, 14 nt, Human
caguaauuuagaaa

SEQ ID NO: 1291143 - RNA, 23 nt, Human
caguacacugucagcagggacug

SEQ ID NO: 1291144 - RNA, 23 nt, Human
caguaauccuguaggaagguacu

SEQ ID NO: 1291145 - RNA, 21 nt, Human
caguaauugguccgaucuuug

SEQ ID NO: 1291146 - RNA, 21 nt, Human
caguaauccuguaggaaggua

SEQ ID NO: 1291147 - RNA, 17 nt, Human
caguaauccuguaggaa

SEQ ID NO: 1291148 - RNA, 16 nt, Human
caguaauccuguagga

SEQ ID NO: 1291149 - RNA, 13 nt, Human
caguaauccugua

SEQ ID NO: 1291150 - RNA, 12 nt, Human
caguaauccugu

SEQ ID NO: 1291151 - RNA, 12 nt, Human
caguaccacaug

SEQ ID NO: 1291152 - RNA, 23 nt, Human
caguaccauuuaauggggaggac

SEQ ID NO: 1291153 - RNA, 17 nt, Human
caguaccccauggagcu

SEQ ID NO: 1291154 - RNA, 23 nt, Human
caguaccccauggagcugggcua

SEQ ID NO: 1291155 - RNA, 14 nt, Human
caguacccucucag

SEQ ID NO: 1291156 - RNA, 15 nt, Human
caguacccucucagc

SEQ ID NO: 1291157 - RNA, 16 nt, Human
caguacccucucagcu

SEQ ID NO: 1291158 - RNA, 19 nt, Human
caguacccucucagcucca

SEQ ID NO: 1291159 - RNA, 20 nt, Human
caguacccucucagcuccag

SEQ ID NO: 1291160 - RNA, 22 nt, Human
caguacccucucagcuccaggu

SEQ ID NO: 1291161 - RNA, 24 nt, Human
caguacccucucagcuccaggugg

SEQ ID NO: 1291162 - RNA, 20 nt, Human
caguaccuagcuggcucugu

SEQ ID NO: 1291163 - RNA, 14 nt, Human
caguaccugagggu

SEQ ID NO: 1291164 - RNA, 15 nt, Human
caguaccugaggguc

SEQ ID NO: 1291165 - RNA, 21 nt, Human
caguaccugagggucuguagg

SEQ ID NO: 1291166 - RNA, 23 nt, Human
caguaccugagggucuguagguu

SEQ ID NO: 1291167 - RNA, 22 nt, Human
caguaccugagggucuguaggu

SEQ ID NO: 1291168 - RNA, 23 nt, Human
caguaccuucaaacuagggccaa

SEQ ID NO: 1291169 - RNA, 15 nt, Human
cagguuauaacagug

SEQ ID NO: 1291170 - RNA, 16 nt, Human
cagguuauaacagugu

SEQ ID NO: 1291171 - RNA, 17 nt, Human
cagguuauaacaguguu

SEQ ID NO: 1291172 - RNA, 15 nt, Human
cagguuccacagagg

SEQ ID NO: 1291173 - RNA, 19 nt, Human
cagguuccacagaggacac

SEQ ID NO: 1291174 - RNA, 14 nt, Human
cagguucccaagcu

SEQ ID NO: 1291175 - RNA, 15 nt, Human
cagguucccaagcuc

SEQ ID NO: 1291176 - RNA, 17 nt, Human
cagguucccaagcucag

SEQ ID NO: 1291177 - RNA, 14 nt, Human
cagguucccacuua

SEQ ID NO: 1291178 - RNA, 15 nt, Human
cagguucccucccag

SEQ ID NO: 1291179 - RNA, 16 nt, Human
cagguucccucccaga

SEQ ID NO: 1291180 - RNA, 18 nt, Human
cagguucccucccagagg

SEQ ID NO: 1291181 - RNA, 23 nt, Human
cagguucccucccagaggagcca

SEQ ID NO: 1291182 - RNA, 20 nt, Human
cagguucuccguuagcuccu

SEQ ID NO: 1291183 - RNA, 15 nt, Human
caguaacaggcucaa

SEQ ID NO: 1291184 - RNA, 18 nt, Human
caguaacgcgucuuccug

SEQ ID NO: 1291185 - RNA, 19 nt, Human
caguaacgcgucuuccuga

SEQ ID NO: 1291186 - RNA, 20 nt, Human
caguaacgcgucuuccugag

SEQ ID NO: 1291187 - RNA, 21 nt, Human
caguaacgcgucuuccugagu

SEQ ID NO: 1291188 - RNA, 14 nt, Human
caguaacucaucug

SEQ ID NO: 1291189 - RNA, 16 nt, Human
caguaacucaucuguc

SEQ ID NO: 1291190 - RNA, 18 nt, Human
caguaacuguuuuuuaag

SEQ ID NO: 1291191 - RNA, 9 nt, Human
caguaacug

SEQ ID NO: 1291192 - RNA, 10 nt, Human
caguaacugu

SEQ ID NO: 1291193 - RNA, 18 nt, Human
caggugugagccaccacg

SEQ ID NO: 1291194 - RNA, 21 nt, Human
caggugugagccaccacgccc

SEQ ID NO: 1291195 - RNA, 17 nt, Human
cagguguuaacauucca

SEQ ID NO: 1291196 - RNA, 18 nt, Human
cagguguuaacauuccaa

SEQ ID NO: 1291197 - RNA, 19 nt, Human
cagguguuaacauuccaag

SEQ ID NO: 1291198 - RNA, 20 nt, Human
cagguguuaacauuccaaga

SEQ ID NO: 1291199 - RNA, 22 nt, Human
cagguguuacuguaauuccuca

SEQ ID NO: 1291200 - RNA, 13 nt, Human
cagguguugccaa

SEQ ID NO: 1291201 - RNA, 14 nt, Human
cagguguugccaaa

SEQ ID NO: 1291202 - RNA, 14 nt, Human
cagguuaagaaaau

SEQ ID NO: 1291203 - RNA, 15 nt, Human
cagucaggaaagaga

SEQ ID NO: 1291204 - RNA, 18 nt, Human
cagucaggaaagagaacu

SEQ ID NO: 1291205 - RNA, 22 nt, Human
cagucaggaaagagaacuucca

SEQ ID NO: 1291206 - RNA, 21 nt, Human
cagucaggaaaggaaucauuu

SEQ ID NO: 1291207 - RNA, 14 nt, Human
cagucaggcccagg

SEQ ID NO: 1291208 - RNA, 15 nt, Human
cagucauaacuaaau

SEQ ID NO: 1291209 - RNA, 21 nt, Human
caguauggguuagggaaaaca

SEQ ID NO: 1291210 - RNA, 16 nt, Human
caguauggguuaggga

SEQ ID NO: 1291211 - RNA, 19 nt, Human
caguauggggguuguaaau

SEQ ID NO: 1291212 - RNA, 20 nt, Human
caguauggggguuguaaauu

SEQ ID NO: 1291213 - RNA, 21 nt, Human
caguauggggguuguaaauug

SEQ ID NO: 1291214 - RNA, 23 nt, Human
caguauggggguuguaaauuggc

SEQ ID NO: 1291215 - RNA, 23 nt, Human
caguauggguuagggaaaacauu

SEQ ID NO: 1291216 - RNA, 19 nt, Human
caguauguucaaagucaaa

SEQ ID NO: 1291217 - RNA, 12 nt, Human
cagucacugcuc

SEQ ID NO: 1291218 - RNA, 17 nt, Human
cagucauucagauauga

SEQ ID NO: 1291219 - RNA, 20 nt, Human
cagucauucagauaugauuc

SEQ ID NO: 1291220 - RNA, 13 nt, Human
cagucauuggcug

SEQ ID NO: 1291221 - RNA, 17 nt, Human
cagucauuggcugucuc

SEQ ID NO: 1291222 - RNA, 21 nt, Human
cagucauuggcugucuccuag

SEQ ID NO: 1291223 - RNA, 13 nt, Human
caguccacaaaau

SEQ ID NO: 1291224 - RNA, 20 nt, Human
caguccaccugaggaacugu

SEQ ID NO: 1291225 - RNA, 23 nt, Human
caguccaccugaggaacugucuc

SEQ ID NO: 1291226 - RNA, 18 nt, Human
caguccacuucugacagc

SEQ ID NO: 1291227 - RNA, 20 nt, Human
caguccacuucugacagccu

SEQ ID NO: 1291228 - RNA, 21 nt, Human
caguccacuucugacagccuc

SEQ ID NO: 1291229 - RNA, 23 nt, Human
caguccaggaugcuaacaucuaa

SEQ ID NO: 1291230 - RNA, 15 nt, Human
caguccaggcugccg

SEQ ID NO: 1291231 - RNA, 18 nt, Human
caguccaggcugccgugg

SEQ ID NO: 1291232 - RNA, 13 nt, Human
caguccaugaaga

SEQ ID NO: 1291233 - RNA, 18 nt, Human
caguccaguccuaucugg

SEQ ID NO: 1291234 - RNA, 20 nt, Human
caguccaguccuaucugggc

SEQ ID NO: 1291235 - RNA, 21 nt, Human
caguccaguccuaucugggcu

SEQ ID NO: 1291236 - RNA, 22 nt, Human
caguccaguccuaucugggcuu

SEQ ID NO: 1291237 - RNA, 23 nt, Human
caguccaguccuaucugggcuuc

SEQ ID NO: 1291238 - RNA, 19 nt, Human
cagucccaagcggugucuc

SEQ ID NO: 1291239 - RNA, 21 nt, Human
cagucccaagcggugucucuc

SEQ ID NO: 1291240 - RNA, 15 nt, Human
cagucccagagcagg

SEQ ID NO: 1291241 - RNA, 14 nt, Human
cagucccagagcag

SEQ ID NO: 1291242 - RNA, 20 nt, Human
cagucccagcggugggaccu

SEQ ID NO: 1291243 - RNA, 22 nt, Human
caguaggggcuuauaauaaagg

SEQ ID NO: 1291244 - RNA, 22 nt, Human
caguaggugcccagaauaaguu

SEQ ID NO: 1291245 - RNA, 19 nt, Human
caguaggggcuuauaauaa

SEQ ID NO: 1291246 - RNA, 22 nt, Human
caguaggagcccagcucugaaa

SEQ ID NO: 1291247 - RNA, 20 nt, Human
caguagguuauuuagcuugg

SEQ ID NO: 1291248 - RNA, 22 nt, Human
caguagguuauuuagcuuggga

SEQ ID NO: 1291249 - RNA, 12 nt, Human
caguagugauag

SEQ ID NO: 1291250 - RNA, 23 nt, Human
caguagucuugaugaccaaaguc

SEQ ID NO: 1291251 - RNA, 14 nt, Human
caguaguucacaua

SEQ ID NO: 1291252 - RNA, 22 nt, Human
caguaguucacauacaaaucau

SEQ ID NO: 1291253 - RNA, 18 nt, Human
caguaguucucaaagugu

SEQ ID NO: 1291254 - RNA, 16 nt, Human
caguacuuugugcauu

SEQ ID NO: 1291255 - RNA, 18 nt, Human
caguacuuugugcauucu

SEQ ID NO: 1291256 - RNA, 20 nt, Human
caguagaccuuguuacuucu

SEQ ID NO: 1291257 - RNA, 23 nt, Human
caguagaggcuauggacagggca

SEQ ID NO: 1291258 - RNA, 15 nt, Human
caguagauugcagaa

SEQ ID NO: 1291259 - RNA, 16 nt, Human
caguagauugcagaaa

SEQ ID NO: 1291260 - RNA, 18 nt, Human
caguagauugcagaaaau

SEQ ID NO: 1291261 - RNA, 16 nt, Human
caguagauuuuccaaa

SEQ ID NO: 1291262 - RNA, 18 nt, Human
caguagauuuuccaaaug

SEQ ID NO: 1291263 - RNA, 18 nt, Human
caguagcacaaguuauuu

SEQ ID NO: 1291264 - RNA, 21 nt, Human
caguagcacaaguuauuuaaa

SEQ ID NO: 1291265 - RNA, 23 nt, Human
caguagcacaaguuauuuaaauc

SEQ ID NO: 1291266 - RNA, 12 nt, Human
caguaggagccc

SEQ ID NO: 1291267 - RNA, 14 nt, Human
caguaggagcccag

SEQ ID NO: 1291268 - RNA, 15 nt, Human
caguaggagcccagc

SEQ ID NO: 1291269 - RNA, 21 nt, Human
caguaggagcccagcucugaa

SEQ ID NO: 1291270 - RNA, 22 nt, Human
caguaucucuucagucucuaua

SEQ ID NO: 1291271 - RNA, 19 nt, Human
caguaucucuucagucucu

SEQ ID NO: 1291272 - RNA, 16 nt, Human
caguaucucaaacaau

SEQ ID NO: 1291273 - RNA, 13 nt, Human
caguaugaaaaua

SEQ ID NO: 1291274 - RNA, 12 nt, Human
caguauggcagc

SEQ ID NO: 1291275 - RNA, 14 nt, Human
caguaugaaaauaa

SEQ ID NO: 1291276 - RNA, 19 nt, Human
caguaugaauuauucaauu

SEQ ID NO: 1291277 - RNA, 18 nt, Human
caguauggggguuguaaa

SEQ ID NO: 1291278 - RNA, 17 nt, Human
caguaucucuucagucu

SEQ ID NO: 1291279 - RNA, 16 nt, Human
caguaucucuucaguc

SEQ ID NO: 1291280 - RNA, 15 nt, Human
caguaucucuucagu

SEQ ID NO: 1291281 - RNA, 14 nt, Human
caguaucucuucag

SEQ ID NO: 1291282 - RNA, 19 nt, Human
caguaucggcacuguacaa

SEQ ID NO: 1291283 - RNA, 20 nt, Human
caguaucggcacuguacaaa

SEQ ID NO: 1291284 - RNA, 16 nt, Human
caguaucggcacugua

SEQ ID NO: 1291285 - RNA, 15 nt, Human
caguaucggcacugu

SEQ ID NO: 1291286 - RNA, 14 nt, Human
caguaucggcacug

SEQ ID NO: 1291287 - RNA, 17 nt, Human
caguaucaugcccugug

SEQ ID NO: 1291288 - RNA, 19 nt, Human
caguaucaugcccugugca

SEQ ID NO: 1291289 - RNA, 20 nt, Human
caguaucaugcccugugcaa

SEQ ID NO: 1291290 - RNA, 16 nt, Human
caguauccacuuugca

SEQ ID NO: 1291291 - RNA, 23 nt, Human
caguauaauugaguuuucagugg

SEQ ID NO: 1291292 - RNA, 13 nt, Human
caguaucaugccc

SEQ ID NO: 1291293 - RNA, 16 nt, Human
caguaucaugcccugu

SEQ ID NO: 1291294 - RNA, 23 nt, Human
caguccccgugaaggagagcccu

SEQ ID NO: 1291295 - RNA, 13 nt, Human
cagucccuccaca

SEQ ID NO: 1291296 - RNA, 19 nt, Human
caguccgucaaaacagauu

SEQ ID NO: 1291297 - RNA, 15 nt, Human
caguccuaucugggc

SEQ ID NO: 1291298 - RNA, 16 nt, Human
caguccuaucugggcu

SEQ ID NO: 1291299 - RNA, 17 nt, Human
caguccuaucugggcuu

SEQ ID NO: 1291300 - RNA, 20 nt, Human
caguccuaucugggcuuccu

SEQ ID NO: 1291301 - RNA, 21 nt, Human
caguccuaucugggcuuccug

SEQ ID NO: 1291302 - RNA, 22 nt, Human
caguccuaucugggcuuccugg

SEQ ID NO: 1291303 - RNA, 14 nt, Human
caguccccuucccu

SEQ ID NO: 1291304 - RNA, 19 nt, Human
caguccccuucccuccaag

SEQ ID NO: 1291305 - RNA, 13 nt, Human
caguccccuuccc

SEQ ID NO: 1291306 - RNA, 16 nt, Human
cagucccccugcccca

SEQ ID NO: 1291307 - RNA, 17 nt, Human
cagucccccugccccag

SEQ ID NO: 1291308 - RNA, 14 nt, Human
caguccccccaccc

SEQ ID NO: 1291309 - RNA, 20 nt, Human
caguccccccacccucauuc

SEQ ID NO: 1291310 - RNA, 20 nt, Human
cagugaaagaaaauaacaau

SEQ ID NO: 1291311 - RNA, 16 nt, Human
cagugaaagaaaauaa

SEQ ID NO: 1291312 - RNA, 14 nt, Human
cagugaaaaacuau

SEQ ID NO: 1291313 - RNA, 17 nt, Human
cagugaaaaacuauuaa

SEQ ID NO: 1291314 - RNA, 12 nt, Human
caguccuguccu

SEQ ID NO: 1291315 - RNA, 15 nt, Human
cagucuguggaucag

SEQ ID NO: 1291316 - RNA, 15 nt, Human
cagucuuccauuugc

SEQ ID NO: 1291317 - RNA, 17 nt, Human
cagucuuccauuugcaa

SEQ ID NO: 1291318 - RNA, 18 nt, Human
cagucuuccauuugcaag

SEQ ID NO: 1291319 - RNA, 21 nt, Human
cagucuuccauuugcaaggga

SEQ ID NO: 1291320 - RNA, 13 nt, Human
cagucuuccugac

SEQ ID NO: 1291321 - RNA, 16 nt, Human
cagucuuccugacacu

SEQ ID NO: 1291322 - RNA, 17 nt, Human
cagucuuccugacacuu

SEQ ID NO: 1291323 - RNA, 18 nt, Human
cagucuuccugacacuuu

SEQ ID NO: 1291324 - RNA, 21 nt, Human
cagucuuccugacacuuuaau

SEQ ID NO: 1291325 - RNA, 22 nt, Human
caguccugaucagagccguggu

SEQ ID NO: 1291326 - RNA, 17 nt, Human
caguccuggaagccagc

SEQ ID NO: 1291327 - RNA, 22 nt, Human
caguccuggaagccagcuuucc

SEQ ID NO: 1291328 - RNA, 12 nt, Human
cagugagccuga

SEQ ID NO: 1291329 - RNA, 21 nt, Human
cagugagggagggcugucauc

SEQ ID NO: 1291330 - RNA, 23 nt, Human
cagugaggguaaguauuuuccug

SEQ ID NO: 1291331 - RNA, 15 nt, Human
cagugagacagcucu

SEQ ID NO: 1291332 - RNA, 13 nt, Human
cagugacuucuga

SEQ ID NO: 1291333 - RNA, 15 nt, Human
cagugacuucugaga

SEQ ID NO: 1291334 - RNA, 16 nt, Human
cagugacuucugagau

SEQ ID NO: 1291335 - RNA, 17 nt, Human
cagugacuucugagauc

SEQ ID NO: 1291336 - RNA, 21 nt, Human
cagugagagaguggcuggggc

SEQ ID NO: 1291337 - RNA, 22 nt, Human
cagugagagaguggcuggggca

SEQ ID NO: 1291338 - RNA, 23 nt, Human
cagugagagaguggcuggggcau

SEQ ID NO: 1291339 - RNA, 15 nt, Human
cagugacagcuagga

SEQ ID NO: 1291340 - RNA, 12 nt, Human
cagugacagcua

SEQ ID NO: 1291341 - RNA, 13 nt, Human
cagugacccuggc

SEQ ID NO: 1291342 - RNA, 16 nt, Human
cagugacccuggcucc

SEQ ID NO: 1291343 - RNA, 17 nt, Human
cagugacccuggcuccu

SEQ ID NO: 1291344 - RNA, 13 nt, Human
cagugaagacaga

SEQ ID NO: 1291345 - RNA, 14 nt, Human
cagugaagacagaa

SEQ ID NO: 1291346 - RNA, 15 nt, Human
cagugaagacagaag

SEQ ID NO: 1291347 - RNA, 16 nt, Human
cagugaagacagaagu

SEQ ID NO: 1291348 - RNA, 15 nt, Human
cagugaagacuauga

SEQ ID NO: 1291349 - RNA, 21 nt, Human
cagugaagagccacugccauu

SEQ ID NO: 1291350 - RNA, 14 nt, Human
cagugaaguugcug

SEQ ID NO: 1291351 - RNA, 15 nt, Human
cagugaaguugcugc

SEQ ID NO: 1291352 - RNA, 16 nt, Human
cagugaaguugcugcu

SEQ ID NO: 1291353 - RNA, 17 nt, Human
cagugaaguugcugcuu

SEQ ID NO: 1291354 - RNA, 18 nt, Human
cagugaaguugcugcuuc

SEQ ID NO: 1291355 - RNA, 19 nt, Human
cagugaaguugcugcuucu

SEQ ID NO: 1291356 - RNA, 23 nt, Human
cagugaaguugcugcuucuccca

SEQ ID NO: 1291357 - RNA, 17 nt, Human
cagugaaugauucagug

SEQ ID NO: 1291358 - RNA, 18 nt, Human
cagugaaugauucagugu

SEQ ID NO: 1291359 - RNA, 20 nt, Human
cagugaaugauucaguguua

SEQ ID NO: 1291360 - RNA, 20 nt, Human
cagugaauuguguaggagag

SEQ ID NO: 1291361 - RNA, 15 nt, Human
cagugacagacaggc

SEQ ID NO: 1291362 - RNA, 16 nt, Human
cagugacagacaggcu

SEQ ID NO: 1291363 - RNA, 17 nt, Human
cagugacagacaggcuc

SEQ ID NO: 1291364 - RNA, 18 nt, Human
cagugacagacaggcucu

SEQ ID NO: 1291365 - RNA, 22 nt, Human
cagugauuaccagggacugagg

SEQ ID NO: 1291366 - RNA, 18 nt, Human
cagugauuaccagggacu

SEQ ID NO: 1291367 - RNA, 17 nt, Human
cagugauuaccagggac

SEQ ID NO: 1291368 - RNA, 15 nt, Human
cagugcccuccagga

SEQ ID NO: 1291369 - RNA, 17 nt, Human
cagugcccucauuuuau

SEQ ID NO: 1291370 - RNA, 19 nt, Human
cagugcccucauuuuaugu

SEQ ID NO: 1291371 - RNA, 13 nt, Human
cagugcccucucc

SEQ ID NO: 1291372 - RNA, 22 nt, Human
cagugcccucuccccucagccu

SEQ ID NO: 1291373 - RNA, 13 nt, Human
cagugcccugagc

SEQ ID NO: 1291374 - RNA, 14 nt, Human
cagugcccugagcc

SEQ ID NO: 1291375 - RNA, 15 nt, Human
cagugcccugagcca

SEQ ID NO: 1291376 - RNA, 12 nt, Human
cagugcccccac

SEQ ID NO: 1291377 - RNA, 15 nt, Human
cagugcccccacuga

SEQ ID NO: 1291378 - RNA, 17 nt, Human
cagugcccccacugacc

SEQ ID NO: 1291379 - RNA, 20 nt, Human
cagugcccccacugaccaga

SEQ ID NO: 1291380 - RNA, 21 nt, Human
cagugcccccacugaccagaa

SEQ ID NO: 1291381 - RNA, 22 nt, Human
cagugcccccacugaccagaac

SEQ ID NO: 1291382 - RNA, 23 nt, Human
cagugcccccacugaccagaacu

SEQ ID NO: 1291383 - RNA, 15 nt, Human
cagugcccugauccc

SEQ ID NO: 1291384 - RNA, 16 nt, Human
cagugcccugagccag

SEQ ID NO: 1291385 - RNA, 22 nt, Human
cagugccuuccuguuuuucaca

SEQ ID NO: 1291386 - RNA, 23 nt, Human
cagugccuuucuucucuccagug

SEQ ID NO: 1291387 - RNA, 12 nt, Human
cagugcggccag

SEQ ID NO: 1291388 - RNA, 14 nt, Human
cagugcucccucac

SEQ ID NO: 1291389 - RNA, 15 nt, Human
cagggggcaagagga

SEQ ID NO: 1291390 - RNA, 18 nt, Human
cagggggagcugggccug

SEQ ID NO: 1291391 - RNA, 19 nt, Human
cagggggagcugggccugg

SEQ ID NO: 1291392 - RNA, 18 nt, Human
caggggcugucccggagg

SEQ ID NO: 1291393 - RNA, 15 nt, Human
caggggcuuccuggu

SEQ ID NO: 1291394 - RNA, 16 nt, Human
caggggcuuccuggug

SEQ ID NO: 1291395 - RNA, 17 nt, Human
caggggcuuccuggugc

SEQ ID NO: 1291396 - RNA, 20 nt, Human
caggggcuuccuggugcugg

SEQ ID NO: 1291397 - RNA, 13 nt, Human
caggggcuugacu

SEQ ID NO: 1291398 - RNA, 16 nt, Human
caggggcuugacuuuu

SEQ ID NO: 1291399 - RNA, 19 nt, Human
cagggggaagguggggucc

SEQ ID NO: 1291400 - RNA, 22 nt, Human
cagggggagcugggccuggucu

SEQ ID NO: 1291401 - RNA, 23 nt, Human
cagggggccccuuugcugacccu

SEQ ID NO: 1291402 - RNA, 12 nt, Human
cagggggcugcu

SEQ ID NO: 1291403 - RNA, 13 nt, Human
cagggggcugcug

SEQ ID NO: 1291404 - RNA, 14 nt, Human
cagggggcugcugc

SEQ ID NO: 1291405 - RNA, 15 nt, Human
cagggggcugcugcu

SEQ ID NO: 1291406 - RNA, 18 nt, Human
cagggggcugcugcuggg

SEQ ID NO: 1291407 - RNA, 20 nt, Human
cagggggcugcugcugggcu

SEQ ID NO: 1291408 - RNA, 23 nt, Human
cagggggcugcugcugggcucag

SEQ ID NO: 1291409 - RNA, 21 nt, Human
cagggggcugcugcugggcuc

SEQ ID NO: 1291410 - RNA, 15 nt, Human
caggggggugaggag

SEQ ID NO: 1291411 - RNA, 18 nt, Human
caggggggugaggagcug

SEQ ID NO: 1291412 - RNA, 19 nt, Human
caggggggugaggagcugg

SEQ ID NO: 1291413 - RNA, 13 nt, Human
cagggggucuggc

SEQ ID NO: 1291414 - RNA, 14 nt, Human
cagggggucuggcu

SEQ ID NO: 1291415 - RNA, 16 nt, Human
cagggggucuggcugg

SEQ ID NO: 1291416 - RNA, 17 nt, Human
cagggggucuggcuggu

SEQ ID NO: 1291417 - RNA, 18 nt, Human
cagggggucuggcuggug

SEQ ID NO: 1291418 - RNA, 19 nt, Human
cagggggucuggcuggugu

SEQ ID NO: 1291419 - RNA, 11 nt, Human
caggggacagg

SEQ ID NO: 1291420 - RNA, 16 nt, Human
caggggacaggauggu

SEQ ID NO: 1291421 - RNA, 16 nt, Human
cagggcgggcagaggg

SEQ ID NO: 1291422 - RNA, 17 nt, Human
cagggcgggcagagggc

SEQ ID NO: 1291423 - RNA, 19 nt, Human
cagggcgggcagagggcug

SEQ ID NO: 1291424 - RNA, 20 nt, Human
cagggcgggcagagggcugg

SEQ ID NO: 1291425 - RNA, 21 nt, Human
cagggcgggcagagggcugga

SEQ ID NO: 1291426 - RNA, 22 nt, Human
cagggcgggcagagggcuggag

SEQ ID NO: 1291427 - RNA, 15 nt, Human
cagggcggggguggc

SEQ ID NO: 1291428 - RNA, 16 nt, Human
caggggacaggagucc

SEQ ID NO: 1291429 - RNA, 22 nt, Human
caggggacaggaguccacuuug

SEQ ID NO: 1291430 - RNA, 16 nt, Human
caggggagcagagggg

SEQ ID NO: 1291431 - RNA, 20 nt, Human
caggggagcagaggggcaga

SEQ ID NO: 1291432 - RNA, 21 nt, Human
caggggagcagaggggcagag

SEQ ID NO: 1291433 - RNA, 22 nt, Human
caggggagcagaggggcagagg

SEQ ID NO: 1291434 - RNA, 14 nt, Human
cagggccugucuca

SEQ ID NO: 1291435 - RNA, 14 nt, Human
caggggcagcccca

SEQ ID NO: 1291436 - RNA, 18 nt, Human
caggggcagccccaggcc

SEQ ID NO: 1291437 - RNA, 22 nt, Human
caggggcccgcgauguggaacu

SEQ ID NO: 1291438 - RNA, 12 nt, Human
caggggccugga

SEQ ID NO: 1291439 - RNA, 13 nt, Human
caggggccuggag

SEQ ID NO: 1291440 - RNA, 14 nt, Human
caggggccuggaga

SEQ ID NO: 1291441 - RNA, 15 nt, Human
caggggccuggagau

SEQ ID NO: 1291442 - RNA, 22 nt, Human
caggggccuggagauccuccug

SEQ ID NO: 1291443 - RNA, 23 nt, Human
caggggccuggagauccuccugc

SEQ ID NO: 1291444 - RNA, 16 nt, Human
caggggccugcccagu

SEQ ID NO: 1291445 - RNA, 14 nt, Human
caggggcucccucc

SEQ ID NO: 1291446 - RNA, 21 nt, Human
caggggcucccuccgccccca

SEQ ID NO: 1291447 - RNA, 18 nt, Human
caggggcucccuccgccc

SEQ ID NO: 1291448 - RNA, 13 nt, Human
caggggcugcuuc

SEQ ID NO: 1291449 - RNA, 16 nt, Human
caggggcugcuuccuc

SEQ ID NO: 1291450 - RNA, 18 nt, Human
caggggcugcuuccuccu

SEQ ID NO: 1291451 - RNA, 19 nt, Human
caggggcugcuuccuccug

SEQ ID NO: 1291452 - RNA, 20 nt, Human
caggggcugcuuccuccugg

SEQ ID NO: 1291453 - RNA, 22 nt, Human
caggggcugcuuccuccuggaa

SEQ ID NO: 1291454 - RNA, 23 nt, Human
cagggaccggcggaccccagcca

SEQ ID NO: 1291455 - RNA, 21 nt, Human
cagggaccgcccccugucucu

SEQ ID NO: 1291456 - RNA, 14 nt, Human
cagggaccauggcu

SEQ ID NO: 1291457 - RNA, 12 nt, Human
cagggacucagg

SEQ ID NO: 1291458 - RNA, 21 nt, Human
cagggacucaucuuucccucc

SEQ ID NO: 1291459 - RNA, 22 nt, Human
cagggacucaucuuucccuccu

SEQ ID NO: 1291460 - RNA, 23 nt, Human
cagggacucaucuuucccuccuu

SEQ ID NO: 1291461 - RNA, 19 nt, Human
cagggacagaggccccagc

SEQ ID NO: 1291462 - RNA, 21 nt, Human
cagggacagaggccccagccu

SEQ ID NO: 1291463 - RNA, 23 nt, Human
cagggacagaggccccagccucc

SEQ ID NO: 1291464 - RNA, 14 nt, Human
cagggacagcaacu

SEQ ID NO: 1291465 - RNA, 16 nt, Human
cagggaccacacccug

SEQ ID NO: 1291466 - RNA, 22 nt, Human
cagggaccacacccuguacugu

SEQ ID NO: 1291467 - RNA, 15 nt, Human
cagggcaaggccauu

SEQ ID NO: 1291468 - RNA, 18 nt, Human
cagggcaaugaugaauga

SEQ ID NO: 1291469 - RNA, 12 nt, Human
cagggcaaagcc

SEQ ID NO: 1291470 - RNA, 13 nt, Human
cagggcaaagcca

SEQ ID NO: 1291471 - RNA, 14 nt, Human
cagggcaaagccag

SEQ ID NO: 1291472 - RNA, 16 nt, Human
cagggcaaagccaggu

SEQ ID NO: 1291473 - RNA, 17 nt, Human
cagggcaaagccagguc

SEQ ID NO: 1291474 - RNA, 18 nt, Human
cagggcaaagccaggucc

SEQ ID NO: 1291475 - RNA, 20 nt, Human
cagggcaaagccaggucccu

SEQ ID NO: 1291476 - RNA, 22 nt, Human
cagggcaaagccaggucccucu

SEQ ID NO: 1291477 - RNA, 23 nt, Human
cagggcaaagccaggucccucuc

SEQ ID NO: 1291478 - RNA, 21 nt, Human
cagggacuucaggaucaaguc

SEQ ID NO: 1291479 - RNA, 12 nt, Human
cagggagaagcu

SEQ ID NO: 1291480 - RNA, 13 nt, Human
cagggagaagcuc

SEQ ID NO: 1291481 - RNA, 12 nt, Human
cagggauguggg

SEQ ID NO: 1291482 - RNA, 13 nt, Human
cagggaugugggu

SEQ ID NO: 1291483 - RNA, 20 nt, Human
cagggauguggguuccacag

SEQ ID NO: 1291484 - RNA, 21 nt, Human
cagggauguggguuccacaga

SEQ ID NO: 1291485 - RNA, 17 nt, Human
cagggauuaaccucugc

SEQ ID NO: 1291486 - RNA, 18 nt, Human
cagggauuaaccucugca

SEQ ID NO: 1291487 - RNA, 19 nt, Human
cagggauuaaccucugcac

SEQ ID NO: 1291488 - RNA, 20 nt, Human
cagggauuaaccucugcacu

SEQ ID NO: 1291489 - RNA, 22 nt, Human
cagggauguggguuccacagac

SEQ ID NO: 1291490 - RNA, 12 nt, Human
cagggcacagga

SEQ ID NO: 1291491 - RNA, 13 nt, Human
cagggcacaggag

SEQ ID NO: 1291492 - RNA, 14 nt, Human
cagggcacaggagc

SEQ ID NO: 1291493 - RNA, 15 nt, Human
cagggcacaggagcu

SEQ ID NO: 1291494 - RNA, 16 nt, Human
cagggcacaggagcua

SEQ ID NO: 1291495 - RNA, 18 nt, Human
cagggcacaggagcuacc

SEQ ID NO: 1291496 - RNA, 19 nt, Human
cagggcacaggagcuaccu

SEQ ID NO: 1291497 - RNA, 20 nt, Human
cagggcacaggagcuaccug

SEQ ID NO: 1291498 - RNA, 22 nt, Human
cagggcacaggagcuaccugug

SEQ ID NO: 1291499 - RNA, 21 nt, Human
cagggcacaggagcuaccugu

SEQ ID NO: 1291500 - RNA, 13 nt, Human
cagggcagaguga

SEQ ID NO: 1291501 - RNA, 19 nt, Human
cagggcagagugagaccca

SEQ ID NO: 1291502 - RNA, 12 nt, Human
cagggcagccag

SEQ ID NO: 1291503 - RNA, 13 nt, Human
cagggcagccagg

SEQ ID NO: 1291504 - RNA, 14 nt, Human
cagggcagccaggg

SEQ ID NO: 1291505 - RNA, 15 nt, Human
cagggcagccaggga

SEQ ID NO: 1291506 - RNA, 16 nt, Human
cagggcagccagggag

SEQ ID NO: 1291507 - RNA, 17 nt, Human
cagggcagccagggaga

SEQ ID NO: 1291508 - RNA, 18 nt, Human
cagggcagccagggagag

SEQ ID NO: 1291509 - RNA, 20 nt, Human
cagggcagccagggagagcc

SEQ ID NO: 1291510 - RNA, 22 nt, Human
cagggcagccagggagagccca

SEQ ID NO: 1291511 - RNA, 23 nt, Human
cagggcagccagggagagcccag

SEQ ID NO: 1291512 - RNA, 13 nt, Human
cagggcagcgcca

SEQ ID NO: 1291513 - RNA, 14 nt, Human
cagggcagcgccag

SEQ ID NO: 1291514 - RNA, 15 nt, Human
cagggcagcgccagg

SEQ ID NO: 1291515 - RNA, 16 nt, Human
cagggcagcgccaggc

SEQ ID NO: 1291516 - RNA, 17 nt, Human
cagggcagcgccaggcu

SEQ ID NO: 1291517 - RNA, 18 nt, Human
cagggcagcgccaggcug

SEQ ID NO: 1291518 - RNA, 19 nt, Human
cagggcagcgccaggcuga

SEQ ID NO: 1291519 - RNA, 22 nt, Human
cagggcagcgccaggcugacca

SEQ ID NO: 1291520 - RNA, 20 nt, Human
cagggcauggccagguggcc

SEQ ID NO: 1291521 - RNA, 17 nt, Human
cagggcaucucugggcu

SEQ ID NO: 1291522 - RNA, 18 nt, Human
cagggcaucucugggcug

SEQ ID NO: 1291523 - RNA, 19 nt, Human
cagggcaucucugggcugg

SEQ ID NO: 1291524 - RNA, 20 nt, Human
cagggcaucucugggcugga

SEQ ID NO: 1291525 - RNA, 24 nt, Human
cagggcaucucugggcuggaugag

SEQ ID NO: 1291526 - RNA, 15 nt, Human
cagggcaugccacgu

SEQ ID NO: 1291527 - RNA, 13 nt, Human
cagggcagggccc

SEQ ID NO: 1291528 - RNA, 14 nt, Human
cagggcaguaccug

SEQ ID NO: 1291529 - RNA, 15 nt, Human
cagggcaguaccuga

SEQ ID NO: 1291530 - RNA, 19 nt, Human
cagggcaguaccugagggu

SEQ ID NO: 1291531 - RNA, 21 nt, Human
cagggcagucauuggcugucu

SEQ ID NO: 1291532 - RNA, 23 nt, Human
cagggcaguaccugagggucugu

SEQ ID NO: 1291533 - RNA, 16 nt, Human
cagggcaucucugggc

SEQ ID NO: 1291534 - RNA, 16 nt, Human
cagggccacgcuccag

SEQ ID NO: 1291535 - RNA, 17 nt, Human
cagggccacgcuccagc

SEQ ID NO: 1291536 - RNA, 18 nt, Human
cagggccacgcuccagcu

SEQ ID NO: 1291537 - RNA, 20 nt, Human
cagggccacgcuccagcugc

SEQ ID NO: 1291538 - RNA, 22 nt, Human
cagggccacgcuccagcugccc

SEQ ID NO: 1291539 - RNA, 23 nt, Human
cagggccacgcuccagcugcccc

SEQ ID NO: 1291540 - RNA, 14 nt, Human
cagggccagccucu

SEQ ID NO: 1291541 - RNA, 19 nt, Human
cagggccagccucuagagc

SEQ ID NO: 1291542 - RNA, 15 nt, Human
cagggccagccucua

SEQ ID NO: 1291543 - RNA, 17 nt, Human
cagggccaggccucucc

SEQ ID NO: 1291544 - RNA, 14 nt, Human
cagggccaugcuga

SEQ ID NO: 1291545 - RNA, 16 nt, Human
cagggccaugcugagg

SEQ ID NO: 1291546 - RNA, 17 nt, Human
cagggccaugcugaggc

SEQ ID NO: 1291547 - RNA, 18 nt, Human
cagggccaugcugaggcc

SEQ ID NO: 1291548 - RNA, 21 nt, Human
cagggccaugcugaggccugg

SEQ ID NO: 1291549 - RNA, 23 nt, Human
cagggccaugcugaggccugggc

SEQ ID NO: 1291550 - RNA, 22 nt, Human
cagggccaugcugaggccuggg

SEQ ID NO: 1291551 - RNA, 12 nt, Human
cagggcccagag

SEQ ID NO: 1291552 - RNA, 13 nt, Human
cagggcccagagc

SEQ ID NO: 1291553 - RNA, 14 nt, Human
cagggcccagagcc

SEQ ID NO: 1291554 - RNA, 15 nt, Human
cagggcccagagccc

SEQ ID NO: 1291555 - RNA, 16 nt, Human
cagggcccagagccca

SEQ ID NO: 1291556 - RNA, 18 nt, Human
cagggcccagagcccagc

SEQ ID NO: 1291557 - RNA, 19 nt, Human
cagggcccagagcccagcu

SEQ ID NO: 1291558 - RNA, 21 nt, Human
cagggcccagagcccagcucc

SEQ ID NO: 1291559 - RNA, 22 nt, Human
cagggcccagagcccagcucca

SEQ ID NO: 1291560 - RNA, 20 nt, Human
cagggccccaggcauugcca

SEQ ID NO: 1291561 - RNA, 15 nt, Human
cagggcccccaucuc

SEQ ID NO: 1291562 - RNA, 16 nt, Human
cagggcccccaucuca

SEQ ID NO: 1291563 - RNA, 21 nt, Human
cagggcccccaucucaugccc

SEQ ID NO: 1291564 - RNA, 18 nt, Human
cagggccccucacccugc

SEQ ID NO: 1291565 - RNA, 21 nt, Human
cagggccccucacccugccuu

SEQ ID NO: 1291566 - RNA, 22 nt, Human
cagggccccucacccugccuua

SEQ ID NO: 1291567 - RNA, 15 nt, Human
cagggccccucuccc

SEQ ID NO: 1291568 - RNA, 22 nt, Human
cagggccccucuccccagggaa

SEQ ID NO: 1291569 - RNA, 12 nt, Human
cagggccgggga

SEQ ID NO: 1291570 - RNA, 20 nt, Human
cagggccggggaacuggcca

SEQ ID NO: 1291571 - RNA, 22 nt, Human
cagggccggggaacuggccaag

SEQ ID NO: 1291572 - RNA, 23 nt, Human
cagggccggggaacuggccaagc

SEQ ID NO: 1291573 - RNA, 24 nt, Human
cagggccggggaacuggccaagcu

SEQ ID NO: 1291574 - RNA, 14 nt, Human
caggcuuuuguuuc

SEQ ID NO: 1291575 - RNA, 15 nt, Human
cagggaaaauaggca

SEQ ID NO: 1291576 - RNA, 18 nt, Human
cagggaaaauaggcagga

SEQ ID NO: 1291577 - RNA, 18 nt, Human
cagggaacgugauuagug

SEQ ID NO: 1291578 - RNA, 15 nt, Human
cagggaagcagcagc

SEQ ID NO: 1291579 - RNA, 17 nt, Human
cagggaagcagcagccu

SEQ ID NO: 1291580 - RNA, 19 nt, Human
cagggaacgugauuaguga

SEQ ID NO: 1291581 - RNA, 20 nt, Human
cagggaacauggggaggagg

SEQ ID NO: 1291582 - RNA, 18 nt, Human
cagggaacauggggagga

SEQ ID NO: 1291583 - RNA, 20 nt, Human
cagggaaaauuauuugcaua

SEQ ID NO: 1291584 - RNA, 14 nt, Human
cagggacagaggcc

SEQ ID NO: 1291585 - RNA, 16 nt, Human
cagggacagaggcccc

SEQ ID NO: 1291586 - RNA, 18 nt, Human
cagggacagaggccccag

SEQ ID NO: 1291587 - RNA, 18 nt, Human
cagggaauuaggccccca

SEQ ID NO: 1291588 - RNA, 22 nt, Human
cagggacaccugggagaaaucu

SEQ ID NO: 1291589 - RNA, 17 nt, Human
cagggacaccugggaga

SEQ ID NO: 1291590 - RNA, 13 nt, Human
cagggaaggaucc

SEQ ID NO: 1291591 - RNA, 20 nt, Human
cagggaaggaggagccuguc

SEQ ID NO: 1291592 - RNA, 21 nt, Human
cagggaaggaggagccugucc

SEQ ID NO: 1291593 - RNA, 22 nt, Human
cagggaaggaggagccuguccu

SEQ ID NO: 1291594 - RNA, 23 nt, Human
cagggaaggaggagccuguccug

SEQ ID NO: 1291595 - RNA, 18 nt, Human
cagggaaggaucccauga

SEQ ID NO: 1291596 - RNA, 12 nt, Human
cagggaaggcag

SEQ ID NO: 1291597 - RNA, 13 nt, Human
cagggaaggcagg

SEQ ID NO: 1291598 - RNA, 14 nt, Human
cagggaaggcaggc

SEQ ID NO: 1291599 - RNA, 15 nt, Human
cagggaaggcaggca

SEQ ID NO: 1291600 - RNA, 14 nt, Human
cagggaaggaggag

SEQ ID NO: 1291601 - RNA, 15 nt, Human
cagggaaggaggagc

SEQ ID NO: 1291602 - RNA, 16 nt, Human
cagggaaggaggagcc

SEQ ID NO: 1291603 - RNA, 18 nt, Human
cagggaaggaggagccug

SEQ ID NO: 1291604 - RNA, 15 nt, Human
cagggaaggggacaa

SEQ ID NO: 1291605 - RNA, 17 nt, Human
cagggaaggggacaagg

SEQ ID NO: 1291606 - RNA, 16 nt, Human
cagggaaggcaggcag

SEQ ID NO: 1291607 - RNA, 17 nt, Human
cagggaaggcaggcagg

SEQ ID NO: 1291608 - RNA, 18 nt, Human
cagggaaggcaggcaggg

SEQ ID NO: 1291609 - RNA, 20 nt, Human
cagggaaggcaggcagggcu

SEQ ID NO: 1291610 - RNA, 21 nt, Human
cagggaaggcaggcagggcuc

SEQ ID NO: 1291611 - RNA, 22 nt, Human
cagggaaggcaggcagggcucu

SEQ ID NO: 1291612 - RNA, 23 nt, Human
cagggaaggcaggcagggcucuc

SEQ ID NO: 1291613 - RNA, 13 nt, Human
caggcuagaugua

SEQ ID NO: 1291614 - RNA, 19 nt, Human
caggcuagauguauguacu

SEQ ID NO: 1291615 - RNA, 14 nt, Human
caggccgcccugcg

SEQ ID NO: 1291616 - RNA, 11 nt, Human
caggcucagag

SEQ ID NO: 1291617 - RNA, 15 nt, Human
caggcucagagggug

SEQ ID NO: 1291618 - RNA, 14 nt, Human
caggcucaggcagg

SEQ ID NO: 1291619 - RNA, 15 nt, Human
caggcucaggcaggg

SEQ ID NO: 1291620 - RNA, 19 nt, Human
caggcucaggcaggggccu

SEQ ID NO: 1291621 - RNA, 18 nt, Human
caggcucaaacaaugaca

SEQ ID NO: 1291622 - RNA, 18 nt, Human
caggcuccugccaccacg

SEQ ID NO: 1291623 - RNA, 13 nt, Human
caggcuccugcca

SEQ ID NO: 1291624 - RNA, 14 nt, Human
caggcuccugccac

SEQ ID NO: 1291625 - RNA, 15 nt, Human
caggcuccugccacc

SEQ ID NO: 1291626 - RNA, 16 nt, Human
caggcuccugccacca

SEQ ID NO: 1291627 - RNA, 21 nt, Human
caggcucaggcaggggccucc

SEQ ID NO: 1291628 - RNA, 14 nt, Human
caggcucccaggga

SEQ ID NO: 1291629 - RNA, 16 nt, Human
caggcucccagggaca

SEQ ID NO: 1291630 - RNA, 19 nt, Human
caggcucccagggacaccu

SEQ ID NO: 1291631 - RNA, 22 nt, Human
caggcucccagggacaccuggg

SEQ ID NO: 1291632 - RNA, 23 nt, Human
caggcucccagggacaccuggga

SEQ ID NO: 1291633 - RNA, 14 nt, Human
caggcucggccugc

SEQ ID NO: 1291634 - RNA, 15 nt, Human
caggcucggccugcc

SEQ ID NO: 1291635 - RNA, 16 nt, Human
caggcucggccugccc

SEQ ID NO: 1291636 - RNA, 19 nt, Human
caggcucggccugccccca

SEQ ID NO: 1291637 - RNA, 20 nt, Human
caggcucggccugcccccac

SEQ ID NO: 1291638 - RNA, 23 nt, Human
caggcucggccugcccccacccc

SEQ ID NO: 1291639 - RNA, 21 nt, Human
caggcucguggacugaguggg

SEQ ID NO: 1291640 - RNA, 12 nt, Human
caggcucucuuu

SEQ ID NO: 1291641 - RNA, 15 nt, Human
caggcccuuccucuc

SEQ ID NO: 1291642 - RNA, 22 nt, Human
caggcccuggccuccccugcca

SEQ ID NO: 1291643 - RNA, 21 nt, Human
caggcccuuauuuucaagaaa

SEQ ID NO: 1291644 - RNA, 16 nt, Human
caggcccuuccucucc

SEQ ID NO: 1291645 - RNA, 17 nt, Human
caggcccuuccucucca

SEQ ID NO: 1291646 - RNA, 14 nt, Human
caggcccuggccuc

SEQ ID NO: 1291647 - RNA, 15 nt, Human
caggcccuggccucc

SEQ ID NO: 1291648 - RNA, 17 nt, Human
caggcccuggccucccc

SEQ ID NO: 1291649 - RNA, 18 nt, Human
caggcccuggccuccccu

SEQ ID NO: 1291650 - RNA, 20 nt, Human
caggcccuggccuccccugc

SEQ ID NO: 1291651 - RNA, 19 nt, Human
caggcccuuccucuccacu

SEQ ID NO: 1291652 - RNA, 20 nt, Human
caggcccuuccucuccacug

SEQ ID NO: 1291653 - RNA, 21 nt, Human
caggcccuuccucuccacugc

SEQ ID NO: 1291654 - RNA, 23 nt, Human
caggcccuuccucuccacugccu

SEQ ID NO: 1291655 - RNA, 16 nt, Human
caggcccggcagggcg

SEQ ID NO: 1291656 - RNA, 22 nt, Human
caggcccucccuguuccccaga

SEQ ID NO: 1291657 - RNA, 23 nt, Human
caggcccucccuguuccccagag

SEQ ID NO: 1291658 - RNA, 21 nt, Human
caggcugggucgcccuggacu

SEQ ID NO: 1291659 - RNA, 23 nt, Human
caggcugggucgcccuggacugu

SEQ ID NO: 1291660 - RNA, 17 nt, Human
caggcuggcccugcccu

SEQ ID NO: 1291661 - RNA, 21 nt, Human
caggcuggccaguccaggcug

SEQ ID NO: 1291662 - RNA, 16 nt, Human
caggcuggucuaaaac

SEQ ID NO: 1291663 - RNA, 12 nt, Human
caggcuggcccu

SEQ ID NO: 1291664 - RNA, 14 nt, Human
caggcuggcccugc

SEQ ID NO: 1291665 - RNA, 15 nt, Human
caggcuggcccugcc

SEQ ID NO: 1291666 - RNA, 16 nt, Human
caggcuggcccugccc

SEQ ID NO: 1291667 - RNA, 14 nt, Human
caggcuggccaguc

SEQ ID NO: 1291668 - RNA, 16 nt, Human
caggcuggccagucca

SEQ ID NO: 1291669 - RNA, 18 nt, Human
caggcuggccaguccagg

SEQ ID NO: 1291670 - RNA, 19 nt, Human
caggcuggccaguccaggc

SEQ ID NO: 1291671 - RNA, 16 nt, Human
caggcuggagugcagu

SEQ ID NO: 1291672 - RNA, 20 nt, Human
caggcuggaagauagcugug

SEQ ID NO: 1291673 - RNA, 19 nt, Human
caggcuggaagauagcugu

SEQ ID NO: 1291674 - RNA, 12 nt, Human
caggcuggccag

SEQ ID NO: 1291675 - RNA, 12 nt, Human
caggcugcucuu

SEQ ID NO: 1291676 - RNA, 20 nt, Human
caggcugcucuugaacuccu

SEQ ID NO: 1291677 - RNA, 23 nt, Human
caggcugcucuugaacuccugac

SEQ ID NO: 1291678 - RNA, 12 nt, Human
caggcucuucuc

SEQ ID NO: 1291679 - RNA, 21 nt, Human
caggcucuuagcagcuuccag

SEQ ID NO: 1291680 - RNA, 22 nt, Human
caggcucuuagcagcuuccaga

SEQ ID NO: 1291681 - RNA, 14 nt, Human
caggcucuucuccu

SEQ ID NO: 1291682 - RNA, 15 nt, Human
caggcucuucuccuu

SEQ ID NO: 1291683 - RNA, 12 nt, Human
caggcucuuagc

SEQ ID NO: 1291684 - RNA, 15 nt, Human
caggcucuuagcagc

SEQ ID NO: 1291685 - RNA, 18 nt, Human
caggcucuuagcagcuuc

SEQ ID NO: 1291686 - RNA, 18 nt, Human
caggcucuucuccuuuca

SEQ ID NO: 1291687 - RNA, 22 nt, Human
caggcucuucuccuuucacaac

SEQ ID NO: 1291688 - RNA, 18 nt, Human
caggcugaagcagguucc

SEQ ID NO: 1291689 - RNA, 14 nt, Human
caggcugaccacag

SEQ ID NO: 1291690 - RNA, 12 nt, Human
caggcugagccu

SEQ ID NO: 1291691 - RNA, 22 nt, Human
caggcugaccacagcacagcca

SEQ ID NO: 1291692 - RNA, 15 nt, Human
caggcugaccacagc

SEQ ID NO: 1291693 - RNA, 17 nt, Human
caggcugaccacagcac

SEQ ID NO: 1291694 - RNA, 20 nt, Human
caggcugaccacagcacagc

SEQ ID NO: 1291695 - RNA, 21 nt, Human
caggcugaccacagcacagcc

SEQ ID NO: 1291696 - RNA, 13 nt, Human
caggcugagccuc

SEQ ID NO: 1291697 - RNA, 14 nt, Human
caggcugagccuca

SEQ ID NO: 1291698 - RNA, 15 nt, Human
caggcugagccucag

SEQ ID NO: 1291699 - RNA, 16 nt, Human
caggcugagccucagu

SEQ ID NO: 1291700 - RNA, 17 nt, Human
caggcugagccucaguc

SEQ ID NO: 1291701 - RNA, 21 nt, Human
caggcugagccucagucuccc

SEQ ID NO: 1291702 - RNA, 22 nt, Human
caggcugagguccugaucagcu

SEQ ID NO: 1291703 - RNA, 17 nt, Human
caggcugauuucuaggu

SEQ ID NO: 1291704 - RNA, 16 nt, Human
caggcugauuucuagg

SEQ ID NO: 1291705 - RNA, 16 nt, Human
caggcugccguggggc

SEQ ID NO: 1291706 - RNA, 16 nt, Human
caggcugccucccuug

SEQ ID NO: 1291707 - RNA, 11 nt, Human
caggcugccug

SEQ ID NO: 1291708 - RNA, 12 nt, Human
caggcugccuga

SEQ ID NO: 1291709 - RNA, 13 nt, Human
caggcugccugag

SEQ ID NO: 1291710 - RNA, 14 nt, Human
caggcugccugagu

SEQ ID NO: 1291711 - RNA, 15 nt, Human
caggcugccugaguc

SEQ ID NO: 1291712 - RNA, 23 nt, Human
caggcuuuuuuaucaugugaaau

SEQ ID NO: 1291713 - RNA, 15 nt, Human
caggcuugccugcag

SEQ ID NO: 1291714 - RNA, 16 nt, Human
caggcuugccugcagg

SEQ ID NO: 1291715 - RNA, 17 nt, Human
caggcuugccugcaggc

SEQ ID NO: 1291716 - RNA, 18 nt, Human
caggcuugccugcaggca

SEQ ID NO: 1291717 - RNA, 16 nt, Human
caggcuucugagcagc

SEQ ID NO: 1291718 - RNA, 21 nt, Human
caggcuucugagcagcgagcc

SEQ ID NO: 1291719 - RNA, 23 nt, Human
caggcuucugagcagcgagccug

SEQ ID NO: 1291720 - RNA, 14 nt, Human
caggcuucugcugg

SEQ ID NO: 1291721 - RNA, 17 nt, Human
caggcuucugcuggggc

SEQ ID NO: 1291722 - RNA, 19 nt, Human
caggcuucugcuggggccu

SEQ ID NO: 1291723 - RNA, 20 nt, Human
caggcuggucucgaacuccu

SEQ ID NO: 1291724 - RNA, 22 nt, Human
caggcuggucucgaacuccuga

SEQ ID NO: 1291725 - RNA, 17 nt, Human
caggcuggucuaaaacu

SEQ ID NO: 1291726 - RNA, 18 nt, Human
caggcuggucuaaaacuc

SEQ ID NO: 1291727 - RNA, 23 nt, Human
caggcuggucucgaacuccugac

SEQ ID NO: 1291728 - RNA, 21 nt, Human
caggcuguaggaaaucuaguu

SEQ ID NO: 1291729 - RNA, 14 nt, Human
caggcugugaguuu

SEQ ID NO: 1291730 - RNA, 22 nt, Human
caggcuguguuuggcuuucagg

SEQ ID NO: 1291731 - RNA, 14 nt, Human
caggcaggagcccu

SEQ ID NO: 1291732 - RNA, 18 nt, Human
caggcaggcucccaggga

SEQ ID NO: 1291733 - RNA, 16 nt, Human
caggcaggcucccagg

SEQ ID NO: 1291734 - RNA, 11 nt, Human
caggcagggcu

SEQ ID NO: 1291735 - RNA, 12 nt, Human
caggcagggcuc

SEQ ID NO: 1291736 - RNA, 13 nt, Human
caggcagggcucu

SEQ ID NO: 1291737 - RNA, 14 nt, Human
caggcagggcucuc

SEQ ID NO: 1291738 - RNA, 15 nt, Human
caggcagggcucucc

SEQ ID NO: 1291739 - RNA, 16 nt, Human
caggcagggcucuccu

SEQ ID NO: 1291740 - RNA, 17 nt, Human
caggcagggcucuccug

SEQ ID NO: 1291741 - RNA, 18 nt, Human
caggcagggcucuccugg

SEQ ID NO: 1291742 - RNA, 21 nt, Human
caggcaggggccuccaugggc

SEQ ID NO: 1291743 - RNA, 18 nt, Human
caggcaggggccuccaug

SEQ ID NO: 1291744 - RNA, 19 nt, Human
caggcagggcucuccuggc

SEQ ID NO: 1291745 - RNA, 20 nt, Human
caggcagggcucuccuggcu

SEQ ID NO: 1291746 - RNA, 23 nt, Human
caggcagggcucuccuggcuucc

SEQ ID NO: 1291747 - RNA, 21 nt, Human
caggcagggcucuccuggcuu

SEQ ID NO: 1291748 - RNA, 13 nt, Human
caggcaggggccu

SEQ ID NO: 1291749 - RNA, 15 nt, Human
caggcaggggccucc

SEQ ID NO: 1291750 - RNA, 16 nt, Human
caggcaggggccucca

SEQ ID NO: 1291751 - RNA, 12 nt, Human
caggcagccagu

SEQ ID NO: 1291752 - RNA, 15 nt, Human
caggcagccagugcc

SEQ ID NO: 1291753 - RNA, 19 nt, Human
caggcagccagugcccuga

SEQ ID NO: 1291754 - RNA, 20 nt, Human
caggcagccagugcccugag

SEQ ID NO: 1291755 - RNA, 24 nt, Human
caggcagccagugcccugagccag

SEQ ID NO: 1291756 - RNA, 13 nt, Human
caggcagccucug

SEQ ID NO: 1291757 - RNA, 23 nt, Human
caggcagccagugcccugagcca

SEQ ID NO: 1291758 - RNA, 14 nt, Human
caggcagccucugg

SEQ ID NO: 1291759 - RNA, 15 nt, Human
caggcagccucuggg

SEQ ID NO: 1291760 - RNA, 16 nt, Human
caggcagccucugggg

SEQ ID NO: 1291761 - RNA, 19 nt, Human
caggcagccucuggggggu

SEQ ID NO: 1291762 - RNA, 20 nt, Human
caggcaggaaggcugagagg

SEQ ID NO: 1291763 - RNA, 13 nt, Human
caggcaggaacaa

SEQ ID NO: 1291764 - RNA, 20 nt, Human
caggcaggaacaaacagggc

SEQ ID NO: 1291765 - RNA, 19 nt, Human
caggcagcuuuuucucucc

SEQ ID NO: 1291766 - RNA, 22 nt, Human
caggcagcuuuuucucucccac

SEQ ID NO: 1291767 - RNA, 13 nt, Human
caggauugcgaga

SEQ ID NO: 1291768 - RNA, 16 nt, Human
caggauugcgagagau

SEQ ID NO: 1291769 - RNA, 17 nt, Human
caggauugcgagagaug

SEQ ID NO: 1291770 - RNA, 18 nt, Human
caggauugcgagagaugu

SEQ ID NO: 1291771 - RNA, 19 nt, Human
caggauugcgagagaugug

SEQ ID NO: 1291772 - RNA, 20 nt, Human
caggauugcgagagaugugu

SEQ ID NO: 1291773 - RNA, 21 nt, Human
caggauugcgagagaugugug

SEQ ID NO: 1291774 - RNA, 22 nt, Human
caggauugcgagagaugugugu

SEQ ID NO: 1291775 - RNA, 23 nt, Human
caggauugcgagagauguguguu

SEQ ID NO: 1291776 - RNA, 14 nt, Human
caggauuggggaag

SEQ ID NO: 1291777 - RNA, 15 nt, Human
caggauuggggaaga

SEQ ID NO: 1291778 - RNA, 20 nt, Human
caggauuggggaagagagcc

SEQ ID NO: 1291779 - RNA, 24 nt, Human
caggauuggggaagagagccugca

SEQ ID NO: 1291780 - RNA, 14 nt, Human
caggcaaaauccuu

SEQ ID NO: 1291781 - RNA, 18 nt, Human
caggcaaaauccuugcuu

SEQ ID NO: 1291782 - RNA, 22 nt, Human
caggcaacgcacaaaacagaaa

SEQ ID NO: 1291783 - RNA, 21 nt, Human
caggcagccagcaucugggcc

SEQ ID NO: 1291784 - RNA, 17 nt, Human
caggcaaggcuguggac

SEQ ID NO: 1291785 - RNA, 13 nt, Human
caggcaaggcugu

SEQ ID NO: 1291786 - RNA, 14 nt, Human
caggcaaggcugug

SEQ ID NO: 1291787 - RNA, 19 nt, Human
caggcauugccaagggcuu

SEQ ID NO: 1291788 - RNA, 15 nt, Human
caggcauuggauauu

SEQ ID NO: 1291789 - RNA, 14 nt, Human
caggcauuuccugg

SEQ ID NO: 1291790 - RNA, 15 nt, Human
caggcauuuccuggg

SEQ ID NO: 1291791 - RNA, 16 nt, Human
caggcauuuccugggu

SEQ ID NO: 1291792 - RNA, 20 nt, Human
caggcaucggggagccggga

SEQ ID NO: 1291793 - RNA, 21 nt, Human
caggcaucggggagccgggag

SEQ ID NO: 1291794 - RNA, 12 nt, Human
caggcauccucc

SEQ ID NO: 1291795 - RNA, 15 nt, Human
caggcagggugcagu

SEQ ID NO: 1291796 - RNA, 20 nt, Human
caggcaggucugaagcucaa

SEQ ID NO: 1291797 - RNA, 13 nt, Human
caggauccaggcc

SEQ ID NO: 1291798 - RNA, 17 nt, Human
caggauccaagcuaagc

SEQ ID NO: 1291799 - RNA, 17 nt, Human
caggaucaguuaacuau

SEQ ID NO: 1291800 - RNA, 22 nt, Human
caggauccccaaggcacuugag

SEQ ID NO: 1291801 - RNA, 12 nt, Human
caggaucuauuu

SEQ ID NO: 1291802 - RNA, 18 nt, Human
caggaucuauuuuuggag

SEQ ID NO: 1291803 - RNA, 19 nt, Human
caggaucuauuuuuggagg

SEQ ID NO: 1291804 - RNA, 20 nt, Human
caggaucuauuuuuggaggu

SEQ ID NO: 1291805 - RNA, 21 nt, Human
caggaucuauuuuuggagguu

SEQ ID NO: 1291806 - RNA, 17 nt, Human
caggaucucaccaggca

SEQ ID NO: 1291807 - RNA, 18 nt, Human
caggaucucaccaggcag

SEQ ID NO: 1291808 - RNA, 22 nt, Human
caggaucucaccaggcagccuc

SEQ ID NO: 1291809 - RNA, 21 nt, Human
caggauauucucacagcucca

SEQ ID NO: 1291810 - RNA, 14 nt, Human
caggauagagacug

SEQ ID NO: 1291811 - RNA, 16 nt, Human
caggauagagacugga

SEQ ID NO: 1291812 - RNA, 15 nt, Human
caggaucaguuaacu

SEQ ID NO: 1291813 - RNA, 20 nt, Human
caggaugaugacuauggaaa

SEQ ID NO: 1291814 - RNA, 18 nt, Human
caggaugaugacuaugga

SEQ ID NO: 1291815 - RNA, 18 nt, Human
caggaugagggaaaagaa

SEQ ID NO: 1291816 - RNA, 22 nt, Human
caggaugagggaaaagaaaaag

SEQ ID NO: 1291817 - RNA, 22 nt, Human
caggaugaugacuauggaaaga

SEQ ID NO: 1291818 - RNA, 23 nt, Human
caggaugcuaacaucuaaaaaua

SEQ ID NO: 1291819 - RNA, 18 nt, Human
caggauggucuccaucuc

SEQ ID NO: 1291820 - RNA, 14 nt, Human
caggauggcgcagg

SEQ ID NO: 1291821 - RNA, 23 nt, Human
caggaugggguauggauucuaaa

SEQ ID NO: 1291822 - RNA, 21 nt, Human
caggauggcaaccagaccauu

SEQ ID NO: 1291823 - RNA, 23 nt, Human
caggauggcgcaggaacucaaua

SEQ ID NO: 1291824 - RNA, 21 nt, Human
caggaugguucccuugaugaa

SEQ ID NO: 1291825 - RNA, 23 nt, Human
caggaugguucccuugaugaaga

SEQ ID NO: 1291826 - RNA, 19 nt, Human
caggauguacaaggacagc

SEQ ID NO: 1291827 - RNA, 15 nt, Human
caggauguguuugcu

SEQ ID NO: 1291828 - RNA, 18 nt, Human
caggauguguuugcuuuc

SEQ ID NO: 1291829 - RNA, 20 nt, Human
caggauguguuugcuuucug

SEQ ID NO: 1291830 - RNA, 21 nt, Human
caggccccgugaggcaauggg

SEQ ID NO: 1291831 - RNA, 16 nt, Human
caggcccccgccuugg

SEQ ID NO: 1291832 - RNA, 17 nt, Human
caggcccccgccuuggc

SEQ ID NO: 1291833 - RNA, 20 nt, Human
caggcccccgccuuggccug

SEQ ID NO: 1291834 - RNA, 21 nt, Human
caggcccccgccuuggccugu

SEQ ID NO: 1291835 - RNA, 17 nt, Human
caggcccccaccuggcu

SEQ ID NO: 1291836 - RNA, 18 nt, Human
caggcccccaccuggcuc

SEQ ID NO: 1291837 - RNA, 19 nt, Human
caggcccccaccuggcuca

SEQ ID NO: 1291838 - RNA, 21 nt, Human
caggccauuccccgucucugg

SEQ ID NO: 1291839 - RNA, 16 nt, Human
caggcccaaggcuccc

SEQ ID NO: 1291840 - RNA, 13 nt, Human
caggcccacagua

SEQ ID NO: 1291841 - RNA, 17 nt, Human
caggcccaaggcucccg

SEQ ID NO: 1291842 - RNA, 15 nt, Human
caggcccacugugcc

SEQ ID NO: 1291843 - RNA, 16 nt, Human
caggcccacugugccu

SEQ ID NO: 1291844 - RNA, 19 nt, Human
caggcccacugugccucag

SEQ ID NO: 1291845 - RNA, 17 nt, Human
caggcccacugugccuc

SEQ ID NO: 1291846 - RNA, 16 nt, Human
caggcccagccgaccc

SEQ ID NO: 1291847 - RNA, 19 nt, Human
caggcccagccgacccccu

SEQ ID NO: 1291848 - RNA, 20 nt, Human
caggcccagccgacccccuc

SEQ ID NO: 1291849 - RNA, 22 nt, Human
caggcccagccgacccccucuc

SEQ ID NO: 1291850 - RNA, 21 nt, Human
caggcccagccgacccccucu

SEQ ID NO: 1291851 - RNA, 15 nt, Human
caggccccaggaaag

SEQ ID NO: 1291852 - RNA, 14 nt, Human
caggccccaugacc

SEQ ID NO: 1291853 - RNA, 16 nt, Human
caggccccaugaccuc

SEQ ID NO: 1291854 - RNA, 17 nt, Human
caggccccaugaccucc

SEQ ID NO: 1291855 - RNA, 18 nt, Human
caggccccaugaccucca

SEQ ID NO: 1291856 - RNA, 19 nt, Human
caggccccaugaccuccag

SEQ ID NO: 1291857 - RNA, 20 nt, Human
caggccccaugaccuccagc

SEQ ID NO: 1291858 - RNA, 22 nt, Human
caggccccaugaccuccagcuu

SEQ ID NO: 1291859 - RNA, 17 nt, Human
caggcauuuccugggug

SEQ ID NO: 1291860 - RNA, 18 nt, Human
caggcauuuccugggugg

SEQ ID NO: 1291861 - RNA, 19 nt, Human
caggcauuuccuggguggc

SEQ ID NO: 1291862 - RNA, 22 nt, Human
caggccaaagagucuccaguuu

SEQ ID NO: 1291863 - RNA, 19 nt, Human
caggccaaaggggaccugg

SEQ ID NO: 1291864 - RNA, 21 nt, Human
caggccaaaggggaccuggaa

SEQ ID NO: 1291865 - RNA, 22 nt, Human
caggccaaaggggaccuggaag

SEQ ID NO: 1291866 - RNA, 17 nt, Human
caggccaagaaacgucu

SEQ ID NO: 1291867 - RNA, 16 nt, Human
caggccacacuucaaa

SEQ ID NO: 1291868 - RNA, 21 nt, Human
caggccacacuucaaacuacu

SEQ ID NO: 1291869 - RNA, 18 nt, Human
caggccacacuucaaacu

SEQ ID NO: 1291870 - RNA, 18 nt, Human
caggccauuccccgucuc

SEQ ID NO: 1291871 - RNA, 21 nt, Human
caggagcccugggaggcucug

SEQ ID NO: 1291872 - RNA, 11 nt, Human
caggagccugg

SEQ ID NO: 1291873 - RNA, 12 nt, Human
caggagccuggc

SEQ ID NO: 1291874 - RNA, 11 nt, Human
caggagccugu

SEQ ID NO: 1291875 - RNA, 15 nt, Human
caggagccugugccu

SEQ ID NO: 1291876 - RNA, 16 nt, Human
caggagccugugccuc

SEQ ID NO: 1291877 - RNA, 14 nt, Human
caggagccugugac

SEQ ID NO: 1291878 - RNA, 17 nt, Human
caggagcuaccugugug

SEQ ID NO: 1291879 - RNA, 18 nt, Human
caggagcuaccugugugg

SEQ ID NO: 1291880 - RNA, 22 nt, Human
caggagcuaccuguguggacag

SEQ ID NO: 1291881 - RNA, 23 nt, Human
caggagcuaccuguguggacagg

SEQ ID NO: 1291882 - RNA, 21 nt, Human
caggagcuccaguguccugag

SEQ ID NO: 1291883 - RNA, 23 nt, Human
caggagcuccaguguccugagcu

SEQ ID NO: 1291884 - RNA, 22 nt, Human
caggagcuccaguguccugagc

SEQ ID NO: 1291885 - RNA, 13 nt, Human
caggagcuccccu

SEQ ID NO: 1291886 - RNA, 14 nt, Human
caggagcuccccuc

SEQ ID NO: 1291887 - RNA, 16 nt, Human
caggagcuccccuccc

SEQ ID NO: 1291888 - RNA, 18 nt, Human
caggagcuccccucccca

SEQ ID NO: 1291889 - RNA, 21 nt, Human
caggagcuccccuccccaacu

SEQ ID NO: 1291890 - RNA, 22 nt, Human
caggagcuccccuccccaacug

SEQ ID NO: 1291891 - RNA, 13 nt, Human
caggaguagcuga

SEQ ID NO: 1291892 - RNA, 14 nt, Human
caggaguagcugag

SEQ ID NO: 1291893 - RNA, 15 nt, Human
caggaguagcugagc

SEQ ID NO: 1291894 - RNA, 16 nt, Human
caggaguagcugagcu

SEQ ID NO: 1291895 - RNA, 17 nt, Human
caggaguagcugagcuc

SEQ ID NO: 1291896 - RNA, 20 nt, Human
caggaguagcugagcucaca

SEQ ID NO: 1291897 - RNA, 18 nt, Human
caggaguagcugagcuca

SEQ ID NO: 1291898 - RNA, 14 nt, Human
caggaguccacuuu

SEQ ID NO: 1291899 - RNA, 18 nt, Human
caggaguccacuuuguuu

SEQ ID NO: 1291900 - RNA, 19 nt, Human
caggagcccugggaggcuc

SEQ ID NO: 1291901 - RNA, 18 nt, Human
caggagcccugggaggcu

SEQ ID NO: 1291902 - RNA, 16 nt, Human
caggagcccugggagg

SEQ ID NO: 1291903 - RNA, 14 nt, Human
caggagcccuggga

SEQ ID NO: 1291904 - RNA, 11 nt, Human
caggagcccug

SEQ ID NO: 1291905 - RNA, 19 nt, Human
caggagcacggcucugucc

SEQ ID NO: 1291906 - RNA, 23 nt, Human
caggagacagguuagcugcuccc

SEQ ID NO: 1291907 - RNA, 20 nt, Human
caggagaagcucagcugcau

SEQ ID NO: 1291908 - RNA, 17 nt, Human
caggagaagcucagcug

SEQ ID NO: 1291909 - RNA, 19 nt, Human
caggagaagcucagcugca

SEQ ID NO: 1291910 - RNA, 19 nt, Human
caggagaaggccaauuccu

SEQ ID NO: 1291911 - RNA, 21 nt, Human
caggagaaggccaauuccuau

SEQ ID NO: 1291912 - RNA, 22 nt, Human
caggagaaggccaauuccuaua

SEQ ID NO: 1291913 - RNA, 19 nt, Human
caggagagaguugaaccua

SEQ ID NO: 1291914 - RNA, 15 nt, Human
caggacuguuucaaa

SEQ ID NO: 1291915 - RNA, 17 nt, Human
caggacuguuucaaaca

SEQ ID NO: 1291916 - RNA, 22 nt, Human
caggacugggagcccccagccu

SEQ ID NO: 1291917 - RNA, 16 nt, Human
caggacuugaaagaaa

SEQ ID NO: 1291918 - RNA, 14 nt, Human
caggagaagaaaga

SEQ ID NO: 1291919 - RNA, 20 nt, Human
caggagaagaaagaggugac

SEQ ID NO: 1291920 - RNA, 21 nt, Human
caggagaagaaagaggugacc

SEQ ID NO: 1291921 - RNA, 13 nt, Human
caggagaagcuca

SEQ ID NO: 1291922 - RNA, 14 nt, Human
caggagaagcucag

SEQ ID NO: 1291923 - RNA, 15 nt, Human
caggagaagcucagc

SEQ ID NO: 1291924 - RNA, 16 nt, Human
caggagaagcucagcu

SEQ ID NO: 1291925 - RNA, 16 nt, Human
caggagcacggcucug

SEQ ID NO: 1291926 - RNA, 17 nt, Human
caggagcacggcucugu

SEQ ID NO: 1291927 - RNA, 12 nt, Human
caggacucugcc

SEQ ID NO: 1291928 - RNA, 13 nt, Human
caggacucugccu

SEQ ID NO: 1291929 - RNA, 15 nt, Human
caggacucugccucc

SEQ ID NO: 1291930 - RNA, 16 nt, Human
caggacucugccuccu

SEQ ID NO: 1291931 - RNA, 11 nt, Human
caggacucugc

SEQ ID NO: 1291932 - RNA, 13 nt, Human
caggacucugcag

SEQ ID NO: 1291933 - RNA, 14 nt, Human
caggacucugcagc

SEQ ID NO: 1291934 - RNA, 15 nt, Human
caggacucugcagcc

SEQ ID NO: 1291935 - RNA, 16 nt, Human
caggacucugcagccu

SEQ ID NO: 1291936 - RNA, 17 nt, Human
caggacucugcagccuc

SEQ ID NO: 1291937 - RNA, 18 nt, Human
caggacucugcagccuca

SEQ ID NO: 1291938 - RNA, 19 nt, Human
caggacucugcagccucag

SEQ ID NO: 1291939 - RNA, 20 nt, Human
caggacucugcagccucaga

SEQ ID NO: 1291940 - RNA, 21 nt, Human
caggacucugcagccucagag

SEQ ID NO: 1291941 - RNA, 12 nt, Human
caggacugaugu

SEQ ID NO: 1291942 - RNA, 17 nt, Human
caggacugaugucuccu

SEQ ID NO: 1291943 - RNA, 23 nt, Human
caggacugaugucuccuaagcac

SEQ ID NO: 1291944 - RNA, 18 nt, Human
caggacugaugucuccua

SEQ ID NO: 1291945 - RNA, 13 nt, Human
caggacugggagc

SEQ ID NO: 1291946 - RNA, 14 nt, Human
caggacugggagcc

SEQ ID NO: 1291947 - RNA, 18 nt, Human
caggacugggagccccca

SEQ ID NO: 1291948 - RNA, 21 nt, Human
caggacugggagcccccagcc

SEQ ID NO: 1291949 - RNA, 23 nt, Human
caggacugggagcccccagccug

SEQ ID NO: 1291950 - RNA, 17 nt, Human
caggacuaacacucaga

SEQ ID NO: 1291951 - RNA, 19 nt, Human
caggacuaacacucagaag

SEQ ID NO: 1291952 - RNA, 20 nt, Human
caggacuaacacucagaagc

SEQ ID NO: 1291953 - RNA, 21 nt, Human
caggacuaacacucagaagcc

SEQ ID NO: 1291954 - RNA, 22 nt, Human
caggacuaacacucagaagccu

SEQ ID NO: 1291955 - RNA, 23 nt, Human
caggacuaacacucagaagccug

SEQ ID NO: 1291956 - RNA, 20 nt, Human
caggacuauauuugggccug

SEQ ID NO: 1291957 - RNA, 16 nt, Human
caggacuccaggccca

SEQ ID NO: 1291958 - RNA, 17 nt, Human
caggacuccaggcccaa

SEQ ID NO: 1291959 - RNA, 18 nt, Human
caggacuccaggcccaag

SEQ ID NO: 1291960 - RNA, 21 nt, Human
caggacuccaggcccaaggcu

SEQ ID NO: 1291961 - RNA, 19 nt, Human
caggacuccaggcccaagg

SEQ ID NO: 1291962 - RNA, 19 nt, Human
caggaguuucguuuucaaa

SEQ ID NO: 1291963 - RNA, 16 nt, Human
caggaguuggaagugu

SEQ ID NO: 1291964 - RNA, 18 nt, Human
caggaguggguggggagu

SEQ ID NO: 1291965 - RNA, 14 nt, Human
caggaguggguggg

SEQ ID NO: 1291966 - RNA, 16 nt, Human
caggagugggugggga

SEQ ID NO: 1291967 - RNA, 17 nt, Human
caggaguggguggggag

SEQ ID NO: 1291968 - RNA, 17 nt, Human
caggaguguccucuucc

SEQ ID NO: 1291969 - RNA, 19 nt, Human
caggaguguccucuucccu

SEQ ID NO: 1291970 - RNA, 21 nt, Human
caggaguguccucuucccucu

SEQ ID NO: 1291971 - RNA, 13 nt, Human
caggagugugugu

SEQ ID NO: 1291972 - RNA, 13 nt, Human
caggauagacuuu

SEQ ID NO: 1291973 - RNA, 19 nt, Human
caggauagagacuggaaca

SEQ ID NO: 1291974 - RNA, 15 nt, Human
caggauacuggcaca

SEQ ID NO: 1291975 - RNA, 17 nt, Human
caggauacuggcacaga

SEQ ID NO: 1291976 - RNA, 18 nt, Human
caggauacuggcacagag

SEQ ID NO: 1291977 - RNA, 19 nt, Human
caggauacuggcacagagg

SEQ ID NO: 1291978 - RNA, 20 nt, Human
caggauacuggcacagaggu

SEQ ID NO: 1291979 - RNA, 19 nt, Human
caggaucucaccaggcagc

SEQ ID NO: 1291980 - RNA, 18 nt, Human
caggaagaucccccagaa

SEQ ID NO: 1291981 - RNA, 17 nt, Human
caggaagaucccccaga

SEQ ID NO: 1291982 - RNA, 17 nt, Human
caggaagagaaggagca

SEQ ID NO: 1291983 - RNA, 15 nt, Human
caggaagagaaggag

SEQ ID NO: 1291984 - RNA, 14 nt, Human
caggaagagaagga

SEQ ID NO: 1291985 - RNA, 19 nt, Human
caggaagaucccccagaaa

SEQ ID NO: 1291986 - RNA, 14 nt, Human
caggaagcagcuuu

SEQ ID NO: 1291987 - RNA, 15 nt, Human
caggaaccgaggcag

SEQ ID NO: 1291988 - RNA, 17 nt, Human
caggaaccgaggcaggg

SEQ ID NO: 1291989 - RNA, 18 nt, Human
caggaaccgaggcaggga

SEQ ID NO: 1291990 - RNA, 15 nt, Human
caggaacguuuagcu

SEQ ID NO: 1291991 - RNA, 12 nt, Human
caggaacugggc

SEQ ID NO: 1291992 - RNA, 13 nt, Human
caggaacugggcc

SEQ ID NO: 1291993 - RNA, 16 nt, Human
caggaagcccaauugc

SEQ ID NO: 1291994 - RNA, 18 nt, Human
caggaagcccaauugcug

SEQ ID NO: 1291995 - RNA, 15 nt, Human
caggaagccguccug

SEQ ID NO: 1291996 - RNA, 18 nt, Human
caggaagccguccuggcg

SEQ ID NO: 1291997 - RNA, 13 nt, Human
caggaagccugca

SEQ ID NO: 1291998 - RNA, 19 nt, Human
caggaagccugcaguccug

SEQ ID NO: 1291999 - RNA, 21 nt, Human
caggaagccugcaguccugga

SEQ ID NO: 1292000 - RNA, 14 nt, Human
caggaagccuuccc

SEQ ID NO: 1292001 - RNA, 21 nt, Human
caggaagcuuuggugagaacc

SEQ ID NO: 1292002 - RNA, 23 nt, Human
caggaagcuuuggugagaaccug

SEQ ID NO: 1292003 - RNA, 22 nt, Human
caggaagcuuuggugagaaccu

SEQ ID NO: 1292004 - RNA, 16 nt, Human
caggaaggacuaugaa

SEQ ID NO: 1292005 - RNA, 19 nt, Human
caggaaggacuaugaaaag

SEQ ID NO: 1292006 - RNA, 21 nt, Human
caggaaucaguuuaaaagcac

SEQ ID NO: 1292007 - RNA, 16 nt, Human
caggaaucaguuuaaa

SEQ ID NO: 1292008 - RNA, 14 nt, Human
caggaaucuuaagg

SEQ ID NO: 1292009 - RNA, 15 nt, Human
caggaaucuuaaggu

SEQ ID NO: 1292010 - RNA, 16 nt, Human
caggaauuucccagga

SEQ ID NO: 1292011 - RNA, 17 nt, Human
caggaauuucccaggac

SEQ ID NO: 1292012 - RNA, 18 nt, Human
caggaauuucccaggacc

SEQ ID NO: 1292013 - RNA, 19 nt, Human
caggaauuucccaggaccc

SEQ ID NO: 1292014 - RNA, 20 nt, Human
caggaauuucccaggacccu

SEQ ID NO: 1292015 - RNA, 21 nt, Human
caggaauuucccaggacccug

SEQ ID NO: 1292016 - RNA, 21 nt, Human
caggaauucuuggagaaaaug

SEQ ID NO: 1292017 - RNA, 14 nt, Human
caggacaagcaugg

SEQ ID NO: 1292018 - RNA, 12 nt, Human
caggacacaggc

SEQ ID NO: 1292019 - RNA, 13 nt, Human
caggacacaggcc

SEQ ID NO: 1292020 - RNA, 14 nt, Human
caggacacaggccu

SEQ ID NO: 1292021 - RNA, 15 nt, Human
caggacacaggccug

SEQ ID NO: 1292022 - RNA, 16 nt, Human
caggacacaggccugu

SEQ ID NO: 1292023 - RNA, 17 nt, Human
caggacacaggccugug

SEQ ID NO: 1292024 - RNA, 18 nt, Human
caggacacaggccugugu

SEQ ID NO: 1292025 - RNA, 19 nt, Human
caggacacaggccugugua

SEQ ID NO: 1292026 - RNA, 20 nt, Human
caggacacaggccuguguag

SEQ ID NO: 1292027 - RNA, 22 nt, Human
caggacacaggccuguguagcu

SEQ ID NO: 1292028 - RNA, 14 nt, Human
caggaccuggcugc

SEQ ID NO: 1292029 - RNA, 16 nt, Human
caggaccuggcugcca

SEQ ID NO: 1292030 - RNA, 17 nt, Human
caggaccuggcugccau

SEQ ID NO: 1292031 - RNA, 18 nt, Human
caggaccuggcugccaua

SEQ ID NO: 1292032 - RNA, 20 nt, Human
caggaccuucgggcugugcc

SEQ ID NO: 1292033 - RNA, 21 nt, Human
caggaccuucgggcugugccc

SEQ ID NO: 1292034 - RNA, 22 nt, Human
caggaccuucgggcugugcccg

SEQ ID NO: 1292035 - RNA, 19 nt, Human
caggaaggcugagaggaga

SEQ ID NO: 1292036 - RNA, 20 nt, Human
caggaaggagcugccuggac

SEQ ID NO: 1292037 - RNA, 21 nt, Human
caggaaggagcugccuggacc

SEQ ID NO: 1292038 - RNA, 22 nt, Human
caggaaggagcugccuggaccc

SEQ ID NO: 1292039 - RNA, 13 nt, Human
caggaaggcuugu

SEQ ID NO: 1292040 - RNA, 12 nt, Human
caggaaggagcu

SEQ ID NO: 1292041 - RNA, 13 nt, Human
caggaaggagcug

SEQ ID NO: 1292042 - RNA, 14 nt, Human
caggaaggagcugc

SEQ ID NO: 1292043 - RNA, 15 nt, Human
caggaaggagcugcc

SEQ ID NO: 1292044 - RNA, 16 nt, Human
caggaaggagcugccu

SEQ ID NO: 1292045 - RNA, 17 nt, Human
caggaaggagcugccug

SEQ ID NO: 1292046 - RNA, 18 nt, Human
caggaaggagcugccugg

SEQ ID NO: 1292047 - RNA, 19 nt, Human
caggaaggagcugccugga

SEQ ID NO: 1292048 - RNA, 22 nt, Human
caggaaggcuuguugugcuuuu

SEQ ID NO: 1292049 - RNA, 15 nt, Human
caggaaguagaggag

SEQ ID NO: 1292050 - RNA, 16 nt, Human
caggaaguagaggagg

SEQ ID NO: 1292051 - RNA, 17 nt, Human
caggaauauuuuccaaa

SEQ ID NO: 1292052 - RNA, 19 nt, Human
cagcuguaugauucccagc

SEQ ID NO: 1292053 - RNA, 16 nt, Human
cagcuguaaucuauga

SEQ ID NO: 1292054 - RNA, 14 nt, Human
cagcuguauagcug

SEQ ID NO: 1292055 - RNA, 13 nt, Human
cagcuuccuucag

SEQ ID NO: 1292056 - RNA, 14 nt, Human
cagcuuccuucaga

SEQ ID NO: 1292057 - RNA, 15 nt, Human
cagcuuccuucagag

SEQ ID NO: 1292058 - RNA, 16 nt, Human
cagcuuccuucagaga

SEQ ID NO: 1292059 - RNA, 19 nt, Human
cagcuuccuucagagagca

SEQ ID NO: 1292060 - RNA, 20 nt, Human
cagcuuccuucagagagcag

SEQ ID NO: 1292061 - RNA, 20 nt, Human
cagcuucguuuauuuucaag

SEQ ID NO: 1292062 - RNA, 22 nt, Human
cagcuucguuuauuuucaagaa

SEQ ID NO: 1292063 - RNA, 18 nt, Human
cagcuucucauccugcag

SEQ ID NO: 1292064 - RNA, 19 nt, Human
cagcuucucauccugcagg

SEQ ID NO: 1292065 - RNA, 20 nt, Human
cagcuucucauccugcaggc

SEQ ID NO: 1292066 - RNA, 21 nt, Human
cagcuucucauccugcaggca

SEQ ID NO: 1292067 - RNA, 21 nt, Human
cagcuuccuucagagagcagu

SEQ ID NO: 1292068 - RNA, 14 nt, Human
cagcuucugccccc

SEQ ID NO: 1292069 - RNA, 16 nt, Human
cagcuucugcccccug

SEQ ID NO: 1292070 - RNA, 20 nt, Human
cagcuucugcccccugcaga

SEQ ID NO: 1292071 - RNA, 19 nt, Human
cagcuucugcccccugcag

SEQ ID NO: 1292072 - RNA, 15 nt, Human
cagcuugaccugagg

SEQ ID NO: 1292073 - RNA, 16 nt, Human
cagcuugaccugaggc

SEQ ID NO: 1292074 - RNA, 17 nt, Human
cagcuugaccugaggcu

SEQ ID NO: 1292075 - RNA, 19 nt, Human
cagcuugaccugaggcugu

SEQ ID NO: 1292076 - RNA, 20 nt, Human
cagcuugaccugaggcugug

SEQ ID NO: 1292077 - RNA, 21 nt, Human
cagcuugaccugaggcugugg

SEQ ID NO: 1292078 - RNA, 22 nt, Human
cagcuugaccugaggcuguggu

SEQ ID NO: 1292079 - RNA, 23 nt, Human
cagcuugaccugaggcugugguc

SEQ ID NO: 1292080 - RNA, 20 nt, Human
cagcuuuucccaaaagccca

SEQ ID NO: 1292081 - RNA, 18 nt, Human
cagcuuuucccaaaagcc

SEQ ID NO: 1292082 - RNA, 13 nt, Human
cagcuuuucaaac

SEQ ID NO: 1292083 - RNA, 18 nt, Human
cagcuuuuaaaagauuuu

SEQ ID NO: 1292084 - RNA, 11 nt, Human
cagcuuuucaa

SEQ ID NO: 1292085 - RNA, 23 nt, Human
cagcuuuuggauuggacaaaaug

SEQ ID NO: 1292086 - RNA, 17 nt, Human
cagcuuuuuaccaaguu

SEQ ID NO: 1292087 - RNA, 12 nt, Human
cagcuuuugcaa

SEQ ID NO: 1292088 - RNA, 18 nt, Human
caggaaccacaagacugc

SEQ ID NO: 1292089 - RNA, 14 nt, Human
cagcuuugauauuu

SEQ ID NO: 1292090 - RNA, 20 nt, Human
cagcuuugcucauauuuccc

SEQ ID NO: 1292091 - RNA, 21 nt, Human
cagcuuugcucauauuuccca

SEQ ID NO: 1292092 - RNA, 16 nt, Human
cagcuuugcucauauu

SEQ ID NO: 1292093 - RNA, 22 nt, Human
cagcuuugcuaccaaagcaccu

SEQ ID NO: 1292094 - RNA, 11 nt, Human
cagcuuugcua

SEQ ID NO: 1292095 - RNA, 14 nt, Human
cagcuuuagccaag

SEQ ID NO: 1292096 - RNA, 18 nt, Human
cagcuuguuuacaugcuu

SEQ ID NO: 1292097 - RNA, 22 nt, Human
cagcuuuaaaaaauuaaucugg

SEQ ID NO: 1292098 - RNA, 14 nt, Human
cagcuuguuuacau

SEQ ID NO: 1292099 - RNA, 15 nt, Human
cagcuuguuuacaug

SEQ ID NO: 1292100 - RNA, 21 nt, Human
cagcuuguuuacaugcuuauu

SEQ ID NO: 1292101 - RNA, 18 nt, Human
cagcuuguggcaagugaa

SEQ ID NO: 1292102 - RNA, 20 nt, Human
cagcuuguggcaagugaauu

SEQ ID NO: 1292103 - RNA, 21 nt, Human
cagcuuguggcaagugaauuu

SEQ ID NO: 1292104 - RNA, 13 nt, Human
cagcuuguuuaca

SEQ ID NO: 1292105 - RNA, 21 nt, Human
cagcuuuauggagauauaauu

SEQ ID NO: 1292106 - RNA, 18 nt, Human
cagcuuuagaaucccagc

SEQ ID NO: 1292107 - RNA, 23 nt, Human
cagcuuuccccaugucucgacuc

SEQ ID NO: 1292108 - RNA, 23 nt, Human
cagcuuuccucaaaacuucagac

SEQ ID NO: 1292109 - RNA, 17 nt, Human
cagcuuucccugccucu

SEQ ID NO: 1292110 - RNA, 19 nt, Human
cagcuuucccugccucuca

SEQ ID NO: 1292111 - RNA, 14 nt, Human
cagcuuuccuguau

SEQ ID NO: 1292112 - RNA, 12 nt, Human
cagcuuguagcc

SEQ ID NO: 1292113 - RNA, 15 nt, Human
cagcuuguagccagc

SEQ ID NO: 1292114 - RNA, 16 nt, Human
cagcuuguagccagcc

SEQ ID NO: 1292115 - RNA, 17 nt, Human
cagcuuguagccagccg

SEQ ID NO: 1292116 - RNA, 18 nt, Human
cagcuuguagccagccgg

SEQ ID NO: 1292117 - RNA, 21 nt, Human
cagcuuguagccagccggggc

SEQ ID NO: 1292118 - RNA, 19 nt, Human
cagcuuguagccagccggg

SEQ ID NO: 1292119 - RNA, 18 nt, Human
cagcucucaguugcagcc

SEQ ID NO: 1292120 - RNA, 15 nt, Human
cagcucuacuggucu

SEQ ID NO: 1292121 - RNA, 20 nt, Human
cagcucuagacacugccaca

SEQ ID NO: 1292122 - RNA, 13 nt, Human
cagcuccuuccug

SEQ ID NO: 1292123 - RNA, 14 nt, Human
cagcuccuuccugg

SEQ ID NO: 1292124 - RNA, 16 nt, Human
cagcuccuuccuggag

SEQ ID NO: 1292125 - RNA, 13 nt, Human
cagcuccuuuggg

SEQ ID NO: 1292126 - RNA, 18 nt, Human
cagcucugaaaccagugu

SEQ ID NO: 1292127 - RNA, 19 nt, Human
cagcucugaaaccaguguu

SEQ ID NO: 1292128 - RNA, 12 nt, Human
cagcucugaaag

SEQ ID NO: 1292129 - RNA, 16 nt, Human
cagcucugaaagagaa

SEQ ID NO: 1292130 - RNA, 14 nt, Human
cagcucugacauuc

SEQ ID NO: 1292131 - RNA, 20 nt, Human
cagcucugacauucugauuc

SEQ ID NO: 1292132 - RNA, 20 nt, Human
cagcucugcauacucauuag

SEQ ID NO: 1292133 - RNA, 21 nt, Human
cagcucugacauucugauucg

SEQ ID NO: 1292134 - RNA, 17 nt, Human
cagcucuggacagcccc

SEQ ID NO: 1292135 - RNA, 18 nt, Human
cagcucuggacagcccca

SEQ ID NO: 1292136 - RNA, 21 nt, Human
cagcucuggacagccccaccc

SEQ ID NO: 1292137 - RNA, 23 nt, Human
cagcucuggacagccccacccug

SEQ ID NO: 1292138 - RNA, 11 nt, Human
cagcucuggag

SEQ ID NO: 1292139 - RNA, 12 nt, Human
cagcucagcacu

SEQ ID NO: 1292140 - RNA, 14 nt, Human
cagcucagcacugc

SEQ ID NO: 1292141 - RNA, 15 nt, Human
cagcucagcacugcc

SEQ ID NO: 1292142 - RNA, 20 nt, Human
cagcucagcacugccugcuc

SEQ ID NO: 1292143 - RNA, 21 nt, Human
cagcucagcacugccugcucc

SEQ ID NO: 1292144 - RNA, 12 nt, Human
cagcucaggaca

SEQ ID NO: 1292145 - RNA, 13 nt, Human
cagcucaggacag

SEQ ID NO: 1292146 - RNA, 16 nt, Human
cagcucaggacagaug

SEQ ID NO: 1292147 - RNA, 18 nt, Human
cagcucaggacagaugcc

SEQ ID NO: 1292148 - RNA, 19 nt, Human
cagcucaggacagaugcca

SEQ ID NO: 1292149 - RNA, 22 nt, Human
cagcucaggacagaugccacac

SEQ ID NO: 1292150 - RNA, 22 nt, Human
cagcucauccaugccucagaag

SEQ ID NO: 1292151 - RNA, 21 nt, Human
cagcucauccaugccucagaa

SEQ ID NO: 1292152 - RNA, 14 nt, Human
cagcuccaaccugc

SEQ ID NO: 1292153 - RNA, 15 nt, Human
cagcuccucugucuc

SEQ ID NO: 1292154 - RNA, 18 nt, Human
cagcuccucugucucgag

SEQ ID NO: 1292155 - RNA, 19 nt, Human
cagcuccucugucucgagc

SEQ ID NO: 1292156 - RNA, 15 nt, Human
cagcuccugaccagu

SEQ ID NO: 1292157 - RNA, 19 nt, Human
cagcuccugaccaguugca

SEQ ID NO: 1292158 - RNA, 20 nt, Human
cagcuccugaccaguugcag

SEQ ID NO: 1292159 - RNA, 22 nt, Human
cagcuccugaccaguugcaguc

SEQ ID NO: 1292160 - RNA, 15 nt, Human
cagcuccuguaacau

SEQ ID NO: 1292161 - RNA, 18 nt, Human
cagcucuggaggggaggg

SEQ ID NO: 1292162 - RNA, 12 nt, Human
cagcucugggcc

SEQ ID NO: 1292163 - RNA, 19 nt, Human
cagcucugggccauucucc

SEQ ID NO: 1292164 - RNA, 22 nt, Human
cagcucugggccauucuccaca

SEQ ID NO: 1292165 - RNA, 23 nt, Human
cagcucugggccauucuccacag

SEQ ID NO: 1292166 - RNA, 16 nt, Human
cagcucuguucuuccu

SEQ ID NO: 1292167 - RNA, 20 nt, Human
cagcucuguucuuccucagc

SEQ ID NO: 1292168 - RNA, 21 nt, Human
cagcucuguucuuccucagcc

SEQ ID NO: 1292169 - RNA, 22 nt, Human
cagcucuguucuuccucagcca

SEQ ID NO: 1292170 - RNA, 23 nt, Human
cagcucuguucuuccucagccag

SEQ ID NO: 1292171 - RNA, 22 nt, Human
cagcuggggccaggcugggucg

SEQ ID NO: 1292172 - RNA, 21 nt, Human
cagcuggggccaggcuggguc

SEQ ID NO: 1292173 - RNA, 14 nt, Human
cagcuggggugcag

SEQ ID NO: 1292174 - RNA, 15 nt, Human
cagcuggggugcagg

SEQ ID NO: 1292175 - RNA, 16 nt, Human
cagcuggggugcaggg

SEQ ID NO: 1292176 - RNA, 17 nt, Human
cagcuggggugcaggga

SEQ ID NO: 1292177 - RNA, 18 nt, Human
cagcuggggugcagggau

SEQ ID NO: 1292178 - RNA, 19 nt, Human
cagcuggggugcagggaug

SEQ ID NO: 1292179 - RNA, 14 nt, Human
cagcugggucaggc

SEQ ID NO: 1292180 - RNA, 15 nt, Human
cagcugggucaggca

SEQ ID NO: 1292181 - RNA, 16 nt, Human
cagcugggucaggcag

SEQ ID NO: 1292182 - RNA, 18 nt, Human
cagcugggucaggcaggg

SEQ ID NO: 1292183 - RNA, 20 nt, Human
cagcugggucaggcagggug

SEQ ID NO: 1292184 - RNA, 23 nt, Human
cagcuggggugcagggauguggg

SEQ ID NO: 1292185 - RNA, 17 nt, Human
cagcuggguuggaaaac

SEQ ID NO: 1292186 - RNA, 16 nt, Human
cagcuggguuggaaaa

SEQ ID NO: 1292187 - RNA, 18 nt, Human
cagcuguaugauucccag

SEQ ID NO: 1292188 - RNA, 20 nt, Human
cagcugguguagcuacagag

SEQ ID NO: 1292189 - RNA, 21 nt, Human
cagcugguguagcuacagaga

SEQ ID NO: 1292190 - RNA, 22 nt, Human
cagcugguguagcuacagagaa

SEQ ID NO: 1292191 - RNA, 23 nt, Human
cagcugguguagcuacagagaaa

SEQ ID NO: 1292192 - RNA, 11 nt, Human
cagcuggugua

SEQ ID NO: 1292193 - RNA, 14 nt, Human
cagcugguguagcu

SEQ ID NO: 1292194 - RNA, 15 nt, Human
cagcugguguagcua

SEQ ID NO: 1292195 - RNA, 19 nt, Human
cagcugguguagcuacaga

SEQ ID NO: 1292196 - RNA, 20 nt, Human
cagcuggggccaggcugggu

SEQ ID NO: 1292197 - RNA, 19 nt, Human
cagcuggggccaggcuggg

SEQ ID NO: 1292198 - RNA, 18 nt, Human
cagcuggggccaggcugg

SEQ ID NO: 1292199 - RNA, 17 nt, Human
cagcugggcucugcaau

SEQ ID NO: 1292200 - RNA, 23 nt, Human
cagcugggaucacauguggacuu

SEQ ID NO: 1292201 - RNA, 15 nt, Human
cagcugggcucugca

SEQ ID NO: 1292202 - RNA, 16 nt, Human
cagcugggcucugcaa

SEQ ID NO: 1292203 - RNA, 12 nt, Human
cagcuggcucua

SEQ ID NO: 1292204 - RNA, 16 nt, Human
cagcuggcucuacuuc

SEQ ID NO: 1292205 - RNA, 22 nt, Human
cagcuggcucuacuuccccaug

SEQ ID NO: 1292206 - RNA, 18 nt, Human
cagcuggcucuacuuccc

SEQ ID NO: 1292207 - RNA, 19 nt, Human
cagcuggccgggagccuga

SEQ ID NO: 1292208 - RNA, 23 nt, Human
cagcuggaugagaauuugagugc

SEQ ID NO: 1292209 - RNA, 16 nt, Human
cagcuggacccugacc

SEQ ID NO: 1292210 - RNA, 17 nt, Human
cagcuggacccugacca

SEQ ID NO: 1292211 - RNA, 23 nt, Human
cagcuggacccugaccagcuccc

SEQ ID NO: 1292212 - RNA, 16 nt, Human
cagcuggagaagaccc

SEQ ID NO: 1292213 - RNA, 18 nt, Human
cagcuggacccugaccag

SEQ ID NO: 1292214 - RNA, 13 nt, Human
cagcuggaggcag

SEQ ID NO: 1292215 - RNA, 14 nt, Human
cagcuggaggcagg

SEQ ID NO: 1292216 - RNA, 15 nt, Human
cagcuggaggcaggg

SEQ ID NO: 1292217 - RNA, 22 nt, Human
cagcuggaggcaggggcuuccu

SEQ ID NO: 1292218 - RNA, 23 nt, Human
cagcuggaggcaggggcuuccug

SEQ ID NO: 1292219 - RNA, 21 nt, Human
cagcugcucaauaaaguacaa

SEQ ID NO: 1292220 - RNA, 23 nt, Human
cagcugcuccgaggacccaggaa

SEQ ID NO: 1292221 - RNA, 13 nt, Human
cagcugacuaaac

SEQ ID NO: 1292222 - RNA, 18 nt, Human
cagcugacuaaacuuuuu

SEQ ID NO: 1292223 - RNA, 16 nt, Human
cagccuucuacugcuc

SEQ ID NO: 1292224 - RNA, 19 nt, Human
cagccuuagcucucccaac

SEQ ID NO: 1292225 - RNA, 23 nt, Human
cagccuucagacagagaggacug

SEQ ID NO: 1292226 - RNA, 21 nt, Human
cagccuuagcucucccaacuc

SEQ ID NO: 1292227 - RNA, 13 nt, Human
cagccuugccaga

SEQ ID NO: 1292228 - RNA, 14 nt, Human
cagccuugccagag

SEQ ID NO: 1292229 - RNA, 15 nt, Human
cagccuugccagaga

SEQ ID NO: 1292230 - RNA, 16 nt, Human
cagccuugccagagau

SEQ ID NO: 1292231 - RNA, 14 nt, Human
cagccuuuguuccc

SEQ ID NO: 1292232 - RNA, 15 nt, Human
cagccuuuguucccc

SEQ ID NO: 1292233 - RNA, 16 nt, Human
cagccuuuguucccca

SEQ ID NO: 1292234 - RNA, 18 nt, Human
cagccuuuguuccccacu

SEQ ID NO: 1292235 - RNA, 20 nt, Human
cagccuuuguuccccacugg

SEQ ID NO: 1292236 - RNA, 21 nt, Human
cagccuuuguuccccacugga

SEQ ID NO: 1292237 - RNA, 22 nt, Human
cagccuuuguuccccacuggag

SEQ ID NO: 1292238 - RNA, 23 nt, Human
cagccuuuguuccccacuggagc

SEQ ID NO: 1292239 - RNA, 20 nt, Human
cagccuuuuuguuucaauga

SEQ ID NO: 1292240 - RNA, 12 nt, Human
cagccugggaaa

SEQ ID NO: 1292241 - RNA, 20 nt, Human
cagccugggaaagccccugc

SEQ ID NO: 1292242 - RNA, 11 nt, Human
cagccugggcc

SEQ ID NO: 1292243 - RNA, 12 nt, Human
cagccugggccu

SEQ ID NO: 1292244 - RNA, 13 nt, Human
cagccugggccua

SEQ ID NO: 1292245 - RNA, 16 nt, Human
cagccugggccuaugg

SEQ ID NO: 1292246 - RNA, 17 nt, Human
cagccugggccuaugga

SEQ ID NO: 1292247 - RNA, 18 nt, Human
cagccugggccuauggag

SEQ ID NO: 1292248 - RNA, 20 nt, Human
cagccugggccuauggagag

SEQ ID NO: 1292249 - RNA, 21 nt, Human
cagccugggccuauggagagc

SEQ ID NO: 1292250 - RNA, 23 nt, Human
cagccugggccuauggagagccc

SEQ ID NO: 1292251 - RNA, 22 nt, Human
cagccugggccuauggagagcc

SEQ ID NO: 1292252 - RNA, 14 nt, Human
cagccugggcgcug

SEQ ID NO: 1292253 - RNA, 15 nt, Human
cagccugggcgcugg

SEQ ID NO: 1292254 - RNA, 16 nt, Human
cagccugggcgcuggu

SEQ ID NO: 1292255 - RNA, 19 nt, Human
cagccugggcgcugguccu

SEQ ID NO: 1292256 - RNA, 20 nt, Human
cagccugggcgcugguccuu

SEQ ID NO: 1292257 - RNA, 23 nt, Human
cagccugggcgcugguccuuucu

SEQ ID NO: 1292258 - RNA, 17 nt, Human
cagccuggggcuggccu

SEQ ID NO: 1292259 - RNA, 18 nt, Human
cagccuggggcuggccuc

SEQ ID NO: 1292260 - RNA, 21 nt, Human
cagccuggggcuggccuccca

SEQ ID NO: 1292261 - RNA, 15 nt, Human
cagccuggggucugg

SEQ ID NO: 1292262 - RNA, 19 nt, Human
cagccuggggucuggaguu

SEQ ID NO: 1292263 - RNA, 16 nt, Human
cagccugucagaucca

SEQ ID NO: 1292264 - RNA, 17 nt, Human
cagccugucagauccag

SEQ ID NO: 1292265 - RNA, 21 nt, Human
cagccugucagauccaggagc

SEQ ID NO: 1292266 - RNA, 22 nt, Human
cagccugucagauccaggagcu

SEQ ID NO: 1292267 - RNA, 23 nt, Human
cagccugucagauccaggagcuc

SEQ ID NO: 1292268 - RNA, 21 nt, Human
cagccucgccccuggcagaga

SEQ ID NO: 1292269 - RNA, 15 nt, Human
cagccuccugaguag

SEQ ID NO: 1292270 - RNA, 19 nt, Human
cagccucgccccuggcaga

SEQ ID NO: 1292271 - RNA, 20 nt, Human
cagccucgccccuggcagag

SEQ ID NO: 1292272 - RNA, 12 nt, Human
cagccucccuga

SEQ ID NO: 1292273 - RNA, 14 nt, Human
cagccucccugaag

SEQ ID NO: 1292274 - RNA, 16 nt, Human
cagccucccugaagcc

SEQ ID NO: 1292275 - RNA, 17 nt, Human
cagccucccugaagccu

SEQ ID NO: 1292276 - RNA, 18 nt, Human
cagccucccugaagccuu

SEQ ID NO: 1292277 - RNA, 23 nt, Human
cagccucuccacucaugugacuc

SEQ ID NO: 1292278 - RNA, 10 nt, Human
cagccuggca

SEQ ID NO: 1292279 - RNA, 13 nt, Human
cagccuggcacag

SEQ ID NO: 1292280 - RNA, 20 nt, Human
cagccuggcacagggcagug

SEQ ID NO: 1292281 - RNA, 21 nt, Human
cagccuggcacagggcagugg

SEQ ID NO: 1292282 - RNA, 23 nt, Human
cagccuggcuguggccuaaccug

SEQ ID NO: 1292283 - RNA, 15 nt, Human
cagccuggccuccug

SEQ ID NO: 1292284 - RNA, 16 nt, Human
cagccuggccuccugc

SEQ ID NO: 1292285 - RNA, 17 nt, Human
cagccuggccuccugcc

SEQ ID NO: 1292286 - RNA, 18 nt, Human
cagccuggccuccugccu

SEQ ID NO: 1292287 - RNA, 21 nt, Human
cagccuggccuccugccucua

SEQ ID NO: 1292288 - RNA, 20 nt, Human
cagccuggccuccugccucu

SEQ ID NO: 1292289 - RNA, 13 nt, Human
cagccuggccaga

SEQ ID NO: 1292290 - RNA, 14 nt, Human
cagccuggccagac

SEQ ID NO: 1292291 - RNA, 15 nt, Human
cagccuggccagaca

SEQ ID NO: 1292292 - RNA, 17 nt, Human
cagccuggccagacaca

SEQ ID NO: 1292293 - RNA, 18 nt, Human
cagccuggccagacacag

SEQ ID NO: 1292294 - RNA, 20 nt, Human
cagccuggccagacacaggc

SEQ ID NO: 1292295 - RNA, 12 nt, Human
cagccuggccca

SEQ ID NO: 1292296 - RNA, 20 nt, Human
cagccuggcccaccccaccc

SEQ ID NO: 1292297 - RNA, 11 nt, Human
cagccuggccu

SEQ ID NO: 1292298 - RNA, 12 nt, Human
cagccuggccuc

SEQ ID NO: 1292299 - RNA, 13 nt, Human
cagccuggccucc

SEQ ID NO: 1292300 - RNA, 14 nt, Human
cagccuggccuccu

SEQ ID NO: 1292301 - RNA, 15 nt, Human
cagcucacugcaacc

SEQ ID NO: 1292302 - RNA, 21 nt, Human
cagcucacugcaaccuucgcc

SEQ ID NO: 1292303 - RNA, 21 nt, Human
cagcucagaaguuucuucuuu

SEQ ID NO: 1292304 - RNA, 22 nt, Human
cagcucagaaguuucuucuuua

SEQ ID NO: 1292305 - RNA, 13 nt, Human
cagcucacugcaa

SEQ ID NO: 1292306 - RNA, 14 nt, Human
cagcucacugcaac

SEQ ID NO: 1292307 - RNA, 12 nt, Human
cagcucacugca

SEQ ID NO: 1292308 - RNA, 20 nt, Human
cagcucaauggacuggaagg

SEQ ID NO: 1292309 - RNA, 22 nt, Human
cagcucaagagaucccaaguag

SEQ ID NO: 1292310 - RNA, 16 nt, Human
cagcucaauggacugg

SEQ ID NO: 1292311 - RNA, 20 nt, Human
cagcuauguuauauugaaaa

SEQ ID NO: 1292312 - RNA, 21 nt, Human
cagcuauguuauauugaaaaa

SEQ ID NO: 1292313 - RNA, 14 nt, Human
cagcuauuuuguga

SEQ ID NO: 1292314 - RNA, 15 nt, Human
cagcuauuuugugaa

SEQ ID NO: 1292315 - RNA, 15 nt, Human
cagcucaagagaucc

SEQ ID NO: 1292316 - RNA, 16 nt, Human
cagcuaggaagagcag

SEQ ID NO: 1292317 - RNA, 20 nt, Human
cagcuaggaagagcaggacu

SEQ ID NO: 1292318 - RNA, 21 nt, Human
cagcuaggaagagcaggacuc

SEQ ID NO: 1292319 - RNA, 13 nt, Human
cagcuagugaccc

SEQ ID NO: 1292320 - RNA, 15 nt, Human
cagcuagugacccac

SEQ ID NO: 1292321 - RNA, 18 nt, Human
cagcuagugacccacaug

SEQ ID NO: 1292322 - RNA, 19 nt, Human
cagcuagugacccacaugc

SEQ ID NO: 1292323 - RNA, 20 nt, Human
cagcuagugacccacaugcc

SEQ ID NO: 1292324 - RNA, 21 nt, Human
cagcuagugacccacaugcca

SEQ ID NO: 1292325 - RNA, 22 nt, Human
cagcuagugacccacaugccau

SEQ ID NO: 1292326 - RNA, 21 nt, Human
cagcgagauaccccaccuccc

SEQ ID NO: 1292327 - RNA, 12 nt, Human
cagcgagccugc

SEQ ID NO: 1292328 - RNA, 13 nt, Human
cagcgagccugcu

SEQ ID NO: 1292329 - RNA, 12 nt, Human
cagcgacuggca

SEQ ID NO: 1292330 - RNA, 14 nt, Human
cagcgagccugcua

SEQ ID NO: 1292331 - RNA, 20 nt, Human
cagcgagcgcccagcuccug

SEQ ID NO: 1292332 - RNA, 16 nt, Human
cagcgaggaggcucca

SEQ ID NO: 1292333 - RNA, 17 nt, Human
cagcgaggaggcuccag

SEQ ID NO: 1292334 - RNA, 18 nt, Human
cagcgaggaggcuccaga

SEQ ID NO: 1292335 - RNA, 21 nt, Human
cagcgagcgcccagcuccuga

SEQ ID NO: 1292336 - RNA, 20 nt, Human
cagcgauucccucucccagg

SEQ ID NO: 1292337 - RNA, 21 nt, Human
cagcgauucccucucccaggc

SEQ ID NO: 1292338 - RNA, 22 nt, Human
cagcgauucccucucccaggcc

SEQ ID NO: 1292339 - RNA, 23 nt, Human
cagcgauucccucucccaggccc

SEQ ID NO: 1292340 - RNA, 18 nt, Human
cagcgaccuuccucaucc

SEQ ID NO: 1292341 - RNA, 17 nt, Human
cagcgacuccguuggcc

SEQ ID NO: 1292342 - RNA, 21 nt, Human
cagcgacuccguuggccacuc

SEQ ID NO: 1292343 - RNA, 22 nt, Human
cagcgacuccguuggccacucc

SEQ ID NO: 1292344 - RNA, 18 nt, Human
cagccuuuuuguuucaau

SEQ ID NO: 1292345 - RNA, 16 nt, Human
cagcgaccgcccccuc

SEQ ID NO: 1292346 - RNA, 17 nt, Human
cagcgaccgcccccucc

SEQ ID NO: 1292347 - RNA, 18 nt, Human
cagcgaccgcccccuccu

SEQ ID NO: 1292348 - RNA, 19 nt, Human
cagcuaaucagcauucuca

SEQ ID NO: 1292349 - RNA, 20 nt, Human
cagcuaagcucacguccuga

SEQ ID NO: 1292350 - RNA, 19 nt, Human
cagcuaagggguggggcug

SEQ ID NO: 1292351 - RNA, 21 nt, Human
cagcuaagggguggggcugcg

SEQ ID NO: 1292352 - RNA, 21 nt, Human
cagcuaauaacugaucucguu

SEQ ID NO: 1292353 - RNA, 12 nt, Human
cagcgccaggcu

SEQ ID NO: 1292354 - RNA, 13 nt, Human
cagcuaagaaccu

SEQ ID NO: 1292355 - RNA, 14 nt, Human
cagcuaagaaccug

SEQ ID NO: 1292356 - RNA, 16 nt, Human
cagcuaagaaccugga

SEQ ID NO: 1292357 - RNA, 18 nt, Human
cagcuaagaaccuggaac

SEQ ID NO: 1292358 - RNA, 19 nt, Human
cagcuaagaaccuggaacu

SEQ ID NO: 1292359 - RNA, 23 nt, Human
cagcuaagaaccuggaacuuggg

SEQ ID NO: 1292360 - RNA, 15 nt, Human
cagcuaagcuaggaa

SEQ ID NO: 1292361 - RNA, 18 nt, Human
cagcuaagcuaggaauga

SEQ ID NO: 1292362 - RNA, 13 nt, Human
cagcuaagcucac

SEQ ID NO: 1292363 - RNA, 14 nt, Human
cagcuaagcucacg

SEQ ID NO: 1292364 - RNA, 19 nt, Human
cagcuacuugggaggcuga

SEQ ID NO: 1292365 - RNA, 15 nt, Human
cagcuacuuccuccu

SEQ ID NO: 1292366 - RNA, 17 nt, Human
cagcuacuuccuccucc

SEQ ID NO: 1292367 - RNA, 21 nt, Human
cagcuacuuccuccuccccac

SEQ ID NO: 1292368 - RNA, 13 nt, Human
cagcuacucuccc

SEQ ID NO: 1292369 - RNA, 15 nt, Human
cagcuacucucccca

SEQ ID NO: 1292370 - RNA, 23 nt, Human
cagcuacucuccccacgagggcu

SEQ ID NO: 1292371 - RNA, 14 nt, Human
cagcuaauucuacu

SEQ ID NO: 1292372 - RNA, 22 nt, Human
cagcuaauucuacucacagugc

SEQ ID NO: 1292373 - RNA, 21 nt, Human
cagcuacccuuuuucuccagc

SEQ ID NO: 1292374 - RNA, 24 nt, Human
cagcuacccuuuuucuccagcugg

SEQ ID NO: 1292375 - RNA, 16 nt, Human
cagccuaguugaucag

SEQ ID NO: 1292376 - RNA, 21 nt, Human
cagccuagggcugagcugggg

SEQ ID NO: 1292377 - RNA, 14 nt, Human
cagccuccaagcuc

SEQ ID NO: 1292378 - RNA, 20 nt, Human
cagccuccaagcuccaucuc

SEQ ID NO: 1292379 - RNA, 21 nt, Human
cagccucagugacccuggcuc

SEQ ID NO: 1292380 - RNA, 12 nt, Human
cagccuccagag

SEQ ID NO: 1292381 - RNA, 21 nt, Human
cagccucagagacaucagccc

SEQ ID NO: 1292382 - RNA, 12 nt, Human
cagccucagaga

SEQ ID NO: 1292383 - RNA, 14 nt, Human
cagccucaggacug

SEQ ID NO: 1292384 - RNA, 16 nt, Human
cagccucaggacuggg

SEQ ID NO: 1292385 - RNA, 17 nt, Human
cagccucaggacuggga

SEQ ID NO: 1292386 - RNA, 18 nt, Human
cagccucaggacugggag

SEQ ID NO: 1292387 - RNA, 19 nt, Human
cagccucaggacugggagc

SEQ ID NO: 1292388 - RNA, 20 nt, Human
cagccucaggacugggagcc

SEQ ID NO: 1292389 - RNA, 21 nt, Human
cagccucaggacugggagccc

SEQ ID NO: 1292390 - RNA, 23 nt, Human
cagccucaggacugggagccccc

SEQ ID NO: 1292391 - RNA, 18 nt, Human
cagccuccccugccaggg

SEQ ID NO: 1292392 - RNA, 19 nt, Human
cagccuccccugccagggc

SEQ ID NO: 1292393 - RNA, 20 nt, Human
cagccuccccugccagggca

SEQ ID NO: 1292394 - RNA, 22 nt, Human
cagccuccccugccagggcagg

SEQ ID NO: 1292395 - RNA, 15 nt, Human
cagccucccaaagug

SEQ ID NO: 1292396 - RNA, 21 nt, Human
cagccucccaaagugcugaga

SEQ ID NO: 1292397 - RNA, 22 nt, Human
cagccucccaaagugcugagau

SEQ ID NO: 1292398 - RNA, 14 nt, Human
cagccucccaucca

SEQ ID NO: 1292399 - RNA, 16 nt, Human
cagccucccauccagg

SEQ ID NO: 1292400 - RNA, 18 nt, Human
cagccucccauccagggc

SEQ ID NO: 1292401 - RNA, 19 nt, Human
cagccucccauccagggcc

SEQ ID NO: 1292402 - RNA, 20 nt, Human
cagccucccauccagggccc

SEQ ID NO: 1292403 - RNA, 23 nt, Human
cagccucccauccagggccccca

SEQ ID NO: 1292404 - RNA, 23 nt, Human
cagccucccccuguccccucuau

SEQ ID NO: 1292405 - RNA, 16 nt, Human
cagccuccccugccag

SEQ ID NO: 1292406 - RNA, 17 nt, Human
cagccuccccugccagg

SEQ ID NO: 1292407 - RNA, 21 nt, Human
cagccuccauccuacccccug

SEQ ID NO: 1292408 - RNA, 14 nt, Human
cagccuccaugcug

SEQ ID NO: 1292409 - RNA, 18 nt, Human
cagccuccauccuacccc

SEQ ID NO: 1292410 - RNA, 15 nt, Human
cagccuccaugcugc

SEQ ID NO: 1292411 - RNA, 17 nt, Human
cagccuccaugcugccu

SEQ ID NO: 1292412 - RNA, 20 nt, Human
cagccuccaugcugccucca

SEQ ID NO: 1292413 - RNA, 14 nt, Human
cagccucccaaagu

SEQ ID NO: 1292414 - RNA, 20 nt, Human
cagcccugcugcugccugcc

SEQ ID NO: 1292415 - RNA, 21 nt, Human
cagcccugccuggaggaccug

SEQ ID NO: 1292416 - RNA, 13 nt, Human
cagcccugccugg

SEQ ID NO: 1292417 - RNA, 14 nt, Human
cagcccugccugga

SEQ ID NO: 1292418 - RNA, 15 nt, Human
cagcccugccuggag

SEQ ID NO: 1292419 - RNA, 16 nt, Human
cagcccugccuggagg

SEQ ID NO: 1292420 - RNA, 17 nt, Human
cagcccugccuggagga

SEQ ID NO: 1292421 - RNA, 19 nt, Human
cagcccugccuggaggacc

SEQ ID NO: 1292422 - RNA, 20 nt, Human
cagcccugccuggaggaccu

SEQ ID NO: 1292423 - RNA, 13 nt, Human
cagcccugcacca

SEQ ID NO: 1292424 - RNA, 15 nt, Human
cagcccugcaccaug

SEQ ID NO: 1292425 - RNA, 17 nt, Human
cagcccugcaccaugcu

SEQ ID NO: 1292426 - RNA, 23 nt, Human
cagcccugcaccaugcugcuggg

SEQ ID NO: 1292427 - RNA, 17 nt, Human
cagcccuccucugcacu

SEQ ID NO: 1292428 - RNA, 18 nt, Human
cagcccuccucugcacuc

SEQ ID NO: 1292429 - RNA, 23 nt, Human
cagcccugaggacagaugccucc

SEQ ID NO: 1292430 - RNA, 16 nt, Human
cagcccucccugcccc

SEQ ID NO: 1292431 - RNA, 17 nt, Human
cagcccucccugccccu

SEQ ID NO: 1292432 - RNA, 18 nt, Human
cagcccucccugccccuc

SEQ ID NO: 1292433 - RNA, 22 nt, Human
cagcccucccugccccucccuu

SEQ ID NO: 1292434 - RNA, 15 nt, Human
cagccgugggcccca

SEQ ID NO: 1292435 - RNA, 17 nt, Human
cagccgugggccccacc

SEQ ID NO: 1292436 - RNA, 14 nt, Human
cagccuacaggccu

SEQ ID NO: 1292437 - RNA, 16 nt, Human
cagccuacaggccuca

SEQ ID NO: 1292438 - RNA, 9 nt, Human
cagccgugc

SEQ ID NO: 1292439 - RNA, 14 nt, Human
cagccgugccuuca

SEQ ID NO: 1292440 - RNA, 17 nt, Human
cagccgugagcauguuu

SEQ ID NO: 1292441 - RNA, 16 nt, Human
cagccgugccuucagc

SEQ ID NO: 1292442 - RNA, 18 nt, Human
cagccgugccuucagcuc

SEQ ID NO: 1292443 - RNA, 20 nt, Human
cagccgugccuucagcucua

SEQ ID NO: 1292444 - RNA, 14 nt, Human
cagccgugagcaug

SEQ ID NO: 1292445 - RNA, 13 nt, Human
cagccgugggccc

SEQ ID NO: 1292446 - RNA, 11 nt, Human
cagcccugcuu

SEQ ID NO: 1292447 - RNA, 13 nt, Human
cagcccugcuuug

SEQ ID NO: 1292448 - RNA, 19 nt, Human
cagcccugcuuugggcugc

SEQ ID NO: 1292449 - RNA, 20 nt, Human
cagcccugcuuugggcugcc

SEQ ID NO: 1292450 - RNA, 21 nt, Human
cagcccugcuuugggcugccc

SEQ ID NO: 1292451 - RNA, 22 nt, Human
cagcccugcuuugggcugcccu

SEQ ID NO: 1292452 - RNA, 23 nt, Human
cagcccugcuuugggcugcccug

SEQ ID NO: 1292453 - RNA, 15 nt, Human
cagccggggcgagug

SEQ ID NO: 1292454 - RNA, 17 nt, Human
cagccggggcgaguggc

SEQ ID NO: 1292455 - RNA, 20 nt, Human
cagccggggcgaguggcacg

SEQ ID NO: 1292456 - RNA, 23 nt, Human
cagccccacaccagggccagccu

SEQ ID NO: 1292457 - RNA, 21 nt, Human
cagccccacaccagggccagc

SEQ ID NO: 1292458 - RNA, 14 nt, Human
cagccccaccccag

SEQ ID NO: 1292459 - RNA, 18 nt, Human
cagccccaccccagggca

SEQ ID NO: 1292460 - RNA, 20 nt, Human
cagccccaccccagggcagc

SEQ ID NO: 1292461 - RNA, 21 nt, Human
cagccccaccccagggcagcc

SEQ ID NO: 1292462 - RNA, 22 nt, Human
cagccccaccccagggcagcca

SEQ ID NO: 1292463 - RNA, 23 nt, Human
cagccccaccccagggcagccag

SEQ ID NO: 1292464 - RNA, 15 nt, Human
cagccccacccuggc

SEQ ID NO: 1292465 - RNA, 18 nt, Human
cagccccacccuggccua

SEQ ID NO: 1292466 - RNA, 17 nt, Human
cagccccacccuggccu

SEQ ID NO: 1292467 - RNA, 15 nt, Human
cagccccacuccucu

SEQ ID NO: 1292468 - RNA, 16 nt, Human
cagccccacuccucug

SEQ ID NO: 1292469 - RNA, 21 nt, Human
cagccccacuccucugcugac

SEQ ID NO: 1292470 - RNA, 18 nt, Human
cagccccacuccucugcu

SEQ ID NO: 1292471 - RNA, 15 nt, Human
cagccccagccaggg

SEQ ID NO: 1292472 - RNA, 13 nt, Human
cagccccuggccc

SEQ ID NO: 1292473 - RNA, 21 nt, Human
cagccccuggccccaggaccu

SEQ ID NO: 1292474 - RNA, 17 nt, Human
cagccccuuagacagag

SEQ ID NO: 1292475 - RNA, 21 nt, Human
cagccccuuagacagaggccc

SEQ ID NO: 1292476 - RNA, 18 nt, Human
cagccccuuagacagagg

SEQ ID NO: 1292477 - RNA, 12 nt, Human
cagccccuuucc

SEQ ID NO: 1292478 - RNA, 13 nt, Human
cagccccuuuccc

SEQ ID NO: 1292479 - RNA, 15 nt, Human
cagccccuuucccuu

SEQ ID NO: 1292480 - RNA, 23 nt, Human
cagccccuuucccuuguagcucc

SEQ ID NO: 1292481 - RNA, 14 nt, Human
cagcccgcacaccu

SEQ ID NO: 1292482 - RNA, 16 nt, Human
cagcccgcacaccugc

SEQ ID NO: 1292483 - RNA, 15 nt, Human
cagcccgcacaccug

SEQ ID NO: 1292484 - RNA, 19 nt, Human
cagcccgcccacuggguaa

SEQ ID NO: 1292485 - RNA, 16 nt, Human
cagcccuaaacaucau

SEQ ID NO: 1292486 - RNA, 14 nt, Human
cagcccuaaacauc

SEQ ID NO: 1292487 - RNA, 22 nt, Human
cagcccuccaucuaaacugccc

SEQ ID NO: 1292488 - RNA, 13 nt, Human
cagcccucauccc

SEQ ID NO: 1292489 - RNA, 14 nt, Human
cagcccucaucccg

SEQ ID NO: 1292490 - RNA, 23 nt, Human
cagcccuccaucuaaacugcccc

SEQ ID NO: 1292491 - RNA, 17 nt, Human
cagcccucaucccgagc

SEQ ID NO: 1292492 - RNA, 13 nt, Human
cagcccucccugc

SEQ ID NO: 1292493 - RNA, 15 nt, Human
cagcccucccugccc

SEQ ID NO: 1292494 - RNA, 18 nt, Human
cagcccuaggguggagag

SEQ ID NO: 1292495 - RNA, 16 nt, Human
cagcccucacacaccc

SEQ ID NO: 1292496 - RNA, 17 nt, Human
cagcccucacacacccu

SEQ ID NO: 1292497 - RNA, 19 nt, Human
cagcccucacacacccugu

SEQ ID NO: 1292498 - RNA, 18 nt, Human
cagccaacuauggccugu

SEQ ID NO: 1292499 - RNA, 18 nt, Human
cagccaacuagccccugg

SEQ ID NO: 1292500 - RNA, 19 nt, Human
cagccaacuagccccuggg

SEQ ID NO: 1292501 - RNA, 20 nt, Human
cagccaacuagccccugggg

SEQ ID NO: 1292502 - RNA, 22 nt, Human
cagccaacuagccccuggggug

SEQ ID NO: 1292503 - RNA, 22 nt, Human
cagccaaauuuaaaacuguugg

SEQ ID NO: 1292504 - RNA, 14 nt, Human
cagccaacuagccc

SEQ ID NO: 1292505 - RNA, 16 nt, Human
cagccaacuagccccu

SEQ ID NO: 1292506 - RNA, 17 nt, Human
cagccaacuagccccug

SEQ ID NO: 1292507 - RNA, 14 nt, Human
cagccaaauuuaaa

SEQ ID NO: 1292508 - RNA, 19 nt, Human
cagccaacacgcaccugcc

SEQ ID NO: 1292509 - RNA, 20 nt, Human
cagccaacacgcaccugccu

SEQ ID NO: 1292510 - RNA, 22 nt, Human
cagccaacacgcaccugccuca

SEQ ID NO: 1292511 - RNA, 23 nt, Human
cagccaacacgcaccugccucag

SEQ ID NO: 1292512 - RNA, 15 nt, Human
cagcauuucccuucc

SEQ ID NO: 1292513 - RNA, 16 nt, Human
cagcauuguauaugug

SEQ ID NO: 1292514 - RNA, 12 nt, Human
cagcauuucacu

SEQ ID NO: 1292515 - RNA, 13 nt, Human
cagcauuucacuu

SEQ ID NO: 1292516 - RNA, 20 nt, Human
cagcagggguuggggaaaca

SEQ ID NO: 1292517 - RNA, 14 nt, Human
cagcaucucagcuc

SEQ ID NO: 1292518 - RNA, 13 nt, Human
cagcaucucagcu

SEQ ID NO: 1292519 - RNA, 21 nt, Human
cagcaucggacaagaccccca

SEQ ID NO: 1292520 - RNA, 22 nt, Human
cagcaucggacaagacccccag

SEQ ID NO: 1292521 - RNA, 23 nt, Human
cagcauccgcaggugcugguccc

SEQ ID NO: 1292522 - RNA, 16 nt, Human
cagcaucuccaagcag

SEQ ID NO: 1292523 - RNA, 17 nt, Human
cagcaucuccaagcagc

SEQ ID NO: 1292524 - RNA, 18 nt, Human
cagcaucuccaagcagcu

SEQ ID NO: 1292525 - RNA, 21 nt, Human
cagcaucuccaagcagcuuag

SEQ ID NO: 1292526 - RNA, 22 nt, Human
cagcaucuccaagcagcuuaga

SEQ ID NO: 1292527 - RNA, 17 nt, Human
cagcaucucuaccuucu

SEQ ID NO: 1292528 - RNA, 20 nt, Human
cagcaucucuaccuucuccc

SEQ ID NO: 1292529 - RNA, 23 nt, Human
cagcaucucuaccuucuccccag

SEQ ID NO: 1292530 - RNA, 21 nt, Human
cagcaucucuaccuucucccc

SEQ ID NO: 1292531 - RNA, 13 nt, Human
cagcaucugggcc

SEQ ID NO: 1292532 - RNA, 14 nt, Human
cagcaucugggccu

SEQ ID NO: 1292533 - RNA, 15 nt, Human
cagcaucugggccuu

SEQ ID NO: 1292534 - RNA, 16 nt, Human
cagcaucugggccuug

SEQ ID NO: 1292535 - RNA, 19 nt, Human
cagcaucugggccuuggcc

SEQ ID NO: 1292536 - RNA, 20 nt, Human
cagcaucugggccuuggccu

SEQ ID NO: 1292537 - RNA, 22 nt, Human
cagcaucugggccuuggccugg

SEQ ID NO: 1292538 - RNA, 12 nt, Human
cagcaugaauuu

SEQ ID NO: 1292539 - RNA, 14 nt, Human
cagcaugaauuugu

SEQ ID NO: 1292540 - RNA, 14 nt, Human
cagcauucucacuc

SEQ ID NO: 1292541 - RNA, 12 nt, Human
cagcauucccag

SEQ ID NO: 1292542 - RNA, 13 nt, Human
cagcauucccagg

SEQ ID NO: 1292543 - RNA, 14 nt, Human
cagcauucccaggu

SEQ ID NO: 1292544 - RNA, 17 nt, Human
cagcauucccagguagg

SEQ ID NO: 1292545 - RNA, 14 nt, Human
cagcauuccagccc

SEQ ID NO: 1292546 - RNA, 16 nt, Human
cagcauuccagccccu

SEQ ID NO: 1292547 - RNA, 20 nt, Human
cagcauuccagccccucugg

SEQ ID NO: 1292548 - RNA, 21 nt, Human
cagcauuccagccccucuggu

SEQ ID NO: 1292549 - RNA, 15 nt, Human
cagcauucucacucc

SEQ ID NO: 1292550 - RNA, 18 nt, Human
cagcauucccagguaggc

SEQ ID NO: 1292551 - RNA, 20 nt, Human
cagcauucccagguaggcca

SEQ ID NO: 1292552 - RNA, 23 nt, Human
cagcauucccagguaggccaagg

SEQ ID NO: 1292553 - RNA, 18 nt, Human
cagcaugaauuuguaaug

SEQ ID NO: 1292554 - RNA, 17 nt, Human
cagcaugaauuuguaau

SEQ ID NO: 1292555 - RNA, 16 nt, Human
cagcaugcaauacaua

SEQ ID NO: 1292556 - RNA, 15 nt, Human
cagcauggcauccaa

SEQ ID NO: 1292557 - RNA, 22 nt, Human
cagcauggcauccaagacucuu

SEQ ID NO: 1292558 - RNA, 20 nt, Human
cagcauguacggauuuucag

SEQ ID NO: 1292559 - RNA, 21 nt, Human
cagcauguacggauuuucagu

SEQ ID NO: 1292560 - RNA, 22 nt, Human
cagcauguacggauuuucaguu

SEQ ID NO: 1292561 - RNA, 18 nt, Human
cagcaugucuauucagcu

SEQ ID NO: 1292562 - RNA, 21 nt, Human
cagcagccucgccccuggcag

SEQ ID NO: 1292563 - RNA, 22 nt, Human
cagcagccucgccccuggcaga

SEQ ID NO: 1292564 - RNA, 20 nt, Human
cagcagccuggggcuggccu

SEQ ID NO: 1292565 - RNA, 21 nt, Human
cagcagccuggggcuggccuc

SEQ ID NO: 1292566 - RNA, 21 nt, Human
cagcagcuuuagaaucccagc

SEQ ID NO: 1292567 - RNA, 15 nt, Human
cagcaggagggggga

SEQ ID NO: 1292568 - RNA, 18 nt, Human
cagcaggaggggggaggg

SEQ ID NO: 1292569 - RNA, 14 nt, Human
cagcaggcuggccu

SEQ ID NO: 1292570 - RNA, 21 nt, Human
cagcagggacuguaaacacag

SEQ ID NO: 1292571 - RNA, 22 nt, Human
cagcagggacuguaaacacaga

SEQ ID NO: 1292572 - RNA, 11 nt, Human
cagcagggcua

SEQ ID NO: 1292573 - RNA, 19 nt, Human
cagcagggcuacccugagc

SEQ ID NO: 1292574 - RNA, 21 nt, Human
cagcagggcuacccugagcug

SEQ ID NO: 1292575 - RNA, 23 nt, Human
cagccauccagggggcaagagga

SEQ ID NO: 1292576 - RNA, 21 nt, Human
cagccaucaccuuagaccacc

SEQ ID NO: 1292577 - RNA, 16 nt, Human
cagccaucaaaaugcu

SEQ ID NO: 1292578 - RNA, 17 nt, Human
cagccaucaaaaugcuu

SEQ ID NO: 1292579 - RNA, 18 nt, Human
cagccaucaagagacuga

SEQ ID NO: 1292580 - RNA, 21 nt, Human
cagccaucaagagacugaguc

SEQ ID NO: 1292581 - RNA, 19 nt, Human
cagccaucaccuuagacca

SEQ ID NO: 1292582 - RNA, 19 nt, Human
cagccauuggcuauuuaaa

SEQ ID NO: 1292583 - RNA, 20 nt, Human
cagccauuggcuauuuaaaa

SEQ ID NO: 1292584 - RNA, 16 nt, Human
cagcccacccccggca

SEQ ID NO: 1292585 - RNA, 17 nt, Human
cagcccacccccggcag

SEQ ID NO: 1292586 - RNA, 18 nt, Human
cagcccacccccggcagc

SEQ ID NO: 1292587 - RNA, 19 nt, Human
cagcccacauagugauggu

SEQ ID NO: 1292588 - RNA, 12 nt, Human
cagcccaccccc

SEQ ID NO: 1292589 - RNA, 22 nt, Human
cagccauuggcuauuuaaaacu

SEQ ID NO: 1292590 - RNA, 20 nt, Human
cagcccacccccggcagcag

SEQ ID NO: 1292591 - RNA, 22 nt, Human
cagcccacccccggcagcagcc

SEQ ID NO: 1292592 - RNA, 11 nt, Human
cagcccagaga

SEQ ID NO: 1292593 - RNA, 12 nt, Human
cagcccagagac

SEQ ID NO: 1292594 - RNA, 13 nt, Human
cagcccagagaca

SEQ ID NO: 1292595 - RNA, 21 nt, Human
cagcccagagacauacuugaa

SEQ ID NO: 1292596 - RNA, 22 nt, Human
cagcccagagacauacuugaag

SEQ ID NO: 1292597 - RNA, 12 nt, Human
cagcccagccag

SEQ ID NO: 1292598 - RNA, 13 nt, Human
cagcccagccagc

SEQ ID NO: 1292599 - RNA, 14 nt, Human
cagcccagccagcg

SEQ ID NO: 1292600 - RNA, 15 nt, Human
cagcccagccagcgu

SEQ ID NO: 1292601 - RNA, 20 nt, Human
cagcccagcccgcccacugg

SEQ ID NO: 1292602 - RNA, 16 nt, Human
cagcccagccccacuc

SEQ ID NO: 1292603 - RNA, 12 nt, Human
cagcccaggaag

SEQ ID NO: 1292604 - RNA, 20 nt, Human
cagcccaggaagucucaucu

SEQ ID NO: 1292605 - RNA, 22 nt, Human
cagcccaggaagucucaucugg

SEQ ID NO: 1292606 - RNA, 23 nt, Human
cagcccaggaagucucaucuggg

SEQ ID NO: 1292607 - RNA, 22 nt, Human
cagcccaggauacuggcacaga

SEQ ID NO: 1292608 - RNA, 16 nt, Human
cagcccagggcuccug

SEQ ID NO: 1292609 - RNA, 17 nt, Human
cagcccagggcuccugc

SEQ ID NO: 1292610 - RNA, 18 nt, Human
cagcccagggcuccugca

SEQ ID NO: 1292611 - RNA, 19 nt, Human
cagcccagggcuccugcac

SEQ ID NO: 1292612 - RNA, 21 nt, Human
cagcccagggcuccugcacuu

SEQ ID NO: 1292613 - RNA, 13 nt, Human
cagccccacacca

SEQ ID NO: 1292614 - RNA, 14 nt, Human
cagccccacaccag

SEQ ID NO: 1292615 - RNA, 16 nt, Human
cagccccacaccaggg

SEQ ID NO: 1292616 - RNA, 20 nt, Human
cagcccaggauacuggcaca

SEQ ID NO: 1292617 - RNA, 13 nt, Human
cagcccauggaga

SEQ ID NO: 1292618 - RNA, 21 nt, Human
cagcccauggagauugaccug

SEQ ID NO: 1292619 - RNA, 22 nt, Human
cagcccauggagauugaccugg

SEQ ID NO: 1292620 - RNA, 21 nt, Human
cagccacggggacucagcccu

SEQ ID NO: 1292621 - RNA, 22 nt, Human
cagccagucccguuucauuuag

SEQ ID NO: 1292622 - RNA, 17 nt, Human
cagccagugcccugagc

SEQ ID NO: 1292623 - RNA, 18 nt, Human
cagccagugcccugagcc

SEQ ID NO: 1292624 - RNA, 19 nt, Human
cagccagugcccugagcca

SEQ ID NO: 1292625 - RNA, 21 nt, Human
cagccagugcccugagccagg

SEQ ID NO: 1292626 - RNA, 13 nt, Human
cagccaucaaaau

SEQ ID NO: 1292627 - RNA, 14 nt, Human
cagccacacuucuc

SEQ ID NO: 1292628 - RNA, 16 nt, Human
cagccacacuucucag

SEQ ID NO: 1292629 - RNA, 17 nt, Human
cagccacacuucucagg

SEQ ID NO: 1292630 - RNA, 14 nt, Human
cagccaagcucugc

SEQ ID NO: 1292631 - RNA, 23 nt, Human
cagccaagguuuuauaaggcuga

SEQ ID NO: 1292632 - RNA, 22 nt, Human
cagccaagucgguuaguggaag

SEQ ID NO: 1292633 - RNA, 18 nt, Human
cagccacacuucucagga

SEQ ID NO: 1292634 - RNA, 19 nt, Human
cagccacacuucucaggac

SEQ ID NO: 1292635 - RNA, 20 nt, Human
cagccacacuucucaggaca

SEQ ID NO: 1292636 - RNA, 21 nt, Human
cagccacacuucucaggacac

SEQ ID NO: 1292637 - RNA, 12 nt, Human
cagccacccuga

SEQ ID NO: 1292638 - RNA, 14 nt, Human
cagccacccugagg

SEQ ID NO: 1292639 - RNA, 15 nt, Human
cagccacccugagga

SEQ ID NO: 1292640 - RNA, 16 nt, Human
cagccacccugaggag

SEQ ID NO: 1292641 - RNA, 18 nt, Human
cagccacccugaggaguc

SEQ ID NO: 1292642 - RNA, 19 nt, Human
cagccacccugaggagucu

SEQ ID NO: 1292643 - RNA, 20 nt, Human
cagccacccugaggagucug

SEQ ID NO: 1292644 - RNA, 21 nt, Human
cagccacccugaggagucuga

SEQ ID NO: 1292645 - RNA, 22 nt, Human
cagccacccugaggagucugag

SEQ ID NO: 1292646 - RNA, 14 nt, Human
cagccacccugagu

SEQ ID NO: 1292647 - RNA, 21 nt, Human
cagccaccgaagccgccugug

SEQ ID NO: 1292648 - RNA, 18 nt, Human
cagccacgaggugcaaca

SEQ ID NO: 1292649 - RNA, 16 nt, Human
cagccacccugaguug

SEQ ID NO: 1292650 - RNA, 23 nt, Human
cagcagagagguuugcaguccca

SEQ ID NO: 1292651 - RNA, 22 nt, Human
cagcagcaccugcccuaccugc

SEQ ID NO: 1292652 - RNA, 12 nt, Human
cagcagcaucuc

SEQ ID NO: 1292653 - RNA, 22 nt, Human
cagcagcaucucuaccuucucc

SEQ ID NO: 1292654 - RNA, 10 nt, Human
cagcagccag

SEQ ID NO: 1292655 - RNA, 11 nt, Human
cagcagccagc

SEQ ID NO: 1292656 - RNA, 12 nt, Human
cagcagccagcc

SEQ ID NO: 1292657 - RNA, 13 nt, Human
cagcagccagccc

SEQ ID NO: 1292658 - RNA, 14 nt, Human
cagcagccagcccu

SEQ ID NO: 1292659 - RNA, 15 nt, Human
cagcagccagcccug

SEQ ID NO: 1292660 - RNA, 16 nt, Human
cagcagccagcccugc

SEQ ID NO: 1292661 - RNA, 17 nt, Human
cagcagccagcccugcc

SEQ ID NO: 1292662 - RNA, 18 nt, Human
cagcagccagcccugccu

SEQ ID NO: 1292663 - RNA, 13 nt, Human
cagcagccccugc

SEQ ID NO: 1292664 - RNA, 16 nt, Human
cagcagccccugcaca

SEQ ID NO: 1292665 - RNA, 23 nt, Human
cagcagccccugcacaaagcccu

SEQ ID NO: 1292666 - RNA, 18 nt, Human
cagcagccucgccccugg

SEQ ID NO: 1292667 - RNA, 19 nt, Human
cagcagccucgccccuggc

SEQ ID NO: 1292668 - RNA, 23 nt, Human
cagcagccucgccccuggcagag

SEQ ID NO: 1292669 - RNA, 19 nt, Human
cagcagccagcccugccug

SEQ ID NO: 1292670 - RNA, 20 nt, Human
cagcagccagcccugccugg

SEQ ID NO: 1292671 - RNA, 21 nt, Human
cagcagccagcccugccugga

SEQ ID NO: 1292672 - RNA, 22 nt, Human
cagcagccagcccugccuggag

SEQ ID NO: 1292673 - RNA, 23 nt, Human
cagcagccagcccugccuggagg

SEQ ID NO: 1292674 - RNA, 15 nt, Human
cagcagccccacacc

SEQ ID NO: 1292675 - RNA, 16 nt, Human
cagcagccccacacca

SEQ ID NO: 1292676 - RNA, 18 nt, Human
cagcagccccacaccagg

SEQ ID NO: 1292677 - RNA, 12 nt, Human
cagcagccccca

SEQ ID NO: 1292678 - RNA, 13 nt, Human
cagcagcccccag

SEQ ID NO: 1292679 - RNA, 20 nt, Human
cagcagcccccagcucccac

SEQ ID NO: 1292680 - RNA, 23 nt, Human
cagcagcccccagcucccaccuc

SEQ ID NO: 1292681 - RNA, 22 nt, Human
cagcacuuuagaauaugccuug

SEQ ID NO: 1292682 - RNA, 19 nt, Human
cagcacuuggcccuucuac

SEQ ID NO: 1292683 - RNA, 14 nt, Human
cagcacuuuagaau

SEQ ID NO: 1292684 - RNA, 18 nt, Human
cagcacuuguccagcuga

SEQ ID NO: 1292685 - RNA, 19 nt, Human
cagcacuuguccagcugag

SEQ ID NO: 1292686 - RNA, 13 nt, Human
cagcacuuauuua

SEQ ID NO: 1292687 - RNA, 13 nt, Human
cagcacuuccaug

SEQ ID NO: 1292688 - RNA, 12 nt, Human
cagcacuuccau

SEQ ID NO: 1292689 - RNA, 14 nt, Human
cagcacuuggcccu

SEQ ID NO: 1292690 - RNA, 15 nt, Human
cagcacuuggcccuu

SEQ ID NO: 1292691 - RNA, 16 nt, Human
cagcacuuggcccuuc

SEQ ID NO: 1292692 - RNA, 23 nt, Human
cagcacuuggggguucaggcccg

SEQ ID NO: 1292693 - RNA, 15 nt, Human
cagcacuuguccagc

SEQ ID NO: 1292694 - RNA, 17 nt, Human
cagcacuuguccagcug

SEQ ID NO: 1292695 - RNA, 12 nt, Human
cagcagacagag

SEQ ID NO: 1292696 - RNA, 14 nt, Human
cagcagacagagcc

SEQ ID NO: 1292697 - RNA, 15 nt, Human
cagcagacagagcca

SEQ ID NO: 1292698 - RNA, 16 nt, Human
cagcagacagagccag

SEQ ID NO: 1292699 - RNA, 17 nt, Human
cagcagacagagccagg

SEQ ID NO: 1292700 - RNA, 18 nt, Human
cagcagacagagccagga

SEQ ID NO: 1292701 - RNA, 20 nt, Human
cagcagacagagccaggaga

SEQ ID NO: 1292702 - RNA, 21 nt, Human
cagcagacagagccaggagaa

SEQ ID NO: 1292703 - RNA, 15 nt, Human
cagcagacucagcuc

SEQ ID NO: 1292704 - RNA, 17 nt, Human
cagcagacucagcucug

SEQ ID NO: 1292705 - RNA, 18 nt, Human
cagcagacucagcucuga

SEQ ID NO: 1292706 - RNA, 21 nt, Human
cagcagacucagcucugacau

SEQ ID NO: 1292707 - RNA, 23 nt, Human
cagcagacucagcucugacauuc

SEQ ID NO: 1292708 - RNA, 16 nt, Human
cagcaauuuaaauguu

SEQ ID NO: 1292709 - RNA, 20 nt, Human
cagcacaaauuaguuauaua

SEQ ID NO: 1292710 - RNA, 13 nt, Human
cagcaauuucuaa

SEQ ID NO: 1292711 - RNA, 13 nt, Human
cagcacaaggcca

SEQ ID NO: 1292712 - RNA, 16 nt, Human
cagcacaaggccaucu

SEQ ID NO: 1292713 - RNA, 13 nt, Human
cagcacacagggc

SEQ ID NO: 1292714 - RNA, 14 nt, Human
cagcacacagggca

SEQ ID NO: 1292715 - RNA, 15 nt, Human
cagcacacagggcag

SEQ ID NO: 1292716 - RNA, 12 nt, Human
cagcacuguccc

SEQ ID NO: 1292717 - RNA, 13 nt, Human
cagcacugucccu

SEQ ID NO: 1292718 - RNA, 14 nt, Human
cagcacugucccuu

SEQ ID NO: 1292719 - RNA, 16 nt, Human
cagcacugucccuugc

SEQ ID NO: 1292720 - RNA, 18 nt, Human
cagcacugucccuugccu

SEQ ID NO: 1292721 - RNA, 20 nt, Human
cagcacugucccuugccuca

SEQ ID NO: 1292722 - RNA, 18 nt, Human
cagcacacagggcaguga

SEQ ID NO: 1292723 - RNA, 15 nt, Human
cagcaauuuaaaugu

SEQ ID NO: 1292724 - RNA, 14 nt, Human
cagcaauuuaaaug

SEQ ID NO: 1292725 - RNA, 23 nt, Human
cagcaauuucuaauuuuuaagaa

SEQ ID NO: 1292726 - RNA, 19 nt, Human
cagcaauucuccugccuca

SEQ ID NO: 1292727 - RNA, 20 nt, Human
cagcaauucuccugccucag

SEQ ID NO: 1292728 - RNA, 15 nt, Human
cagcaauucuccugc

SEQ ID NO: 1292729 - RNA, 16 nt, Human
cagcaauucuccugcc

SEQ ID NO: 1292730 - RNA, 17 nt, Human
cagcaauucuccugccu

SEQ ID NO: 1292731 - RNA, 18 nt, Human
cagcaauucuccugccuc

SEQ ID NO: 1292732 - RNA, 22 nt, Human
cagcaauuacaacggagucaaa

SEQ ID NO: 1292733 - RNA, 15 nt, Human
cagcaauagagacgg

SEQ ID NO: 1292734 - RNA, 17 nt, Human
cagcaauagagacggga

SEQ ID NO: 1292735 - RNA, 23 nt, Human
cagcaaguuagaacuagccaaac

SEQ ID NO: 1292736 - RNA, 23 nt, Human
cagcaagacuucucuuugccuca

SEQ ID NO: 1292737 - RNA, 20 nt, Human
cagcaagacuucucuuugcc

SEQ ID NO: 1292738 - RNA, 14 nt, Human
cagcaaggcccgag

SEQ ID NO: 1292739 - RNA, 15 nt, Human
cagcaaggcccgagc

SEQ ID NO: 1292740 - RNA, 16 nt, Human
cagcaaggcccgagca

SEQ ID NO: 1292741 - RNA, 19 nt, Human
cagcaaggcccgagcagcu

SEQ ID NO: 1292742 - RNA, 20 nt, Human
cagcaaggcccgagcagcug

SEQ ID NO: 1292743 - RNA, 21 nt, Human
cagcaaggcccgagcagcuga

SEQ ID NO: 1292744 - RNA, 23 nt, Human
cagcaaggcccgagcagcugagc

SEQ ID NO: 1292745 - RNA, 22 nt, Human
cagcaaggcccgagcagcugag

SEQ ID NO: 1292746 - RNA, 20 nt, Human
cagcaacaauaaauagacac

SEQ ID NO: 1292747 - RNA, 19 nt, Human
cagcaacaauaaauagaca

SEQ ID NO: 1292748 - RNA, 14 nt, Human
cagcaacaauaaau

SEQ ID NO: 1292749 - RNA, 18 nt, Human
cagcaaauccuuugugaa

SEQ ID NO: 1292750 - RNA, 13 nt, Human
cagcaaaugcaaa

SEQ ID NO: 1292751 - RNA, 22 nt, Human
cagcaaaugcaaaaacucuuug

SEQ ID NO: 1292752 - RNA, 16 nt, Human
cagcaaauccuuugug

SEQ ID NO: 1292753 - RNA, 14 nt, Human
cagcaaagugguuc

SEQ ID NO: 1292754 - RNA, 23 nt, Human
cagcaaagcccccagagcccagg

SEQ ID NO: 1292755 - RNA, 13 nt, Human
cagcaaagccccc

SEQ ID NO: 1292756 - RNA, 14 nt, Human
cagcaaagccccca

SEQ ID NO: 1292757 - RNA, 15 nt, Human
cagcaaagcccccag

SEQ ID NO: 1292758 - RNA, 17 nt, Human
cagcaaagcccccagag

SEQ ID NO: 1292759 - RNA, 18 nt, Human
cagcaaagcccccagagc

SEQ ID NO: 1292760 - RNA, 22 nt, Human
cagcaaagcccccagagcccag

SEQ ID NO: 1292761 - RNA, 14 nt, Human
cagcaaacaggugc

SEQ ID NO: 1292762 - RNA, 14 nt, Human
cagcaaaccggggc

SEQ ID NO: 1292763 - RNA, 16 nt, Human
cagcaaaccggggccu

SEQ ID NO: 1292764 - RNA, 20 nt, Human
cagcaaacucuuuucccacu

SEQ ID NO: 1292765 - RNA, 12 nt, Human
cagcaaccccag

SEQ ID NO: 1292766 - RNA, 13 nt, Human
cagcaaccccagg

SEQ ID NO: 1292767 - RNA, 16 nt, Human
cagcaaccccaggcug

SEQ ID NO: 1292768 - RNA, 17 nt, Human
cagcaaccccaggcuga

SEQ ID NO: 1292769 - RNA, 20 nt, Human
cagcaacggcacagcuaauu

SEQ ID NO: 1292770 - RNA, 20 nt, Human
cagcaacuaucagacuaagc

SEQ ID NO: 1292771 - RNA, 21 nt, Human
cagcaacuaucagacuaagcc

SEQ ID NO: 1292772 - RNA, 23 nt, Human
cagcaacuaucagacuaagccag

SEQ ID NO: 1292773 - RNA, 17 nt, Human
cagcaacuuguccuagc

SEQ ID NO: 1292774 - RNA, 22 nt, Human
cagcaacuuguccuagcacaga

SEQ ID NO: 1292775 - RNA, 23 nt, Human
cagcaacuuguccuagcacagau

SEQ ID NO: 1292776 - RNA, 22 nt, Human
cagauuuuuuacagcugccugc

SEQ ID NO: 1292777 - RNA, 19 nt, Human
cagauuuuuuacagcugcc

SEQ ID NO: 1292778 - RNA, 16 nt, Human
cagauuuuuacacaug

SEQ ID NO: 1292779 - RNA, 23 nt, Human
cagauuuuguuggcauagcucug

SEQ ID NO: 1292780 - RNA, 14 nt, Human
cagauuuuccugaa

SEQ ID NO: 1292781 - RNA, 15 nt, Human
cagauuuuccugaaa

SEQ ID NO: 1292782 - RNA, 19 nt, Human
cagauuuucagcaaacucu

SEQ ID NO: 1292783 - RNA, 22 nt, Human
cagauuuucagcaaacucuuuu

SEQ ID NO: 1292784 - RNA, 13 nt, Human
cagauuuucagca

SEQ ID NO: 1292785 - RNA, 15 nt, Human
cagauuuucagcaaa

SEQ ID NO: 1292786 - RNA, 15 nt, Human
cagauucuugcaucc

SEQ ID NO: 1292787 - RNA, 14 nt, Human
cagauuccuuccca

SEQ ID NO: 1292788 - RNA, 13 nt, Human
cagauuccuuccc

SEQ ID NO: 1292789 - RNA, 18 nt, Human
cagauucccagagcaaaa

SEQ ID NO: 1292790 - RNA, 19 nt, Human
cagauucccagagcaaaau

SEQ ID NO: 1292791 - RNA, 21 nt, Human
cagauucccagagcaaaauaa

SEQ ID NO: 1292792 - RNA, 12 nt, Human
cagauuccuucc

SEQ ID NO: 1292793 - RNA, 15 nt, Human
cagauucagaaauga

SEQ ID NO: 1292794 - RNA, 17 nt, Human
cagauucagaaaugagg

SEQ ID NO: 1292795 - RNA, 21 nt, Human
cagauucagaaaugaggccau

SEQ ID NO: 1292796 - RNA, 14 nt, Human
cagauucccagagc

SEQ ID NO: 1292797 - RNA, 17 nt, Human
cagauucccagagcaaa

SEQ ID NO: 1292798 - RNA, 15 nt, Human
cagaugucuauauug

SEQ ID NO: 1292799 - RNA, 21 nt, Human
cagauguccaucagaugacaa

SEQ ID NO: 1292800 - RNA, 19 nt, Human
cagauguccaucagaugac

SEQ ID NO: 1292801 - RNA, 16 nt, Human
cagauguccaucagau

SEQ ID NO: 1292802 - RNA, 18 nt, Human
cagauguaggagggacug

SEQ ID NO: 1292803 - RNA, 24 nt, Human
cagauguaggagggacugucgcug

SEQ ID NO: 1292804 - RNA, 15 nt, Human
cagauguaggaggga

SEQ ID NO: 1292805 - RNA, 17 nt, Human
cagauguaggagggacu

SEQ ID NO: 1292806 - RNA, 14 nt, Human
cagaugugaaccau

SEQ ID NO: 1292807 - RNA, 17 nt, Human
cagaugugaaccauuaa

SEQ ID NO: 1292808 - RNA, 16 nt, Human
cagauggccagccccu

SEQ ID NO: 1292809 - RNA, 22 nt, Human
cagauggcauguguuuacuuua

SEQ ID NO: 1292810 - RNA, 19 nt, Human
cagauggcagcuuuuaaaa

SEQ ID NO: 1292811 - RNA, 12 nt, Human
cagauggcacuu

SEQ ID NO: 1292812 - RNA, 13 nt, Human
cagauggcagcuu

SEQ ID NO: 1292813 - RNA, 15 nt, Human
cagauggcagcuuuu

SEQ ID NO: 1292814 - RNA, 16 nt, Human
cagauggcagcuuuua

SEQ ID NO: 1292815 - RNA, 16 nt, Human
cagauggcauguguuu

SEQ ID NO: 1292816 - RNA, 14 nt, Human
cagaugcuuuccug

SEQ ID NO: 1292817 - RNA, 21 nt, Human
cagaugcuuuccugcacauua

SEQ ID NO: 1292818 - RNA, 19 nt, Human
cagauggaaaauucauuuu

SEQ ID NO: 1292819 - RNA, 21 nt, Human
cagauggaaaauucauuuuuu

SEQ ID NO: 1292820 - RNA, 15 nt, Human
cagaugcugugcaaa

SEQ ID NO: 1292821 - RNA, 14 nt, Human
cagaugcuccaaga

SEQ ID NO: 1292822 - RNA, 15 nt, Human
cagaugcuccaagau

SEQ ID NO: 1292823 - RNA, 16 nt, Human
cagaugcuccaagauu

SEQ ID NO: 1292824 - RNA, 18 nt, Human
cagaugcuccaagauucu

SEQ ID NO: 1292825 - RNA, 19 nt, Human
cagaugcuccaagauucua

SEQ ID NO: 1292826 - RNA, 20 nt, Human
cagaugcuccaagauucuag

SEQ ID NO: 1292827 - RNA, 21 nt, Human
cagaugcuccaagauucuaga

SEQ ID NO: 1292828 - RNA, 22 nt, Human
cagaugcuccaagauucuagau

SEQ ID NO: 1292829 - RNA, 23 nt, Human
cagaugcuccaagauucuagaug

SEQ ID NO: 1292830 - RNA, 17 nt, Human
cagaugcagggcaguca

SEQ ID NO: 1292831 - RNA, 15 nt, Human
cagaugccccuuucu

SEQ ID NO: 1292832 - RNA, 17 nt, Human
cagaugccccuuucugg

SEQ ID NO: 1292833 - RNA, 12 nt, Human
cagaugccuccu

SEQ ID NO: 1292834 - RNA, 17 nt, Human
cagaugccuccuuccuc

SEQ ID NO: 1292835 - RNA, 14 nt, Human
cagaugccuccuuc

SEQ ID NO: 1292836 - RNA, 18 nt, Human
cagccuccaugcugccuc

SEQ ID NO: 1292837 - RNA, 13 nt, Human
cagagccaggaag

SEQ ID NO: 1292838 - RNA, 12 nt, Human
cagagccacagu

SEQ ID NO: 1292839 - RNA, 13 nt, Human
cagagccacaguu

SEQ ID NO: 1292840 - RNA, 22 nt, Human
cagagccaccccuaaagagaua

SEQ ID NO: 1292841 - RNA, 20 nt, Human
cagagccaaggggcuucagg

SEQ ID NO: 1292842 - RNA, 21 nt, Human
cagagccaaggggcuucaggu

SEQ ID NO: 1292843 - RNA, 23 nt, Human
cagagccaggaagaucccccaga

SEQ ID NO: 1292844 - RNA, 12 nt, Human
cagagccaggag

SEQ ID NO: 1292845 - RNA, 13 nt, Human
cagagccaggaga

SEQ ID NO: 1292846 - RNA, 16 nt, Human
cagagccaggagaagc

SEQ ID NO: 1292847 - RNA, 17 nt, Human
cagagccaggagaagcu

SEQ ID NO: 1292848 - RNA, 20 nt, Human
cagagccaggagaagcucag

SEQ ID NO: 1292849 - RNA, 23 nt, Human
cagagccaggagaagcucagcug

SEQ ID NO: 1292850 - RNA, 21 nt, Human
cagagccaggaagauccccca

SEQ ID NO: 1292851 - RNA, 17 nt, Human
cagagccaggaagaucc

SEQ ID NO: 1292852 - RNA, 15 nt, Human
cagagccaggaagau

SEQ ID NO: 1292853 - RNA, 14 nt, Human
cagagccaggaaga

SEQ ID NO: 1292854 - RNA, 23 nt, Human
cagagccaggggggugaggagcu

SEQ ID NO: 1292855 - RNA, 18 nt, Human
cagagccaugucuucucc

SEQ ID NO: 1292856 - RNA, 20 nt, Human
cagagccaugucuucucccu

SEQ ID NO: 1292857 - RNA, 21 nt, Human
cagagccaugucuucucccug

SEQ ID NO: 1292858 - RNA, 15 nt, Human
cagagcacugcucca

SEQ ID NO: 1292859 - RNA, 21 nt, Human
cagagcaccugcugucugggu

SEQ ID NO: 1292860 - RNA, 13 nt, Human
cagagcacugcuc

SEQ ID NO: 1292861 - RNA, 13 nt, Human
cagagcccacucc

SEQ ID NO: 1292862 - RNA, 18 nt, Human
cagagcccacuccaucug

SEQ ID NO: 1292863 - RNA, 19 nt, Human
cagagcccacuccaucugg

SEQ ID NO: 1292864 - RNA, 11 nt, Human
cagagcccagc

SEQ ID NO: 1292865 - RNA, 13 nt, Human
cagagcccagcuc

SEQ ID NO: 1292866 - RNA, 14 nt, Human
cagagcccagcucc

SEQ ID NO: 1292867 - RNA, 13 nt, Human
cagagcccaggcu

SEQ ID NO: 1292868 - RNA, 14 nt, Human
cagagcccaggcuc

SEQ ID NO: 1292869 - RNA, 17 nt, Human
cagagcccaggcucggc

SEQ ID NO: 1292870 - RNA, 23 nt, Human
cagagcccaggcucggccugccc

SEQ ID NO: 1292871 - RNA, 19 nt, Human
cagagcccaggcucggccu

SEQ ID NO: 1292872 - RNA, 22 nt, Human
cagagccggggugggguggcug

SEQ ID NO: 1292873 - RNA, 19 nt, Human
cagagccgugguccuuugg

SEQ ID NO: 1292874 - RNA, 20 nt, Human
cagagccgugguccuuuggg

SEQ ID NO: 1292875 - RNA, 20 nt, Human
cagagccuccuuucuggcuu

SEQ ID NO: 1292876 - RNA, 23 nt, Human
cagagcccugugaggcugggucc

SEQ ID NO: 1292877 - RNA, 23 nt, Human
cagagccggggugggguggcugc

SEQ ID NO: 1292878 - RNA, 16 nt, Human
cagaggaaggggccag

SEQ ID NO: 1292879 - RNA, 18 nt, Human
cagaggagccaccaguuc

SEQ ID NO: 1292880 - RNA, 19 nt, Human
cagaggagccaccaguucu

SEQ ID NO: 1292881 - RNA, 20 nt, Human
cagaggagccaccaguucuc

SEQ ID NO: 1292882 - RNA, 15 nt, Human
cagaggacacagaga

SEQ ID NO: 1292883 - RNA, 17 nt, Human
cagaggacacagagaag

SEQ ID NO: 1292884 - RNA, 18 nt, Human
cagaggaaggggccagag

SEQ ID NO: 1292885 - RNA, 19 nt, Human
cagaggaaggggccagagg

SEQ ID NO: 1292886 - RNA, 20 nt, Human
cagaggaaggggccagaggc

SEQ ID NO: 1292887 - RNA, 21 nt, Human
cagaggaaggggccagaggcu

SEQ ID NO: 1292888 - RNA, 19 nt, Human
cagagaagaaagaacggaa

SEQ ID NO: 1292889 - RNA, 18 nt, Human
cagagaagaaagaacgga

SEQ ID NO: 1292890 - RNA, 14 nt, Human
cagagaagaaagaa

SEQ ID NO: 1292891 - RNA, 11 nt, Human
cagagaagcca

SEQ ID NO: 1292892 - RNA, 12 nt, Human
cagagaagccag

SEQ ID NO: 1292893 - RNA, 13 nt, Human
cagagaagccagc

SEQ ID NO: 1292894 - RNA, 14 nt, Human
cagagaagccagcu

SEQ ID NO: 1292895 - RNA, 15 nt, Human
cagagaagccagcuu

SEQ ID NO: 1292896 - RNA, 16 nt, Human
cagagaagccagcuug

SEQ ID NO: 1292897 - RNA, 17 nt, Human
cagagaagccagcuugu

SEQ ID NO: 1292898 - RNA, 13 nt, Human
cagagaagaaaga

SEQ ID NO: 1292899 - RNA, 16 nt, Human
cagagaacccagccca

SEQ ID NO: 1292900 - RNA, 19 nt, Human
cagagaaaggggagcccac

SEQ ID NO: 1292901 - RNA, 14 nt, Human
cagagaaccaggcu

SEQ ID NO: 1292902 - RNA, 11 nt, Human
cagagaaccca

SEQ ID NO: 1292903 - RNA, 22 nt, Human
cagagaacccagcccacccccg

SEQ ID NO: 1292904 - RNA, 18 nt, Human
cagagaagccagcuuguu

SEQ ID NO: 1292905 - RNA, 19 nt, Human
cagagaagccagcuuguuu

SEQ ID NO: 1292906 - RNA, 20 nt, Human
cagagaagccagcuuguuua

SEQ ID NO: 1292907 - RNA, 21 nt, Human
cagagaagccagcuuguuuac

SEQ ID NO: 1292908 - RNA, 12 nt, Human
cagagaagccau

SEQ ID NO: 1292909 - RNA, 13 nt, Human
cagagaagccauc

SEQ ID NO: 1292910 - RNA, 14 nt, Human
cagagaagccauca

SEQ ID NO: 1292911 - RNA, 18 nt, Human
cagagaagccaucaccuc

SEQ ID NO: 1292912 - RNA, 19 nt, Human
cagagaagccaucaccuca

SEQ ID NO: 1292913 - RNA, 21 nt, Human
cagagaagccaucaccucaga

SEQ ID NO: 1292914 - RNA, 22 nt, Human
cagagaagccaucaccucagau

SEQ ID NO: 1292915 - RNA, 11 nt, Human
cagagaagccu

SEQ ID NO: 1292916 - RNA, 12 nt, Human
cagagaagccuu

SEQ ID NO: 1292917 - RNA, 13 nt, Human
cagagaagccuuc

SEQ ID NO: 1292918 - RNA, 14 nt, Human
cagagaagccuuca

SEQ ID NO: 1292919 - RNA, 15 nt, Human
cagagaagccuucaa

SEQ ID NO: 1292920 - RNA, 16 nt, Human
cagagaagccuucaag

SEQ ID NO: 1292921 - RNA, 17 nt, Human
cagagaagccuucaagc

SEQ ID NO: 1292922 - RNA, 18 nt, Human
cagagaagccuucaagcu

SEQ ID NO: 1292923 - RNA, 19 nt, Human
cagagaagccuucaagcuc

SEQ ID NO: 1292924 - RNA, 20 nt, Human
cagagaagccuucaagcucu

SEQ ID NO: 1292925 - RNA, 21 nt, Human
cagagaagccuucaagcucug

SEQ ID NO: 1292926 - RNA, 22 nt, Human
cagagaagccuucaagcucuga

SEQ ID NO: 1292927 - RNA, 23 nt, Human
cagagaagccuucaagcucugag

SEQ ID NO: 1292928 - RNA, 13 nt, Human
cagagaagucaca

SEQ ID NO: 1292929 - RNA, 16 nt, Human
cagagaagucacaggg

SEQ ID NO: 1292930 - RNA, 18 nt, Human
cagagaagucacagggca

SEQ ID NO: 1292931 - RNA, 20 nt, Human
cagagaagucacagggcagu

SEQ ID NO: 1292932 - RNA, 19 nt, Human
cagagaagucacagggcag

SEQ ID NO: 1292933 - RNA, 13 nt, Human
cagagaauuucua

SEQ ID NO: 1292934 - RNA, 15 nt, Human
cagagaauuucuacc

SEQ ID NO: 1292935 - RNA, 16 nt, Human
cagagaauuucuacca

SEQ ID NO: 1292936 - RNA, 22 nt, Human
cagagaauuucuaccauuucag

SEQ ID NO: 1292937 - RNA, 14 nt, Human
cagagacaacaggu

SEQ ID NO: 1292938 - RNA, 23 nt, Human
cagagacaacagguaaaacaggg

SEQ ID NO: 1292939 - RNA, 22 nt, Human
cagagacaacagguaaaacagg

SEQ ID NO: 1292940 - RNA, 23 nt, Human
cagagaccaagauggcccauccu

SEQ ID NO: 1292941 - RNA, 18 nt, Human
cagagacaugcagagauu

SEQ ID NO: 1292942 - RNA, 12 nt, Human
cagagaccaggg

SEQ ID NO: 1292943 - RNA, 15 nt, Human
cagagacauacuuga

SEQ ID NO: 1292944 - RNA, 16 nt, Human
cagagacauacuugaa

SEQ ID NO: 1292945 - RNA, 17 nt, Human
cagagacauacuugaag

SEQ ID NO: 1292946 - RNA, 19 nt, Human
cagagacauacuugaaggg

SEQ ID NO: 1292947 - RNA, 20 nt, Human
cagagacauacuugaagggc

SEQ ID NO: 1292948 - RNA, 21 nt, Human
cagagacauacuugaagggcc

SEQ ID NO: 1292949 - RNA, 23 nt, Human
cagagacauacuugaagggccag

SEQ ID NO: 1292950 - RNA, 17 nt, Human
cagagacaucagcccuu

SEQ ID NO: 1292951 - RNA, 23 nt, Human
cagagacaucagcccuugggggu

SEQ ID NO: 1292952 - RNA, 14 nt, Human
cagagacaugcaga

SEQ ID NO: 1292953 - RNA, 16 nt, Human
cagagacaugcagaga

SEQ ID NO: 1292954 - RNA, 17 nt, Human
cagagacaugcagagau

SEQ ID NO: 1292955 - RNA, 17 nt, Human
cagagcaagaccccauc

SEQ ID NO: 1292956 - RNA, 16 nt, Human
cagagauucugaacua

SEQ ID NO: 1292957 - RNA, 14 nt, Human
cagagcaaaauaau

SEQ ID NO: 1292958 - RNA, 16 nt, Human
cagagcaaaauaauuu

SEQ ID NO: 1292959 - RNA, 24 nt, Human
cagagauuggguuuuuggacuucu

SEQ ID NO: 1292960 - RNA, 18 nt, Human
cagagcacagcagccccu

SEQ ID NO: 1292961 - RNA, 16 nt, Human
cagagcaccugcuguc

SEQ ID NO: 1292962 - RNA, 18 nt, Human
cagagcaccugcugucug

SEQ ID NO: 1292963 - RNA, 19 nt, Human
cagagcaccugcugucugg

SEQ ID NO: 1292964 - RNA, 13 nt, Human
cagagaguggcuc

SEQ ID NO: 1292965 - RNA, 14 nt, Human
cagagaguggcucc

SEQ ID NO: 1292966 - RNA, 15 nt, Human
cagagaguggcuccu

SEQ ID NO: 1292967 - RNA, 18 nt, Human
cagagaguggcuccuccc

SEQ ID NO: 1292968 - RNA, 16 nt, Human
cagagauaaagaccuu

SEQ ID NO: 1292969 - RNA, 19 nt, Human
cagagauccaaaagaagcc

SEQ ID NO: 1292970 - RNA, 20 nt, Human
cagagauccaaaagaagccc

SEQ ID NO: 1292971 - RNA, 21 nt, Human
cagagauccaaaagaagcccc

SEQ ID NO: 1292972 - RNA, 23 nt, Human
cagagauccaaaagaagccccca

SEQ ID NO: 1292973 - RNA, 20 nt, Human
cagagaugcaccaccaagcc

SEQ ID NO: 1292974 - RNA, 21 nt, Human
cagagaugcaccaccaagcca

SEQ ID NO: 1292975 - RNA, 23 nt, Human
cagagagugagagacauuaacuc

SEQ ID NO: 1292976 - RNA, 14 nt, Human
cagagaugccuccc

SEQ ID NO: 1292977 - RNA, 15 nt, Human
cagagaugccucccu

SEQ ID NO: 1292978 - RNA, 23 nt, Human
cagagaugccucccugagcuaga

SEQ ID NO: 1292979 - RNA, 16 nt, Human
cagagaugccucccug

SEQ ID NO: 1292980 - RNA, 13 nt, Human
cagagaccagggc

SEQ ID NO: 1292981 - RNA, 15 nt, Human
cagagaccagggcuc

SEQ ID NO: 1292982 - RNA, 21 nt, Human
cagagaccagggcuccagccc

SEQ ID NO: 1292983 - RNA, 12 nt, Human
cagagacccagc

SEQ ID NO: 1292984 - RNA, 13 nt, Human
cagagacccagcg

SEQ ID NO: 1292985 - RNA, 22 nt, Human
cagagacccagcggacacacgc

SEQ ID NO: 1292986 - RNA, 15 nt, Human
cagagacccagcgga

SEQ ID NO: 1292987 - RNA, 17 nt, Human
cagagaccuuccagaaa

SEQ ID NO: 1292988 - RNA, 23 nt, Human
cagaggcgcaugaauuugugaag

SEQ ID NO: 1292989 - RNA, 14 nt, Human
cagaggccugggcu

SEQ ID NO: 1292990 - RNA, 16 nt, Human
cagaggccugggcugg

SEQ ID NO: 1292991 - RNA, 17 nt, Human
cagaggcgcacugugac

SEQ ID NO: 1292992 - RNA, 18 nt, Human
cagaggcgcacugugacc

SEQ ID NO: 1292993 - RNA, 19 nt, Human
cagaggccugggcugggaa

SEQ ID NO: 1292994 - RNA, 20 nt, Human
cagaggcuauuauuuucacu

SEQ ID NO: 1292995 - RNA, 21 nt, Human
cagaggcucagauuguaauau

SEQ ID NO: 1292996 - RNA, 13 nt, Human
cagaggccccagc

SEQ ID NO: 1292997 - RNA, 14 nt, Human
cagaggccccagcc

SEQ ID NO: 1292998 - RNA, 16 nt, Human
cagaggccccagccuc

SEQ ID NO: 1292999 - RNA, 17 nt, Human
cagaggccccagccucc

SEQ ID NO: 1293000 - RNA, 16 nt, Human
cagaggcccccagccc

SEQ ID NO: 1293001 - RNA, 17 nt, Human
cagaggcccccagccca

SEQ ID NO: 1293002 - RNA, 19 nt, Human
cagaggcccccagcccagg

SEQ ID NO: 1293003 - RNA, 22 nt, Human
cagaggcccccagcccagggcu

SEQ ID NO: 1293004 - RNA, 23 nt, Human
cagaggcccccagcccagggcuc

SEQ ID NO: 1293005 - RNA, 24 nt, Human
cagaggcccccagcccagggcucc

SEQ ID NO: 1293006 - RNA, 12 nt, Human
cagaggcccuca

SEQ ID NO: 1293007 - RNA, 19 nt, Human
cagaggcccucgcugccag

SEQ ID NO: 1293008 - RNA, 20 nt, Human
cagaggcccucgcugccagc

SEQ ID NO: 1293009 - RNA, 21 nt, Human
cagaggcccucaagucuuucu

SEQ ID NO: 1293010 - RNA, 12 nt, Human
cagaggcugggu

SEQ ID NO: 1293011 - RNA, 13 nt, Human
cagaggcuggguu

SEQ ID NO: 1293012 - RNA, 14 nt, Human
cagaggcuggguuc

SEQ ID NO: 1293013 - RNA, 21 nt, Human
cagaggauugcugccccauca

SEQ ID NO: 1293014 - RNA, 21 nt, Human
cagaggcagcccgcacaccug

SEQ ID NO: 1293015 - RNA, 17 nt, Human
cagaggcaguaccuggg

SEQ ID NO: 1293016 - RNA, 21 nt, Human
cagaggcaguaccugggcaag

SEQ ID NO: 1293017 - RNA, 20 nt, Human
cagaggccagaggcccccag

SEQ ID NO: 1293018 - RNA, 14 nt, Human
cagaggccaaggag

SEQ ID NO: 1293019 - RNA, 20 nt, Human
cagaggcccacauuggaaga

SEQ ID NO: 1293020 - RNA, 14 nt, Human
cagaggcccaggcu

SEQ ID NO: 1293021 - RNA, 15 nt, Human
cagaggcccaggcug

SEQ ID NO: 1293022 - RNA, 16 nt, Human
cagaggcccaggcugc

SEQ ID NO: 1293023 - RNA, 17 nt, Human
cagaggcccaggcugcc

SEQ ID NO: 1293024 - RNA, 19 nt, Human
cagaggcccaggcugccgu

SEQ ID NO: 1293025 - RNA, 18 nt, Human
cagaggcccaggcugccg

SEQ ID NO: 1293026 - RNA, 20 nt, Human
cagagucuggugaagcucac

SEQ ID NO: 1293027 - RNA, 20 nt, Human
cagagugacauccaggagga

SEQ ID NO: 1293028 - RNA, 14 nt, Human
cagagugagaccca

SEQ ID NO: 1293029 - RNA, 15 nt, Human
cagagugagacccag

SEQ ID NO: 1293030 - RNA, 17 nt, Human
cagagugagacccagcc

SEQ ID NO: 1293031 - RNA, 20 nt, Human
cagagugagacccagcccuc

SEQ ID NO: 1293032 - RNA, 14 nt, Human
cagagggcacucug

SEQ ID NO: 1293033 - RNA, 18 nt, Human
cagagucccugccuggac

SEQ ID NO: 1293034 - RNA, 16 nt, Human
cagaguccuuaaaaug

SEQ ID NO: 1293035 - RNA, 14 nt, Human
cagagucccugccu

SEQ ID NO: 1293036 - RNA, 14 nt, Human
cagauaaucacaau

SEQ ID NO: 1293037 - RNA, 15 nt, Human
cagauaaucccugua

SEQ ID NO: 1293038 - RNA, 13 nt, Human
cagauaaugugaa

SEQ ID NO: 1293039 - RNA, 14 nt, Human
cagauaaugugaaa

SEQ ID NO: 1293040 - RNA, 16 nt, Human
cagauaaugugaaaau

SEQ ID NO: 1293041 - RNA, 22 nt, Human
cagauaacugaaaauuauuuaa

SEQ ID NO: 1293042 - RNA, 19 nt, Human
cagauaacugaaaauuauu

SEQ ID NO: 1293043 - RNA, 15 nt, Human
cagauaacuuagcuu

SEQ ID NO: 1293044 - RNA, 16 nt, Human
cagauaacuuagcuua

SEQ ID NO: 1293045 - RNA, 12 nt, Human
cagauaacuuuu

SEQ ID NO: 1293046 - RNA, 13 nt, Human
cagauaacuuuuu

SEQ ID NO: 1293047 - RNA, 20 nt, Human
cagauaacuuuuuuuuuucu

SEQ ID NO: 1293048 - RNA, 20 nt, Human
cagauaagguaaaaugccau

SEQ ID NO: 1293049 - RNA, 22 nt, Human
cagauaagguaaaaugccauga

SEQ ID NO: 1293050 - RNA, 22 nt, Human
cagauaaagguucaugcaaacu

SEQ ID NO: 1293051 - RNA, 23 nt, Human
cagauaaauaguuuaugauucca

SEQ ID NO: 1293052 - RNA, 14 nt, Human
cagauaaacaguag

SEQ ID NO: 1293053 - RNA, 18 nt, Human
cagaguguggacucuggu

SEQ ID NO: 1293054 - RNA, 12 nt, Human
cagaguuacagu

SEQ ID NO: 1293055 - RNA, 13 nt, Human
cagaguuacaguu

SEQ ID NO: 1293056 - RNA, 14 nt, Human
cagaguuacaguuc

SEQ ID NO: 1293057 - RNA, 15 nt, Human
cagaguuacaguucu

SEQ ID NO: 1293058 - RNA, 16 nt, Human
cagaguuacaguucug

SEQ ID NO: 1293059 - RNA, 17 nt, Human
cagaguuacaguucugu

SEQ ID NO: 1293060 - RNA, 18 nt, Human
cagaguuacaguucugug

SEQ ID NO: 1293061 - RNA, 19 nt, Human
cagaguuacaguucugugg

SEQ ID NO: 1293062 - RNA, 23 nt, Human
cagaguucuuuuugaaguauuua

SEQ ID NO: 1293063 - RNA, 20 nt, Human
cagaguugcugcaaaccuga

SEQ ID NO: 1293064 - RNA, 23 nt, Human
cagaucugauuuguaacccacug

SEQ ID NO: 1293065 - RNA, 14 nt, Human
cagaucuggaaccu

SEQ ID NO: 1293066 - RNA, 15 nt, Human
cagaucuggaaccuc

SEQ ID NO: 1293067 - RNA, 18 nt, Human
cagaucuggaaccucagc

SEQ ID NO: 1293068 - RNA, 19 nt, Human
cagaucuggaaccucagcc

SEQ ID NO: 1293069 - RNA, 20 nt, Human
cagaucuggaaccucagccu

SEQ ID NO: 1293070 - RNA, 21 nt, Human
cagaucuggaaccucagccug

SEQ ID NO: 1293071 - RNA, 22 nt, Human
cagaucuggaaccucagccugg

SEQ ID NO: 1293072 - RNA, 23 nt, Human
cagaucuggaaccucagccuggc

SEQ ID NO: 1293073 - RNA, 14 nt, Human
cagauccuggaaau

SEQ ID NO: 1293074 - RNA, 21 nt, Human
cagaucuagucaaucaagucu

SEQ ID NO: 1293075 - RNA, 16 nt, Human
cagaugcagcucaaga

SEQ ID NO: 1293076 - RNA, 13 nt, Human
cagaugcagggca

SEQ ID NO: 1293077 - RNA, 14 nt, Human
cagaugcagggcag

SEQ ID NO: 1293078 - RNA, 23 nt, Human
cagaugacaagaaaggcugcugu

SEQ ID NO: 1293079 - RNA, 16 nt, Human
cagaugaggcuuucca

SEQ ID NO: 1293080 - RNA, 14 nt, Human
cagaugagucacac

SEQ ID NO: 1293081 - RNA, 17 nt, Human
cagaugaaugccgugga

SEQ ID NO: 1293082 - RNA, 21 nt, Human
cagaccauggacacuacaccc

SEQ ID NO: 1293083 - RNA, 22 nt, Human
cagaccauggacacuacaccca

SEQ ID NO: 1293084 - RNA, 17 nt, Human
cagaccauugucucaga

SEQ ID NO: 1293085 - RNA, 13 nt, Human
cagaccccuggcu

SEQ ID NO: 1293086 - RNA, 14 nt, Human
cagaccccuggcuu

SEQ ID NO: 1293087 - RNA, 15 nt, Human
cagaccccuggcuuu

SEQ ID NO: 1293088 - RNA, 16 nt, Human
cagaccccuggcuuuu

SEQ ID NO: 1293089 - RNA, 18 nt, Human
cagaccccuggcuuuuca

SEQ ID NO: 1293090 - RNA, 14 nt, Human
cagaccauggacac

SEQ ID NO: 1293091 - RNA, 16 nt, Human
cagaccauaauguuac

SEQ ID NO: 1293092 - RNA, 19 nt, Human
cagaccagcaggcuggccu

SEQ ID NO: 1293093 - RNA, 23 nt, Human
cagaccacgcccguccugccugu

SEQ ID NO: 1293094 - RNA, 24 nt, Human
cagaccacgcccguccugccugug

SEQ ID NO: 1293095 - RNA, 13 nt, Human
cagaccacggcuc

SEQ ID NO: 1293096 - RNA, 15 nt, Human
cagaccacaugcccc

SEQ ID NO: 1293097 - RNA, 16 nt, Human
cagaccacaugcccca

SEQ ID NO: 1293098 - RNA, 16 nt, Human
cagaccacauugcuuu

SEQ ID NO: 1293099 - RNA, 13 nt, Human
cagaccaccccgc

SEQ ID NO: 1293100 - RNA, 15 nt, Human
cagaccaccccgccu

SEQ ID NO: 1293101 - RNA, 19 nt, Human
cagaccaccccgccugccc

SEQ ID NO: 1293102 - RNA, 22 nt, Human
cagaccaccccgccugcccuca

SEQ ID NO: 1293103 - RNA, 22 nt, Human
cagaccacgcccguccugccug

SEQ ID NO: 1293104 - RNA, 13 nt, Human
cagacauuuuaaa

SEQ ID NO: 1293105 - RNA, 14 nt, Human
cagacauugugcua

SEQ ID NO: 1293106 - RNA, 14 nt, Human
cagacauuggcacc

SEQ ID NO: 1293107 - RNA, 21 nt, Human
cagaccccuggcuuuucacug

SEQ ID NO: 1293108 - RNA, 22 nt, Human
cagaccccuggcuuuucacugc

SEQ ID NO: 1293109 - RNA, 23 nt, Human
cagaccccuggcuuuucacugcu

SEQ ID NO: 1293110 - RNA, 13 nt, Human
cagacccugcccu

SEQ ID NO: 1293111 - RNA, 15 nt, Human
cagacccugcccuug

SEQ ID NO: 1293112 - RNA, 13 nt, Human
cagacccuggagg

SEQ ID NO: 1293113 - RNA, 11 nt, Human
cagacccugga

SEQ ID NO: 1293114 - RNA, 14 nt, Human
cagacccuggaggc

SEQ ID NO: 1293115 - RNA, 18 nt, Human
cagacccuggaggcccca

SEQ ID NO: 1293116 - RNA, 19 nt, Human
cagacccuggaggccccaa

SEQ ID NO: 1293117 - RNA, 22 nt, Human
cagacccuggaggccccaaccc

SEQ ID NO: 1293118 - RNA, 22 nt, Human
cagaccuaggauuucaugauuu

SEQ ID NO: 1293119 - RNA, 18 nt, Human
cagagaaaggggagccca

SEQ ID NO: 1293120 - RNA, 12 nt, Human
cagagaaaaagg

SEQ ID NO: 1293121 - RNA, 20 nt, Human
cagacuuuuuuuaaauagua

SEQ ID NO: 1293122 - RNA, 17 nt, Human
cagagaaaaagggaggg

SEQ ID NO: 1293123 - RNA, 18 nt, Human
cagagaaaaagggagggg

SEQ ID NO: 1293124 - RNA, 13 nt, Human
cagagaaaccagc

SEQ ID NO: 1293125 - RNA, 14 nt, Human
cagagaaaccagcu

SEQ ID NO: 1293126 - RNA, 15 nt, Human
cagagaaaccagcuu

SEQ ID NO: 1293127 - RNA, 16 nt, Human
cagagaaaccagcuuc

SEQ ID NO: 1293128 - RNA, 17 nt, Human
cagagaaaccagcuucc

SEQ ID NO: 1293129 - RNA, 18 nt, Human
cagagaaaccagcuuccu

SEQ ID NO: 1293130 - RNA, 19 nt, Human
cagagaaaccagcuuccuu

SEQ ID NO: 1293131 - RNA, 21 nt, Human
cagagaaaccagcuuccuuca

SEQ ID NO: 1293132 - RNA, 23 nt, Human
cagagaaaccagcuuccuucaga

SEQ ID NO: 1293133 - RNA, 22 nt, Human
cagagaaaccagcuuccuucag

SEQ ID NO: 1293134 - RNA, 12 nt, Human
cagacuucccac

SEQ ID NO: 1293135 - RNA, 22 nt, Human
cagacuucccacggcuccucga

SEQ ID NO: 1293136 - RNA, 14 nt, Human
cagacucccauucc

SEQ ID NO: 1293137 - RNA, 17 nt, Human
cagacucccauuccuga

SEQ ID NO: 1293138 - RNA, 18 nt, Human
cagacucccauuccugaa

SEQ ID NO: 1293139 - RNA, 14 nt, Human
cagacucagacauu

SEQ ID NO: 1293140 - RNA, 14 nt, Human
cagacucagcucug

SEQ ID NO: 1293141 - RNA, 15 nt, Human
cagacucagcucuga

SEQ ID NO: 1293142 - RNA, 19 nt, Human
cagacucccauuccugaag

SEQ ID NO: 1293143 - RNA, 14 nt, Human
cagacuucccagcu

SEQ ID NO: 1293144 - RNA, 15 nt, Human
cagacuucccagcua

SEQ ID NO: 1293145 - RNA, 20 nt, Human
cagacuucccagcuaggaag

SEQ ID NO: 1293146 - RNA, 11 nt, Human
cagacuuguug

SEQ ID NO: 1293147 - RNA, 13 nt, Human
cagaccugauccu

SEQ ID NO: 1293148 - RNA, 14 nt, Human
cagaccugauccug

SEQ ID NO: 1293149 - RNA, 17 nt, Human
cagaccugauccuggag

SEQ ID NO: 1293150 - RNA, 20 nt, Human
cagaccugauccuggaggcc

SEQ ID NO: 1293151 - RNA, 22 nt, Human
cagaccugauccuggaggccca

SEQ ID NO: 1293152 - RNA, 23 nt, Human
cagaccugauccuggaggcccag

SEQ ID NO: 1293153 - RNA, 19 nt, Human
cagaccuguuagcagacag

SEQ ID NO: 1293154 - RNA, 20 nt, Human
cagaccuguuagcagacagg

SEQ ID NO: 1293155 - RNA, 15 nt, Human
cagaccuuuuuuagg

SEQ ID NO: 1293156 - RNA, 16 nt, Human
cagacgccugaggaac

SEQ ID NO: 1293157 - RNA, 13 nt, Human
cagacgccuggcu

SEQ ID NO: 1293158 - RNA, 14 nt, Human
cagacgccuggcug

SEQ ID NO: 1293159 - RNA, 15 nt, Human
cagacgccuggcugc

SEQ ID NO: 1293160 - RNA, 16 nt, Human
cagacgccuggcugcu

SEQ ID NO: 1293161 - RNA, 17 nt, Human
cagacgccuggcugcug

SEQ ID NO: 1293162 - RNA, 23 nt, Human
cagacgccuggcugcugaucgcc

SEQ ID NO: 1293163 - RNA, 17 nt, Human
cagacgcugcugucaca

SEQ ID NO: 1293164 - RNA, 18 nt, Human
cagacgcugcugucacaa

SEQ ID NO: 1293165 - RNA, 19 nt, Human
cagacggaaggguaaacaa

SEQ ID NO: 1293166 - RNA, 20 nt, Human
cagacggaaggguaaacaau

SEQ ID NO: 1293167 - RNA, 22 nt, Human
cagacggaaggguaaacaauau

SEQ ID NO: 1293168 - RNA, 14 nt, Human
cagacuaagccagc

SEQ ID NO: 1293169 - RNA, 15 nt, Human
cagacuaagccagca

SEQ ID NO: 1293170 - RNA, 18 nt, Human
cagacuaagccagcaccg

SEQ ID NO: 1293171 - RNA, 21 nt, Human
cagacuaagccagcaccggac

SEQ ID NO: 1293172 - RNA, 22 nt, Human
cagacuaagccagcaccggacc

SEQ ID NO: 1293173 - RNA, 23 nt, Human
cagacuaagccagcaccggacca

SEQ ID NO: 1293174 - RNA, 21 nt, Human
cagacuacagcuggggugcag

SEQ ID NO: 1293175 - RNA, 12 nt, Human
cagacuacagcu

SEQ ID NO: 1293176 - RNA, 21 nt, Human
cagacuagauggaccugccug

SEQ ID NO: 1293177 - RNA, 22 nt, Human
cagacuagauggaccugccugc

SEQ ID NO: 1293178 - RNA, 23 nt, Human
cagacuagauggaccugccugca

SEQ ID NO: 1293179 - RNA, 14 nt, Human
cagacuagauguag

SEQ ID NO: 1293180 - RNA, 15 nt, Human
cagacuagauguagu

SEQ ID NO: 1293181 - RNA, 19 nt, Human
cagacuagauguaguauuu

SEQ ID NO: 1293182 - RNA, 20 nt, Human
cagacuagauguaguauuuu

SEQ ID NO: 1293183 - RNA, 21 nt, Human
cagacuagauguaguauuuuu

SEQ ID NO: 1293184 - RNA, 15 nt, Human
cagacuauuuuuaga

SEQ ID NO: 1293185 - RNA, 20 nt, Human
cagacuauuuuuagauuuuc

SEQ ID NO: 1293186 - RNA, 22 nt, Human
cagacuauuuuuagauuuucuu

SEQ ID NO: 1293187 - RNA, 21 nt, Human
cagaaugagacauccagcaga

SEQ ID NO: 1293188 - RNA, 15 nt, Human
cagaaucucgcucug

SEQ ID NO: 1293189 - RNA, 11 nt, Human
cagaaugcugu

SEQ ID NO: 1293190 - RNA, 16 nt, Human
cagaaugcuguacauc

SEQ ID NO: 1293191 - RNA, 17 nt, Human
cagaaugcuguacaucu

SEQ ID NO: 1293192 - RNA, 18 nt, Human
cagaaugcuguacaucua

SEQ ID NO: 1293193 - RNA, 21 nt, Human
cagaaugcuguacaucuauuu

SEQ ID NO: 1293194 - RNA, 14 nt, Human
cagaauguauauua

SEQ ID NO: 1293195 - RNA, 21 nt, Human
cagaaugugauaaggaaauca

SEQ ID NO: 1293196 - RNA, 21 nt, Human
cagaaugucauuuugguacuu

SEQ ID NO: 1293197 - RNA, 16 nt, Human
cagaauguugauuaca

SEQ ID NO: 1293198 - RNA, 22 nt, Human
cagaauguugauuacagugcag

SEQ ID NO: 1293199 - RNA, 14 nt, Human
cagaauuaaacuuu

SEQ ID NO: 1293200 - RNA, 15 nt, Human
cagaauuaaacuuuu

SEQ ID NO: 1293201 - RNA, 16 nt, Human
cagaauuaaacuuuua

SEQ ID NO: 1293202 - RNA, 17 nt, Human
cagaauuaaacuuuuaa

SEQ ID NO: 1293203 - RNA, 23 nt, Human
cagaauuaaacuuuuaauucauu

SEQ ID NO: 1293204 - RNA, 23 nt, Human
cagaauuacuguaacugauuaca

SEQ ID NO: 1293205 - RNA, 19 nt, Human
cagaauuaaacuuuuaauu

SEQ ID NO: 1293206 - RNA, 14 nt, Human
cagaauuacuguaa

SEQ ID NO: 1293207 - RNA, 22 nt, Human
cagaauuacuguaacugauuac

SEQ ID NO: 1293208 - RNA, 18 nt, Human
cagaauuuaguguaucca

SEQ ID NO: 1293209 - RNA, 19 nt, Human
cagaauuuggguucugccu

SEQ ID NO: 1293210 - RNA, 20 nt, Human
cagaauuuuauacuuucccu

SEQ ID NO: 1293211 - RNA, 21 nt, Human
cagaauuuuauacuuucccua

SEQ ID NO: 1293212 - RNA, 22 nt, Human
cagaauuuuauacuuucccuac

SEQ ID NO: 1293213 - RNA, 23 nt, Human
cagaauuuuauacuuucccuacc

SEQ ID NO: 1293214 - RNA, 17 nt, Human
cagacaacacguuacua

SEQ ID NO: 1293215 - RNA, 21 nt, Human
cagacacaaagagacaaagcu

SEQ ID NO: 1293216 - RNA, 14 nt, Human
cagacacaggcccu

SEQ ID NO: 1293217 - RNA, 15 nt, Human
cagacacaggcccuc

SEQ ID NO: 1293218 - RNA, 18 nt, Human
cagacacaggcccucccu

SEQ ID NO: 1293219 - RNA, 12 nt, Human
cagacacccagg

SEQ ID NO: 1293220 - RNA, 13 nt, Human
cagacacccagga

SEQ ID NO: 1293221 - RNA, 14 nt, Human
cagacacccaggac

SEQ ID NO: 1293222 - RNA, 15 nt, Human
cagacacccaggacu

SEQ ID NO: 1293223 - RNA, 17 nt, Human
cagacacccaggacuua

SEQ ID NO: 1293224 - RNA, 22 nt, Human
cagacacugguuugaagaaugu

SEQ ID NO: 1293225 - RNA, 18 nt, Human
cagacaccuuggacaucc

SEQ ID NO: 1293226 - RNA, 14 nt, Human
cagacaccuuggac

SEQ ID NO: 1293227 - RNA, 14 nt, Human
cagacauaaaggaa

SEQ ID NO: 1293228 - RNA, 15 nt, Human
cagacauaaaggaaa

SEQ ID NO: 1293229 - RNA, 17 nt, Human
cagacauaaaggaaaag

SEQ ID NO: 1293230 - RNA, 19 nt, Human
cagacauaaaggaaaagac

SEQ ID NO: 1293231 - RNA, 19 nt, Human
cagacauagaauuaacaca

SEQ ID NO: 1293232 - RNA, 17 nt, Human
cagacauagaauuaaca

SEQ ID NO: 1293233 - RNA, 22 nt, Human
cagacauaaaggaaaagacaca

SEQ ID NO: 1293234 - RNA, 20 nt, Human
cagacauaaaggaaaagaca

SEQ ID NO: 1293235 - RNA, 17 nt, Human
cagacauccaaacuaaa

SEQ ID NO: 1293236 - RNA, 22 nt, Human
cagacauccaaacuaaaaggaa

SEQ ID NO: 1293237 - RNA, 18 nt, Human
cagacaugccacaaggac

SEQ ID NO: 1293238 - RNA, 20 nt, Human
cagacaucugagguuuuauu

SEQ ID NO: 1293239 - RNA, 23 nt, Human
cagaaacacccucacacugggac

SEQ ID NO: 1293240 - RNA, 22 nt, Human
cagaaacacccucacacuggga

SEQ ID NO: 1293241 - RNA, 21 nt, Human
cagaaacacccucacacuggg

SEQ ID NO: 1293242 - RNA, 20 nt, Human
cagaaacacccucacacugg

SEQ ID NO: 1293243 - RNA, 18 nt, Human
cagaaacacccucacacu

SEQ ID NO: 1293244 - RNA, 18 nt, Human
cagaaagcagaacaguga

SEQ ID NO: 1293245 - RNA, 24 nt, Human
cagaaagaaguggggacagagcag

SEQ ID NO: 1293246 - RNA, 22 nt, Human
cagaaagcaucccucacccauc

SEQ ID NO: 1293247 - RNA, 23 nt, Human
cagaaagcaguugagacaagaaa

SEQ ID NO: 1293248 - RNA, 22 nt, Human
cagaaagcaguugagacaagaa

SEQ ID NO: 1293249 - RNA, 19 nt, Human
cagaaagcagaacagugau

SEQ ID NO: 1293250 - RNA, 20 nt, Human
cagaaagccccacccaggcc

SEQ ID NO: 1293251 - RNA, 21 nt, Human
cagaaagccccacccaggcca

SEQ ID NO: 1293252 - RNA, 22 nt, Human
cagaaagccccacccaggccag

SEQ ID NO: 1293253 - RNA, 23 nt, Human
cagaaagccccacccaggccagg

SEQ ID NO: 1293254 - RNA, 19 nt, Human
cagaaagccugggugacau

SEQ ID NO: 1293255 - RNA, 22 nt, Human
cagaaagccugggugacauuug

SEQ ID NO: 1293256 - RNA, 14 nt, Human
cagaaagcugccug

SEQ ID NO: 1293257 - RNA, 15 nt, Human
cagaaagcugccugg

SEQ ID NO: 1293258 - RNA, 23 nt, Human
cagaacagugauuaccagggacu

SEQ ID NO: 1293259 - RNA, 16 nt, Human
cagaacauagacagaa

SEQ ID NO: 1293260 - RNA, 21 nt, Human
cagaacauagacagaagaaac

SEQ ID NO: 1293261 - RNA, 19 nt, Human
cagaacauagacagaagaa

SEQ ID NO: 1293262 - RNA, 15 nt, Human
cagaaccaauuauuu

SEQ ID NO: 1293263 - RNA, 20 nt, Human
cagaaccaauuauuuucauc

SEQ ID NO: 1293264 - RNA, 17 nt, Human
cagaaccaauuauuuuc

SEQ ID NO: 1293265 - RNA, 12 nt, Human
cagaaccacagg

SEQ ID NO: 1293266 - RNA, 20 nt, Human
cagaaccacagggcuauuuu

SEQ ID NO: 1293267 - RNA, 14 nt, Human
cagaaccacagggc

SEQ ID NO: 1293268 - RNA, 23 nt, Human
cagaaaagaaagcuacagaagaa

SEQ ID NO: 1293269 - RNA, 23 nt, Human
cagaaaacccuugggccagaagu

SEQ ID NO: 1293270 - RNA, 17 nt, Human
cagaaaaguugaauuuu

SEQ ID NO: 1293271 - RNA, 20 nt, Human
cagaaaaguugaauuuuaca

SEQ ID NO: 1293272 - RNA, 22 nt, Human
cagaaaaguugaauuuuacaug

SEQ ID NO: 1293273 - RNA, 19 nt, Human
cagaaaauaucccuccugu

SEQ ID NO: 1293274 - RNA, 23 nt, Human
cagaaaauaaggcacccaucugu

SEQ ID NO: 1293275 - RNA, 12 nt, Human
cagaaaauaagg

SEQ ID NO: 1293276 - RNA, 21 nt, Human
cagaaaauaaggcacccaucu

SEQ ID NO: 1293277 - RNA, 19 nt, Human
cagaaaaugaacacagcag

SEQ ID NO: 1293278 - RNA, 14 nt, Human
cagaaaauguugag

SEQ ID NO: 1293279 - RNA, 18 nt, Human
cagaaaauguugagaauc

SEQ ID NO: 1293280 - RNA, 23 nt, Human
cagaaaauguugagaaucccaaa

SEQ ID NO: 1293281 - RNA, 13 nt, Human
cagaaaauucugu

SEQ ID NO: 1293282 - RNA, 14 nt, Human
cagaaaauucugug

SEQ ID NO: 1293283 - RNA, 15 nt, Human
cagaaaauucugugc

SEQ ID NO: 1293284 - RNA, 23 nt, Human
cagaaaauucugugccuuguuuu

SEQ ID NO: 1293285 - RNA, 18 nt, Human
cagaaacaaaaacacuaa

SEQ ID NO: 1293286 - RNA, 20 nt, Human
cagaaacaaaaacacuaaaa

SEQ ID NO: 1293287 - RNA, 17 nt, Human
cagaaaauucugugccu

SEQ ID NO: 1293288 - RNA, 12 nt, Human
cacuuugcauaa

SEQ ID NO: 1293289 - RNA, 17 nt, Human
cacuuugcacagcucuc

SEQ ID NO: 1293290 - RNA, 14 nt, Human
cacuuugcacagcu

SEQ ID NO: 1293291 - RNA, 19 nt, Human
cacuuugcacugauauauc

SEQ ID NO: 1293292 - RNA, 22 nt, Human
cacuuugcacugauauaucaug

SEQ ID NO: 1293293 - RNA, 12 nt, Human
cacuuugcuuua

SEQ ID NO: 1293294 - RNA, 17 nt, Human
cacuuugcuuuaauaua

SEQ ID NO: 1293295 - RNA, 18 nt, Human
cacuuugcuuuaauauaa

SEQ ID NO: 1293296 - RNA, 19 nt, Human
cacuuugcuuuaauauaaa

SEQ ID NO: 1293297 - RNA, 20 nt, Human
cacuuugcuuuaauauaaau

SEQ ID NO: 1293298 - RNA, 18 nt, Human
cacuuuggcuuauaauuc

SEQ ID NO: 1293299 - RNA, 19 nt, Human
cacuugguaauuguacuaa

SEQ ID NO: 1293300 - RNA, 15 nt, Human
cacuugguaauugua

SEQ ID NO: 1293301 - RNA, 20 nt, Human
cacuuucuauccucuguaaa

SEQ ID NO: 1293302 - RNA, 19 nt, Human
cacuuucucaguuuucaua

SEQ ID NO: 1293303 - RNA, 23 nt, Human
cacuuucuuuuuuuucuauuuca

SEQ ID NO: 1293304 - RNA, 11 nt, Human
cacuuucuuau

SEQ ID NO: 1293305 - RNA, 23 nt, Human
cacuuuggcuuauaauucuuuca

SEQ ID NO: 1293306 - RNA, 15 nt, Human
cacuuuuugcagcuu

SEQ ID NO: 1293307 - RNA, 18 nt, Human
cacuuuuugcagcuuucu

SEQ ID NO: 1293308 - RNA, 14 nt, Human
cacuuuuugcagcu

SEQ ID NO: 1293309 - RNA, 14 nt, Human
cacuuuuugaggca

SEQ ID NO: 1293310 - RNA, 16 nt, Human
cacuuuuugaggcaaa

SEQ ID NO: 1293311 - RNA, 17 nt, Human
cacuuuuucucuuucca

SEQ ID NO: 1293312 - RNA, 20 nt, Human
cacuuuuugaggcaaaagaa

SEQ ID NO: 1293313 - RNA, 22 nt, Human
cagaaaaaccaacaucuacaaa

SEQ ID NO: 1293314 - RNA, 15 nt, Human
cagaaaaaccuuggg

SEQ ID NO: 1293315 - RNA, 18 nt, Human
cagaaaaauauguaccaa

SEQ ID NO: 1293316 - RNA, 22 nt, Human
cagaaaaauauguaccaagaau

SEQ ID NO: 1293317 - RNA, 13 nt, Human
cagaaaacaaaac

SEQ ID NO: 1293318 - RNA, 14 nt, Human
cagaaaacaaaacu

SEQ ID NO: 1293319 - RNA, 16 nt, Human
cagaaaacauguuucc

SEQ ID NO: 1293320 - RNA, 17 nt, Human
cagaaaacccuugggcc

SEQ ID NO: 1293321 - RNA, 19 nt, Human
cagaaaacccuugggccag

SEQ ID NO: 1293322 - RNA, 20 nt, Human
cagaaaacccuugggccaga

SEQ ID NO: 1293323 - RNA, 22 nt, Human
cagaaaacccuugggccagaag

SEQ ID NO: 1293324 - RNA, 16 nt, Human
cacuuuuccucccuca

SEQ ID NO: 1293325 - RNA, 17 nt, Human
cacuuuugacaaaggca

SEQ ID NO: 1293326 - RNA, 18 nt, Human
cacuuuugacaaaggcaa

SEQ ID NO: 1293327 - RNA, 18 nt, Human
cacuuuuauuuagcacca

SEQ ID NO: 1293328 - RNA, 12 nt, Human
cacuuuucccac

SEQ ID NO: 1293329 - RNA, 13 nt, Human
cacuuuucccacu

SEQ ID NO: 1293330 - RNA, 14 nt, Human
cacuuuucccacuc

SEQ ID NO: 1293331 - RNA, 15 nt, Human
cacuuuucccacucc

SEQ ID NO: 1293332 - RNA, 19 nt, Human
cacuuuucccacuccaagc

SEQ ID NO: 1293333 - RNA, 22 nt, Human
cacuuugguaccagauaacuuu

SEQ ID NO: 1293334 - RNA, 20 nt, Human
cacuuugucgcccaggcugg

SEQ ID NO: 1293335 - RNA, 20 nt, Human
cacuuuguuucguggggagg

SEQ ID NO: 1293336 - RNA, 21 nt, Human
cacuuuguuucguggggaggu

SEQ ID NO: 1293337 - RNA, 17 nt, Human
cacuuuuaaugaacaaa

SEQ ID NO: 1293338 - RNA, 13 nt, Human
cagaacuacuucu

SEQ ID NO: 1293339 - RNA, 13 nt, Human
cagaacuagaauu

SEQ ID NO: 1293340 - RNA, 19 nt, Human
cagaacuagaauuugauua

SEQ ID NO: 1293341 - RNA, 19 nt, Human
cagaacuaccaccugacau

SEQ ID NO: 1293342 - RNA, 18 nt, Human
cagaaccggagagccagc

SEQ ID NO: 1293343 - RNA, 22 nt, Human
cagaacccuuggagccaaugga

SEQ ID NO: 1293344 - RNA, 23 nt, Human
cagaaccccuacaugaaacagaa

SEQ ID NO: 1293345 - RNA, 19 nt, Human
cagaaccggagagccagcu

SEQ ID NO: 1293346 - RNA, 15 nt, Human
cagaacuagaauuug

SEQ ID NO: 1293347 - RNA, 20 nt, Human
cagaacucaaauggggccag

SEQ ID NO: 1293348 - RNA, 21 nt, Human
cagaacucaaauggggccaga

SEQ ID NO: 1293349 - RNA, 22 nt, Human
cagaacucaaauggggccagau

SEQ ID NO: 1293350 - RNA, 14 nt, Human
cagaacucuuucaa

SEQ ID NO: 1293351 - RNA, 15 nt, Human
cagaacucuuucaaa

SEQ ID NO: 1293352 - RNA, 16 nt, Human
cagaacucuuucaaaa

SEQ ID NO: 1293353 - RNA, 13 nt, Human
cagaacuucagaa

SEQ ID NO: 1293354 - RNA, 16 nt, Human
cagaacuucagaaaga

SEQ ID NO: 1293355 - RNA, 17 nt, Human
cagaacuucagaaagac

SEQ ID NO: 1293356 - RNA, 19 nt, Human
cagaacuucagaaagacuu

SEQ ID NO: 1293357 - RNA, 20 nt, Human
cagaacuucagaaagacuug

SEQ ID NO: 1293358 - RNA, 21 nt, Human
cagaacuugacccugagcuga

SEQ ID NO: 1293359 - RNA, 19 nt, Human
cagaacuugugcccucccu

SEQ ID NO: 1293360 - RNA, 14 nt, Human
cagaagaaacaagg

SEQ ID NO: 1293361 - RNA, 20 nt, Human
cagaagcaacccaaauguuc

SEQ ID NO: 1293362 - RNA, 19 nt, Human
cagaagcaacccaaauguu

SEQ ID NO: 1293363 - RNA, 14 nt, Human
cagaagaugacuga

SEQ ID NO: 1293364 - RNA, 22 nt, Human
cagaaggaaggcagggaggagg

SEQ ID NO: 1293365 - RNA, 20 nt, Human
cagaaggaaggcagggagga

SEQ ID NO: 1293366 - RNA, 15 nt, Human
cagaaggaaggcagg

SEQ ID NO: 1293367 - RNA, 11 nt, Human
cagaaggaagg

SEQ ID NO: 1293368 - RNA, 18 nt, Human
cagaaggcaaacccauca

SEQ ID NO: 1293369 - RNA, 21 nt, Human
cagaagcucccccagcaaagc

SEQ ID NO: 1293370 - RNA, 23 nt, Human
cagaagcucccccagcaaagccc

SEQ ID NO: 1293371 - RNA, 18 nt, Human
cagaagccugaugcugac

SEQ ID NO: 1293372 - RNA, 12 nt, Human
cagaagccuggg

SEQ ID NO: 1293373 - RNA, 13 nt, Human
cagaagccugggg

SEQ ID NO: 1293374 - RNA, 14 nt, Human
cagaagccuggggg

SEQ ID NO: 1293375 - RNA, 19 nt, Human
cagaagccugggggccugg

SEQ ID NO: 1293376 - RNA, 20 nt, Human
cagaagccugggggccuggc

SEQ ID NO: 1293377 - RNA, 21 nt, Human
cagaagccugggggccuggcu

SEQ ID NO: 1293378 - RNA, 22 nt, Human
cagaagccugggggccuggcug

SEQ ID NO: 1293379 - RNA, 23 nt, Human
cagaagccugggggccuggcugg

SEQ ID NO: 1293380 - RNA, 24 nt, Human
cagaagccugggggccuggcuggc

SEQ ID NO: 1293381 - RNA, 15 nt, Human
cagaagcucccccag

SEQ ID NO: 1293382 - RNA, 16 nt, Human
cagaagcucccccagc

SEQ ID NO: 1293383 - RNA, 17 nt, Human
cagaagcucccccagca

SEQ ID NO: 1293384 - RNA, 18 nt, Human
cagaagcucccccagcaa

SEQ ID NO: 1293385 - RNA, 19 nt, Human
cagaagcucccccagcaaa

SEQ ID NO: 1293386 - RNA, 15 nt, Human
cagaaguaccagacu

SEQ ID NO: 1293387 - RNA, 16 nt, Human
cagaaguaccagacua

SEQ ID NO: 1293388 - RNA, 20 nt, Human
cagaaguaccagacuagaug

SEQ ID NO: 1293389 - RNA, 14 nt, Human
cagaagucaucuug

SEQ ID NO: 1293390 - RNA, 16 nt, Human
cagaagucaucuugcu

SEQ ID NO: 1293391 - RNA, 17 nt, Human
cagaagucaucuugcua

SEQ ID NO: 1293392 - RNA, 20 nt, Human
cagaagucaucuugcuacca

SEQ ID NO: 1293393 - RNA, 22 nt, Human
cagaagucaucuugcuaccagu

SEQ ID NO: 1293394 - RNA, 13 nt, Human
cagaagggagggc

SEQ ID NO: 1293395 - RNA, 15 nt, Human
cagaagggagggcag

SEQ ID NO: 1293396 - RNA, 16 nt, Human
cagaagggagggcaga

SEQ ID NO: 1293397 - RNA, 17 nt, Human
cagaagggagggcagag

SEQ ID NO: 1293398 - RNA, 19 nt, Human
cagaagggagggcagagcu

SEQ ID NO: 1293399 - RNA, 21 nt, Human
cagaagggagggcagagcugg

SEQ ID NO: 1293400 - RNA, 22 nt, Human
cagaagggagggcagagcuggu

SEQ ID NO: 1293401 - RNA, 23 nt, Human
cagaagggagggcagagcuggug

SEQ ID NO: 1293402 - RNA, 17 nt, Human
cagaaggggagauggac

SEQ ID NO: 1293403 - RNA, 15 nt, Human
cagaagggggucucu

SEQ ID NO: 1293404 - RNA, 23 nt, Human
cagaagguugcucuagauugaga

SEQ ID NO: 1293405 - RNA, 23 nt, Human
cagagaauuucuaccauuucaga

SEQ ID NO: 1293406 - RNA, 15 nt, Human
cagaaaacaaaacug

SEQ ID NO: 1293407 - RNA, 16 nt, Human
cacucguguguuucua

SEQ ID NO: 1293408 - RNA, 15 nt, Human
cacucguguguuucu

SEQ ID NO: 1293409 - RNA, 13 nt, Human
cacucuaaagcaa

SEQ ID NO: 1293410 - RNA, 20 nt, Human
cacucgcuagcaguggcagg

SEQ ID NO: 1293411 - RNA, 13 nt, Human
cacucgucucccc

SEQ ID NO: 1293412 - RNA, 14 nt, Human
cacucgucuccccc

SEQ ID NO: 1293413 - RNA, 16 nt, Human
cacucgucucccccaa

SEQ ID NO: 1293414 - RNA, 19 nt, Human
cacucgaggucgggcagca

SEQ ID NO: 1293415 - RNA, 15 nt, Human
cacuccuuuuaaaga

SEQ ID NO: 1293416 - RNA, 13 nt, Human
cacucgacaugaa

SEQ ID NO: 1293417 - RNA, 15 nt, Human
cacuccuuccugccc

SEQ ID NO: 1293418 - RNA, 17 nt, Human
cacuccuuccugcccca

SEQ ID NO: 1293419 - RNA, 21 nt, Human
cacuccuuccugccccaacuc

SEQ ID NO: 1293420 - RNA, 16 nt, Human
cacucgcuagcagugg

SEQ ID NO: 1293421 - RNA, 21 nt, Human
cacucgcuagcaguggcaggc

SEQ ID NO: 1293422 - RNA, 12 nt, Human
cacuccuuccug

SEQ ID NO: 1293423 - RNA, 13 nt, Human
cacuccuuccugc

SEQ ID NO: 1293424 - RNA, 14 nt, Human
cacuccuuccugcc

SEQ ID NO: 1293425 - RNA, 19 nt, Human
cacucuagucaaugacaug

SEQ ID NO: 1293426 - RNA, 14 nt, Human
cacucuacuuagca

SEQ ID NO: 1293427 - RNA, 11 nt, Human
cacucuagauu

SEQ ID NO: 1293428 - RNA, 14 nt, Human
cacucuagauucca

SEQ ID NO: 1293429 - RNA, 18 nt, Human
cacucuagguuuuacaga

SEQ ID NO: 1293430 - RNA, 18 nt, Human
cacucuagucaaugacau

SEQ ID NO: 1293431 - RNA, 20 nt, Human
cacucuagucaaugacauga

SEQ ID NO: 1293432 - RNA, 16 nt, Human
cacucugaguguuuua

SEQ ID NO: 1293433 - RNA, 12 nt, Human
cacucugcucug

SEQ ID NO: 1293434 - RNA, 13 nt, Human
cacucugcucuga

SEQ ID NO: 1293435 - RNA, 14 nt, Human
cacucugcucugau

SEQ ID NO: 1293436 - RNA, 15 nt, Human
cacucugcucugaug

SEQ ID NO: 1293437 - RNA, 16 nt, Human
cacucugcucugaugc

SEQ ID NO: 1293438 - RNA, 12 nt, Human
cacucuggcagc

SEQ ID NO: 1293439 - RNA, 13 nt, Human
cacucuggcagcc

SEQ ID NO: 1293440 - RNA, 14 nt, Human
cacucuggcagcca

SEQ ID NO: 1293441 - RNA, 15 nt, Human
cacucuggcagccac

SEQ ID NO: 1293442 - RNA, 16 nt, Human
cacucuggcagccaca

SEQ ID NO: 1293443 - RNA, 17 nt, Human
cacucugcucugaugca

SEQ ID NO: 1293444 - RNA, 12 nt, Human
cacucugcuguu

SEQ ID NO: 1293445 - RNA, 12 nt, Human
cacucugcuucu

SEQ ID NO: 1293446 - RNA, 13 nt, Human
cacucugcuucuc

SEQ ID NO: 1293447 - RNA, 14 nt, Human
cacucugcuucucu

SEQ ID NO: 1293448 - RNA, 15 nt, Human
cacucugcuucucug

SEQ ID NO: 1293449 - RNA, 16 nt, Human
cacucugcuucucuga

SEQ ID NO: 1293450 - RNA, 17 nt, Human
cacucugcuucucugac

SEQ ID NO: 1293451 - RNA, 18 nt, Human
cacucugcuucucugacu

SEQ ID NO: 1293452 - RNA, 19 nt, Human
cacucugcuucucugacuu

SEQ ID NO: 1293453 - RNA, 21 nt, Human
cacucugcuucucugacuucu

SEQ ID NO: 1293454 - RNA, 16 nt, Human
cacucugcuuguuauu

SEQ ID NO: 1293455 - RNA, 13 nt, Human
cacucccucacaa

SEQ ID NO: 1293456 - RNA, 14 nt, Human
cacucccuccuaac

SEQ ID NO: 1293457 - RNA, 13 nt, Human
cacucccuugggc

SEQ ID NO: 1293458 - RNA, 16 nt, Human
cacucccuugggcucc

SEQ ID NO: 1293459 - RNA, 20 nt, Human
cacucccuugggcucccugu

SEQ ID NO: 1293460 - RNA, 13 nt, Human
cacuccuaccugg

SEQ ID NO: 1293461 - RNA, 14 nt, Human
cacuccuaccuggu

SEQ ID NO: 1293462 - RNA, 19 nt, Human
cacuccgagaggugggcca

SEQ ID NO: 1293463 - RNA, 12 nt, Human
cacuccucugac

SEQ ID NO: 1293464 - RNA, 13 nt, Human
cacuccucugacu

SEQ ID NO: 1293465 - RNA, 20 nt, Human
cacuccucugacucagggcu

SEQ ID NO: 1293466 - RNA, 21 nt, Human
cacuccucugacucagggcuc

SEQ ID NO: 1293467 - RNA, 23 nt, Human
cacuccucugacucagggcuccu

SEQ ID NO: 1293468 - RNA, 13 nt, Human
cacuccucugcug

SEQ ID NO: 1293469 - RNA, 14 nt, Human
cacuccucugcuga

SEQ ID NO: 1293470 - RNA, 16 nt, Human
cacuccucugcugacc

SEQ ID NO: 1293471 - RNA, 18 nt, Human
cacuccucugcugaccug

SEQ ID NO: 1293472 - RNA, 21 nt, Human
cacuccucugcugaccugcug

SEQ ID NO: 1293473 - RNA, 22 nt, Human
cacuccucugcugaccugcuga

SEQ ID NO: 1293474 - RNA, 18 nt, Human
cacucagucucucuucuc

SEQ ID NO: 1293475 - RNA, 18 nt, Human
cacucagccacccugagu

SEQ ID NO: 1293476 - RNA, 22 nt, Human
cacucaugugacucuuuccaac

SEQ ID NO: 1293477 - RNA, 16 nt, Human
cacucaugugacucuu

SEQ ID NO: 1293478 - RNA, 19 nt, Human
cacucaugcauuguccucu

SEQ ID NO: 1293479 - RNA, 20 nt, Human
cacucaucaauggggccagu

SEQ ID NO: 1293480 - RNA, 17 nt, Human
cacucaugcauuguccu

SEQ ID NO: 1293481 - RNA, 18 nt, Human
cacucaugcauuguccuc

SEQ ID NO: 1293482 - RNA, 17 nt, Human
cacuaagagagaaugag

SEQ ID NO: 1293483 - RNA, 14 nt, Human
cacuaaccuugccu

SEQ ID NO: 1293484 - RNA, 23 nt, Human
cacuaaccuugccugguacagua

SEQ ID NO: 1293485 - RNA, 21 nt, Human
cacuaacgguugaguuuugac

SEQ ID NO: 1293486 - RNA, 20 nt, Human
cacuaacguugagccccugg

SEQ ID NO: 1293487 - RNA, 16 nt, Human
cacuaacaugauuugg

SEQ ID NO: 1293488 - RNA, 21 nt, Human
cacuaaauugacacuuaaaaa

SEQ ID NO: 1293489 - RNA, 14 nt, Human
cacuaacagagugg

SEQ ID NO: 1293490 - RNA, 22 nt, Human
cacuaaccaagcugaguuuccu

SEQ ID NO: 1293491 - RNA, 23 nt, Human
cacuaaccaagcugaguuuccua

SEQ ID NO: 1293492 - RNA, 19 nt, Human
cacuaguauuucuaugaaa

SEQ ID NO: 1293493 - RNA, 18 nt, Human
cacuaucccggcugcccu

SEQ ID NO: 1293494 - RNA, 19 nt, Human
cacuaucccggcugcccuu

SEQ ID NO: 1293495 - RNA, 14 nt, Human
cacuaucuuucagc

SEQ ID NO: 1293496 - RNA, 21 nt, Human
cacucaaggcggugcuugaua

SEQ ID NO: 1293497 - RNA, 11 nt, Human
cacucaaggcg

SEQ ID NO: 1293498 - RNA, 17 nt, Human
cacucaaggcggugcuu

SEQ ID NO: 1293499 - RNA, 19 nt, Human
cacucaaggcggugcuuga

SEQ ID NO: 1293500 - RNA, 17 nt, Human
cacucacaacagcugcc

SEQ ID NO: 1293501 - RNA, 12 nt, Human
cacucaccugca

SEQ ID NO: 1293502 - RNA, 16 nt, Human
cacucacuaggccccc

SEQ ID NO: 1293503 - RNA, 17 nt, Human
cacucacuaggccccca

SEQ ID NO: 1293504 - RNA, 22 nt, Human
cacucacuaggcccccacuugc

SEQ ID NO: 1293505 - RNA, 13 nt, Human
cacucagaagccu

SEQ ID NO: 1293506 - RNA, 14 nt, Human
cacucagaagccug

SEQ ID NO: 1293507 - RNA, 15 nt, Human
cacucagaagccugg

SEQ ID NO: 1293508 - RNA, 16 nt, Human
cacucagaagccuggg

SEQ ID NO: 1293509 - RNA, 17 nt, Human
cacucagaagccugggg

SEQ ID NO: 1293510 - RNA, 19 nt, Human
cacucagaagccugggggc

SEQ ID NO: 1293511 - RNA, 22 nt, Human
cacucagaagccugggggccug

SEQ ID NO: 1293512 - RNA, 12 nt, Human
cacucagaccug

SEQ ID NO: 1293513 - RNA, 23 nt, Human
cacucagaagccugggggccugg

SEQ ID NO: 1293514 - RNA, 15 nt, Human
cacucagagacaugc

SEQ ID NO: 1293515 - RNA, 16 nt, Human
cacucagagacaugca

SEQ ID NO: 1293516 - RNA, 18 nt, Human
cacucagagacaugcaga

SEQ ID NO: 1293517 - RNA, 20 nt, Human
cacucagagacaugcagaga

SEQ ID NO: 1293518 - RNA, 12 nt, Human
cacucagcacaa

SEQ ID NO: 1293519 - RNA, 13 nt, Human
cacucagcacaag

SEQ ID NO: 1293520 - RNA, 15 nt, Human
cacucagcacaaggc

SEQ ID NO: 1293521 - RNA, 22 nt, Human
cacucagcacaaggccaucugg

SEQ ID NO: 1293522 - RNA, 18 nt, Human
cacucagauccuccucau

SEQ ID NO: 1293523 - RNA, 17 nt, Human
cacucagcacuuggccc

SEQ ID NO: 1293524 - RNA, 16 nt, Human
cacucagccacccuga

SEQ ID NO: 1293525 - RNA, 17 nt, Human
cacucagccacccugag

SEQ ID NO: 1293526 - RNA, 13 nt, Human
cacuaaacaaaga

SEQ ID NO: 1293527 - RNA, 19 nt, Human
cacuaaaacacacaggugc

SEQ ID NO: 1293528 - RNA, 21 nt, Human
cacuaaagcaggccuuuugau

SEQ ID NO: 1293529 - RNA, 16 nt, Human
cacgugggcucauaug

SEQ ID NO: 1293530 - RNA, 18 nt, Human
cacgugguaaaacacuug

SEQ ID NO: 1293531 - RNA, 22 nt, Human
cacguucuuacuaguuucccuu

SEQ ID NO: 1293532 - RNA, 15 nt, Human
cacguguguuuuucu

SEQ ID NO: 1293533 - RNA, 17 nt, Human
cacguguguuuuucuau

SEQ ID NO: 1293534 - RNA, 18 nt, Human
cacguguguuuuucuauu

SEQ ID NO: 1293535 - RNA, 19 nt, Human
cacguguguuuuucuauua

SEQ ID NO: 1293536 - RNA, 20 nt, Human
cacguguguuuuucuauuaa

SEQ ID NO: 1293537 - RNA, 22 nt, Human
cacguguguuuuucuauuaaaa

SEQ ID NO: 1293538 - RNA, 16 nt, Human
cacguguuugugcugu

SEQ ID NO: 1293539 - RNA, 23 nt, Human
cacguguguuuuucuauuaaaag

SEQ ID NO: 1293540 - RNA, 20 nt, Human
cacgucaaaugcauacaagu

SEQ ID NO: 1293541 - RNA, 13 nt, Human
cacguccugagaa

SEQ ID NO: 1293542 - RNA, 19 nt, Human
cacguccugagaaagcuca

SEQ ID NO: 1293543 - RNA, 13 nt, Human
cacgugacagccg

SEQ ID NO: 1293544 - RNA, 14 nt, Human
cacgugacacaaac

SEQ ID NO: 1293545 - RNA, 17 nt, Human
cacgugacacaaacaca

SEQ ID NO: 1293546 - RNA, 12 nt, Human
cacguggccucu

SEQ ID NO: 1293547 - RNA, 13 nt, Human
cacguggccucuu

SEQ ID NO: 1293548 - RNA, 17 nt, Human
cacguggccucuugagc

SEQ ID NO: 1293549 - RNA, 18 nt, Human
cacguggccucuugagca

SEQ ID NO: 1293550 - RNA, 20 nt, Human
cacguggccucuugagcagu

SEQ ID NO: 1293551 - RNA, 23 nt, Human
cacguggccucuugagcaguggc

SEQ ID NO: 1293552 - RNA, 15 nt, Human
cacgggggccaagga

SEQ ID NO: 1293553 - RNA, 22 nt, Human
cacggucggggcaucuggccug

SEQ ID NO: 1293554 - RNA, 20 nt, Human
cacggcuccucgagauccca

SEQ ID NO: 1293555 - RNA, 22 nt, Human
cacggcuccucgagaucccaac

SEQ ID NO: 1293556 - RNA, 17 nt, Human
cacggcucuguccccag

SEQ ID NO: 1293557 - RNA, 18 nt, Human
cacggcucuguccccagc

SEQ ID NO: 1293558 - RNA, 19 nt, Human
cacggcucuguccccagcc

SEQ ID NO: 1293559 - RNA, 20 nt, Human
cacggcucuguccccagccu

SEQ ID NO: 1293560 - RNA, 21 nt, Human
cacggcucuguccccagccug

SEQ ID NO: 1293561 - RNA, 17 nt, Human
cacggcugcgcacugug

SEQ ID NO: 1293562 - RNA, 16 nt, Human
cacggcugcgcacugu

SEQ ID NO: 1293563 - RNA, 14 nt, Human
cacgggccugucca

SEQ ID NO: 1293564 - RNA, 17 nt, Human
cacgggccuguccacag

SEQ ID NO: 1293565 - RNA, 18 nt, Human
cacgggccuguccacagg

SEQ ID NO: 1293566 - RNA, 24 nt, Human
cacgggccuguccacaggcuucug

SEQ ID NO: 1293567 - RNA, 14 nt, Human
cacgcuccuuccuc

SEQ ID NO: 1293568 - RNA, 19 nt, Human
cacgcucucuccaggcagg

SEQ ID NO: 1293569 - RNA, 23 nt, Human
cacgcucucuccaggcaggucug

SEQ ID NO: 1293570 - RNA, 16 nt, Human
cacgccuggcuaauuu

SEQ ID NO: 1293571 - RNA, 16 nt, Human
cacgcuagggcuggcu

SEQ ID NO: 1293572 - RNA, 12 nt, Human
cacgcuccagcu

SEQ ID NO: 1293573 - RNA, 13 nt, Human
cacgcuccagcug

SEQ ID NO: 1293574 - RNA, 14 nt, Human
cacgcuccagcugc

SEQ ID NO: 1293575 - RNA, 15 nt, Human
cacgcuccagcugcc

SEQ ID NO: 1293576 - RNA, 19 nt, Human
cacgcuccagcugccccgg

SEQ ID NO: 1293577 - RNA, 18 nt, Human
cacgcuccagcugccccg

SEQ ID NO: 1293578 - RNA, 13 nt, Human
cacgcacggcagc

SEQ ID NO: 1293579 - RNA, 15 nt, Human
cacgcaugcaguguu

SEQ ID NO: 1293580 - RNA, 11 nt, Human
cacgccacagc

SEQ ID NO: 1293581 - RNA, 12 nt, Human
cacgccacagcc

SEQ ID NO: 1293582 - RNA, 13 nt, Human
cacgccacagccc

SEQ ID NO: 1293583 - RNA, 14 nt, Human
cacgccacagcccu

SEQ ID NO: 1293584 - RNA, 14 nt, Human
cacgcccguccugc

SEQ ID NO: 1293585 - RNA, 15 nt, Human
cacgcccguccugcc

SEQ ID NO: 1293586 - RNA, 16 nt, Human
cacgcccguccugccu

SEQ ID NO: 1293587 - RNA, 19 nt, Human
cacgcccguccugccugug

SEQ ID NO: 1293588 - RNA, 20 nt, Human
cacgcccguccugccugugg

SEQ ID NO: 1293589 - RNA, 21 nt, Human
cacgcccguccugccuguggc

SEQ ID NO: 1293590 - RNA, 16 nt, Human
cacgcaccugccucag

SEQ ID NO: 1293591 - RNA, 12 nt, Human
cacgcaccugcc

SEQ ID NO: 1293592 - RNA, 15 nt, Human
cacgcaccugccuca

SEQ ID NO: 1293593 - RNA, 17 nt, Human
cacgacuggccagggcc

SEQ ID NO: 1293594 - RNA, 20 nt, Human
cacgagcuguuuacuaggga

SEQ ID NO: 1293595 - RNA, 22 nt, Human
cacgaggaaucugugggucugg

SEQ ID NO: 1293596 - RNA, 23 nt, Human
cacgaggaaucugugggucuggg

SEQ ID NO: 1293597 - RNA, 11 nt, Human
cacgagggcug

SEQ ID NO: 1293598 - RNA, 12 nt, Human
cacgagggcugg

SEQ ID NO: 1293599 - RNA, 13 nt, Human
cacgagggcuggc

SEQ ID NO: 1293600 - RNA, 17 nt, Human
cacgagggcuggcuggc

SEQ ID NO: 1293601 - RNA, 21 nt, Human
cacgagggcuggcuggccuca

SEQ ID NO: 1293602 - RNA, 22 nt, Human
cacgagggcuggcuggccucac

SEQ ID NO: 1293603 - RNA, 22 nt, Human
caccuguggaacauaaaaagga

SEQ ID NO: 1293604 - RNA, 19 nt, Human
caccugugcuucgggcccu

SEQ ID NO: 1293605 - RNA, 22 nt, Human
caccugucugucugucuguccc

SEQ ID NO: 1293606 - RNA, 16 nt, Human
caccugucugucuguc

SEQ ID NO: 1293607 - RNA, 22 nt, Human
caccuuagccugcccuccuuuc

SEQ ID NO: 1293608 - RNA, 20 nt, Human
caccuuagaccaccaagccu

SEQ ID NO: 1293609 - RNA, 21 nt, Human
caccuuagaccaccaagccuu

SEQ ID NO: 1293610 - RNA, 13 nt, Human
caccuuagcuggc

SEQ ID NO: 1293611 - RNA, 14 nt, Human
caccuuagaccacc

SEQ ID NO: 1293612 - RNA, 18 nt, Human
caccuuagaccaccaagc

SEQ ID NO: 1293613 - RNA, 19 nt, Human
caccuuagaccaccaagcc

SEQ ID NO: 1293614 - RNA, 23 nt, Human
caccuuagaccaccaagccuuga

SEQ ID NO: 1293615 - RNA, 19 nt, Human
caccuucaccuucauccau

SEQ ID NO: 1293616 - RNA, 14 nt, Human
caccuuccagcucc

SEQ ID NO: 1293617 - RNA, 15 nt, Human
caccuuccagcuccu

SEQ ID NO: 1293618 - RNA, 16 nt, Human
caccuuccagcuccug

SEQ ID NO: 1293619 - RNA, 18 nt, Human
caccuuccagcuccugua

SEQ ID NO: 1293620 - RNA, 18 nt, Human
caccuucccacuuuccca

SEQ ID NO: 1293621 - RNA, 13 nt, Human
caccuucccaugc

SEQ ID NO: 1293622 - RNA, 14 nt, Human
caccuucccaugcc

SEQ ID NO: 1293623 - RNA, 12 nt, Human
caccuucugagu

SEQ ID NO: 1293624 - RNA, 15 nt, Human
cacgacacugcagcc

SEQ ID NO: 1293625 - RNA, 15 nt, Human
cacgaccgccccagu

SEQ ID NO: 1293626 - RNA, 14 nt, Human
cacgacaguggaug

SEQ ID NO: 1293627 - RNA, 16 nt, Human
cacgacuggccagggc

SEQ ID NO: 1293628 - RNA, 13 nt, Human
cacgacugucucc

SEQ ID NO: 1293629 - RNA, 16 nt, Human
cacgacugucuccaug

SEQ ID NO: 1293630 - RNA, 16 nt, Human
cacugaugcuuagaug

SEQ ID NO: 1293631 - RNA, 14 nt, Human
cacugcaaccucug

SEQ ID NO: 1293632 - RNA, 19 nt, Human
cacugcaaccuccaccucg

SEQ ID NO: 1293633 - RNA, 17 nt, Human
cacugcaaccuccaccu

SEQ ID NO: 1293634 - RNA, 14 nt, Human
cacugcaaccucca

SEQ ID NO: 1293635 - RNA, 14 nt, Human
cacugcaaccuccg

SEQ ID NO: 1293636 - RNA, 19 nt, Human
cacugauguuguguuuuua

SEQ ID NO: 1293637 - RNA, 13 nt, Human
cacugcaaccucc

SEQ ID NO: 1293638 - RNA, 21 nt, Human
cacugcaaaccgccaccuccc

SEQ ID NO: 1293639 - RNA, 20 nt, Human
cacugcaaaccgccaccucc

SEQ ID NO: 1293640 - RNA, 13 nt, Human
cacugcaacauga

SEQ ID NO: 1293641 - RNA, 14 nt, Human
cacugcaaccuucg

SEQ ID NO: 1293642 - RNA, 22 nt, Human
cacugcaaccuucgccaccugg

SEQ ID NO: 1293643 - RNA, 23 nt, Human
cacugcaaccuucgccaccuggg

SEQ ID NO: 1293644 - RNA, 19 nt, Human
cacugcaaccuccaccucc

SEQ ID NO: 1293645 - RNA, 18 nt, Human
cacugcacagugcaucuc

SEQ ID NO: 1293646 - RNA, 19 nt, Human
cacugcacagugcaucuca

SEQ ID NO: 1293647 - RNA, 21 nt, Human
cacugcacagugcaucucagc

SEQ ID NO: 1293648 - RNA, 22 nt, Human
cacugcacagugcaucucagcc

SEQ ID NO: 1293649 - RNA, 20 nt, Human
cacugcaaucuccaccuccc

SEQ ID NO: 1293650 - RNA, 20 nt, Human
cacugcaauuggcaccgaag

SEQ ID NO: 1293651 - RNA, 18 nt, Human
cacugcacaauaacuccu

SEQ ID NO: 1293652 - RNA, 22 nt, Human
cacugcacaauaacuccuccca

SEQ ID NO: 1293653 - RNA, 23 nt, Human
cacugcacaauaacuccucccag

SEQ ID NO: 1293654 - RNA, 15 nt, Human
cacugagaccaaggc

SEQ ID NO: 1293655 - RNA, 23 nt, Human
cacugagaccccaggcuguuagg

SEQ ID NO: 1293656 - RNA, 17 nt, Human
cacugagaccaaggcuu

SEQ ID NO: 1293657 - RNA, 21 nt, Human
cacugagaggacagagagaaa

SEQ ID NO: 1293658 - RNA, 22 nt, Human
cacugagaggacagagagaaau

SEQ ID NO: 1293659 - RNA, 18 nt, Human
cacugagauaccagcgag

SEQ ID NO: 1293660 - RNA, 19 nt, Human
cacugagauaccagcgagg

SEQ ID NO: 1293661 - RNA, 23 nt, Human
cacugagauaccagcgaggaggc

SEQ ID NO: 1293662 - RNA, 19 nt, Human
cacugagcacuguuuucua

SEQ ID NO: 1293663 - RNA, 22 nt, Human
cacugagcacuguuuucuagug

SEQ ID NO: 1293664 - RNA, 18 nt, Human
cacugagcacuguuuucu

SEQ ID NO: 1293665 - RNA, 17 nt, Human
cacugagcacuguuuuc

SEQ ID NO: 1293666 - RNA, 16 nt, Human
cacugagcacuguuuu

SEQ ID NO: 1293667 - RNA, 15 nt, Human
cacugagcacuguuu

SEQ ID NO: 1293668 - RNA, 13 nt, Human
cacugagcacugu

SEQ ID NO: 1293669 - RNA, 20 nt, Human
cacugagcaacgcuauucca

SEQ ID NO: 1293670 - RNA, 19 nt, Human
cacugaugcugccccucau

SEQ ID NO: 1293671 - RNA, 15 nt, Human
cacugaugcuuagau

SEQ ID NO: 1293672 - RNA, 12 nt, Human
cacugaugcugc

SEQ ID NO: 1293673 - RNA, 17 nt, Human
cacugaugcugccccuc

SEQ ID NO: 1293674 - RNA, 14 nt, Human
cacugagggcaguc

SEQ ID NO: 1293675 - RNA, 20 nt, Human
cacugaggggggauccaguu

SEQ ID NO: 1293676 - RNA, 15 nt, Human
cacugaguuuuccau

SEQ ID NO: 1293677 - RNA, 21 nt, Human
cacugaguuuuccauggcagg

SEQ ID NO: 1293678 - RNA, 20 nt, Human
cacugauauaucaugaguga

SEQ ID NO: 1293679 - RNA, 22 nt, Human
cacugaguuuuccauggcagga

SEQ ID NO: 1293680 - RNA, 18 nt, Human
cacucuggcagccacacu

SEQ ID NO: 1293681 - RNA, 13 nt, Human
cacucuguaauug

SEQ ID NO: 1293682 - RNA, 14 nt, Human
cacucuguaauuga

SEQ ID NO: 1293683 - RNA, 23 nt, Human
cacucuguaauugaauauuauuc

SEQ ID NO: 1293684 - RNA, 20 nt, Human
cacucuguaauugcaaaaaa

SEQ ID NO: 1293685 - RNA, 14 nt, Human
cacugacugggacc

SEQ ID NO: 1293686 - RNA, 13 nt, Human
cacugaccagaac

SEQ ID NO: 1293687 - RNA, 14 nt, Human
cacugaccagaacu

SEQ ID NO: 1293688 - RNA, 15 nt, Human
cacugaccagaacua

SEQ ID NO: 1293689 - RNA, 17 nt, Human
cacucuguaauugcaaa

SEQ ID NO: 1293690 - RNA, 20 nt, Human
cacugacugggaccaggcac

SEQ ID NO: 1293691 - RNA, 20 nt, Human
cacugccuucucaacuccaa

SEQ ID NO: 1293692 - RNA, 18 nt, Human
cacugccuucgcuucuug

SEQ ID NO: 1293693 - RNA, 19 nt, Human
cacugccuucgcuucuugc

SEQ ID NO: 1293694 - RNA, 21 nt, Human
cacugccuucgcuucuugccu

SEQ ID NO: 1293695 - RNA, 23 nt, Human
cacugccuucgcuucuugccucu

SEQ ID NO: 1293696 - RNA, 12 nt, Human
cacugccuuuga

SEQ ID NO: 1293697 - RNA, 20 nt, Human
cacugccuucgauacaccgg

SEQ ID NO: 1293698 - RNA, 22 nt, Human
cacugccuucgauacaccgggc

SEQ ID NO: 1293699 - RNA, 19 nt, Human
cacugccugcucccauccu

SEQ ID NO: 1293700 - RNA, 20 nt, Human
cacugccugcucccauccug

SEQ ID NO: 1293701 - RNA, 21 nt, Human
cacugccugcucccauccugu

SEQ ID NO: 1293702 - RNA, 13 nt, Human
cacugccugcucc

SEQ ID NO: 1293703 - RNA, 14 nt, Human
cacugccugcuccc

SEQ ID NO: 1293704 - RNA, 20 nt, Human
cacugcucugaugaagagga

SEQ ID NO: 1293705 - RNA, 20 nt, Human
cacugcugauauuuucucua

SEQ ID NO: 1293706 - RNA, 15 nt, Human
cacugcugcccagcc

SEQ ID NO: 1293707 - RNA, 17 nt, Human
cacugcugcccagccuc

SEQ ID NO: 1293708 - RNA, 17 nt, Human
cacugcuggagaggccc

SEQ ID NO: 1293709 - RNA, 13 nt, Human
cacugcucacacu

SEQ ID NO: 1293710 - RNA, 15 nt, Human
cacugcucuaacagc

SEQ ID NO: 1293711 - RNA, 18 nt, Human
cacugcucuaacagcccu

SEQ ID NO: 1293712 - RNA, 19 nt, Human
cacugcucuaacagcccuc

SEQ ID NO: 1293713 - RNA, 23 nt, Human
cacugcacagugcaucucagccc

SEQ ID NO: 1293714 - RNA, 21 nt, Human
cacugccauuaaagaauauga

SEQ ID NO: 1293715 - RNA, 17 nt, Human
cacugcccauggacagg

SEQ ID NO: 1293716 - RNA, 18 nt, Human
cacugcccauggacaggc

SEQ ID NO: 1293717 - RNA, 17 nt, Human
cacugcccccugcugcc

SEQ ID NO: 1293718 - RNA, 19 nt, Human
cacugcccccugcugccau

SEQ ID NO: 1293719 - RNA, 20 nt, Human
cacugcccccugcugccaug

SEQ ID NO: 1293720 - RNA, 16 nt, Human
cacugccucuuccucc

SEQ ID NO: 1293721 - RNA, 19 nt, Human
cacugcccugguggcccuc

SEQ ID NO: 1293722 - RNA, 12 nt, Human
cacugcuggcug

SEQ ID NO: 1293723 - RNA, 13 nt, Human
cacugcuggcugc

SEQ ID NO: 1293724 - RNA, 14 nt, Human
cacugcuggcugcc

SEQ ID NO: 1293725 - RNA, 15 nt, Human
cacugcuggcugccu

SEQ ID NO: 1293726 - RNA, 16 nt, Human
cacugcuggcugccuu

SEQ ID NO: 1293727 - RNA, 21 nt, Human
cacugcuggcugccuuagaac

SEQ ID NO: 1293728 - RNA, 18 nt, Human
cacugcuguuauauuuca

SEQ ID NO: 1293729 - RNA, 21 nt, Human
cacugcuguuauauuucauca

SEQ ID NO: 1293730 - RNA, 17 nt, Human
cacugcuuccauuuaau

SEQ ID NO: 1293731 - RNA, 17 nt, Human
cacugcuugaacuaggc

SEQ ID NO: 1293732 - RNA, 13 nt, Human
cacugcuugagga

SEQ ID NO: 1293733 - RNA, 14 nt, Human
cacugcuugaggaa

SEQ ID NO: 1293734 - RNA, 20 nt, Human
cacugcuugaggaaaacaag

SEQ ID NO: 1293735 - RNA, 15 nt, Human
cacugcuugaggaaa

SEQ ID NO: 1293736 - RNA, 20 nt, Human
cacugcuugaacuaggcuga

SEQ ID NO: 1293737 - RNA, 13 nt, Human
cacugcuuuuccc

SEQ ID NO: 1293738 - RNA, 21 nt, Human
cacugcuuuucccuuugugag

SEQ ID NO: 1293739 - RNA, 15 nt, Human
cacuggacucaccuc

SEQ ID NO: 1293740 - RNA, 16 nt, Human
cacuggaccacugggc

SEQ ID NO: 1293741 - RNA, 18 nt, Human
cacuggacucaccucccc

SEQ ID NO: 1293742 - RNA, 19 nt, Human
cacuggagacgcauaugag

SEQ ID NO: 1293743 - RNA, 10 nt, Human
cacuggagca

SEQ ID NO: 1293744 - RNA, 13 nt, Human
cacuggagcacaa

SEQ ID NO: 1293745 - RNA, 12 nt, Human
cacuggagcaca

SEQ ID NO: 1293746 - RNA, 14 nt, Human
cacuggagcagaag

SEQ ID NO: 1293747 - RNA, 23 nt, Human
cacuggagcagaaggggagaugg

SEQ ID NO: 1293748 - RNA, 19 nt, Human
cacuggagcagaaggggag

SEQ ID NO: 1293749 - RNA, 19 nt, Human
cacuguacuugcucuugau

SEQ ID NO: 1293750 - RNA, 18 nt, Human
cacuguagaaugauuuca

SEQ ID NO: 1293751 - RNA, 18 nt, Human
cacuguacuugcucuuga

SEQ ID NO: 1293752 - RNA, 15 nt, Human
cacuguacuugcucu

SEQ ID NO: 1293753 - RNA, 17 nt, Human
cacuguagcucuaaaau

SEQ ID NO: 1293754 - RNA, 19 nt, Human
cacuguagcucuaaaaucu

SEQ ID NO: 1293755 - RNA, 19 nt, Human
cacuguaguaaauaaugcu

SEQ ID NO: 1293756 - RNA, 20 nt, Human
cacuguaguaaauaaugcuu

SEQ ID NO: 1293757 - RNA, 21 nt, Human
cacuguaguaaauaaugcuuu

SEQ ID NO: 1293758 - RNA, 22 nt, Human
cacuguaguaaauaaugcuuug

SEQ ID NO: 1293759 - RNA, 23 nt, Human
cacuguaguaaauaaugcuuuga

SEQ ID NO: 1293760 - RNA, 14 nt, Human
cacuguaguucuaa

SEQ ID NO: 1293761 - RNA, 15 nt, Human
cacuguaguucuaag

SEQ ID NO: 1293762 - RNA, 16 nt, Human
cacuguaguucuaaga

SEQ ID NO: 1293763 - RNA, 17 nt, Human
cacuguaguucuaagac

SEQ ID NO: 1293764 - RNA, 18 nt, Human
cacuguaguucuaagacu

SEQ ID NO: 1293765 - RNA, 20 nt, Human
cacuguaguucuaagacuca

SEQ ID NO: 1293766 - RNA, 14 nt, Human
cacuguauccaggu

SEQ ID NO: 1293767 - RNA, 15 nt, Human
cacuguaugagugga

SEQ ID NO: 1293768 - RNA, 13 nt, Human
cacuggcgaggag

SEQ ID NO: 1293769 - RNA, 16 nt, Human
cacuggccccacccuc

SEQ ID NO: 1293770 - RNA, 14 nt, Human
cacuggccccaccc

SEQ ID NO: 1293771 - RNA, 13 nt, Human
cacuggccccacc

SEQ ID NO: 1293772 - RNA, 13 nt, Human
cacuggccccuca

SEQ ID NO: 1293773 - RNA, 24 nt, Human
cacuggccccucaaaucguccagc

SEQ ID NO: 1293774 - RNA, 14 nt, Human
cacuggcucuccug

SEQ ID NO: 1293775 - RNA, 15 nt, Human
cacuggcucuccugg

SEQ ID NO: 1293776 - RNA, 21 nt, Human
cacuggcucuccuggcccugg

SEQ ID NO: 1293777 - RNA, 17 nt, Human
cacuggcucuccuggcc

SEQ ID NO: 1293778 - RNA, 12 nt, Human
cacuguaaaaug

SEQ ID NO: 1293779 - RNA, 13 nt, Human
cacuguaaaaugu

SEQ ID NO: 1293780 - RNA, 19 nt, Human
cacugucuuuaauucugua

SEQ ID NO: 1293781 - RNA, 18 nt, Human
cacugucuuuaauucugu

SEQ ID NO: 1293782 - RNA, 13 nt, Human
cacugugaaggac

SEQ ID NO: 1293783 - RNA, 14 nt, Human
cacugugaaggacc

SEQ ID NO: 1293784 - RNA, 14 nt, Human
cacuguacuaaccu

SEQ ID NO: 1293785 - RNA, 23 nt, Human
cacugugacccccagcuccggcc

SEQ ID NO: 1293786 - RNA, 17 nt, Human
cacugugaaggacccuu

SEQ ID NO: 1293787 - RNA, 15 nt, Human
cacugugaaggaccc

SEQ ID NO: 1293788 - RNA, 14 nt, Human
cacugugaccccca

SEQ ID NO: 1293789 - RNA, 15 nt, Human
cacugugacccccag

SEQ ID NO: 1293790 - RNA, 19 nt, Human
cacugugacccccagcucc

SEQ ID NO: 1293791 - RNA, 20 nt, Human
cacugugacccccagcuccg

SEQ ID NO: 1293792 - RNA, 22 nt, Human
cacugugacccccagcuccggc

SEQ ID NO: 1293793 - RNA, 21 nt, Human
cacugucaccacccugcucau

SEQ ID NO: 1293794 - RNA, 22 nt, Human
cacugucagcagggacuguaaa

SEQ ID NO: 1293795 - RNA, 12 nt, Human
cacugucccuug

SEQ ID NO: 1293796 - RNA, 17 nt, Human
cacugucccuugccuca

SEQ ID NO: 1293797 - RNA, 18 nt, Human
cacugucccuugccucaa

SEQ ID NO: 1293798 - RNA, 15 nt, Human
cacuguccugggccu

SEQ ID NO: 1293799 - RNA, 18 nt, Human
cacuguccugggccugca

SEQ ID NO: 1293800 - RNA, 22 nt, Human
cacuguggguagacacacauga

SEQ ID NO: 1293801 - RNA, 24 nt, Human
cacuguggguagacacacaugaag

SEQ ID NO: 1293802 - RNA, 17 nt, Human
cacuguguuccuuccgc

SEQ ID NO: 1293803 - RNA, 15 nt, Human
cacuguuaucaaaac

SEQ ID NO: 1293804 - RNA, 15 nt, Human
cacuguguuccuucc

SEQ ID NO: 1293805 - RNA, 17 nt, Human
cacuguucccccugugc

SEQ ID NO: 1293806 - RNA, 19 nt, Human
cacuguucccccugugcag

SEQ ID NO: 1293807 - RNA, 19 nt, Human
cacuguggguagacacaca

SEQ ID NO: 1293808 - RNA, 21 nt, Human
cacugugcuguuguuaugaug

SEQ ID NO: 1293809 - RNA, 23 nt, Human
cacugugcuguuguuaugaugug

SEQ ID NO: 1293810 - RNA, 20 nt, Human
cacugugcuguuguuaugau

SEQ ID NO: 1293811 - RNA, 19 nt, Human
cacugugcuguuguuauga

SEQ ID NO: 1293812 - RNA, 17 nt, Human
cacugugcuguuguuau

SEQ ID NO: 1293813 - RNA, 15 nt, Human
cacugugcuguuguu

SEQ ID NO: 1293814 - RNA, 14 nt, Human
cacugugcuguugu

SEQ ID NO: 1293815 - RNA, 20 nt, Human
cacugugcacaucugugucu

SEQ ID NO: 1293816 - RNA, 22 nt, Human
cacugugcacaucugugucuug

SEQ ID NO: 1293817 - RNA, 13 nt, Human
cacugugccucag

SEQ ID NO: 1293818 - RNA, 17 nt, Human
cacugugccucagagac

SEQ ID NO: 1293819 - RNA, 20 nt, Human
cacugugccucagagaccag

SEQ ID NO: 1293820 - RNA, 21 nt, Human
cacugugccucagagaccagg

SEQ ID NO: 1293821 - RNA, 22 nt, Human
cacugugccucagagaccaggg

SEQ ID NO: 1293822 - RNA, 14 nt, Human
cacuucaggcucuu

SEQ ID NO: 1293823 - RNA, 15 nt, Human
cacuucaggcucuuc

SEQ ID NO: 1293824 - RNA, 16 nt, Human
cacuucaggcucuucu

SEQ ID NO: 1293825 - RNA, 20 nt, Human
cacuucaggcucuucuccuu

SEQ ID NO: 1293826 - RNA, 23 nt, Human
cacuucaggcucuucuccuuuca

SEQ ID NO: 1293827 - RNA, 19 nt, Human
cacuucagggcuuuacucc

SEQ ID NO: 1293828 - RNA, 18 nt, Human
cacuucagguauaccuca

SEQ ID NO: 1293829 - RNA, 19 nt, Human
cacuucagguauaccucac

SEQ ID NO: 1293830 - RNA, 20 nt, Human
cacuucagguauaccucacu

SEQ ID NO: 1293831 - RNA, 14 nt, Human
cacuucauaaucca

SEQ ID NO: 1293832 - RNA, 15 nt, Human
cacuucauaauccag

SEQ ID NO: 1293833 - RNA, 22 nt, Human
cacuuauuggaacucugcuuga

SEQ ID NO: 1293834 - RNA, 20 nt, Human
cacuuauuuaugaaccugcc

SEQ ID NO: 1293835 - RNA, 11 nt, Human
cacuucaaacu

SEQ ID NO: 1293836 - RNA, 12 nt, Human
cacuucaaacua

SEQ ID NO: 1293837 - RNA, 14 nt, Human
cacuucaaacuacu

SEQ ID NO: 1293838 - RNA, 16 nt, Human
cacuguucuuagcuca

SEQ ID NO: 1293839 - RNA, 23 nt, Human
cacuguucuuagcucaaugagca

SEQ ID NO: 1293840 - RNA, 21 nt, Human
cacuguucuuagcucaaugag

SEQ ID NO: 1293841 - RNA, 15 nt, Human
cacuucacugugcug

SEQ ID NO: 1293842 - RNA, 13 nt, Human
cacuucacugugc

SEQ ID NO: 1293843 - RNA, 12 nt, Human
cacuucacugug

SEQ ID NO: 1293844 - RNA, 18 nt, Human
cacuucaaauucaaauaa

SEQ ID NO: 1293845 - RNA, 16 nt, Human
cacuucaaacuacuuu

SEQ ID NO: 1293846 - RNA, 13 nt, Human
cacuuccauggga

SEQ ID NO: 1293847 - RNA, 20 nt, Human
cacuuccauaaucuggacuc

SEQ ID NO: 1293848 - RNA, 18 nt, Human
cacuucccugcuuaaauu

SEQ ID NO: 1293849 - RNA, 21 nt, Human
cacuuccucucgcggcccuca

SEQ ID NO: 1293850 - RNA, 14 nt, Human
cacuucugcacuug

SEQ ID NO: 1293851 - RNA, 11 nt, Human
cacuucugcac

SEQ ID NO: 1293852 - RNA, 18 nt, Human
cacuucugggcuucaucu

SEQ ID NO: 1293853 - RNA, 13 nt, Human
cacuucucaggac

SEQ ID NO: 1293854 - RNA, 14 nt, Human
cacuucucaggaca

SEQ ID NO: 1293855 - RNA, 15 nt, Human
cacuucucaggacac

SEQ ID NO: 1293856 - RNA, 19 nt, Human
cacuucucaggacacaggc

SEQ ID NO: 1293857 - RNA, 23 nt, Human
cacuucucaggacacaggccugu

SEQ ID NO: 1293858 - RNA, 21 nt, Human
cacuucucaggacacaggccu

SEQ ID NO: 1293859 - RNA, 22 nt, Human
cacuucucaggacacaggccug

SEQ ID NO: 1293860 - RNA, 17 nt, Human
cacuucugacagccuca

SEQ ID NO: 1293861 - RNA, 19 nt, Human
cacuugaugacccccaacc

SEQ ID NO: 1293862 - RNA, 12 nt, Human
cacuugcaaccu

SEQ ID NO: 1293863 - RNA, 23 nt, Human
cacuugaacccgggaggcagagg

SEQ ID NO: 1293864 - RNA, 21 nt, Human
cacuugaacccgggaggcaga

SEQ ID NO: 1293865 - RNA, 20 nt, Human
cacuugaacccgggaggcag

SEQ ID NO: 1293866 - RNA, 20 nt, Human
cacuucugggcuucaucugg

SEQ ID NO: 1293867 - RNA, 19 nt, Human
cacuucuuacaauaauucu

SEQ ID NO: 1293868 - RNA, 16 nt, Human
cacuugccaaaaucca

SEQ ID NO: 1293869 - RNA, 12 nt, Human
cacuugccucuu

SEQ ID NO: 1293870 - RNA, 13 nt, Human
cacuugccucuuc

SEQ ID NO: 1293871 - RNA, 14 nt, Human
cacuugccucuucc

SEQ ID NO: 1293872 - RNA, 17 nt, Human
cacuugccucuuccuug

SEQ ID NO: 1293873 - RNA, 21 nt, Human
cacuugccucuuccuugaaga

SEQ ID NO: 1293874 - RNA, 22 nt, Human
cacuugcggauauucuggacug

SEQ ID NO: 1293875 - RNA, 17 nt, Human
cacuuggucugugagau

SEQ ID NO: 1293876 - RNA, 15 nt, Human
cacuuggucugugag

SEQ ID NO: 1293877 - RNA, 16 nt, Human
cacuugcuggaagacg

SEQ ID NO: 1293878 - RNA, 12 nt, Human
cacuuggcagcc

SEQ ID NO: 1293879 - RNA, 14 nt, Human
cacuuggcagccuu

SEQ ID NO: 1293880 - RNA, 15 nt, Human
cacuuggcagccuug

SEQ ID NO: 1293881 - RNA, 18 nt, Human
cacuuggcagccuuguga

SEQ ID NO: 1293882 - RNA, 16 nt, Human
cacuuggcagccuugu

SEQ ID NO: 1293883 - RNA, 23 nt, Human
cacuuggcugcauaaauguggua

SEQ ID NO: 1293884 - RNA, 20 nt, Human
cacuuggggcaccuugcucc

SEQ ID NO: 1293885 - RNA, 22 nt, Human
cacuuggggcaccuugcuccuc

SEQ ID NO: 1293886 - RNA, 20 nt, Human
cacuuggggguucaggcccg

SEQ ID NO: 1293887 - RNA, 13 nt, Human
caccucucaauau

SEQ ID NO: 1293888 - RNA, 15 nt, Human
caccgcagaaggaag

SEQ ID NO: 1293889 - RNA, 14 nt, Human
caccgcagaaggaa

SEQ ID NO: 1293890 - RNA, 19 nt, Human
caccggaccagccuggccc

SEQ ID NO: 1293891 - RNA, 22 nt, Human
caccggccccauuuacccaacu

SEQ ID NO: 1293892 - RNA, 16 nt, Human
caccggcucucaccug

SEQ ID NO: 1293893 - RNA, 21 nt, Human
caccggcucucaccuggcccu

SEQ ID NO: 1293894 - RNA, 17 nt, Human
caccggaccagccuggc

SEQ ID NO: 1293895 - RNA, 14 nt, Human
caccggggccuggg

SEQ ID NO: 1293896 - RNA, 21 nt, Human
caccggggccugggcaggagg

SEQ ID NO: 1293897 - RNA, 22 nt, Human
caccggggccugggcaggaggg

SEQ ID NO: 1293898 - RNA, 13 nt, Human
caccgggccugga

SEQ ID NO: 1293899 - RNA, 12 nt, Human
caccgggccacu

SEQ ID NO: 1293900 - RNA, 14 nt, Human
caccgggccacucc

SEQ ID NO: 1293901 - RNA, 15 nt, Human
caccggggccucgga

SEQ ID NO: 1293902 - RNA, 19 nt, Human
caccgggccacuccuuccu

SEQ ID NO: 1293903 - RNA, 21 nt, Human
caccgggccacuccuuccugc

SEQ ID NO: 1293904 - RNA, 23 nt, Human
caccgggccacuccuuccugccc

SEQ ID NO: 1293905 - RNA, 15 nt, Human
caccgugccuggcca

SEQ ID NO: 1293906 - RNA, 20 nt, Human
caccgugccuggccacgccc

SEQ ID NO: 1293907 - RNA, 24 nt, Human
caccgugcccagcccuaaacauca

SEQ ID NO: 1293908 - RNA, 15 nt, Human
caccgugggcaggga

SEQ ID NO: 1293909 - RNA, 13 nt, Human
caccgugggcucc

SEQ ID NO: 1293910 - RNA, 17 nt, Human
caccgugggcucccuga

SEQ ID NO: 1293911 - RNA, 18 nt, Human
caccgugggcucccugac

SEQ ID NO: 1293912 - RNA, 19 nt, Human
caccucccucaaccucauc

SEQ ID NO: 1293913 - RNA, 17 nt, Human
caccucccucaaccuca

SEQ ID NO: 1293914 - RNA, 15 nt, Human
caccucccucaaccu

SEQ ID NO: 1293915 - RNA, 21 nt, Human
caccucccuauacugcuugga

SEQ ID NO: 1293916 - RNA, 14 nt, Human
caccuccccuuggg

SEQ ID NO: 1293917 - RNA, 20 nt, Human
caccucccuauacugcuugg

SEQ ID NO: 1293918 - RNA, 14 nt, Human
caccucccccaucu

SEQ ID NO: 1293919 - RNA, 21 nt, Human
caccucccccaucucuucugg

SEQ ID NO: 1293920 - RNA, 23 nt, Human
caccuccccccacaagugcccuc

SEQ ID NO: 1293921 - RNA, 11 nt, Human
caccucaugga

SEQ ID NO: 1293922 - RNA, 12 nt, Human
caccucauggaa

SEQ ID NO: 1293923 - RNA, 14 nt, Human
caccucauggaauu

SEQ ID NO: 1293924 - RNA, 17 nt, Human
caccuccacauccucca

SEQ ID NO: 1293925 - RNA, 16 nt, Human
caccuccacauccucc

SEQ ID NO: 1293926 - RNA, 15 nt, Human
caccuccaucccaga

SEQ ID NO: 1293927 - RNA, 10 nt, Human
caccucccag

SEQ ID NO: 1293928 - RNA, 11 nt, Human
caccucccagg

SEQ ID NO: 1293929 - RNA, 12 nt, Human
caccucccagga

SEQ ID NO: 1293930 - RNA, 14 nt, Human
caccuccccagcau

SEQ ID NO: 1293931 - RNA, 16 nt, Human
caccuccccagcauuc

SEQ ID NO: 1293932 - RNA, 23 nt, Human
caccucucaauauucaauaaagc

SEQ ID NO: 1293933 - RNA, 22 nt, Human
caccucucaauauucaauaaag

SEQ ID NO: 1293934 - RNA, 21 nt, Human
caccucucaauauucaauaaa

SEQ ID NO: 1293935 - RNA, 22 nt, Human
caccucuagguccccauacucc

SEQ ID NO: 1293936 - RNA, 17 nt, Human
caccucuaacagcacca

SEQ ID NO: 1293937 - RNA, 20 nt, Human
caccucuaacagcaccaaau

SEQ ID NO: 1293938 - RNA, 22 nt, Human
caccucuaacagcaccaaauca

SEQ ID NO: 1293939 - RNA, 19 nt, Human
caccucgcagguucaagca

SEQ ID NO: 1293940 - RNA, 16 nt, Human
caccucuaacagcacc

SEQ ID NO: 1293941 - RNA, 22 nt, Human
caccuccuucccucucuggaga

SEQ ID NO: 1293942 - RNA, 19 nt, Human
caccuccugacacccuucu

SEQ ID NO: 1293943 - RNA, 20 nt, Human
caccuccuggguucaagcga

SEQ ID NO: 1293944 - RNA, 22 nt, Human
caccuccuggguucaagcgauu

SEQ ID NO: 1293945 - RNA, 13 nt, Human
caccuccuucccu

SEQ ID NO: 1293946 - RNA, 17 nt, Human
caccuccuucccucucu

SEQ ID NO: 1293947 - RNA, 21 nt, Human
caccucccucaaccucauccu

SEQ ID NO: 1293948 - RNA, 14 nt, Human
caccuccucagccu

SEQ ID NO: 1293949 - RNA, 14 nt, Human
caccuccucaugua

SEQ ID NO: 1293950 - RNA, 16 nt, Human
caccuccucagccuga

SEQ ID NO: 1293951 - RNA, 15 nt, Human
caccuccugccucag

SEQ ID NO: 1293952 - RNA, 13 nt, Human
caccuccugccuc

SEQ ID NO: 1293953 - RNA, 14 nt, Human
caccugucugucug

SEQ ID NO: 1293954 - RNA, 13 nt, Human
caccugucugucu

SEQ ID NO: 1293955 - RNA, 12 nt, Human
caccugucuguc

SEQ ID NO: 1293956 - RNA, 11 nt, Human
caccugucugu

SEQ ID NO: 1293957 - RNA, 15 nt, Human
caccugucccagaaa

SEQ ID NO: 1293958 - RNA, 14 nt, Human
caccugucccagaa

SEQ ID NO: 1293959 - RNA, 18 nt, Human
caccuguagcacuuacug

SEQ ID NO: 1293960 - RNA, 22 nt, Human
caccuguagcacuuacugguag

SEQ ID NO: 1293961 - RNA, 15 nt, Human
caccuguagcagcca

SEQ ID NO: 1293962 - RNA, 16 nt, Human
caccugggagaaaucu

SEQ ID NO: 1293963 - RNA, 17 nt, Human
caccugggagaaaucug

SEQ ID NO: 1293964 - RNA, 14 nt, Human
caccugggcccugg

SEQ ID NO: 1293965 - RNA, 17 nt, Human
caccugggcccuggggc

SEQ ID NO: 1293966 - RNA, 18 nt, Human
caccugggcccuggggcc

SEQ ID NO: 1293967 - RNA, 19 nt, Human
caccugggcccuggggccu

SEQ ID NO: 1293968 - RNA, 20 nt, Human
caccugggcccuggggccug

SEQ ID NO: 1293969 - RNA, 21 nt, Human
caccugggcccuggggccugu

SEQ ID NO: 1293970 - RNA, 22 nt, Human
caccugggcccuggggccugua

SEQ ID NO: 1293971 - RNA, 23 nt, Human
caccugggcccuggggccuguac

SEQ ID NO: 1293972 - RNA, 20 nt, Human
caccugguacucccucucag

SEQ ID NO: 1293973 - RNA, 15 nt, Human
caccugguggccaug

SEQ ID NO: 1293974 - RNA, 16 nt, Human
caccugguggccaugc

SEQ ID NO: 1293975 - RNA, 21 nt, Human
caccugguggccaugcuccuc

SEQ ID NO: 1293976 - RNA, 17 nt, Human
caccugguggccaugcu

SEQ ID NO: 1293977 - RNA, 14 nt, Human
caccuguaaaccug

SEQ ID NO: 1293978 - RNA, 15 nt, Human
caccuguaaaccuga

SEQ ID NO: 1293979 - RNA, 16 nt, Human
caccuguaaaccugag

SEQ ID NO: 1293980 - RNA, 20 nt, Human
caccuguaaugugcgaggga

SEQ ID NO: 1293981 - RNA, 20 nt, Human
caccugggauuacaagcaug

SEQ ID NO: 1293982 - RNA, 22 nt, Human
caccuggcccugcuuccugcuu

SEQ ID NO: 1293983 - RNA, 20 nt, Human
caccuggcccugcuuccugc

SEQ ID NO: 1293984 - RNA, 16 nt, Human
caccuggcucucaccu

SEQ ID NO: 1293985 - RNA, 17 nt, Human
caccuggcucucaccuc

SEQ ID NO: 1293986 - RNA, 18 nt, Human
caccuggcucucaccucu

SEQ ID NO: 1293987 - RNA, 19 nt, Human
caccuggcucucaccucua

SEQ ID NO: 1293988 - RNA, 11 nt, Human
caccuggaccc

SEQ ID NO: 1293989 - RNA, 12 nt, Human
caccuggacccc

SEQ ID NO: 1293990 - RNA, 15 nt, Human
caccuggaccccugc

SEQ ID NO: 1293991 - RNA, 16 nt, Human
caccuggaccccugca

SEQ ID NO: 1293992 - RNA, 17 nt, Human
caccuggaccccugcau

SEQ ID NO: 1293993 - RNA, 18 nt, Human
caccuggaccccugcauu

SEQ ID NO: 1293994 - RNA, 19 nt, Human
caccuggaccccugcauug

SEQ ID NO: 1293995 - RNA, 23 nt, Human
caccuggcaucgcaccauucuga

SEQ ID NO: 1293996 - RNA, 13 nt, Human
caccuggcccugc

SEQ ID NO: 1293997 - RNA, 15 nt, Human
caccuggcccugcuu

SEQ ID NO: 1293998 - RNA, 16 nt, Human
caccuggcccugcuuc

SEQ ID NO: 1293999 - RNA, 17 nt, Human
caccugaacugaacacc

SEQ ID NO: 1294000 - RNA, 19 nt, Human
caccugaacugaacaccau

SEQ ID NO: 1294001 - RNA, 16 nt, Human
caccugacacaccagg

SEQ ID NO: 1294002 - RNA, 17 nt, Human
caccugacacaccaggc

SEQ ID NO: 1294003 - RNA, 12 nt, Human
caccucugcugc

SEQ ID NO: 1294004 - RNA, 13 nt, Human
caccugaacugaa

SEQ ID NO: 1294005 - RNA, 23 nt, Human
caccugcugagaaaacaugccuc

SEQ ID NO: 1294006 - RNA, 23 nt, Human
caccugcugucuggguggcucac

SEQ ID NO: 1294007 - RNA, 21 nt, Human
caccuggaagcauuuguuucu

SEQ ID NO: 1294008 - RNA, 22 nt, Human
caccuggaagcauuuguuucua

SEQ ID NO: 1294009 - RNA, 20 nt, Human
caccugacacaccaggcgcu

SEQ ID NO: 1294010 - RNA, 14 nt, Human
caccugaggaacug

SEQ ID NO: 1294011 - RNA, 11 nt, Human
caccugaggaa

SEQ ID NO: 1294012 - RNA, 19 nt, Human
caccugagucacccuaccu

SEQ ID NO: 1294013 - RNA, 23 nt, Human
caccugagucacccuaccugugc

SEQ ID NO: 1294014 - RNA, 15 nt, Human
caccugcacuaacag

SEQ ID NO: 1294015 - RNA, 16 nt, Human
caccugcacuaacaga

SEQ ID NO: 1294016 - RNA, 21 nt, Human
caccugcacuaacagaguggc

SEQ ID NO: 1294017 - RNA, 13 nt, Human
caccgcagaagga

SEQ ID NO: 1294018 - RNA, 12 nt, Human
caccgagugggg

SEQ ID NO: 1294019 - RNA, 15 nt, Human
caccgacugaaaaua

SEQ ID NO: 1294020 - RNA, 18 nt, Human
cacccuugguuccuaacu

SEQ ID NO: 1294021 - RNA, 20 nt, Human
cacccuuugcugugaggcug

SEQ ID NO: 1294022 - RNA, 22 nt, Human
cacccuuugcugugaggcuguc

SEQ ID NO: 1294023 - RNA, 15 nt, Human
cacccuuuuccagcu

SEQ ID NO: 1294024 - RNA, 17 nt, Human
cacccuuuuccagcugg

SEQ ID NO: 1294025 - RNA, 21 nt, Human
cacccuuuuccagcuggauga

SEQ ID NO: 1294026 - RNA, 14 nt, Human
caccgaagcccaga

SEQ ID NO: 1294027 - RNA, 15 nt, Human
caccgaagcccagag

SEQ ID NO: 1294028 - RNA, 21 nt, Human
caccgaagcccagagggucug

SEQ ID NO: 1294029 - RNA, 19 nt, Human
cacccugucugccccgccc

SEQ ID NO: 1294030 - RNA, 18 nt, Human
cacccuguggucuuccuc

SEQ ID NO: 1294031 - RNA, 14 nt, Human
cacccuguuccugc

SEQ ID NO: 1294032 - RNA, 15 nt, Human
cacccuguuccugcu

SEQ ID NO: 1294033 - RNA, 16 nt, Human
cacccuguuccugcug

SEQ ID NO: 1294034 - RNA, 18 nt, Human
cacccuguuccugcugcu

SEQ ID NO: 1294035 - RNA, 17 nt, Human
cacccuguuccugcugc

SEQ ID NO: 1294036 - RNA, 13 nt, Human
cacccuucuccca

SEQ ID NO: 1294037 - RNA, 15 nt, Human
cacccuucucccacu

SEQ ID NO: 1294038 - RNA, 16 nt, Human
cacccuucucccacuc

SEQ ID NO: 1294039 - RNA, 17 nt, Human
cacccuucucccacucu

SEQ ID NO: 1294040 - RNA, 18 nt, Human
cacccuucucccacucuc

SEQ ID NO: 1294041 - RNA, 19 nt, Human
cacccuucucccacucucc

SEQ ID NO: 1294042 - RNA, 23 nt, Human
cacccuucucccacucuccuagg

SEQ ID NO: 1294043 - RNA, 21 nt, Human
cacccuucucccacucuccua

SEQ ID NO: 1294044 - RNA, 12 nt, Human
cacccucacacu

SEQ ID NO: 1294045 - RNA, 20 nt, Human
cacccucacuggcucuccug

SEQ ID NO: 1294046 - RNA, 14 nt, Human
cacccugucugccc

SEQ ID NO: 1294047 - RNA, 21 nt, Human
cacccucacuggcucuccugg

SEQ ID NO: 1294048 - RNA, 15 nt, Human
cacccggcugcagag

SEQ ID NO: 1294049 - RNA, 21 nt, Human
cacccggcugcagaggccaga

SEQ ID NO: 1294050 - RNA, 16 nt, Human
cacccuaccugugccu

SEQ ID NO: 1294051 - RNA, 12 nt, Human
caccccuaggac

SEQ ID NO: 1294052 - RNA, 13 nt, Human
caccccugcacag

SEQ ID NO: 1294053 - RNA, 18 nt, Human
aggaguuucguuuucaaa

SEQ ID NO: 1294054 - RNA, 23 nt, Human
aggaguuuauguuccauuaaacg

SEQ ID NO: 1294055 - RNA, 14 nt, Human
aggaguuuauguuc

SEQ ID NO: 1294056 - RNA, 18 nt, Human
aggagguccuuaggccuc

SEQ ID NO: 1294057 - RNA, 23 nt, Human
aggagguccuuaggccucugaga

SEQ ID NO: 1294058 - RNA, 14 nt, Human
aggaggugccacug

SEQ ID NO: 1294059 - RNA, 11 nt, Human
aggaguaacaa

SEQ ID NO: 1294060 - RNA, 13 nt, Human
aggaguagcugag

SEQ ID NO: 1294061 - RNA, 14 nt, Human
aggaguagcugagc

SEQ ID NO: 1294062 - RNA, 22 nt, Human
aggagucugagguccugagcac

SEQ ID NO: 1294063 - RNA, 23 nt, Human
aggagucugagguccugagcacu

SEQ ID NO: 1294064 - RNA, 15 nt, Human
aggaggugucucagg

SEQ ID NO: 1294065 - RNA, 19 nt, Human
aggaggugucucaggcugc

SEQ ID NO: 1294066 - RNA, 20 nt, Human
aggaggugucucaggcugcc

SEQ ID NO: 1294067 - RNA, 21 nt, Human
aggaggugucucaggcugccu

SEQ ID NO: 1294068 - RNA, 23 nt, Human
aggaggugucucaggcugccuga

SEQ ID NO: 1294069 - RNA, 22 nt, Human
aggaggugucucaggcugccug

SEQ ID NO: 1294070 - RNA, 19 nt, Human
aggaguaacaauacaaaug

SEQ ID NO: 1294071 - RNA, 13 nt, Human
aggaaguagagga

SEQ ID NO: 1294072 - RNA, 20 nt, Human
aggagacagguuagcugcuc

SEQ ID NO: 1294073 - RNA, 18 nt, Human
aggagacaguucaagaaa

SEQ ID NO: 1294074 - RNA, 14 nt, Human
aggaaguagaaaca

SEQ ID NO: 1294075 - RNA, 15 nt, Human
aggaaguagaaacaa

SEQ ID NO: 1294076 - RNA, 16 nt, Human
aggagagcccuucauu

SEQ ID NO: 1294077 - RNA, 21 nt, Human
aggagggucggugccuucaag

SEQ ID NO: 1294078 - RNA, 17 nt, Human
aggagggucggugccuu

SEQ ID NO: 1294079 - RNA, 14 nt, Human
aggagggugggaag

SEQ ID NO: 1294080 - RNA, 15 nt, Human
aggagggugggaagg

SEQ ID NO: 1294081 - RNA, 15 nt, Human
aggagggcaggcauc

SEQ ID NO: 1294082 - RNA, 16 nt, Human
aggagggucggugccu

SEQ ID NO: 1294083 - RNA, 15 nt, Human
aggagggaggugcuu

SEQ ID NO: 1294084 - RNA, 13 nt, Human
aggagggcaggca

SEQ ID NO: 1294085 - RNA, 17 nt, Human
aggauguguuugcuuuc

SEQ ID NO: 1294086 - RNA, 18 nt, Human
aggauguguuugcuuucu

SEQ ID NO: 1294087 - RNA, 19 nt, Human
aggauguguuugcuuucug

SEQ ID NO: 1294088 - RNA, 18 nt, Human
aggaugugauauauaagu

SEQ ID NO: 1294089 - RNA, 21 nt, Human
aggaugugauauauaagugua

SEQ ID NO: 1294090 - RNA, 20 nt, Human
aggaugugauuguggaaugg

SEQ ID NO: 1294091 - RNA, 14 nt, Human
aggaugugaauugu

SEQ ID NO: 1294092 - RNA, 20 nt, Human
aggauguggaaaccuccuuc

SEQ ID NO: 1294093 - RNA, 21 nt, Human
aggaugugucccaucuaggga

SEQ ID NO: 1294094 - RNA, 13 nt, Human
aggauguguuugc

SEQ ID NO: 1294095 - RNA, 19 nt, Human
aggauggucuuacagcagg

SEQ ID NO: 1294096 - RNA, 14 nt, Human
aggaugugauauau

SEQ ID NO: 1294097 - RNA, 18 nt, Human
aggauggucuuacagcag

SEQ ID NO: 1294098 - RNA, 13 nt, Human
aggauggcgcagg

SEQ ID NO: 1294099 - RNA, 20 nt, Human
aggaugggcaugguguucuc

SEQ ID NO: 1294100 - RNA, 23 nt, Human
aggcaugugucaccaugcccagc

SEQ ID NO: 1294101 - RNA, 17 nt, Human
aggcagauccaggacua

SEQ ID NO: 1294102 - RNA, 15 nt, Human
aggcagccagcaucu

SEQ ID NO: 1294103 - RNA, 16 nt, Human
aggcagccagcaucug

SEQ ID NO: 1294104 - RNA, 19 nt, Human
aggcaucggggagccggga

SEQ ID NO: 1294105 - RNA, 17 nt, Human
aggcaucgcaauguaag

SEQ ID NO: 1294106 - RNA, 20 nt, Human
aggcagccagcaucugggcc

SEQ ID NO: 1294107 - RNA, 13 nt, Human
aggcagccagcca

SEQ ID NO: 1294108 - RNA, 23 nt, Human
aggcaucgucaugcacaguauuu

SEQ ID NO: 1294109 - RNA, 19 nt, Human
aggcaucgucaugcacagu

SEQ ID NO: 1294110 - RNA, 14 nt, Human
aggcauuaaauuuu

SEQ ID NO: 1294111 - RNA, 22 nt, Human
aggcauuaaauuuuagcaaaga

SEQ ID NO: 1294112 - RNA, 15 nt, Human
aggcauucuggaccu

SEQ ID NO: 1294113 - RNA, 16 nt, Human
aggcauucuggaccuc

SEQ ID NO: 1294114 - RNA, 20 nt, Human
aggcauucuggaccucuggg

SEQ ID NO: 1294115 - RNA, 21 nt, Human
aggcauucuggaccucugggu

SEQ ID NO: 1294116 - RNA, 13 nt, Human
aggccagggcaga

SEQ ID NO: 1294117 - RNA, 15 nt, Human
aggccagggcagagu

SEQ ID NO: 1294118 - RNA, 22 nt, Human
aggcagaacucaucuagguaaa

SEQ ID NO: 1294119 - RNA, 22 nt, Human
aggcagaggccugggcugggaa

SEQ ID NO: 1294120 - RNA, 20 nt, Human
aggcagagguugcagugagc

SEQ ID NO: 1294121 - RNA, 11 nt, Human
aggcagaucca

SEQ ID NO: 1294122 - RNA, 15 nt, Human
aggcagauccaggac

SEQ ID NO: 1294123 - RNA, 16 nt, Human
aggcagauccaggacu

SEQ ID NO: 1294124 - RNA, 19 nt, Human
aggcacuugagggggaagg

SEQ ID NO: 1294125 - RNA, 15 nt, Human
aggcacuuggcagcc

SEQ ID NO: 1294126 - RNA, 17 nt, Human
aggcacuuggcagccuu

SEQ ID NO: 1294127 - RNA, 18 nt, Human
aggcacuuggcagccuug

SEQ ID NO: 1294128 - RNA, 14 nt, Human
agggacugagaaau

SEQ ID NO: 1294129 - RNA, 13 nt, Human
agggacugagaaa

SEQ ID NO: 1294130 - RNA, 15 nt, Human
agggacugagaaauu

SEQ ID NO: 1294131 - RNA, 17 nt, Human
agggacugagaaauuua

SEQ ID NO: 1294132 - RNA, 16 nt, Human
agggacugaccagcag

SEQ ID NO: 1294133 - RNA, 15 nt, Human
agggcuacccugagc

SEQ ID NO: 1294134 - RNA, 20 nt, Human
agggauucugguuccagggu

SEQ ID NO: 1294135 - RNA, 17 nt, Human
agggcuacccugagcug

SEQ ID NO: 1294136 - RNA, 18 nt, Human
agggcuacccugagcuga

SEQ ID NO: 1294137 - RNA, 20 nt, Human
agggcuacccugagcugagg

SEQ ID NO: 1294138 - RNA, 21 nt, Human
agggcuacccugagcugaggc

SEQ ID NO: 1294139 - RNA, 22 nt, Human
agggcuacccugagcugaggca

SEQ ID NO: 1294140 - RNA, 23 nt, Human
agggcuacccugagcugaggcag

SEQ ID NO: 1294141 - RNA, 22 nt, Human
agggcuagugacuuguguccca

SEQ ID NO: 1294142 - RNA, 24 nt, Human
agggcuagugacuugugucccaug

SEQ ID NO: 1294143 - RNA, 13 nt, Human
agggcucacucag

SEQ ID NO: 1294144 - RNA, 24 nt, Human
agggcucaaucucugggggcugag

SEQ ID NO: 1294145 - RNA, 15 nt, Human
agggauggacaucuu

SEQ ID NO: 1294146 - RNA, 17 nt, Human
agggauggacaucuugu

SEQ ID NO: 1294147 - RNA, 16 nt, Human
agggauggacaucuug

SEQ ID NO: 1294148 - RNA, 15 nt, Human
agggaugacuaaaau

SEQ ID NO: 1294149 - RNA, 22 nt, Human
agggaugacuaaaauauuuauu

SEQ ID NO: 1294150 - RNA, 22 nt, Human
aggcucuggagcccacuguacu

SEQ ID NO: 1294151 - RNA, 21 nt, Human
aggcuagguggguugaaagcc

SEQ ID NO: 1294152 - RNA, 23 nt, Human
aggcuagguggguugaaagccaa

SEQ ID NO: 1294153 - RNA, 15 nt, Human
aggcucugucuggaa

SEQ ID NO: 1294154 - RNA, 17 nt, Human
aggcucuguuccacaua

SEQ ID NO: 1294155 - RNA, 19 nt, Human
aggcucuuagcagcuucca

SEQ ID NO: 1294156 - RNA, 22 nt, Human
aggcucuuagcagcuuccagau

SEQ ID NO: 1294157 - RNA, 13 nt, Human
aggcucuucuccu

SEQ ID NO: 1294158 - RNA, 11 nt, Human
aggcugagccu

SEQ ID NO: 1294159 - RNA, 13 nt, Human
aggcugagccuca

SEQ ID NO: 1294160 - RNA, 14 nt, Human
aggcucuucuccuu

SEQ ID NO: 1294161 - RNA, 11 nt, Human
aggcugaggac

SEQ ID NO: 1294162 - RNA, 13 nt, Human
aggcugaggacuu

SEQ ID NO: 1294163 - RNA, 14 nt, Human
aggcuagggugggg

SEQ ID NO: 1294164 - RNA, 15 nt, Human
aggcuagggugggga

SEQ ID NO: 1294165 - RNA, 16 nt, Human
aggcuaggguggggag

SEQ ID NO: 1294166 - RNA, 19 nt, Human
aggcuaggguggggagaga

SEQ ID NO: 1294167 - RNA, 20 nt, Human
aggcugcauugaaaagagcu

SEQ ID NO: 1294168 - RNA, 21 nt, Human
aggcugcauugaaaagagcug

SEQ ID NO: 1294169 - RNA, 22 nt, Human
aggcugcauugaaaagagcuga

SEQ ID NO: 1294170 - RNA, 23 nt, Human
aggcuguuaaauacaggaaacag

SEQ ID NO: 1294171 - RNA, 20 nt, Human
aggcuguuaaauacaggaaa

SEQ ID NO: 1294172 - RNA, 14 nt, Human
aggcuuaaacccau

SEQ ID NO: 1294173 - RNA, 14 nt, Human
aggcuuacacccac

SEQ ID NO: 1294174 - RNA, 19 nt, Human
agggacaugcuuagcaguc

SEQ ID NO: 1294175 - RNA, 14 nt, Human
agggacaugcuuag

SEQ ID NO: 1294176 - RNA, 17 nt, Human
agcuguaugauucccag

SEQ ID NO: 1294177 - RNA, 18 nt, Human
agcuguaugauucccagc

SEQ ID NO: 1294178 - RNA, 16 nt, Human
agcugucaaggcucag

SEQ ID NO: 1294179 - RNA, 17 nt, Human
agcugguuagaaaugca

SEQ ID NO: 1294180 - RNA, 16 nt, Human
agcuguauugucugaa

SEQ ID NO: 1294181 - RNA, 18 nt, Human
aggaaaaaauaacaauga

SEQ ID NO: 1294182 - RNA, 19 nt, Human
aggaaaaccaagccguggc

SEQ ID NO: 1294183 - RNA, 13 nt, Human
aggaaaaacaggu

SEQ ID NO: 1294184 - RNA, 19 nt, Human
agcuuuuuucucugauaca

SEQ ID NO: 1294185 - RNA, 20 nt, Human
agcuuuuuucucugauacag

SEQ ID NO: 1294186 - RNA, 22 nt, Human
agcuuuuuucucugauacagaa

SEQ ID NO: 1294187 - RNA, 23 nt, Human
agcuuuuuucucugauacagaaa

SEQ ID NO: 1294188 - RNA, 22 nt, Human
agcuuugucacuguuucacuac

SEQ ID NO: 1294189 - RNA, 12 nt, Human
agcuuuguucuu

SEQ ID NO: 1294190 - RNA, 18 nt, Human
agcuuuguucuucuuaaa

SEQ ID NO: 1294191 - RNA, 15 nt, Human
aggaaaaaauaaaca

SEQ ID NO: 1294192 - RNA, 20 nt, Human
aggaaaaccaagccguggcu

SEQ ID NO: 1294193 - RNA, 21 nt, Human
aggaaaaccaagccguggcuu

SEQ ID NO: 1294194 - RNA, 22 nt, Human
aggaaaaccaagccguggcuuc

SEQ ID NO: 1294195 - RNA, 23 nt, Human
aggaaaaccaagccguggcuucc

SEQ ID NO: 1294196 - RNA, 14 nt, Human
aggaacuuccaggu

SEQ ID NO: 1294197 - RNA, 18 nt, Human
aggaagguacuguaugau

SEQ ID NO: 1294198 - RNA, 17 nt, Human
aggaagguacuguauga

SEQ ID NO: 1294199 - RNA, 15 nt, Human
aggaagguacuguau

SEQ ID NO: 1294200 - RNA, 14 nt, Human
aggaagguacugua

SEQ ID NO: 1294201 - RNA, 20 nt, Human
aggaagaauggugugggaga

SEQ ID NO: 1294202 - RNA, 15 nt, Human
aggaagguggauggc

SEQ ID NO: 1294203 - RNA, 16 nt, Human
aggaagguggauggcc

SEQ ID NO: 1294204 - RNA, 14 nt, Human
agcugacuuggcug

SEQ ID NO: 1294205 - RNA, 16 nt, Human
agcugacuuggcuggu

SEQ ID NO: 1294206 - RNA, 23 nt, Human
agcugacuaaacuuuuuuucugu

SEQ ID NO: 1294207 - RNA, 13 nt, Human
agcugacucacac

SEQ ID NO: 1294208 - RNA, 15 nt, Human
agcucuuggagcugu

SEQ ID NO: 1294209 - RNA, 18 nt, Human
agcucuuguugagccgug

SEQ ID NO: 1294210 - RNA, 16 nt, Human
agcuccucuccccagc

SEQ ID NO: 1294211 - RNA, 17 nt, Human
agcuccucuccccagcc

SEQ ID NO: 1294212 - RNA, 18 nt, Human
agcuccucuccccagccc

SEQ ID NO: 1294213 - RNA, 19 nt, Human
agcuccucuccccagccca

SEQ ID NO: 1294214 - RNA, 20 nt, Human
agcuccucuccccagcccag

SEQ ID NO: 1294215 - RNA, 21 nt, Human
agcuccucuccccagcccaga

SEQ ID NO: 1294216 - RNA, 22 nt, Human
agcuccucuccccagcccagag

SEQ ID NO: 1294217 - RNA, 23 nt, Human
agcuccucuccccagcccagaga

SEQ ID NO: 1294218 - RNA, 24 nt, Human
agcuccucuccccagcccagagac

SEQ ID NO: 1294219 - RNA, 19 nt, Human
agcugguguagcuacagag

SEQ ID NO: 1294220 - RNA, 20 nt, Human
agcugguguagcuacagaga

SEQ ID NO: 1294221 - RNA, 21 nt, Human
agcugguguagcuacagagaa

SEQ ID NO: 1294222 - RNA, 22 nt, Human
agcugguguagcuacagagaaa

SEQ ID NO: 1294223 - RNA, 23 nt, Human
agcugguguagcuacagagaaac

SEQ ID NO: 1294224 - RNA, 15 nt, Human
agcugguuagaaaug

SEQ ID NO: 1294225 - RNA, 19 nt, Human
agcuggugcggcuggccau

SEQ ID NO: 1294226 - RNA, 17 nt, Human
agcuggugcggcuggcc

SEQ ID NO: 1294227 - RNA, 13 nt, Human
agcugguguagcu

SEQ ID NO: 1294228 - RNA, 14 nt, Human
agcugguguagcua

SEQ ID NO: 1294229 - RNA, 17 nt, Human
agcugguguagcuacag

SEQ ID NO: 1294230 - RNA, 18 nt, Human
agcugguguagcuacaga

SEQ ID NO: 1294231 - RNA, 13 nt, Human
agcuggugcggcu

SEQ ID NO: 1294232 - RNA, 20 nt, Human
agcuggguuggaaaacagua

SEQ ID NO: 1294233 - RNA, 16 nt, Human
agcuggguuggaaaac

SEQ ID NO: 1294234 - RNA, 17 nt, Human
agcugacuuggcuggug

SEQ ID NO: 1294235 - RNA, 18 nt, Human
agcugacuuggcuggugu

SEQ ID NO: 1294236 - RNA, 22 nt, Human
agcugacuuggcugguguggua

SEQ ID NO: 1294237 - RNA, 19 nt, Human
agcugacuuggcuggugug

SEQ ID NO: 1294238 - RNA, 24 nt, Human
agcgauucuccugccucagccucc

SEQ ID NO: 1294239 - RNA, 23 nt, Human
agcgauucccucucccaggcccc

SEQ ID NO: 1294240 - RNA, 18 nt, Human
agcuaaacggauuccaaa

SEQ ID NO: 1294241 - RNA, 13 nt, Human
agcuaaauccuuu

SEQ ID NO: 1294242 - RNA, 20 nt, Human
agcuaaauaccucaaucagu

SEQ ID NO: 1294243 - RNA, 13 nt, Human
agcuaacagggaa

SEQ ID NO: 1294244 - RNA, 16 nt, Human
agcuaacagggaaggc

SEQ ID NO: 1294245 - RNA, 18 nt, Human
agcuaacagggaaggcag

SEQ ID NO: 1294246 - RNA, 19 nt, Human
agcuaacagggaaggcagg

SEQ ID NO: 1294247 - RNA, 20 nt, Human
agcuaacagggaaggcaggc

SEQ ID NO: 1294248 - RNA, 21 nt, Human
agcuaacagggaaggcaggca

SEQ ID NO: 1294249 - RNA, 23 nt, Human
agcuaacagggaaggcaggcagg

SEQ ID NO: 1294250 - RNA, 12 nt, Human
agcuaagaaccu

SEQ ID NO: 1294251 - RNA, 13 nt, Human
agcuaagaaccug

SEQ ID NO: 1294252 - RNA, 17 nt, Human
agcgacagugagacucu

SEQ ID NO: 1294253 - RNA, 15 nt, Human
agcgacagugagacu

SEQ ID NO: 1294254 - RNA, 13 nt, Human
agcgacagugaga

SEQ ID NO: 1294255 - RNA, 13 nt, Human
agcuacaaaugca

SEQ ID NO: 1294256 - RNA, 13 nt, Human
agcuacagagaaa

SEQ ID NO: 1294257 - RNA, 14 nt, Human
agcuacagagaaac

SEQ ID NO: 1294258 - RNA, 15 nt, Human
agcuacagagaaacc

SEQ ID NO: 1294259 - RNA, 18 nt, Human
agcucacaaggcagcaag

SEQ ID NO: 1294260 - RNA, 20 nt, Human
agcucacaaggcagcaaggc

SEQ ID NO: 1294261 - RNA, 19 nt, Human
agcucacaaggcagcaagg

SEQ ID NO: 1294262 - RNA, 14 nt, Human
agcuaagaaccugg

SEQ ID NO: 1294263 - RNA, 16 nt, Human
agcuaagaaccuggaa

SEQ ID NO: 1294264 - RNA, 17 nt, Human
agcuaagaaccuggaac

SEQ ID NO: 1294265 - RNA, 17 nt, Human
agcuaagcuaggaauga

SEQ ID NO: 1294266 - RNA, 18 nt, Human
agcuaagcuaggaaugaa

SEQ ID NO: 1294267 - RNA, 23 nt, Human
agcuaagcucacguccugagaaa

SEQ ID NO: 1294268 - RNA, 10 nt, Human
agcuaaggcu

SEQ ID NO: 1294269 - RNA, 13 nt, Human
agcuaaggcucua

SEQ ID NO: 1294270 - RNA, 15 nt, Human
agcuaaggcucuaug

SEQ ID NO: 1294271 - RNA, 18 nt, Human
agcuaaggcucuaugagu

SEQ ID NO: 1294272 - RNA, 20 nt, Human
agcuaaggcucuaugagucu

SEQ ID NO: 1294273 - RNA, 19 nt, Human
agcuaagggguggggcugc

SEQ ID NO: 1294274 - RNA, 19 nt, Human
agcuaagguuuagauaaau

SEQ ID NO: 1294275 - RNA, 18 nt, Human
agcuaagggguggggcug

SEQ ID NO: 1294276 - RNA, 16 nt, Human
agcuaauaaaaagcuu

SEQ ID NO: 1294277 - RNA, 17 nt, Human
agccugcugccugcuuu

SEQ ID NO: 1294278 - RNA, 10 nt, Human
agccuggacc

SEQ ID NO: 1294279 - RNA, 15 nt, Human
agccuggaccucuga

SEQ ID NO: 1294280 - RNA, 16 nt, Human
agccuggaccucugac

SEQ ID NO: 1294281 - RNA, 17 nt, Human
agccuggaccucugaca

SEQ ID NO: 1294282 - RNA, 18 nt, Human
agccuggaccucugacag

SEQ ID NO: 1294283 - RNA, 19 nt, Human
agccuggaccucugacagc

SEQ ID NO: 1294284 - RNA, 21 nt, Human
agccuggaccucugacagcag

SEQ ID NO: 1294285 - RNA, 24 nt, Human
agccuggaccucugacagcagcau

SEQ ID NO: 1294286 - RNA, 22 nt, Human
agccuggaccucugacagcagc

SEQ ID NO: 1294287 - RNA, 17 nt, Human
agccuggcacagggcag

SEQ ID NO: 1294288 - RNA, 18 nt, Human
agccuggcacagggcagu

SEQ ID NO: 1294289 - RNA, 20 nt, Human
agccuggcacagggcagugg

SEQ ID NO: 1294290 - RNA, 12 nt, Human
agccuggccaga

SEQ ID NO: 1294291 - RNA, 13 nt, Human
agccuggccagac

SEQ ID NO: 1294292 - RNA, 18 nt, Human
agccuggccuccugccuc

SEQ ID NO: 1294293 - RNA, 19 nt, Human
agccuggccuccugccucu

SEQ ID NO: 1294294 - RNA, 19 nt, Human
agccuggcuauguccuaau

SEQ ID NO: 1294295 - RNA, 20 nt, Human
agccuggccuccugccucua

SEQ ID NO: 1294296 - RNA, 14 nt, Human
agccuggccagaca

SEQ ID NO: 1294297 - RNA, 15 nt, Human
agccuggccagacac

SEQ ID NO: 1294298 - RNA, 16 nt, Human
agccuggccagacaca

SEQ ID NO: 1294299 - RNA, 18 nt, Human
agccuggccagacacagg

SEQ ID NO: 1294300 - RNA, 21 nt, Human
agccuggccagacacaggccc

SEQ ID NO: 1294301 - RNA, 22 nt, Human
agccuggccagacacaggcccu

SEQ ID NO: 1294302 - RNA, 16 nt, Human
agccuggccccauggu

SEQ ID NO: 1294303 - RNA, 17 nt, Human
agccuggccccaugguc

SEQ ID NO: 1294304 - RNA, 11 nt, Human
agccuggccuc

SEQ ID NO: 1294305 - RNA, 13 nt, Human
agccuggccuccu

SEQ ID NO: 1294306 - RNA, 14 nt, Human
agccuggccuccug

SEQ ID NO: 1294307 - RNA, 15 nt, Human
agccuggccuccugc

SEQ ID NO: 1294308 - RNA, 16 nt, Human
agccuggccuccugcc

SEQ ID NO: 1294309 - RNA, 17 nt, Human
agccuggccuccugccu

SEQ ID NO: 1294310 - RNA, 21 nt, Human
agccuuuuuguauaaaauaga

SEQ ID NO: 1294311 - RNA, 18 nt, Human
agccuuuuuguuucaaug

SEQ ID NO: 1294312 - RNA, 16 nt, Human
agccuuuuuuccccag

SEQ ID NO: 1294313 - RNA, 17 nt, Human
agccuuuuuuccccaga

SEQ ID NO: 1294314 - RNA, 19 nt, Human
agccuuuuuuccccagacu

SEQ ID NO: 1294315 - RNA, 20 nt, Human
agccuuuuuuccccagacuu

SEQ ID NO: 1294316 - RNA, 21 nt, Human
agccuuuuuuccccagacuug

SEQ ID NO: 1294317 - RNA, 23 nt, Human
agcgaaaaaaucagguggcuuuu

SEQ ID NO: 1294318 - RNA, 23 nt, Human
agccuuuuuuccccagacuuguu

SEQ ID NO: 1294319 - RNA, 15 nt, Human
agccuuucucucuuu

SEQ ID NO: 1294320 - RNA, 23 nt, Human
agccuuucucucuuuauacagcu

SEQ ID NO: 1294321 - RNA, 14 nt, Human
agauaugauucaaa

SEQ ID NO: 1294322 - RNA, 15 nt, Human
agauaugaaagcuga

SEQ ID NO: 1294323 - RNA, 15 nt, Human
agauaugauucaaau

SEQ ID NO: 1294324 - RNA, 16 nt, Human
agauaugauucaaaug

SEQ ID NO: 1294325 - RNA, 14 nt, Human
agauauauauucau

SEQ ID NO: 1294326 - RNA, 19 nt, Human
agauaucuuggacaaauca

SEQ ID NO: 1294327 - RNA, 21 nt, Human
agauaucuuggacaaaucaca

SEQ ID NO: 1294328 - RNA, 22 nt, Human
agauaucuuggacaaaucacau

SEQ ID NO: 1294329 - RNA, 18 nt, Human
agauaugaacauauuguu

SEQ ID NO: 1294330 - RNA, 20 nt, Human
agauagauaggucagugcaa

SEQ ID NO: 1294331 - RNA, 15 nt, Human
agauagcccuguccu

SEQ ID NO: 1294332 - RNA, 17 nt, Human
agauagcccuguccugg

SEQ ID NO: 1294333 - RNA, 20 nt, Human
agauagcccuguccuggugg

SEQ ID NO: 1294334 - RNA, 18 nt, Human
agauagcccuguccuggu

SEQ ID NO: 1294335 - RNA, 19 nt, Human
agauagcccuguccuggug

SEQ ID NO: 1294336 - RNA, 16 nt, Human
agauagcugugacuuc

SEQ ID NO: 1294337 - RNA, 14 nt, Human
agauagcugugacu

SEQ ID NO: 1294338 - RNA, 20 nt, Human
agaguucuuuuugaaguauu

SEQ ID NO: 1294339 - RNA, 21 nt, Human
agaguucuuuuugaaguauuu

SEQ ID NO: 1294340 - RNA, 22 nt, Human
agaguucuuuuugaaguauuua

SEQ ID NO: 1294341 - RNA, 12 nt, Human
agaguugaaccu

SEQ ID NO: 1294342 - RNA, 13 nt, Human
agaguugaaccua

SEQ ID NO: 1294343 - RNA, 12 nt, Human
agauagaaugac

SEQ ID NO: 1294344 - RNA, 15 nt, Human
agauagaaugacagu

SEQ ID NO: 1294345 - RNA, 16 nt, Human
agauagaaugacaguc

SEQ ID NO: 1294346 - RNA, 18 nt, Human
agagggucugggggcaca

SEQ ID NO: 1294347 - RNA, 14 nt, Human
agaguggggguggg

SEQ ID NO: 1294348 - RNA, 15 nt, Human
agaguggcuccuccc

SEQ ID NO: 1294349 - RNA, 12 nt, Human
agaguggcuccu

SEQ ID NO: 1294350 - RNA, 13 nt, Human
agaguggcuccuc

SEQ ID NO: 1294351 - RNA, 14 nt, Human
agaguggcuccucc

SEQ ID NO: 1294352 - RNA, 17 nt, Human
agauugagauguguuca

SEQ ID NO: 1294353 - RNA, 18 nt, Human
agauugagagaagagaca

SEQ ID NO: 1294354 - RNA, 19 nt, Human
agauugagagaagagacaa

SEQ ID NO: 1294355 - RNA, 13 nt, Human
agauugagagaau

SEQ ID NO: 1294356 - RNA, 15 nt, Human
agauugagagaauuu

SEQ ID NO: 1294357 - RNA, 17 nt, Human
agauugagcucucugcc

SEQ ID NO: 1294358 - RNA, 18 nt, Human
agauugagcucucugccc

SEQ ID NO: 1294359 - RNA, 17 nt, Human
agauugacgacaagugc

SEQ ID NO: 1294360 - RNA, 15 nt, Human
agauugacgacaagu

SEQ ID NO: 1294361 - RNA, 14 nt, Human
agauugauuguauu

SEQ ID NO: 1294362 - RNA, 15 nt, Human
agauugauuguauug

SEQ ID NO: 1294363 - RNA, 16 nt, Human
agauugauuguauugu

SEQ ID NO: 1294364 - RNA, 16 nt, Human
agauugcagaaaauuc

SEQ ID NO: 1294365 - RNA, 18 nt, Human
agauugcagaaaauucug

SEQ ID NO: 1294366 - RNA, 19 nt, Human
agauugcagaaaauucugu

SEQ ID NO: 1294367 - RNA, 20 nt, Human
agauugcagaaaauucugug

SEQ ID NO: 1294368 - RNA, 21 nt, Human
agauugcagaaaauucugugc

SEQ ID NO: 1294369 - RNA, 23 nt, Human
agauugcagaaaauucugugccu

SEQ ID NO: 1294370 - RNA, 13 nt, Human
agauugcugaaau

SEQ ID NO: 1294371 - RNA, 14 nt, Human
agauugcugaaauu

SEQ ID NO: 1294372 - RNA, 15 nt, Human
agcaaaaucuaccag

SEQ ID NO: 1294373 - RNA, 23 nt, Human
agcaaaauuuuuucucuaggaaa

SEQ ID NO: 1294374 - RNA, 13 nt, Human
agcaaacucuuuu

SEQ ID NO: 1294375 - RNA, 17 nt, Human
agcaaacucuuuuccca

SEQ ID NO: 1294376 - RNA, 15 nt, Human
agcaaacugcaugcc

SEQ ID NO: 1294377 - RNA, 19 nt, Human
agcaaacugcaugcccaga

SEQ ID NO: 1294378 - RNA, 22 nt, Human
agcaaacugcaugcccagagac

SEQ ID NO: 1294379 - RNA, 20 nt, Human
agcaaacugcaugcccagag

SEQ ID NO: 1294380 - RNA, 20 nt, Human
agcaaagauaucucaucucu

SEQ ID NO: 1294381 - RNA, 12 nt, Human
agcaaagcacag

SEQ ID NO: 1294382 - RNA, 13 nt, Human
agcaaagcacaga

SEQ ID NO: 1294383 - RNA, 15 nt, Human
agcaaagcacagaga

SEQ ID NO: 1294384 - RNA, 14 nt, Human
agcaaagcacagag

SEQ ID NO: 1294385 - RNA, 18 nt, Human
agcaacaauaaauagaca

SEQ ID NO: 1294386 - RNA, 13 nt, Human
agcaacaauaaau

SEQ ID NO: 1294387 - RNA, 12 nt, Human
agcaacaauaaa

SEQ ID NO: 1294388 - RNA, 15 nt, Human
agcaacaauuuauga

SEQ ID NO: 1294389 - RNA, 15 nt, Human
agcaaaucgaaugaa

SEQ ID NO: 1294390 - RNA, 20 nt, Human
agcaaauccuuugugaaaaa

SEQ ID NO: 1294391 - RNA, 12 nt, Human
agcaaauccuuu

SEQ ID NO: 1294392 - RNA, 17 nt, Human
agcaaaucgaaugaaau

SEQ ID NO: 1294393 - RNA, 23 nt, Human
agcaaaucaccacaaacuguaau

SEQ ID NO: 1294394 - RNA, 19 nt, Human
agcaaaucauuuguuuaaa

SEQ ID NO: 1294395 - RNA, 22 nt, Human
agcaaaucauuuguuuaaaaag

SEQ ID NO: 1294396 - RNA, 11 nt, Human
agcaaaucacc

SEQ ID NO: 1294397 - RNA, 18 nt, Human
agcaaaucaccacaaacu

SEQ ID NO: 1294398 - RNA, 21 nt, Human
agcaaaucaccacaaacugua

SEQ ID NO: 1294399 - RNA, 22 nt, Human
agcaaaucaccacaaacuguaa

SEQ ID NO: 1294400 - RNA, 23 nt, Human
agaucugauuuguaacccacuga

SEQ ID NO: 1294401 - RNA, 21 nt, Human
agaucugcagggggugugucu

SEQ ID NO: 1294402 - RNA, 18 nt, Human
agaucucugcuuuggaaa

SEQ ID NO: 1294403 - RNA, 23 nt, Human
agaucucugcuuuggaaaucaca

SEQ ID NO: 1294404 - RNA, 19 nt, Human
agaugaaugaagcaaaugu

SEQ ID NO: 1294405 - RNA, 16 nt, Human
agaugaaugccgugga

SEQ ID NO: 1294406 - RNA, 18 nt, Human
agaugacaagaaaggcug

SEQ ID NO: 1294407 - RNA, 20 nt, Human
agaugaccacuuuuuagaaa

SEQ ID NO: 1294408 - RNA, 17 nt, Human
agaugaauguccugaaa

SEQ ID NO: 1294409 - RNA, 18 nt, Human
agauggcugugccucugc

SEQ ID NO: 1294410 - RNA, 19 nt, Human
agauggcugugccucugcc

SEQ ID NO: 1294411 - RNA, 20 nt, Human
agauggcugugccucugccu

SEQ ID NO: 1294412 - RNA, 21 nt, Human
agauggcugugccucugccug

SEQ ID NO: 1294413 - RNA, 22 nt, Human
agauggcugugccucugccugu

SEQ ID NO: 1294414 - RNA, 15 nt, Human
agauucuaaagauuc

SEQ ID NO: 1294415 - RNA, 16 nt, Human
agauucuaaagauucu

SEQ ID NO: 1294416 - RNA, 17 nt, Human
agauucuaaagauucua

SEQ ID NO: 1294417 - RNA, 18 nt, Human
agauucuaaagauucuau

SEQ ID NO: 1294418 - RNA, 21 nt, Human
agauucuaaagauucuauagu

SEQ ID NO: 1294419 - RNA, 12 nt, Human
agauucuaaagg

SEQ ID NO: 1294420 - RNA, 19 nt, Human
agauucuauaguucuagac

SEQ ID NO: 1294421 - RNA, 20 nt, Human
agauucuauaguucuagaca

SEQ ID NO: 1294422 - RNA, 21 nt, Human
agauucuauaguucuagacau

SEQ ID NO: 1294423 - RNA, 12 nt, Human
agauucuuuccc

SEQ ID NO: 1294424 - RNA, 13 nt, Human
agauucuaaaggu

SEQ ID NO: 1294425 - RNA, 23 nt, Human
agauucuaaagguccacaggucu

SEQ ID NO: 1294426 - RNA, 10 nt, Human
agauucuaac

SEQ ID NO: 1294427 - RNA, 12 nt, Human
agauucuaacgg

SEQ ID NO: 1294428 - RNA, 13 nt, Human
agauucuaaugau

SEQ ID NO: 1294429 - RNA, 14 nt, Human
agauucuaaugaug

SEQ ID NO: 1294430 - RNA, 11 nt, Human
agauucuagau

SEQ ID NO: 1294431 - RNA, 12 nt, Human
agauucuagauc

SEQ ID NO: 1294432 - RNA, 14 nt, Human
agauucuagaucag

SEQ ID NO: 1294433 - RNA, 14 nt, Human
agauucuagaugau

SEQ ID NO: 1294434 - RNA, 15 nt, Human
agauucuauaguucu

SEQ ID NO: 1294435 - RNA, 16 nt, Human
agauucuauaguucua

SEQ ID NO: 1294436 - RNA, 18 nt, Human
agauucuauaguucuaga

SEQ ID NO: 1294437 - RNA, 17 nt, Human
agccaacuauggccugu

SEQ ID NO: 1294438 - RNA, 23 nt, Human
agcaucugggccuuggccuggag

SEQ ID NO: 1294439 - RNA, 15 nt, Human
agcaucugucccccu

SEQ ID NO: 1294440 - RNA, 16 nt, Human
agccaacuagccccug

SEQ ID NO: 1294441 - RNA, 17 nt, Human
agccaacuagccccugg

SEQ ID NO: 1294442 - RNA, 17 nt, Human
agccaacuaugauuauu

SEQ ID NO: 1294443 - RNA, 20 nt, Human
agccaacuaugauuauuaac

SEQ ID NO: 1294444 - RNA, 17 nt, Human
agcaucuccaagcagcu

SEQ ID NO: 1294445 - RNA, 14 nt, Human
agcaucucuaccuu

SEQ ID NO: 1294446 - RNA, 15 nt, Human
agcaucucuaccuuc

SEQ ID NO: 1294447 - RNA, 17 nt, Human
agcaucucuaccuucuc

SEQ ID NO: 1294448 - RNA, 18 nt, Human
agcaucucuaccuucucc

SEQ ID NO: 1294449 - RNA, 19 nt, Human
agcaucucuaccuucuccc

SEQ ID NO: 1294450 - RNA, 22 nt, Human
agcaucucuaccuucuccccag

SEQ ID NO: 1294451 - RNA, 23 nt, Human
agcaucucuaccuucuccccagc

SEQ ID NO: 1294452 - RNA, 13 nt, Human
agcaucuggcucu

SEQ ID NO: 1294453 - RNA, 16 nt, Human
agcaucuggcucuaau

SEQ ID NO: 1294454 - RNA, 18 nt, Human
agcaucuggcucuaauuc

SEQ ID NO: 1294455 - RNA, 13 nt, Human
agcaucugggccu

SEQ ID NO: 1294456 - RNA, 18 nt, Human
agcaucugggccuuggcc

SEQ ID NO: 1294457 - RNA, 19 nt, Human
agcaucugggccuuggccu

SEQ ID NO: 1294458 - RNA, 22 nt, Human
agcaucugggccuuggccugga

SEQ ID NO: 1294459 - RNA, 16 nt, Human
agccaagggaaccugu

SEQ ID NO: 1294460 - RNA, 17 nt, Human
agccaagggaaccugug

SEQ ID NO: 1294461 - RNA, 19 nt, Human
agccaagggaaccuguguc

SEQ ID NO: 1294462 - RNA, 20 nt, Human
agccaagggaaccugugucc

SEQ ID NO: 1294463 - RNA, 21 nt, Human
agccaagggaaccuguguccg

SEQ ID NO: 1294464 - RNA, 11 nt, Human
agccaagggau

SEQ ID NO: 1294465 - RNA, 14 nt, Human
agccaagggaugga

SEQ ID NO: 1294466 - RNA, 18 nt, Human
agccaagggauggacauc

SEQ ID NO: 1294467 - RNA, 20 nt, Human
agccaagggauggacaucuu

SEQ ID NO: 1294468 - RNA, 16 nt, Human
agccaaggggcuucag

SEQ ID NO: 1294469 - RNA, 23 nt, Human
agccaagggcaacagaucaguaa

SEQ ID NO: 1294470 - RNA, 22 nt, Human
agccaagguuuuauaaggcuga

SEQ ID NO: 1294471 - RNA, 22 nt, Human
agccaagggauggacaucuugu

SEQ ID NO: 1294472 - RNA, 15 nt, Human
agcaucucagcucau

SEQ ID NO: 1294473 - RNA, 16 nt, Human
agcaucuccaagcagc

SEQ ID NO: 1294474 - RNA, 22 nt, Human
agcaucggacaagacccccagc

SEQ ID NO: 1294475 - RNA, 23 nt, Human
agcaucggacaagacccccagca

SEQ ID NO: 1294476 - RNA, 12 nt, Human
agcaucuaaguu

SEQ ID NO: 1294477 - RNA, 20 nt, Human
agcaucuaaguuauaagacu

SEQ ID NO: 1294478 - RNA, 22 nt, Human
agcaucuaaguuauaagacucu

SEQ ID NO: 1294479 - RNA, 23 nt, Human
agcaucuaaguuauaagacucuc

SEQ ID NO: 1294480 - RNA, 19 nt, Human
agcaauuuaaauguuauga

SEQ ID NO: 1294481 - RNA, 17 nt, Human
agcaauuuaaauguuau

SEQ ID NO: 1294482 - RNA, 16 nt, Human
agcaauuuaaauguua

SEQ ID NO: 1294483 - RNA, 13 nt, Human
agcaauuuaaaug

SEQ ID NO: 1294484 - RNA, 16 nt, Human
agcaauucuuucaagu

SEQ ID NO: 1294485 - RNA, 17 nt, Human
agcaauucuccugccuc

SEQ ID NO: 1294486 - RNA, 18 nt, Human
agcaauucuccugccuca

SEQ ID NO: 1294487 - RNA, 19 nt, Human
agcaauucuccugccucag

SEQ ID NO: 1294488 - RNA, 20 nt, Human
agcaauucuccugccucagc

SEQ ID NO: 1294489 - RNA, 15 nt, Human
agcaauucuccugcc

SEQ ID NO: 1294490 - RNA, 13 nt, Human
agcaauuucuaau

SEQ ID NO: 1294491 - RNA, 12 nt, Human
agcacagagagu

SEQ ID NO: 1294492 - RNA, 19 nt, Human
agcacagagagucuggaua

SEQ ID NO: 1294493 - RNA, 17 nt, Human
agcacagagagucugga

SEQ ID NO: 1294494 - RNA, 15 nt, Human
agcacagauggccag

SEQ ID NO: 1294495 - RNA, 16 nt, Human
agcacagauggccagc

SEQ ID NO: 1294496 - RNA, 17 nt, Human
agcacagauggccagcc

SEQ ID NO: 1294497 - RNA, 20 nt, Human
agcacagauggccagccccu

SEQ ID NO: 1294498 - RNA, 14 nt, Human
agcacugccaccag

SEQ ID NO: 1294499 - RNA, 12 nt, Human
agcacugccagg

SEQ ID NO: 1294500 - RNA, 13 nt, Human
agcacugccagga

SEQ ID NO: 1294501 - RNA, 16 nt, Human
agcacuagccaaaccu

SEQ ID NO: 1294502 - RNA, 19 nt, Human
agcacuagccaaaccucac

SEQ ID NO: 1294503 - RNA, 20 nt, Human
agcacuagccaaaccucacc

SEQ ID NO: 1294504 - RNA, 19 nt, Human
agcacucgcuagcaguggc

SEQ ID NO: 1294505 - RNA, 23 nt, Human
agcagccugagcaacucuugauu

SEQ ID NO: 1294506 - RNA, 11 nt, Human
agcagccuuuc

SEQ ID NO: 1294507 - RNA, 19 nt, Human
agcagugauugucuuaaua

SEQ ID NO: 1294508 - RNA, 12 nt, Human
agcagugcuuuu

SEQ ID NO: 1294509 - RNA, 15 nt, Human
agcaguggcaggcag

SEQ ID NO: 1294510 - RNA, 22 nt, Human
agcaguggcaggcagaggccca

SEQ ID NO: 1294511 - RNA, 12 nt, Human
agcaguggccuu

SEQ ID NO: 1294512 - RNA, 19 nt, Human
agcaguggccuuauugcau

SEQ ID NO: 1294513 - RNA, 22 nt, Human
agcaguggcugguccagggcua

SEQ ID NO: 1294514 - RNA, 11 nt, Human
agcaguggcug

SEQ ID NO: 1294515 - RNA, 12 nt, Human
agcaguggcugg

SEQ ID NO: 1294516 - RNA, 13 nt, Human
agcaguggcuggu

SEQ ID NO: 1294517 - RNA, 16 nt, Human
agcaguggcuggucca

SEQ ID NO: 1294518 - RNA, 17 nt, Human
agcaguggcugguccag

SEQ ID NO: 1294519 - RNA, 18 nt, Human
agcaguggcugguccagg

SEQ ID NO: 1294520 - RNA, 19 nt, Human
agcaguggcugguccaggg

SEQ ID NO: 1294521 - RNA, 21 nt, Human
agcaguggcugguccagggcu

SEQ ID NO: 1294522 - RNA, 18 nt, Human
agacgaaacauuuguucu

SEQ ID NO: 1294523 - RNA, 20 nt, Human
agaccuuuuucugcacuaua

SEQ ID NO: 1294524 - RNA, 18 nt, Human
agaccuuuuucugcacua

SEQ ID NO: 1294525 - RNA, 14 nt, Human
agaccuuuuucugc

SEQ ID NO: 1294526 - RNA, 16 nt, Human
agaccuuuuuuaggaa

SEQ ID NO: 1294527 - RNA, 14 nt, Human
agaccuuuuuuagg

SEQ ID NO: 1294528 - RNA, 17 nt, Human
agacccaaaaggcagaa

SEQ ID NO: 1294529 - RNA, 23 nt, Human
agaccauggacacuacacccagc

SEQ ID NO: 1294530 - RNA, 22 nt, Human
agaccauggacacuacacccag

SEQ ID NO: 1294531 - RNA, 21 nt, Human
agaccauggacacuacaccca

SEQ ID NO: 1294532 - RNA, 12 nt, Human
agaccauggaca

SEQ ID NO: 1294533 - RNA, 17 nt, Human
agaccaccucucaauau

SEQ ID NO: 1294534 - RNA, 19 nt, Human
agaccacgcccguccugcc

SEQ ID NO: 1294535 - RNA, 12 nt, Human
agaccaccucuc

SEQ ID NO: 1294536 - RNA, 16 nt, Human
agaccaccccgccugc

SEQ ID NO: 1294537 - RNA, 20 nt, Human
agaccacgcccguccugccu

SEQ ID NO: 1294538 - RNA, 21 nt, Human
agaccacgcccguccugccug

SEQ ID NO: 1294539 - RNA, 23 nt, Human
agaccacgcccguccugccugug

SEQ ID NO: 1294540 - RNA, 24 nt, Human
agaccacgcccguccugccugugg

SEQ ID NO: 1294541 - RNA, 23 nt, Human
agacaauugagguaaguuuuuug

SEQ ID NO: 1294542 - RNA, 19 nt, Human
agacaauugacaacaguua

SEQ ID NO: 1294543 - RNA, 13 nt, Human
agacagcccucca

SEQ ID NO: 1294544 - RNA, 17 nt, Human
agacagcuccacccugg

SEQ ID NO: 1294545 - RNA, 11 nt, Human
agaccaccagg

SEQ ID NO: 1294546 - RNA, 14 nt, Human
agaccaccagggca

SEQ ID NO: 1294547 - RNA, 23 nt, Human
agaccaccagggcaucucugggc

SEQ ID NO: 1294548 - RNA, 14 nt, Human
agaccaccccgccu

SEQ ID NO: 1294549 - RNA, 12 nt, Human
agacuagaugua

SEQ ID NO: 1294550 - RNA, 13 nt, Human
agacuagauguag

SEQ ID NO: 1294551 - RNA, 14 nt, Human
agacuagauguagu

SEQ ID NO: 1294552 - RNA, 16 nt, Human
agacuagauguaguau

SEQ ID NO: 1294553 - RNA, 19 nt, Human
agacuagauguaguauuuu

SEQ ID NO: 1294554 - RNA, 23 nt, Human
agacuagauguaguauuuuuugu

SEQ ID NO: 1294555 - RNA, 16 nt, Human
agacuagauggaccug

SEQ ID NO: 1294556 - RNA, 19 nt, Human
agacaaggaaaaaauaaca

SEQ ID NO: 1294557 - RNA, 19 nt, Human
agacaaaacauacauuuug

SEQ ID NO: 1294558 - RNA, 15 nt, Human
agacaagccagaacu

SEQ ID NO: 1294559 - RNA, 16 nt, Human
agacaauugacaacag

SEQ ID NO: 1294560 - RNA, 17 nt, Human
agacaagccuggccuac

SEQ ID NO: 1294561 - RNA, 17 nt, Human
agacaagccagaacuug

SEQ ID NO: 1294562 - RNA, 23 nt, Human
agacaagugaugcuaaaaccuga

SEQ ID NO: 1294563 - RNA, 15 nt, Human
agaauuuugagcagg

SEQ ID NO: 1294564 - RNA, 22 nt, Human
agaauuuuauacuuucccuacc

SEQ ID NO: 1294565 - RNA, 21 nt, Human
agaauuuuauacuuucccuac

SEQ ID NO: 1294566 - RNA, 19 nt, Human
agacaaaaaacuauaugua

SEQ ID NO: 1294567 - RNA, 18 nt, Human
agaauuuuauacuuuccc

SEQ ID NO: 1294568 - RNA, 20 nt, Human
agaauuuuauacuuucccua

SEQ ID NO: 1294569 - RNA, 22 nt, Human
agagaggccauucuuucccaac

SEQ ID NO: 1294570 - RNA, 23 nt, Human
agagaggccauucuuucccaaca

SEQ ID NO: 1294571 - RNA, 12 nt, Human
agagaggccauu

SEQ ID NO: 1294572 - RNA, 17 nt, Human
agagccugcaggaucuc

SEQ ID NO: 1294573 - RNA, 23 nt, Human
agagcccacuccaucugguagaa

SEQ ID NO: 1294574 - RNA, 12 nt, Human
agagcccagcuc

SEQ ID NO: 1294575 - RNA, 13 nt, Human
agagcccagcucc

SEQ ID NO: 1294576 - RNA, 14 nt, Human
agagcccagcucca

SEQ ID NO: 1294577 - RNA, 15 nt, Human
agagcccagcuccaa

SEQ ID NO: 1294578 - RNA, 14 nt, Human
agagccugagggau

SEQ ID NO: 1294579 - RNA, 13 nt, Human
agagccugaggga

SEQ ID NO: 1294580 - RNA, 14 nt, Human
agagccugcaggau

SEQ ID NO: 1294581 - RNA, 16 nt, Human
agagccugcaggaucu

SEQ ID NO: 1294582 - RNA, 20 nt, Human
agagaaaaugcgguuauaaa

SEQ ID NO: 1294583 - RNA, 24 nt, Human
agacugaauagauaugaaagcuga

SEQ ID NO: 1294584 - RNA, 21 nt, Human
agacucuuuuccuucccuuuu

SEQ ID NO: 1294585 - RNA, 18 nt, Human
agacucuuuuccuucccu

SEQ ID NO: 1294586 - RNA, 21 nt, Human
agacugaauagauaugaaagc

SEQ ID NO: 1294587 - RNA, 22 nt, Human
agacugaauagauaugaaagcu

SEQ ID NO: 1294588 - RNA, 22 nt, Human
agacugacaguuuacagacgcu

SEQ ID NO: 1294589 - RNA, 13 nt, Human
agagaaacaguug

SEQ ID NO: 1294590 - RNA, 16 nt, Human
agagaaacaguuggua

SEQ ID NO: 1294591 - RNA, 12 nt, Human
agagaaaccagc

SEQ ID NO: 1294592 - RNA, 13 nt, Human
agagaaaccagcu

SEQ ID NO: 1294593 - RNA, 14 nt, Human
agagaaaccagcuu

SEQ ID NO: 1294594 - RNA, 15 nt, Human
agagaaaccagcuuc

SEQ ID NO: 1294595 - RNA, 17 nt, Human
agagaaaccagcuuccu

SEQ ID NO: 1294596 - RNA, 18 nt, Human
agagaaaccagcuuccuu

SEQ ID NO: 1294597 - RNA, 19 nt, Human
agagaaaccagcuuccuuc

SEQ ID NO: 1294598 - RNA, 20 nt, Human
agagaaaccagcuuccuuca

SEQ ID NO: 1294599 - RNA, 22 nt, Human
agagaaaccagcuuccuucaga

SEQ ID NO: 1294600 - RNA, 21 nt, Human
agagaaaccagcuuccuucag

SEQ ID NO: 1294601 - RNA, 15 nt, Human
agagaagucacaggg

SEQ ID NO: 1294602 - RNA, 18 nt, Human
agagaagucacagggcag

SEQ ID NO: 1294603 - RNA, 18 nt, Human
agagaaguauacauaagu

SEQ ID NO: 1294604 - RNA, 18 nt, Human
agagaacccagcccaccc

SEQ ID NO: 1294605 - RNA, 15 nt, Human
agagaacccagccca

SEQ ID NO: 1294606 - RNA, 14 nt, Human
agagaaauaugaag

SEQ ID NO: 1294607 - RNA, 23 nt, Human
agagaaauaagugcccucuccca

SEQ ID NO: 1294608 - RNA, 13 nt, Human
agagaaccaggcu

SEQ ID NO: 1294609 - RNA, 14 nt, Human
agagaacccagccc

SEQ ID NO: 1294610 - RNA, 19 nt, Human
agagaagucacagggcagu

SEQ ID NO: 1294611 - RNA, 20 nt, Human
agagaagucacagggcagua

SEQ ID NO: 1294612 - RNA, 23 nt, Human
agagaagucacagggcaguaccu

SEQ ID NO: 1294613 - RNA, 12 nt, Human
agagaaguugua

SEQ ID NO: 1294614 - RNA, 13 nt, Human
agagaauaaauug

SEQ ID NO: 1294615 - RNA, 12 nt, Human
agagaaucaaca

SEQ ID NO: 1294616 - RNA, 15 nt, Human
agagaaucaacauuu

SEQ ID NO: 1294617 - RNA, 20 nt, Human
agagaaucaacauuucucaa

SEQ ID NO: 1294618 - RNA, 21 nt, Human
agaagacugcauuauauuuau

SEQ ID NO: 1294619 - RNA, 20 nt, Human
agaaccaggcaacuugggaa

SEQ ID NO: 1294620 - RNA, 16 nt, Human
agaaccaggcuacaag

SEQ ID NO: 1294621 - RNA, 16 nt, Human
agaaccagucccccca

SEQ ID NO: 1294622 - RNA, 19 nt, Human
agaaccaguccccccaccc

SEQ ID NO: 1294623 - RNA, 20 nt, Human
agaaccaguccccccacccu

SEQ ID NO: 1294624 - RNA, 11 nt, Human
agaaccaaaga

SEQ ID NO: 1294625 - RNA, 19 nt, Human
agaaccaaagaagaaaguc

SEQ ID NO: 1294626 - RNA, 17 nt, Human
agaaccaggcaacuugg

SEQ ID NO: 1294627 - RNA, 22 nt, Human
agaaccacagggcuauuuuguu

SEQ ID NO: 1294628 - RNA, 16 nt, Human
agaaccaaagaagaaa

SEQ ID NO: 1294629 - RNA, 13 nt, Human
agaaccaaaucug

SEQ ID NO: 1294630 - RNA, 16 nt, Human
agaaccaaaucuggaa

SEQ ID NO: 1294631 - RNA, 18 nt, Human
agaaccaaaucuggaagc

SEQ ID NO: 1294632 - RNA, 24 nt, Human
agaagagcgagagaucaaagauga

SEQ ID NO: 1294633 - RNA, 14 nt, Human
agaagucucagcua

SEQ ID NO: 1294634 - RNA, 22 nt, Human
agaagucucagcuaagcucacg

SEQ ID NO: 1294635 - RNA, 15 nt, Human
agaagucucuuccag

SEQ ID NO: 1294636 - RNA, 21 nt, Human
agaauccuaggcuccacccca

SEQ ID NO: 1294637 - RNA, 22 nt, Human
agaaucccuuaacaguuguauu

SEQ ID NO: 1294638 - RNA, 23 nt, Human
agaagucacagggcaguaccuga

SEQ ID NO: 1294639 - RNA, 13 nt, Human
agaagucucagcu

SEQ ID NO: 1294640 - RNA, 14 nt, Human
agaagucacagggc

SEQ ID NO: 1294641 - RNA, 15 nt, Human
agaagucacagggca

SEQ ID NO: 1294642 - RNA, 16 nt, Human
agaagucacagggcag

SEQ ID NO: 1294643 - RNA, 17 nt, Human
agaagucacagggcagu

SEQ ID NO: 1294644 - RNA, 18 nt, Human
agaagucacagggcagua

SEQ ID NO: 1294645 - RNA, 19 nt, Human
agaagucacagggcaguac

SEQ ID NO: 1294646 - RNA, 21 nt, Human
agaagucacagggcaguaccu

SEQ ID NO: 1294647 - RNA, 15 nt, Human
agaagggagggcaga

SEQ ID NO: 1294648 - RNA, 16 nt, Human
agaagggagggcagag

SEQ ID NO: 1294649 - RNA, 19 nt, Human
agaagggagggcagagcug

SEQ ID NO: 1294650 - RNA, 21 nt, Human
agaagggagggcagagcuggu

SEQ ID NO: 1294651 - RNA, 22 nt, Human
agaagggagggcagagcuggug

SEQ ID NO: 1294652 - RNA, 23 nt, Human
agaagggagggcagagcuggugc

SEQ ID NO: 1294653 - RNA, 21 nt, Human
agaagggcugcuucccugaag

SEQ ID NO: 1294654 - RNA, 15 nt, Human
agaaggggagaugga

SEQ ID NO: 1294655 - RNA, 17 nt, Human
agaaugauuaugaauua

SEQ ID NO: 1294656 - RNA, 16 nt, Human
agaaugcacaagaaug

SEQ ID NO: 1294657 - RNA, 17 nt, Human
agaaugcacaagaaugg

SEQ ID NO: 1294658 - RNA, 16 nt, Human
agaaugaucugauuga

SEQ ID NO: 1294659 - RNA, 20 nt, Human
agaaugcacaagaauggauc

SEQ ID NO: 1294660 - RNA, 19 nt, Human
agaaugcacaagaauggau

SEQ ID NO: 1294661 - RNA, 17 nt, Human
agaaugaucugauugac

SEQ ID NO: 1294662 - RNA, 14 nt, Human
agaaugaucugauu

SEQ ID NO: 1294663 - RNA, 17 nt, Human
agaaucgaggugcuguu

SEQ ID NO: 1294664 - RNA, 18 nt, Human
agaaucuauauuuaacaa

SEQ ID NO: 1294665 - RNA, 17 nt, Human
agaaucugcaauucaaa

SEQ ID NO: 1294666 - RNA, 19 nt, Human
agaaucuugguuugccuuc

SEQ ID NO: 1294667 - RNA, 20 nt, Human
agaaucuugguuugccuucc

SEQ ID NO: 1294668 - RNA, 12 nt, Human
agaaugagccuc

SEQ ID NO: 1294669 - RNA, 14 nt, Human
agaaucuuuagaga

SEQ ID NO: 1294670 - RNA, 23 nt, Human
agaaucuuuagagaaguauacau

SEQ ID NO: 1294671 - RNA, 17 nt, Human
agaacaucccuccuggg

SEQ ID NO: 1294672 - RNA, 13 nt, Human
agaacaucccucc

SEQ ID NO: 1294673 - RNA, 20 nt, Human
agaacaucuguauacccucu

SEQ ID NO: 1294674 - RNA, 18 nt, Human
agaacauggccuaagggc

SEQ ID NO: 1294675 - RNA, 13 nt, Human
agaacaugugaga

SEQ ID NO: 1294676 - RNA, 22 nt, Human
agaacaugugagagguuugacu

SEQ ID NO: 1294677 - RNA, 22 nt, Human
agaacagugauuaccagggacu

SEQ ID NO: 1294678 - RNA, 19 nt, Human
agaacagggaaaauaggca

SEQ ID NO: 1294679 - RNA, 20 nt, Human
agaacagggaaaauaggcag

SEQ ID NO: 1294680 - RNA, 22 nt, Human
agaacagggaaaauaggcagga

SEQ ID NO: 1294681 - RNA, 19 nt, Human
agaacauagacagaagaaa

SEQ ID NO: 1294682 - RNA, 21 nt, Human
agaacauagacagaagaaaca

SEQ ID NO: 1294683 - RNA, 18 nt, Human
agaacagcagacucagcu

SEQ ID NO: 1294684 - RNA, 12 nt, Human
agaacaaaugaa

SEQ ID NO: 1294685 - RNA, 15 nt, Human
agaacaaaugaagac

SEQ ID NO: 1294686 - RNA, 10 nt, Human
agaacaaggc

SEQ ID NO: 1294687 - RNA, 15 nt, Human
agaacaaugugcuau

SEQ ID NO: 1294688 - RNA, 15 nt, Human
agaacaacuaccuga

SEQ ID NO: 1294689 - RNA, 12 nt, Human
agaacacacaca

SEQ ID NO: 1294690 - RNA, 14 nt, Human
agaacacacacacu

SEQ ID NO: 1294691 - RNA, 15 nt, Human
agaacacacacacuu

SEQ ID NO: 1294692 - RNA, 20 nt, Human
agaacacagcaauuccucag

SEQ ID NO: 1294693 - RNA, 11 nt, Human
agaacacaguu

SEQ ID NO: 1294694 - RNA, 17 nt, Human
agaacaccuaugcaaag

SEQ ID NO: 1294695 - RNA, 11 nt, Human
agaacacuaau

SEQ ID NO: 1294696 - RNA, 14 nt, Human
agaacacuaauuca

SEQ ID NO: 1294697 - RNA, 15 nt, Human
agaacacuaauucau

SEQ ID NO: 1294698 - RNA, 19 nt, Human
agaacacuaauucauaauc

SEQ ID NO: 1294699 - RNA, 16 nt, Human
agaacacuaauucaua

SEQ ID NO: 1294700 - RNA, 12 nt, Human
agaacacuuaug

SEQ ID NO: 1294701 - RNA, 17 nt, Human
aucccccagaaaagaaa

SEQ ID NO: 1294702 - RNA, 15 nt, Human
auccccccaucuugc

SEQ ID NO: 1294703 - RNA, 17 nt, Human
auccccccaucuugcuu

SEQ ID NO: 1294704 - RNA, 20 nt, Human
auccccccaucuugcuuccc

SEQ ID NO: 1294705 - RNA, 12 nt, Human
aucccccagaaa

SEQ ID NO: 1294706 - RNA, 17 nt, Human
auccagggggcaagagg

SEQ ID NO: 1294707 - RNA, 23 nt, Human
auccagggaggcugguccuaugg

SEQ ID NO: 1294708 - RNA, 12 nt, Human
auccuugaagau

SEQ ID NO: 1294709 - RNA, 17 nt, Human
auccuuccucacaccag

SEQ ID NO: 1294710 - RNA, 14 nt, Human
aucgaccugccucg

SEQ ID NO: 1294711 - RNA, 18 nt, Human
aucgaaucuacuaauucc

SEQ ID NO: 1294712 - RNA, 20 nt, Human
aucgaaucuacuaauuccac

SEQ ID NO: 1294713 - RNA, 21 nt, Human
aucgacuuguuuuugcacaug

SEQ ID NO: 1294714 - RNA, 13 nt, Human
aucgaaugaaauu

SEQ ID NO: 1294715 - RNA, 14 nt, Human
aucgaaugaaauua

SEQ ID NO: 1294716 - RNA, 14 nt, Human
auccuugaagguau

SEQ ID NO: 1294717 - RNA, 15 nt, Human
auccuugaagguaua

SEQ ID NO: 1294718 - RNA, 15 nt, Human
aucgaaccguuuuga

SEQ ID NO: 1294719 - RNA, 23 nt, Human
auccaggccggcuugccacaccc

SEQ ID NO: 1294720 - RNA, 12 nt, Human
auccagggacag

SEQ ID NO: 1294721 - RNA, 13 nt, Human
auccagggacaga

SEQ ID NO: 1294722 - RNA, 14 nt, Human
auccagggacagag

SEQ ID NO: 1294723 - RNA, 16 nt, Human
auccagggacagaggc

SEQ ID NO: 1294724 - RNA, 19 nt, Human
auccagggacagaggcccc

SEQ ID NO: 1294725 - RNA, 20 nt, Human
auccagggacagaggcccca

SEQ ID NO: 1294726 - RNA, 21 nt, Human
auccagggacagaggccccag

SEQ ID NO: 1294727 - RNA, 14 nt, Human
auccaggccggcuu

SEQ ID NO: 1294728 - RNA, 21 nt, Human
auccagccuggggcugaggcu

SEQ ID NO: 1294729 - RNA, 17 nt, Human
auccagccuggggucug

SEQ ID NO: 1294730 - RNA, 15 nt, Human
auccagcuauguuau

SEQ ID NO: 1294731 - RNA, 22 nt, Human
auccaggcagauccaggacuau

SEQ ID NO: 1294732 - RNA, 12 nt, Human
auccacuuugca

SEQ ID NO: 1294733 - RNA, 19 nt, Human
auccagccuggggcugagg

SEQ ID NO: 1294734 - RNA, 12 nt, Human
auccagccuggg

SEQ ID NO: 1294735 - RNA, 23 nt, Human
auccagccuaacuuacauucuua

SEQ ID NO: 1294736 - RNA, 23 nt, Human
auccacuuuaucuugaauaaugu

SEQ ID NO: 1294737 - RNA, 23 nt, Human
aucaugccucugaggccagccug

SEQ ID NO: 1294738 - RNA, 14 nt, Human
aucaugccucugag

SEQ ID NO: 1294739 - RNA, 15 nt, Human
aucaugccucugagg

SEQ ID NO: 1294740 - RNA, 16 nt, Human
aucaugccucugaggc

SEQ ID NO: 1294741 - RNA, 17 nt, Human
aucaugccucugaggcc

SEQ ID NO: 1294742 - RNA, 19 nt, Human
aucaugccucugaggccag

SEQ ID NO: 1294743 - RNA, 20 nt, Human
aucaugccucugaggccagc

SEQ ID NO: 1294744 - RNA, 22 nt, Human
aucaugccucugaggccagccu

SEQ ID NO: 1294745 - RNA, 21 nt, Human
aucaucuaccuagauuuaaua

SEQ ID NO: 1294746 - RNA, 23 nt, Human
aucaugagugaauaaaugucuug

SEQ ID NO: 1294747 - RNA, 21 nt, Human
aucaugcauguccuguaaagg

SEQ ID NO: 1294748 - RNA, 12 nt, Human
aucaugcccugu

SEQ ID NO: 1294749 - RNA, 13 nt, Human
aucaaauacauuu

SEQ ID NO: 1294750 - RNA, 14 nt, Human
aucaaauacauuua

SEQ ID NO: 1294751 - RNA, 13 nt, Human
aucauccucuggc

SEQ ID NO: 1294752 - RNA, 15 nt, Human
aucauccucuggcuu

SEQ ID NO: 1294753 - RNA, 21 nt, Human
aucauccuuuagguaagaagu

SEQ ID NO: 1294754 - RNA, 19 nt, Human
auauuuuuuucugaaauuu

SEQ ID NO: 1294755 - RNA, 22 nt, Human
auauuuuuuuucuuuuuaccca

SEQ ID NO: 1294756 - RNA, 18 nt, Human
auauuuuuuuuuaagcuc

SEQ ID NO: 1294757 - RNA, 21 nt, Human
auauuuuuuuuuaagcucuga

SEQ ID NO: 1294758 - RNA, 23 nt, Human
auauuuuuuuuuaagcucugagc

SEQ ID NO: 1294759 - RNA, 19 nt, Human
aucaaaaaaggcaguuacc

SEQ ID NO: 1294760 - RNA, 14 nt, Human
aucaaaagaaagaa

SEQ ID NO: 1294761 - RNA, 15 nt, Human
aucaaaacuuucuuu

SEQ ID NO: 1294762 - RNA, 21 nt, Human
aucaaaacuuucuuuucugga

SEQ ID NO: 1294763 - RNA, 14 nt, Human
auauuuuuuucuga

SEQ ID NO: 1294764 - RNA, 16 nt, Human
auauuuuuuucugaaa

SEQ ID NO: 1294765 - RNA, 18 nt, Human
auauuuuuuucugaaauu

SEQ ID NO: 1294766 - RNA, 22 nt, Human
aucaaacccuagccuugcuugu

SEQ ID NO: 1294767 - RNA, 12 nt, Human
aucaaaggacac

SEQ ID NO: 1294768 - RNA, 18 nt, Human
aucaaaagggccaaagaa

SEQ ID NO: 1294769 - RNA, 22 nt, Human
aucaaaagggccaaagaaccaa

SEQ ID NO: 1294770 - RNA, 14 nt, Human
aucaaacauuuuga

SEQ ID NO: 1294771 - RNA, 15 nt, Human
aucaaacauuuugaa

SEQ ID NO: 1294772 - RNA, 16 nt, Human
aucaaacauuuugaaa

SEQ ID NO: 1294773 - RNA, 17 nt, Human
aucaaacccuagccuug

SEQ ID NO: 1294774 - RNA, 18 nt, Human
aucaaacccuagccuugc

SEQ ID NO: 1294775 - RNA, 20 nt, Human
aucaaacccuagccuugcuu

SEQ ID NO: 1294776 - RNA, 21 nt, Human
aucaaacccuagccuugcuug

SEQ ID NO: 1294777 - RNA, 16 nt, Human
augaaacuuuuggaag

SEQ ID NO: 1294778 - RNA, 20 nt, Human
augaagccuccuuagaaaaa

SEQ ID NO: 1294779 - RNA, 17 nt, Human
augaaacuagaaagcag

SEQ ID NO: 1294780 - RNA, 23 nt, Human
augaaacuagaaagcagagauuu

SEQ ID NO: 1294781 - RNA, 14 nt, Human
augaauacauuucc

SEQ ID NO: 1294782 - RNA, 21 nt, Human
augaauacauuuccaaaaugg

SEQ ID NO: 1294783 - RNA, 24 nt, Human
augaauaccuuagugcaguuauuu

SEQ ID NO: 1294784 - RNA, 21 nt, Human
augaauacuguauuuuguauu

SEQ ID NO: 1294785 - RNA, 12 nt, Human
augaauacuuug

SEQ ID NO: 1294786 - RNA, 17 nt, Human
augaauaaagacaccua

SEQ ID NO: 1294787 - RNA, 13 nt, Human
augaaguacucau

SEQ ID NO: 1294788 - RNA, 13 nt, Human
augaagcuguugu

SEQ ID NO: 1294789 - RNA, 17 nt, Human
augaggccagaccaugg

SEQ ID NO: 1294790 - RNA, 15 nt, Human
augaggccauggacu

SEQ ID NO: 1294791 - RNA, 21 nt, Human
augaggccauggacucugucc

SEQ ID NO: 1294792 - RNA, 14 nt, Human
augaggccagacca

SEQ ID NO: 1294793 - RNA, 13 nt, Human
augaggccagacc

SEQ ID NO: 1294794 - RNA, 12 nt, Human
augaggccagac

SEQ ID NO: 1294795 - RNA, 15 nt, Human
augaggccacuggag

SEQ ID NO: 1294796 - RNA, 23 nt, Human
augagcuuucugaacagcuggug

SEQ ID NO: 1294797 - RNA, 14 nt, Human
augaggcccuccac

SEQ ID NO: 1294798 - RNA, 15 nt, Human
augaggcccuccaca

SEQ ID NO: 1294799 - RNA, 20 nt, Human
augaggcccuccacaccugc

SEQ ID NO: 1294800 - RNA, 19 nt, Human
augaggcccuccacaccug

SEQ ID NO: 1294801 - RNA, 16 nt, Human
augagcucuucauguu

SEQ ID NO: 1294802 - RNA, 12 nt, Human
augagcuuucug

SEQ ID NO: 1294803 - RNA, 13 nt, Human
augagcuuucuga

SEQ ID NO: 1294804 - RNA, 14 nt, Human
augagcuuucugaa

SEQ ID NO: 1294805 - RNA, 15 nt, Human
augagcuuucugaac

SEQ ID NO: 1294806 - RNA, 17 nt, Human
augagcuuucugaacag

SEQ ID NO: 1294807 - RNA, 18 nt, Human
augagcuuucugaacagc

SEQ ID NO: 1294808 - RNA, 19 nt, Human
augagcuuucugaacagcu

SEQ ID NO: 1294809 - RNA, 20 nt, Human
augagcuuucugaacagcug

SEQ ID NO: 1294810 - RNA, 21 nt, Human
augagcuuucugaacagcugg

SEQ ID NO: 1294811 - RNA, 22 nt, Human
augagcuuucugaacagcuggu

SEQ ID NO: 1294812 - RNA, 21 nt, Human
augagcuuugucuacuucaaa

SEQ ID NO: 1294813 - RNA, 12 nt, Human
augaauauaaaa

SEQ ID NO: 1294814 - RNA, 19 nt, Human
aucuaggauuuuaagggaa

SEQ ID NO: 1294815 - RNA, 18 nt, Human
aucuaggcaacauaguau

SEQ ID NO: 1294816 - RNA, 11 nt, Human
aucuaggauuu

SEQ ID NO: 1294817 - RNA, 15 nt, Human
augagggaaaagaaa

SEQ ID NO: 1294818 - RNA, 13 nt, Human
augagggaaaaga

SEQ ID NO: 1294819 - RNA, 14 nt, Human
augagggaaaagaa

SEQ ID NO: 1294820 - RNA, 13 nt, Human
augaggcuuucca

SEQ ID NO: 1294821 - RNA, 20 nt, Human
augggacauuugcucaugga

SEQ ID NO: 1294822 - RNA, 15 nt, Human
augggacagggagga

SEQ ID NO: 1294823 - RNA, 17 nt, Human
augggaacaauugaagu

SEQ ID NO: 1294824 - RNA, 23 nt, Human
auggcuuccuggcaauagucaaa

SEQ ID NO: 1294825 - RNA, 18 nt, Human
auggagugcaccaaagag

SEQ ID NO: 1294826 - RNA, 19 nt, Human
auggagugcaccaaagaga

SEQ ID NO: 1294827 - RNA, 20 nt, Human
auggagugcaccaaagagaa

SEQ ID NO: 1294828 - RNA, 12 nt, Human
auggagugcugu

SEQ ID NO: 1294829 - RNA, 13 nt, Human
auggagugcuguu

SEQ ID NO: 1294830 - RNA, 18 nt, Human
auggagugcuguuuuguu

SEQ ID NO: 1294831 - RNA, 19 nt, Human
auggagugcuguuuuguua

SEQ ID NO: 1294832 - RNA, 20 nt, Human
auggagugcuguuuuguuau

SEQ ID NO: 1294833 - RNA, 21 nt, Human
auggagugcuguuuuguuaua

SEQ ID NO: 1294834 - RNA, 17 nt, Human
auggaguggcagcccag

SEQ ID NO: 1294835 - RNA, 18 nt, Human
auggaguggcagcccagc

SEQ ID NO: 1294836 - RNA, 20 nt, Human
auggaguggcagcccagcca

SEQ ID NO: 1294837 - RNA, 22 nt, Human
auggaguggcagcccagccagc

SEQ ID NO: 1294838 - RNA, 16 nt, Human
auggaguguacaagua

SEQ ID NO: 1294839 - RNA, 13 nt, Human
auggaguuucuaa

SEQ ID NO: 1294840 - RNA, 14 nt, Human
auggaguuucuaag

SEQ ID NO: 1294841 - RNA, 16 nt, Human
auggaguuucuaaggu

SEQ ID NO: 1294842 - RNA, 15 nt, Human
auggaguuucuaagg

SEQ ID NO: 1294843 - RNA, 19 nt, Human
augcucuuauuucaucauu

SEQ ID NO: 1294844 - RNA, 17 nt, Human
augcucuuauuucauca

SEQ ID NO: 1294845 - RNA, 15 nt, Human
augcucuuauuucau

SEQ ID NO: 1294846 - RNA, 16 nt, Human
augcucuuaauugcca

SEQ ID NO: 1294847 - RNA, 19 nt, Human
augcucuuaauugccaccu

SEQ ID NO: 1294848 - RNA, 23 nt, Human
augcucuuaauugccaccucuaa

SEQ ID NO: 1294849 - RNA, 15 nt, Human
augcucuuaauugcc

SEQ ID NO: 1294850 - RNA, 17 nt, Human
augcuuugaaacagaaa

SEQ ID NO: 1294851 - RNA, 18 nt, Human
augcuuugaaacagaaaa

SEQ ID NO: 1294852 - RNA, 21 nt, Human
augcuuugaaauugaaccuuu

SEQ ID NO: 1294853 - RNA, 19 nt, Human
augcuuugaaauugaaccu

SEQ ID NO: 1294854 - RNA, 18 nt, Human
augcucuuauuucaucau

SEQ ID NO: 1294855 - RNA, 16 nt, Human
augcuuugaaacagaa

SEQ ID NO: 1294856 - RNA, 16 nt, Human
auggagagcccuggga

SEQ ID NO: 1294857 - RNA, 19 nt, Human
auggagauucaguuuucau

SEQ ID NO: 1294858 - RNA, 13 nt, Human
auggagagcccug

SEQ ID NO: 1294859 - RNA, 15 nt, Human
auggagagcccuggg

SEQ ID NO: 1294860 - RNA, 18 nt, Human
auggagagcccugggacc

SEQ ID NO: 1294861 - RNA, 20 nt, Human
auggagauucaguuuucauu

SEQ ID NO: 1294862 - RNA, 17 nt, Human
auggagauugaccugga

SEQ ID NO: 1294863 - RNA, 20 nt, Human
auggagauugaccuggaugg

SEQ ID NO: 1294864 - RNA, 17 nt, Human
auggagugcaccaaaga

SEQ ID NO: 1294865 - RNA, 24 nt, Human
augcauauuauuuuauguugcaua

SEQ ID NO: 1294866 - RNA, 12 nt, Human
augcauauuugu

SEQ ID NO: 1294867 - RNA, 17 nt, Human
augcauacacucucaaa

SEQ ID NO: 1294868 - RNA, 23 nt, Human
augcauauuuuuuuucuuuuuac

SEQ ID NO: 1294869 - RNA, 16 nt, Human
augcauauuuguuuau

SEQ ID NO: 1294870 - RNA, 14 nt, Human
augcaucagaaagg

SEQ ID NO: 1294871 - RNA, 15 nt, Human
augcaucagaaaggg

SEQ ID NO: 1294872 - RNA, 18 nt, Human
augcaucagaaagggagg

SEQ ID NO: 1294873 - RNA, 20 nt, Human
augcaucagaaagggagggc

SEQ ID NO: 1294874 - RNA, 23 nt, Human
augcauggagggcugcccuguac

SEQ ID NO: 1294875 - RNA, 16 nt, Human
augcauggugccccag

SEQ ID NO: 1294876 - RNA, 17 nt, Human
augcauggugccccagg

SEQ ID NO: 1294877 - RNA, 18 nt, Human
augcauggugccccagga

SEQ ID NO: 1294878 - RNA, 19 nt, Human
augcauggugccccaggac

SEQ ID NO: 1294879 - RNA, 20 nt, Human
augcauggugccccaggacc

SEQ ID NO: 1294880 - RNA, 14 nt, Human
augcauacaaguuu

SEQ ID NO: 1294881 - RNA, 14 nt, Human
augcauaaaugcau

SEQ ID NO: 1294882 - RNA, 17 nt, Human
augcauguccuguaaag

SEQ ID NO: 1294883 - RNA, 21 nt, Human
augcauggugccccaggacca

SEQ ID NO: 1294884 - RNA, 22 nt, Human
augcauggugccccaggaccag

SEQ ID NO: 1294885 - RNA, 13 nt, Human
augcaugguuuca

SEQ ID NO: 1294886 - RNA, 16 nt, Human
augcaugguuucagca

SEQ ID NO: 1294887 - RNA, 17 nt, Human
augcaugguuucagcac

SEQ ID NO: 1294888 - RNA, 18 nt, Human
augcaugguuucagcacu

SEQ ID NO: 1294889 - RNA, 19 nt, Human
augcaugguuucagcacua

SEQ ID NO: 1294890 - RNA, 20 nt, Human
augcaugguuucagcacuag

SEQ ID NO: 1294891 - RNA, 16 nt, Human
augcauguccuguaaa

SEQ ID NO: 1294892 - RNA, 20 nt, Human
agucuggauaacuuccacag

SEQ ID NO: 1294893 - RNA, 23 nt, Human
agucuggauaacuuccacagggu

SEQ ID NO: 1294894 - RNA, 21 nt, Human
agucuggauaacuuccacagg

SEQ ID NO: 1294895 - RNA, 15 nt, Human
agucuggugaagcuc

SEQ ID NO: 1294896 - RNA, 12 nt, Human
agucuguccuug

SEQ ID NO: 1294897 - RNA, 13 nt, Human
agucuguccuuga

SEQ ID NO: 1294898 - RNA, 21 nt, Human
agucugugagauucauucaug

SEQ ID NO: 1294899 - RNA, 18 nt, Human
agucugugagauucauuc

SEQ ID NO: 1294900 - RNA, 13 nt, Human
agugaauaaaugu

SEQ ID NO: 1294901 - RNA, 19 nt, Human
agucgauagagcuguauua

SEQ ID NO: 1294902 - RNA, 24 nt, Human
aguccuuaaaauguaagauuauag

SEQ ID NO: 1294903 - RNA, 14 nt, Human
aguccuuggccugc

SEQ ID NO: 1294904 - RNA, 16 nt, Human
aguccuuuuuuuccau

SEQ ID NO: 1294905 - RNA, 21 nt, Human
aguccuuuuuuuccaucuuua

SEQ ID NO: 1294906 - RNA, 22 nt, Human
aguccugugaaugccacugccu

SEQ ID NO: 1294907 - RNA, 19 nt, Human
agucauuugcugagcaugu

SEQ ID NO: 1294908 - RNA, 22 nt, Human
agucauuugcugagcauguacu

SEQ ID NO: 1294909 - RNA, 19 nt, Human
aguaucaugcccugugcaa

SEQ ID NO: 1294910 - RNA, 15 nt, Human
aguaucaugcccugu

SEQ ID NO: 1294911 - RNA, 20 nt, Human
aguaucaucagauagcaucu

SEQ ID NO: 1294912 - RNA, 15 nt, Human
agugauuaccaggga

SEQ ID NO: 1294913 - RNA, 23 nt, Human
agugcuaacaugaagaccuuuuu

SEQ ID NO: 1294914 - RNA, 13 nt, Human
agugcuaagguuc

SEQ ID NO: 1294915 - RNA, 14 nt, Human
agugcuaagguucu

SEQ ID NO: 1294916 - RNA, 15 nt, Human
agugcuaagguucua

SEQ ID NO: 1294917 - RNA, 22 nt, Human
agugcuaacaugaagaccuuuu

SEQ ID NO: 1294918 - RNA, 19 nt, Human
agugcuaacaugaagaccu

SEQ ID NO: 1294919 - RNA, 17 nt, Human
agugcuaacaugaagac

SEQ ID NO: 1294920 - RNA, 16 nt, Human
agugcuaacaugaaga

SEQ ID NO: 1294921 - RNA, 16 nt, Human
agugcuaagguucuaa

SEQ ID NO: 1294922 - RNA, 17 nt, Human
agugcuaagguucuaag

SEQ ID NO: 1294923 - RNA, 18 nt, Human
agugcuaagguucuaagg

SEQ ID NO: 1294924 - RNA, 21 nt, Human
agugcuaagguucuaaggccu

SEQ ID NO: 1294925 - RNA, 16 nt, Human
agugcuacagggucca

SEQ ID NO: 1294926 - RNA, 19 nt, Human
agugccuuccuguuuuuca

SEQ ID NO: 1294927 - RNA, 13 nt, Human
agugccuuucagg

SEQ ID NO: 1294928 - RNA, 17 nt, Human
agugccuuucaggaucu

SEQ ID NO: 1294929 - RNA, 19 nt, Human
agugccuuucaggaucuau

SEQ ID NO: 1294930 - RNA, 21 nt, Human
agugccuuucaggaucuauuu

SEQ ID NO: 1294931 - RNA, 15 nt, Human
agugcguccacgagc

SEQ ID NO: 1294932 - RNA, 16 nt, Human
agugcggguccggcag

SEQ ID NO: 1294933 - RNA, 19 nt, Human
agugcgguuuacucacugc

SEQ ID NO: 1294934 - RNA, 13 nt, Human
agugauuaccagg

SEQ ID NO: 1294935 - RNA, 16 nt, Human
agugaaugauucagug

SEQ ID NO: 1294936 - RNA, 17 nt, Human
agugaaugauucagugu

SEQ ID NO: 1294937 - RNA, 19 nt, Human
agugaaugauucaguguua

SEQ ID NO: 1294938 - RNA, 14 nt, Human
agugaauaaauguc

SEQ ID NO: 1294939 - RNA, 17 nt, Human
agugaauaaaugucuug

SEQ ID NO: 1294940 - RNA, 16 nt, Human
agugaauacugcuaca

SEQ ID NO: 1294941 - RNA, 20 nt, Human
agugaauacugcuacagcaa

SEQ ID NO: 1294942 - RNA, 13 nt, Human
agugaaugauuca

SEQ ID NO: 1294943 - RNA, 11 nt, Human
agugacagcua

SEQ ID NO: 1294944 - RNA, 15 nt, Human
agugaaugcugggac

SEQ ID NO: 1294945 - RNA, 14 nt, Human
agugaaugcuggga

SEQ ID NO: 1294946 - RNA, 22 nt, Human
aguauauugauccagaaagaaa

SEQ ID NO: 1294947 - RNA, 21 nt, Human
aguauauugauaaccuugaaa

SEQ ID NO: 1294948 - RNA, 20 nt, Human
aguacuggcugauggaguaa

SEQ ID NO: 1294949 - RNA, 15 nt, Human
aguaccugagggucu

SEQ ID NO: 1294950 - RNA, 16 nt, Human
aguaccugagggucug

SEQ ID NO: 1294951 - RNA, 19 nt, Human
aguaccugagggucuguag

SEQ ID NO: 1294952 - RNA, 21 nt, Human
aguaccugagggucuguaggu

SEQ ID NO: 1294953 - RNA, 22 nt, Human
aguaccugagggucuguagguu

SEQ ID NO: 1294954 - RNA, 13 nt, Human
aguaccugggcaa

SEQ ID NO: 1294955 - RNA, 19 nt, Human
aguaccugggcaagcuggc

SEQ ID NO: 1294956 - RNA, 18 nt, Human
aguaccugggcaagcugg

SEQ ID NO: 1294957 - RNA, 19 nt, Human
aguaccuuuuauaucccau

SEQ ID NO: 1294958 - RNA, 16 nt, Human
aguacgaaccuacagu

SEQ ID NO: 1294959 - RNA, 18 nt, Human
aguacgaaccuacaguuu

SEQ ID NO: 1294960 - RNA, 13 nt, Human
aguacuccacacu

SEQ ID NO: 1294961 - RNA, 14 nt, Human
aguacuccacacug

SEQ ID NO: 1294962 - RNA, 15 nt, Human
aguacuccacacugc

SEQ ID NO: 1294963 - RNA, 16 nt, Human
aguacuccacacugca

SEQ ID NO: 1294964 - RNA, 18 nt, Human
aguacuccacacugcaca

SEQ ID NO: 1294965 - RNA, 19 nt, Human
aguacuccacacugcacaa

SEQ ID NO: 1294966 - RNA, 20 nt, Human
aguacuccacacugcacaau

SEQ ID NO: 1294967 - RNA, 19 nt, Human
aguaacuacaguuagggcu

SEQ ID NO: 1294968 - RNA, 17 nt, Human
aguaacuacaguuaggg

SEQ ID NO: 1294969 - RNA, 19 nt, Human
aguaacgcgucuuccugag

SEQ ID NO: 1294970 - RNA, 22 nt, Human
aguaacgcgucuuccugagugg

SEQ ID NO: 1294971 - RNA, 16 nt, Human
aguaacgcgucuuccu

SEQ ID NO: 1294972 - RNA, 17 nt, Human
aguaacgcgucuuccug

SEQ ID NO: 1294973 - RNA, 18 nt, Human
aguaacgcgucuuccuga

SEQ ID NO: 1294974 - RNA, 14 nt, Human
aguaacucaucugu

SEQ ID NO: 1294975 - RNA, 17 nt, Human
aguaacucauugcucug

SEQ ID NO: 1294976 - RNA, 11 nt, Human
aguaacuguuu

SEQ ID NO: 1294977 - RNA, 23 nt, Human
aguaacuguuuuuuaagucucuc

SEQ ID NO: 1294978 - RNA, 17 nt, Human
aguaacuucuuauggaa

SEQ ID NO: 1294979 - RNA, 19 nt, Human
aguaacuucuuauggaauu

SEQ ID NO: 1294980 - RNA, 17 nt, Human
aguaacuguuuuuuaag

SEQ ID NO: 1294981 - RNA, 13 nt, Human
aguaccugagggu

SEQ ID NO: 1294982 - RNA, 15 nt, Human
aguaaauacaauuuu

SEQ ID NO: 1294983 - RNA, 22 nt, Human
aguaaagaacguggucagagua

SEQ ID NO: 1294984 - RNA, 16 nt, Human
aguaaagaauuauuuu

SEQ ID NO: 1294985 - RNA, 15 nt, Human
aguaaagaauuauuu

SEQ ID NO: 1294986 - RNA, 16 nt, Human
aguaaagguuaaaaau

SEQ ID NO: 1294987 - RNA, 16 nt, Human
aguaaagucaaggaga

SEQ ID NO: 1294988 - RNA, 18 nt, Human
aguaaagucaaggagaaa

SEQ ID NO: 1294989 - RNA, 14 nt, Human
aguaaauaaugcuu

SEQ ID NO: 1294990 - RNA, 23 nt, Human
aguaaacaauaaaaguguccauu

SEQ ID NO: 1294991 - RNA, 15 nt, Human
aguaaaccacugaaa

SEQ ID NO: 1294992 - RNA, 17 nt, Human
aguaaaccacugaaaaa

SEQ ID NO: 1294993 - RNA, 23 nt, Human
aguaaaccacugaaaaaauauau

SEQ ID NO: 1294994 - RNA, 14 nt, Human
aguaaacuuuuugu

SEQ ID NO: 1294995 - RNA, 17 nt, Human
aggggccagaggcucgu

SEQ ID NO: 1294996 - RNA, 12 nt, Human
aggggccagagg

SEQ ID NO: 1294997 - RNA, 13 nt, Human
aggggccagaggc

SEQ ID NO: 1294998 - RNA, 14 nt, Human
aggggccagaggcu

SEQ ID NO: 1294999 - RNA, 15 nt, Human
aggggccagaggcuc

SEQ ID NO: 1295000 - RNA, 13 nt, Human
auaaaaagaauga

SEQ ID NO: 1295001 - RNA, 14 nt, Human
auaaaaagaucacu

SEQ ID NO: 1295002 - RNA, 14 nt, Human
auaaaaagaaaggc

SEQ ID NO: 1295003 - RNA, 13 nt, Human
auaaaaaaugguu

SEQ ID NO: 1295004 - RNA, 17 nt, Human
auaaaaaagaucccaaa

SEQ ID NO: 1295005 - RNA, 11 nt, Human
auaaaaaagau

SEQ ID NO: 1295006 - RNA, 15 nt, Human
auaaaaaagauccca

SEQ ID NO: 1295007 - RNA, 16 nt, Human
auaaaaaagaucccaa

SEQ ID NO: 1295008 - RNA, 16 nt, Human
auaaaagacagugaaa

SEQ ID NO: 1295009 - RNA, 22 nt, Human
auaaaaagaucacuuucucagu

SEQ ID NO: 1295010 - RNA, 18 nt, Human
auaaaaagaucacuuucu

SEQ ID NO: 1295011 - RNA, 17 nt, Human
auaaaaaugaucuaaac

SEQ ID NO: 1295012 - RNA, 12 nt, Human
auaaaaauguuu

SEQ ID NO: 1295013 - RNA, 16 nt, Human
auaaaaaugaucuaaa

SEQ ID NO: 1295014 - RNA, 12 nt, Human
auaaaacaggua

SEQ ID NO: 1295015 - RNA, 16 nt, Human
aguuugaugaggcccu

SEQ ID NO: 1295016 - RNA, 17 nt, Human
aguuugaugaggcccuc

SEQ ID NO: 1295017 - RNA, 18 nt, Human
aguuugaugaggcccucc

SEQ ID NO: 1295018 - RNA, 17 nt, Human
aguuucugggaccucag

SEQ ID NO: 1295019 - RNA, 20 nt, Human
aguuucugucguuaaaaaca

SEQ ID NO: 1295020 - RNA, 22 nt, Human
aguuucugucguuaaaaacaga

SEQ ID NO: 1295021 - RNA, 23 nt, Human
aguuucugucguuaaaaacagau

SEQ ID NO: 1295022 - RNA, 20 nt, Human
aguuaacuauugcauuuaua

SEQ ID NO: 1295023 - RNA, 24 nt, Human
aguuaacuauugcauuuauaugua

SEQ ID NO: 1295024 - RNA, 14 nt, Human
aguuaauuuaaagu

SEQ ID NO: 1295025 - RNA, 15 nt, Human
aguuaauuuuuccaa

SEQ ID NO: 1295026 - RNA, 17 nt, Human
aguuaauuuuuccaacu

SEQ ID NO: 1295027 - RNA, 23 nt, Human
aguuaauuuuuccaacuacuaau

SEQ ID NO: 1295028 - RNA, 19 nt, Human
aguuaacuauugcauuuau

SEQ ID NO: 1295029 - RNA, 17 nt, Human
aguuaacuauugcauuu

SEQ ID NO: 1295030 - RNA, 15 nt, Human
aguuaacuauugcau

SEQ ID NO: 1295031 - RNA, 20 nt, Human
aguuaacaccuuuaaagugu

SEQ ID NO: 1295032 - RNA, 19 nt, Human
aguuaacagacaacacguu

SEQ ID NO: 1295033 - RNA, 18 nt, Human
aguguuuuaugagaaagc

SEQ ID NO: 1295034 - RNA, 21 nt, Human
aguguuuuaugagaaagccuu

SEQ ID NO: 1295035 - RNA, 14 nt, Human
aguguuuucucuga

SEQ ID NO: 1295036 - RNA, 13 nt, Human
aguguuuucuggg

SEQ ID NO: 1295037 - RNA, 15 nt, Human
aguguuuucugggau

SEQ ID NO: 1295038 - RNA, 15 nt, Human
aguguuuucucugaa

SEQ ID NO: 1295039 - RNA, 12 nt, Human
aguuaaauguag

SEQ ID NO: 1295040 - RNA, 12 nt, Human
aguuaacacacu

SEQ ID NO: 1295041 - RNA, 13 nt, Human
aguuaacacacua

SEQ ID NO: 1295042 - RNA, 16 nt, Human
aguuaacacacuaccg

SEQ ID NO: 1295043 - RNA, 22 nt, Human
aguuaacacacuaccgaaugug

SEQ ID NO: 1295044 - RNA, 11 nt, Human
aguguuucuuu

SEQ ID NO: 1295045 - RNA, 21 nt, Human
aguggccaagagaugcagugc

SEQ ID NO: 1295046 - RNA, 18 nt, Human
aguggccaagaagcagug

SEQ ID NO: 1295047 - RNA, 19 nt, Human
aguggcccauggcauuuua

SEQ ID NO: 1295048 - RNA, 19 nt, Human
aguggcaucaucucagcuc

SEQ ID NO: 1295049 - RNA, 20 nt, Human
aguggcaucaucucagcuca

SEQ ID NO: 1295050 - RNA, 14 nt, Human
agugcucccucaca

SEQ ID NO: 1295051 - RNA, 17 nt, Human
agugcucccucacaugu

SEQ ID NO: 1295052 - RNA, 17 nt, Human
agugcucauuucaggau

SEQ ID NO: 1295053 - RNA, 11 nt, Human
agugcucccuc

SEQ ID NO: 1295054 - RNA, 16 nt, Human
agugcucaaggccagc

SEQ ID NO: 1295055 - RNA, 14 nt, Human
agugcucaaggcca

SEQ ID NO: 1295056 - RNA, 18 nt, Human
aguuacacaugaucauaa

SEQ ID NO: 1295057 - RNA, 18 nt, Human
aguucauauguaccaugu

SEQ ID NO: 1295058 - RNA, 22 nt, Human
aguucauauguaccauguacau

SEQ ID NO: 1295059 - RNA, 17 nt, Human
aguucauccauucuauu

SEQ ID NO: 1295060 - RNA, 18 nt, Human
aguuccagaagugugacu

SEQ ID NO: 1295061 - RNA, 14 nt, Human
aguuccagaagugu

SEQ ID NO: 1295062 - RNA, 21 nt, Human
aguucuuugggccagacaugc

SEQ ID NO: 1295063 - RNA, 19 nt, Human
aguucuuuguucauagccc

SEQ ID NO: 1295064 - RNA, 20 nt, Human
aguuccaagagucuaaagau

SEQ ID NO: 1295065 - RNA, 13 nt, Human
aguuccacugaga

SEQ ID NO: 1295066 - RNA, 15 nt, Human
aguuccacugagacc

SEQ ID NO: 1295067 - RNA, 20 nt, Human
aguuccacuuauagccucug

SEQ ID NO: 1295068 - RNA, 15 nt, Human
aguuccagaaaguaa

SEQ ID NO: 1295069 - RNA, 16 nt, Human
aguuccagaaaguaaa

SEQ ID NO: 1295070 - RNA, 21 nt, Human
aguucuuuguucauagcccag

SEQ ID NO: 1295071 - RNA, 22 nt, Human
aguucuuuguucauagcccagu

SEQ ID NO: 1295072 - RNA, 14 nt, Human
aguugaagcaaauc

SEQ ID NO: 1295073 - RNA, 19 nt, Human
aguucuuuuugaaguauuu

SEQ ID NO: 1295074 - RNA, 12 nt, Human
aguugaauauug

SEQ ID NO: 1295075 - RNA, 19 nt, Human
aguuguuccuuaagucaga

SEQ ID NO: 1295076 - RNA, 21 nt, Human
aguuguucgggccaaggaccu

SEQ ID NO: 1295077 - RNA, 20 nt, Human
aguuguuagauuaagaaaua

SEQ ID NO: 1295078 - RNA, 18 nt, Human
auaagcuuaugcuuaaau

SEQ ID NO: 1295079 - RNA, 19 nt, Human
auaagguuuuaauuuagua

SEQ ID NO: 1295080 - RNA, 13 nt, Human
auaagcuauuuga

SEQ ID NO: 1295081 - RNA, 15 nt, Human
auaagcuauuugaug

SEQ ID NO: 1295082 - RNA, 16 nt, Human
auaagcuauuugaugu

SEQ ID NO: 1295083 - RNA, 18 nt, Human
auaagcuauuugauguaa

SEQ ID NO: 1295084 - RNA, 22 nt, Human
auaagcuauuugauguaauacu

SEQ ID NO: 1295085 - RNA, 23 nt, Human
auaagcuauuugauguaauacuu

SEQ ID NO: 1295086 - RNA, 16 nt, Human
auaagcuauuuuucua

SEQ ID NO: 1295087 - RNA, 18 nt, Human
auaagcuauuuuucuaac

SEQ ID NO: 1295088 - RNA, 15 nt, Human
auaaguggugugugu

SEQ ID NO: 1295089 - RNA, 18 nt, Human
auaauguguaguucaugu

SEQ ID NO: 1295090 - RNA, 19 nt, Human
auaauguguaguucaugua

SEQ ID NO: 1295091 - RNA, 23 nt, Human
auaauguguaguucauguaaaua

SEQ ID NO: 1295092 - RNA, 20 nt, Human
auaauguguaguucauguaa

SEQ ID NO: 1295093 - RNA, 22 nt, Human
auaaguggacaaauuuugaguu

SEQ ID NO: 1295094 - RNA, 13 nt, Human
auaaguaaguuug

SEQ ID NO: 1295095 - RNA, 12 nt, Human
auaagugcccuc

SEQ ID NO: 1295096 - RNA, 24 nt, Human
auaaagacguuuuauaagcaucau

SEQ ID NO: 1295097 - RNA, 16 nt, Human
auaaagauauuguuca

SEQ ID NO: 1295098 - RNA, 20 nt, Human
auaaaacaucuuugaaauua

SEQ ID NO: 1295099 - RNA, 20 nt, Human
auaaaagaugaaagagcagu

SEQ ID NO: 1295100 - RNA, 14 nt, Human
auaaagaccacuuu

SEQ ID NO: 1295101 - RNA, 16 nt, Human
auaaagacguuuuaua

SEQ ID NO: 1295102 - RNA, 20 nt, Human
auaaagacguuuuauaagca

SEQ ID NO: 1295103 - RNA, 21 nt, Human
auaaagacguuuuauaagcau

SEQ ID NO: 1295104 - RNA, 22 nt, Human
auaaagacguuuuauaagcauc

SEQ ID NO: 1295105 - RNA, 14 nt, Human
auacaccgggccug

SEQ ID NO: 1295106 - RNA, 18 nt, Human
auacaccgggccuggaga

SEQ ID NO: 1295107 - RNA, 24 nt, Human
auacacccaagaugggcaucuuuu

SEQ ID NO: 1295108 - RNA, 17 nt, Human
auacacuguguaaauac

SEQ ID NO: 1295109 - RNA, 18 nt, Human
auacacuguguaaauacc

SEQ ID NO: 1295110 - RNA, 11 nt, Human
auacacugugu

SEQ ID NO: 1295111 - RNA, 11 nt, Human
auacuguugca

SEQ ID NO: 1295112 - RNA, 12 nt, Human
auacuguugcac

SEQ ID NO: 1295113 - RNA, 13 nt, Human
auacuguugcacg

SEQ ID NO: 1295114 - RNA, 14 nt, Human
auacuguugcacgu

SEQ ID NO: 1295115 - RNA, 15 nt, Human
auacuguugcacgug

SEQ ID NO: 1295116 - RNA, 18 nt, Human
auacuguugcacgugugu

SEQ ID NO: 1295117 - RNA, 19 nt, Human
auacuguugcacguguguu

SEQ ID NO: 1295118 - RNA, 21 nt, Human
auacuugaacguuuucuaauu

SEQ ID NO: 1295119 - RNA, 16 nt, Human
auacuugaagggccag

SEQ ID NO: 1295120 - RNA, 17 nt, Human
auacuugaagggccaga

SEQ ID NO: 1295121 - RNA, 18 nt, Human
auacuugaagggccagag

SEQ ID NO: 1295122 - RNA, 19 nt, Human
auacuugaagggccagagc

SEQ ID NO: 1295123 - RNA, 20 nt, Human
auacuugaagggccagagcc

SEQ ID NO: 1295124 - RNA, 21 nt, Human
auacuugaagggccagagcca

SEQ ID NO: 1295125 - RNA, 22 nt, Human
auacuugaagggccagagccag

SEQ ID NO: 1295126 - RNA, 19 nt, Human
auacuugaacguuuucuaa

SEQ ID NO: 1295127 - RNA, 20 nt, Human
auacuuuuacaaguaacaaa

SEQ ID NO: 1295128 - RNA, 21 nt, Human
auacuuuuacaaguaacaaaa

SEQ ID NO: 1295129 - RNA, 15 nt, Human
auacuuuuacucugc

SEQ ID NO: 1295130 - RNA, 16 nt, Human
auacuuuuacucugcc

SEQ ID NO: 1295131 - RNA, 20 nt, Human
auacuuuuacucugccuaca

SEQ ID NO: 1295132 - RNA, 16 nt, Human
auacuuuugcccuuug

SEQ ID NO: 1295133 - RNA, 19 nt, Human
auacuuuuuaaauguaaag

SEQ ID NO: 1295134 - RNA, 13 nt, Human
auacuuuuuacaa

SEQ ID NO: 1295135 - RNA, 20 nt, Human
auacuuuuuacaauuaaaaa

SEQ ID NO: 1295136 - RNA, 17 nt, Human
auacuuuuacucugccu

SEQ ID NO: 1295137 - RNA, 21 nt, Human
auacuuuuuuuucuuuaaaaa

SEQ ID NO: 1295138 - RNA, 12 nt, Human
acccucaugcug

SEQ ID NO: 1295139 - RNA, 16 nt, Human
acccucaucuuucuuc

SEQ ID NO: 1295140 - RNA, 19 nt, Human
acccucaucuuucuuccaa

SEQ ID NO: 1295141 - RNA, 13 nt, Human
acccucaucuuuc

SEQ ID NO: 1295142 - RNA, 14 nt, Human
acccucaucuuucu

SEQ ID NO: 1295143 - RNA, 13 nt, Human
acccucaugcugu

SEQ ID NO: 1295144 - RNA, 18 nt, Human
acccucauacacagaaac

SEQ ID NO: 1295145 - RNA, 12 nt, Human
acccuggaggca

SEQ ID NO: 1295146 - RNA, 17 nt, Human
acccuggaggcaccugg

SEQ ID NO: 1295147 - RNA, 20 nt, Human
acccuggaggcaccuggugg

SEQ ID NO: 1295148 - RNA, 21 nt, Human
acccuggaggccccaacccug

SEQ ID NO: 1295149 - RNA, 18 nt, Human
acccuggcacccagggug

SEQ ID NO: 1295150 - RNA, 14 nt, Human
acccuggccccucu

SEQ ID NO: 1295151 - RNA, 15 nt, Human
acccuggccccucuc

SEQ ID NO: 1295152 - RNA, 18 nt, Human
acccucagagccaccccu

SEQ ID NO: 1295153 - RNA, 18 nt, Human
acccucagggcaaagcca

SEQ ID NO: 1295154 - RNA, 19 nt, Human
acccucagggcaaagccag

SEQ ID NO: 1295155 - RNA, 21 nt, Human
acccucagggcaaagccaggu

SEQ ID NO: 1295156 - RNA, 18 nt, Human
acccugggcccugggcug

SEQ ID NO: 1295157 - RNA, 20 nt, Human
acccugggcccugggcugga

SEQ ID NO: 1295158 - RNA, 22 nt, Human
acccugggcccugggcuggaau

SEQ ID NO: 1295159 - RNA, 15 nt, Human
acccuggcuccuugu

SEQ ID NO: 1295160 - RNA, 16 nt, Human
acccuggccccucucc

SEQ ID NO: 1295161 - RNA, 17 nt, Human
acccuggccccucuccc

SEQ ID NO: 1295162 - RNA, 18 nt, Human
acccuggccccucucccu

SEQ ID NO: 1295163 - RNA, 19 nt, Human
acccuggccccucucccuu

SEQ ID NO: 1295164 - RNA, 18 nt, Human
acccuggccgaguccaag

SEQ ID NO: 1295165 - RNA, 21 nt, Human
acccuggccgaguccaagcug

SEQ ID NO: 1295166 - RNA, 22 nt, Human
acccuggccgaguccaagcugg

SEQ ID NO: 1295167 - RNA, 16 nt, Human
acccuggccgcccccu

SEQ ID NO: 1295168 - RNA, 17 nt, Human
acccuggccgcccccug

SEQ ID NO: 1295169 - RNA, 19 nt, Human
acccuggccgcccccugcc

SEQ ID NO: 1295170 - RNA, 22 nt, Human
acccuggccgcccccugccccc

SEQ ID NO: 1295171 - RNA, 23 nt, Human
acccuggccuagaccagcagaca

SEQ ID NO: 1295172 - RNA, 14 nt, Human
acccugggcccugg

SEQ ID NO: 1295173 - RNA, 15 nt, Human
acccugggcccuggg

SEQ ID NO: 1295174 - RNA, 17 nt, Human
acccugggcccugggcu

SEQ ID NO: 1295175 - RNA, 21 nt, Human
acccugucugccccgcccuca

SEQ ID NO: 1295176 - RNA, 13 nt, Human
acccugucugccc

SEQ ID NO: 1295177 - RNA, 21 nt, Human
acccugucucuacuaaaaaua

SEQ ID NO: 1295178 - RNA, 11 nt, Human
acccuguccuc

SEQ ID NO: 1295179 - RNA, 15 nt, Human
acccuggugggccaa

SEQ ID NO: 1295180 - RNA, 20 nt, Human
acccuguacuguucuguguc

SEQ ID NO: 1295181 - RNA, 22 nt, Human
acccuguacuguucugugucuu

SEQ ID NO: 1295182 - RNA, 13 nt, Human
acccuagcaaaag

SEQ ID NO: 1295183 - RNA, 18 nt, Human
acccuacuucuuuugcuc

SEQ ID NO: 1295184 - RNA, 14 nt, Human
acccuacuucuuuu

SEQ ID NO: 1295185 - RNA, 12 nt, Human
acccuagccuug

SEQ ID NO: 1295186 - RNA, 15 nt, Human
acccuagccuugcuu

SEQ ID NO: 1295187 - RNA, 17 nt, Human
acccuaaccaaguuccu

SEQ ID NO: 1295188 - RNA, 16 nt, Human
acccuaaccaaguucc

SEQ ID NO: 1295189 - RNA, 13 nt, Human
acccuaccugugc

SEQ ID NO: 1295190 - RNA, 16 nt, Human
acccuaccugugccug

SEQ ID NO: 1295191 - RNA, 17 nt, Human
acccuaccugugccuga

SEQ ID NO: 1295192 - RNA, 15 nt, Human
acccuaaccaaguuc

SEQ ID NO: 1295193 - RNA, 14 nt, Human
acccuaaccaaguu

SEQ ID NO: 1295194 - RNA, 13 nt, Human
acccuaaccaagu

SEQ ID NO: 1295195 - RNA, 16 nt, Human
acccuaaaucuugacu

SEQ ID NO: 1295196 - RNA, 20 nt, Human
acccuaaauaauaaaaauaa

SEQ ID NO: 1295197 - RNA, 16 nt, Human
acccuaaauaauaaaa

SEQ ID NO: 1295198 - RNA, 15 nt, Human
acccguggaggcugc

SEQ ID NO: 1295199 - RNA, 17 nt, Human
acccguggaggcugcuc

SEQ ID NO: 1295200 - RNA, 13 nt, Human
acccguucaacuu

SEQ ID NO: 1295201 - RNA, 21 nt, Human
acccguucaacuuuuccuuug

SEQ ID NO: 1295202 - RNA, 16 nt, Human
acccguucacauuuuu

SEQ ID NO: 1295203 - RNA, 16 nt, Human
acccguucauggggga

SEQ ID NO: 1295204 - RNA, 17 nt, Human
acccguucaugggggag

SEQ ID NO: 1295205 - RNA, 23 nt, Human
acccguucaugggggagggggca

SEQ ID NO: 1295206 - RNA, 18 nt, Human
acccguucaugggggagg

SEQ ID NO: 1295207 - RNA, 15 nt, Human
acccucacacuggga

SEQ ID NO: 1295208 - RNA, 15 nt, Human
acccucacuggcucu

SEQ ID NO: 1295209 - RNA, 19 nt, Human
acccucacuggcucuccug

SEQ ID NO: 1295210 - RNA, 11 nt, Human
acccucagagc

SEQ ID NO: 1295211 - RNA, 22 nt, Human
acccucacuggcucuccuggcc

SEQ ID NO: 1295212 - RNA, 21 nt, Human
acccucacuggcucuccuggc

SEQ ID NO: 1295213 - RNA, 14 nt, Human
acccuaugggucua

SEQ ID NO: 1295214 - RNA, 16 nt, Human
acccuaugggucuagg

SEQ ID NO: 1295215 - RNA, 19 nt, Human
acccuaugggucuaggaca

SEQ ID NO: 1295216 - RNA, 23 nt, Human
acccuaugggucuaggacacagu

SEQ ID NO: 1295217 - RNA, 17 nt, Human
acccuagccuugcuugu

SEQ ID NO: 1295218 - RNA, 15 nt, Human
acccuaguucuaccu

SEQ ID NO: 1295219 - RNA, 21 nt, Human
acccuaguucuaccucaggca

SEQ ID NO: 1295220 - RNA, 23 nt, Human
acccuauauuuugcauaguacca

SEQ ID NO: 1295221 - RNA, 18 nt, Human
acccgugccaaguccagg

SEQ ID NO: 1295222 - RNA, 21 nt, Human
acccgugccaaguccaggucc

SEQ ID NO: 1295223 - RNA, 22 nt, Human
acccgugccaaguccagguccu

SEQ ID NO: 1295224 - RNA, 23 nt, Human
acccgugccaaguccagguccug

SEQ ID NO: 1295225 - RNA, 13 nt, Human
acccguggaggcu

SEQ ID NO: 1295226 - RNA, 16 nt, Human
accucaggcagcucaa

SEQ ID NO: 1295227 - RNA, 17 nt, Human
accucaggcagcucaag

SEQ ID NO: 1295228 - RNA, 15 nt, Human
accucaguaauuuag

SEQ ID NO: 1295229 - RNA, 17 nt, Human
accucaguaauuuagaa

SEQ ID NO: 1295230 - RNA, 21 nt, Human
accucaguaauuuagaaauca

SEQ ID NO: 1295231 - RNA, 23 nt, Human
accucagugccuuccuguuuuuc

SEQ ID NO: 1295232 - RNA, 11 nt, Human
accucagccug

SEQ ID NO: 1295233 - RNA, 16 nt, Human
accguggcccuuccug

SEQ ID NO: 1295234 - RNA, 13 nt, Human
accucagccuggc

SEQ ID NO: 1295235 - RNA, 14 nt, Human
accucagccuggcc

SEQ ID NO: 1295236 - RNA, 15 nt, Human
accucagccuggcca

SEQ ID NO: 1295237 - RNA, 16 nt, Human
accucagccuggccag

SEQ ID NO: 1295238 - RNA, 17 nt, Human
accucagccuggccaga

SEQ ID NO: 1295239 - RNA, 19 nt, Human
accucagccuggccagaca

SEQ ID NO: 1295240 - RNA, 20 nt, Human
accucagccuggccagacac

SEQ ID NO: 1295241 - RNA, 21 nt, Human
accucagccuggccagacaca

SEQ ID NO: 1295242 - RNA, 12 nt, Human
accucagccugg

SEQ ID NO: 1295243 - RNA, 13 nt, Human
accucagccuggg

SEQ ID NO: 1295244 - RNA, 14 nt, Human
accucagccugggc

SEQ ID NO: 1295245 - RNA, 15 nt, Human
accucagccugggcg

SEQ ID NO: 1295246 - RNA, 17 nt, Human
accucagccugggcgcu

SEQ ID NO: 1295247 - RNA, 12 nt, Human
accucaggcagc

SEQ ID NO: 1295248 - RNA, 15 nt, Human
accucaggcagcuca

SEQ ID NO: 1295249 - RNA, 13 nt, Human
accggggccuggg

SEQ ID NO: 1295250 - RNA, 23 nt, Human
accgggcugggagcucugcagag

SEQ ID NO: 1295251 - RNA, 21 nt, Human
accgggcugggagcucugcag

SEQ ID NO: 1295252 - RNA, 21 nt, Human
accgggccacuccuuccugcc

SEQ ID NO: 1295253 - RNA, 12 nt, Human
accgggccacuc

SEQ ID NO: 1295254 - RNA, 19 nt, Human
accgggccacuccuuccug

SEQ ID NO: 1295255 - RNA, 20 nt, Human
accgggccacuccuuccugc

SEQ ID NO: 1295256 - RNA, 17 nt, Human
accguggcccuuccugg

SEQ ID NO: 1295257 - RNA, 19 nt, Human
accggggccugggcaggag

SEQ ID NO: 1295258 - RNA, 19 nt, Human
accgugccuggccacgccc

SEQ ID NO: 1295259 - RNA, 21 nt, Human
accuccaaagcuucccacggc

SEQ ID NO: 1295260 - RNA, 19 nt, Human
accuccaaagcuucccacg

SEQ ID NO: 1295261 - RNA, 13 nt, Human
acgucuuaaauau

SEQ ID NO: 1295262 - RNA, 14 nt, Human
acgucuuaaauauu

SEQ ID NO: 1295263 - RNA, 12 nt, Human
acgucuucuaaa

SEQ ID NO: 1295264 - RNA, 13 nt, Human
acgugacacaaac

SEQ ID NO: 1295265 - RNA, 19 nt, Human
acgugacacaaacacacac

SEQ ID NO: 1295266 - RNA, 20 nt, Human
acgugacacaaacacacaca

SEQ ID NO: 1295267 - RNA, 23 nt, Human
acggacaaaaccccccagauauc

SEQ ID NO: 1295268 - RNA, 14 nt, Human
acgcuuaaauacag

SEQ ID NO: 1295269 - RNA, 12 nt, Human
acgcagcccugc

SEQ ID NO: 1295270 - RNA, 22 nt, Human
acgcagcccugcuuugggcugc

SEQ ID NO: 1295271 - RNA, 23 nt, Human
acgcagcccugcuuugggcugcc

SEQ ID NO: 1295272 - RNA, 22 nt, Human
acgcaccaccaugccaggcuaa

SEQ ID NO: 1295273 - RNA, 14 nt, Human
acgcaccugccuca

SEQ ID NO: 1295274 - RNA, 15 nt, Human
acgcaccugccucag

SEQ ID NO: 1295275 - RNA, 16 nt, Human
acgcaccugccucagg

SEQ ID NO: 1295276 - RNA, 18 nt, Human
acgauuuuuaaaauguac

SEQ ID NO: 1295277 - RNA, 16 nt, Human
acgcaaagagagauuu

SEQ ID NO: 1295278 - RNA, 17 nt, Human
acgcaaagagagauuuu

SEQ ID NO: 1295279 - RNA, 15 nt, Human
acgcaaguucccagu

SEQ ID NO: 1295280 - RNA, 18 nt, Human
acgugcucugugggucuc

SEQ ID NO: 1295281 - RNA, 23 nt, Human
acgugcucuuuguuuugugucuc

SEQ ID NO: 1295282 - RNA, 19 nt, Human
acgugcucuuuguuuugug

SEQ ID NO: 1295283 - RNA, 20 nt, Human
acuaauguguaagacaaaaa

SEQ ID NO: 1295284 - RNA, 21 nt, Human
acuaauggcaugagaaauaca

SEQ ID NO: 1295285 - RNA, 22 nt, Human
acuaauggcaugagaaauacaa

SEQ ID NO: 1295286 - RNA, 18 nt, Human
acuaauucauaaucacuc

SEQ ID NO: 1295287 - RNA, 13 nt, Human
acuaauuccacac

SEQ ID NO: 1295288 - RNA, 23 nt, Human
acuaaugccuuacucuucuugaa

SEQ ID NO: 1295289 - RNA, 24 nt, Human
acuaaugccuuacucuucuugaaa

SEQ ID NO: 1295290 - RNA, 12 nt, Human
acuaauggcaug

SEQ ID NO: 1295291 - RNA, 13 nt, Human
acuaauggcauga

SEQ ID NO: 1295292 - RNA, 16 nt, Human
acuaauggcaugagaa

SEQ ID NO: 1295293 - RNA, 23 nt, Human
accuguggaacauaaaaaggaca

SEQ ID NO: 1295294 - RNA, 10 nt, Human
accuguggau

SEQ ID NO: 1295295 - RNA, 20 nt, Human
accuguggaacauaaaaagg

SEQ ID NO: 1295296 - RNA, 23 nt, Human
accugugcuucgggcccuuccca

SEQ ID NO: 1295297 - RNA, 19 nt, Human
accugugcuucgggcccuu

SEQ ID NO: 1295298 - RNA, 22 nt, Human
accugugcuucgggcccuuccc

SEQ ID NO: 1295299 - RNA, 13 nt, Human
accuguggauauu

SEQ ID NO: 1295300 - RNA, 14 nt, Human
accuguggauauuu

SEQ ID NO: 1295301 - RNA, 22 nt, Human
accuugcugcaagcacagcccu

SEQ ID NO: 1295302 - RNA, 23 nt, Human
accuugcugcaagcacagcccuu

SEQ ID NO: 1295303 - RNA, 15 nt, Human
accuguaagugucuu

SEQ ID NO: 1295304 - RNA, 11 nt, Human
accuguaauca

SEQ ID NO: 1295305 - RNA, 19 nt, Human
accugugcacaccccacuc

SEQ ID NO: 1295306 - RNA, 22 nt, Human
accucuguauuugaaucagccu

SEQ ID NO: 1295307 - RNA, 22 nt, Human
accuuggcaccagacacccagg

SEQ ID NO: 1295308 - RNA, 19 nt, Human
accuugcuuugauggaaua

SEQ ID NO: 1295309 - RNA, 18 nt, Human
accuuggacauccuccuc

SEQ ID NO: 1295310 - RNA, 19 nt, Human
accuuggacauccuccucc

SEQ ID NO: 1295311 - RNA, 14 nt, Human
accuuggcaccaga

SEQ ID NO: 1295312 - RNA, 16 nt, Human
accuuggcaccagaca

SEQ ID NO: 1295313 - RNA, 17 nt, Human
accuuggcaccagacac

SEQ ID NO: 1295314 - RNA, 18 nt, Human
accuuggcaccagacacc

SEQ ID NO: 1295315 - RNA, 13 nt, Human
acugaauuaugaa

SEQ ID NO: 1295316 - RNA, 14 nt, Human
acugaauuaugaaa

SEQ ID NO: 1295317 - RNA, 15 nt, Human
acugaauuaugaaac

SEQ ID NO: 1295318 - RNA, 20 nt, Human
acugaauuaugaaacuuuug

SEQ ID NO: 1295319 - RNA, 12 nt, Human
acugaaugaggu

SEQ ID NO: 1295320 - RNA, 20 nt, Human
acugaaugaggucagcaugu

SEQ ID NO: 1295321 - RNA, 14 nt, Human
acugaaugucauug

SEQ ID NO: 1295322 - RNA, 17 nt, Human
acucuacccauauuaca

SEQ ID NO: 1295323 - RNA, 19 nt, Human
acucuacccauauuacaga

SEQ ID NO: 1295324 - RNA, 17 nt, Human
acugacaagcuccauuu

SEQ ID NO: 1295325 - RNA, 20 nt, Human
acugacaagcuccauuuaaa

SEQ ID NO: 1295326 - RNA, 18 nt, Human
acugacaagccaucuuga

SEQ ID NO: 1295327 - RNA, 13 nt, Human
acugacacacacg

SEQ ID NO: 1295328 - RNA, 14 nt, Human
acugacagaggggg

SEQ ID NO: 1295329 - RNA, 12 nt, Human
acugacaugugg

SEQ ID NO: 1295330 - RNA, 18 nt, Human
acugacauguggggccag

SEQ ID NO: 1295331 - RNA, 14 nt, Human
acugauuacugccu

SEQ ID NO: 1295332 - RNA, 17 nt, Human
acugaugucuccuaagc

SEQ ID NO: 1295333 - RNA, 14 nt, Human
acugaugucuccua

SEQ ID NO: 1295334 - RNA, 14 nt, Human
acugaucucguuuu

SEQ ID NO: 1295335 - RNA, 13 nt, Human
acugaugucuccu

SEQ ID NO: 1295336 - RNA, 19 nt, Human
acugauaugggucuugaua

SEQ ID NO: 1295337 - RNA, 22 nt, Human
acugacauguggggccagguca

SEQ ID NO: 1295338 - RNA, 15 nt, Human
acugaucacaaaaac

SEQ ID NO: 1295339 - RNA, 13 nt, Human
acugauguugugu

SEQ ID NO: 1295340 - RNA, 17 nt, Human
acugauguuguguuuuu

SEQ ID NO: 1295341 - RNA, 18 nt, Human
acugauguuguguuuuua

SEQ ID NO: 1295342 - RNA, 14 nt, Human
acucguuaauuugu

SEQ ID NO: 1295343 - RNA, 19 nt, Human
acucguuaauuuguagugu

SEQ ID NO: 1295344 - RNA, 15 nt, Human
acucuaaaauuauaa

SEQ ID NO: 1295345 - RNA, 21 nt, Human
acucuaaaauuauaaaugaca

SEQ ID NO: 1295346 - RNA, 14 nt, Human
acucguuuuuuaca

SEQ ID NO: 1295347 - RNA, 20 nt, Human
acuccgugcuuaaccaaaga

SEQ ID NO: 1295348 - RNA, 15 nt, Human
acuccguuggccacu

SEQ ID NO: 1295349 - RNA, 17 nt, Human
acuccguuggccacucc

SEQ ID NO: 1295350 - RNA, 19 nt, Human
acuccguaacagauuuugu

SEQ ID NO: 1295351 - RNA, 18 nt, Human
acuccguuggccacuccg

SEQ ID NO: 1295352 - RNA, 21 nt, Human
acuccguuggccacuccgaga

SEQ ID NO: 1295353 - RNA, 16 nt, Human
acucccaccugacaca

SEQ ID NO: 1295354 - RNA, 13 nt, Human
acucccauuccug

SEQ ID NO: 1295355 - RNA, 16 nt, Human
acucccauuccugaag

SEQ ID NO: 1295356 - RNA, 20 nt, Human
acucccauuccugaagaacc

SEQ ID NO: 1295357 - RNA, 15 nt, Human
acucccaagcuggac

SEQ ID NO: 1295358 - RNA, 14 nt, Human
acucccaccugaca

SEQ ID NO: 1295359 - RNA, 14 nt, Human
acuccauguuggcu

SEQ ID NO: 1295360 - RNA, 20 nt, Human
acuccauguuggcuagccuc

SEQ ID NO: 1295361 - RNA, 14 nt, Human
acucccuuucaaca

SEQ ID NO: 1295362 - RNA, 14 nt, Human
acucccuuucagug

SEQ ID NO: 1295363 - RNA, 22 nt, Human
acuccgagaggugggccagucu

SEQ ID NO: 1295364 - RNA, 23 nt, Human
acuccgagaggugggccagucug

SEQ ID NO: 1295365 - RNA, 18 nt, Human
acucccugccccccagcc

SEQ ID NO: 1295366 - RNA, 13 nt, Human
acucccucucagg

SEQ ID NO: 1295367 - RNA, 21 nt, Human
acucccucucaggauccaagc

SEQ ID NO: 1295368 - RNA, 22 nt, Human
acucccauuccugaagaaccag

SEQ ID NO: 1295369 - RNA, 16 nt, Human
acuccccaacccccaa

SEQ ID NO: 1295370 - RNA, 15 nt, Human
acuccccaaccccca

SEQ ID NO: 1295371 - RNA, 20 nt, Human
acuucuugcuucuuucuaga

SEQ ID NO: 1295372 - RNA, 15 nt, Human
acuucuuguguguau

SEQ ID NO: 1295373 - RNA, 19 nt, Human
acuucuuguguguaugcac

SEQ ID NO: 1295374 - RNA, 19 nt, Human
acuucuugcuggucuaguc

SEQ ID NO: 1295375 - RNA, 11 nt, Human
acuucuugcuu

SEQ ID NO: 1295376 - RNA, 18 nt, Human
acuucuugcuucuuucua

SEQ ID NO: 1295377 - RNA, 19 nt, Human
acuucuugcuucuuucuag

SEQ ID NO: 1295378 - RNA, 17 nt, Human
acuucagcgguuuauau

SEQ ID NO: 1295379 - RNA, 20 nt, Human
acuucuugaaggugcugacg

SEQ ID NO: 1295380 - RNA, 21 nt, Human
acuucagacauagaauuaaca

SEQ ID NO: 1295381 - RNA, 21 nt, Human
acuucaaacuacuuugcugcu

SEQ ID NO: 1295382 - RNA, 16 nt, Human
acuugaaaauuaacau

SEQ ID NO: 1295383 - RNA, 14 nt, Human
acuugaaaauuaac

SEQ ID NO: 1295384 - RNA, 12 nt, Human
acuugaaaauua

SEQ ID NO: 1295385 - RNA, 23 nt, Human
acuucuuuuuucaaaagaaaguc

SEQ ID NO: 1295386 - RNA, 22 nt, Human
acuucuuuuuucaaaagaaagu

SEQ ID NO: 1295387 - RNA, 21 nt, Human
acuucuuuuuucaaaagaaag

SEQ ID NO: 1295388 - RNA, 13 nt, Human
acuuggucuguga

SEQ ID NO: 1295389 - RNA, 19 nt, Human
acuuggggguucaggcccg

SEQ ID NO: 1295390 - RNA, 20 nt, Human
acuuggggguucaggcccgg

SEQ ID NO: 1295391 - RNA, 16 nt, Human
acuugguaauuguacu

SEQ ID NO: 1295392 - RNA, 13 nt, Human
acuuguaauuaug

SEQ ID NO: 1295393 - RNA, 15 nt, Human
acuuguaauuaugga

SEQ ID NO: 1295394 - RNA, 16 nt, Human
acuuguaauuauggag

SEQ ID NO: 1295395 - RNA, 18 nt, Human
acuuguaauuuuuuuaau

SEQ ID NO: 1295396 - RNA, 14 nt, Human
acuuguacaaaaua

SEQ ID NO: 1295397 - RNA, 18 nt, Human
acuuguacaaaauaaaca

SEQ ID NO: 1295398 - RNA, 20 nt, Human
acuuguacaaaauaaacaaa

SEQ ID NO: 1295399 - RNA, 17 nt, Human
acuucaaauccuugaag

SEQ ID NO: 1295400 - RNA, 20 nt, Human
acuuaaaauauuccugcauu

SEQ ID NO: 1295401 - RNA, 18 nt, Human
acuucaaacuacuuugcu

SEQ ID NO: 1295402 - RNA, 18 nt, Human
acuucaaauccuugaaga

SEQ ID NO: 1295403 - RNA, 19 nt, Human
acuucaaauccuugaagau

SEQ ID NO: 1295404 - RNA, 22 nt, Human
acuuaaaaaugguuuaaauggu

SEQ ID NO: 1295405 - RNA, 20 nt, Human
acuguuucacuacucagcau

SEQ ID NO: 1295406 - RNA, 19 nt, Human
acuguuuuucggacaguuu

SEQ ID NO: 1295407 - RNA, 18 nt, Human
acuguuuuucggacaguu

SEQ ID NO: 1295408 - RNA, 13 nt, Human
acuguuuuuuaag

SEQ ID NO: 1295409 - RNA, 15 nt, Human
acuguuuuuuaaguc

SEQ ID NO: 1295410 - RNA, 16 nt, Human
acuggagugugcgugg

SEQ ID NO: 1295411 - RNA, 17 nt, Human
acuggagugugcguggu

SEQ ID NO: 1295412 - RNA, 12 nt, Human
acugguggcccg

SEQ ID NO: 1295413 - RNA, 23 nt, Human
acuggugcaaguugaggacuucu

SEQ ID NO: 1295414 - RNA, 17 nt, Human
acuguaaaauaauaacu

SEQ ID NO: 1295415 - RNA, 15 nt, Human
acugccuauuuuaau

SEQ ID NO: 1295416 - RNA, 18 nt, Human
acugccgucagugcugug

SEQ ID NO: 1295417 - RNA, 13 nt, Human
acugccuagaaac

SEQ ID NO: 1295418 - RNA, 14 nt, Human
acugccuagaaaca

SEQ ID NO: 1295419 - RNA, 15 nt, Human
acugccuagaaacaa

SEQ ID NO: 1295420 - RNA, 16 nt, Human
acugccuagaaacaac

SEQ ID NO: 1295421 - RNA, 19 nt, Human
acugccuagaaacaacacu

SEQ ID NO: 1295422 - RNA, 20 nt, Human
acugccuagaaacaacacug

SEQ ID NO: 1295423 - RNA, 21 nt, Human
acugccuagaaacaacacugu

SEQ ID NO: 1295424 - RNA, 22 nt, Human
acugccuagaaacaacacugua

SEQ ID NO: 1295425 - RNA, 23 nt, Human
acugccuagaaacaacacuguag

SEQ ID NO: 1295426 - RNA, 16 nt, Human
acuggaaaacagaaca

SEQ ID NO: 1295427 - RNA, 17 nt, Human
acuggaaaacagaacac

SEQ ID NO: 1295428 - RNA, 18 nt, Human
acuggaaaacagaacacu

SEQ ID NO: 1295429 - RNA, 19 nt, Human
acuggaaaacagaacacuu

SEQ ID NO: 1295430 - RNA, 20 nt, Human
acuggaaaacagaacacuua

SEQ ID NO: 1295431 - RNA, 23 nt, Human
acuggaaaacagaacacuuaugu

SEQ ID NO: 1295432 - RNA, 23 nt, Human
acuggaaagcuuuucuauuuuaa

SEQ ID NO: 1295433 - RNA, 12 nt, Human
acuggaaagaag

SEQ ID NO: 1295434 - RNA, 12 nt, Human
acuggaacucuc

SEQ ID NO: 1295435 - RNA, 22 nt, Human
acuggaacacuagacaagccag

SEQ ID NO: 1295436 - RNA, 16 nt, Human
acuggaacacuagaca

SEQ ID NO: 1295437 - RNA, 19 nt, Human
acugcccaggccugccugu

SEQ ID NO: 1295438 - RNA, 16 nt, Human
acugcccauggacagg

SEQ ID NO: 1295439 - RNA, 11 nt, Human
acugcccuggu

SEQ ID NO: 1295440 - RNA, 17 nt, Human
acugcccaggcacugca

SEQ ID NO: 1295441 - RNA, 15 nt, Human
acugccguaauuuaa

SEQ ID NO: 1295442 - RNA, 16 nt, Human
acugccguaauuuaac

SEQ ID NO: 1295443 - RNA, 17 nt, Human
acugccguaauuuaacu

SEQ ID NO: 1295444 - RNA, 20 nt, Human
acugccgucagugcugugcu

SEQ ID NO: 1295445 - RNA, 16 nt, Human
acugucuuuuuucuaa

SEQ ID NO: 1295446 - RNA, 13 nt, Human
acuguaaagaugu

SEQ ID NO: 1295447 - RNA, 15 nt, Human
acuguaacauucagg

SEQ ID NO: 1295448 - RNA, 18 nt, Human
acuguaaauaaaaagaaa

SEQ ID NO: 1295449 - RNA, 16 nt, Human
acuguaaaauguggga

SEQ ID NO: 1295450 - RNA, 21 nt, Human
acuguaaaaugugggauuaug

SEQ ID NO: 1295451 - RNA, 22 nt, Human
acuguaaaaugugggauuaugg

SEQ ID NO: 1295452 - RNA, 13 nt, Human
acuguaaacacag

SEQ ID NO: 1295453 - RNA, 16 nt, Human
acuguaaacacagaca

SEQ ID NO: 1295454 - RNA, 14 nt, Human
acuguaaacacaga

SEQ ID NO: 1295455 - RNA, 20 nt, Human
acugguggcccgacagccug

SEQ ID NO: 1295456 - RNA, 23 nt, Human
acugucuuuuuucuaaaguaaaa

SEQ ID NO: 1295457 - RNA, 22 nt, Human
acugucuuuuuucuaaaguaaa

SEQ ID NO: 1295458 - RNA, 16 nt, Human
acuguaacugauuaca

SEQ ID NO: 1295459 - RNA, 19 nt, Human
acugugccucagagaccag

SEQ ID NO: 1295460 - RNA, 18 nt, Human
acugugccucagagacca

SEQ ID NO: 1295461 - RNA, 15 nt, Human
acugugccucagaga

SEQ ID NO: 1295462 - RNA, 16 nt, Human
acugugccauguguuu

SEQ ID NO: 1295463 - RNA, 23 nt, Human
acagugaucaaguuauuuuuaau

SEQ ID NO: 1295464 - RNA, 18 nt, Human
acagugauauuggaacuu

SEQ ID NO: 1295465 - RNA, 18 nt, Human
acaggcacugcccuggug

SEQ ID NO: 1295466 - RNA, 23 nt, Human
acaggcacugcccugguggcccu

SEQ ID NO: 1295467 - RNA, 13 nt, Human
acaggcacuuggc

SEQ ID NO: 1295468 - RNA, 16 nt, Human
acaggcacuuggcagc

SEQ ID NO: 1295469 - RNA, 20 nt, Human
acaggcacuuggcagccuug

SEQ ID NO: 1295470 - RNA, 15 nt, Human
acaggcacugcccug

SEQ ID NO: 1295471 - RNA, 16 nt, Human
acaggcacugcccugg

SEQ ID NO: 1295472 - RNA, 20 nt, Human
acagugauuaccagggacug

SEQ ID NO: 1295473 - RNA, 19 nt, Human
acagugauuaccagggacu

SEQ ID NO: 1295474 - RNA, 15 nt, Human
acagugcaucucagc

SEQ ID NO: 1295475 - RNA, 17 nt, Human
acagugcaucucagccc

SEQ ID NO: 1295476 - RNA, 18 nt, Human
acagugcaucucagccca

SEQ ID NO: 1295477 - RNA, 15 nt, Human
acagugcucuuuucu

SEQ ID NO: 1295478 - RNA, 16 nt, Human
acagugcucuuuucuc

SEQ ID NO: 1295479 - RNA, 17 nt, Human
acagugcucuuuucucc

SEQ ID NO: 1295480 - RNA, 21 nt, Human
acagugcucuuuucuccucac

SEQ ID NO: 1295481 - RNA, 20 nt, Human
acagugcugaccagacagcc

SEQ ID NO: 1295482 - RNA, 21 nt, Human
acagugcuuuuaagugaaaau

SEQ ID NO: 1295483 - RNA, 16 nt, Human
acaguggaacuacauu

SEQ ID NO: 1295484 - RNA, 18 nt, Human
acaguggaacuacauuag

SEQ ID NO: 1295485 - RNA, 15 nt, Human
acaguggaucacaaa

SEQ ID NO: 1295486 - RNA, 17 nt, Human
acaguggaucacaaagu

SEQ ID NO: 1295487 - RNA, 18 nt, Human
acaguggaucacaaagug

SEQ ID NO: 1295488 - RNA, 21 nt, Human
acaguggcucacgccuguaau

SEQ ID NO: 1295489 - RNA, 24 nt, Human
acaggaugguucccuugaugaaga

SEQ ID NO: 1295490 - RNA, 22 nt, Human
acaggauguguuugcuuucuga

SEQ ID NO: 1295491 - RNA, 16 nt, Human
acaggauguguuugcu

SEQ ID NO: 1295492 - RNA, 18 nt, Human
acaggauguguuugcuuu

SEQ ID NO: 1295493 - RNA, 19 nt, Human
acaggauguguuugcuuuc

SEQ ID NO: 1295494 - RNA, 20 nt, Human
acaggauguguuugcuuucu

SEQ ID NO: 1295495 - RNA, 21 nt, Human
acaggauguguuugcuuucug

SEQ ID NO: 1295496 - RNA, 15 nt, Human
acauuugcucaugga

SEQ ID NO: 1295497 - RNA, 16 nt, Human
acauuugcucauggaa

SEQ ID NO: 1295498 - RNA, 16 nt, Human
acauuuguauaaaaua

SEQ ID NO: 1295499 - RNA, 19 nt, Human
acauuuguauaaaauaauu

SEQ ID NO: 1295500 - RNA, 21 nt, Human
acauuuguauaaaauaauuuu

SEQ ID NO: 1295501 - RNA, 16 nt, Human
accaacccucagggca

SEQ ID NO: 1295502 - RNA, 21 nt, Human
accaacccucagggcaaagcc

SEQ ID NO: 1295503 - RNA, 18 nt, Human
accaccccgccugcccuc

SEQ ID NO: 1295504 - RNA, 14 nt, Human
accaagccguggcu

SEQ ID NO: 1295505 - RNA, 19 nt, Human
accaaccugaagacaccgu

SEQ ID NO: 1295506 - RNA, 15 nt, Human
accaagccguggcuu

SEQ ID NO: 1295507 - RNA, 16 nt, Human
accaagccguggcuuc

SEQ ID NO: 1295508 - RNA, 17 nt, Human
accaagccguggcuucc

SEQ ID NO: 1295509 - RNA, 18 nt, Human
accaagccguggcuuccc

SEQ ID NO: 1295510 - RNA, 12 nt, Human
accaccagcugu

SEQ ID NO: 1295511 - RNA, 13 nt, Human
accaccagcugug

SEQ ID NO: 1295512 - RNA, 15 nt, Human
accaccagcuguguc

SEQ ID NO: 1295513 - RNA, 17 nt, Human
accaccagcugugucca

SEQ ID NO: 1295514 - RNA, 17 nt, Human
accaccagggcaucucu

SEQ ID NO: 1295515 - RNA, 20 nt, Human
accaccagggcaucucuggg

SEQ ID NO: 1295516 - RNA, 21 nt, Human
accaccagggcaucucugggc

SEQ ID NO: 1295517 - RNA, 22 nt, Human
accaccagggcaucucugggcu

SEQ ID NO: 1295518 - RNA, 20 nt, Human
acaucccuuaccugggaaag

SEQ ID NO: 1295519 - RNA, 18 nt, Human
acaucccugggccugcug

SEQ ID NO: 1295520 - RNA, 19 nt, Human
acaucccugggccugcugc

SEQ ID NO: 1295521 - RNA, 20 nt, Human
acaucccugggccugcugcu

SEQ ID NO: 1295522 - RNA, 21 nt, Human
acaucccugggccugcugcug

SEQ ID NO: 1295523 - RNA, 18 nt, Human
acaugcacuuggcugcau

SEQ ID NO: 1295524 - RNA, 22 nt, Human
acaugcacuuggcugcauaaau

SEQ ID NO: 1295525 - RNA, 19 nt, Human
acauccaaagcagacagcu

SEQ ID NO: 1295526 - RNA, 21 nt, Human
acaucauuucuuuuugggaga

SEQ ID NO: 1295527 - RNA, 12 nt, Human
acaucccugggc

SEQ ID NO: 1295528 - RNA, 13 nt, Human
acaucccugggcc

SEQ ID NO: 1295529 - RNA, 14 nt, Human
acaucccugggccu

SEQ ID NO: 1295530 - RNA, 15 nt, Human
acaucccugggccug

SEQ ID NO: 1295531 - RNA, 16 nt, Human
acaucccugggccugc

SEQ ID NO: 1295532 - RNA, 17 nt, Human
acaucccugggccugcu

SEQ ID NO: 1295533 - RNA, 17 nt, Human
acaugcgguagccagca

SEQ ID NO: 1295534 - RNA, 18 nt, Human
acaugcgguagccagcac

SEQ ID NO: 1295535 - RNA, 22 nt, Human
acaugugccagggcaaugauga

SEQ ID NO: 1295536 - RNA, 18 nt, Human
acaugugcugcccuacag

SEQ ID NO: 1295537 - RNA, 16 nt, Human
acauguggggccaggu

SEQ ID NO: 1295538 - RNA, 18 nt, Human
acauguggggccagguca

SEQ ID NO: 1295539 - RNA, 20 nt, Human
acauaaguauuuaauucaug

SEQ ID NO: 1295540 - RNA, 19 nt, Human
acauaaguuuaggauaaaa

SEQ ID NO: 1295541 - RNA, 12 nt, Human
acauaacugaaa

SEQ ID NO: 1295542 - RNA, 20 nt, Human
acauaacugaaaaugugcua

SEQ ID NO: 1295543 - RNA, 16 nt, Human
acauaaccacugcuuc

SEQ ID NO: 1295544 - RNA, 23 nt, Human
acauaaucuucugccuucucaug

SEQ ID NO: 1295545 - RNA, 21 nt, Human
acauacaccuaugucauuuca

SEQ ID NO: 1295546 - RNA, 18 nt, Human
acauacagaauuacugua

SEQ ID NO: 1295547 - RNA, 19 nt, Human
acauacagaauuacuguaa

SEQ ID NO: 1295548 - RNA, 20 nt, Human
acauacagaauuacuguaac

SEQ ID NO: 1295549 - RNA, 15 nt, Human
acaucauucuugaga

SEQ ID NO: 1295550 - RNA, 11 nt, Human
acaucauuucu

SEQ ID NO: 1295551 - RNA, 12 nt, Human
acaucauuucuu

SEQ ID NO: 1295552 - RNA, 13 nt, Human
acaucauuucuuu

SEQ ID NO: 1295553 - RNA, 22 nt, Human
acaucauuucuuuuugggagag

SEQ ID NO: 1295554 - RNA, 21 nt, Human
acauccaaaauaguuaagaca

SEQ ID NO: 1295555 - RNA, 15 nt, Human
acauccaaagcagac

SEQ ID NO: 1295556 - RNA, 16 nt, Human
acauccaaagcagaca

SEQ ID NO: 1295557 - RNA, 17 nt, Human
acauccaaagcagacag

SEQ ID NO: 1295558 - RNA, 18 nt, Human
acauccaaagcagacagc

SEQ ID NO: 1295559 - RNA, 17 nt, Human
acauguguuggcagccu

SEQ ID NO: 1295560 - RNA, 20 nt, Human
acauguguuaaguauuuuca

SEQ ID NO: 1295561 - RNA, 21 nt, Human
acauguuugcaccuuucuagu

SEQ ID NO: 1295562 - RNA, 16 nt, Human
acauguuuuaaagaaa

SEQ ID NO: 1295563 - RNA, 22 nt, Human
acauguuugcaccuuucuaguu

SEQ ID NO: 1295564 - RNA, 14 nt, Human
aauuauauguugua

SEQ ID NO: 1295565 - RNA, 23 nt, Human
aauuauagcucuaauguuugcau

SEQ ID NO: 1295566 - RNA, 22 nt, Human
aauuauagugauguaaucuuga

SEQ ID NO: 1295567 - RNA, 13 nt, Human
aauuauaguuucu

SEQ ID NO: 1295568 - RNA, 14 nt, Human
aauuauaguuucug

SEQ ID NO: 1295569 - RNA, 15 nt, Human
aauuauaguuucuga

SEQ ID NO: 1295570 - RNA, 16 nt, Human
aauuauaguuucugag

SEQ ID NO: 1295571 - RNA, 17 nt, Human
aauuauaguuucugagg

SEQ ID NO: 1295572 - RNA, 21 nt, Human
aauuauaguuucugaggcuuu

SEQ ID NO: 1295573 - RNA, 14 nt, Human
aauuauauaacugu

SEQ ID NO: 1295574 - RNA, 17 nt, Human
aauuauauaacuguauu

SEQ ID NO: 1295575 - RNA, 19 nt, Human
aauuauauaacuguauuug

SEQ ID NO: 1295576 - RNA, 21 nt, Human
aauuauauaacuguauuugaa

SEQ ID NO: 1295577 - RNA, 19 nt, Human
aauuauacccccugcaaag

SEQ ID NO: 1295578 - RNA, 22 nt, Human
aauuauagcucuaauguuugca

SEQ ID NO: 1295579 - RNA, 20 nt, Human
aauuauagcucuaauguuug

SEQ ID NO: 1295580 - RNA, 19 nt, Human
aauuauagcucuaauguuu

SEQ ID NO: 1295581 - RNA, 18 nt, Human
aauuauagcucuaauguu

SEQ ID NO: 1295582 - RNA, 17 nt, Human
aauuauagcucuaaugu

SEQ ID NO: 1295583 - RNA, 22 nt, Human
aauuaucuauagcuaaguacac

SEQ ID NO: 1295584 - RNA, 15 nt, Human
aauuaucuauagcua

SEQ ID NO: 1295585 - RNA, 19 nt, Human
aauuaucuaauuuauaaaa

SEQ ID NO: 1295586 - RNA, 14 nt, Human
aauuaucuaauuua

SEQ ID NO: 1295587 - RNA, 15 nt, Human
aauuaucuaauuuau

SEQ ID NO: 1295588 - RNA, 18 nt, Human
aauuaucuaauuuauaaa

SEQ ID NO: 1295589 - RNA, 13 nt, Human
aauuauccaggaa

SEQ ID NO: 1295590 - RNA, 22 nt, Human
aauuaucaggcaaauuugcauu

SEQ ID NO: 1295591 - RNA, 12 nt, Human
aauuaugaaacu

SEQ ID NO: 1295592 - RNA, 13 nt, Human
aauuaugaaacuu

SEQ ID NO: 1295593 - RNA, 15 nt, Human
aauuaugaaacuuuu

SEQ ID NO: 1295594 - RNA, 23 nt, Human
aauuaucuauagcuaaguacaca

SEQ ID NO: 1295595 - RNA, 15 nt, Human
aauuaugaagauuua

SEQ ID NO: 1295596 - RNA, 18 nt, Human
aauuaugaaacuuuugga

SEQ ID NO: 1295597 - RNA, 17 nt, Human
aauuaugccuuuuuuga

SEQ ID NO: 1295598 - RNA, 19 nt, Human
aauuaugccuuuuuugauc

SEQ ID NO: 1295599 - RNA, 21 nt, Human
aauuauggaaaaaaaauauuc

SEQ ID NO: 1295600 - RNA, 12 nt, Human
aauuauguaaau

SEQ ID NO: 1295601 - RNA, 15 nt, Human
aauuauguaaauuau

SEQ ID NO: 1295602 - RNA, 17 nt, Human
aauuauguaaauuaugu

SEQ ID NO: 1295603 - RNA, 17 nt, Human
aauuauguaaauuauca

SEQ ID NO: 1295604 - RNA, 12 nt, Human
aauuauguagcu

SEQ ID NO: 1295605 - RNA, 13 nt, Human
aauuauguagcuc

SEQ ID NO: 1295606 - RNA, 16 nt, Human
aauuauguagcucuuu

SEQ ID NO: 1295607 - RNA, 22 nt, Human
aauuauguagcucuuugucagg

SEQ ID NO: 1295608 - RNA, 15 nt, Human
aauucggugugcacc

SEQ ID NO: 1295609 - RNA, 16 nt, Human
aauucugugccuuguu

SEQ ID NO: 1295610 - RNA, 16 nt, Human
aauucugcucagauag

SEQ ID NO: 1295611 - RNA, 21 nt, Human
aauucuggcugguagagcagg

SEQ ID NO: 1295612 - RNA, 17 nt, Human
aauucugaguuuugugu

SEQ ID NO: 1295613 - RNA, 23 nt, Human
aauucugaguuuuguguuuguug

SEQ ID NO: 1295614 - RNA, 16 nt, Human
aauugggccagcuuuu

SEQ ID NO: 1295615 - RNA, 11 nt, Human
aauuggauuuc

SEQ ID NO: 1295616 - RNA, 15 nt, Human
aauuggauuuccuaa

SEQ ID NO: 1295617 - RNA, 17 nt, Human
aauuggauuuccuaaua

SEQ ID NO: 1295618 - RNA, 20 nt, Human
aauuggcaccgaagcccaga

SEQ ID NO: 1295619 - RNA, 23 nt, Human
aauuggcauggaaauuuaaagca

SEQ ID NO: 1295620 - RNA, 21 nt, Human
aauugggagcuugggaaugga

SEQ ID NO: 1295621 - RNA, 23 nt, Human
aauucuaccaaggucuucuuaau

SEQ ID NO: 1295622 - RNA, 22 nt, Human
aauucuagcuuugagcuuaaga

SEQ ID NO: 1295623 - RNA, 13 nt, Human
aauucguguguuu

SEQ ID NO: 1295624 - RNA, 22 nt, Human
aauucguguguuuuuuuaugaa

SEQ ID NO: 1295625 - RNA, 12 nt, Human
aauucuaaaaug

SEQ ID NO: 1295626 - RNA, 14 nt, Human
aauucuaaaaugau

SEQ ID NO: 1295627 - RNA, 13 nt, Human
aauucuaaaugaa

SEQ ID NO: 1295628 - RNA, 17 nt, Human
aauucuaacccagguau

SEQ ID NO: 1295629 - RNA, 19 nt, Human
aauucuaaaugaauguuua

SEQ ID NO: 1295630 - RNA, 16 nt, Human
aauucuauaaggccau

SEQ ID NO: 1295631 - RNA, 22 nt, Human
aauucuauaaggccauaaaaca

SEQ ID NO: 1295632 - RNA, 13 nt, Human
aauucuaugccug

SEQ ID NO: 1295633 - RNA, 15 nt, Human
aauucuaugccuguc

SEQ ID NO: 1295634 - RNA, 15 nt, Human
aauucuauuaaagug

SEQ ID NO: 1295635 - RNA, 23 nt, Human
aauucuauuaaagugcuaagguu

SEQ ID NO: 1295636 - RNA, 14 nt, Human
aauucuccugccuc

SEQ ID NO: 1295637 - RNA, 18 nt, Human
aauucucauuaaaagaau

SEQ ID NO: 1295638 - RNA, 15 nt, Human
aauucuccugccuca

SEQ ID NO: 1295639 - RNA, 16 nt, Human
aauucuccugccucag

SEQ ID NO: 1295640 - RNA, 12 nt, Human
aauucuccugga

SEQ ID NO: 1295641 - RNA, 13 nt, Human
aauucuccuggag

SEQ ID NO: 1295642 - RNA, 15 nt, Human
aauucuccuggaggu

SEQ ID NO: 1295643 - RNA, 17 nt, Human
aauuuccugggagcuuu

SEQ ID NO: 1295644 - RNA, 12 nt, Human
aauuuccuggga

SEQ ID NO: 1295645 - RNA, 15 nt, Human
aauuuccugggagcu

SEQ ID NO: 1295646 - RNA, 14 nt, Human
aauuguacagccgg

SEQ ID NO: 1295647 - RNA, 16 nt, Human
aauuguacuaaagcca

SEQ ID NO: 1295648 - RNA, 17 nt, Human
aauuguacuaaagccaa

SEQ ID NO: 1295649 - RNA, 19 nt, Human
aauugggccagcuuuucaa

SEQ ID NO: 1295650 - RNA, 20 nt, Human
aauugggccagcuuuucaaa

SEQ ID NO: 1295651 - RNA, 13 nt, Human
aauuguaaucuga

SEQ ID NO: 1295652 - RNA, 11 nt, Human
aauuguaauag

SEQ ID NO: 1295653 - RNA, 12 nt, Human
aauuucccagga

SEQ ID NO: 1295654 - RNA, 14 nt, Human
aauuucccaggacc

SEQ ID NO: 1295655 - RNA, 15 nt, Human
aauuucccaggaccc

SEQ ID NO: 1295656 - RNA, 16 nt, Human
aauuucccaggacccu

SEQ ID NO: 1295657 - RNA, 17 nt, Human
aauuucccaggacccug

SEQ ID NO: 1295658 - RNA, 21 nt, Human
aauuucccaggacccugaagg

SEQ ID NO: 1295659 - RNA, 22 nt, Human
aauuucccaggacccugaaggg

SEQ ID NO: 1295660 - RNA, 21 nt, Human
acacgcacggcagccacagcu

SEQ ID NO: 1295661 - RNA, 13 nt, Human
acacgcaccugcc

SEQ ID NO: 1295662 - RNA, 14 nt, Human
acacgcaccugccu

SEQ ID NO: 1295663 - RNA, 16 nt, Human
acacgcaccugccuca

SEQ ID NO: 1295664 - RNA, 17 nt, Human
acacgcaccugccucag

SEQ ID NO: 1295665 - RNA, 14 nt, Human
acacuaaaaauaaa

SEQ ID NO: 1295666 - RNA, 23 nt, Human
acacguggccaagagaaacuucc

SEQ ID NO: 1295667 - RNA, 19 nt, Human
acacguaucccaccugaca

SEQ ID NO: 1295668 - RNA, 19 nt, Human
acacguauuugaauggccu

SEQ ID NO: 1295669 - RNA, 22 nt, Human
acacguauuugaauggccuuca

SEQ ID NO: 1295670 - RNA, 17 nt, Human
acacgugacacaaacac

SEQ ID NO: 1295671 - RNA, 16 nt, Human
acaccaagcacagcag

SEQ ID NO: 1295672 - RNA, 18 nt, Human
acaccaagcacagcagcc

SEQ ID NO: 1295673 - RNA, 19 nt, Human
acaccaagcacagcagccu

SEQ ID NO: 1295674 - RNA, 20 nt, Human
acaccaagcacagcagccug

SEQ ID NO: 1295675 - RNA, 21 nt, Human
acaccaagcacagcagccugg

SEQ ID NO: 1295676 - RNA, 15 nt, Human
acaccaauauucaua

SEQ ID NO: 1295677 - RNA, 17 nt, Human
acacagcauuguauaug

SEQ ID NO: 1295678 - RNA, 18 nt, Human
acacagcauuguauaugu

SEQ ID NO: 1295679 - RNA, 20 nt, Human
acacagcauuguauauguga

SEQ ID NO: 1295680 - RNA, 18 nt, Human
acacagaaaauguugaga

SEQ ID NO: 1295681 - RNA, 19 nt, Human
acacagaaaauguugagaa

SEQ ID NO: 1295682 - RNA, 20 nt, Human
acacagaaaauguugagaau

SEQ ID NO: 1295683 - RNA, 20 nt, Human
acaaguguaaugaauaccuu

SEQ ID NO: 1295684 - RNA, 16 nt, Human
acaaguuauuuaaauc

SEQ ID NO: 1295685 - RNA, 16 nt, Human
acaaguguaaugaaua

SEQ ID NO: 1295686 - RNA, 13 nt, Human
acaaguguaauga

SEQ ID NO: 1295687 - RNA, 18 nt, Human
acaaguggacucagggca

SEQ ID NO: 1295688 - RNA, 19 nt, Human
acaaguggacucagggcag

SEQ ID NO: 1295689 - RNA, 19 nt, Human
acaagugcccuccaggcuu

SEQ ID NO: 1295690 - RNA, 14 nt, Human
acaagugcugaaca

SEQ ID NO: 1295691 - RNA, 15 nt, Human
acaaguggacucagg

SEQ ID NO: 1295692 - RNA, 23 nt, Human
acaagguccucugucagucacag

SEQ ID NO: 1295693 - RNA, 16 nt, Human
acaaggucuuuaaagu

SEQ ID NO: 1295694 - RNA, 14 nt, Human
acaagugcccucca

SEQ ID NO: 1295695 - RNA, 14 nt, Human
acaaccaugucauu

SEQ ID NO: 1295696 - RNA, 19 nt, Human
acaacucacuccuuuuaaa

SEQ ID NO: 1295697 - RNA, 14 nt, Human
acaacucauacacu

SEQ ID NO: 1295698 - RNA, 21 nt, Human
acaacucacuccuuuuaaaga

SEQ ID NO: 1295699 - RNA, 21 nt, Human
acaacugccucgaaacacaga

SEQ ID NO: 1295700 - RNA, 22 nt, Human
acaacugccucgaaacacagaa

SEQ ID NO: 1295701 - RNA, 17 nt, Human
acaacugcucccaccuc

SEQ ID NO: 1295702 - RNA, 16 nt, Human
acaacuggcaggcagg

SEQ ID NO: 1295703 - RNA, 19 nt, Human
acaacuggcaggcaggcuc

SEQ ID NO: 1295704 - RNA, 22 nt, Human
acaaacugcaccaguugcugcu

SEQ ID NO: 1295705 - RNA, 13 nt, Human
acaaacuguaaau

SEQ ID NO: 1295706 - RNA, 16 nt, Human
acaaacuguaauacaa

SEQ ID NO: 1295707 - RNA, 17 nt, Human
acaaacuguaauacaau

SEQ ID NO: 1295708 - RNA, 14 nt, Human
acaaacaugacccu

SEQ ID NO: 1295709 - RNA, 21 nt, Human
acaaacucguuuuuuacaaag

SEQ ID NO: 1295710 - RNA, 20 nt, Human
acaaacucguuuuuuacaaa

SEQ ID NO: 1295711 - RNA, 11 nt, Human
acaaacugaag

SEQ ID NO: 1295712 - RNA, 19 nt, Human
acaaacuguaauacaauga

SEQ ID NO: 1295713 - RNA, 15 nt, Human
acaaacuguguaacu

SEQ ID NO: 1295714 - RNA, 16 nt, Human
acaaacuguguaacug

SEQ ID NO: 1295715 - RNA, 16 nt, Human
acaacauguuuccagc

SEQ ID NO: 1295716 - RNA, 21 nt, Human
acaacauguuuccagcauucc

SEQ ID NO: 1295717 - RNA, 19 nt, Human
acaacauguuuccagcauu

SEQ ID NO: 1295718 - RNA, 14 nt, Human
acaacauuucuaua

SEQ ID NO: 1295719 - RNA, 20 nt, Human
acaacauuucuauagccaaa

SEQ ID NO: 1295720 - RNA, 22 nt, Human
acaacauuucuauagccaaaaa

SEQ ID NO: 1295721 - RNA, 16 nt, Human
acaaccaauggaaugu

SEQ ID NO: 1295722 - RNA, 15 nt, Human
acaaccacuggucug

SEQ ID NO: 1295723 - RNA, 22 nt, Human
acaaccaugucauuucagaagu

SEQ ID NO: 1295724 - RNA, 14 nt, Human
acaaccauuccaga

SEQ ID NO: 1295725 - RNA, 14 nt, Human
acaaacaauaccug

SEQ ID NO: 1295726 - RNA, 13 nt, Human
acaaacaaugaaa

SEQ ID NO: 1295727 - RNA, 12 nt, Human
acaaacaaauuu

SEQ ID NO: 1295728 - RNA, 13 nt, Human
acaaacaaauuuu

SEQ ID NO: 1295729 - RNA, 17 nt, Human
acaaacacacacaaaag

SEQ ID NO: 1295730 - RNA, 15 nt, Human
acaaacaccucccag

SEQ ID NO: 1295731 - RNA, 20 nt, Human
acaaacagggcugccuucug

SEQ ID NO: 1295732 - RNA, 18 nt, Human
aacaucuuuaaggggagg

SEQ ID NO: 1295733 - RNA, 12 nt, Human
aacaucuuuaag

SEQ ID NO: 1295734 - RNA, 22 nt, Human
aacaucuuugaaauuauguaaa

SEQ ID NO: 1295735 - RNA, 14 nt, Human
aacaggcucagagg

SEQ ID NO: 1295736 - RNA, 21 nt, Human
aacaggcacuuggcagccuug

SEQ ID NO: 1295737 - RNA, 14 nt, Human
aacaggccucaggg

SEQ ID NO: 1295738 - RNA, 15 nt, Human
aacaggccucagggc

SEQ ID NO: 1295739 - RNA, 20 nt, Human
aacaggccucagggcuccuu

SEQ ID NO: 1295740 - RNA, 20 nt, Human
aacaugacuccauagaccuu

SEQ ID NO: 1295741 - RNA, 18 nt, Human
aacaugaggccacuggag

SEQ ID NO: 1295742 - RNA, 22 nt, Human
aacaugaagaccuuuuucugca

SEQ ID NO: 1295743 - RNA, 18 nt, Human
aacaugaagaccuuuuuc

SEQ ID NO: 1295744 - RNA, 20 nt, Human
aacaugacccuaaaucuuga

SEQ ID NO: 1295745 - RNA, 23 nt, Human
aacaugaagaccuuuuucugcac

SEQ ID NO: 1295746 - RNA, 14 nt, Human
aacaugaagaccuu

SEQ ID NO: 1295747 - RNA, 21 nt, Human
aacaucuuugaaauuauguaa

SEQ ID NO: 1295748 - RNA, 16 nt, Human
aacaggcacugcccug

SEQ ID NO: 1295749 - RNA, 17 nt, Human
aacaggcacugcccugg

SEQ ID NO: 1295750 - RNA, 18 nt, Human
aacaggcacugcccuggu

SEQ ID NO: 1295751 - RNA, 13 nt, Human
aacaggcacuugg

SEQ ID NO: 1295752 - RNA, 18 nt, Human
aacaggcacuuggcagcc

SEQ ID NO: 1295753 - RNA, 18 nt, Human
aacagccugacaacauuu

SEQ ID NO: 1295754 - RNA, 19 nt, Human
aacagccaacuagccccug

SEQ ID NO: 1295755 - RNA, 17 nt, Human
aacagcccuccucugca

SEQ ID NO: 1295756 - RNA, 19 nt, Human
aacagcccuccucugcacu

SEQ ID NO: 1295757 - RNA, 23 nt, Human
aaauucuucugaacucaaacuga

SEQ ID NO: 1295758 - RNA, 18 nt, Human
aaccuuuguuugcaucug

SEQ ID NO: 1295759 - RNA, 14 nt, Human
aaccuuugugcccu

SEQ ID NO: 1295760 - RNA, 16 nt, Human
aaccuuugugcccuau

SEQ ID NO: 1295761 - RNA, 12 nt, Human
aaccuuuuuaaa

SEQ ID NO: 1295762 - RNA, 13 nt, Human
aacauggcuuuga

SEQ ID NO: 1295763 - RNA, 19 nt, Human
aacccucagagccaccccu

SEQ ID NO: 1295764 - RNA, 23 nt, Human
aacaugguuaccaugucuuucuc

SEQ ID NO: 1295765 - RNA, 10 nt, Human
aacccucagg

SEQ ID NO: 1295766 - RNA, 11 nt, Human
aacccucaggg

SEQ ID NO: 1295767 - RNA, 20 nt, Human
aacccucagggcaaagccag

SEQ ID NO: 1295768 - RNA, 18 nt, Human
aacccucagggcaaagcc

SEQ ID NO: 1295769 - RNA, 18 nt, Human
aacccucuguuccuuccc

SEQ ID NO: 1295770 - RNA, 17 nt, Human
aaccguagaugauuuca

SEQ ID NO: 1295771 - RNA, 16 nt, Human
aaccgucuguuaugcu

SEQ ID NO: 1295772 - RNA, 18 nt, Human
aaccgucuguuaugcugu

SEQ ID NO: 1295773 - RNA, 22 nt, Human
aaccgucuguuaugcugugaca

SEQ ID NO: 1295774 - RNA, 11 nt, Human
aaccguggccc

SEQ ID NO: 1295775 - RNA, 17 nt, Human
aaccguggcccuuccug

SEQ ID NO: 1295776 - RNA, 18 nt, Human
aaccguggcccuuccugg

SEQ ID NO: 1295777 - RNA, 21 nt, Human
aaccguggcccuuccuggaca

SEQ ID NO: 1295778 - RNA, 19 nt, Human
aaccguggcccuuccugga

SEQ ID NO: 1295779 - RNA, 17 nt, Human
aaccuaaaacucuuucg

SEQ ID NO: 1295780 - RNA, 17 nt, Human
aaccguuuugaagcuac

SEQ ID NO: 1295781 - RNA, 18 nt, Human
aaccguuuugaagcuacu

SEQ ID NO: 1295782 - RNA, 22 nt, Human
aaauguugacaugggacauuug

SEQ ID NO: 1295783 - RNA, 17 nt, Human
aaauguucaucaaugaa

SEQ ID NO: 1295784 - RNA, 13 nt, Human
aaauguucaucaa

SEQ ID NO: 1295785 - RNA, 13 nt, Human
aaauguucacuuu

SEQ ID NO: 1295786 - RNA, 16 nt, Human
aaauguucacuuuuga

SEQ ID NO: 1295787 - RNA, 15 nt, Human
aaauguucagaaggu

SEQ ID NO: 1295788 - RNA, 21 nt, Human
aaauguucagaagguugcucu

SEQ ID NO: 1295789 - RNA, 21 nt, Human
aaauguuauuuuuuaauuauu

SEQ ID NO: 1295790 - RNA, 23 nt, Human
aaauguugacaugggacauuugc

SEQ ID NO: 1295791 - RNA, 11 nt, Human
aaauguugcug

SEQ ID NO: 1295792 - RNA, 19 nt, Human
aaauguugcugaaaaaugg

SEQ ID NO: 1295793 - RNA, 19 nt, Human
aaauguugagaaucccaaa

SEQ ID NO: 1295794 - RNA, 20 nt, Human
aaauguuuuuaauaaaagaa

SEQ ID NO: 1295795 - RNA, 21 nt, Human
aaauguuuuuaauaaaagaaa

SEQ ID NO: 1295796 - RNA, 22 nt, Human
aaauguuuuuaauaaaagaaaa

SEQ ID NO: 1295797 - RNA, 12 nt, Human
aaauguuuuugg

SEQ ID NO: 1295798 - RNA, 14 nt, Human
aaauguuuuugguc

SEQ ID NO: 1295799 - RNA, 21 nt, Human
aaauguuuuuggucuuuuaua

SEQ ID NO: 1295800 - RNA, 23 nt, Human
aaauguuuuuggucuuuuauaau

SEQ ID NO: 1295801 - RNA, 16 nt, Human
aaauggccauuugcuu

SEQ ID NO: 1295802 - RNA, 13 nt, Human
aaauggccauuug

SEQ ID NO: 1295803 - RNA, 22 nt, Human
aaauauuguuuuacaauaguuc

SEQ ID NO: 1295804 - RNA, 16 nt, Human
aaauagcaaaagaaga

SEQ ID NO: 1295805 - RNA, 21 nt, Human
aaauagauaagaguagaaacu

SEQ ID NO: 1295806 - RNA, 17 nt, Human
aaauagcaaaagaagaa

SEQ ID NO: 1295807 - RNA, 21 nt, Human
aaauauuuauuuuaauaaugu

SEQ ID NO: 1295808 - RNA, 22 nt, Human
aaauauuuagauguaauuuugu

SEQ ID NO: 1295809 - RNA, 14 nt, Human
aaauauuuguacau

SEQ ID NO: 1295810 - RNA, 15 nt, Human
aaauauuuguacaua

SEQ ID NO: 1295811 - RNA, 22 nt, Human
aaauauuuguacauaguuauuu

SEQ ID NO: 1295812 - RNA, 19 nt, Human
aaauauuuuaaaaucagcu

SEQ ID NO: 1295813 - RNA, 14 nt, Human
aaauauuuuaaaga

SEQ ID NO: 1295814 - RNA, 18 nt, Human
aaauauuuuaaagaauug

SEQ ID NO: 1295815 - RNA, 15 nt, Human
aaauauuuuaaagaa

SEQ ID NO: 1295816 - RNA, 16 nt, Human
aaauauuuuaaagaau

SEQ ID NO: 1295817 - RNA, 17 nt, Human
aaauauuuuaaagaauu

SEQ ID NO: 1295818 - RNA, 16 nt, Human
aaauauuuugcuaguu

SEQ ID NO: 1295819 - RNA, 18 nt, Human
aaaugcuuuuuauuucug

SEQ ID NO: 1295820 - RNA, 19 nt, Human
aaaugcuuagaaauucagc

SEQ ID NO: 1295821 - RNA, 14 nt, Human
aaaugaaaaaauau

SEQ ID NO: 1295822 - RNA, 18 nt, Human
aaaucuuuuauaggauuu

SEQ ID NO: 1295823 - RNA, 11 nt, Human
aaaucuuuuac

SEQ ID NO: 1295824 - RNA, 23 nt, Human
aaaugcuggcuauagaugucuuu

SEQ ID NO: 1295825 - RNA, 18 nt, Human
aaaucucaauauuucaga

SEQ ID NO: 1295826 - RNA, 16 nt, Human
aaaucaaaaucucucc

SEQ ID NO: 1295827 - RNA, 17 nt, Human
aaaucaaaaucucucca

SEQ ID NO: 1295828 - RNA, 20 nt, Human
aaaucaaaaucucuccacuu

SEQ ID NO: 1295829 - RNA, 22 nt, Human
aaauauuuuuggucauuguaau

SEQ ID NO: 1295830 - RNA, 21 nt, Human
aaauauuuuuucuuuucuauu

SEQ ID NO: 1295831 - RNA, 22 nt, Human
aaaucaaaagggccaaagaacc

SEQ ID NO: 1295832 - RNA, 13 nt, Human
aaaucaaaaucuc

SEQ ID NO: 1295833 - RNA, 14 nt, Human
aaaucaaaaucucu

SEQ ID NO: 1295834 - RNA, 15 nt, Human
aaaucaaaaucucuc

SEQ ID NO: 1295835 - RNA, 16 nt, Human
aaaucucaauucuucc

SEQ ID NO: 1295836 - RNA, 13 nt, Human
aaagccugcucaa

SEQ ID NO: 1295837 - RNA, 20 nt, Human
aaagccuggguuugguguau

SEQ ID NO: 1295838 - RNA, 23 nt, Human
aaagccuggguuugguguauggu

SEQ ID NO: 1295839 - RNA, 17 nt, Human
aaagccuguucauggca

SEQ ID NO: 1295840 - RNA, 18 nt, Human
aaagccuguucauggcag

SEQ ID NO: 1295841 - RNA, 12 nt, Human
aaaggaugugau

SEQ ID NO: 1295842 - RNA, 14 nt, Human
aaaggaugugauau

SEQ ID NO: 1295843 - RNA, 17 nt, Human
aaaggaugugauauaua

SEQ ID NO: 1295844 - RNA, 19 nt, Human
aaaggaugugauauauaag

SEQ ID NO: 1295845 - RNA, 23 nt, Human
aaaggaugugauauauaagugua

SEQ ID NO: 1295846 - RNA, 13 nt, Human
aaaggaugugauu

SEQ ID NO: 1295847 - RNA, 15 nt, Human
aaaagaaaauuuuug

SEQ ID NO: 1295848 - RNA, 11 nt, Human
aaaagaaaauu

SEQ ID NO: 1295849 - RNA, 22 nt, Human
aaaagaaaaucuuuauaaaugu

SEQ ID NO: 1295850 - RNA, 17 nt, Human
aaaagaaagaaaaucag

SEQ ID NO: 1295851 - RNA, 16 nt, Human
aaaagaaaagucaagg

SEQ ID NO: 1295852 - RNA, 13 nt, Human
aaaagaaaaagau

SEQ ID NO: 1295853 - RNA, 12 nt, Human
aaaagaaacuuu

SEQ ID NO: 1295854 - RNA, 18 nt, Human
aaaagaaaggcuguuaaa

SEQ ID NO: 1295855 - RNA, 11 nt, Human
aaaagaaaggc

SEQ ID NO: 1295856 - RNA, 12 nt, Human
aaaagaagaagu

SEQ ID NO: 1295857 - RNA, 19 nt, Human
aaaagaagcccggcuccug

SEQ ID NO: 1295858 - RNA, 20 nt, Human
aaaagacaaggaaaaaauaa

SEQ ID NO: 1295859 - RNA, 14 nt, Human
aaaagaagaaguuu

SEQ ID NO: 1295860 - RNA, 11 nt, Human
aaaagaaguaa

SEQ ID NO: 1295861 - RNA, 11 nt, Human
aaaagaaugau

SEQ ID NO: 1295862 - RNA, 13 nt, Human
aaaagaauuguug

SEQ ID NO: 1295863 - RNA, 22 nt, Human
aaaagaauuguuggggguuuuu

SEQ ID NO: 1295864 - RNA, 20 nt, Human
aaaagacacacuuguccaca

SEQ ID NO: 1295865 - RNA, 13 nt, Human
aaaagacauucag

SEQ ID NO: 1295866 - RNA, 15 nt, Human
aaaagacauucagga

SEQ ID NO: 1295867 - RNA, 13 nt, Human
aaaagacucaucc

SEQ ID NO: 1295868 - RNA, 21 nt, Human
aaaacacuaaaaauaaaaaug

SEQ ID NO: 1295869 - RNA, 13 nt, Human
aaaacacugugca

SEQ ID NO: 1295870 - RNA, 14 nt, Human
aaaacagaacacuu

SEQ ID NO: 1295871 - RNA, 13 nt, Human
aaaacagaagccu

SEQ ID NO: 1295872 - RNA, 17 nt, Human
aaaacagacacuggcau

SEQ ID NO: 1295873 - RNA, 17 nt, Human
aaaacaggcacugcccu

SEQ ID NO: 1295874 - RNA, 18 nt, Human
aaaacaggcacugcccug

SEQ ID NO: 1295875 - RNA, 23 nt, Human
aaaacaggcacugcccugguggc

SEQ ID NO: 1295876 - RNA, 18 nt, Human
aaaacagggccacauaga

SEQ ID NO: 1295877 - RNA, 23 nt, Human
aaaacagggccacauagaugcug

SEQ ID NO: 1295878 - RNA, 12 nt, Human
aaaacagguaga

SEQ ID NO: 1295879 - RNA, 17 nt, Human
aaaacagguagaauuau

SEQ ID NO: 1295880 - RNA, 22 nt, Human
aaaacagguagaauuaucuaau

SEQ ID NO: 1295881 - RNA, 11 nt, Human
aaaacuuugga

SEQ ID NO: 1295882 - RNA, 16 nt, Human
aaaacuuuggaaccag

SEQ ID NO: 1295883 - RNA, 17 nt, Human
aaaacuuuggaaccaga

SEQ ID NO: 1295884 - RNA, 19 nt, Human
aaaacuuuggaaccagacu

SEQ ID NO: 1295885 - RNA, 12 nt, Human
aaaagauaaaca

SEQ ID NO: 1295886 - RNA, 19 nt, Human
aaaagauaaacacaagauu

SEQ ID NO: 1295887 - RNA, 17 nt, Human
aaaagauaaacacaaga

SEQ ID NO: 1295888 - RNA, 10 nt, Human
aaaagacuca

SEQ ID NO: 1295889 - RNA, 11 nt, Human
aaaagacucau

SEQ ID NO: 1295890 - RNA, 12 nt, Human
aaaagacucauc

SEQ ID NO: 1295891 - RNA, 15 nt, Human
aaaagacuuguuucu

SEQ ID NO: 1295892 - RNA, 10 nt, Human
aaaagauccc

SEQ ID NO: 1295893 - RNA, 23 nt, Human
aaaagaucuguuuugaaggcaaa

SEQ ID NO: 1295894 - RNA, 14 nt, Human
aaaaguugcuauuu

SEQ ID NO: 1295895 - RNA, 18 nt, Human
aaaaguugaauuuuacau

SEQ ID NO: 1295896 - RNA, 14 nt, Human
aaaaguugcagcug

SEQ ID NO: 1295897 - RNA, 15 nt, Human
aaaaguugcagcugu

SEQ ID NO: 1295898 - RNA, 18 nt, Human
aaaaguugcagcuguuuu

SEQ ID NO: 1295899 - RNA, 21 nt, Human
aaaaguugcagcuguuuuguu

SEQ ID NO: 1295900 - RNA, 22 nt, Human
aaaaguugcuauuugaacuuuu

SEQ ID NO: 1295901 - RNA, 13 nt, Human
aaaauaaaaaugg

SEQ ID NO: 1295902 - RNA, 22 nt, Human
aaaauaaaacccguugauuacu

SEQ ID NO: 1295903 - RNA, 18 nt, Human
aaaaucagcuauuuugug

SEQ ID NO: 1295904 - RNA, 13 nt, Human
aaaagugaaauaa

SEQ ID NO: 1295905 - RNA, 15 nt, Human
aaaagugaagacaga

SEQ ID NO: 1295906 - RNA, 13 nt, Human
aaagccaugcugg

SEQ ID NO: 1295907 - RNA, 19 nt, Human
aaagccugaguacuccaca

SEQ ID NO: 1295908 - RNA, 12 nt, Human
aaagccugcuca

SEQ ID NO: 1295909 - RNA, 17 nt, Human
aaagccugggugacauu

SEQ ID NO: 1295910 - RNA, 18 nt, Human
aaagccugggugacauuu

SEQ ID NO: 1295911 - RNA, 21 nt, Human
aaagaucuguuuugaaggcaa

SEQ ID NO: 1295912 - RNA, 16 nt, Human
aaagaucuguuuugaa

SEQ ID NO: 1295913 - RNA, 21 nt, Human
aaagaucuguccucagccuug

SEQ ID NO: 1295914 - RNA, 13 nt, Human
aaagaucuguuuu

SEQ ID NO: 1295915 - RNA, 13 nt, Human
aaagaucccaaau

SEQ ID NO: 1295916 - RNA, 18 nt, Human
aaagaucuguccucagcc

SEQ ID NO: 1295917 - RNA, 19 nt, Human
aaagaucuguccucagccu

SEQ ID NO: 1295918 - RNA, 20 nt, Human
aaagaucuguccucagccuu

SEQ ID NO: 1295919 - RNA, 10 nt, Human
aaagaaaaaa

SEQ ID NO: 1295920 - RNA, 23 nt, Human
aaagaaaaaaaaccaucaaguug

SEQ ID NO: 1295921 - RNA, 17 nt, Human
aaagaaaaaaauguauu

SEQ ID NO: 1295922 - RNA, 22 nt, Human
aaagaaaaaaauguauuuuaug

SEQ ID NO: 1295923 - RNA, 18 nt, Human
aaagaaaaaaauguauuu

SEQ ID NO: 1295924 - RNA, 13 nt, Human
aaagaaaaaaauu

SEQ ID NO: 1295925 - RNA, 15 nt, Human
aaagaaaaaaauuga

SEQ ID NO: 1295926 - RNA, 16 nt, Human
aaagaaaaaaauugaa

SEQ ID NO: 1295927 - RNA, 18 nt, Human
aaagaaaaaaauugaaau

SEQ ID NO: 1295928 - RNA, 19 nt, Human
aaagaaaaaaauugaaaug

SEQ ID NO: 1295929 - RNA, 22 nt, Human
aaagaaaaaaauugaaauguaa

SEQ ID NO: 1295930 - RNA, 21 nt, Human
aaagaaaaaaauugaaaugua

SEQ ID NO: 1295931 - RNA, 16 nt, Human
aaagauauuuuuaucu

SEQ ID NO: 1295932 - RNA, 19 nt, Human
aaaccaguguuagggaagg

SEQ ID NO: 1295933 - RNA, 15 nt, Human
aaacccaauccaaau

SEQ ID NO: 1295934 - RNA, 20 nt, Human
aaaccagguccaaugagcuu

SEQ ID NO: 1295935 - RNA, 22 nt, Human
aaaccagguccaaugagcuuuc

SEQ ID NO: 1295936 - RNA, 24 nt, Human
aaaccagguccaaugagcuuucug

SEQ ID NO: 1295937 - RNA, 22 nt, Human
aaaccgaacugauguaaguaaa

SEQ ID NO: 1295938 - RNA, 18 nt, Human
aaacccaccugcuagugu

SEQ ID NO: 1295939 - RNA, 13 nt, Human
aaaccgccagcuc

SEQ ID NO: 1295940 - RNA, 14 nt, Human
aaaccgccagcucu

SEQ ID NO: 1295941 - RNA, 15 nt, Human
aaaccgccagcucug

SEQ ID NO: 1295942 - RNA, 18 nt, Human
aaaccgccagcucuguuc

SEQ ID NO: 1295943 - RNA, 18 nt, Human
aaacucuguuacacuuuu

SEQ ID NO: 1295944 - RNA, 22 nt, Human
aaacucuguuacacuuuuugga

SEQ ID NO: 1295945 - RNA, 19 nt, Human
aaacucuguugcaagugca

SEQ ID NO: 1295946 - RNA, 20 nt, Human
aaacucuguugcaagugcaa

SEQ ID NO: 1295947 - RNA, 23 nt, Human
aaacuuuuuuucuguaccaguua

SEQ ID NO: 1295948 - RNA, 11 nt, Human
aaagaaaaaaa

SEQ ID NO: 1295949 - RNA, 20 nt, Human
aaaaucuauuuuguaacuuu

SEQ ID NO: 1295950 - RNA, 13 nt, Human
aagcuacuuauug

SEQ ID NO: 1295951 - RNA, 22 nt, Human
aagcuacugugugugugaauga

SEQ ID NO: 1295952 - RNA, 23 nt, Human
aagcuacugugugugugaaugaa

SEQ ID NO: 1295953 - RNA, 21 nt, Human
aagcggugucucuccugcccc

SEQ ID NO: 1295954 - RNA, 19 nt, Human
aagcgauucucuugccuca

SEQ ID NO: 1295955 - RNA, 20 nt, Human
aagcgauucucuugccucaa

SEQ ID NO: 1295956 - RNA, 14 nt, Human
aagcggugucucuc

SEQ ID NO: 1295957 - RNA, 15 nt, Human
aagcgaaaaaaucag

SEQ ID NO: 1295958 - RNA, 14 nt, Human
aagcgauucuccug

SEQ ID NO: 1295959 - RNA, 10 nt, Human
aagccuuugu

SEQ ID NO: 1295960 - RNA, 20 nt, Human
aagccaguuuggguaaaaua

SEQ ID NO: 1295961 - RNA, 23 nt, Human
aagccaguuuggguaaaauacuu

SEQ ID NO: 1295962 - RNA, 21 nt, Human
aagccagguuccacagaggac

SEQ ID NO: 1295963 - RNA, 23 nt, Human
aagccagguuccacagaggacac

SEQ ID NO: 1295964 - RNA, 17 nt, Human
aagccaggucccucuca

SEQ ID NO: 1295965 - RNA, 24 nt, Human
aagccaggaauuucccaggacccu

SEQ ID NO: 1295966 - RNA, 13 nt, Human
aagccaggucccu

SEQ ID NO: 1295967 - RNA, 15 nt, Human
aagccaggucccucu

SEQ ID NO: 1295968 - RNA, 16 nt, Human
aagccaggucccucuc

SEQ ID NO: 1295969 - RNA, 20 nt, Human
aagaguuugaugaggcccuc

SEQ ID NO: 1295970 - RNA, 19 nt, Human
aagauaaggucugaauaau

SEQ ID NO: 1295971 - RNA, 12 nt, Human
aagauaauuaua

SEQ ID NO: 1295972 - RNA, 15 nt, Human
aagauaauucacugu

SEQ ID NO: 1295973 - RNA, 20 nt, Human
aagauacagaacucuuucaa

SEQ ID NO: 1295974 - RNA, 22 nt, Human
aagauacagaacucuuucaaaa

SEQ ID NO: 1295975 - RNA, 18 nt, Human
aagcuagacacaugaagg

SEQ ID NO: 1295976 - RNA, 20 nt, Human
aagcuagacacaugaaggua

SEQ ID NO: 1295977 - RNA, 22 nt, Human
aagcuagacacaugaagguaaa

SEQ ID NO: 1295978 - RNA, 19 nt, Human
aagcuagaauugaguguuu

SEQ ID NO: 1295979 - RNA, 15 nt, Human
aagcuagacacauga

SEQ ID NO: 1295980 - RNA, 16 nt, Human
aagcuagacacaugaa

SEQ ID NO: 1295981 - RNA, 17 nt, Human
aagcuagacacaugaag

SEQ ID NO: 1295982 - RNA, 21 nt, Human
aagcuagacacaugaagguaa

SEQ ID NO: 1295983 - RNA, 18 nt, Human
aagcugaguauuaaaaug

SEQ ID NO: 1295984 - RNA, 19 nt, Human
aagcugaguauuaaaaugu

SEQ ID NO: 1295985 - RNA, 22 nt, Human
aagcugaguuaggugucugucc

SEQ ID NO: 1295986 - RNA, 23 nt, Human
aagcugaguuaggugucuguccu

SEQ ID NO: 1295987 - RNA, 13 nt, Human
aagcugaguuucc

SEQ ID NO: 1295988 - RNA, 14 nt, Human
aagcugaguuuccu

SEQ ID NO: 1295989 - RNA, 15 nt, Human
aagcugaguuuccua

SEQ ID NO: 1295990 - RNA, 22 nt, Human
aagcugaguuuccuaugggaac

SEQ ID NO: 1295991 - RNA, 16 nt, Human
aagcugauuaaaugac

SEQ ID NO: 1295992 - RNA, 15 nt, Human
aagcugauuaaauga

SEQ ID NO: 1295993 - RNA, 18 nt, Human
aagcugauuuuuuuuaau

SEQ ID NO: 1295994 - RNA, 14 nt, Human
aaggacuuuguaca

SEQ ID NO: 1295995 - RNA, 15 nt, Human
aaggacuuuguacau

SEQ ID NO: 1295996 - RNA, 17 nt, Human
aaggacuuuguacauuu

SEQ ID NO: 1295997 - RNA, 15 nt, Human
aaggagaaccagcac

SEQ ID NO: 1295998 - RNA, 22 nt, Human
aaggcaacaaaagaagcccggc

SEQ ID NO: 1295999 - RNA, 21 nt, Human
aaggcaacaaaagaagcccgg

SEQ ID NO: 1296000 - RNA, 18 nt, Human
aaggcaagcacuuguggg

SEQ ID NO: 1296001 - RNA, 19 nt, Human
aaggcagggaggaggcaga

SEQ ID NO: 1296002 - RNA, 19 nt, Human
aaggcagggagggccuggg

SEQ ID NO: 1296003 - RNA, 22 nt, Human
aaggcagggagggccugggccc

SEQ ID NO: 1296004 - RNA, 21 nt, Human
aaggcauacgagagcagaggu

SEQ ID NO: 1296005 - RNA, 22 nt, Human
aaggcauacgagagcagagguc

SEQ ID NO: 1296006 - RNA, 22 nt, Human
aaggcaguuaccauuaaaccau

SEQ ID NO: 1296007 - RNA, 23 nt, Human
aaggcaguuaccauuaaaccauc

SEQ ID NO: 1296008 - RNA, 15 nt, Human
aaggcaguuugcaaa

SEQ ID NO: 1296009 - RNA, 15 nt, Human
aaggcaguuuucuaa

SEQ ID NO: 1296010 - RNA, 19 nt, Human
aaggcaguuugcaaaaaau

SEQ ID NO: 1296011 - RNA, 17 nt, Human
aaggcauacgagagcag

SEQ ID NO: 1296012 - RNA, 22 nt, Human
aagagaucaggaagagaaggag

SEQ ID NO: 1296013 - RNA, 16 nt, Human
aagagaucaggaagag

SEQ ID NO: 1296014 - RNA, 15 nt, Human
aagagaucaggaaga

SEQ ID NO: 1296015 - RNA, 14 nt, Human
aagagauacagagg

SEQ ID NO: 1296016 - RNA, 16 nt, Human
aagagauaacuguaaa

SEQ ID NO: 1296017 - RNA, 14 nt, Human
aagagacagugaua

SEQ ID NO: 1296018 - RNA, 11 nt, Human
aagagaaaaag

SEQ ID NO: 1296019 - RNA, 20 nt, Human
aagagaaacaguugguaacu

SEQ ID NO: 1296020 - RNA, 13 nt, Human
aagagaaacuucc

SEQ ID NO: 1296021 - RNA, 20 nt, Human
aagacagaaccacagggcua

SEQ ID NO: 1296022 - RNA, 16 nt, Human
aagacagaaguuugca

SEQ ID NO: 1296023 - RNA, 18 nt, Human
aagacagaaguuugcacu

SEQ ID NO: 1296024 - RNA, 12 nt, Human
aagacaugaagc

SEQ ID NO: 1296025 - RNA, 14 nt, Human
aagacaugauuucc

SEQ ID NO: 1296026 - RNA, 15 nt, Human
aagacaugauuuccu

SEQ ID NO: 1296027 - RNA, 16 nt, Human
aagacaugauuuccuu

SEQ ID NO: 1296028 - RNA, 20 nt, Human
aagacaugauuuccuugaau

SEQ ID NO: 1296029 - RNA, 21 nt, Human
aagacaugauuuccuugaaug

SEQ ID NO: 1296030 - RNA, 14 nt, Human
aagaacggaagaag

SEQ ID NO: 1296031 - RNA, 14 nt, Human
aagaaccuggaacu

SEQ ID NO: 1296032 - RNA, 11 nt, Human
aagaacaugug

SEQ ID NO: 1296033 - RNA, 16 nt, Human
aagaaccaaagaagaa

SEQ ID NO: 1296034 - RNA, 17 nt, Human
aagaaccagucccccca

SEQ ID NO: 1296035 - RNA, 20 nt, Human
aagaaccaguccccccaccc

SEQ ID NO: 1296036 - RNA, 14 nt, Human
aagaacuagcauaa

SEQ ID NO: 1296037 - RNA, 16 nt, Human
aacgcagcccugcuuu

SEQ ID NO: 1296038 - RNA, 22 nt, Human
aacgcaucuaguuccccuguuu

SEQ ID NO: 1296039 - RNA, 23 nt, Human
aacgcaucuaguuccccuguuua

SEQ ID NO: 1296040 - RNA, 11 nt, Human
aagaacugaaa

SEQ ID NO: 1296041 - RNA, 13 nt, Human
aagaaccacuugu

SEQ ID NO: 1296042 - RNA, 13 nt, Human
aagaacucucugg

SEQ ID NO: 1296043 - RNA, 12 nt, Human
aagaacugaaau

SEQ ID NO: 1296044 - RNA, 13 nt, Human
aagaacugaaauc

SEQ ID NO: 1296045 - RNA, 15 nt, Human
aagaacugaaaucau

SEQ ID NO: 1296046 - RNA, 14 nt, Human
aagaacucucugga

SEQ ID NO: 1296047 - RNA, 18 nt, Human
aagaacugcaggcccugg

SEQ ID NO: 1296048 - RNA, 22 nt, Human
aagaacugcaggcccuggccuc

SEQ ID NO: 1296049 - RNA, 23 nt, Human
aagaacugcaggcccuggccucc

SEQ ID NO: 1296050 - RNA, 21 nt, Human
aagacaaggaaaaaauaacaa

SEQ ID NO: 1296051 - RNA, 20 nt, Human
aagaagacugcauuauauuu

SEQ ID NO: 1296052 - RNA, 20 nt, Human
aagaagaccugagaauguau

SEQ ID NO: 1296053 - RNA, 21 nt, Human
aagaagaccugagaauguauc

SEQ ID NO: 1296054 - RNA, 15 nt, Human
aagaagacugcauua

SEQ ID NO: 1296055 - RNA, 15 nt, Human
aagaagacaaacuuu

SEQ ID NO: 1296056 - RNA, 19 nt, Human
aagaagacaaacuuugcau

SEQ ID NO: 1296057 - RNA, 16 nt, Human
aagaagacaaacuuug

SEQ ID NO: 1296058 - RNA, 20 nt, Human
aagaacuuugagcuacugcc

SEQ ID NO: 1296059 - RNA, 17 nt, Human
aagaacuuuaaauugug

SEQ ID NO: 1296060 - RNA, 13 nt, Human
aagaacuuugagc

SEQ ID NO: 1296061 - RNA, 18 nt, Human
aagaacuuugagcuacug

SEQ ID NO: 1296062 - RNA, 13 nt, Human
aagaagaagggca

SEQ ID NO: 1296063 - RNA, 22 nt, Human
aagacaagaacuccccuuuuuu

SEQ ID NO: 1296064 - RNA, 23 nt, Human
aagacaagugaugcuaaaaccug

SEQ ID NO: 1296065 - RNA, 13 nt, Human
aagacaauauaau

SEQ ID NO: 1296066 - RNA, 21 nt, Human
aagacacauuuuuuaggaaau

SEQ ID NO: 1296067 - RNA, 18 nt, Human
aagacaccguucauucag

SEQ ID NO: 1296068 - RNA, 14 nt, Human
aagaguucaagaaa

SEQ ID NO: 1296069 - RNA, 16 nt, Human
aagaguucaagaaaua

SEQ ID NO: 1296070 - RNA, 14 nt, Human
aagaguuggcuggu

SEQ ID NO: 1296071 - RNA, 15 nt, Human
aagaguuuaaaauca

SEQ ID NO: 1296072 - RNA, 13 nt, Human
aagagucuaaaga

SEQ ID NO: 1296073 - RNA, 14 nt, Human
aagagucuaaagau

SEQ ID NO: 1296074 - RNA, 24 nt, Human
aagagucuaaagauggaguuucua

SEQ ID NO: 1296075 - RNA, 18 nt, Human
aagaguccauuguuuaaa

SEQ ID NO: 1296076 - RNA, 21 nt, Human
aagaguccauuguuuaaaaau

SEQ ID NO: 1296077 - RNA, 16 nt, Human
aauaaacacucuugaa

SEQ ID NO: 1296078 - RNA, 11 nt, Human
aauaaacacuc

SEQ ID NO: 1296079 - RNA, 14 nt, Human
aaguuuaauaaauu

SEQ ID NO: 1296080 - RNA, 17 nt, Human
aaguuuaauaaauuuau

SEQ ID NO: 1296081 - RNA, 19 nt, Human
aauaaacacucuugaaaaa

SEQ ID NO: 1296082 - RNA, 10 nt, Human
aauaaaccau

SEQ ID NO: 1296083 - RNA, 13 nt, Human
aauaaacuuuaau

SEQ ID NO: 1296084 - RNA, 13 nt, Human
aauaaagaaaaga

SEQ ID NO: 1296085 - RNA, 14 nt, Human
aauaaagaaaagau

SEQ ID NO: 1296086 - RNA, 12 nt, Human
aaguugaauuuu

SEQ ID NO: 1296087 - RNA, 23 nt, Human
aaguuggaguuuuguuuccucug

SEQ ID NO: 1296088 - RNA, 21 nt, Human
aaguuggggacacauguauuu

SEQ ID NO: 1296089 - RNA, 17 nt, Human
aaguugggcuugcuauu

SEQ ID NO: 1296090 - RNA, 20 nt, Human
aaguugggcuugcuauucug

SEQ ID NO: 1296091 - RNA, 21 nt, Human
aaguugggcuugcuauucugu

SEQ ID NO: 1296092 - RNA, 17 nt, Human
aaguuguaaaguaugua

SEQ ID NO: 1296093 - RNA, 14 nt, Human
aaguuguaaaguau

SEQ ID NO: 1296094 - RNA, 19 nt, Human
aaguggccaagaagcagug

SEQ ID NO: 1296095 - RNA, 17 nt, Human
aaguggacucagggcag

SEQ ID NO: 1296096 - RNA, 12 nt, Human
aauaaagcaauu

SEQ ID NO: 1296097 - RNA, 11 nt, Human
aauaaagcaau

SEQ ID NO: 1296098 - RNA, 17 nt, Human
aauaaagaauggaaagc

SEQ ID NO: 1296099 - RNA, 15 nt, Human
aauaaagaaaagaug

SEQ ID NO: 1296100 - RNA, 16 nt, Human
aauaaagaaaagaugc

SEQ ID NO: 1296101 - RNA, 20 nt, Human
aauaaagaaaagaugcacuu

SEQ ID NO: 1296102 - RNA, 17 nt, Human
aauaaagaaaagaugca

SEQ ID NO: 1296103 - RNA, 12 nt, Human
aauaaagaaugg

SEQ ID NO: 1296104 - RNA, 17 nt, Human
aauaaugugcacugaau

SEQ ID NO: 1296105 - RNA, 14 nt, Human
aauaauguguaguu

SEQ ID NO: 1296106 - RNA, 19 nt, Human
aauaauguguaguucaugu

SEQ ID NO: 1296107 - RNA, 22 nt, Human
aauaauguguaguucauguaaa

SEQ ID NO: 1296108 - RNA, 20 nt, Human
aauaauguguaguucaugua

SEQ ID NO: 1296109 - RNA, 21 nt, Human
aauaauguguaguucauguaa

SEQ ID NO: 1296110 - RNA, 17 nt, Human
aaucucaauucuucccu

SEQ ID NO: 1296111 - RNA, 15 nt, Human
aaucucacauauaca

SEQ ID NO: 1296112 - RNA, 23 nt, Human
aaucucacauauacaaguagcuu

SEQ ID NO: 1296113 - RNA, 16 nt, Human
aaucucaauauuucag

SEQ ID NO: 1296114 - RNA, 22 nt, Human
aaucucaguugauuuucuggau

SEQ ID NO: 1296115 - RNA, 16 nt, Human
aaucucaguugauuuu

SEQ ID NO: 1296116 - RNA, 21 nt, Human
aaucucaguugauuuucugga

SEQ ID NO: 1296117 - RNA, 12 nt, Human
aaucugacccag

SEQ ID NO: 1296118 - RNA, 13 nt, Human
aaucugacccagu

SEQ ID NO: 1296119 - RNA, 14 nt, Human
aaucugacccagug

SEQ ID NO: 1296120 - RNA, 15 nt, Human
aaucugacccagugc

SEQ ID NO: 1296121 - RNA, 17 nt, Human
aaucugacccagugccc

SEQ ID NO: 1296122 - RNA, 14 nt, Human
aaugaagcaaugcu

SEQ ID NO: 1296123 - RNA, 12 nt, Human
aaugaagaucua

SEQ ID NO: 1296124 - RNA, 24 nt, Human
aaugaagaucuaaauaaaaugcua

SEQ ID NO: 1296125 - RNA, 23 nt, Human
aaugaagcaaaugucaugcugcc

SEQ ID NO: 1296126 - RNA, 22 nt, Human
aaugaagccauaugaacagcug

SEQ ID NO: 1296127 - RNA, 20 nt, Human
aaugaagauacugaaauaaa

SEQ ID NO: 1296128 - RNA, 20 nt, Human
aaugaauacuuuauaaagga

SEQ ID NO: 1296129 - RNA, 13 nt, Human
aaugaauaccuua

SEQ ID NO: 1296130 - RNA, 12 nt, Human
aaugaauaccuu

SEQ ID NO: 1296131 - RNA, 14 nt, Human
aaugauggcaauuu

SEQ ID NO: 1296132 - RNA, 17 nt, Human
aaugauggcaauuuugu

SEQ ID NO: 1296133 - RNA, 20 nt, Human
aaugauguauguugaagccu

SEQ ID NO: 1296134 - RNA, 18 nt, Human
aaugauggcaauuuugua

SEQ ID NO: 1296135 - RNA, 19 nt, Human
aaugauggcaauuuuguaa

SEQ ID NO: 1296136 - RNA, 16 nt, Human
aauauauaucaaauau

SEQ ID NO: 1296137 - RNA, 11 nt, Human
aauaugucagu

SEQ ID NO: 1296138 - RNA, 12 nt, Human
aauauguccugg

SEQ ID NO: 1296139 - RNA, 13 nt, Human
aauauguccuggg

SEQ ID NO: 1296140 - RNA, 13 nt, Human
aauauuaaaucug

SEQ ID NO: 1296141 - RNA, 21 nt, Human
aauauuaaaucugcuggaguu

SEQ ID NO: 1296142 - RNA, 22 nt, Human
aaucaaugcuauaacuauguug

SEQ ID NO: 1296143 - RNA, 14 nt, Human
aaucaaucuugcau

SEQ ID NO: 1296144 - RNA, 16 nt, Human
aaucaaucuugcaugu

SEQ ID NO: 1296145 - RNA, 14 nt, Human
aaucaauuaaaagu

SEQ ID NO: 1296146 - RNA, 18 nt, Human
aaucaaucuugcauguaa

SEQ ID NO: 1296147 - RNA, 16 nt, Human
aaucacgcuuuccuga

SEQ ID NO: 1296148 - RNA, 17 nt, Human
aaucacgcuuuuugaaa

SEQ ID NO: 1296149 - RNA, 18 nt, Human
aaucacgcuuuuugaaaa

SEQ ID NO: 1296150 - RNA, 14 nt, Human
aaucacgcuuuuug

SEQ ID NO: 1296151 - RNA, 15 nt, Human
aaucacgcuuuuuga

SEQ ID NO: 1296152 - RNA, 16 nt, Human
aaucacgcuuuuugaa

SEQ ID NO: 1296153 - RNA, 20 nt, Human
aaucacgcuuuuugaaaaag

SEQ ID NO: 1296154 - RNA, 22 nt, Human
aauauuaagguaguuauucaca

SEQ ID NO: 1296155 - RNA, 20 nt, Human
aauauuacagauaaaaugua

SEQ ID NO: 1296156 - RNA, 13 nt, Human
aauauuagaaaca

SEQ ID NO: 1296157 - RNA, 18 nt, Human
aaucaaaagggccaaaga

SEQ ID NO: 1296158 - RNA, 19 nt, Human
aaucaaaagggccaaagaa

SEQ ID NO: 1296159 - RNA, 23 nt, Human
aaucaaaagggccaaagaaccaa

SEQ ID NO: 1296160 - RNA, 20 nt, Human
aaucaaaagggccaaagaac

SEQ ID NO: 1296161 - RNA, 12 nt, Human
aaucaaaaucuc

SEQ ID NO: 1296162 - RNA, 15 nt, Human
aaucaaaaucucucc

SEQ ID NO: 1296163 - RNA, 16 nt, Human
aaucaaaaucucucca

SEQ ID NO: 1296164 - RNA, 19 nt, Human
aaucaaaaucucuccacuu

SEQ ID NO: 1296165 - RNA, 13 nt, Human
aaucaaacauuuu

SEQ ID NO: 1296166 - RNA, 16 nt, Human
aaucaaacauuuucug

SEQ ID NO: 1296167 - RNA, 17 nt, Human
aaucaaacauuuucugg

SEQ ID NO: 1296168 - RNA, 23 nt, Human
aaucaaacauuuugaaagucugu

SEQ ID NO: 1296169 - RNA, 15 nt, Human
aaucaaacauuuuga

SEQ ID NO: 1296170 - RNA, 12 nt, Human
aaucaauaauau

SEQ ID NO: 1296171 - RNA, 20 nt, Human
aaucaaucuugcauguaacg

SEQ ID NO: 1296172 - RNA, 13 nt, Human
gccaggccgggaa

SEQ ID NO: 1296173 - RNA, 14 nt, Human
gccaggccucuccc

SEQ ID NO: 1296174 - RNA, 23 nt, Human
gccaggccucucccuccuccagg

SEQ ID NO: 1296175 - RNA, 21 nt, Human
gccagccacggggacucagcc

SEQ ID NO: 1296176 - RNA, 20 nt, Human
gccagccaagcucugcaguc

SEQ ID NO: 1296177 - RNA, 21 nt, Human
gccagccaagcucugcagucc

SEQ ID NO: 1296178 - RNA, 15 nt, Human
gccagccaagcucug

SEQ ID NO: 1296179 - RNA, 16 nt, Human
gccagccaagcucugc

SEQ ID NO: 1296180 - RNA, 19 nt, Human
gccagccaagcucugcagu

SEQ ID NO: 1296181 - RNA, 15 nt, Human
gccaggaggacccag

SEQ ID NO: 1296182 - RNA, 16 nt, Human
gccaggaggacccagg

SEQ ID NO: 1296183 - RNA, 17 nt, Human
gccaggaggacccaggg

SEQ ID NO: 1296184 - RNA, 19 nt, Human
gccaggaggacccagggcu

SEQ ID NO: 1296185 - RNA, 22 nt, Human
gccaggaggacccagggcucug

SEQ ID NO: 1296186 - RNA, 13 nt, Human
gccaggagggaca

SEQ ID NO: 1296187 - RNA, 19 nt, Human
gccaggagggacaaaggag

SEQ ID NO: 1296188 - RNA, 20 nt, Human
gccaggauggaacacggcca

SEQ ID NO: 1296189 - RNA, 22 nt, Human
gccaggauggaacacggccaca

SEQ ID NO: 1296190 - RNA, 21 nt, Human
gccaggagggacaaaggagcc

SEQ ID NO: 1296191 - RNA, 22 nt, Human
gccaggagggacaaaggagccu

SEQ ID NO: 1296192 - RNA, 23 nt, Human
gccaggagggacaaaggagccug

SEQ ID NO: 1296193 - RNA, 17 nt, Human
gccaggaggugccacug

SEQ ID NO: 1296194 - RNA, 18 nt, Human
gccaggaggugccacugg

SEQ ID NO: 1296195 - RNA, 17 nt, Human
gccagaccauggacacu

SEQ ID NO: 1296196 - RNA, 16 nt, Human
gccagaccauggacac

SEQ ID NO: 1296197 - RNA, 13 nt, Human
gccagaccaugga

SEQ ID NO: 1296198 - RNA, 16 nt, Human
gccagaccagcaggcu

SEQ ID NO: 1296199 - RNA, 18 nt, Human
gccagaccagcaggcugg

SEQ ID NO: 1296200 - RNA, 12 nt, Human
gccagauuuuuu

SEQ ID NO: 1296201 - RNA, 13 nt, Human
gccagauuuuuua

SEQ ID NO: 1296202 - RNA, 23 nt, Human
gccagauuuuuuaaaauuuauau

SEQ ID NO: 1296203 - RNA, 16 nt, Human
gccagauuuuuuaaaa

SEQ ID NO: 1296204 - RNA, 12 nt, Human
gccagcacacag

SEQ ID NO: 1296205 - RNA, 13 nt, Human
gccagcacacagg

SEQ ID NO: 1296206 - RNA, 15 nt, Human
gccagcacacagggc

SEQ ID NO: 1296207 - RNA, 16 nt, Human
gccagcacacagggca

SEQ ID NO: 1296208 - RNA, 17 nt, Human
gccagcacacagggcag

SEQ ID NO: 1296209 - RNA, 18 nt, Human
gccagcacacagggcagu

SEQ ID NO: 1296210 - RNA, 22 nt, Human
gccagcacacagggcagugagg

SEQ ID NO: 1296211 - RNA, 15 nt, Human
gccagcaccggacca

SEQ ID NO: 1296212 - RNA, 18 nt, Human
gccagcaccggaccagcc

SEQ ID NO: 1296213 - RNA, 19 nt, Human
gccagcaccggaccagccu

SEQ ID NO: 1296214 - RNA, 20 nt, Human
gccagcaccggaccagccug

SEQ ID NO: 1296215 - RNA, 22 nt, Human
gccagacaucaacagauaaaua

SEQ ID NO: 1296216 - RNA, 18 nt, Human
gccagacaugccacaagg

SEQ ID NO: 1296217 - RNA, 15 nt, Human
gccagaauuucaaac

SEQ ID NO: 1296218 - RNA, 16 nt, Human
gccagacacaggcccu

SEQ ID NO: 1296219 - RNA, 17 nt, Human
gccagacacaggcccuc

SEQ ID NO: 1296220 - RNA, 14 nt, Human
gccagaagcuacug

SEQ ID NO: 1296221 - RNA, 14 nt, Human
gccagaaguaccag

SEQ ID NO: 1296222 - RNA, 17 nt, Human
gccagaaguaccagacu

SEQ ID NO: 1296223 - RNA, 18 nt, Human
gccagaaguaccagacua

SEQ ID NO: 1296224 - RNA, 21 nt, Human
gccagaaguaccagacuagau

SEQ ID NO: 1296225 - RNA, 21 nt, Human
gccagcaccggaccagccugg

SEQ ID NO: 1296226 - RNA, 22 nt, Human
gccagcaccggaccagccuggc

SEQ ID NO: 1296227 - RNA, 14 nt, Human
gccagcaccuggca

SEQ ID NO: 1296228 - RNA, 23 nt, Human
gccagcacucgcuagcaguggca

SEQ ID NO: 1296229 - RNA, 18 nt, Human
gccagcacucgcuagcag

SEQ ID NO: 1296230 - RNA, 14 nt, Human
gccagcacuugucc

SEQ ID NO: 1296231 - RNA, 19 nt, Human
gccagcacuuguccagcug

SEQ ID NO: 1296232 - RNA, 20 nt, Human
gccagcacuuguccagcuga

SEQ ID NO: 1296233 - RNA, 13 nt, Human
gccagcagcaccu

SEQ ID NO: 1296234 - RNA, 14 nt, Human
gccagcagcaccug

SEQ ID NO: 1296235 - RNA, 16 nt, Human
gccagcagcaccugcc

SEQ ID NO: 1296236 - RNA, 19 nt, Human
gccagcagcaccugcccua

SEQ ID NO: 1296237 - RNA, 13 nt, Human
gccagcaucuggg

SEQ ID NO: 1296238 - RNA, 15 nt, Human
gccagcaucugggcc

SEQ ID NO: 1296239 - RNA, 14 nt, Human
gccagcaucugggc

SEQ ID NO: 1296240 - RNA, 16 nt, Human
gccauaugauuuacau

SEQ ID NO: 1296241 - RNA, 17 nt, Human
gccauaugauuuacauu

SEQ ID NO: 1296242 - RNA, 14 nt, Human
gccauauuaaauuu

SEQ ID NO: 1296243 - RNA, 16 nt, Human
gccauauuaaauuuuu

SEQ ID NO: 1296244 - RNA, 20 nt, Human
gccauauuaaauuuuuuguu

SEQ ID NO: 1296245 - RNA, 23 nt, Human
gccauauuaaauuuuuuguugac

SEQ ID NO: 1296246 - RNA, 14 nt, Human
gccaugucuucucc

SEQ ID NO: 1296247 - RNA, 22 nt, Human
gccaugucuucucccuggaaug

SEQ ID NO: 1296248 - RNA, 17 nt, Human
gccaugucaaacaaaua

SEQ ID NO: 1296249 - RNA, 14 nt, Human
gccauguccaaaga

SEQ ID NO: 1296250 - RNA, 15 nt, Human
gccauguccaaagag

SEQ ID NO: 1296251 - RNA, 18 nt, Human
gccauguccaaagaggcu

SEQ ID NO: 1296252 - RNA, 19 nt, Human
gccauguccaaagaggcug

SEQ ID NO: 1296253 - RNA, 22 nt, Human
gccauguccaaagaggcugccc

SEQ ID NO: 1296254 - RNA, 20 nt, Human
gccauucuccugccucagcc

SEQ ID NO: 1296255 - RNA, 17 nt, Human
gccauucuccacagcaa

SEQ ID NO: 1296256 - RNA, 19 nt, Human
gcccacgacacugcagccc

SEQ ID NO: 1296257 - RNA, 15 nt, Human
gcccacgacacugca

SEQ ID NO: 1296258 - RNA, 21 nt, Human
gccauucacuucauaauccag

SEQ ID NO: 1296259 - RNA, 22 nt, Human
gccauucacuucauaauccagu

SEQ ID NO: 1296260 - RNA, 21 nt, Human
gccaugucuucucccuggaau

SEQ ID NO: 1296261 - RNA, 17 nt, Human
gccauuccccgucucug

SEQ ID NO: 1296262 - RNA, 18 nt, Human
gccauuccccgucucugg

SEQ ID NO: 1296263 - RNA, 18 nt, Human
gcacuuggagacuuguau

SEQ ID NO: 1296264 - RNA, 13 nt, Human
gcacuuggcagcc

SEQ ID NO: 1296265 - RNA, 13 nt, Human
gcacuuggcccuu

SEQ ID NO: 1296266 - RNA, 15 nt, Human
gcacuuggcugcaua

SEQ ID NO: 1296267 - RNA, 16 nt, Human
gcacuuggcagccuug

SEQ ID NO: 1296268 - RNA, 17 nt, Human
gcacuuggggcaccuug

SEQ ID NO: 1296269 - RNA, 21 nt, Human
gcacuuggggcaccuugcucc

SEQ ID NO: 1296270 - RNA, 16 nt, Human
gccacccucaugcugu

SEQ ID NO: 1296271 - RNA, 15 nt, Human
gccacccucaugcug

SEQ ID NO: 1296272 - RNA, 12 nt, Human
gccacccugagg

SEQ ID NO: 1296273 - RNA, 13 nt, Human
gccacccugagga

SEQ ID NO: 1296274 - RNA, 14 nt, Human
gccacccugaggag

SEQ ID NO: 1296275 - RNA, 16 nt, Human
gccacccugaggaguc

SEQ ID NO: 1296276 - RNA, 19 nt, Human
gccacccugaggagucuga

SEQ ID NO: 1296277 - RNA, 20 nt, Human
gccacccugaggagucugag

SEQ ID NO: 1296278 - RNA, 22 nt, Human
gccacccugaggagucugaggu

SEQ ID NO: 1296279 - RNA, 23 nt, Human
gccacccugaggagucugagguc

SEQ ID NO: 1296280 - RNA, 13 nt, Human
gccacccucaugc

SEQ ID NO: 1296281 - RNA, 14 nt, Human
gccacccagcccca

SEQ ID NO: 1296282 - RNA, 15 nt, Human
gccacccagccccag

SEQ ID NO: 1296283 - RNA, 23 nt, Human
gccacccagccccagccagggcu

SEQ ID NO: 1296284 - RNA, 12 nt, Human
gccacccaggau

SEQ ID NO: 1296285 - RNA, 13 nt, Human
gccacccaggauc

SEQ ID NO: 1296286 - RNA, 19 nt, Human
gccacugccauuaaagaau

SEQ ID NO: 1296287 - RNA, 12 nt, Human
gccacuggggcu

SEQ ID NO: 1296288 - RNA, 14 nt, Human
gccacuggggcuca

SEQ ID NO: 1296289 - RNA, 15 nt, Human
gccacuggggcucag

SEQ ID NO: 1296290 - RNA, 16 nt, Human
gccacuggggcucaga

SEQ ID NO: 1296291 - RNA, 17 nt, Human
gccacuggggcucagag

SEQ ID NO: 1296292 - RNA, 18 nt, Human
gccacuggggcucagagc

SEQ ID NO: 1296293 - RNA, 19 nt, Human
gccacuggggcucagagcc

SEQ ID NO: 1296294 - RNA, 15 nt, Human
gccacuguguuccuu

SEQ ID NO: 1296295 - RNA, 16 nt, Human
gccacuguguuccuuc

SEQ ID NO: 1296296 - RNA, 12 nt, Human
gccacugccucu

SEQ ID NO: 1296297 - RNA, 13 nt, Human
gccacugccucuu

SEQ ID NO: 1296298 - RNA, 16 nt, Human
gccacugccucuuccu

SEQ ID NO: 1296299 - RNA, 17 nt, Human
gccacugccucuuccuc

SEQ ID NO: 1296300 - RNA, 18 nt, Human
gccacugccuucgcuucu

SEQ ID NO: 1296301 - RNA, 23 nt, Human
gccacugccuucgcuucuugccu

SEQ ID NO: 1296302 - RNA, 22 nt, Human
gccacugccuucgcuucuugcc

SEQ ID NO: 1296303 - RNA, 22 nt, Human
gccacuggagugugcguggugg

SEQ ID NO: 1296304 - RNA, 23 nt, Human
gccacugcuuuucccuuugugag

SEQ ID NO: 1296305 - RNA, 21 nt, Human
gccacuugaugacccccaacc

SEQ ID NO: 1296306 - RNA, 18 nt, Human
gccacuguguuccuuccg

SEQ ID NO: 1296307 - RNA, 20 nt, Human
gccacuguguuccuuccgcu

SEQ ID NO: 1296308 - RNA, 18 nt, Human
gccacuuaaaauguucac

SEQ ID NO: 1296309 - RNA, 13 nt, Human
gccacuuaaugua

SEQ ID NO: 1296310 - RNA, 16 nt, Human
gccacuuaauguaugu

SEQ ID NO: 1296311 - RNA, 18 nt, Human
gccacuuaauguauguua

SEQ ID NO: 1296312 - RNA, 19 nt, Human
gccacuuaauguauguuac

SEQ ID NO: 1296313 - RNA, 16 nt, Human
gccacuguuguuuugg

SEQ ID NO: 1296314 - RNA, 14 nt, Human
gccaccaagaggga

SEQ ID NO: 1296315 - RNA, 19 nt, Human
gccaccaagagggacgccu

SEQ ID NO: 1296316 - RNA, 13 nt, Human
gccaccacgcccg

SEQ ID NO: 1296317 - RNA, 22 nt, Human
gccaccaagagggacgccuggg

SEQ ID NO: 1296318 - RNA, 14 nt, Human
gccaccacgcccgg

SEQ ID NO: 1296319 - RNA, 12 nt, Human
gccaccaggcca

SEQ ID NO: 1296320 - RNA, 15 nt, Human
gccaccaggccaccu

SEQ ID NO: 1296321 - RNA, 18 nt, Human
gccaccaggccaccuccc

SEQ ID NO: 1296322 - RNA, 20 nt, Human
gccaccaggccaccucccca

SEQ ID NO: 1296323 - RNA, 11 nt, Human
gccaccaguuc

SEQ ID NO: 1296324 - RNA, 13 nt, Human
gccaccaguucuc

SEQ ID NO: 1296325 - RNA, 19 nt, Human
gccaccaguucucaugggu

SEQ ID NO: 1296326 - RNA, 13 nt, Human
gccaccaugcccg

SEQ ID NO: 1296327 - RNA, 15 nt, Human
gccacaugggaggcu

SEQ ID NO: 1296328 - RNA, 14 nt, Human
gccacauuuggaau

SEQ ID NO: 1296329 - RNA, 22 nt, Human
gccacauuuggaauacuuuuug

SEQ ID NO: 1296330 - RNA, 19 nt, Human
gccacauuuggaauacuuu

SEQ ID NO: 1296331 - RNA, 20 nt, Human
gcccaugggagcugguuaga

SEQ ID NO: 1296332 - RNA, 23 nt, Human
gcccacuagacccacuggacuca

SEQ ID NO: 1296333 - RNA, 15 nt, Human
gcccacuccaucugg

SEQ ID NO: 1296334 - RNA, 18 nt, Human
gcccacuccaucugguag

SEQ ID NO: 1296335 - RNA, 17 nt, Human
gcccacuagacccacug

SEQ ID NO: 1296336 - RNA, 19 nt, Human
gcccacuccaucugguaga

SEQ ID NO: 1296337 - RNA, 22 nt, Human
gcccccaguaucucuucagucu

SEQ ID NO: 1296338 - RNA, 19 nt, Human
gcccccaggguccugggag

SEQ ID NO: 1296339 - RNA, 14 nt, Human
gcccccagguaggg

SEQ ID NO: 1296340 - RNA, 14 nt, Human
gcccccucugcccu

SEQ ID NO: 1296341 - RNA, 17 nt, Human
gcccccaucauccucug

SEQ ID NO: 1296342 - RNA, 18 nt, Human
gcccccaucauccucugg

SEQ ID NO: 1296343 - RNA, 13 nt, Human
gcccccaucucau

SEQ ID NO: 1296344 - RNA, 18 nt, Human
gcccccaucucaugcccc

SEQ ID NO: 1296345 - RNA, 18 nt, Human
gcccccuccgcccugcca

SEQ ID NO: 1296346 - RNA, 20 nt, Human
gcccccuccgcccugccacu

SEQ ID NO: 1296347 - RNA, 22 nt, Human
gcccccuccgcccugccacuca

SEQ ID NO: 1296348 - RNA, 16 nt, Human
gcccccuccucuagcu

SEQ ID NO: 1296349 - RNA, 19 nt, Human
gcccccuccucuagcugug

SEQ ID NO: 1296350 - RNA, 20 nt, Human
gcccccuccucuagcugugg

SEQ ID NO: 1296351 - RNA, 21 nt, Human
gcccccuccucuagcuguggg

SEQ ID NO: 1296352 - RNA, 19 nt, Human
gcccccaucauccucuggc

SEQ ID NO: 1296353 - RNA, 13 nt, Human
gccccuggcagag

SEQ ID NO: 1296354 - RNA, 17 nt, Human
gccccuggcagagaugc

SEQ ID NO: 1296355 - RNA, 21 nt, Human
gccccuggcagagaugccucc

SEQ ID NO: 1296356 - RNA, 22 nt, Human
gccccuggcagagaugccuccc

SEQ ID NO: 1296357 - RNA, 23 nt, Human
gccccuggcagagaugccucccu

SEQ ID NO: 1296358 - RNA, 17 nt, Human
gcccuagacuggugcua

SEQ ID NO: 1296359 - RNA, 15 nt, Human
gcccuacagcacccu

SEQ ID NO: 1296360 - RNA, 21 nt, Human
gcccuaccugccccacuuguc

SEQ ID NO: 1296361 - RNA, 16 nt, Human
gcccuaccugccccac

SEQ ID NO: 1296362 - RNA, 18 nt, Human
gcccuaccugccccacuu

SEQ ID NO: 1296363 - RNA, 12 nt, Human
gcccuacuggga

SEQ ID NO: 1296364 - RNA, 18 nt, Human
gcccugcugcugccugcc

SEQ ID NO: 1296365 - RNA, 21 nt, Human
gcccugcugagucccaggcug

SEQ ID NO: 1296366 - RNA, 22 nt, Human
gcccugcugagucccaggcuga

SEQ ID NO: 1296367 - RNA, 23 nt, Human
gcccugcugagucccaggcugag

SEQ ID NO: 1296368 - RNA, 13 nt, Human
gcccugcugcccu

SEQ ID NO: 1296369 - RNA, 14 nt, Human
gcccugcugcccuc

SEQ ID NO: 1296370 - RNA, 15 nt, Human
gcccugcugcccucc

SEQ ID NO: 1296371 - RNA, 17 nt, Human
gcccugcugcccucccc

SEQ ID NO: 1296372 - RNA, 16 nt, Human
gcccugcugaguccca

SEQ ID NO: 1296373 - RNA, 15 nt, Human
gccgcugagcgagga

SEQ ID NO: 1296374 - RNA, 17 nt, Human
gccgcugagcgaggaga

SEQ ID NO: 1296375 - RNA, 16 nt, Human
gccgcugaguggcagg

SEQ ID NO: 1296376 - RNA, 12 nt, Human
gccgcugccacg

SEQ ID NO: 1296377 - RNA, 19 nt, Human
gccgcuuggcgaugccagc

SEQ ID NO: 1296378 - RNA, 12 nt, Human
gccggccagccc

SEQ ID NO: 1296379 - RNA, 14 nt, Human
gccggccagccccu

SEQ ID NO: 1296380 - RNA, 14 nt, Human
gccuggccuccugc

SEQ ID NO: 1296381 - RNA, 15 nt, Human
gccuggccuccugcc

SEQ ID NO: 1296382 - RNA, 16 nt, Human
gccuggccuccugccu

SEQ ID NO: 1296383 - RNA, 19 nt, Human
gccuggccuccugccucua

SEQ ID NO: 1296384 - RNA, 22 nt, Human
gccuggccuccugccucuacug

SEQ ID NO: 1296385 - RNA, 16 nt, Human
gccugggaaagccccu

SEQ ID NO: 1296386 - RNA, 18 nt, Human
gccugggaaagccccugc

SEQ ID NO: 1296387 - RNA, 16 nt, Human
gccugggacaacugcu

SEQ ID NO: 1296388 - RNA, 22 nt, Human
gccugggacaacugcucccacc

SEQ ID NO: 1296389 - RNA, 19 nt, Human
gccugggacaacugcuccc

SEQ ID NO: 1296390 - RNA, 10 nt, Human
gccugggagg

SEQ ID NO: 1296391 - RNA, 20 nt, Human
gccuguguccaugcgcucag

SEQ ID NO: 1296392 - RNA, 21 nt, Human
gccuguguccaugcgcucagg

SEQ ID NO: 1296393 - RNA, 23 nt, Human
gccuguguccaugcgcucagggc

SEQ ID NO: 1296394 - RNA, 22 nt, Human
gccugccuccccugccucacca

SEQ ID NO: 1296395 - RNA, 17 nt, Human
gccugccuguucccauu

SEQ ID NO: 1296396 - RNA, 14 nt, Human
gccugccuuuccau

SEQ ID NO: 1296397 - RNA, 23 nt, Human
gccugccuuuccauccauggcca

SEQ ID NO: 1296398 - RNA, 21 nt, Human
gccugcgccaccgcccagaga

SEQ ID NO: 1296399 - RNA, 22 nt, Human
gccugccuuuccauccauggcc

SEQ ID NO: 1296400 - RNA, 14 nt, Human
gccucuucugggag

SEQ ID NO: 1296401 - RNA, 15 nt, Human
gccucuucugggagg

SEQ ID NO: 1296402 - RNA, 18 nt, Human
gccucuucugggagggca

SEQ ID NO: 1296403 - RNA, 22 nt, Human
gccucuuccucccucauuccac

SEQ ID NO: 1296404 - RNA, 12 nt, Human
gccucuuccucc

SEQ ID NO: 1296405 - RNA, 11 nt, Human
gccucugugcu

SEQ ID NO: 1296406 - RNA, 12 nt, Human
gccucugugcug

SEQ ID NO: 1296407 - RNA, 14 nt, Human
gccucugugcugug

SEQ ID NO: 1296408 - RNA, 17 nt, Human
gccucugugcugugugu

SEQ ID NO: 1296409 - RNA, 18 nt, Human
gccucugugcugugugug

SEQ ID NO: 1296410 - RNA, 18 nt, Human
gccucugucuucuggacu

SEQ ID NO: 1296411 - RNA, 13 nt, Human
gccucuugaccag

SEQ ID NO: 1296412 - RNA, 14 nt, Human
gccucuugaccagg

SEQ ID NO: 1296413 - RNA, 15 nt, Human
gccucuugaccaggc

SEQ ID NO: 1296414 - RNA, 16 nt, Human
gccucuugaccaggcu

SEQ ID NO: 1296415 - RNA, 17 nt, Human
gccucuugaccaggcug

SEQ ID NO: 1296416 - RNA, 20 nt, Human
gccucuugaccaggcugccu

SEQ ID NO: 1296417 - RNA, 18 nt, Human
gccucuugagcaguggcu

SEQ ID NO: 1296418 - RNA, 19 nt, Human
gccucuugagcaguggcug

SEQ ID NO: 1296419 - RNA, 20 nt, Human
gccucuugagcaguggcugg

SEQ ID NO: 1296420 - RNA, 21 nt, Human
gccucuugagcaguggcuggu

SEQ ID NO: 1296421 - RNA, 22 nt, Human
gccucuugaccaggcugccucc

SEQ ID NO: 1296422 - RNA, 12 nt, Human
gccugccgagca

SEQ ID NO: 1296423 - RNA, 14 nt, Human
gccugccgagcaac

SEQ ID NO: 1296424 - RNA, 16 nt, Human
gccugccgagcaaccg

SEQ ID NO: 1296425 - RNA, 20 nt, Human
gccugccgagcaaccguggc

SEQ ID NO: 1296426 - RNA, 19 nt, Human
gccugccgagcaaccgugg

SEQ ID NO: 1296427 - RNA, 12 nt, Human
gccugccucacc

SEQ ID NO: 1296428 - RNA, 21 nt, Human
gccuccuggcugucugaggcu

SEQ ID NO: 1296429 - RNA, 20 nt, Human
gccucugucuggcaaugcca

SEQ ID NO: 1296430 - RNA, 23 nt, Human
gccucugucuggcaaugccacag

SEQ ID NO: 1296431 - RNA, 19 nt, Human
gccucugucuucuggacug

SEQ ID NO: 1296432 - RNA, 12 nt, Human
gccuccucaucc

SEQ ID NO: 1296433 - RNA, 15 nt, Human
gccuccucaucccgu

SEQ ID NO: 1296434 - RNA, 17 nt, Human
gccuccucaucccgugu

SEQ ID NO: 1296435 - RNA, 22 nt, Human
gccuccucaucccguguucucc

SEQ ID NO: 1296436 - RNA, 11 nt, Human
gccuccucccu

SEQ ID NO: 1296437 - RNA, 12 nt, Human
gccuccucccuc

SEQ ID NO: 1296438 - RNA, 13 nt, Human
gccuccucccucc

SEQ ID NO: 1296439 - RNA, 14 nt, Human
gccuccucccuccc

SEQ ID NO: 1296440 - RNA, 16 nt, Human
gccuccucccucccuc

SEQ ID NO: 1296441 - RNA, 17 nt, Human
gccuccucccucccucu

SEQ ID NO: 1296442 - RNA, 19 nt, Human
gccuccucccucccucucc

SEQ ID NO: 1296443 - RNA, 20 nt, Human
gccuccucccucccucuccg

SEQ ID NO: 1296444 - RNA, 21 nt, Human
gccuccucccucccucuccga

SEQ ID NO: 1296445 - RNA, 13 nt, Human
gccuccugccggc

SEQ ID NO: 1296446 - RNA, 17 nt, Human
gccuccugccggcuccu

SEQ ID NO: 1296447 - RNA, 20 nt, Human
gccuccugccggcuccuugg

SEQ ID NO: 1296448 - RNA, 12 nt, Human
gccuccugccuc

SEQ ID NO: 1296449 - RNA, 13 nt, Human
gccuccugccucu

SEQ ID NO: 1296450 - RNA, 14 nt, Human
gccggccccaggcu

SEQ ID NO: 1296451 - RNA, 12 nt, Human
gccggccccagg

SEQ ID NO: 1296452 - RNA, 14 nt, Human
gccuaccccgcaga

SEQ ID NO: 1296453 - RNA, 17 nt, Human
gccuaccccgcagacac

SEQ ID NO: 1296454 - RNA, 21 nt, Human
gccuaccccgcagacaccuug

SEQ ID NO: 1296455 - RNA, 17 nt, Human
gccuacuccaaaauguu

SEQ ID NO: 1296456 - RNA, 17 nt, Human
gccuguguucuuccugg

SEQ ID NO: 1296457 - RNA, 18 nt, Human
gccuguguucuuccuggc

SEQ ID NO: 1296458 - RNA, 20 nt, Human
gccuguguucuuccuggccg

SEQ ID NO: 1296459 - RNA, 21 nt, Human
gccuguuagcaugcuggugag

SEQ ID NO: 1296460 - RNA, 15 nt, Human
gccuguucauggcag

SEQ ID NO: 1296461 - RNA, 16 nt, Human
gccuguucauggcaga

SEQ ID NO: 1296462 - RNA, 20 nt, Human
gcuaggaagagcaggacucc

SEQ ID NO: 1296463 - RNA, 17 nt, Human
gcuaggaagaggagugg

SEQ ID NO: 1296464 - RNA, 12 nt, Human
gcuaggaagagg

SEQ ID NO: 1296465 - RNA, 15 nt, Human
gcuaggagcaaagcc

SEQ ID NO: 1296466 - RNA, 16 nt, Human
gcuaggagcaaagccu

SEQ ID NO: 1296467 - RNA, 17 nt, Human
gcuaggagcaaagccug

SEQ ID NO: 1296468 - RNA, 18 nt, Human
gcuaggagcaaagccugu

SEQ ID NO: 1296469 - RNA, 19 nt, Human
gcuaggagcaaagccuguu

SEQ ID NO: 1296470 - RNA, 16 nt, Human
gcuaguaucaaaagaa

SEQ ID NO: 1296471 - RNA, 16 nt, Human
gcuaggccagagccca

SEQ ID NO: 1296472 - RNA, 17 nt, Human
gcuaggccagagcccac

SEQ ID NO: 1296473 - RNA, 19 nt, Human
gcuaggccagagcccacuc

SEQ ID NO: 1296474 - RNA, 16 nt, Human
gcuauugucaccaggg

SEQ ID NO: 1296475 - RNA, 18 nt, Human
gcuaugucccaggaauca

SEQ ID NO: 1296476 - RNA, 18 nt, Human
gcuauggugcucugucua

SEQ ID NO: 1296477 - RNA, 13 nt, Human
gcuaugguuuucu

SEQ ID NO: 1296478 - RNA, 20 nt, Human
gcuauugucaccagggcugg

SEQ ID NO: 1296479 - RNA, 21 nt, Human
gcuauugucaccagggcugga

SEQ ID NO: 1296480 - RNA, 14 nt, Human
gcuauuuaaaacuu

SEQ ID NO: 1296481 - RNA, 13 nt, Human
gcuauuuaaaacu

SEQ ID NO: 1296482 - RNA, 14 nt, Human
gcuauuucaucuau

SEQ ID NO: 1296483 - RNA, 15 nt, Human
gcuauuucaucuauu

SEQ ID NO: 1296484 - RNA, 18 nt, Human
gcucaggagcccugggag

SEQ ID NO: 1296485 - RNA, 15 nt, Human
gcucaggagcccugg

SEQ ID NO: 1296486 - RNA, 21 nt, Human
gcucaggagcccugggaggcu

SEQ ID NO: 1296487 - RNA, 23 nt, Human
gcucagggccaugcugaggccug

SEQ ID NO: 1296488 - RNA, 17 nt, Human
gcucagggggcgccugu

SEQ ID NO: 1296489 - RNA, 16 nt, Human
gcucagguacuuguaa

SEQ ID NO: 1296490 - RNA, 15 nt, Human
gcucaggucccuggg

SEQ ID NO: 1296491 - RNA, 14 nt, Human
gcucaggagcccug

SEQ ID NO: 1296492 - RNA, 18 nt, Human
gcucaccuugugcugggg

SEQ ID NO: 1296493 - RNA, 20 nt, Human
gcucacguccugagaaagcu

SEQ ID NO: 1296494 - RNA, 21 nt, Human
gcucaggugcuggggccuggu

SEQ ID NO: 1296495 - RNA, 19 nt, Human
gcucaggucccuggggcua

SEQ ID NO: 1296496 - RNA, 21 nt, Human
gcucaggucacauaaaacuuu

SEQ ID NO: 1296497 - RNA, 17 nt, Human
gcucaggugcuggggcc

SEQ ID NO: 1296498 - RNA, 20 nt, Human
gcucuacagcuaaucagcau

SEQ ID NO: 1296499 - RNA, 22 nt, Human
gcucuacagcuaaucagcauuc

SEQ ID NO: 1296500 - RNA, 15 nt, Human
gcucuaauucacagu

SEQ ID NO: 1296501 - RNA, 16 nt, Human
gcucuaauucacagug

SEQ ID NO: 1296502 - RNA, 18 nt, Human
gcucuaauucacagugcu

SEQ ID NO: 1296503 - RNA, 19 nt, Human
gcucuaauucacagugcuc

SEQ ID NO: 1296504 - RNA, 19 nt, Human
gcucuaauguuugcauaua

SEQ ID NO: 1296505 - RNA, 16 nt, Human
gcucuacaucuucugc

SEQ ID NO: 1296506 - RNA, 17 nt, Human
gcucuacaucuucugcc

SEQ ID NO: 1296507 - RNA, 14 nt, Human
gcuccccacucugc

SEQ ID NO: 1296508 - RNA, 16 nt, Human
gcuccccacucugcuc

SEQ ID NO: 1296509 - RNA, 17 nt, Human
gcuccccacucugcucu

SEQ ID NO: 1296510 - RNA, 18 nt, Human
gcuccccacucugcucug

SEQ ID NO: 1296511 - RNA, 19 nt, Human
gcuccccacucugcucuga

SEQ ID NO: 1296512 - RNA, 22 nt, Human
gcuccccacucugcucugaugc

SEQ ID NO: 1296513 - RNA, 20 nt, Human
gcuccccacucugcucugau

SEQ ID NO: 1296514 - RNA, 19 nt, Human
gcuccccuaaagccucaaa

SEQ ID NO: 1296515 - RNA, 14 nt, Human
gcuccccuccccaa

SEQ ID NO: 1296516 - RNA, 22 nt, Human
gcuccugccaccacgcccggcu

SEQ ID NO: 1296517 - RNA, 24 nt, Human
gcuccugaccaguugcagucacuc

SEQ ID NO: 1296518 - RNA, 21 nt, Human
gcuccugaccaguugcaguca

SEQ ID NO: 1296519 - RNA, 12 nt, Human
gcuccugcccac

SEQ ID NO: 1296520 - RNA, 21 nt, Human
gcuccucugucucgagcgccc

SEQ ID NO: 1296521 - RNA, 22 nt, Human
gcuccucugucucgagcgcccu

SEQ ID NO: 1296522 - RNA, 23 nt, Human
gcuccucugucucgagcgcccug

SEQ ID NO: 1296523 - RNA, 22 nt, Human
gcuccucuuccaugcugugcgc

SEQ ID NO: 1296524 - RNA, 14 nt, Human
gcuccucuucccca

SEQ ID NO: 1296525 - RNA, 15 nt, Human
gcuccucuuccccag

SEQ ID NO: 1296526 - RNA, 16 nt, Human
gcuccucuuccccaga

SEQ ID NO: 1296527 - RNA, 23 nt, Human
gcuccucuuccccagacgccugg

SEQ ID NO: 1296528 - RNA, 16 nt, Human
gcuccugacacugcug

SEQ ID NO: 1296529 - RNA, 17 nt, Human
gcuccugacacugcugg

SEQ ID NO: 1296530 - RNA, 18 nt, Human
gcuccugacacugcugga

SEQ ID NO: 1296531 - RNA, 19 nt, Human
gcuccugacacugcuggag

SEQ ID NO: 1296532 - RNA, 15 nt, Human
gcuccugaccaguug

SEQ ID NO: 1296533 - RNA, 19 nt, Human
gcuccugaccaguugcagu

SEQ ID NO: 1296534 - RNA, 20 nt, Human
gcuccugaccaguugcaguc

SEQ ID NO: 1296535 - RNA, 21 nt, Human
gcuccccuccccaacugacca

SEQ ID NO: 1296536 - RNA, 12 nt, Human
gcuccucugcuu

SEQ ID NO: 1296537 - RNA, 13 nt, Human
gcuccucugucuc

SEQ ID NO: 1296538 - RNA, 17 nt, Human
gcuccucugucucgagc

SEQ ID NO: 1296539 - RNA, 18 nt, Human
gcucuaauguuugcauau

SEQ ID NO: 1296540 - RNA, 17 nt, Human
gcucuaauguuugcaua

SEQ ID NO: 1296541 - RNA, 16 nt, Human
gcucuaauguuugcau

SEQ ID NO: 1296542 - RNA, 15 nt, Human
gcucuaauguuugca

SEQ ID NO: 1296543 - RNA, 23 nt, Human
gcucuaacgccugagcccaggga

SEQ ID NO: 1296544 - RNA, 22 nt, Human
gcucuaacgccugagcccaggg

SEQ ID NO: 1296545 - RNA, 12 nt, Human
gcucuaauacau

SEQ ID NO: 1296546 - RNA, 16 nt, Human
gcucggggugcacagg

SEQ ID NO: 1296547 - RNA, 20 nt, Human
gcucuaacgccugagcccag

SEQ ID NO: 1296548 - RNA, 21 nt, Human
gcucuaacgccugagcccagg

SEQ ID NO: 1296549 - RNA, 14 nt, Human
gcucggccugcccc

SEQ ID NO: 1296550 - RNA, 15 nt, Human
gcucggccugccccc

SEQ ID NO: 1296551 - RNA, 17 nt, Human
gcucggccugcccccac

SEQ ID NO: 1296552 - RNA, 21 nt, Human
gcucggccugcccccacccca

SEQ ID NO: 1296553 - RNA, 22 nt, Human
gcuccugcuaacggugcucagg

SEQ ID NO: 1296554 - RNA, 23 nt, Human
gcuccugcuaacggugcucaggg

SEQ ID NO: 1296555 - RNA, 13 nt, Human
gcucgcucccugc

SEQ ID NO: 1296556 - RNA, 15 nt, Human
gcucggaggaagccc

SEQ ID NO: 1296557 - RNA, 23 nt, Human
gcucuggagcccacuguacuugc

SEQ ID NO: 1296558 - RNA, 13 nt, Human
gcucuggagggga

SEQ ID NO: 1296559 - RNA, 15 nt, Human
gcucuggaggggagg

SEQ ID NO: 1296560 - RNA, 16 nt, Human
gcucuggaggggaggg

SEQ ID NO: 1296561 - RNA, 20 nt, Human
gcucugagcaaauguggcuc

SEQ ID NO: 1296562 - RNA, 21 nt, Human
gcucugagcaaauguggcucc

SEQ ID NO: 1296563 - RNA, 17 nt, Human
gcucugagaggcccugg

SEQ ID NO: 1296564 - RNA, 18 nt, Human
gcucugagaggcccugga

SEQ ID NO: 1296565 - RNA, 20 nt, Human
gcucugagaggcccuggauc

SEQ ID NO: 1296566 - RNA, 23 nt, Human
gcucugagaggcccuggaucagc

SEQ ID NO: 1296567 - RNA, 13 nt, Human
gcucugagagucu

SEQ ID NO: 1296568 - RNA, 14 nt, Human
gcucugagagucua

SEQ ID NO: 1296569 - RNA, 18 nt, Human
gcucugagagucuagauu

SEQ ID NO: 1296570 - RNA, 20 nt, Human
gcucugagagucuagauucu

SEQ ID NO: 1296571 - RNA, 21 nt, Human
gcucugagagucuagauucuc

SEQ ID NO: 1296572 - RNA, 18 nt, Human
gcucugcaauuccccucu

SEQ ID NO: 1296573 - RNA, 23 nt, Human
gcucugcaauuccccucugcugc

SEQ ID NO: 1296574 - RNA, 11 nt, Human
gcucugagaac

SEQ ID NO: 1296575 - RNA, 10 nt, Human
gcucugagaa

SEQ ID NO: 1296576 - RNA, 15 nt, Human
gcucugagaggcccu

SEQ ID NO: 1296577 - RNA, 16 nt, Human
gcucugagaggcccug

SEQ ID NO: 1296578 - RNA, 19 nt, Human
gcucugucgcccaggcugg

SEQ ID NO: 1296579 - RNA, 23 nt, Human
gcucugucgcccaggcuggagug

SEQ ID NO: 1296580 - RNA, 20 nt, Human
gcucuguuaauaaucucaca

SEQ ID NO: 1296581 - RNA, 14 nt, Human
gcucuguucuuccu

SEQ ID NO: 1296582 - RNA, 18 nt, Human
gcucuguucuuccucagc

SEQ ID NO: 1296583 - RNA, 19 nt, Human
gcucuguucuuccucagcc

SEQ ID NO: 1296584 - RNA, 20 nt, Human
gcucuguucuuccucagcca

SEQ ID NO: 1296585 - RNA, 21 nt, Human
gcucuguucuuccucagccag

SEQ ID NO: 1296586 - RNA, 22 nt, Human
gcucuguucuuccucagccagc

SEQ ID NO: 1296587 - RNA, 23 nt, Human
gcucuguucuuccucagccagcc

SEQ ID NO: 1296588 - RNA, 18 nt, Human
gcucuggauaacaagacu

SEQ ID NO: 1296589 - RNA, 15 nt, Human
gcucuuauuucauca

SEQ ID NO: 1296590 - RNA, 14 nt, Human
gcucuuauuucauc

SEQ ID NO: 1296591 - RNA, 13 nt, Human
gcucuuauuucau

SEQ ID NO: 1296592 - RNA, 19 nt, Human
gcucuuagcagcuuccaga

SEQ ID NO: 1296593 - RNA, 17 nt, Human
gcucuuagcagcuucca

SEQ ID NO: 1296594 - RNA, 18 nt, Human
gcucuuagcagcuuccag

SEQ ID NO: 1296595 - RNA, 14 nt, Human
gcucuuaauugcca

SEQ ID NO: 1296596 - RNA, 13 nt, Human
gcucuuaauugcc

SEQ ID NO: 1296597 - RNA, 16 nt, Human
gcucuuagcagcuucc

SEQ ID NO: 1296598 - RNA, 14 nt, Human
gcucuucauguuuc

SEQ ID NO: 1296599 - RNA, 14 nt, Human
gcugaaauucuccu

SEQ ID NO: 1296600 - RNA, 15 nt, Human
gcugaaauucuccug

SEQ ID NO: 1296601 - RNA, 16 nt, Human
gcugaaauucuccugg

SEQ ID NO: 1296602 - RNA, 17 nt, Human
gcugaaauucuccugga

SEQ ID NO: 1296603 - RNA, 18 nt, Human
gcugaaauucuccuggag

SEQ ID NO: 1296604 - RNA, 15 nt, Human
gcugaaauuuuauau

SEQ ID NO: 1296605 - RNA, 17 nt, Human
gcugaaauuuuauaugc

SEQ ID NO: 1296606 - RNA, 16 nt, Human
gcugaauagcuucucc

SEQ ID NO: 1296607 - RNA, 17 nt, Human
gcugaauguugggacug

SEQ ID NO: 1296608 - RNA, 20 nt, Human
gcugaauguugggacugcua

SEQ ID NO: 1296609 - RNA, 23 nt, Human
gcugaauguugggacugcuaaau

SEQ ID NO: 1296610 - RNA, 13 nt, Human
gcugaauguuuuu

SEQ ID NO: 1296611 - RNA, 17 nt, Human
gcugaauguuuuucuaa

SEQ ID NO: 1296612 - RNA, 15 nt, Human
gcugaauguuuuucu

SEQ ID NO: 1296613 - RNA, 14 nt, Human
gcugagcgccagga

SEQ ID NO: 1296614 - RNA, 16 nt, Human
gcugagcucacaaggc

SEQ ID NO: 1296615 - RNA, 19 nt, Human
gcugagcucacaaggcagc

SEQ ID NO: 1296616 - RNA, 20 nt, Human
gcugagcucacaaggcagca

SEQ ID NO: 1296617 - RNA, 21 nt, Human
gcugagcucacaaggcagcaa

SEQ ID NO: 1296618 - RNA, 22 nt, Human
gcugagcucacaaggcagcaag

SEQ ID NO: 1296619 - RNA, 23 nt, Human
gcugagcucacaaggcagcaagg

SEQ ID NO: 1296620 - RNA, 14 nt, Human
gcugagcucucugu

SEQ ID NO: 1296621 - RNA, 13 nt, Human
gcugagcucugag

SEQ ID NO: 1296622 - RNA, 14 nt, Human
gcugagcucugaga

SEQ ID NO: 1296623 - RNA, 15 nt, Human
gcugagcucugagag

SEQ ID NO: 1296624 - RNA, 16 nt, Human
gcugagcucugagagg

SEQ ID NO: 1296625 - RNA, 17 nt, Human
gcugagcucugagaggc

SEQ ID NO: 1296626 - RNA, 18 nt, Human
gcugagcucugagaggcc

SEQ ID NO: 1296627 - RNA, 20 nt, Human
gcuguaugucuuaaaaccug

SEQ ID NO: 1296628 - RNA, 17 nt, Human
gcuguauuaagccacuu

SEQ ID NO: 1296629 - RNA, 23 nt, Human
gcuguaaggauccggaaagaaga

SEQ ID NO: 1296630 - RNA, 13 nt, Human
gcuguaaggcucu

SEQ ID NO: 1296631 - RNA, 15 nt, Human
gcuguaaggcucuag

SEQ ID NO: 1296632 - RNA, 16 nt, Human
gcuguaaggcucuaga

SEQ ID NO: 1296633 - RNA, 17 nt, Human
gcuguaaggcucuagau

SEQ ID NO: 1296634 - RNA, 23 nt, Human
gcuguaaggcucuagaucauaag

SEQ ID NO: 1296635 - RNA, 22 nt, Human
gcuguaaucuaugaauucuaag

SEQ ID NO: 1296636 - RNA, 19 nt, Human
gcuguaauguuaauauuga

SEQ ID NO: 1296637 - RNA, 16 nt, Human
gcuguacacugcacga

SEQ ID NO: 1296638 - RNA, 12 nt, Human
gcuguacacugc

SEQ ID NO: 1296639 - RNA, 21 nt, Human
gcuguaacuacuuuauaacua

SEQ ID NO: 1296640 - RNA, 15 nt, Human
gcuguaacugccagg

SEQ ID NO: 1296641 - RNA, 12 nt, Human
gcugugaccugc

SEQ ID NO: 1296642 - RNA, 13 nt, Human
gcugugaccugcu

SEQ ID NO: 1296643 - RNA, 14 nt, Human
gcugugaccugcug

SEQ ID NO: 1296644 - RNA, 15 nt, Human
gcugugaccugcuga

SEQ ID NO: 1296645 - RNA, 16 nt, Human
gcugugaccugcugag

SEQ ID NO: 1296646 - RNA, 17 nt, Human
gcugugaccugcugagc

SEQ ID NO: 1296647 - RNA, 18 nt, Human
gcugugaccugcugagcu

SEQ ID NO: 1296648 - RNA, 19 nt, Human
gcugugaccugcugagcuc

SEQ ID NO: 1296649 - RNA, 20 nt, Human
gcugugaccugcugagcucu

SEQ ID NO: 1296650 - RNA, 23 nt, Human
gcugugaccugcugagcucugag

SEQ ID NO: 1296651 - RNA, 22 nt, Human
gcugugaccugcugagcucuga

SEQ ID NO: 1296652 - RNA, 17 nt, Human
gcugugcuuaugguacc

SEQ ID NO: 1296653 - RNA, 22 nt, Human
gcuguggaccauggaguggcag

SEQ ID NO: 1296654 - RNA, 14 nt, Human
gcuguggcaggcca

SEQ ID NO: 1296655 - RNA, 23 nt, Human
gcuguggcaggccagcugugguu

SEQ ID NO: 1296656 - RNA, 21 nt, Human
gcuguggcaugggugaagagg

SEQ ID NO: 1296657 - RNA, 12 nt, Human
gcuguggccagg

SEQ ID NO: 1296658 - RNA, 13 nt, Human
gcuguggccagga

SEQ ID NO: 1296659 - RNA, 14 nt, Human
gcuguggccaggag

SEQ ID NO: 1296660 - RNA, 13 nt, Human
gcuuaaaacuuug

SEQ ID NO: 1296661 - RNA, 18 nt, Human
gcuuaaaacuuugaaguu

SEQ ID NO: 1296662 - RNA, 18 nt, Human
gcuuaaagaauucaaauu

SEQ ID NO: 1296663 - RNA, 22 nt, Human
gcuuaaacccauauuguaaaac

SEQ ID NO: 1296664 - RNA, 17 nt, Human
gcuuaaaauaagcaggu

SEQ ID NO: 1296665 - RNA, 21 nt, Human
gcuuaaaauaagcagguggau

SEQ ID NO: 1296666 - RNA, 12 nt, Human
gcuuaaaauaca

SEQ ID NO: 1296667 - RNA, 13 nt, Human
gcuuaaaauacaa

SEQ ID NO: 1296668 - RNA, 14 nt, Human
gcuuaaaauacaag

SEQ ID NO: 1296669 - RNA, 18 nt, Human
gcuuaaaauacaagacug

SEQ ID NO: 1296670 - RNA, 19 nt, Human
gcuuaacagggaacgugau

SEQ ID NO: 1296671 - RNA, 15 nt, Human
gcuucaauuuauacc

SEQ ID NO: 1296672 - RNA, 14 nt, Human
gcuucccuuuccug

SEQ ID NO: 1296673 - RNA, 14 nt, Human
gcuucccugacuca

SEQ ID NO: 1296674 - RNA, 18 nt, Human
gcuucccugacucauucu

SEQ ID NO: 1296675 - RNA, 13 nt, Human
gcuucccugaagc

SEQ ID NO: 1296676 - RNA, 15 nt, Human
gcuucccugaagcuc

SEQ ID NO: 1296677 - RNA, 16 nt, Human
gcuucccugaagcucc

SEQ ID NO: 1296678 - RNA, 14 nt, Human
gcuuccuucauuuc

SEQ ID NO: 1296679 - RNA, 17 nt, Human
gcuuccuucauuuccuc

SEQ ID NO: 1296680 - RNA, 15 nt, Human
gcuucccgcucagcc

SEQ ID NO: 1296681 - RNA, 16 nt, Human
gcuucccgcucagccc

SEQ ID NO: 1296682 - RNA, 17 nt, Human
gcuucccgcucagcccu

SEQ ID NO: 1296683 - RNA, 18 nt, Human
gcuucccgcucagcccuc

SEQ ID NO: 1296684 - RNA, 23 nt, Human
gcuucccgcucagcccucccugc

SEQ ID NO: 1296685 - RNA, 13 nt, Human
gcuucccuaaucu

SEQ ID NO: 1296686 - RNA, 14 nt, Human
gcuucccuaaucua

SEQ ID NO: 1296687 - RNA, 20 nt, Human
gcuucccuccccucuaguuu

SEQ ID NO: 1296688 - RNA, 18 nt, Human
gcuucccaagggcugccg

SEQ ID NO: 1296689 - RNA, 13 nt, Human
gcuucccaucccc

SEQ ID NO: 1296690 - RNA, 16 nt, Human
gcuucccauccccagc

SEQ ID NO: 1296691 - RNA, 18 nt, Human
gcuucccauccccagcga

SEQ ID NO: 1296692 - RNA, 17 nt, Human
gcuucccauccccagcg

SEQ ID NO: 1296693 - RNA, 19 nt, Human
gcuugaaacccguggcgcu

SEQ ID NO: 1296694 - RNA, 19 nt, Human
gcuuggcgaugccagccaa

SEQ ID NO: 1296695 - RNA, 18 nt, Human
gcuuggcgaugccagcca

SEQ ID NO: 1296696 - RNA, 22 nt, Human
gcuugggaaaggugguguuucu

SEQ ID NO: 1296697 - RNA, 21 nt, Human
gcuugggaagacuccuagcug

SEQ ID NO: 1296698 - RNA, 12 nt, Human
gcuucuuucuag

SEQ ID NO: 1296699 - RNA, 15 nt, Human
gcuucuuucuagaaa

SEQ ID NO: 1296700 - RNA, 21 nt, Human
gcuucuuucuagaaagagaaa

SEQ ID NO: 1296701 - RNA, 18 nt, Human
gcuucgggcccuucccac

SEQ ID NO: 1296702 - RNA, 20 nt, Human
gcuucgggcccuucccacag

SEQ ID NO: 1296703 - RNA, 21 nt, Human
gcuucuugccucugugcugug

SEQ ID NO: 1296704 - RNA, 20 nt, Human
gcuucuugccucugugcugu

SEQ ID NO: 1296705 - RNA, 14 nt, Human
gcuugggccuaggc

SEQ ID NO: 1296706 - RNA, 18 nt, Human
gcuugggccuaggcugca

SEQ ID NO: 1296707 - RNA, 21 nt, Human
gcuugggccuaggcugcauug

SEQ ID NO: 1296708 - RNA, 19 nt, Human
gcuugggccuaggcugcau

SEQ ID NO: 1296709 - RNA, 16 nt, Human
gcuuggggcucacaca

SEQ ID NO: 1296710 - RNA, 20 nt, Human
gcuuggggcucacacaccug

SEQ ID NO: 1296711 - RNA, 15 nt, Human
gcuugggaauuuuau

SEQ ID NO: 1296712 - RNA, 14 nt, Human
gcuugggauuugcu

SEQ ID NO: 1296713 - RNA, 17 nt, Human
gcuugggauuugcugug

SEQ ID NO: 1296714 - RNA, 17 nt, Human
gcuugggcagcaucccc

SEQ ID NO: 1296715 - RNA, 15 nt, Human
gcuugggauuugcug

SEQ ID NO: 1296716 - RNA, 17 nt, Human
gcuuggggcuggagagg

SEQ ID NO: 1296717 - RNA, 22 nt, Human
gcuuggggggugaugagggcag

SEQ ID NO: 1296718 - RNA, 14 nt, Human
gcuuggggggugau

SEQ ID NO: 1296719 - RNA, 12 nt, Human
gcuggagugcag

SEQ ID NO: 1296720 - RNA, 15 nt, Human
gcuggaggagcccag

SEQ ID NO: 1296721 - RNA, 16 nt, Human
gcuggaggagcccagg

SEQ ID NO: 1296722 - RNA, 17 nt, Human
gcuggaggagcccaggc

SEQ ID NO: 1296723 - RNA, 20 nt, Human
gcuggaggagcccaggccag

SEQ ID NO: 1296724 - RNA, 22 nt, Human
gcuggaggagcccaggccagga

SEQ ID NO: 1296725 - RNA, 21 nt, Human
gcuggaggagcccaggccagg

SEQ ID NO: 1296726 - RNA, 17 nt, Human
gcuggagcucugcccau

SEQ ID NO: 1296727 - RNA, 13 nt, Human
gcuggaggagccc

SEQ ID NO: 1296728 - RNA, 14 nt, Human
gcuggaggagccca

SEQ ID NO: 1296729 - RNA, 21 nt, Human
gcuggacucucagucucugag

SEQ ID NO: 1296730 - RNA, 22 nt, Human
gcuggacucucagucucugagc

SEQ ID NO: 1296731 - RNA, 19 nt, Human
gcugggucgcccuggacug

SEQ ID NO: 1296732 - RNA, 17 nt, Human
gcugggugguacccucu

SEQ ID NO: 1296733 - RNA, 16 nt, Human
gcuggguucauuugug

SEQ ID NO: 1296734 - RNA, 18 nt, Human
gcugggucgcccuggacu

SEQ ID NO: 1296735 - RNA, 17 nt, Human
gcugggucgcccuggac

SEQ ID NO: 1296736 - RNA, 16 nt, Human
gcugggucgcccugga

SEQ ID NO: 1296737 - RNA, 14 nt, Human
gcuggagugcagug

SEQ ID NO: 1296738 - RNA, 22 nt, Human
gcugggauuacaggcuccugcc

SEQ ID NO: 1296739 - RNA, 23 nt, Human
gcugggauuacaggcuccugcca

SEQ ID NO: 1296740 - RNA, 18 nt, Human
gcugggauuacaggugug

SEQ ID NO: 1296741 - RNA, 17 nt, Human
gcugggauuacaggugu

SEQ ID NO: 1296742 - RNA, 16 nt, Human
gcugcugccugccugg

SEQ ID NO: 1296743 - RNA, 22 nt, Human
gcugcugcucuuggcuggaccc

SEQ ID NO: 1296744 - RNA, 12 nt, Human
gcugcugccugc

SEQ ID NO: 1296745 - RNA, 20 nt, Human
gcugcugaucgccuucccca

SEQ ID NO: 1296746 - RNA, 18 nt, Human
gcugcugcccauguuuca

SEQ ID NO: 1296747 - RNA, 13 nt, Human
gcugccuggaccc

SEQ ID NO: 1296748 - RNA, 18 nt, Human
gcugcucggggugcacag

SEQ ID NO: 1296749 - RNA, 19 nt, Human
gcugcucggggugcacagg

SEQ ID NO: 1296750 - RNA, 20 nt, Human
gcugcucggggugcacagga

SEQ ID NO: 1296751 - RNA, 21 nt, Human
gcugcucggggugcacaggag

SEQ ID NO: 1296752 - RNA, 22 nt, Human
gcugcucggggugcacaggagg

SEQ ID NO: 1296753 - RNA, 17 nt, Human
gcugcugaucgccuucc

SEQ ID NO: 1296754 - RNA, 20 nt, Human
gcugccuggaagagcagccc

SEQ ID NO: 1296755 - RNA, 12 nt, Human
gcugccuggacc

SEQ ID NO: 1296756 - RNA, 14 nt, Human
gcugccuggacccg

SEQ ID NO: 1296757 - RNA, 20 nt, Human
gcugccuagauucagggaaa

SEQ ID NO: 1296758 - RNA, 18 nt, Human
gcugccccaucagugcuc

SEQ ID NO: 1296759 - RNA, 16 nt, Human
gcugccgcgcagugug

SEQ ID NO: 1296760 - RNA, 17 nt, Human
gcugccggggcagcccc

SEQ ID NO: 1296761 - RNA, 19 nt, Human
gcugccggucgcccuuugc

SEQ ID NO: 1296762 - RNA, 19 nt, Human
gcugccggggcagcccccu

SEQ ID NO: 1296763 - RNA, 13 nt, Human
gcugccguggggc

SEQ ID NO: 1296764 - RNA, 22 nt, Human
gcugccguggggccgccgccuc

SEQ ID NO: 1296765 - RNA, 13 nt, Human
gcugccacugagg

SEQ ID NO: 1296766 - RNA, 12 nt, Human
gcugccacugag

SEQ ID NO: 1296767 - RNA, 17 nt, Human
gcugccagcucuguauc

SEQ ID NO: 1296768 - RNA, 18 nt, Human
gcugccagcucuguauca

SEQ ID NO: 1296769 - RNA, 13 nt, Human
gcugccaggagca

SEQ ID NO: 1296770 - RNA, 21 nt, Human
gcugagggcaguucgcagcca

SEQ ID NO: 1296771 - RNA, 22 nt, Human
gcugagggcaguucgcagccac

SEQ ID NO: 1296772 - RNA, 12 nt, Human
gcugagggcagu

SEQ ID NO: 1296773 - RNA, 20 nt, Human
gcugagggcaguucgcagcc

SEQ ID NO: 1296774 - RNA, 19 nt, Human
gcugagcucugagaggccc

SEQ ID NO: 1296775 - RNA, 20 nt, Human
gcugagcucugagaggcccu

SEQ ID NO: 1296776 - RNA, 21 nt, Human
gcugagcucugagaggcccug

SEQ ID NO: 1296777 - RNA, 22 nt, Human
gcugagcucugagaggcccugg

SEQ ID NO: 1296778 - RNA, 23 nt, Human
gcugagcucugagaggcccugga

SEQ ID NO: 1296779 - RNA, 12 nt, Human
gcugaggagcag

SEQ ID NO: 1296780 - RNA, 16 nt, Human
gcugaggagcagcagg

SEQ ID NO: 1296781 - RNA, 18 nt, Human
gcugaggaggcaccuaca

SEQ ID NO: 1296782 - RNA, 15 nt, Human
gcugaggcuggcaca

SEQ ID NO: 1296783 - RNA, 16 nt, Human
gcugaggcuggcacag

SEQ ID NO: 1296784 - RNA, 18 nt, Human
gcugaggcuggcacagga

SEQ ID NO: 1296785 - RNA, 14 nt, Human
gcugagggagccug

SEQ ID NO: 1296786 - RNA, 22 nt, Human
ggcugggaauggaggggcagag

SEQ ID NO: 1296787 - RNA, 21 nt, Human
ggcugggaauggaggggcaga

SEQ ID NO: 1296788 - RNA, 17 nt, Human
ggcugggaacagugugc

SEQ ID NO: 1296789 - RNA, 18 nt, Human
ggcugggacguggcucag

SEQ ID NO: 1296790 - RNA, 19 nt, Human
ggcugggacguggcucagc

SEQ ID NO: 1296791 - RNA, 23 nt, Human
ggcugggacguggcucagccagc

SEQ ID NO: 1296792 - RNA, 24 nt, Human
ggcuggcuccagaugcagggcagu

SEQ ID NO: 1296793 - RNA, 22 nt, Human
ggcuggcuccagaugcagggca

SEQ ID NO: 1296794 - RNA, 12 nt, Human
ggcuggcugagg

SEQ ID NO: 1296795 - RNA, 14 nt, Human
ggcuggcugagggc

SEQ ID NO: 1296796 - RNA, 15 nt, Human
ggcuggcugagggca

SEQ ID NO: 1296797 - RNA, 10 nt, Human
ggcuggcugg

SEQ ID NO: 1296798 - RNA, 13 nt, Human
ggcuggcuggccu

SEQ ID NO: 1296799 - RNA, 15 nt, Human
ggcuggcuggccuca

SEQ ID NO: 1296800 - RNA, 13 nt, Human
ggcuggcccugcc

SEQ ID NO: 1296801 - RNA, 14 nt, Human
ggcuggcccugccc

SEQ ID NO: 1296802 - RNA, 15 nt, Human
ggcuggcccugcccu

SEQ ID NO: 1296803 - RNA, 16 nt, Human
ggcuggcccugcccug

SEQ ID NO: 1296804 - RNA, 17 nt, Human
ggcuggcccugcccugg

SEQ ID NO: 1296805 - RNA, 13 nt, Human
ggcugccccucuc

SEQ ID NO: 1296806 - RNA, 13 nt, Human
ggcuggaugagcu

SEQ ID NO: 1296807 - RNA, 14 nt, Human
ggcuggaugagcuc

SEQ ID NO: 1296808 - RNA, 15 nt, Human
ggcuggaugagcucc

SEQ ID NO: 1296809 - RNA, 16 nt, Human
ggcuggaugagcuccc

SEQ ID NO: 1296810 - RNA, 18 nt, Human
ggcuggaugagcucccac

SEQ ID NO: 1296811 - RNA, 23 nt, Human
ggcuggaugagcucccacaagcc

SEQ ID NO: 1296812 - RNA, 19 nt, Human
ggcuggaugagcucccaca

SEQ ID NO: 1296813 - RNA, 13 nt, Human
ggcuggcacagga

SEQ ID NO: 1296814 - RNA, 14 nt, Human
ggcuggcacaggac

SEQ ID NO: 1296815 - RNA, 15 nt, Human
ggcuggcacaggaca

SEQ ID NO: 1296816 - RNA, 23 nt, Human
ggcuccuccaggguggcagcaac

SEQ ID NO: 1296817 - RNA, 17 nt, Human
ggcuccgugugggagac

SEQ ID NO: 1296818 - RNA, 17 nt, Human
ggcuccucccggugccc

SEQ ID NO: 1296819 - RNA, 20 nt, Human
ggcuccucgagaucccaaca

SEQ ID NO: 1296820 - RNA, 12 nt, Human
ggcuccugccac

SEQ ID NO: 1296821 - RNA, 9 nt, Human
ggcuccugc

SEQ ID NO: 1296822 - RNA, 13 nt, Human
ggcuccugccacc

SEQ ID NO: 1296823 - RNA, 17 nt, Human
ggcuccuauucaacaca

SEQ ID NO: 1296824 - RNA, 18 nt, Human
ggcuccgugugggagacc

SEQ ID NO: 1296825 - RNA, 14 nt, Human
ggcuccguguggga

SEQ ID NO: 1296826 - RNA, 15 nt, Human
ggcuccgugugggag

SEQ ID NO: 1296827 - RNA, 16 nt, Human
ggcuccgugugggaga

SEQ ID NO: 1296828 - RNA, 18 nt, Human
ggcucgaaucucugugcc

SEQ ID NO: 1296829 - RNA, 19 nt, Human
ggcucgaaucucugugccu

SEQ ID NO: 1296830 - RNA, 20 nt, Human
ggcucgaaucucugugccuu

SEQ ID NO: 1296831 - RNA, 20 nt, Human
ggcuccuugugggccugggc

SEQ ID NO: 1296832 - RNA, 12 nt, Human
ggcuccuuucca

SEQ ID NO: 1296833 - RNA, 22 nt, Human
ggcuccuugugggccugggcuc

SEQ ID NO: 1296834 - RNA, 13 nt, Human
ggcucgaaucucu

SEQ ID NO: 1296835 - RNA, 15 nt, Human
ggcucgaaucucugu

SEQ ID NO: 1296836 - RNA, 17 nt, Human
ggcucgaaucucugugc

SEQ ID NO: 1296837 - RNA, 22 nt, Human
ggcugcaguucgacucugugcu

SEQ ID NO: 1296838 - RNA, 23 nt, Human
ggcugcaguucgacucugugcug

SEQ ID NO: 1296839 - RNA, 21 nt, Human
ggcugaaaggaagcugugcgu

SEQ ID NO: 1296840 - RNA, 14 nt, Human
ggcugaaauucucc

SEQ ID NO: 1296841 - RNA, 16 nt, Human
ggcugaaauucuccug

SEQ ID NO: 1296842 - RNA, 17 nt, Human
ggcugaaauucuccugg

SEQ ID NO: 1296843 - RNA, 18 nt, Human
ggcugaaauucuccugga

SEQ ID NO: 1296844 - RNA, 19 nt, Human
ggcugaaauucuccuggag

SEQ ID NO: 1296845 - RNA, 21 nt, Human
ggcugaaauucuccuggaggu

SEQ ID NO: 1296846 - RNA, 22 nt, Human
ggcugaaauucuccuggagguc

SEQ ID NO: 1296847 - RNA, 16 nt, Human
aaaaaggacaucagca

SEQ ID NO: 1296848 - RNA, 15 nt, Human
aaaaagggaggggga

SEQ ID NO: 1296849 - RNA, 19 nt, Human
aaaaagcuuccaugauucu

SEQ ID NO: 1296850 - RNA, 20 nt, Human
aaaaagcuccaaaugcagcu

SEQ ID NO: 1296851 - RNA, 18 nt, Human
aaaaagcgaaaaaaucag

SEQ ID NO: 1296852 - RNA, 12 nt, Human
aaaaagcuuaaa

SEQ ID NO: 1296853 - RNA, 15 nt, Human
aaaaagcuuaaaacu

SEQ ID NO: 1296854 - RNA, 17 nt, Human
aaaaagcuuaaaacuuu

SEQ ID NO: 1296855 - RNA, 19 nt, Human
aaaaagcuuaaaacuuuga

SEQ ID NO: 1296856 - RNA, 20 nt, Human
aaaaagcuuaaaacuuugaa

SEQ ID NO: 1296857 - RNA, 13 nt, Human
aaaaagguuuaca

SEQ ID NO: 1296858 - RNA, 18 nt, Human
aaaaagguuuacagaauu

SEQ ID NO: 1296859 - RNA, 17 nt, Human
aaaaagugaaauaaugu

SEQ ID NO: 1296860 - RNA, 11 nt, Human
aaaaaagauga

SEQ ID NO: 1296861 - RNA, 13 nt, Human
aaaaaaaagcuuc

SEQ ID NO: 1296862 - RNA, 12 nt, Human
aaaaaaaauaca

SEQ ID NO: 1296863 - RNA, 14 nt, Human
aaaaaaaaguugca

SEQ ID NO: 1296864 - RNA, 13 nt, Human
aaaaaaaauuacu

SEQ ID NO: 1296865 - RNA, 20 nt, Human
aaaaaaguugcagcuguuuu

SEQ ID NO: 1296866 - RNA, 17 nt, Human
aaaaagcuaauaccagu

SEQ ID NO: 1296867 - RNA, 14 nt, Human
aaaaaaaaauguuc

SEQ ID NO: 1296868 - RNA, 12 nt, Human
aaaaaaaacagu

SEQ ID NO: 1296869 - RNA, 15 nt, Human
ggcuucaugccagcu

SEQ ID NO: 1296870 - RNA, 16 nt, Human
ggcuucagguccaggc

SEQ ID NO: 1296871 - RNA, 16 nt, Human
ggcuucaugccagcua

SEQ ID NO: 1296872 - RNA, 13 nt, Human
ggcuucaggucca

SEQ ID NO: 1296873 - RNA, 17 nt, Human
ggcuucccauccccagc

SEQ ID NO: 1296874 - RNA, 18 nt, Human
ggcuucccauccccagcg

SEQ ID NO: 1296875 - RNA, 12 nt, Human
ggcuucccaagg

SEQ ID NO: 1296876 - RNA, 20 nt, Human
ggcuucccaagggcugccgg

SEQ ID NO: 1296877 - RNA, 12 nt, Human
ggcuuccuggag

SEQ ID NO: 1296878 - RNA, 13 nt, Human
ggcuuccuggagc

SEQ ID NO: 1296879 - RNA, 14 nt, Human
ggcuuccuggagca

SEQ ID NO: 1296880 - RNA, 15 nt, Human
ggcuuccuggagcag

SEQ ID NO: 1296881 - RNA, 16 nt, Human
ggcuuccuggagcaga

SEQ ID NO: 1296882 - RNA, 21 nt, Human
ggcuuccuggagcagaagcag

SEQ ID NO: 1296883 - RNA, 11 nt, Human
ggcuuccuggu

SEQ ID NO: 1296884 - RNA, 12 nt, Human
ggcuuccuggug

SEQ ID NO: 1296885 - RNA, 13 nt, Human
ggcuuccuggugc

SEQ ID NO: 1296886 - RNA, 14 nt, Human
ggcuuccuggugcu

SEQ ID NO: 1296887 - RNA, 18 nt, Human
ggcuuccuggugcuggag

SEQ ID NO: 1296888 - RNA, 20 nt, Human
gggaaaaacuuuggaaccag

SEQ ID NO: 1296889 - RNA, 17 nt, Human
ggcuuccuggugcugga

SEQ ID NO: 1296890 - RNA, 17 nt, Human
gggaaaauuauuugcau

SEQ ID NO: 1296891 - RNA, 18 nt, Human
gggaaaauuauuugcaua

SEQ ID NO: 1296892 - RNA, 22 nt, Human
gggaaacagcaucuccaagcag

SEQ ID NO: 1296893 - RNA, 14 nt, Human
gggaaacuggccau

SEQ ID NO: 1296894 - RNA, 21 nt, Human
gggaaacuggccauggccugc

SEQ ID NO: 1296895 - RNA, 14 nt, Human
gggaaacuuggcuc

SEQ ID NO: 1296896 - RNA, 14 nt, Human
gggaaagcaaagca

SEQ ID NO: 1296897 - RNA, 18 nt, Human
ggcuggugugguacagag

SEQ ID NO: 1296898 - RNA, 19 nt, Human
ggcuggugugguacagaga

SEQ ID NO: 1296899 - RNA, 20 nt, Human
ggcuggugugguacagagaa

SEQ ID NO: 1296900 - RNA, 21 nt, Human
ggcuggugugguacagagaag

SEQ ID NO: 1296901 - RNA, 22 nt, Human
ggcuggugugguacagagaagc

SEQ ID NO: 1296902 - RNA, 23 nt, Human
ggcuggugugguacagagaagcc

SEQ ID NO: 1296903 - RNA, 16 nt, Human
ggcugguguuaacaga

SEQ ID NO: 1296904 - RNA, 17 nt, Human
ggcugguguuaacagaa

SEQ ID NO: 1296905 - RNA, 23 nt, Human
ggcuggugggugccuaggccugg

SEQ ID NO: 1296906 - RNA, 15 nt, Human
ggcuggugugguaca

SEQ ID NO: 1296907 - RNA, 16 nt, Human
ggcuggugugguacag

SEQ ID NO: 1296908 - RNA, 17 nt, Human
ggcuggugugguacaga

SEQ ID NO: 1296909 - RNA, 14 nt, Human
aaaaagugaaauaa

SEQ ID NO: 1296910 - RNA, 20 nt, Human
aaaaaguggguuuuuuaguu

SEQ ID NO: 1296911 - RNA, 22 nt, Human
aaaaaguggguuuuuuaguuga

SEQ ID NO: 1296912 - RNA, 12 nt, Human
aaaaagugucaa

SEQ ID NO: 1296913 - RNA, 23 nt, Human
aaaaaguggguuuuuuaguugaa

SEQ ID NO: 1296914 - RNA, 15 nt, Human
aaaaaguugcagcug

SEQ ID NO: 1296915 - RNA, 20 nt, Human
aaaaaguugcagcuguuuug

SEQ ID NO: 1296916 - RNA, 22 nt, Human
aaaaaguugcagcuguuuuguu

SEQ ID NO: 1296917 - RNA, 23 nt, Human
aaaaaguugcagcuguuuuguug

SEQ ID NO: 1296918 - RNA, 16 nt, Human
ggcuucagcugccagu

SEQ ID NO: 1296919 - RNA, 21 nt, Human
ggcugguguuaacagaaggga

SEQ ID NO: 1296920 - RNA, 14 nt, Human
ggcugucaucugug

SEQ ID NO: 1296921 - RNA, 17 nt, Human
ggcugucaucugugcac

SEQ ID NO: 1296922 - RNA, 19 nt, Human
aaaagggacugagaaauuu

SEQ ID NO: 1296923 - RNA, 13 nt, Human
aaaagguuuacag

SEQ ID NO: 1296924 - RNA, 14 nt, Human
aaaagguuuacaga

SEQ ID NO: 1296925 - RNA, 16 nt, Human
aaaagguuuacagaau

SEQ ID NO: 1296926 - RNA, 16 nt, Human
aaaagggacugagaaa

SEQ ID NO: 1296927 - RNA, 20 nt, Human
aaaaggcuagguacacagcu

SEQ ID NO: 1296928 - RNA, 14 nt, Human
gggcaggaguagcu

SEQ ID NO: 1296929 - RNA, 15 nt, Human
gggcaggaguagcug

SEQ ID NO: 1296930 - RNA, 19 nt, Human
gggcaggaguagcugagcu

SEQ ID NO: 1296931 - RNA, 14 nt, Human
aaaaggccuggggu

SEQ ID NO: 1296932 - RNA, 20 nt, Human
gggcaggaguagcugagcuc

SEQ ID NO: 1296933 - RNA, 13 nt, Human
aaaaggccugggg

SEQ ID NO: 1296934 - RNA, 16 nt, Human
gggcagagcuggugcg

SEQ ID NO: 1296935 - RNA, 15 nt, Human
gggcagcacaggagg

SEQ ID NO: 1296936 - RNA, 12 nt, Human
gggcagcagcca

SEQ ID NO: 1296937 - RNA, 13 nt, Human
gggcagcagccag

SEQ ID NO: 1296938 - RNA, 14 nt, Human
gggcagcagccagc

SEQ ID NO: 1296939 - RNA, 15 nt, Human
gggcagcagccagcc

SEQ ID NO: 1296940 - RNA, 17 nt, Human
gggcagcagccagcccu

SEQ ID NO: 1296941 - RNA, 18 nt, Human
gggcagcagccagcccug

SEQ ID NO: 1296942 - RNA, 19 nt, Human
gggcagcagccagcccugc

SEQ ID NO: 1296943 - RNA, 20 nt, Human
gggcagcagccagcccugcc

SEQ ID NO: 1296944 - RNA, 22 nt, Human
gggcagcagccagcccugccug

SEQ ID NO: 1296945 - RNA, 23 nt, Human
gggcagcagccagcccugccugg

SEQ ID NO: 1296946 - RNA, 14 nt, Human
gggcagcagggcua

SEQ ID NO: 1296947 - RNA, 11 nt, Human
gggcagccagg

SEQ ID NO: 1296948 - RNA, 20 nt, Human
gggcagccagggagagccca

SEQ ID NO: 1296949 - RNA, 14 nt, Human
gggcagccagggag

SEQ ID NO: 1296950 - RNA, 18 nt, Human
gggcagccagggagagcc

SEQ ID NO: 1296951 - RNA, 19 nt, Human
gggcagccagggagagccc

SEQ ID NO: 1296952 - RNA, 14 nt, Human
gggaggggcuccuu

SEQ ID NO: 1296953 - RNA, 15 nt, Human
gggaggggcuccuuu

SEQ ID NO: 1296954 - RNA, 15 nt, Human
gggagggggauccga

SEQ ID NO: 1296955 - RNA, 18 nt, Human
gggauuaugggucacagg

SEQ ID NO: 1296956 - RNA, 20 nt, Human
gggauuaugggucacaggaa

SEQ ID NO: 1296957 - RNA, 23 nt, Human
gggauuauuagaaucaaacauuu

SEQ ID NO: 1296958 - RNA, 22 nt, Human
gggauucaggaaaaggccuggg

SEQ ID NO: 1296959 - RNA, 21 nt, Human
gggauucaggaaaaggccugg

SEQ ID NO: 1296960 - RNA, 14 nt, Human
gggagggggagagg

SEQ ID NO: 1296961 - RNA, 12 nt, Human
gggagggcucug

SEQ ID NO: 1296962 - RNA, 14 nt, Human
gggagggcucugag

SEQ ID NO: 1296963 - RNA, 15 nt, Human
gggagggcucugagg

SEQ ID NO: 1296964 - RNA, 16 nt, Human
gggagggcucugaggc

SEQ ID NO: 1296965 - RNA, 18 nt, Human
gggagggcucugaggcgc

SEQ ID NO: 1296966 - RNA, 20 nt, Human
gggagggcucugaggcgccc

SEQ ID NO: 1296967 - RNA, 19 nt, Human
gggagggcucugaggcgcc

SEQ ID NO: 1296968 - RNA, 16 nt, Human
gggcagagccaggaag

SEQ ID NO: 1296969 - RNA, 14 nt, Human
gggcagagccagga

SEQ ID NO: 1296970 - RNA, 13 nt, Human
gggcagagccagg

SEQ ID NO: 1296971 - RNA, 12 nt, Human
gggcagagccca

SEQ ID NO: 1296972 - RNA, 14 nt, Human
gggcagagcccaag

SEQ ID NO: 1296973 - RNA, 16 nt, Human
gggcagcaauuuaaau

SEQ ID NO: 1296974 - RNA, 19 nt, Human
gggcagagcuggcucugag

SEQ ID NO: 1296975 - RNA, 13 nt, Human
gggcagagcuggu

SEQ ID NO: 1296976 - RNA, 15 nt, Human
gggcagagcuggugc

SEQ ID NO: 1296977 - RNA, 11 nt, Human
gggcagagcug

SEQ ID NO: 1296978 - RNA, 16 nt, Human
gggcagagcuggcucu

SEQ ID NO: 1296979 - RNA, 17 nt, Human
gggcagagcuggcucug

SEQ ID NO: 1296980 - RNA, 19 nt, Human
gggauucugguuccagggu

SEQ ID NO: 1296981 - RNA, 12 nt, Human
gggcaaagccag

SEQ ID NO: 1296982 - RNA, 14 nt, Human
aaaauauauacuaa

SEQ ID NO: 1296983 - RNA, 15 nt, Human
aaaauauauugaaua

SEQ ID NO: 1296984 - RNA, 14 nt, Human
aaaauauguaccaa

SEQ ID NO: 1296985 - RNA, 18 nt, Human
aaaauauauaucaaauau

SEQ ID NO: 1296986 - RNA, 17 nt, Human
aaaauauauacuaaaca

SEQ ID NO: 1296987 - RNA, 13 nt, Human
aaaauauauacua

SEQ ID NO: 1296988 - RNA, 13 nt, Human
aaaauauagcuaa

SEQ ID NO: 1296989 - RNA, 15 nt, Human
aaaauagcguucuug

SEQ ID NO: 1296990 - RNA, 16 nt, Human
aaaauagcguucuugu

SEQ ID NO: 1296991 - RNA, 17 nt, Human
aaaauagcguucuugua

SEQ ID NO: 1296992 - RNA, 18 nt, Human
aaaauagcguucuuguaa

SEQ ID NO: 1296993 - RNA, 19 nt, Human
aaaauagcguucuuguaau

SEQ ID NO: 1296994 - RNA, 20 nt, Human
aaaauagcguucuuguaauu

SEQ ID NO: 1296995 - RNA, 20 nt, Human
aaaauagcuaaauaccucaa

SEQ ID NO: 1296996 - RNA, 12 nt, Human
aaaauaggcagg

SEQ ID NO: 1296997 - RNA, 13 nt, Human
aaaauaggcagga

SEQ ID NO: 1296998 - RNA, 22 nt, Human
aaaauagggacuaucuaucuua

SEQ ID NO: 1296999 - RNA, 20 nt, Human
aaaauaggguauauuuuccu

SEQ ID NO: 1297000 - RNA, 21 nt, Human
aaaauaggguauauuuuccua

SEQ ID NO: 1297001 - RNA, 23 nt, Human
aaaauaguuaagacaugauuucc

SEQ ID NO: 1297002 - RNA, 13 nt, Human
aaaauaguuugga

SEQ ID NO: 1297003 - RNA, 16 nt, Human
aaaauaguuuggauau

SEQ ID NO: 1297004 - RNA, 19 nt, Human
aaaauaguuuggauaugua

SEQ ID NO: 1297005 - RNA, 22 nt, Human
aaaauaguuuggauauguaaaa

SEQ ID NO: 1297006 - RNA, 20 nt, Human
aaaauaguuuggauauguaa

SEQ ID NO: 1297007 - RNA, 13 nt, Human
aaaauauaaaaua

SEQ ID NO: 1297008 - RNA, 10 nt, Human
aaaauauaac

SEQ ID NO: 1297009 - RNA, 21 nt, Human
aaaauaauuuuuauauuugaa

SEQ ID NO: 1297010 - RNA, 23 nt, Human
aaaauaauuuuuauauuugaaau

SEQ ID NO: 1297011 - RNA, 23 nt, Human
aaaauaaaugucaccagguacuu

SEQ ID NO: 1297012 - RNA, 15 nt, Human
aaaauacaagacugc

SEQ ID NO: 1297013 - RNA, 14 nt, Human
aaaauacaagacug

SEQ ID NO: 1297014 - RNA, 16 nt, Human
aaaauacggugggggu

SEQ ID NO: 1297015 - RNA, 15 nt, Human
aaaauacuauucuga

SEQ ID NO: 1297016 - RNA, 17 nt, Human
aaaauagcaaaagaaga

SEQ ID NO: 1297017 - RNA, 14 nt, Human
aaaauaaauauauc

SEQ ID NO: 1297018 - RNA, 17 nt, Human
aaaauaaauauaucuac

SEQ ID NO: 1297019 - RNA, 18 nt, Human
aaaagguuuacagaauuu

SEQ ID NO: 1297020 - RNA, 14 nt, Human
aaaagguuuaugaa

SEQ ID NO: 1297021 - RNA, 19 nt, Human
aaaagguuuaugaaaaaga

SEQ ID NO: 1297022 - RNA, 20 nt, Human
aaaagguuuaugaaaaagaa

SEQ ID NO: 1297023 - RNA, 23 nt, Human
aaaagguuuaugaaaaagaagaa

SEQ ID NO: 1297024 - RNA, 13 nt, Human
aaaaguaauaaaa

SEQ ID NO: 1297025 - RNA, 15 nt, Human
aaaauaaagaaugga

SEQ ID NO: 1297026 - RNA, 16 nt, Human
aaaauaaagaauggaa

SEQ ID NO: 1297027 - RNA, 18 nt, Human
aaaagccuguuuaagaga

SEQ ID NO: 1297028 - RNA, 16 nt, Human
aaaagccuguuuaaga

SEQ ID NO: 1297029 - RNA, 11 nt, Human
aaaagccugcu

SEQ ID NO: 1297030 - RNA, 17 nt, Human
aaaagcgugagcuuaaa

SEQ ID NO: 1297031 - RNA, 19 nt, Human
aaaagcgugagcuuaaaau

SEQ ID NO: 1297032 - RNA, 21 nt, Human
aaaagcgugagcuuaaaauac

SEQ ID NO: 1297033 - RNA, 23 nt, Human
aaaagcgugagcuuaaaauacaa

SEQ ID NO: 1297034 - RNA, 21 nt, Human
aaaacuuuaugcuaagugaaa

SEQ ID NO: 1297035 - RNA, 11 nt, Human
aaaacugcucc

SEQ ID NO: 1297036 - RNA, 22 nt, Human
aaaacugcuccuccuccuguau

SEQ ID NO: 1297037 - RNA, 13 nt, Human
aaaacuuuaaagc

SEQ ID NO: 1297038 - RNA, 14 nt, Human
aaaacuuuccucgc

SEQ ID NO: 1297039 - RNA, 16 nt, Human
aaaacuuuccucgccu

SEQ ID NO: 1297040 - RNA, 20 nt, Human
aaaacuuuccucgccugaca

SEQ ID NO: 1297041 - RNA, 22 nt, Human
aaaagcuccauuuuuagugaaa

SEQ ID NO: 1297042 - RNA, 14 nt, Human
aaaagcuaagagaa

SEQ ID NO: 1297043 - RNA, 16 nt, Human
aaaagcuaauaccagu

SEQ ID NO: 1297044 - RNA, 14 nt, Human
aaaagcuagaauug

SEQ ID NO: 1297045 - RNA, 17 nt, Human
aaaagcuauaaagcagu

SEQ ID NO: 1297046 - RNA, 21 nt, Human
aaaagcuauaaagcaguauuu

SEQ ID NO: 1297047 - RNA, 20 nt, Human
aaaagcuauuuaaagcaucu

SEQ ID NO: 1297048 - RNA, 15 nt, Human
aaaagcuuacaaaua

SEQ ID NO: 1297049 - RNA, 21 nt, Human
aaaagcuuagcuuuagaaaca

SEQ ID NO: 1297050 - RNA, 23 nt, Human
aaaagcuuagcuuuagaaacagu

SEQ ID NO: 1297051 - RNA, 14 nt, Human
aaaagcuuccauga

SEQ ID NO: 1297052 - RNA, 17 nt, Human
gggacugcggaggaagg

SEQ ID NO: 1297053 - RNA, 16 nt, Human
gggacugcuaaauaaa

SEQ ID NO: 1297054 - RNA, 15 nt, Human
gggacugcuaaauaa

SEQ ID NO: 1297055 - RNA, 13 nt, Human
gggacuguaaguu

SEQ ID NO: 1297056 - RNA, 15 nt, Human
gggacugucgcugcu

SEQ ID NO: 1297057 - RNA, 17 nt, Human
gggacugucgcugcuuc

SEQ ID NO: 1297058 - RNA, 14 nt, Human
gggagacugggcug

SEQ ID NO: 1297059 - RNA, 16 nt, Human
gggagacugggcugag

SEQ ID NO: 1297060 - RNA, 19 nt, Human
gggagacugggcugaggga

SEQ ID NO: 1297061 - RNA, 20 nt, Human
gggagacugggcugagggag

SEQ ID NO: 1297062 - RNA, 13 nt, Human
gggagggccuggg

SEQ ID NO: 1297063 - RNA, 21 nt, Human
gggagggcggcaggggccugg

SEQ ID NO: 1297064 - RNA, 22 nt, Human
gggagggcggcaggggccugga

SEQ ID NO: 1297065 - RNA, 15 nt, Human
gggagggcagagcug

SEQ ID NO: 1297066 - RNA, 18 nt, Human
gggagggcagagcuggug

SEQ ID NO: 1297067 - RNA, 20 nt, Human
gggagggcagagcuggugcg

SEQ ID NO: 1297068 - RNA, 11 nt, Human
gggagggcagc

SEQ ID NO: 1297069 - RNA, 13 nt, Human
gggagggcagcag

SEQ ID NO: 1297070 - RNA, 20 nt, Human
gggaggcagagguugcagug

SEQ ID NO: 1297071 - RNA, 21 nt, Human
aaaaauuaaaccggaccaucu

SEQ ID NO: 1297072 - RNA, 12 nt, Human
aaaaauuaaaau

SEQ ID NO: 1297073 - RNA, 23 nt, Human
aaaaauguuuuuggucuuuuaua

SEQ ID NO: 1297074 - RNA, 12 nt, Human
aaaaaugucuua

SEQ ID NO: 1297075 - RNA, 20 nt, Human
aaaaauguucuauuuuaauu

SEQ ID NO: 1297076 - RNA, 17 nt, Human
aaaaauguauuuuaugu

SEQ ID NO: 1297077 - RNA, 17 nt, Human
aaaaaucuuccaauuua

SEQ ID NO: 1297078 - RNA, 14 nt, Human
aaaaaugaucuaaa

SEQ ID NO: 1297079 - RNA, 20 nt, Human
aaaaaugauuucaguagcac

SEQ ID NO: 1297080 - RNA, 16 nt, Human
aaaaaugauuucagua

SEQ ID NO: 1297081 - RNA, 21 nt, Human
gggaaaugguacuguacagcu

SEQ ID NO: 1297082 - RNA, 14 nt, Human
gggaacaauuuggc

SEQ ID NO: 1297083 - RNA, 21 nt, Human
gggaacaauuuggcaauuuug

SEQ ID NO: 1297084 - RNA, 22 nt, Human
gggaacacuggggacuuggccu

SEQ ID NO: 1297085 - RNA, 20 nt, Human
gggaaagcaaagcacagaga

SEQ ID NO: 1297086 - RNA, 16 nt, Human
gggaaagccccugccc

SEQ ID NO: 1297087 - RNA, 22 nt, Human
gggaaaucaaaagggccaaaga

SEQ ID NO: 1297088 - RNA, 15 nt, Human
gggaacacuggggac

SEQ ID NO: 1297089 - RNA, 19 nt, Human
aaaaauuaucuauagcuaa

SEQ ID NO: 1297090 - RNA, 16 nt, Human
aaaaauuacuuaguau

SEQ ID NO: 1297091 - RNA, 19 nt, Human
aaaacugcucauaugaugu

SEQ ID NO: 1297092 - RNA, 17 nt, Human
aaaacuacuucuuuuuu

SEQ ID NO: 1297093 - RNA, 14 nt, Human
aaaacugcauuuca

SEQ ID NO: 1297094 - RNA, 19 nt, Human
aaaaccaagccguggcuuc

SEQ ID NO: 1297095 - RNA, 13 nt, Human
aaaacuaaaaacu

SEQ ID NO: 1297096 - RNA, 16 nt, Human
aaaacuaaaaacuaga

SEQ ID NO: 1297097 - RNA, 22 nt, Human
aaaacuacaaccaauggaaugu

SEQ ID NO: 1297098 - RNA, 21 nt, Human
aaaacuacaaaucaaguauuu

SEQ ID NO: 1297099 - RNA, 19 nt, Human
aaaauuuuuaaucuuuaau

SEQ ID NO: 1297100 - RNA, 19 nt, Human
aaaauuuuuucucuaggaa

SEQ ID NO: 1297101 - RNA, 22 nt, Human
aaaauuuuuucucuaggaaaua

SEQ ID NO: 1297102 - RNA, 16 nt, Human
aaaauuuuuaaucuuu

SEQ ID NO: 1297103 - RNA, 20 nt, Human
aaaauuguuaauuuuuccua

SEQ ID NO: 1297104 - RNA, 13 nt, Human
aaaauugugauca

SEQ ID NO: 1297105 - RNA, 17 nt, Human
aaaauguauaugcacuu

SEQ ID NO: 1297106 - RNA, 13 nt, Human
aaacaaagaaauu

SEQ ID NO: 1297107 - RNA, 15 nt, Human
aaaauguaugcaugu

SEQ ID NO: 1297108 - RNA, 20 nt, Human
aaacaaacucguuuuuuaca

SEQ ID NO: 1297109 - RNA, 18 nt, Human
aaacaaagaguucaagaa

SEQ ID NO: 1297110 - RNA, 16 nt, Human
aaacaaagcaauucuu

SEQ ID NO: 1297111 - RNA, 12 nt, Human
aaacaaagaugu

SEQ ID NO: 1297112 - RNA, 12 nt, Human
aaacaacacugu

SEQ ID NO: 1297113 - RNA, 17 nt, Human
aaacaaggaugaauuaa

SEQ ID NO: 1297114 - RNA, 15 nt, Human
aaacaaccaugucau

SEQ ID NO: 1297115 - RNA, 17 nt, Human
aaacaacucuuugagaa

SEQ ID NO: 1297116 - RNA, 17 nt, Human
aaacaaccaugucauuu

SEQ ID NO: 1297117 - RNA, 13 nt, Human
aaacaagaaaaau

SEQ ID NO: 1297118 - RNA, 17 nt, Human
aaacaagaaaaauaaag

SEQ ID NO: 1297119 - RNA, 18 nt, Human
aaacaagaaaaauaaaga

SEQ ID NO: 1297120 - RNA, 19 nt, Human
aaacaagaaaaauaaagaa

SEQ ID NO: 1297121 - RNA, 20 nt, Human
aaacaagaaaaauaaagaaa

SEQ ID NO: 1297122 - RNA, 12 nt, Human
aaaauggaauac

SEQ ID NO: 1297123 - RNA, 22 nt, Human
aaaauggaggccauugugugag

SEQ ID NO: 1297124 - RNA, 21 nt, Human
aaaauggcaggggguggaauu

SEQ ID NO: 1297125 - RNA, 19 nt, Human
aaaauggccauuugcuuuu

SEQ ID NO: 1297126 - RNA, 12 nt, Human
aaaauguaggag

SEQ ID NO: 1297127 - RNA, 17 nt, Human
aaaauguaggagacugu

SEQ ID NO: 1297128 - RNA, 21 nt, Human
aaaauguaggcuuaguuugug

SEQ ID NO: 1297129 - RNA, 14 nt, Human
aaaauguauaugca

SEQ ID NO: 1297130 - RNA, 19 nt, Human
aaaauauuauuuuauuaua

SEQ ID NO: 1297131 - RNA, 14 nt, Human
aaaauauucaauaa

SEQ ID NO: 1297132 - RNA, 18 nt, Human
gggcugcuuccuccugga

SEQ ID NO: 1297133 - RNA, 19 nt, Human
gggcugcuuccuccuggaa

SEQ ID NO: 1297134 - RNA, 20 nt, Human
gggcugcuuccuccuggaaa

SEQ ID NO: 1297135 - RNA, 13 nt, Human
gggcuggaggagc

SEQ ID NO: 1297136 - RNA, 14 nt, Human
gggcuggaggagcc

SEQ ID NO: 1297137 - RNA, 15 nt, Human
gggcuggaggagccc

SEQ ID NO: 1297138 - RNA, 16 nt, Human
gggcuggaggagccca

SEQ ID NO: 1297139 - RNA, 17 nt, Human
gggcuggaggagcccag

SEQ ID NO: 1297140 - RNA, 18 nt, Human
gggcuggaggagcccagg

SEQ ID NO: 1297141 - RNA, 22 nt, Human
gggcuggaggagcccaggccag

SEQ ID NO: 1297142 - RNA, 23 nt, Human
gggcuggaggagcccaggccagg

SEQ ID NO: 1297143 - RNA, 14 nt, Human
gggcuggaggccca

SEQ ID NO: 1297144 - RNA, 15 nt, Human
gggcuggaggcccag

SEQ ID NO: 1297145 - RNA, 16 nt, Human
gggcuggaggcccagg

SEQ ID NO: 1297146 - RNA, 19 nt, Human
gggcuggaggcccaggcug

SEQ ID NO: 1297147 - RNA, 18 nt, Human
gggcuggaugagcuccca

SEQ ID NO: 1297148 - RNA, 15 nt, Human
gggcuggaugagcuc

SEQ ID NO: 1297149 - RNA, 14 nt, Human
aaacacaacuauau

SEQ ID NO: 1297150 - RNA, 23 nt, Human
aaacaaguauuuguuaauuuaga

SEQ ID NO: 1297151 - RNA, 19 nt, Human
aaacaagucagucauucag

SEQ ID NO: 1297152 - RNA, 16 nt, Human
aaacaagguuuucagu

SEQ ID NO: 1297153 - RNA, 12 nt, Human
aaacaaguauuu

SEQ ID NO: 1297154 - RNA, 13 nt, Human
aaacaaguauuug

SEQ ID NO: 1297155 - RNA, 22 nt, Human
aaacaaguauuuguuaauuuag

SEQ ID NO: 1297156 - RNA, 21 nt, Human
aaacacaagauugguguuuuu

SEQ ID NO: 1297157 - RNA, 15 nt, Human
aaacacaagauuggu

SEQ ID NO: 1297158 - RNA, 16 nt, Human
aaacaguugguaacuu

SEQ ID NO: 1297159 - RNA, 18 nt, Human
aaacaguugguaacuuuu

SEQ ID NO: 1297160 - RNA, 19 nt, Human
aaacaguugguaacuuuug

SEQ ID NO: 1297161 - RNA, 22 nt, Human
aaacaguugguaacuuuuguga

SEQ ID NO: 1297162 - RNA, 13 nt, Human
aaacauauauaac

SEQ ID NO: 1297163 - RNA, 20 nt, Human
aaacauaaucuucugccuuc

SEQ ID NO: 1297164 - RNA, 16 nt, Human
aaacauauauaacaau

SEQ ID NO: 1297165 - RNA, 19 nt, Human
aaacauauauaacaaugcu

SEQ ID NO: 1297166 - RNA, 21 nt, Human
aaacauauauaacaaugcugu

SEQ ID NO: 1297167 - RNA, 14 nt, Human
ggggccaggcuggg

SEQ ID NO: 1297168 - RNA, 16 nt, Human
ggggaccuggaaggga

SEQ ID NO: 1297169 - RNA, 16 nt, Human
ggggccaggcuggguc

SEQ ID NO: 1297170 - RNA, 17 nt, Human
ggggaagacaguggccc

SEQ ID NO: 1297171 - RNA, 18 nt, Human
ggggaaagcaaagcacag

SEQ ID NO: 1297172 - RNA, 21 nt, Human
ggggaaagcaaagcacagaga

SEQ ID NO: 1297173 - RNA, 17 nt, Human
ggggaaaggcaaggucc

SEQ ID NO: 1297174 - RNA, 22 nt, Human
ggggaaaggcaagguccggccc

SEQ ID NO: 1297175 - RNA, 18 nt, Human
ggggaacucagauccagg

SEQ ID NO: 1297176 - RNA, 21 nt, Human
ggggaacucagauccagggac

SEQ ID NO: 1297177 - RNA, 23 nt, Human
ggggucucuucugaauaaagcaa

SEQ ID NO: 1297178 - RNA, 20 nt, Human
ggggucuggaguugaucugg

SEQ ID NO: 1297179 - RNA, 21 nt, Human
ggggucuggaguugaucugga

SEQ ID NO: 1297180 - RNA, 13 nt, Human
ggggucuggcugg

SEQ ID NO: 1297181 - RNA, 16 nt, Human
ggggucuggcuggugu

SEQ ID NO: 1297182 - RNA, 21 nt, Human
ggggucuggcugguguuaaca

SEQ ID NO: 1297183 - RNA, 18 nt, Human
ggggucguggagagcuag

SEQ ID NO: 1297184 - RNA, 19 nt, Human
ggggucguggagagcuagg

SEQ ID NO: 1297185 - RNA, 12 nt, Human
ggggccugggca

SEQ ID NO: 1297186 - RNA, 11 nt, Human
ggggccuggcu

SEQ ID NO: 1297187 - RNA, 22 nt, Human
ggggccuggcuggcugagggca

SEQ ID NO: 1297188 - RNA, 21 nt, Human
ggggaacuggccaagcugagg

SEQ ID NO: 1297189 - RNA, 13 nt, Human
ggggaacuggcca

SEQ ID NO: 1297190 - RNA, 12 nt, Human
ggggaagacagu

SEQ ID NO: 1297191 - RNA, 16 nt, Human
ggggaagacaguggcc

SEQ ID NO: 1297192 - RNA, 15 nt, Human
ggggccugggcagga

SEQ ID NO: 1297193 - RNA, 19 nt, Human
ggggccuggcuggcugagg

SEQ ID NO: 1297194 - RNA, 12 nt, Human
ggggccugggag

SEQ ID NO: 1297195 - RNA, 14 nt, Human
ggggccuguacugc

SEQ ID NO: 1297196 - RNA, 15 nt, Human
ggggccuguacugcc

SEQ ID NO: 1297197 - RNA, 17 nt, Human
ggggccuguacugccug

SEQ ID NO: 1297198 - RNA, 18 nt, Human
ggggccuguacugccugc

SEQ ID NO: 1297199 - RNA, 19 nt, Human
ggggccuguacugccugcu

SEQ ID NO: 1297200 - RNA, 12 nt, Human
ggguaggcagga

SEQ ID NO: 1297201 - RNA, 13 nt, Human
ggguaggcaggau

SEQ ID NO: 1297202 - RNA, 14 nt, Human
ggguaggcuggagu

SEQ ID NO: 1297203 - RNA, 18 nt, Human
ggguagggggcuggagga

SEQ ID NO: 1297204 - RNA, 15 nt, Human
ggguaggguaaauca

SEQ ID NO: 1297205 - RNA, 22 nt, Human
ggguaggguaaaucaguaagag

SEQ ID NO: 1297206 - RNA, 19 nt, Human
ggguaggagggugggaagg

SEQ ID NO: 1297207 - RNA, 20 nt, Human
ggguaggcaggauuggggaa

SEQ ID NO: 1297208 - RNA, 23 nt, Human
ggguauaaaacuuuccucgccug

SEQ ID NO: 1297209 - RNA, 19 nt, Human
gggucagacgccugaggaa

SEQ ID NO: 1297210 - RNA, 18 nt, Human
aaaccaaaucacugaacu

SEQ ID NO: 1297211 - RNA, 14 nt, Human
aaaccaagccgugg

SEQ ID NO: 1297212 - RNA, 16 nt, Human
aaaccaagccguggcu

SEQ ID NO: 1297213 - RNA, 21 nt, Human
aaacauuuauuuugacauaaa

SEQ ID NO: 1297214 - RNA, 20 nt, Human
aaacauuuauuuugacauaa

SEQ ID NO: 1297215 - RNA, 14 nt, Human
aaacauuaaaauau

SEQ ID NO: 1297216 - RNA, 14 nt, Human
aaacauuuauuuug

SEQ ID NO: 1297217 - RNA, 17 nt, Human
aaacauuuauuuugaca

SEQ ID NO: 1297218 - RNA, 18 nt, Human
aaacauuuauuuugacau

SEQ ID NO: 1297219 - RNA, 23 nt, Human
aaacauguuucuuuguaaugaaa

SEQ ID NO: 1297220 - RNA, 22 nt, Human
aaacauguuucuuuguaaugaa

SEQ ID NO: 1297221 - RNA, 19 nt, Human
aaacauguuucuuuguaau

SEQ ID NO: 1297222 - RNA, 19 nt, Human
aaacauguuuccacuauug

SEQ ID NO: 1297223 - RNA, 12 nt, Human
aaacauguuucc

SEQ ID NO: 1297224 - RNA, 20 nt, Human
aaacauguuuauuuuucuug

SEQ ID NO: 1297225 - RNA, 21 nt, Human
aaacauguuuauuuuucuugu

SEQ ID NO: 1297226 - RNA, 12 nt, Human
gggucaggccuu

SEQ ID NO: 1297227 - RNA, 19 nt, Human
gggucaggccuuugagcuc

SEQ ID NO: 1297228 - RNA, 13 nt, Human
gggucguggagag

SEQ ID NO: 1297229 - RNA, 18 nt, Human
gggucguggagagcuagg

SEQ ID NO: 1297230 - RNA, 23 nt, Human
aaacggccucacuaggcuucugg

SEQ ID NO: 1297231 - RNA, 21 nt, Human
aaaccacauuggagauguuua

SEQ ID NO: 1297232 - RNA, 15 nt, Human
aaacuacauauugua

SEQ ID NO: 1297233 - RNA, 21 nt, Human
aaacuacaaccaauggaaugu

SEQ ID NO: 1297234 - RNA, 16 nt, Human
aaacuaagaugugcag

SEQ ID NO: 1297235 - RNA, 15 nt, Human
aaacuaauaauugca

SEQ ID NO: 1297236 - RNA, 11 nt, Human
aaacuaaucca

SEQ ID NO: 1297237 - RNA, 12 nt, Human
aaacgugaaaau

SEQ ID NO: 1297238 - RNA, 21 nt, Human
aaacugcccccucugcccugc

SEQ ID NO: 1297239 - RNA, 10 nt, Human
aaacuggaga

SEQ ID NO: 1297240 - RNA, 11 nt, Human
aaacuggagac

SEQ ID NO: 1297241 - RNA, 21 nt, Human
aaacuggagacugugugugcc

SEQ ID NO: 1297242 - RNA, 13 nt, Human
aaacugcccccuc

SEQ ID NO: 1297243 - RNA, 17 nt, Human
aaacugcccccucugcc

SEQ ID NO: 1297244 - RNA, 19 nt, Human
aaacugcccccucugcccu

SEQ ID NO: 1297245 - RNA, 20 nt, Human
aaacugcccccucugcccug

SEQ ID NO: 1297246 - RNA, 12 nt, Human
aaacuggagacu

SEQ ID NO: 1297247 - RNA, 18 nt, Human
aaacuggccauggccugc

SEQ ID NO: 1297248 - RNA, 18 nt, Human
aaacugggaaccccuuuc

SEQ ID NO: 1297249 - RNA, 17 nt, Human
aaacuguaauacaauga

SEQ ID NO: 1297250 - RNA, 11 nt, Human
aaacuguacag

SEQ ID NO: 1297251 - RNA, 12 nt, Human
aaacuguacagu

SEQ ID NO: 1297252 - RNA, 12 nt, Human
aaacugcccccu

SEQ ID NO: 1297253 - RNA, 14 nt, Human
aaacuccugugacc

SEQ ID NO: 1297254 - RNA, 15 nt, Human
aaacuccaccuuccc

SEQ ID NO: 1297255 - RNA, 15 nt, Human
aaacuccagaugcca

SEQ ID NO: 1297256 - RNA, 22 nt, Human
aaacuccagaugccacaaugga

SEQ ID NO: 1297257 - RNA, 23 nt, Human
aaacucccacuugucaugugaca

SEQ ID NO: 1297258 - RNA, 16 nt, Human
aaacuacuuugcugcu

SEQ ID NO: 1297259 - RNA, 22 nt, Human
aaacuagaggugagaaauuuaa

SEQ ID NO: 1297260 - RNA, 22 nt, Human
aaacuagaaagcagagauuuuc

SEQ ID NO: 1297261 - RNA, 23 nt, Human
aaacuagaaagcagagauuuuca

SEQ ID NO: 1297262 - RNA, 20 nt, Human
aaacuacuuugcugcuaaua

SEQ ID NO: 1297263 - RNA, 18 nt, Human
aaagagaacuuccagauc

SEQ ID NO: 1297264 - RNA, 13 nt, Human
aaagagaaacacg

SEQ ID NO: 1297265 - RNA, 15 nt, Human
aaagagacaaagcuu

SEQ ID NO: 1297266 - RNA, 13 nt, Human
aaagagacaguga

SEQ ID NO: 1297267 - RNA, 15 nt, Human
aaagagacagugaua

SEQ ID NO: 1297268 - RNA, 21 nt, Human
aaagagacagugauauuggaa

SEQ ID NO: 1297269 - RNA, 12 nt, Human
aaagacuuaagc

SEQ ID NO: 1297270 - RNA, 18 nt, Human
aaagacuugguugguagg

SEQ ID NO: 1297271 - RNA, 20 nt, Human
aaagacuugguugguagggu

SEQ ID NO: 1297272 - RNA, 12 nt, Human
aaagagaaacac

SEQ ID NO: 1297273 - RNA, 19 nt, Human
aaagagaaacaguugguaa

SEQ ID NO: 1297274 - RNA, 22 nt, Human
aaagagaaacaguugguaacuu

SEQ ID NO: 1297275 - RNA, 10 nt, Human
aaagacucau

SEQ ID NO: 1297276 - RNA, 14 nt, Human
aaagacucauccgu

SEQ ID NO: 1297277 - RNA, 15 nt, Human
aaagacucauccguc

SEQ ID NO: 1297278 - RNA, 17 nt, Human
aaagaauggaaggugga

SEQ ID NO: 1297279 - RNA, 17 nt, Human
aaagaauggcagaaaag

SEQ ID NO: 1297280 - RNA, 15 nt, Human
aaagaauucaaauuu

SEQ ID NO: 1297281 - RNA, 19 nt, Human
aaagaauugugguuuauau

SEQ ID NO: 1297282 - RNA, 16 nt, Human
aaagaauucaaauuuu

SEQ ID NO: 1297283 - RNA, 15 nt, Human
aaagaauuauuuugu

SEQ ID NO: 1297284 - RNA, 22 nt, Human
aaagaauuguuggggguuuuuu

SEQ ID NO: 1297285 - RNA, 20 nt, Human
aaagaauuguuggggguuuu

SEQ ID NO: 1297286 - RNA, 13 nt, Human
aaagagagauuuu

SEQ ID NO: 1297287 - RNA, 14 nt, Human
aaagagagauuuuu

SEQ ID NO: 1297288 - RNA, 15 nt, Human
aaagagagauuuuuu

SEQ ID NO: 1297289 - RNA, 19 nt, Human
aaagaugcacuuugcuuua

SEQ ID NO: 1297290 - RNA, 21 nt, Human
aaagaugcacuuugcuuuaau

SEQ ID NO: 1297291 - RNA, 23 nt, Human
aaagaugcacuuugcuuuaauau

SEQ ID NO: 1297292 - RNA, 22 nt, Human
aaagaugcacuuugcuuuaaua

SEQ ID NO: 1297293 - RNA, 14 nt, Human
aaagaugccacauu

SEQ ID NO: 1297294 - RNA, 12 nt, Human
aaagaugcacuu

SEQ ID NO: 1297295 - RNA, 17 nt, Human
aaagaugcacuuugcuu

SEQ ID NO: 1297296 - RNA, 20 nt, Human
aaagaugagcuuugucuacu

SEQ ID NO: 1297297 - RNA, 16 nt, Human
aaagauguucuggaua

SEQ ID NO: 1297298 - RNA, 12 nt, Human
aaagauucuaua

SEQ ID NO: 1297299 - RNA, 18 nt, Human
aaagauucuauaguucua

SEQ ID NO: 1297300 - RNA, 19 nt, Human
aaagauucuauaguucuag

SEQ ID NO: 1297301 - RNA, 20 nt, Human
aaagauucuauaguucuaga

SEQ ID NO: 1297302 - RNA, 22 nt, Human
aaacuuuaaagcguuugcacag

SEQ ID NO: 1297303 - RNA, 20 nt, Human
aaacuuuucuuaaaaaguua

SEQ ID NO: 1297304 - RNA, 12 nt, Human
aaacuuuuuuau

SEQ ID NO: 1297305 - RNA, 17 nt, Human
aaacuuuuuuauuuaaa

SEQ ID NO: 1297306 - RNA, 19 nt, Human
aaacuuuuuuauuuaaaaa

SEQ ID NO: 1297307 - RNA, 15 nt, Human
aaacuuuuuuucugu

SEQ ID NO: 1297308 - RNA, 19 nt, Human
aaacuuuuuuucuguacca

SEQ ID NO: 1297309 - RNA, 22 nt, Human
aaacuuuuuuucuguaccaguu

SEQ ID NO: 1297310 - RNA, 13 nt, Human
aaacuuuaauaua

SEQ ID NO: 1297311 - RNA, 23 nt, Human
ggucccacaucccugggccugcu

SEQ ID NO: 1297312 - RNA, 21 nt, Human
ggucccacaucccugggccug

SEQ ID NO: 1297313 - RNA, 22 nt, Human
ggucccacaucccugggccugc

SEQ ID NO: 1297314 - RNA, 16 nt, Human
ggucccacaucccugg

SEQ ID NO: 1297315 - RNA, 17 nt, Human
ggucccacaucccuggg

SEQ ID NO: 1297316 - RNA, 19 nt, Human
ggucccacaucccugggcc

SEQ ID NO: 1297317 - RNA, 20 nt, Human
ggucccacaucccugggccu

SEQ ID NO: 1297318 - RNA, 14 nt, Human
ggucccacagccac

SEQ ID NO: 1297319 - RNA, 19 nt, Human
gguccaaugagcuuucuga

SEQ ID NO: 1297320 - RNA, 22 nt, Human
gguccaaugagcuuucugaaca

SEQ ID NO: 1297321 - RNA, 17 nt, Human
gguccaugggcagagcc

SEQ ID NO: 1297322 - RNA, 18 nt, Human
gguccaugggcagagccc

SEQ ID NO: 1297323 - RNA, 17 nt, Human
gguauucguuaucuaau

SEQ ID NO: 1297324 - RNA, 21 nt, Human
gguauggcguaaguacagaga

SEQ ID NO: 1297325 - RNA, 22 nt, Human
gguauggcguaaguacagagaa

SEQ ID NO: 1297326 - RNA, 16 nt, Human
ggucaugggccacugc

SEQ ID NO: 1297327 - RNA, 16 nt, Human
gguccaaugagcuuuc

SEQ ID NO: 1297328 - RNA, 17 nt, Human
gguccaaugagcuuucu

SEQ ID NO: 1297329 - RNA, 18 nt, Human
gguccaaugagcuuucug

SEQ ID NO: 1297330 - RNA, 21 nt, Human
gguccaaugcucaggugcugg

SEQ ID NO: 1297331 - RNA, 18 nt, Human
gguauaaguggugugugu

SEQ ID NO: 1297332 - RNA, 20 nt, Human
gguaguuuuuucaucuucag

SEQ ID NO: 1297333 - RNA, 20 nt, Human
gguauggcguaaguacagag

SEQ ID NO: 1297334 - RNA, 23 nt, Human
gguauggcguaaguacagagaag

SEQ ID NO: 1297335 - RNA, 21 nt, Human
gguauaaaacuuuccucgccu

SEQ ID NO: 1297336 - RNA, 22 nt, Human
gguauaaaacuuuccucgccug

SEQ ID NO: 1297337 - RNA, 13 nt, Human
aaacuguacagug

SEQ ID NO: 1297338 - RNA, 16 nt, Human
aaacuguacagugucu

SEQ ID NO: 1297339 - RNA, 18 nt, Human
aaacuguacagugucuuu

SEQ ID NO: 1297340 - RNA, 21 nt, Human
gguaguaccuuuuauauccca

SEQ ID NO: 1297341 - RNA, 15 nt, Human
gguagucucacugcu

SEQ ID NO: 1297342 - RNA, 20 nt, Human
gguagucucacugcuugaac

SEQ ID NO: 1297343 - RNA, 17 nt, Human
ggugcacuggccccacc

SEQ ID NO: 1297344 - RNA, 14 nt, Human
ggugcacaggaggg

SEQ ID NO: 1297345 - RNA, 12 nt, Human
ggugcacaggag

SEQ ID NO: 1297346 - RNA, 13 nt, Human
ggugcacaggagg

SEQ ID NO: 1297347 - RNA, 15 nt, Human
ggugcacaggagggg

SEQ ID NO: 1297348 - RNA, 18 nt, Human
ggugcaaaguucccuacu

SEQ ID NO: 1297349 - RNA, 18 nt, Human
ggugauuccgcagugaga

SEQ ID NO: 1297350 - RNA, 22 nt, Human
ggugcacagcacaaauuaguua

SEQ ID NO: 1297351 - RNA, 13 nt, Human
ggugcacugggag

SEQ ID NO: 1297352 - RNA, 14 nt, Human
ggugcacugggagg

SEQ ID NO: 1297353 - RNA, 22 nt, Human
ggugaugagggcagcagccagc

SEQ ID NO: 1297354 - RNA, 19 nt, Human
ggugaugagggcagcagcc

SEQ ID NO: 1297355 - RNA, 22 nt, Human
ggugauuguaugaaguuugaau

SEQ ID NO: 1297356 - RNA, 18 nt, Human
ggugauuuaagggcccag

SEQ ID NO: 1297357 - RNA, 16 nt, Human
ggucuguuggcaggcu

SEQ ID NO: 1297358 - RNA, 18 nt, Human
ggucuguuggcaggcugg

SEQ ID NO: 1297359 - RNA, 23 nt, Human
ggucuuggaacuugccugccuuu

SEQ ID NO: 1297360 - RNA, 17 nt, Human
ggucuuggaacuugccu

SEQ ID NO: 1297361 - RNA, 21 nt, Human
ggugauccacucgccuucauc

SEQ ID NO: 1297362 - RNA, 21 nt, Human
ggugauccauguaacugccua

SEQ ID NO: 1297363 - RNA, 20 nt, Human
ggugauccauguaacugccu

SEQ ID NO: 1297364 - RNA, 17 nt, Human
ggugaucugggauuagg

SEQ ID NO: 1297365 - RNA, 13 nt, Human
ggugaugagggca

SEQ ID NO: 1297366 - RNA, 15 nt, Human
ggugaugagggcagc

SEQ ID NO: 1297367 - RNA, 16 nt, Human
ggugaugagggcagca

SEQ ID NO: 1297368 - RNA, 17 nt, Human
ggugaugagggcagcag

SEQ ID NO: 1297369 - RNA, 16 nt, Human
ggucuuuuauaauucu

SEQ ID NO: 1297370 - RNA, 17 nt, Human
ggucuguucuguuucaa

SEQ ID NO: 1297371 - RNA, 24 nt, Human
ggucugugagaugcuagaacuccc

SEQ ID NO: 1297372 - RNA, 14 nt, Human
ggucugugagaugc

SEQ ID NO: 1297373 - RNA, 13 nt, Human
aaagauuuuuuaa

SEQ ID NO: 1297374 - RNA, 14 nt, Human
aaagauuuuuuaau

SEQ ID NO: 1297375 - RNA, 19 nt, Human
aaagauuuuuuaauaauuu

SEQ ID NO: 1297376 - RNA, 20 nt, Human
aaagauuuuuuaauaauuua

SEQ ID NO: 1297377 - RNA, 22 nt, Human
aaagauuuuuuaauaauuuaga

SEQ ID NO: 1297378 - RNA, 21 nt, Human
aaagauuuuuuaauaauuuag

SEQ ID NO: 1297379 - RNA, 23 nt, Human
aaagauuuuuuuuuuuucucuca

SEQ ID NO: 1297380 - RNA, 14 nt, Human
aaagcaaaaaagaa

SEQ ID NO: 1297381 - RNA, 15 nt, Human
aaagcaaaaaagaaa

SEQ ID NO: 1297382 - RNA, 21 nt, Human
aaagcaaaaaagaaaaccuuu

SEQ ID NO: 1297383 - RNA, 16 nt, Human
aaagcaaaaaagaaaa

SEQ ID NO: 1297384 - RNA, 15 nt, Human
ggucuggcagccucc

SEQ ID NO: 1297385 - RNA, 22 nt, Human
ggucuggcagccucccauccag

SEQ ID NO: 1297386 - RNA, 12 nt, Human
ggucuggcuggu

SEQ ID NO: 1297387 - RNA, 13 nt, Human
ggucuggcuggug

SEQ ID NO: 1297388 - RNA, 14 nt, Human
ggucuggcuggugu

SEQ ID NO: 1297389 - RNA, 15 nt, Human
ggucuggcugguguu

SEQ ID NO: 1297390 - RNA, 20 nt, Human
ggucuggcugguguuaacag

SEQ ID NO: 1297391 - RNA, 23 nt, Human
ggucuggcugguguuaacagaag

SEQ ID NO: 1297392 - RNA, 19 nt, Human
ggucugggagucacacagu

SEQ ID NO: 1297393 - RNA, 20 nt, Human
ggucugggagucacacagug

SEQ ID NO: 1297394 - RNA, 21 nt, Human
ggucugggggcacaagacuga

SEQ ID NO: 1297395 - RNA, 20 nt, Human
ggucugggggcacaagacug

SEQ ID NO: 1297396 - RNA, 15 nt, Human
ggucugguugggcag

SEQ ID NO: 1297397 - RNA, 14 nt, Human
ggucuguagggauu

SEQ ID NO: 1297398 - RNA, 15 nt, Human
ggucuguagguugca

SEQ ID NO: 1297399 - RNA, 18 nt, Human
ggucuguagguugcacac

SEQ ID NO: 1297400 - RNA, 19 nt, Human
ggucuguagguugcacacu

SEQ ID NO: 1297401 - RNA, 20 nt, Human
ggucuguagguugcacacuu

SEQ ID NO: 1297402 - RNA, 16 nt, Human
aaagcuacuuauugua

SEQ ID NO: 1297403 - RNA, 17 nt, Human
aaagcuacuuauuguag

SEQ ID NO: 1297404 - RNA, 23 nt, Human
aaagcgugagcuuaaaauacaag

SEQ ID NO: 1297405 - RNA, 14 nt, Human
aaagcguuugcaca

SEQ ID NO: 1297406 - RNA, 14 nt, Human
aaagcuaaaauaaa

SEQ ID NO: 1297407 - RNA, 16 nt, Human
aaagcuaaaauaaaga

SEQ ID NO: 1297408 - RNA, 21 nt, Human
aaagcuaaaauaaagaaauag

SEQ ID NO: 1297409 - RNA, 21 nt, Human
aaagcgugagcuuaaaauaca

SEQ ID NO: 1297410 - RNA, 22 nt, Human
aaagcgugagcuuaaaauacaa

SEQ ID NO: 1297411 - RNA, 23 nt, Human
ggugcccagaauaaguuauugca

SEQ ID NO: 1297412 - RNA, 13 nt, Human
ggugcccacaggc

SEQ ID NO: 1297413 - RNA, 14 nt, Human
ggugcccacaggcc

SEQ ID NO: 1297414 - RNA, 23 nt, Human
ggugcccacagugucaggcacug

SEQ ID NO: 1297415 - RNA, 14 nt, Human
ggugcccaagccag

SEQ ID NO: 1297416 - RNA, 17 nt, Human
ggugcccaagccagagg

SEQ ID NO: 1297417 - RNA, 18 nt, Human
ggugcccaagccagaggc

SEQ ID NO: 1297418 - RNA, 21 nt, Human
ggugcccaagccagaggcugg

SEQ ID NO: 1297419 - RNA, 22 nt, Human
ggugcccaagccagaggcuggg

SEQ ID NO: 1297420 - RNA, 23 nt, Human
ggugcccaagccagaggcugggu

SEQ ID NO: 1297421 - RNA, 17 nt, Human
aaagcuauauaagacaa

SEQ ID NO: 1297422 - RNA, 20 nt, Human
aaagcuauaaagcaguauuu

SEQ ID NO: 1297423 - RNA, 16 nt, Human
aaagcuucacaguacc

SEQ ID NO: 1297424 - RNA, 17 nt, Human
aaagcuucagugcugcc

SEQ ID NO: 1297425 - RNA, 20 nt, Human
aaagcuucagugcugccgau

SEQ ID NO: 1297426 - RNA, 17 nt, Human
aaagcuuccaugauucu

SEQ ID NO: 1297427 - RNA, 18 nt, Human
aaagcuuccaugauucua

SEQ ID NO: 1297428 - RNA, 20 nt, Human
aaagcuuccaugauucuauu

SEQ ID NO: 1297429 - RNA, 19 nt, Human
aaagcuuuuuauuccuccu

SEQ ID NO: 1297430 - RNA, 15 nt, Human
aaaggaaaaacaaac

SEQ ID NO: 1297431 - RNA, 19 nt, Human
aaagcuugcaacaaaauuc

SEQ ID NO: 1297432 - RNA, 15 nt, Human
aaaggacaucagcaa

SEQ ID NO: 1297433 - RNA, 15 nt, Human
aaaggacgcacugag

SEQ ID NO: 1297434 - RNA, 16 nt, Human
aaaggacaucagcaaa

SEQ ID NO: 1297435 - RNA, 14 nt, Human
aaaggacaucagca

SEQ ID NO: 1297436 - RNA, 12 nt, Human
aaaggaaaagac

SEQ ID NO: 1297437 - RNA, 13 nt, Human
aaaggaauuuaaa

SEQ ID NO: 1297438 - RNA, 16 nt, Human
aaaggaaagaaaacau

SEQ ID NO: 1297439 - RNA, 17 nt, Human
aaaggaaucauuucuau

SEQ ID NO: 1297440 - RNA, 15 nt, Human
aaaggaaagaaaaca

SEQ ID NO: 1297441 - RNA, 16 nt, Human
aaagcuuuugucuaca

SEQ ID NO: 1297442 - RNA, 13 nt, Human
aaaggaaaagaca

SEQ ID NO: 1297443 - RNA, 13 nt, Human
gcuuguagccagc

SEQ ID NO: 1297444 - RNA, 14 nt, Human
gcuuguagccagcc

SEQ ID NO: 1297445 - RNA, 17 nt, Human
ggaccccagccauccag

SEQ ID NO: 1297446 - RNA, 23 nt, Human
ggaccccugcauuggaacuggag

SEQ ID NO: 1297447 - RNA, 11 nt, Human
ggaccccugca

SEQ ID NO: 1297448 - RNA, 12 nt, Human
ggaccccugcau

SEQ ID NO: 1297449 - RNA, 18 nt, Human
ggaccccccuuucacagg

SEQ ID NO: 1297450 - RNA, 21 nt, Human
ggaccccccuuucacaggcag

SEQ ID NO: 1297451 - RNA, 22 nt, Human
ggaccccccuuucacaggcagc

SEQ ID NO: 1297452 - RNA, 20 nt, Human
ggacccggaggggccuggca

SEQ ID NO: 1297453 - RNA, 21 nt, Human
ggacccggaggggccuggcag

SEQ ID NO: 1297454 - RNA, 17 nt, Human
ggacccguucauggggg

SEQ ID NO: 1297455 - RNA, 19 nt, Human
ggacccguucaugggggag

SEQ ID NO: 1297456 - RNA, 18 nt, Human
ggaccgcccccugucucu

SEQ ID NO: 1297457 - RNA, 19 nt, Human
ggaccgcuacaccacucug

SEQ ID NO: 1297458 - RNA, 20 nt, Human
ggaccgcuacaccacucugg

SEQ ID NO: 1297459 - RNA, 21 nt, Human
ggaccgcuacaccacucuggc

SEQ ID NO: 1297460 - RNA, 22 nt, Human
ggaccgcuacaccacucuggca

SEQ ID NO: 1297461 - RNA, 17 nt, Human
ggaccggagaguggggg

SEQ ID NO: 1297462 - RNA, 19 nt, Human
ggaccggagagugggggug

SEQ ID NO: 1297463 - RNA, 17 nt, Human
ggaccuaaauggccuca

SEQ ID NO: 1297464 - RNA, 22 nt, Human
ggaccuaaauggccucaugugg

SEQ ID NO: 1297465 - RNA, 23 nt, Human
ggacuuccuguccagcuccaacc

SEQ ID NO: 1297466 - RNA, 14 nt, Human
ggacuucuggggua

SEQ ID NO: 1297467 - RNA, 22 nt, Human
ggacuucugggguaaguggucu

SEQ ID NO: 1297468 - RNA, 13 nt, Human
ggacuuggccucu

SEQ ID NO: 1297469 - RNA, 17 nt, Human
ggacuuggccucucucu

SEQ ID NO: 1297470 - RNA, 15 nt, Human
ggacuuggccucucu

SEQ ID NO: 1297471 - RNA, 18 nt, Human
ggacuuuuauuuccagug

SEQ ID NO: 1297472 - RNA, 16 nt, Human
ggacuugugucucugu

SEQ ID NO: 1297473 - RNA, 12 nt, Human
ggacuuuguaca

SEQ ID NO: 1297474 - RNA, 13 nt, Human
ggacuuuucugca

SEQ ID NO: 1297475 - RNA, 12 nt, Human
ggacuugugucu

SEQ ID NO: 1297476 - RNA, 20 nt, Human
ggagaaccaaaucuggaagc

SEQ ID NO: 1297477 - RNA, 13 nt, Human
ggagaacuagaga

SEQ ID NO: 1297478 - RNA, 13 nt, Human
ggagacugggcug

SEQ ID NO: 1297479 - RNA, 17 nt, Human
ggagacugggcugaggg

SEQ ID NO: 1297480 - RNA, 20 nt, Human
ggagacugggcugagggagc

SEQ ID NO: 1297481 - RNA, 16 nt, Human
ggagacugucucaaga

SEQ ID NO: 1297482 - RNA, 23 nt, Human
ggagacugggcugagggagccug

SEQ ID NO: 1297483 - RNA, 19 nt, Human
ggagacugucuggcccccc

SEQ ID NO: 1297484 - RNA, 20 nt, Human
ggagacugucuggccccccu

SEQ ID NO: 1297485 - RNA, 18 nt, Human
ggagacugugugugcccu

SEQ ID NO: 1297486 - RNA, 19 nt, Human
ggagacugugugugcccuc

SEQ ID NO: 1297487 - RNA, 20 nt, Human
ggagacugugugugcccucu

SEQ ID NO: 1297488 - RNA, 21 nt, Human
ggagacugugugugcccucug

SEQ ID NO: 1297489 - RNA, 23 nt, Human
ggacugugugcucaggagcccug

SEQ ID NO: 1297490 - RNA, 15 nt, Human
ggacucagccuucag

SEQ ID NO: 1297491 - RNA, 13 nt, Human
ggacuguuucaaa

SEQ ID NO: 1297492 - RNA, 22 nt, Human
ggacugugugcucaggagcccu

SEQ ID NO: 1297493 - RNA, 17 nt, Human
ggacuuagcugggagaa

SEQ ID NO: 1297494 - RNA, 23 nt, Human
ggacuuagaaaaccagcucagca

SEQ ID NO: 1297495 - RNA, 23 nt, Human
ggacuuaagcaucuggcucuaau

SEQ ID NO: 1297496 - RNA, 19 nt, Human
ggacuuagaaaaccagcuc

SEQ ID NO: 1297497 - RNA, 22 nt, Human
ggacuuagaaaaccagcucagc

SEQ ID NO: 1297498 - RNA, 11 nt, Human
ggacuuccugu

SEQ ID NO: 1297499 - RNA, 18 nt, Human
ggacuuccuguccagcuc

SEQ ID NO: 1297500 - RNA, 19 nt, Human
ggacuuccuguccagcucc

SEQ ID NO: 1297501 - RNA, 20 nt, Human
ggacuuccuguccagcucca

SEQ ID NO: 1297502 - RNA, 21 nt, Human
ggacuuccuguccagcuccaa

SEQ ID NO: 1297503 - RNA, 16 nt, Human
ggacuaggguccuggg

SEQ ID NO: 1297504 - RNA, 20 nt, Human
ggacuauauuugggccugcu

SEQ ID NO: 1297505 - RNA, 18 nt, Human
ggaccggagagugggggu

SEQ ID NO: 1297506 - RNA, 17 nt, Human
ggaccuagggaggcaug

SEQ ID NO: 1297507 - RNA, 22 nt, Human
ggaccuagggaggcauggucug

SEQ ID NO: 1297508 - RNA, 23 nt, Human
ggaccuagggaggcauggucugc

SEQ ID NO: 1297509 - RNA, 13 nt, Human
ggaccucaccaag

SEQ ID NO: 1297510 - RNA, 21 nt, Human
ggagagccagcuaaggggugg

SEQ ID NO: 1297511 - RNA, 12 nt, Human
ggagagcccagg

SEQ ID NO: 1297512 - RNA, 13 nt, Human
ggagagcccagga

SEQ ID NO: 1297513 - RNA, 15 nt, Human
ggagagcccaggagc

SEQ ID NO: 1297514 - RNA, 20 nt, Human
ggagagcccaggagcucccc

SEQ ID NO: 1297515 - RNA, 21 nt, Human
ggagagcccaggagcuccccu

SEQ ID NO: 1297516 - RNA, 22 nt, Human
ggagagcccaggagcuccccuc

SEQ ID NO: 1297517 - RNA, 11 nt, Human
ggagagcccug

SEQ ID NO: 1297518 - RNA, 12 nt, Human
ggagagcccugg

SEQ ID NO: 1297519 - RNA, 14 nt, Human
ggagagcccuggga

SEQ ID NO: 1297520 - RNA, 13 nt, Human
ggagagcccuggg

SEQ ID NO: 1297521 - RNA, 15 nt, Human
ggagagacgggcccu

SEQ ID NO: 1297522 - RNA, 17 nt, Human
ggagagacgggcccugg

SEQ ID NO: 1297523 - RNA, 22 nt, Human
ggagacuuagggcaccaggggu

SEQ ID NO: 1297524 - RNA, 12 nt, Human
ggagagacuugu

SEQ ID NO: 1297525 - RNA, 14 nt, Human
ggagagagacucca

SEQ ID NO: 1297526 - RNA, 17 nt, Human
ggagagaguugaaccua

SEQ ID NO: 1297527 - RNA, 20 nt, Human
ggagagaguugaaccuaaac

SEQ ID NO: 1297528 - RNA, 22 nt, Human
ggagagccaccaagagggacgc

SEQ ID NO: 1297529 - RNA, 19 nt, Human
ggagcagagcugauggaga

SEQ ID NO: 1297530 - RNA, 15 nt, Human
ggagcagaccacccc

SEQ ID NO: 1297531 - RNA, 23 nt, Human
ggagcagaaaacccuugggccag

SEQ ID NO: 1297532 - RNA, 14 nt, Human
ggagcagaagcagc

SEQ ID NO: 1297533 - RNA, 15 nt, Human
ggagcccacuguacu

SEQ ID NO: 1297534 - RNA, 22 nt, Human
ggagccaugcgcccccuccgcc

SEQ ID NO: 1297535 - RNA, 23 nt, Human
ggagccaugcgcccccuccgccc

SEQ ID NO: 1297536 - RNA, 16 nt, Human
ggagcaggcagccagc

SEQ ID NO: 1297537 - RNA, 13 nt, Human
ggagcaggcagcc

SEQ ID NO: 1297538 - RNA, 23 nt, Human
ggagcagagcugauggagaagga

SEQ ID NO: 1297539 - RNA, 12 nt, Human
ggagcagagggg

SEQ ID NO: 1297540 - RNA, 19 nt, Human
ggagcagaggggcagaggc

SEQ ID NO: 1297541 - RNA, 21 nt, Human
ggagcagaggggcagaggccc

SEQ ID NO: 1297542 - RNA, 12 nt, Human
ggagcagcagga

SEQ ID NO: 1297543 - RNA, 19 nt, Human
ggagcagcaggagggggga

SEQ ID NO: 1297544 - RNA, 21 nt, Human
ggagcagcaggaggggggagg

SEQ ID NO: 1297545 - RNA, 21 nt, Human
ggaggcucuggagcccacugu

SEQ ID NO: 1297546 - RNA, 19 nt, Human
ggaggcccaguucacccug

SEQ ID NO: 1297547 - RNA, 22 nt, Human
ggaggcccaggcugggaacuca

SEQ ID NO: 1297548 - RNA, 22 nt, Human
ggaggccccaacccuguccucc

SEQ ID NO: 1297549 - RNA, 19 nt, Human
ggaggcugagaugggagaa

SEQ ID NO: 1297550 - RNA, 15 nt, Human
ggaggcugagauggg

SEQ ID NO: 1297551 - RNA, 18 nt, Human
ggaggucgguagguucag

SEQ ID NO: 1297552 - RNA, 13 nt, Human
ggaggugucucag

SEQ ID NO: 1297553 - RNA, 16 nt, Human
ggaggugucucaggcu

SEQ ID NO: 1297554 - RNA, 17 nt, Human
ggaggugucucaggcug

SEQ ID NO: 1297555 - RNA, 12 nt, Human
ggagguucuaag

SEQ ID NO: 1297556 - RNA, 23 nt, Human
ggagguucuaaggccuaggauuc

SEQ ID NO: 1297557 - RNA, 18 nt, Human
ggaggugucucaggcugc

SEQ ID NO: 1297558 - RNA, 20 nt, Human
ggaggugucucaggcugccu

SEQ ID NO: 1297559 - RNA, 22 nt, Human
ggaggugucucaggcugccuga

SEQ ID NO: 1297560 - RNA, 18 nt, Human
ggagguguggagccgagg

SEQ ID NO: 1297561 - RNA, 22 nt, Human
ggagcccacuguacuugcucuu

SEQ ID NO: 1297562 - RNA, 14 nt, Human
ggagccauuugaga

SEQ ID NO: 1297563 - RNA, 17 nt, Human
ggagcccacgacacugc

SEQ ID NO: 1297564 - RNA, 21 nt, Human
ggagcccacgacacugcagcc

SEQ ID NO: 1297565 - RNA, 18 nt, Human
ggagcccacuguacuugc

SEQ ID NO: 1297566 - RNA, 12 nt, Human
ggagcccacugu

SEQ ID NO: 1297567 - RNA, 20 nt, Human
ggagcccacgcucacccccu

SEQ ID NO: 1297568 - RNA, 17 nt, Human
ggagccccagcuacccu

SEQ ID NO: 1297569 - RNA, 18 nt, Human
ggagccccagcuacccuu

SEQ ID NO: 1297570 - RNA, 16 nt, Human
ggagccccauuccugg

SEQ ID NO: 1297571 - RNA, 17 nt, Human
ggagccccauuccuggg

SEQ ID NO: 1297572 - RNA, 14 nt, Human
ggagcccccacccu

SEQ ID NO: 1297573 - RNA, 20 nt, Human
ggagcuccacucugcuucuc

SEQ ID NO: 1297574 - RNA, 15 nt, Human
ggagcccccacccug

SEQ ID NO: 1297575 - RNA, 13 nt, Human
ggagcuccagccu

SEQ ID NO: 1297576 - RNA, 15 nt, Human
ggagcuccagccuga

SEQ ID NO: 1297577 - RNA, 16 nt, Human
ggagcuccagccugac

SEQ ID NO: 1297578 - RNA, 18 nt, Human
ggagcuccagccugacau

SEQ ID NO: 1297579 - RNA, 17 nt, Human
ggagcuccaguguccug

SEQ ID NO: 1297580 - RNA, 19 nt, Human
ggagcuccaguguccugag

SEQ ID NO: 1297581 - RNA, 20 nt, Human
ggagcuccaguguccugagc

SEQ ID NO: 1297582 - RNA, 13 nt, Human
ggagcuccccucc

SEQ ID NO: 1297583 - RNA, 16 nt, Human
ggagcuccccucccca

SEQ ID NO: 1297584 - RNA, 17 nt, Human
ggagcuccccuccccaa

SEQ ID NO: 1297585 - RNA, 15 nt, Human
ggagcuugggaaugg

SEQ ID NO: 1297586 - RNA, 16 nt, Human
ggagcuuugacucagg

SEQ ID NO: 1297587 - RNA, 19 nt, Human
ggagcuuugacucaggagc

SEQ ID NO: 1297588 - RNA, 20 nt, Human
ggaggcucuggagcccacug

SEQ ID NO: 1297589 - RNA, 17 nt, Human
ggaggcucuggagccca

SEQ ID NO: 1297590 - RNA, 17 nt, Human
ggaggccauugugugag

SEQ ID NO: 1297591 - RNA, 14 nt, Human
ggaggcccaggcug

SEQ ID NO: 1297592 - RNA, 16 nt, Human
ggaggcccaggcuggg

SEQ ID NO: 1297593 - RNA, 20 nt, Human
ggaggcccaggcugggaacu

SEQ ID NO: 1297594 - RNA, 13 nt, Human
ggaggcccaguuc

SEQ ID NO: 1297595 - RNA, 19 nt, Human
ggaggaaccagagugcuga

SEQ ID NO: 1297596 - RNA, 20 nt, Human
ggaggaaaaccaagccgugg

SEQ ID NO: 1297597 - RNA, 22 nt, Human
ggagcuuugacucaggagccug

SEQ ID NO: 1297598 - RNA, 20 nt, Human
ggagcuuugacucaggagcc

SEQ ID NO: 1297599 - RNA, 21 nt, Human
ggaggaaaaccaagccguggc

SEQ ID NO: 1297600 - RNA, 22 nt, Human
ggaggaaaaccaagccguggcu

SEQ ID NO: 1297601 - RNA, 19 nt, Human
ggaggcaggggcuuccugg

SEQ ID NO: 1297602 - RNA, 21 nt, Human
ggaggcaggggcuuccuggug

SEQ ID NO: 1297603 - RNA, 16 nt, Human
ggaggcaucagugucc

SEQ ID NO: 1297604 - RNA, 11 nt, Human
ggaggaagccc

SEQ ID NO: 1297605 - RNA, 19 nt, Human
ggccagguggccacuccag

SEQ ID NO: 1297606 - RNA, 14 nt, Human
ggccaguccaggcu

SEQ ID NO: 1297607 - RNA, 15 nt, Human
ggccaguccaggcug

SEQ ID NO: 1297608 - RNA, 16 nt, Human
ggccaguccaggcugc

SEQ ID NO: 1297609 - RNA, 21 nt, Human
ggccagccgcgcaucagacug

SEQ ID NO: 1297610 - RNA, 21 nt, Human
ggccaguccaggcugccgugg

SEQ ID NO: 1297611 - RNA, 21 nt, Human
ggccaaggaugccccgucccc

SEQ ID NO: 1297612 - RNA, 14 nt, Human
ggccaacaaagaac

SEQ ID NO: 1297613 - RNA, 15 nt, Human
ggccaagguguccua

SEQ ID NO: 1297614 - RNA, 19 nt, Human
ggccaagguguccuacaga

SEQ ID NO: 1297615 - RNA, 12 nt, Human
ggccagauccag

SEQ ID NO: 1297616 - RNA, 13 nt, Human
ggccagauccagc

SEQ ID NO: 1297617 - RNA, 16 nt, Human
ggccagauccagccug

SEQ ID NO: 1297618 - RNA, 15 nt, Human
ggccagccccuuaga

SEQ ID NO: 1297619 - RNA, 19 nt, Human
ggccagccccuuagacaga

SEQ ID NO: 1297620 - RNA, 20 nt, Human
ggccagccccuuagacagag

SEQ ID NO: 1297621 - RNA, 23 nt, Human
ggccagccccuuagacagaggcc

SEQ ID NO: 1297622 - RNA, 21 nt, Human
ggccagccccuuagacagagg

SEQ ID NO: 1297623 - RNA, 22 nt, Human
ggccagccgcgcaucagacugu

SEQ ID NO: 1297624 - RNA, 11 nt, Human
ggcauuuccua

SEQ ID NO: 1297625 - RNA, 11 nt, Human
ggccaaagaac

SEQ ID NO: 1297626 - RNA, 22 nt, Human
ggccaaagaaccaaagaagaaa

SEQ ID NO: 1297627 - RNA, 17 nt, Human
ggccaaagaaccaaaga

SEQ ID NO: 1297628 - RNA, 16 nt, Human
ggccaaagagucucca

SEQ ID NO: 1297629 - RNA, 19 nt, Human
ggccaaaggggaccuggaa

SEQ ID NO: 1297630 - RNA, 20 nt, Human
ggccaaaggggaccuggaag

SEQ ID NO: 1297631 - RNA, 21 nt, Human
ggccaaaggggaccuggaagg

SEQ ID NO: 1297632 - RNA, 18 nt, Human
ggcauucuggaccucugg

SEQ ID NO: 1297633 - RNA, 20 nt, Human
ggcauucuggaccucugggu

SEQ ID NO: 1297634 - RNA, 19 nt, Human
ggcauucuggaccucuggg

SEQ ID NO: 1297635 - RNA, 19 nt, Human
ggccuccaugggccccagg

SEQ ID NO: 1297636 - RNA, 16 nt, Human
ggccucccaaagugcu

SEQ ID NO: 1297637 - RNA, 19 nt, Human
ggcccuuccucuccacugc

SEQ ID NO: 1297638 - RNA, 22 nt, Human
ggcccuuccucuccacugccuu

SEQ ID NO: 1297639 - RNA, 23 nt, Human
ggcccucccuguuccccagagaa

SEQ ID NO: 1297640 - RNA, 23 nt, Human
ggcccuuccucuccacugccuuc

SEQ ID NO: 1297641 - RNA, 12 nt, Human
ggcccuuccugg

SEQ ID NO: 1297642 - RNA, 13 nt, Human
ggcccuuccugga

SEQ ID NO: 1297643 - RNA, 14 nt, Human
ggcccuuccuggac

SEQ ID NO: 1297644 - RNA, 15 nt, Human
ggcccuuccuggaca

SEQ ID NO: 1297645 - RNA, 16 nt, Human
ggcccuuccuggacag

SEQ ID NO: 1297646 - RNA, 17 nt, Human
ggcccuuccuggacagc

SEQ ID NO: 1297647 - RNA, 19 nt, Human
ggcccuuccuggacagcug

SEQ ID NO: 1297648 - RNA, 20 nt, Human
ggcccuuccuggacagcugu

SEQ ID NO: 1297649 - RNA, 21 nt, Human
ggcccuuccuggacagcugug

SEQ ID NO: 1297650 - RNA, 22 nt, Human
ggcccuuccuggacagcugugc

SEQ ID NO: 1297651 - RNA, 23 nt, Human
ggcccuuccuggacagcugugcc

SEQ ID NO: 1297652 - RNA, 18 nt, Human
ggccuccaugggccccag

SEQ ID NO: 1297653 - RNA, 11 nt, Human
ggccuccccca

SEQ ID NO: 1297654 - RNA, 12 nt, Human
ggccucccccac

SEQ ID NO: 1297655 - RNA, 13 nt, Human
ggccucccccacu

SEQ ID NO: 1297656 - RNA, 14 nt, Human
ggccucccccacuu

SEQ ID NO: 1297657 - RNA, 15 nt, Human
ggccuccccugccac

SEQ ID NO: 1297658 - RNA, 17 nt, Human
ggccuccccugccacca

SEQ ID NO: 1297659 - RNA, 19 nt, Human
ggccuccccugccaccagg

SEQ ID NO: 1297660 - RNA, 22 nt, Human
ggccuccccugccaccaggcca

SEQ ID NO: 1297661 - RNA, 15 nt, Human
ggccucccccacuuu

SEQ ID NO: 1297662 - RNA, 21 nt, Human
ggccuccguccaggagccugg

SEQ ID NO: 1297663 - RNA, 16 nt, Human
ggcccagccgaccccc

SEQ ID NO: 1297664 - RNA, 18 nt, Human
ggcccagccgacccccuc

SEQ ID NO: 1297665 - RNA, 19 nt, Human
ggcccagccgacccccucu

SEQ ID NO: 1297666 - RNA, 11 nt, Human
ggcccagccuu

SEQ ID NO: 1297667 - RNA, 12 nt, Human
ggcccagccuuu

SEQ ID NO: 1297668 - RNA, 23 nt, Human
ggcccagccuuuguuccccacug

SEQ ID NO: 1297669 - RNA, 19 nt, Human
ggcccagccuuuguucccc

SEQ ID NO: 1297670 - RNA, 11 nt, Human
ggcccaggcug

SEQ ID NO: 1297671 - RNA, 13 nt, Human
ggcccaggcugcc

SEQ ID NO: 1297672 - RNA, 14 nt, Human
ggcccaggcuggga

SEQ ID NO: 1297673 - RNA, 15 nt, Human
ggcccaggcugccgu

SEQ ID NO: 1297674 - RNA, 14 nt, Human
ggcccagggcccag

SEQ ID NO: 1297675 - RNA, 16 nt, Human
ggcccgacagccuggc

SEQ ID NO: 1297676 - RNA, 17 nt, Human
ggcccgacagccuggca

SEQ ID NO: 1297677 - RNA, 14 nt, Human
ggccccaugaccuc

SEQ ID NO: 1297678 - RNA, 16 nt, Human
ggccccaugaccucca

SEQ ID NO: 1297679 - RNA, 18 nt, Human
ggccccaugaccuccagc

SEQ ID NO: 1297680 - RNA, 13 nt, Human
ggcccgagcagcu

SEQ ID NO: 1297681 - RNA, 14 nt, Human
ggcccgagcagcug

SEQ ID NO: 1297682 - RNA, 15 nt, Human
ggcccgagcagcuga

SEQ ID NO: 1297683 - RNA, 16 nt, Human
ggcccgagcagcugag

SEQ ID NO: 1297684 - RNA, 18 nt, Human
ggcccgagcagcugagca

SEQ ID NO: 1297685 - RNA, 20 nt, Human
ggcccgagcagcugagcagg

SEQ ID NO: 1297686 - RNA, 23 nt, Human
ggcccgagcagcugagcagggcc

SEQ ID NO: 1297687 - RNA, 22 nt, Human
ggcccgagcagcugagcagggc

SEQ ID NO: 1297688 - RNA, 23 nt, Human
ggcccgcgauguggaacugcugc

SEQ ID NO: 1297689 - RNA, 21 nt, Human
ggcccucaguagucccugcac

SEQ ID NO: 1297690 - RNA, 14 nt, Human
ggcccuccacaccu

SEQ ID NO: 1297691 - RNA, 15 nt, Human
ggcccuccacaccug

SEQ ID NO: 1297692 - RNA, 16 nt, Human
ggcccuccacaccugc

SEQ ID NO: 1297693 - RNA, 17 nt, Human
ggcccuccacaccugcg

SEQ ID NO: 1297694 - RNA, 21 nt, Human
ggcccuccacaccugcggccc

SEQ ID NO: 1297695 - RNA, 19 nt, Human
ggcccuccacaccugcggc

SEQ ID NO: 1297696 - RNA, 19 nt, Human
ggcccucccuguuccccag

SEQ ID NO: 1297697 - RNA, 20 nt, Human
ggcccucccuguuccccaga

SEQ ID NO: 1297698 - RNA, 21 nt, Human
ggcccucccuguuccccagag

SEQ ID NO: 1297699 - RNA, 22 nt, Human
ggcccucccuguuccccagaga

SEQ ID NO: 1297700 - RNA, 15 nt, Human
ggcccagggcccaga

SEQ ID NO: 1297701 - RNA, 21 nt, Human
ggcccaucaggguaggcugga

SEQ ID NO: 1297702 - RNA, 19 nt, Human
ggccccaacccuguccucc

SEQ ID NO: 1297703 - RNA, 18 nt, Human
ggccccaacccuguccuc

SEQ ID NO: 1297704 - RNA, 18 nt, Human
ggccccaggaaaggccca

SEQ ID NO: 1297705 - RNA, 16 nt, Human
ggccccaggaccuggc

SEQ ID NO: 1297706 - RNA, 21 nt, Human
ggccccaggaccuggcugcca

SEQ ID NO: 1297707 - RNA, 22 nt, Human
ggccccaggcauugccaagggc

SEQ ID NO: 1297708 - RNA, 18 nt, Human
ggcaacagaucaguaaag

SEQ ID NO: 1297709 - RNA, 14 nt, Human
ggcaacagaucugg

SEQ ID NO: 1297710 - RNA, 15 nt, Human
ggcaacagaucugga

SEQ ID NO: 1297711 - RNA, 19 nt, Human
ggcaacagaucuggaaccu

SEQ ID NO: 1297712 - RNA, 14 nt, Human
ggcaacaucuuuau

SEQ ID NO: 1297713 - RNA, 20 nt, Human
ggcaacagaucaguaaagaa

SEQ ID NO: 1297714 - RNA, 22 nt, Human
ggaugguucccuugaugaagaa

SEQ ID NO: 1297715 - RNA, 23 nt, Human
ggaugguucccuugaugaagaag

SEQ ID NO: 1297716 - RNA, 16 nt, Human
ggauguguccugacac

SEQ ID NO: 1297717 - RNA, 20 nt, Human
ggauguucagcacugucccu

SEQ ID NO: 1297718 - RNA, 23 nt, Human
ggauguucagcacugucccuugc

SEQ ID NO: 1297719 - RNA, 15 nt, Human
ggaugugacaguggc

SEQ ID NO: 1297720 - RNA, 18 nt, Human
ggaugugauuguggaaug

SEQ ID NO: 1297721 - RNA, 16 nt, Human
ggaugugacaguggcg

SEQ ID NO: 1297722 - RNA, 19 nt, Human
ggauguggguuccacagac

SEQ ID NO: 1297723 - RNA, 14 nt, Human
ggauguguccugac

SEQ ID NO: 1297724 - RNA, 15 nt, Human
ggauguguccugaca

SEQ ID NO: 1297725 - RNA, 21 nt, Human
ggaugagaauuugagugcucu

SEQ ID NO: 1297726 - RNA, 23 nt, Human
ggaugagaauuugagugcucuga

SEQ ID NO: 1297727 - RNA, 20 nt, Human
ggauuaacccacuagcucuu

SEQ ID NO: 1297728 - RNA, 15 nt, Human
ggauuaaccucugca

SEQ ID NO: 1297729 - RNA, 16 nt, Human
ggauuaaccucugcac

SEQ ID NO: 1297730 - RNA, 17 nt, Human
ggauuaaccucugcacu

SEQ ID NO: 1297731 - RNA, 18 nt, Human
ggauuaaccucugcacua

SEQ ID NO: 1297732 - RNA, 16 nt, Human
ggcaaaauccuugcuu

SEQ ID NO: 1297733 - RNA, 13 nt, Human
ggcaaaauugcaa

SEQ ID NO: 1297734 - RNA, 13 nt, Human
ggcaaacccauca

SEQ ID NO: 1297735 - RNA, 22 nt, Human
ggcaaagcacgaaauguuauuu

SEQ ID NO: 1297736 - RNA, 14 nt, Human
ggcaaagccagguc

SEQ ID NO: 1297737 - RNA, 11 nt, Human
ggcaaagccag

SEQ ID NO: 1297738 - RNA, 16 nt, Human
ggcaaaggaaggugga

SEQ ID NO: 1297739 - RNA, 17 nt, Human
ggcaaaggaagguggau

SEQ ID NO: 1297740 - RNA, 19 nt, Human
ggcaaaggaagguggaugg

SEQ ID NO: 1297741 - RNA, 12 nt, Human
ggcaaauaaaag

SEQ ID NO: 1297742 - RNA, 16 nt, Human
ggcaaauaucuugaaa

SEQ ID NO: 1297743 - RNA, 19 nt, Human
ggcaacaaaagaagcccgg

SEQ ID NO: 1297744 - RNA, 14 nt, Human
ggcaacacagaggc

SEQ ID NO: 1297745 - RNA, 20 nt, Human
ggcagagaagaaagaacgga

SEQ ID NO: 1297746 - RNA, 20 nt, Human
ggcagacucuuuaugcuugc

SEQ ID NO: 1297747 - RNA, 22 nt, Human
ggcagacucuuuaugcuugcaa

SEQ ID NO: 1297748 - RNA, 17 nt, Human
ggcagaaggcaaaccca

SEQ ID NO: 1297749 - RNA, 17 nt, Human
ggcagaaguguuuuuua

SEQ ID NO: 1297750 - RNA, 18 nt, Human
ggcagccgugccuucagc

SEQ ID NO: 1297751 - RNA, 17 nt, Human
ggcagccagggagagcc

SEQ ID NO: 1297752 - RNA, 18 nt, Human
ggcagccagggagagccc

SEQ ID NO: 1297753 - RNA, 19 nt, Human
ggcagccagggagagccca

SEQ ID NO: 1297754 - RNA, 20 nt, Human
ggcagccagggagagcccag

SEQ ID NO: 1297755 - RNA, 19 nt, Human
ggcagccgugccuucagcu

SEQ ID NO: 1297756 - RNA, 21 nt, Human
ggcagccgugccuucagcucu

SEQ ID NO: 1297757 - RNA, 16 nt, Human
ggcagagaugccuccc

SEQ ID NO: 1297758 - RNA, 22 nt, Human
ggcagagaugccucccugagcu

SEQ ID NO: 1297759 - RNA, 18 nt, Human
ggcagagaugccucccug

SEQ ID NO: 1297760 - RNA, 12 nt, Human
ggcagccaggga

SEQ ID NO: 1297761 - RNA, 13 nt, Human
ggcagccagggag

SEQ ID NO: 1297762 - RNA, 23 nt, Human
ggcaggcaucggggagccgggag

SEQ ID NO: 1297763 - RNA, 13 nt, Human
ggcaggcagggcu

SEQ ID NO: 1297764 - RNA, 14 nt, Human
ggcaggcagggcuc

SEQ ID NO: 1297765 - RNA, 15 nt, Human
ggcaggcagggcucu

SEQ ID NO: 1297766 - RNA, 19 nt, Human
ggcaggcagggcucuccug

SEQ ID NO: 1297767 - RNA, 23 nt, Human
ggcaggcagaggcccaggcugcc

SEQ ID NO: 1297768 - RNA, 20 nt, Human
ggcaggcagaggcccaggcu

SEQ ID NO: 1297769 - RNA, 18 nt, Human
ggcaggcaggcucccagg

SEQ ID NO: 1297770 - RNA, 21 nt, Human
ggcaggaccuucgggcugugc

SEQ ID NO: 1297771 - RNA, 23 nt, Human
ggcaggaccuucgggcugugccc

SEQ ID NO: 1297772 - RNA, 17 nt, Human
ggcaggcagaggcccag

SEQ ID NO: 1297773 - RNA, 22 nt, Human
ggcagccgugccuucagcucua

SEQ ID NO: 1297774 - RNA, 22 nt, Human
ggcagccgugggccccacccuc

SEQ ID NO: 1297775 - RNA, 14 nt, Human
ggcagccucccauc

SEQ ID NO: 1297776 - RNA, 21 nt, Human
ggcagccucccauccagggcc

SEQ ID NO: 1297777 - RNA, 22 nt, Human
ggcagccucccauccagggccc

SEQ ID NO: 1297778 - RNA, 13 nt, Human
ggcagccucuggg

SEQ ID NO: 1297779 - RNA, 12 nt, Human
ggcagccucugg

SEQ ID NO: 1297780 - RNA, 23 nt, Human
ggcaggcagggcucuccuggcuu

SEQ ID NO: 1297781 - RNA, 22 nt, Human
ggcaggcagggcucuccuggcu

SEQ ID NO: 1297782 - RNA, 15 nt, Human
ggcaggccaccuggc

SEQ ID NO: 1297783 - RNA, 18 nt, Human
ggcaggccaccuggcucu

SEQ ID NO: 1297784 - RNA, 19 nt, Human
ggcaggccaccuggcucuc

SEQ ID NO: 1297785 - RNA, 15 nt, Human
ggcaggccagcugug

SEQ ID NO: 1297786 - RNA, 10 nt, Human
ggcaggcugg

SEQ ID NO: 1297787 - RNA, 11 nt, Human
ggcaggcuggc

SEQ ID NO: 1297788 - RNA, 12 nt, Human
ggcaggcuggcc

SEQ ID NO: 1297789 - RNA, 13 nt, Human
ggcaggcuggcca

SEQ ID NO: 1297790 - RNA, 17 nt, Human
ggcaggcuggccagucc

SEQ ID NO: 1297791 - RNA, 20 nt, Human
ggcaggcuggccaguccagg

SEQ ID NO: 1297792 - RNA, 12 nt, Human
ggcaggcugggc

SEQ ID NO: 1297793 - RNA, 13 nt, Human
ggcaggcugggcc

SEQ ID NO: 1297794 - RNA, 15 nt, Human
cuuagcagcuuccag

SEQ ID NO: 1297795 - RNA, 16 nt, Human
cuuagcagcuuccaga

SEQ ID NO: 1297796 - RNA, 17 nt, Human
cuuagcagcuuccagau

SEQ ID NO: 1297797 - RNA, 18 nt, Human
cuuagcagcuuccagauu

SEQ ID NO: 1297798 - RNA, 16 nt, Human
cuuauggaauugauuu

SEQ ID NO: 1297799 - RNA, 17 nt, Human
cuuauggaauugauuug

SEQ ID NO: 1297800 - RNA, 19 nt, Human
cuuauggaauugauuugca

SEQ ID NO: 1297801 - RNA, 20 nt, Human
cuuauggaauugauuugcau

SEQ ID NO: 1297802 - RNA, 21 nt, Human
cuuauggaauugauuugcauu

SEQ ID NO: 1297803 - RNA, 23 nt, Human
cuuauggaauugauuugcauuga

SEQ ID NO: 1297804 - RNA, 14 nt, Human
cuuauggauguccc

SEQ ID NO: 1297805 - RNA, 16 nt, Human
cuuauggaugucccca

SEQ ID NO: 1297806 - RNA, 17 nt, Human
cuuauggauguccccag

SEQ ID NO: 1297807 - RNA, 18 nt, Human
cuuauggauguccccagc

SEQ ID NO: 1297808 - RNA, 14 nt, Human
cuuauggaauugau

SEQ ID NO: 1297809 - RNA, 21 nt, Human
cuuauggauguccccagcaga

SEQ ID NO: 1297810 - RNA, 20 nt, Human
cuuauggauguccccagcag

SEQ ID NO: 1297811 - RNA, 19 nt, Human
cuuaugguaccagaugcag

SEQ ID NO: 1297812 - RNA, 13 nt, Human
cuuaugguaccag

SEQ ID NO: 1297813 - RNA, 17 nt, Human
cuuauuagagugucuuu

SEQ ID NO: 1297814 - RNA, 21 nt, Human
cuuauuaacaauuaggcagac

SEQ ID NO: 1297815 - RNA, 15 nt, Human
cuuccaugucgccuc

SEQ ID NO: 1297816 - RNA, 16 nt, Human
cuuccaugucgccucu

SEQ ID NO: 1297817 - RNA, 14 nt, Human
cuuccaugauucua

SEQ ID NO: 1297818 - RNA, 17 nt, Human
cuuccaugauucuauuu

SEQ ID NO: 1297819 - RNA, 14 nt, Human
cuuccaugcugugc

SEQ ID NO: 1297820 - RNA, 15 nt, Human
cuuccaugcugugcg

SEQ ID NO: 1297821 - RNA, 17 nt, Human
cuuccaugucgccucug

SEQ ID NO: 1297822 - RNA, 18 nt, Human
cuuccaugucgccucugc

SEQ ID NO: 1297823 - RNA, 19 nt, Human
cuuccaugucgccucugca

SEQ ID NO: 1297824 - RNA, 20 nt, Human
cuuccaugucgccucugcau

SEQ ID NO: 1297825 - RNA, 23 nt, Human
cuucaugcauggaaauucccuuc

SEQ ID NO: 1297826 - RNA, 21 nt, Human
cuucaugcauggaaauucccu

SEQ ID NO: 1297827 - RNA, 14 nt, Human
cuucaugccagcua

SEQ ID NO: 1297828 - RNA, 15 nt, Human
cuucaugccagcuac

SEQ ID NO: 1297829 - RNA, 16 nt, Human
cuucaugccagcuacu

SEQ ID NO: 1297830 - RNA, 23 nt, Human
cuucaugcugucuacacuaagag

SEQ ID NO: 1297831 - RNA, 13 nt, Human
cuucauggauggg

SEQ ID NO: 1297832 - RNA, 11 nt, Human
cuucauccucu

SEQ ID NO: 1297833 - RNA, 15 nt, Human
cuucaucgaaucuac

SEQ ID NO: 1297834 - RNA, 17 nt, Human
cuucaucgaaucuacua

SEQ ID NO: 1297835 - RNA, 22 nt, Human
cuucaucucccaaagugcuggg

SEQ ID NO: 1297836 - RNA, 13 nt, Human
cuucaucucccac

SEQ ID NO: 1297837 - RNA, 19 nt, Human
cuucaucucccaccuagca

SEQ ID NO: 1297838 - RNA, 20 nt, Human
cuucaucucccaccuagcag

SEQ ID NO: 1297839 - RNA, 17 nt, Human
cuucaguuaagccuuug

SEQ ID NO: 1297840 - RNA, 17 nt, Human
cuucaguguauggaaau

SEQ ID NO: 1297841 - RNA, 18 nt, Human
cuucaguuaagccuuugg

SEQ ID NO: 1297842 - RNA, 20 nt, Human
cuucaguguauggaaauaaa

SEQ ID NO: 1297843 - RNA, 17 nt, Human
cuucaguuaugauuuuu

SEQ ID NO: 1297844 - RNA, 19 nt, Human
cuucaucccacuccaacuc

SEQ ID NO: 1297845 - RNA, 13 nt, Human
cuucacugugcug

SEQ ID NO: 1297846 - RNA, 14 nt, Human
cuucacugugcugu

SEQ ID NO: 1297847 - RNA, 17 nt, Human
cuucaccuucaccuuca

SEQ ID NO: 1297848 - RNA, 13 nt, Human
cuuauugccucac

SEQ ID NO: 1297849 - RNA, 14 nt, Human
cuuauugccucacu

SEQ ID NO: 1297850 - RNA, 19 nt, Human
cuuauugccucacuucagg

SEQ ID NO: 1297851 - RNA, 20 nt, Human
cuucagacagagaggacugu

SEQ ID NO: 1297852 - RNA, 11 nt, Human
cuucagacaua

SEQ ID NO: 1297853 - RNA, 12 nt, Human
cuucagaaagac

SEQ ID NO: 1297854 - RNA, 19 nt, Human
cuucagacagagaggacug

SEQ ID NO: 1297855 - RNA, 11 nt, Human
cuucagaaaga

SEQ ID NO: 1297856 - RNA, 15 nt, Human
cuguucacucuacuu

SEQ ID NO: 1297857 - RNA, 16 nt, Human
cuguucacuuuuccuc

SEQ ID NO: 1297858 - RNA, 17 nt, Human
cuguucacuuuuccucc

SEQ ID NO: 1297859 - RNA, 18 nt, Human
cuguucacuuuuccuccc

SEQ ID NO: 1297860 - RNA, 15 nt, Human
cugugaccaaugucu

SEQ ID NO: 1297861 - RNA, 16 nt, Human
cugugaccaaugucuu

SEQ ID NO: 1297862 - RNA, 17 nt, Human
cugugaccaaugucuug

SEQ ID NO: 1297863 - RNA, 14 nt, Human
cugugaccacaaca

SEQ ID NO: 1297864 - RNA, 16 nt, Human
cugugaccacaacaug

SEQ ID NO: 1297865 - RNA, 17 nt, Human
cugugaccacaacauga

SEQ ID NO: 1297866 - RNA, 17 nt, Human
cugugacuucagcucug

SEQ ID NO: 1297867 - RNA, 23 nt, Human
cugugaccugcugagcucugaga

SEQ ID NO: 1297868 - RNA, 22 nt, Human
cugugacuucagcucuguuuua

SEQ ID NO: 1297869 - RNA, 22 nt, Human
cugugcguguguguguguguau

SEQ ID NO: 1297870 - RNA, 19 nt, Human
cugugcuauggugcucugu

SEQ ID NO: 1297871 - RNA, 21 nt, Human
cugugcuauggugcucugucu

SEQ ID NO: 1297872 - RNA, 13 nt, Human
cugugcucagccc

SEQ ID NO: 1297873 - RNA, 15 nt, Human
cugugcucagcccug

SEQ ID NO: 1297874 - RNA, 19 nt, Human
cugugcucagcccugagga

SEQ ID NO: 1297875 - RNA, 16 nt, Human
cugugcucagcccuga

SEQ ID NO: 1297876 - RNA, 11 nt, Human
cuguguaacug

SEQ ID NO: 1297877 - RNA, 13 nt, Human
cuguguaacugcc

SEQ ID NO: 1297878 - RNA, 15 nt, Human
cuguguaacugccca

SEQ ID NO: 1297879 - RNA, 16 nt, Human
cuguguaacugcccaa

SEQ ID NO: 1297880 - RNA, 13 nt, Human
cuguguaagauuu

SEQ ID NO: 1297881 - RNA, 23 nt, Human
cuguguaagggccagaaauaucu

SEQ ID NO: 1297882 - RNA, 18 nt, Human
cuguguaauuagugccac

SEQ ID NO: 1297883 - RNA, 18 nt, Human
cuguguaagauuuguuuu

SEQ ID NO: 1297884 - RNA, 17 nt, Human
cuguguacauaacugaa

SEQ ID NO: 1297885 - RNA, 19 nt, Human
cuguguacauaacugaaaa

SEQ ID NO: 1297886 - RNA, 20 nt, Human
cuguguacauaacugaaaau

SEQ ID NO: 1297887 - RNA, 22 nt, Human
cuguguacauaacugaaaaugu

SEQ ID NO: 1297888 - RNA, 15 nt, Human
cuguguacugcaguu

SEQ ID NO: 1297889 - RNA, 16 nt, Human
cugugucuaagauucu

SEQ ID NO: 1297890 - RNA, 17 nt, Human
cugugucuaagauucua

SEQ ID NO: 1297891 - RNA, 18 nt, Human
cugugucuaagauucuag

SEQ ID NO: 1297892 - RNA, 19 nt, Human
cugugucuaagauucuaga

SEQ ID NO: 1297893 - RNA, 20 nt, Human
cugugucuaagauucuagau

SEQ ID NO: 1297894 - RNA, 21 nt, Human
cugugucuaagauucuagauc

SEQ ID NO: 1297895 - RNA, 15 nt, Human
cuguugcugccucau

SEQ ID NO: 1297896 - RNA, 16 nt, Human
cuguugcugccucaug

SEQ ID NO: 1297897 - RNA, 17 nt, Human
cuguugcugccucaugc

SEQ ID NO: 1297898 - RNA, 17 nt, Human
cuuacacauuaagcaaa

SEQ ID NO: 1297899 - RNA, 11 nt, Human
cuuacacccac

SEQ ID NO: 1297900 - RNA, 20 nt, Human
cuuacacccacaguggaaag

SEQ ID NO: 1297901 - RNA, 13 nt, Human
cuuaaacaaaaau

SEQ ID NO: 1297902 - RNA, 19 nt, Human
cuuaaacaaaaauuaaaau

SEQ ID NO: 1297903 - RNA, 15 nt, Human
cuuaaagcuuucaga

SEQ ID NO: 1297904 - RNA, 13 nt, Human
cuuaaaggggaga

SEQ ID NO: 1297905 - RNA, 16 nt, Human
cuuaaagugccaguau

SEQ ID NO: 1297906 - RNA, 22 nt, Human
cuuaaagugccaguauuuuaaa

SEQ ID NO: 1297907 - RNA, 23 nt, Human
cuguuggaauggauuuuucuuua

SEQ ID NO: 1297908 - RNA, 18 nt, Human
cuuaaaauauuccugcau

SEQ ID NO: 1297909 - RNA, 20 nt, Human
cuuaaaauauuccugcauuu

SEQ ID NO: 1297910 - RNA, 20 nt, Human
cuguugggagagggcgcagg

SEQ ID NO: 1297911 - RNA, 22 nt, Human
cuguugggagagggcgcaggcc

SEQ ID NO: 1297912 - RNA, 24 nt, Human
cuuaaaauguucacuuuugacaaa

SEQ ID NO: 1297913 - RNA, 18 nt, Human
cuuacagcaaauccuuug

SEQ ID NO: 1297914 - RNA, 12 nt, Human
cuuacagcaggc

SEQ ID NO: 1297915 - RNA, 16 nt, Human
cuuacagcaaauccuu

SEQ ID NO: 1297916 - RNA, 13 nt, Human
cuuacagcaggca

SEQ ID NO: 1297917 - RNA, 20 nt, Human
cuuagauguuccaguaaucu

SEQ ID NO: 1297918 - RNA, 14 nt, Human
cuuagauguucuaa

SEQ ID NO: 1297919 - RNA, 18 nt, Human
cuuagauguucuaagucu

SEQ ID NO: 1297920 - RNA, 11 nt, Human
cuuagauucuc

SEQ ID NO: 1297921 - RNA, 20 nt, Human
cuuagauucucugugucuaa

SEQ ID NO: 1297922 - RNA, 22 nt, Human
cuuagauucucugugucuaaga

SEQ ID NO: 1297923 - RNA, 24 nt, Human
cuuagauucucugugucuaagauu

SEQ ID NO: 1297924 - RNA, 13 nt, Human
cuuagauuucaua

SEQ ID NO: 1297925 - RNA, 14 nt, Human
cuuagauuucauag

SEQ ID NO: 1297926 - RNA, 21 nt, Human
cuuagauuucauaguucagaa

SEQ ID NO: 1297927 - RNA, 12 nt, Human
cuuagauuuuac

SEQ ID NO: 1297928 - RNA, 13 nt, Human
cuuagauuuuaca

SEQ ID NO: 1297929 - RNA, 15 nt, Human
cuuagauuuuacaug

SEQ ID NO: 1297930 - RNA, 16 nt, Human
cuuagauuuuacauga

SEQ ID NO: 1297931 - RNA, 19 nt, Human
cuuagauuuuacaugaagu

SEQ ID NO: 1297932 - RNA, 20 nt, Human
cuuagauuuuacaugaagua

SEQ ID NO: 1297933 - RNA, 23 nt, Human
cuugugauccacucgccucagcc

SEQ ID NO: 1297934 - RNA, 20 nt, Human
cuugugaugucauacagaga

SEQ ID NO: 1297935 - RNA, 21 nt, Human
cuugugaugucauacagagaa

SEQ ID NO: 1297936 - RNA, 22 nt, Human
cuugugaugucauacagagaag

SEQ ID NO: 1297937 - RNA, 24 nt, Human
cuugugaugucauacagagaaguc

SEQ ID NO: 1297938 - RNA, 23 nt, Human
cuuuaaagugacuaauggcauga

SEQ ID NO: 1297939 - RNA, 13 nt, Human
cuuuaaaguucuu

SEQ ID NO: 1297940 - RNA, 13 nt, Human
cuuuaaauugugu

SEQ ID NO: 1297941 - RNA, 15 nt, Human
cuuuaacaacauguu

SEQ ID NO: 1297942 - RNA, 16 nt, Human
cuuuaacaacauguuu

SEQ ID NO: 1297943 - RNA, 19 nt, Human
cuuuaacaacauguuucca

SEQ ID NO: 1297944 - RNA, 22 nt, Human
cuuuaacaacauguuuccagca

SEQ ID NO: 1297945 - RNA, 16 nt, Human
cuuuacaaaacaaacu

SEQ ID NO: 1297946 - RNA, 18 nt, Human
cuuuacaaaacaaacuca

SEQ ID NO: 1297947 - RNA, 23 nt, Human
cuuuacaaaacaaacucauucau

SEQ ID NO: 1297948 - RNA, 20 nt, Human
cuuuacacaauagaauuaua

SEQ ID NO: 1297949 - RNA, 16 nt, Human
cuuuaaugauaugcuu

SEQ ID NO: 1297950 - RNA, 20 nt, Human
cuuuaaggggaggaaccaga

SEQ ID NO: 1297951 - RNA, 22 nt, Human
cuuuaacucccauuaccaugua

SEQ ID NO: 1297952 - RNA, 17 nt, Human
cuuuaacucccauuacc

SEQ ID NO: 1297953 - RNA, 21 nt, Human
cuuuaacucccauuaccaugu

SEQ ID NO: 1297954 - RNA, 18 nt, Human
cuuuaacugacaagccau

SEQ ID NO: 1297955 - RNA, 12 nt, Human
cuuuaauauaaa

SEQ ID NO: 1297956 - RNA, 14 nt, Human
cuuuaauauaaaug

SEQ ID NO: 1297957 - RNA, 15 nt, Human
cuuuaauauaaaugc

SEQ ID NO: 1297958 - RNA, 16 nt, Human
cuuuaauauaaaugca

SEQ ID NO: 1297959 - RNA, 20 nt, Human
cuuuaauauaaaugcaaaua

SEQ ID NO: 1297960 - RNA, 18 nt, Human
cuuuaauauaaaugcaaa

SEQ ID NO: 1297961 - RNA, 19 nt, Human
cuuuaauauaaaugcaaau

SEQ ID NO: 1297962 - RNA, 14 nt, Human
cuuucagaauaugu

SEQ ID NO: 1297963 - RNA, 16 nt, Human
cuuucagaauauguca

SEQ ID NO: 1297964 - RNA, 21 nt, Human
cuuucagaauaugucagugcu

SEQ ID NO: 1297965 - RNA, 11 nt, Human
cuuucagagcc

SEQ ID NO: 1297966 - RNA, 12 nt, Human
cuuucagagccu

SEQ ID NO: 1297967 - RNA, 13 nt, Human
cuuucagagccuc

SEQ ID NO: 1297968 - RNA, 14 nt, Human
cuuucagagccucc

SEQ ID NO: 1297969 - RNA, 21 nt, Human
cuuugagcuuaaucuuugaaa

SEQ ID NO: 1297970 - RNA, 16 nt, Human
cuuugagcuuaagaau

SEQ ID NO: 1297971 - RNA, 22 nt, Human
cuuugagcuacugccgucagug

SEQ ID NO: 1297972 - RNA, 21 nt, Human
cuuugagugcaguccugauca

SEQ ID NO: 1297973 - RNA, 14 nt, Human
cuuugauguuccuu

SEQ ID NO: 1297974 - RNA, 20 nt, Human
cuuugauuaaagacuccagu

SEQ ID NO: 1297975 - RNA, 16 nt, Human
cuuugauguuccuucc

SEQ ID NO: 1297976 - RNA, 12 nt, Human
cuuugauucaua

SEQ ID NO: 1297977 - RNA, 19 nt, Human
cuuugauucauaguaacuu

SEQ ID NO: 1297978 - RNA, 21 nt, Human
cuuugauucauaguaacuucu

SEQ ID NO: 1297979 - RNA, 22 nt, Human
cuuucggggagaggcugaggac

SEQ ID NO: 1297980 - RNA, 17 nt, Human
cuuucggauccagggag

SEQ ID NO: 1297981 - RNA, 14 nt, Human
cuuucgggccaugu

SEQ ID NO: 1297982 - RNA, 20 nt, Human
cuuucgggccauguugcccc

SEQ ID NO: 1297983 - RNA, 17 nt, Human
cuuucuaaugugugaau

SEQ ID NO: 1297984 - RNA, 14 nt, Human
cuuucuaguugaaa

SEQ ID NO: 1297985 - RNA, 16 nt, Human
cuuucuaguugaaaau

SEQ ID NO: 1297986 - RNA, 18 nt, Human
cuuucuaguugaaaauaa

SEQ ID NO: 1297987 - RNA, 21 nt, Human
cuuucuaguugaaaauaaagu

SEQ ID NO: 1297988 - RNA, 16 nt, Human
cuuucuauccucugua

SEQ ID NO: 1297989 - RNA, 17 nt, Human
cuuucuauccucuguaa

SEQ ID NO: 1297990 - RNA, 18 nt, Human
cuuucuccuuuaauugua

SEQ ID NO: 1297991 - RNA, 21 nt, Human
cuuuuaguaaagucaaggaga

SEQ ID NO: 1297992 - RNA, 19 nt, Human
cuuuuauuuagcaccaggg

SEQ ID NO: 1297993 - RNA, 16 nt, Human
cuuuuacuuuucuucu

SEQ ID NO: 1297994 - RNA, 15 nt, Human
cuuugguaccagaua

SEQ ID NO: 1297995 - RNA, 20 nt, Human
cuuugguaccagauaacuuu

SEQ ID NO: 1297996 - RNA, 18 nt, Human
cuuugggcuucagcugcc

SEQ ID NO: 1297997 - RNA, 21 nt, Human
cuuugggcuucagcugccagu

SEQ ID NO: 1297998 - RNA, 16 nt, Human
cuuugggcuugggccu

SEQ ID NO: 1297999 - RNA, 18 nt, Human
cuuuggggcuaauuuaac

SEQ ID NO: 1298000 - RNA, 14 nt, Human
cuuugguagaaaag

SEQ ID NO: 1298001 - RNA, 14 nt, Human
cuuugguccuucaa

SEQ ID NO: 1298002 - RNA, 15 nt, Human
cuuuggucucuugcu

SEQ ID NO: 1298003 - RNA, 16 nt, Human
cuuuggucucuugcuu

SEQ ID NO: 1298004 - RNA, 17 nt, Human
cuuuggucucuugcuug

SEQ ID NO: 1298005 - RNA, 19 nt, Human
cuuuggugagaaccugggu

SEQ ID NO: 1298006 - RNA, 22 nt, Human
cuuuucaaauagggucuaacuc

SEQ ID NO: 1298007 - RNA, 18 nt, Human
cuuggccaugcagaaagc

SEQ ID NO: 1298008 - RNA, 15 nt, Human
cuuggccaugcagaa

SEQ ID NO: 1298009 - RNA, 16 nt, Human
cuuggccacagccagg

SEQ ID NO: 1298010 - RNA, 18 nt, Human
cuuggccacagccagggg

SEQ ID NO: 1298011 - RNA, 20 nt, Human
cuuggccaugggaggccuuu

SEQ ID NO: 1298012 - RNA, 16 nt, Human
cuuggccaugggaggc

SEQ ID NO: 1298013 - RNA, 19 nt, Human
cuuggccaugggaggccuu

SEQ ID NO: 1298014 - RNA, 23 nt, Human
cuuggccaugggaggccuuuccc

SEQ ID NO: 1298015 - RNA, 12 nt, Human
cuugaaugaaaa

SEQ ID NO: 1298016 - RNA, 14 nt, Human
cuugacaacuggca

SEQ ID NO: 1298017 - RNA, 20 nt, Human
cuugacaacuggcaggcagg

SEQ ID NO: 1298018 - RNA, 16 nt, Human
cuugacaacuggcagg

SEQ ID NO: 1298019 - RNA, 13 nt, Human
cuugacaccugcu

SEQ ID NO: 1298020 - RNA, 15 nt, Human
cuugacaccugcuga

SEQ ID NO: 1298021 - RNA, 22 nt, Human
cuugacaccugcugagaaaaca

SEQ ID NO: 1298022 - RNA, 17 nt, Human
cuugccucaaugccagu

SEQ ID NO: 1298023 - RNA, 12 nt, Human
cuugccugcagg

SEQ ID NO: 1298024 - RNA, 15 nt, Human
cuugcuccuccuucu

SEQ ID NO: 1298025 - RNA, 18 nt, Human
cuugcuccuccuucugcu

SEQ ID NO: 1298026 - RNA, 17 nt, Human
cuugccucaaccuccca

SEQ ID NO: 1298027 - RNA, 18 nt, Human
cuugccucaaccucccaa

SEQ ID NO: 1298028 - RNA, 15 nt, Human
cuugccucaaugcca

SEQ ID NO: 1298029 - RNA, 13 nt, Human
cuugccucugugc

SEQ ID NO: 1298030 - RNA, 14 nt, Human
cuugccucugugcu

SEQ ID NO: 1298031 - RNA, 15 nt, Human
cuugccucugugcug

SEQ ID NO: 1298032 - RNA, 16 nt, Human
cuugccucugugcugu

SEQ ID NO: 1298033 - RNA, 19 nt, Human
cuugccucugugcugugug

SEQ ID NO: 1298034 - RNA, 20 nt, Human
cuugccucugugcugugugu

SEQ ID NO: 1298035 - RNA, 12 nt, Human
cuugccucuucc

SEQ ID NO: 1298036 - RNA, 13 nt, Human
cuugccucuuccu

SEQ ID NO: 1298037 - RNA, 16 nt, Human
cuugccucuuccuuga

SEQ ID NO: 1298038 - RNA, 18 nt, Human
cuugccucuuccuugaag

SEQ ID NO: 1298039 - RNA, 15 nt, Human
cuucuguuuuauaau

SEQ ID NO: 1298040 - RNA, 20 nt, Human
cuucuguuuuauaauuuugu

SEQ ID NO: 1298041 - RNA, 22 nt, Human
cuucugagacgucaugaggaga

SEQ ID NO: 1298042 - RNA, 11 nt, Human
cuucugagacg

SEQ ID NO: 1298043 - RNA, 15 nt, Human
cuucugagcacuguu

SEQ ID NO: 1298044 - RNA, 23 nt, Human
cuucugagcacuguuuauacacu

SEQ ID NO: 1298045 - RNA, 18 nt, Human
cuucugagcagcgagccu

SEQ ID NO: 1298046 - RNA, 20 nt, Human
cuucugagcagcgagccugc

SEQ ID NO: 1298047 - RNA, 21 nt, Human
cuucugagcagcgagccugcu

SEQ ID NO: 1298048 - RNA, 22 nt, Human
cuucugagcagcgagccugcua

SEQ ID NO: 1298049 - RNA, 22 nt, Human
cuucugagcccgguaagagcaa

SEQ ID NO: 1298050 - RNA, 16 nt, Human
cuucugagcuauuuca

SEQ ID NO: 1298051 - RNA, 17 nt, Human
cuucugagcuauuucau

SEQ ID NO: 1298052 - RNA, 18 nt, Human
cuucugagcuauuucauc

SEQ ID NO: 1298053 - RNA, 20 nt, Human
cuucugagcuauuucaucua

SEQ ID NO: 1298054 - RNA, 12 nt, Human
cuucugagcucc

SEQ ID NO: 1298055 - RNA, 14 nt, Human
cuucuuaaaguauu

SEQ ID NO: 1298056 - RNA, 19 nt, Human
cuucuuaaaguauucuucu

SEQ ID NO: 1298057 - RNA, 23 nt, Human
cuggacugugugcucaggagccc

SEQ ID NO: 1298058 - RNA, 18 nt, Human
cuggacuuaagcaucugg

SEQ ID NO: 1298059 - RNA, 22 nt, Human
cuggacuuaagcaucuggcucu

SEQ ID NO: 1298060 - RNA, 23 nt, Human
cuggacuuaagcaucuggcucua

SEQ ID NO: 1298061 - RNA, 22 nt, Human
cuggacugugugcucaggagcc

SEQ ID NO: 1298062 - RNA, 19 nt, Human
cuggacugugugcucagga

SEQ ID NO: 1298063 - RNA, 13 nt, Human
cugcuuaauucaa

SEQ ID NO: 1298064 - RNA, 12 nt, Human
cugcuuaauuca

SEQ ID NO: 1298065 - RNA, 13 nt, Human
cuggaucucccug

SEQ ID NO: 1298066 - RNA, 15 nt, Human
cuggaguugaucugg

SEQ ID NO: 1298067 - RNA, 16 nt, Human
cuggaguugaucugga

SEQ ID NO: 1298068 - RNA, 17 nt, Human
cuggaguugaucuggaa

SEQ ID NO: 1298069 - RNA, 18 nt, Human
cuggaguugaucuggaac

SEQ ID NO: 1298070 - RNA, 16 nt, Human
cuggaugauacuaaua

SEQ ID NO: 1298071 - RNA, 18 nt, Human
cuggaugauacuaauaaa

SEQ ID NO: 1298072 - RNA, 15 nt, Human
cuggaugacauuaaa

SEQ ID NO: 1298073 - RNA, 14 nt, Human
cuggaugagcuccc

SEQ ID NO: 1298074 - RNA, 15 nt, Human
cuggaugagcuccca

SEQ ID NO: 1298075 - RNA, 20 nt, Human
cuggaugagcucccacaagc

SEQ ID NO: 1298076 - RNA, 14 nt, Human
cuggaugauacuaa

SEQ ID NO: 1298077 - RNA, 15 nt, Human
cuggaugauacuaau

SEQ ID NO: 1298078 - RNA, 23 nt, Human
cuggaugauacuaauaaacuaau

SEQ ID NO: 1298079 - RNA, 22 nt, Human
cuggaugauacuaauaaacuaa

SEQ ID NO: 1298080 - RNA, 18 nt, Human
cugcugucgcucucaguu

SEQ ID NO: 1298081 - RNA, 12 nt, Human
cugcugucuggg

SEQ ID NO: 1298082 - RNA, 13 nt, Human
cugcugucugggu

SEQ ID NO: 1298083 - RNA, 14 nt, Human
cugcugucugggug

SEQ ID NO: 1298084 - RNA, 15 nt, Human
cugcugucugggugc

SEQ ID NO: 1298085 - RNA, 16 nt, Human
cugcugucugggugcu

SEQ ID NO: 1298086 - RNA, 21 nt, Human
cugcugucugggugcuacugg

SEQ ID NO: 1298087 - RNA, 15 nt, Human
cugcugugaaagaag

SEQ ID NO: 1298088 - RNA, 19 nt, Human
cugcugucuggguggcuca

SEQ ID NO: 1298089 - RNA, 21 nt, Human
cugcugucuggguggcucacu

SEQ ID NO: 1298090 - RNA, 21 nt, Human
cugcugugauacgaugcuuca

SEQ ID NO: 1298091 - RNA, 12 nt, Human
cugcuguggcca

SEQ ID NO: 1298092 - RNA, 14 nt, Human
cugcuguggccagg

SEQ ID NO: 1298093 - RNA, 15 nt, Human
cugcuguggccagga

SEQ ID NO: 1298094 - RNA, 16 nt, Human
cugcuguggccaggag

SEQ ID NO: 1298095 - RNA, 17 nt, Human
cugcuguggccaggagg

SEQ ID NO: 1298096 - RNA, 21 nt, Human
cugcuguggccaggaggugcc

SEQ ID NO: 1298097 - RNA, 18 nt, Human
cugcuguggccaggaggu

SEQ ID NO: 1298098 - RNA, 19 nt, Human
cugcugagucccaggcuga

SEQ ID NO: 1298099 - RNA, 23 nt, Human
cugcugagucccaggcugagccu

SEQ ID NO: 1298100 - RNA, 18 nt, Human
cugcucacgucaaaugca

SEQ ID NO: 1298101 - RNA, 14 nt, Human
cugcugauauuuuc

SEQ ID NO: 1298102 - RNA, 17 nt, Human
cugcugauauuuucucu

SEQ ID NO: 1298103 - RNA, 18 nt, Human
cugcugauauuuucucua

SEQ ID NO: 1298104 - RNA, 19 nt, Human
cugcugauauuuucucuag

SEQ ID NO: 1298105 - RNA, 16 nt, Human
cugcugaucgccuucc

SEQ ID NO: 1298106 - RNA, 17 nt, Human
cugcugaucgccuuccc

SEQ ID NO: 1298107 - RNA, 18 nt, Human
cugcugaucgccuucccc

SEQ ID NO: 1298108 - RNA, 19 nt, Human
cugcugaucgccuucccca

SEQ ID NO: 1298109 - RNA, 19 nt, Human
cugggugguacccucugga

SEQ ID NO: 1298110 - RNA, 17 nt, Human
cugggugguggccuggu

SEQ ID NO: 1298111 - RNA, 14 nt, Human
cugggugguggccu

SEQ ID NO: 1298112 - RNA, 19 nt, Human
cuggguguaaaaccuggag

SEQ ID NO: 1298113 - RNA, 21 nt, Human
cuggguguaaaaccuggagau

SEQ ID NO: 1298114 - RNA, 20 nt, Human
cuggguguaaaaccuggaga

SEQ ID NO: 1298115 - RNA, 15 nt, Human
cuggugccaauuuca

SEQ ID NO: 1298116 - RNA, 16 nt, Human
cuggugccaauuucaa

SEQ ID NO: 1298117 - RNA, 18 nt, Human
cuggugccaauuucaagu

SEQ ID NO: 1298118 - RNA, 20 nt, Human
cuggugccaauuucaaguuc

SEQ ID NO: 1298119 - RNA, 21 nt, Human
cuggugccucaccccuugcca

SEQ ID NO: 1298120 - RNA, 14 nt, Human
cuggugccuccaga

SEQ ID NO: 1298121 - RNA, 16 nt, Human
cuggugccuccagagg

SEQ ID NO: 1298122 - RNA, 15 nt, Human
cuggugccuccagag

SEQ ID NO: 1298123 - RNA, 14 nt, Human
cuggugcggcuggc

SEQ ID NO: 1298124 - RNA, 15 nt, Human
cuggugcggcuggcc

SEQ ID NO: 1298125 - RNA, 18 nt, Human
cuggugcggcuggccaug

SEQ ID NO: 1298126 - RNA, 12 nt, Human
cuggugccaccu

SEQ ID NO: 1298127 - RNA, 19 nt, Human
cuggugcggcuggccaugg

SEQ ID NO: 1298128 - RNA, 20 nt, Human
cuggugcggcuggccaugga

SEQ ID NO: 1298129 - RNA, 21 nt, Human
cuggugcggcuggccauggag

SEQ ID NO: 1298130 - RNA, 12 nt, Human
cuggggccuggg

SEQ ID NO: 1298131 - RNA, 13 nt, Human
cuggggccuggga

SEQ ID NO: 1298132 - RNA, 15 nt, Human
cuggggccugggaca

SEQ ID NO: 1298133 - RNA, 16 nt, Human
cuggggccugggacaa

SEQ ID NO: 1298134 - RNA, 14 nt, Human
cuggggccuguacu

SEQ ID NO: 1298135 - RNA, 16 nt, Human
cuggggccuguacugc

SEQ ID NO: 1298136 - RNA, 17 nt, Human
cuggggccuguacugcc

SEQ ID NO: 1298137 - RNA, 19 nt, Human
cuggggacagguccucagu

SEQ ID NO: 1298138 - RNA, 12 nt, Human
cuggggacaggu

SEQ ID NO: 1298139 - RNA, 20 nt, Human
cuggggaccugguacccucc

SEQ ID NO: 1298140 - RNA, 22 nt, Human
cuggggaccugguacccuccug

SEQ ID NO: 1298141 - RNA, 14 nt, Human
cuggggacuuggcc

SEQ ID NO: 1298142 - RNA, 15 nt, Human
cuggggacuuggccu

SEQ ID NO: 1298143 - RNA, 17 nt, Human
cuggggacuuggccucu

SEQ ID NO: 1298144 - RNA, 18 nt, Human
cuggggacuuggccucuc

SEQ ID NO: 1298145 - RNA, 19 nt, Human
cuggggacuuggccucucu

SEQ ID NO: 1298146 - RNA, 13 nt, Human
cuggggacuugug

SEQ ID NO: 1298147 - RNA, 17 nt, Human
cuggggacuugugucug

SEQ ID NO: 1298148 - RNA, 18 nt, Human
cuggggacuugugucugc

SEQ ID NO: 1298149 - RNA, 14 nt, Human
cugggugcuacugg

SEQ ID NO: 1298150 - RNA, 17 nt, Human
cugggugcuacugggga

SEQ ID NO: 1298151 - RNA, 18 nt, Human
cugggugcuacuggggaa

SEQ ID NO: 1298152 - RNA, 21 nt, Human
cugggugcuacuggggaaacu

SEQ ID NO: 1298153 - RNA, 18 nt, Human
cuggggccuguacugccu

SEQ ID NO: 1298154 - RNA, 19 nt, Human
cuggggccuguacugccug

SEQ ID NO: 1298155 - RNA, 20 nt, Human
cuggggccuguacugccugc

SEQ ID NO: 1298156 - RNA, 21 nt, Human
cuggggccuguacugccugcu

SEQ ID NO: 1298157 - RNA, 22 nt, Human
cuggggccuguacugccugcuu

SEQ ID NO: 1298158 - RNA, 23 nt, Human
cuggggccuguacugccugcuug

SEQ ID NO: 1298159 - RNA, 14 nt, Human
cugggugacauuug

SEQ ID NO: 1298160 - RNA, 13 nt, Human
cugggcaggaggg

SEQ ID NO: 1298161 - RNA, 23 nt, Human
cugggcaugagggguuccucccc

SEQ ID NO: 1298162 - RNA, 22 nt, Human
cugggcaugagggguuccuccc

SEQ ID NO: 1298163 - RNA, 17 nt, Human
cugggccauguccaaag

SEQ ID NO: 1298164 - RNA, 18 nt, Human
cugggccauguccaaaga

SEQ ID NO: 1298165 - RNA, 19 nt, Human
cugggccauguccaaagag

SEQ ID NO: 1298166 - RNA, 22 nt, Human
cugggccauguccaaagaggcu

SEQ ID NO: 1298167 - RNA, 23 nt, Human
cugggccauguccaaagaggcug

SEQ ID NO: 1298168 - RNA, 19 nt, Human
cugggccauucuccacagc

SEQ ID NO: 1298169 - RNA, 20 nt, Human
cugggccauucuccacagca

SEQ ID NO: 1298170 - RNA, 21 nt, Human
cugggccauucuccacagcaa

SEQ ID NO: 1298171 - RNA, 22 nt, Human
cugggccauucuccacagcaac

SEQ ID NO: 1298172 - RNA, 13 nt, Human
cugggagaaaucu

SEQ ID NO: 1298173 - RNA, 18 nt, Human
cugggagaaaucuggcuu

SEQ ID NO: 1298174 - RNA, 19 nt, Human
cugggagaaaucuggcuuc

SEQ ID NO: 1298175 - RNA, 20 nt, Human
cugggagaaaucuggcuucu

SEQ ID NO: 1298176 - RNA, 21 nt, Human
cugggagaaaucuggcuucug

SEQ ID NO: 1298177 - RNA, 16 nt, Human
cugggagaaaugaaaa

SEQ ID NO: 1298178 - RNA, 21 nt, Human
cugggacguggcucagccagc

SEQ ID NO: 1298179 - RNA, 23 nt, Human
cugggacguggcucagccagcac

SEQ ID NO: 1298180 - RNA, 17 nt, Human
cugggagaaaugaaaaa

SEQ ID NO: 1298181 - RNA, 20 nt, Human
cugggacguggcucagccag

SEQ ID NO: 1298182 - RNA, 13 nt, Human
cuggcucucaccu

SEQ ID NO: 1298183 - RNA, 14 nt, Human
cuggcucucaccuc

SEQ ID NO: 1298184 - RNA, 16 nt, Human
cuggcucucaccucua

SEQ ID NO: 1298185 - RNA, 19 nt, Human
cuggcucucaccucuaggu

SEQ ID NO: 1298186 - RNA, 22 nt, Human
cuggcucucaccucuagguccc

SEQ ID NO: 1298187 - RNA, 20 nt, Human
cuggcuccguccaggagccu

SEQ ID NO: 1298188 - RNA, 18 nt, Human
cuggcuccuugugccaga

SEQ ID NO: 1298189 - RNA, 21 nt, Human
cuggcuccuugugccagagaa

SEQ ID NO: 1298190 - RNA, 15 nt, Human
cuggcucuaauucac

SEQ ID NO: 1298191 - RNA, 19 nt, Human
cuggcucuaauucacagug

SEQ ID NO: 1298192 - RNA, 20 nt, Human
cuggcucuaauucacagugc

SEQ ID NO: 1298193 - RNA, 22 nt, Human
cuggcucuaauucacagugcuc

SEQ ID NO: 1298194 - RNA, 23 nt, Human
cuggcucuaauucacagugcucu

SEQ ID NO: 1298195 - RNA, 18 nt, Human
cuggcuauagaugucuuu

SEQ ID NO: 1298196 - RNA, 19 nt, Human
cuggcuauagaugucuuuu

SEQ ID NO: 1298197 - RNA, 23 nt, Human
cuggcuauagaugucuuuuccca

SEQ ID NO: 1298198 - RNA, 13 nt, Human
cuggcccugcuuc

SEQ ID NO: 1298199 - RNA, 17 nt, Human
cuggcccugcuuccugc

SEQ ID NO: 1298200 - RNA, 21 nt, Human
cuggcccugcuuccugcuugc

SEQ ID NO: 1298201 - RNA, 22 nt, Human
cuggcccugcuuccugcuugcc

SEQ ID NO: 1298202 - RNA, 21 nt, Human
cuggcccugggagaaucgcuc

SEQ ID NO: 1298203 - RNA, 23 nt, Human
cuggcccugcuuccugcuugcca

SEQ ID NO: 1298204 - RNA, 21 nt, Human
cuggcccuugcuuaccucuca

SEQ ID NO: 1298205 - RNA, 16 nt, Human
cuggccgaguccaagc

SEQ ID NO: 1298206 - RNA, 11 nt, Human
cugccagggca

SEQ ID NO: 1298207 - RNA, 12 nt, Human
cugccagggcag

SEQ ID NO: 1298208 - RNA, 13 nt, Human
cugccagggcagg

SEQ ID NO: 1298209 - RNA, 15 nt, Human
cugccagggcagggc

SEQ ID NO: 1298210 - RNA, 16 nt, Human
cugccagggcagggcc

SEQ ID NO: 1298211 - RNA, 16 nt, Human
cugccagggccccucu

SEQ ID NO: 1298212 - RNA, 17 nt, Human
cugccagucccccugcc

SEQ ID NO: 1298213 - RNA, 17 nt, Human
cugccagggccccucuc

SEQ ID NO: 1298214 - RNA, 18 nt, Human
cugccagggccccucucc

SEQ ID NO: 1298215 - RNA, 19 nt, Human
cugccagggccccucuccc

SEQ ID NO: 1298216 - RNA, 20 nt, Human
cugccagggccccucucccc

SEQ ID NO: 1298217 - RNA, 20 nt, Human
cugccagucccccugcccca

SEQ ID NO: 1298218 - RNA, 21 nt, Human
cugccagucccccugccccag

SEQ ID NO: 1298219 - RNA, 22 nt, Human
cugccagucccccugccccagg

SEQ ID NO: 1298220 - RNA, 21 nt, Human
cugccagggccccucucccca

SEQ ID NO: 1298221 - RNA, 23 nt, Human
cugccagggccccucuccccagg

SEQ ID NO: 1298222 - RNA, 16 nt, Human
cugccaguccuguccu

SEQ ID NO: 1298223 - RNA, 12 nt, Human
cugccagugaca

SEQ ID NO: 1298224 - RNA, 16 nt, Human
cugccagugacagaca

SEQ ID NO: 1298225 - RNA, 19 nt, Human
cugccagugacagacaggc

SEQ ID NO: 1298226 - RNA, 21 nt, Human
cugccagugacagacaggcuc

SEQ ID NO: 1298227 - RNA, 23 nt, Human
cugccagugacagacaggcucuu

SEQ ID NO: 1298228 - RNA, 17 nt, Human
cugccaguguccugagc

SEQ ID NO: 1298229 - RNA, 23 nt, Human
cugccaguguccugagccccagg

SEQ ID NO: 1298230 - RNA, 18 nt, Human
cugccauaugauuuacau

SEQ ID NO: 1298231 - RNA, 14 nt, Human
cugccauauuaaau

SEQ ID NO: 1298232 - RNA, 23 nt, Human
cugcccccaccccauucccgcag

SEQ ID NO: 1298233 - RNA, 22 nt, Human
cugcccccaccccauucccgca

SEQ ID NO: 1298234 - RNA, 14 nt, Human
cugcccccagagcc

SEQ ID NO: 1298235 - RNA, 16 nt, Human
cugcccccagagccac

SEQ ID NO: 1298236 - RNA, 17 nt, Human
cugcccccagagccaca

SEQ ID NO: 1298237 - RNA, 18 nt, Human
cugcccccagagccacag

SEQ ID NO: 1298238 - RNA, 20 nt, Human
cugcccccagagccacaguu

SEQ ID NO: 1298239 - RNA, 19 nt, Human
cugcccccagagccacagu

SEQ ID NO: 1298240 - RNA, 13 nt, Human
cugccccccagcc

SEQ ID NO: 1298241 - RNA, 16 nt, Human
cugccccccagccucu

SEQ ID NO: 1298242 - RNA, 19 nt, Human
cugccccccagccucuggc

SEQ ID NO: 1298243 - RNA, 21 nt, Human
cugccccccagccucuggcau

SEQ ID NO: 1298244 - RNA, 12 nt, Human
cugccccccagc

SEQ ID NO: 1298245 - RNA, 14 nt, Human
cugccccgcccuca

SEQ ID NO: 1298246 - RNA, 22 nt, Human
cugccccggccccucccccuga

SEQ ID NO: 1298247 - RNA, 15 nt, Human
cugccccgcccucau

SEQ ID NO: 1298248 - RNA, 19 nt, Human
cugccccuccucucugccc

SEQ ID NO: 1298249 - RNA, 17 nt, Human
cugccccuacccuggac

SEQ ID NO: 1298250 - RNA, 14 nt, Human
cugccccucccuuc

SEQ ID NO: 1298251 - RNA, 17 nt, Human
cugccccucccuucaac

SEQ ID NO: 1298252 - RNA, 21 nt, Human
cugccccuacccuggacuugc

SEQ ID NO: 1298253 - RNA, 13 nt, Human
cugccccucccuu

SEQ ID NO: 1298254 - RNA, 17 nt, Human
cugccccuccucucugc

SEQ ID NO: 1298255 - RNA, 18 nt, Human
cugccccuccucucugcc

SEQ ID NO: 1298256 - RNA, 20 nt, Human
cugccccuccucucugcccu

SEQ ID NO: 1298257 - RNA, 16 nt, Human
cugcaaccuccaccuc

SEQ ID NO: 1298258 - RNA, 14 nt, Human
cugcaaccuccacc

SEQ ID NO: 1298259 - RNA, 17 nt, Human
cugcaaccuccaccucc

SEQ ID NO: 1298260 - RNA, 17 nt, Human
cugcaaccuucgccacc

SEQ ID NO: 1298261 - RNA, 19 nt, Human
cugcaaccuucgccaccug

SEQ ID NO: 1298262 - RNA, 20 nt, Human
cugcaaccuucgccaccugg

SEQ ID NO: 1298263 - RNA, 22 nt, Human
cugcaaccuucgccaccugggu

SEQ ID NO: 1298264 - RNA, 19 nt, Human
cugcaacuuguaaaugugg

SEQ ID NO: 1298265 - RNA, 18 nt, Human
cugcaacuuguaaaugug

SEQ ID NO: 1298266 - RNA, 15 nt, Human
cugcaacucaaggac

SEQ ID NO: 1298267 - RNA, 23 nt, Human
cugcaacucaaggacuuugcagc

SEQ ID NO: 1298268 - RNA, 18 nt, Human
cugcaaaucaggcuuuug

SEQ ID NO: 1298269 - RNA, 20 nt, Human
cugcaaaucaggcuuuuguu

SEQ ID NO: 1298270 - RNA, 13 nt, Human
cugcaaccuccac

SEQ ID NO: 1298271 - RNA, 19 nt, Human
cugcaaauacuguauauuc

SEQ ID NO: 1298272 - RNA, 15 nt, Human
cugcaaaucaggcuu

SEQ ID NO: 1298273 - RNA, 14 nt, Human
cugcaagcacagcc

SEQ ID NO: 1298274 - RNA, 17 nt, Human
cugcaagcacagcccuu

SEQ ID NO: 1298275 - RNA, 16 nt, Human
cugcaagguacucugg

SEQ ID NO: 1298276 - RNA, 17 nt, Human
cugcaagguacucuggu

SEQ ID NO: 1298277 - RNA, 18 nt, Human
cugcaagguacucuggug

SEQ ID NO: 1298278 - RNA, 19 nt, Human
cugcaagguacucugguga

SEQ ID NO: 1298279 - RNA, 17 nt, Human
cugcaaggucuuugguu

SEQ ID NO: 1298280 - RNA, 14 nt, Human
cugcaccggggccu

SEQ ID NO: 1298281 - RNA, 16 nt, Human
cugcaccggggccugg

SEQ ID NO: 1298282 - RNA, 19 nt, Human
cugcaagucaguccaggau

SEQ ID NO: 1298283 - RNA, 18 nt, Human
cugcaccggggccugggc

SEQ ID NO: 1298284 - RNA, 19 nt, Human
cugcaccggggccugggca

SEQ ID NO: 1298285 - RNA, 15 nt, Human
cucuuauaucuauau

SEQ ID NO: 1298286 - RNA, 18 nt, Human
cucuuauaucuauauuuu

SEQ ID NO: 1298287 - RNA, 13 nt, Human
cucuuaugcugua

SEQ ID NO: 1298288 - RNA, 17 nt, Human
cucuuaugcuguaccca

SEQ ID NO: 1298289 - RNA, 19 nt, Human
cucuuaugcuguacccagu

SEQ ID NO: 1298290 - RNA, 20 nt, Human
cucuuaugcuguacccaguu

SEQ ID NO: 1298291 - RNA, 19 nt, Human
cucuuauggauguccccag

SEQ ID NO: 1298292 - RNA, 21 nt, Human
cucuuauggauguccccagca

SEQ ID NO: 1298293 - RNA, 22 nt, Human
cucuuauggauguccccagcag

SEQ ID NO: 1298294 - RNA, 12 nt, Human
cugaugcugaca

SEQ ID NO: 1298295 - RNA, 14 nt, Human
cugaugcugccccu

SEQ ID NO: 1298296 - RNA, 21 nt, Human
cugaugauuuagagugcuguc

SEQ ID NO: 1298297 - RNA, 12 nt, Human
cugaugcagcuu

SEQ ID NO: 1298298 - RNA, 16 nt, Human
cugaugcagcuuauac

SEQ ID NO: 1298299 - RNA, 14 nt, Human
cugaugcaucagaa

SEQ ID NO: 1298300 - RNA, 17 nt, Human
cugaugcaucagaaagg

SEQ ID NO: 1298301 - RNA, 18 nt, Human
cugaugcaucagaaaggg

SEQ ID NO: 1298302 - RNA, 21 nt, Human
cugaugcaucagaaagggagg

SEQ ID NO: 1298303 - RNA, 22 nt, Human
cugaugcaucagaaagggaggg

SEQ ID NO: 1298304 - RNA, 23 nt, Human
cugaugcaucagaaagggagggc

SEQ ID NO: 1298305 - RNA, 17 nt, Human
cugauggagaaggaagg

SEQ ID NO: 1298306 - RNA, 15 nt, Human
cugauggagccuucc

SEQ ID NO: 1298307 - RNA, 16 nt, Human
cugauggagaaggaag

SEQ ID NO: 1298308 - RNA, 15 nt, Human
cugauggagaaggaa

SEQ ID NO: 1298309 - RNA, 14 nt, Human
cugauggagaagga

SEQ ID NO: 1298310 - RNA, 13 nt, Human
cugauggagaagg

SEQ ID NO: 1298311 - RNA, 18 nt, Human
cugcaaagcccagcuuga

SEQ ID NO: 1298312 - RNA, 23 nt, Human
cugaugggguggaaggcauggcg

SEQ ID NO: 1298313 - RNA, 21 nt, Human
cugaugggguggaaggcaugg

SEQ ID NO: 1298314 - RNA, 22 nt, Human
cugcacgaauggaagaggcacc

SEQ ID NO: 1298315 - RNA, 15 nt, Human
cugcacgugcgggug

SEQ ID NO: 1298316 - RNA, 17 nt, Human
cugcacuaacagagugg

SEQ ID NO: 1298317 - RNA, 14 nt, Human
cugcacuauaugca

SEQ ID NO: 1298318 - RNA, 16 nt, Human
cugcacuacugacaug

SEQ ID NO: 1298319 - RNA, 14 nt, Human
cugcacuacugaca

SEQ ID NO: 1298320 - RNA, 16 nt, Human
cugcacuccagccuga

SEQ ID NO: 1298321 - RNA, 20 nt, Human
cugcacuccagccugagcga

SEQ ID NO: 1298322 - RNA, 17 nt, Human
cugcacuccagccugag

SEQ ID NO: 1298323 - RNA, 17 nt, Human
cugcacucaaccuuaag

SEQ ID NO: 1298324 - RNA, 12 nt, Human
cugcagccucag

SEQ ID NO: 1298325 - RNA, 13 nt, Human
cugcagccucaga

SEQ ID NO: 1298326 - RNA, 14 nt, Human
cugcagccucagag

SEQ ID NO: 1298327 - RNA, 13 nt, Human
cugcagccucagg

SEQ ID NO: 1298328 - RNA, 14 nt, Human
cugcagccucagga

SEQ ID NO: 1298329 - RNA, 16 nt, Human
cugcagccucaggacu

SEQ ID NO: 1298330 - RNA, 17 nt, Human
cugcagccucaggacug

SEQ ID NO: 1298331 - RNA, 18 nt, Human
cugcagccucaggacugg

SEQ ID NO: 1298332 - RNA, 19 nt, Human
cugcagccucaggacuggg

SEQ ID NO: 1298333 - RNA, 20 nt, Human
cugcagccucaggacuggga

SEQ ID NO: 1298334 - RNA, 21 nt, Human
cugcagccucaggacugggag

SEQ ID NO: 1298335 - RNA, 11 nt, Human
cugcagccucc

SEQ ID NO: 1298336 - RNA, 22 nt, Human
cugcagccucaggacugggagc

SEQ ID NO: 1298337 - RNA, 11 nt, Human
cugcagcuugu

SEQ ID NO: 1298338 - RNA, 16 nt, Human
cugcagcuuguagcca

SEQ ID NO: 1298339 - RNA, 17 nt, Human
cugcagcuuguagccag

SEQ ID NO: 1298340 - RNA, 18 nt, Human
cugcagcuuguagccagc

SEQ ID NO: 1298341 - RNA, 19 nt, Human
cugcagcuuguagccagcc

SEQ ID NO: 1298342 - RNA, 20 nt, Human
cugcagcuuguagccagccg

SEQ ID NO: 1298343 - RNA, 21 nt, Human
cugcagcuuguagccagccgg

SEQ ID NO: 1298344 - RNA, 22 nt, Human
cugcagcuuguagccagccggg

SEQ ID NO: 1298345 - RNA, 13 nt, Human
cugcaggaaggag

SEQ ID NO: 1298346 - RNA, 14 nt, Human
cugcaggaaggagc

SEQ ID NO: 1298347 - RNA, 15 nt, Human
cugcaggaaggagcu

SEQ ID NO: 1298348 - RNA, 16 nt, Human
cugcaggaaggagcug

SEQ ID NO: 1298349 - RNA, 17 nt, Human
cugcaggaaggagcugc

SEQ ID NO: 1298350 - RNA, 18 nt, Human
cugcaggaaggagcugcc

SEQ ID NO: 1298351 - RNA, 19 nt, Human
cugcaggaaggagcugccu

SEQ ID NO: 1298352 - RNA, 20 nt, Human
cugcaggaaggagcugccug

SEQ ID NO: 1298353 - RNA, 21 nt, Human
cugcaggaaggagcugccugg

SEQ ID NO: 1298354 - RNA, 22 nt, Human
cugcaggaaggagcugccugga

SEQ ID NO: 1298355 - RNA, 23 nt, Human
cugcaggaaggagcugccuggac

SEQ ID NO: 1298356 - RNA, 14 nt, Human
cugcaggaaucuuu

SEQ ID NO: 1298357 - RNA, 20 nt, Human
cugcaggaucucaccaggca

SEQ ID NO: 1298358 - RNA, 21 nt, Human
cugcaggaucucaccaggcag

SEQ ID NO: 1298359 - RNA, 14 nt, Human
cugcaggcaggaac

SEQ ID NO: 1298360 - RNA, 15 nt, Human
cugcaggcaggaaca

SEQ ID NO: 1298361 - RNA, 22 nt, Human
cugcaggcaggaacaaacaggg

SEQ ID NO: 1298362 - RNA, 13 nt, Human
cugcaggcccugg

SEQ ID NO: 1298363 - RNA, 14 nt, Human
cugcaggcccuggc

SEQ ID NO: 1298364 - RNA, 15 nt, Human
cugcaggcccuggcc

SEQ ID NO: 1298365 - RNA, 16 nt, Human
cugcaggcccuggccu

SEQ ID NO: 1298366 - RNA, 17 nt, Human
cugcaggcccuggccuc

SEQ ID NO: 1298367 - RNA, 18 nt, Human
cugcaggcccuggccucc

SEQ ID NO: 1298368 - RNA, 19 nt, Human
cugcaggcccuggccuccc

SEQ ID NO: 1298369 - RNA, 20 nt, Human
gaagcaaugcuucaucccuu

SEQ ID NO: 1298370 - RNA, 22 nt, Human
gaagcaaccucaguaauuuaga

SEQ ID NO: 1298371 - RNA, 16 nt, Human
gaagcaagcuuaaugg

SEQ ID NO: 1298372 - RNA, 23 nt, Human
gaagcaacccaaauguucaucaa

SEQ ID NO: 1298373 - RNA, 17 nt, Human
gaagcaaaucgaaugaa

SEQ ID NO: 1298374 - RNA, 21 nt, Human
gaagcaaaugucaugcugccu

SEQ ID NO: 1298375 - RNA, 22 nt, Human
gaagcaaaugucaugcugccuu

SEQ ID NO: 1298376 - RNA, 20 nt, Human
gaagcaaguaaaaaggcuaa

SEQ ID NO: 1298377 - RNA, 23 nt, Human
gaagcaaaugucaugcugccuua

SEQ ID NO: 1298378 - RNA, 20 nt, Human
gaagcaaccucaguaauuua

SEQ ID NO: 1298379 - RNA, 14 nt, Human
gaagcaaaauuuuu

SEQ ID NO: 1298380 - RNA, 12 nt, Human
gaagacaaacuu

SEQ ID NO: 1298381 - RNA, 14 nt, Human
gaagacaauugaca

SEQ ID NO: 1298382 - RNA, 18 nt, Human
gaagacaauugacaacag

SEQ ID NO: 1298383 - RNA, 12 nt, Human
gaagacacagac

SEQ ID NO: 1298384 - RNA, 21 nt, Human
gaagacacagacugcgauuug

SEQ ID NO: 1298385 - RNA, 23 nt, Human
gaagacaaaacauacauuuugua

SEQ ID NO: 1298386 - RNA, 19 nt, Human
gaagacaaaacauacauuu

SEQ ID NO: 1298387 - RNA, 14 nt, Human
gaacugaaaucaua

SEQ ID NO: 1298388 - RNA, 20 nt, Human
gaacucugacaacagacuuc

SEQ ID NO: 1298389 - RNA, 22 nt, Human
gaacuccuugauuuuagccuuc

SEQ ID NO: 1298390 - RNA, 12 nt, Human
gaaccgaggcag

SEQ ID NO: 1298391 - RNA, 15 nt, Human
gaaccgaggcaggga

SEQ ID NO: 1298392 - RNA, 15 nt, Human
gaacuccuugauuuu

SEQ ID NO: 1298393 - RNA, 20 nt, Human
gaacccuaaauaauaaaaau

SEQ ID NO: 1298394 - RNA, 23 nt, Human
gaacccuuaaacaguugcacagc

SEQ ID NO: 1298395 - RNA, 19 nt, Human
gaacccucuguuccuuccc

SEQ ID NO: 1298396 - RNA, 16 nt, Human
gaacccugcccacucc

SEQ ID NO: 1298397 - RNA, 16 nt, Human
gaacuggccaagcuga

SEQ ID NO: 1298398 - RNA, 18 nt, Human
gaacuggccaagcugagg

SEQ ID NO: 1298399 - RNA, 23 nt, Human
gaagaauacuucucauuuuuuaa

SEQ ID NO: 1298400 - RNA, 21 nt, Human
gaagaaucucaucucagugaa

SEQ ID NO: 1298401 - RNA, 23 nt, Human
gaagaaugcacaagaauggauca

SEQ ID NO: 1298402 - RNA, 24 nt, Human
gaagaaugcuuaaucagauagaua

SEQ ID NO: 1298403 - RNA, 20 nt, Human
gaagaaugcacaagaaugga

SEQ ID NO: 1298404 - RNA, 22 nt, Human
gaagaauguuaagacuugacag

SEQ ID NO: 1298405 - RNA, 12 nt, Human
gaagaauuccag

SEQ ID NO: 1298406 - RNA, 13 nt, Human
gaagaauuauuuu

SEQ ID NO: 1298407 - RNA, 16 nt, Human
gaacugcugccacuga

SEQ ID NO: 1298408 - RNA, 17 nt, Human
gaacugcugccacugag

SEQ ID NO: 1298409 - RNA, 11 nt, Human
gaacuggaggc

SEQ ID NO: 1298410 - RNA, 16 nt, Human
gaacuggaggcaggga

SEQ ID NO: 1298411 - RNA, 14 nt, Human
gaacuggccaagcu

SEQ ID NO: 1298412 - RNA, 15 nt, Human
gaacuggccaagcug

SEQ ID NO: 1298413 - RNA, 12 nt, Human
gaacucugaaau

SEQ ID NO: 1298414 - RNA, 12 nt, Human
gaacugaacacc

SEQ ID NO: 1298415 - RNA, 21 nt, Human
gaacugaacaccauugaaggc

SEQ ID NO: 1298416 - RNA, 22 nt, Human
gaacugaacaccauugaaggcu

SEQ ID NO: 1298417 - RNA, 23 nt, Human
gaacugaacaccauugaaggcuu

SEQ ID NO: 1298418 - RNA, 12 nt, Human
gaacugaacuca

SEQ ID NO: 1298419 - RNA, 19 nt, Human
gaacugaagggggcggccu

SEQ ID NO: 1298420 - RNA, 22 nt, Human
gaacugcuagucaagugcgucc

SEQ ID NO: 1298421 - RNA, 13 nt, Human
gaacugcugccac

SEQ ID NO: 1298422 - RNA, 14 nt, Human
gaacugcugccacu

SEQ ID NO: 1298423 - RNA, 15 nt, Human
gaacugcugccacug

SEQ ID NO: 1298424 - RNA, 23 nt, Human
gaaguugacuuauaguacaugau

SEQ ID NO: 1298425 - RNA, 21 nt, Human
gaaguugacuuauaguacaug

SEQ ID NO: 1298426 - RNA, 19 nt, Human
gaaguuagcuuuaacuuaa

SEQ ID NO: 1298427 - RNA, 17 nt, Human
gaaguuagcuuuaacuu

SEQ ID NO: 1298428 - RNA, 15 nt, Human
gaaguuaguuuguau

SEQ ID NO: 1298429 - RNA, 16 nt, Human
gaaguuaguuuguaua

SEQ ID NO: 1298430 - RNA, 17 nt, Human
gaaguuaguuuguauau

SEQ ID NO: 1298431 - RNA, 21 nt, Human
gaaguugcugcuucucccagg

SEQ ID NO: 1298432 - RNA, 12 nt, Human
gaaguugcugcu

SEQ ID NO: 1298433 - RNA, 14 nt, Human
gaaguugcugcuuc

SEQ ID NO: 1298434 - RNA, 15 nt, Human
gaaggggacccuccg

SEQ ID NO: 1298435 - RNA, 20 nt, Human
gaauauuagugaccucagcu

SEQ ID NO: 1298436 - RNA, 19 nt, Human
gaauauaauuguuuuaucu

SEQ ID NO: 1298437 - RNA, 20 nt, Human
gaauauaauuguuuuaucug

SEQ ID NO: 1298438 - RNA, 22 nt, Human
gaauauacagcaggugcucaau

SEQ ID NO: 1298439 - RNA, 21 nt, Human
gaauaugucagugcugaugua

SEQ ID NO: 1298440 - RNA, 17 nt, Human
gaauauuaucuucauaa

SEQ ID NO: 1298441 - RNA, 13 nt, Human
gaauauuguccau

SEQ ID NO: 1298442 - RNA, 20 nt, Human
gaagcuaucguaaaauuaag

SEQ ID NO: 1298443 - RNA, 22 nt, Human
gaagcuagacacaugaagguaa

SEQ ID NO: 1298444 - RNA, 14 nt, Human
gaagcuagucuuuu

SEQ ID NO: 1298445 - RNA, 16 nt, Human
gaagcuagucuuuugc

SEQ ID NO: 1298446 - RNA, 20 nt, Human
gaagcuauuuuuuucaguuu

SEQ ID NO: 1298447 - RNA, 21 nt, Human
gaagcuagacacaugaaggua

SEQ ID NO: 1298448 - RNA, 23 nt, Human
gaagcuagacacaugaagguaaa

SEQ ID NO: 1298449 - RNA, 17 nt, Human
gaagcuccucuccccag

SEQ ID NO: 1298450 - RNA, 19 nt, Human
gaagcuccucuccccagcc

SEQ ID NO: 1298451 - RNA, 20 nt, Human
gaagcuccucuccccagccc

SEQ ID NO: 1298452 - RNA, 21 nt, Human
gaagcuccucuccccagccca

SEQ ID NO: 1298453 - RNA, 22 nt, Human
gaagcuccucuccccagcccag

SEQ ID NO: 1298454 - RNA, 23 nt, Human
gaagcuccucuccccagcccaga

SEQ ID NO: 1298455 - RNA, 20 nt, Human
gaagcucuuggagcugugag

SEQ ID NO: 1298456 - RNA, 16 nt, Human
gaaggcuucucucugu

SEQ ID NO: 1298457 - RNA, 14 nt, Human
gaagggccagagcc

SEQ ID NO: 1298458 - RNA, 15 nt, Human
gaagggccagagcca

SEQ ID NO: 1298459 - RNA, 16 nt, Human
gaagggccagagccag

SEQ ID NO: 1298460 - RNA, 17 nt, Human
gaagggccagagccagg

SEQ ID NO: 1298461 - RNA, 18 nt, Human
gaagggccagagccaggg

SEQ ID NO: 1298462 - RNA, 15 nt, Human
gaaggcuugggauuu

SEQ ID NO: 1298463 - RNA, 22 nt, Human
gaagggccugcccaguugcacu

SEQ ID NO: 1298464 - RNA, 22 nt, Human
gaagggcugcuucccugaagcu

SEQ ID NO: 1298465 - RNA, 16 nt, Human
gacauuugcucaugga

SEQ ID NO: 1298466 - RNA, 17 nt, Human
gacauuugcucauggaa

SEQ ID NO: 1298467 - RNA, 13 nt, Human
gacauuucucuaa

SEQ ID NO: 1298468 - RNA, 16 nt, Human
gacauuucucuaagag

SEQ ID NO: 1298469 - RNA, 23 nt, Human
gacauugaccuauuuccagaaau

SEQ ID NO: 1298470 - RNA, 22 nt, Human
gacauucugaaugcuucuaagu

SEQ ID NO: 1298471 - RNA, 13 nt, Human
gacauucugauuc

SEQ ID NO: 1298472 - RNA, 23 nt, Human
gacauucugauucgaaugacacu

SEQ ID NO: 1298473 - RNA, 22 nt, Human
gacauucugauucgaaugacac

SEQ ID NO: 1298474 - RNA, 16 nt, Human
gacauuccuugcugaa

SEQ ID NO: 1298475 - RNA, 12 nt, Human
gacauucugaau

SEQ ID NO: 1298476 - RNA, 14 nt, Human
gacauucugaaugc

SEQ ID NO: 1298477 - RNA, 15 nt, Human
gacauucugaaugcu

SEQ ID NO: 1298478 - RNA, 19 nt, Human
gacauucugaaugcuucua

SEQ ID NO: 1298479 - RNA, 20 nt, Human
gacauucugaaugcuucuaa

SEQ ID NO: 1298480 - RNA, 21 nt, Human
gacagugagacucugucucag

SEQ ID NO: 1298481 - RNA, 19 nt, Human
gacagugauauuggaacuu

SEQ ID NO: 1298482 - RNA, 21 nt, Human
gacauucaccugccccaacuc

SEQ ID NO: 1298483 - RNA, 22 nt, Human
gaccagcuuuucccaaaagccc

SEQ ID NO: 1298484 - RNA, 23 nt, Human
gaccagcugcuccgaggacccag

SEQ ID NO: 1298485 - RNA, 13 nt, Human
gaccagcucagga

SEQ ID NO: 1298486 - RNA, 14 nt, Human
gaccagcucaggac

SEQ ID NO: 1298487 - RNA, 22 nt, Human
gaccagcucaggacagaugcca

SEQ ID NO: 1298488 - RNA, 13 nt, Human
gaccagcuccccc

SEQ ID NO: 1298489 - RNA, 18 nt, Human
gaccagcucccccucccu

SEQ ID NO: 1298490 - RNA, 19 nt, Human
gaccagcucccccucccuc

SEQ ID NO: 1298491 - RNA, 20 nt, Human
gaccagcucccccucccucc

SEQ ID NO: 1298492 - RNA, 21 nt, Human
gaccagcucccccucccuccc

SEQ ID NO: 1298493 - RNA, 13 nt, Human
gaccagcugcucc

SEQ ID NO: 1298494 - RNA, 15 nt, Human
gaccagcugcuccga

SEQ ID NO: 1298495 - RNA, 19 nt, Human
gaccagcugcuccgaggac

SEQ ID NO: 1298496 - RNA, 20 nt, Human
gaccagcugcuccgaggacc

SEQ ID NO: 1298497 - RNA, 21 nt, Human
gaccagcugcuccgaggaccc

SEQ ID NO: 1298498 - RNA, 14 nt, Human
gaccagccuggccc

SEQ ID NO: 1298499 - RNA, 16 nt, Human
gaccagccuggcccac

SEQ ID NO: 1298500 - RNA, 15 nt, Human
gaccagccuggccca

SEQ ID NO: 1298501 - RNA, 12 nt, Human
gaccagcucagg

SEQ ID NO: 1298502 - RNA, 13 nt, Human
gaccauacuaauu

SEQ ID NO: 1298503 - RNA, 21 nt, Human
gaccagggcuccagccccucu

SEQ ID NO: 1298504 - RNA, 11 nt, Human
gaccagggcuc

SEQ ID NO: 1298505 - RNA, 18 nt, Human
gaccagggcuccagcccc

SEQ ID NO: 1298506 - RNA, 20 nt, Human
gaccauaauguuacauuauu

SEQ ID NO: 1298507 - RNA, 17 nt, Human
gacagaaccacagggcu

SEQ ID NO: 1298508 - RNA, 20 nt, Human
gacagaaccccuacaugaaa

SEQ ID NO: 1298509 - RNA, 15 nt, Human
gacacacugaagaag

SEQ ID NO: 1298510 - RNA, 16 nt, Human
gacacacugaagaagc

SEQ ID NO: 1298511 - RNA, 11 nt, Human
gacacagaaaa

SEQ ID NO: 1298512 - RNA, 16 nt, Human
gacacagaaaauguug

SEQ ID NO: 1298513 - RNA, 18 nt, Human
gacacagaaaauguugag

SEQ ID NO: 1298514 - RNA, 16 nt, Human
gaccaucugauuaaaa

SEQ ID NO: 1298515 - RNA, 21 nt, Human
gaccaugcucaucugcugguc

SEQ ID NO: 1298516 - RNA, 22 nt, Human
gaccucuccccuggaacugucu

SEQ ID NO: 1298517 - RNA, 14 nt, Human
gaccucugacagca

SEQ ID NO: 1298518 - RNA, 15 nt, Human
gaccucugacagcag

SEQ ID NO: 1298519 - RNA, 16 nt, Human
gaccucugacagcagc

SEQ ID NO: 1298520 - RNA, 17 nt, Human
gaccucugacagcagca

SEQ ID NO: 1298521 - RNA, 15 nt, Human
gaccucuggguuggg

SEQ ID NO: 1298522 - RNA, 15 nt, Human
gaccugaaauuccaa

SEQ ID NO: 1298523 - RNA, 17 nt, Human
gaccugaaauuccaaag

SEQ ID NO: 1298524 - RNA, 19 nt, Human
gaccugaaauuccaaaguc

SEQ ID NO: 1298525 - RNA, 12 nt, Human
gaccugaagaau

SEQ ID NO: 1298526 - RNA, 24 nt, Human
gaccugaaggguugacuuuaccca

SEQ ID NO: 1298527 - RNA, 23 nt, Human
gaccugaaauuccaaagucucua

SEQ ID NO: 1298528 - RNA, 16 nt, Human
gaccugagaauguauc

SEQ ID NO: 1298529 - RNA, 16 nt, Human
gaccugagaccugaag

SEQ ID NO: 1298530 - RNA, 11 nt, Human
gaccugagccu

SEQ ID NO: 1298531 - RNA, 12 nt, Human
gaccugagccug

SEQ ID NO: 1298532 - RNA, 13 nt, Human
gaccugagccugc

SEQ ID NO: 1298533 - RNA, 14 nt, Human
gaccugagccugcc

SEQ ID NO: 1298534 - RNA, 15 nt, Human
gaccugagccugccg

SEQ ID NO: 1298535 - RNA, 16 nt, Human
gaccugagccugccga

SEQ ID NO: 1298536 - RNA, 17 nt, Human
gaccugagccugccgag

SEQ ID NO: 1298537 - RNA, 18 nt, Human
gaccugagccugccgagc

SEQ ID NO: 1298538 - RNA, 19 nt, Human
gacgccugggggugccagg

SEQ ID NO: 1298539 - RNA, 21 nt, Human
gacgccugggggugccaggac

SEQ ID NO: 1298540 - RNA, 17 nt, Human
gacgcucucuggccuuc

SEQ ID NO: 1298541 - RNA, 16 nt, Human
gacgcucucuggccuu

SEQ ID NO: 1298542 - RNA, 19 nt, Human
gacuuuaacauaagcuauu

SEQ ID NO: 1298543 - RNA, 21 nt, Human
gacuuuacccauuuggguggg

SEQ ID NO: 1298544 - RNA, 19 nt, Human
gacuuuauagaucagccag

SEQ ID NO: 1298545 - RNA, 17 nt, Human
gacuuuauguaguuuuu

SEQ ID NO: 1298546 - RNA, 14 nt, Human
gacucuuaagaaga

SEQ ID NO: 1298547 - RNA, 15 nt, Human
gacucuuaagaagac

SEQ ID NO: 1298548 - RNA, 13 nt, Human
gacucugugcugg

SEQ ID NO: 1298549 - RNA, 14 nt, Human
gacucugugcuggc

SEQ ID NO: 1298550 - RNA, 16 nt, Human
gacucugugcuggcca

SEQ ID NO: 1298551 - RNA, 17 nt, Human
gacucugugcuggccag

SEQ ID NO: 1298552 - RNA, 18 nt, Human
gacucugugcuggccagc

SEQ ID NO: 1298553 - RNA, 21 nt, Human
gacucuuaagaagacugcauu

SEQ ID NO: 1298554 - RNA, 21 nt, Human
gacucugugcuggccagcgag

SEQ ID NO: 1298555 - RNA, 17 nt, Human
gacucuucugagcaccu

SEQ ID NO: 1298556 - RNA, 11 nt, Human
gacucuugccu

SEQ ID NO: 1298557 - RNA, 21 nt, Human
gacucuugccuguuucccagg

SEQ ID NO: 1298558 - RNA, 19 nt, Human
gacugaaaauauuguuuua

SEQ ID NO: 1298559 - RNA, 15 nt, Human
gacucaccuccccca

SEQ ID NO: 1298560 - RNA, 22 nt, Human
gacucaccucccccaucucuuc

SEQ ID NO: 1298561 - RNA, 12 nt, Human
gacucugccucc

SEQ ID NO: 1298562 - RNA, 16 nt, Human
gacucugccuccucuu

SEQ ID NO: 1298563 - RNA, 13 nt, Human
gacucugcagccu

SEQ ID NO: 1298564 - RNA, 14 nt, Human
gacucugcagccuc

SEQ ID NO: 1298565 - RNA, 15 nt, Human
gacucugcagccuca

SEQ ID NO: 1298566 - RNA, 16 nt, Human
gacucugcagccucag

SEQ ID NO: 1298567 - RNA, 18 nt, Human
gacucugcagccucagag

SEQ ID NO: 1298568 - RNA, 22 nt, Human
gacugugugcucaggagcccug

SEQ ID NO: 1298569 - RNA, 15 nt, Human
gacugugauucagaa

SEQ ID NO: 1298570 - RNA, 15 nt, Human
gacugugugugcccu

SEQ ID NO: 1298571 - RNA, 17 nt, Human
gacugugugugcccucu

SEQ ID NO: 1298572 - RNA, 21 nt, Human
gacugugugugcccucugggc

SEQ ID NO: 1298573 - RNA, 18 nt, Human
gacugugugugcccucug

SEQ ID NO: 1298574 - RNA, 21 nt, Human
gacuguuguuaucuguuugag

SEQ ID NO: 1298575 - RNA, 14 nt, Human
gacuuuaacauaag

SEQ ID NO: 1298576 - RNA, 18 nt, Human
gacuuuaacauaagcuau

SEQ ID NO: 1298577 - RNA, 13 nt, Human
gacuguuucaaac

SEQ ID NO: 1298578 - RNA, 13 nt, Human
gacuguuuggaaa

SEQ ID NO: 1298579 - RNA, 18 nt, Human
gacuuguuuuugcacaug

SEQ ID NO: 1298580 - RNA, 20 nt, Human
gacuguuguuaucuguuuga

SEQ ID NO: 1298581 - RNA, 19 nt, Human
gacuguuguuaucuguuug

SEQ ID NO: 1298582 - RNA, 14 nt, Human
gacuguuguuaucu

SEQ ID NO: 1298583 - RNA, 20 nt, Human
gacugaauuaugaaacuuuu

SEQ ID NO: 1298584 - RNA, 23 nt, Human
gacuguacuccucccaggcgccc

SEQ ID NO: 1298585 - RNA, 14 nt, Human
gacugaauuaugaa

SEQ ID NO: 1298586 - RNA, 13 nt, Human
gacuguagggagg

SEQ ID NO: 1298587 - RNA, 22 nt, Human
gacuguagggagggcggcaggg

SEQ ID NO: 1298588 - RNA, 23 nt, Human
gacuguagggagggcggcagggg

SEQ ID NO: 1298589 - RNA, 19 nt, Human
gacugucuggccccccugg

SEQ ID NO: 1298590 - RNA, 15 nt, Human
gacugucuggggagc

SEQ ID NO: 1298591 - RNA, 14 nt, Human
gacugucuggggag

SEQ ID NO: 1298592 - RNA, 19 nt, Human
gaggggccgaugcccagag

SEQ ID NO: 1298593 - RNA, 9 nt, Human
gagggcugc

SEQ ID NO: 1298594 - RNA, 13 nt, Human
gagggcucugagg

SEQ ID NO: 1298595 - RNA, 14 nt, Human
gagggcucugaggc

SEQ ID NO: 1298596 - RNA, 15 nt, Human
gagggcucugaggcg

SEQ ID NO: 1298597 - RNA, 16 nt, Human
gagggcugccuuugga

SEQ ID NO: 1298598 - RNA, 13 nt, Human
gagggcugcccug

SEQ ID NO: 1298599 - RNA, 20 nt, Human
gaggcugaggcuggcacagg

SEQ ID NO: 1298600 - RNA, 15 nt, Human
gaggcugaggcuggc

SEQ ID NO: 1298601 - RNA, 16 nt, Human
gaggcugaggcuggca

SEQ ID NO: 1298602 - RNA, 19 nt, Human
gaggcugaggcuggcacag

SEQ ID NO: 1298603 - RNA, 10 nt, Human
gagggcugga

SEQ ID NO: 1298604 - RNA, 16 nt, Human
gagggcuggaggccca

SEQ ID NO: 1298605 - RNA, 17 nt, Human
gagggcuggaggcccag

SEQ ID NO: 1298606 - RNA, 19 nt, Human
gagggcuggaggcccaggc

SEQ ID NO: 1298607 - RNA, 20 nt, Human
gagggcuggaggcccaggcu

SEQ ID NO: 1298608 - RNA, 23 nt, Human
gagggcuggaggcccaggcuggg

SEQ ID NO: 1298609 - RNA, 10 nt, Human
gagggcuggc

SEQ ID NO: 1298610 - RNA, 13 nt, Human
gagggcuggcugg

SEQ ID NO: 1298611 - RNA, 14 nt, Human
gagggcuggcuggc

SEQ ID NO: 1298612 - RNA, 16 nt, Human
gagggcuggcuggccu

SEQ ID NO: 1298613 - RNA, 18 nt, Human
gagggcuggcuggccuca

SEQ ID NO: 1298614 - RNA, 18 nt, Human
gaggccagaccauggaca

SEQ ID NO: 1298615 - RNA, 12 nt, Human
gaggccagacca

SEQ ID NO: 1298616 - RNA, 17 nt, Human
gaggcaucgcaauguaa

SEQ ID NO: 1298617 - RNA, 18 nt, Human
gaggccacacucagcaca

SEQ ID NO: 1298618 - RNA, 21 nt, Human
gaggccacacucagcacaagg

SEQ ID NO: 1298619 - RNA, 12 nt, Human
gaggcuccacuu

SEQ ID NO: 1298620 - RNA, 12 nt, Human
gaggcucagguc

SEQ ID NO: 1298621 - RNA, 14 nt, Human
gaggcuccagaggg

SEQ ID NO: 1298622 - RNA, 23 nt, Human
gaggcuccacuuggucugugaga

SEQ ID NO: 1298623 - RNA, 14 nt, Human
gaggcugaggccug

SEQ ID NO: 1298624 - RNA, 16 nt, Human
gaggcugaggccugga

SEQ ID NO: 1298625 - RNA, 18 nt, Human
gaggcugaggccuggacu

SEQ ID NO: 1298626 - RNA, 19 nt, Human
gaggcugaggccuggacuu

SEQ ID NO: 1298627 - RNA, 19 nt, Human
gaggcuccacuuggucugu

SEQ ID NO: 1298628 - RNA, 22 nt, Human
gaggcuagguggguugaaagcc

SEQ ID NO: 1298629 - RNA, 20 nt, Human
gaggcuauuauuuucacugu

SEQ ID NO: 1298630 - RNA, 14 nt, Human
gaggcucagauugu

SEQ ID NO: 1298631 - RNA, 10 nt, Human
gaggcucagg

SEQ ID NO: 1298632 - RNA, 23 nt, Human
gaggcaggggcuuccuggugcug

SEQ ID NO: 1298633 - RNA, 22 nt, Human
gaggcaguaccugggcaagcug

SEQ ID NO: 1298634 - RNA, 23 nt, Human
gaggcaguaccugggcaagcugg

SEQ ID NO: 1298635 - RNA, 17 nt, Human
gaggcaggggcuuccug

SEQ ID NO: 1298636 - RNA, 18 nt, Human
gaggcaggggcuuccugg

SEQ ID NO: 1298637 - RNA, 20 nt, Human
gaggcaggggcuuccuggug

SEQ ID NO: 1298638 - RNA, 21 nt, Human
gaggcaggggcuuccuggugc

SEQ ID NO: 1298639 - RNA, 20 nt, Human
gaggacgcucucuggccuuc

SEQ ID NO: 1298640 - RNA, 16 nt, Human
gaggcaggggcuuccu

SEQ ID NO: 1298641 - RNA, 15 nt, Human
gaggacgcucucugg

SEQ ID NO: 1298642 - RNA, 21 nt, Human
gaggaccugagccugccgagc

SEQ ID NO: 1298643 - RNA, 12 nt, Human
gaggaccugagc

SEQ ID NO: 1298644 - RNA, 13 nt, Human
gaggaccugagcc

SEQ ID NO: 1298645 - RNA, 14 nt, Human
gaggaccugagccu

SEQ ID NO: 1298646 - RNA, 15 nt, Human
gaggaccugagccug

SEQ ID NO: 1298647 - RNA, 16 nt, Human
gaggaccugagccugc

SEQ ID NO: 1298648 - RNA, 17 nt, Human
gaggaccugagccugcc

SEQ ID NO: 1298649 - RNA, 18 nt, Human
gaggaccugagccugccg

SEQ ID NO: 1298650 - RNA, 22 nt, Human
gaggaccugagccugccgagca

SEQ ID NO: 1298651 - RNA, 21 nt, Human
gagcuggagaugaggccagac

SEQ ID NO: 1298652 - RNA, 20 nt, Human
gagcuggagaugaggccaga

SEQ ID NO: 1298653 - RNA, 17 nt, Human
gagcuggaccucaccaa

SEQ ID NO: 1298654 - RNA, 16 nt, Human
gagcgaguggagucug

SEQ ID NO: 1298655 - RNA, 20 nt, Human
gagcgaguggagucugccac

SEQ ID NO: 1298656 - RNA, 23 nt, Human
gagcgaguggagucugccaccca

SEQ ID NO: 1298657 - RNA, 21 nt, Human
gagcgcacagggagugcacau

SEQ ID NO: 1298658 - RNA, 21 nt, Human
gagcgcccacuagacccacug

SEQ ID NO: 1298659 - RNA, 23 nt, Human
gagcgcccagcuccugacacugc

SEQ ID NO: 1298660 - RNA, 12 nt, Human
gagcgcccugca

SEQ ID NO: 1298661 - RNA, 13 nt, Human
gagcgcccugcag

SEQ ID NO: 1298662 - RNA, 14 nt, Human
gagcgcccugcaga

SEQ ID NO: 1298663 - RNA, 16 nt, Human
gagcgcccugcagacc

SEQ ID NO: 1298664 - RNA, 19 nt, Human
gagcgcccugcagacccug

SEQ ID NO: 1298665 - RNA, 20 nt, Human
gagcgcccugcagacccugc

SEQ ID NO: 1298666 - RNA, 21 nt, Human
gagcgcccugcagacccugcc

SEQ ID NO: 1298667 - RNA, 23 nt, Human
gagcgcccugcagacccugcccu

SEQ ID NO: 1298668 - RNA, 22 nt, Human
gagcgcccugcagacccugccc

SEQ ID NO: 1298669 - RNA, 19 nt, Human
gagcgccuccauccaaggc

SEQ ID NO: 1298670 - RNA, 23 nt, Human
gagcgccuccauccaaggccagg

SEQ ID NO: 1298671 - RNA, 16 nt, Human
gaguuuaaauuguaau

SEQ ID NO: 1298672 - RNA, 14 nt, Human
gaguuuaaaaucau

SEQ ID NO: 1298673 - RNA, 20 nt, Human
gaguuuaaaaucaucagaaa

SEQ ID NO: 1298674 - RNA, 18 nt, Human
gaguugcugcaaaccuga

SEQ ID NO: 1298675 - RNA, 22 nt, Human
gaguugcuuuucagcugagguu

SEQ ID NO: 1298676 - RNA, 15 nt, Human
gaguuggaaucacug

SEQ ID NO: 1298677 - RNA, 15 nt, Human
gaggugagaccaccu

SEQ ID NO: 1298678 - RNA, 22 nt, Human
gaggugaccccagggcacagga

SEQ ID NO: 1298679 - RNA, 23 nt, Human
gaggugaccccagggcacaggag

SEQ ID NO: 1298680 - RNA, 17 nt, Human
gaggugaccccagggca

SEQ ID NO: 1298681 - RNA, 18 nt, Human
gaggugaccccagggcac

SEQ ID NO: 1298682 - RNA, 19 nt, Human
gaggugaccccagggcaca

SEQ ID NO: 1298683 - RNA, 21 nt, Human
gaggugaccccagggcacagg

SEQ ID NO: 1298684 - RNA, 16 nt, Human
gaggugagaccaccuc

SEQ ID NO: 1298685 - RNA, 14 nt, Human
gaggugcacuggga

SEQ ID NO: 1298686 - RNA, 22 nt, Human
gaggugcuucuaguucugccag

SEQ ID NO: 1298687 - RNA, 23 nt, Human
gaggugcuucuaguucugccagg

SEQ ID NO: 1298688 - RNA, 17 nt, Human
gagucacuacgccuggc

SEQ ID NO: 1298689 - RNA, 22 nt, Human
gagucagacauuuuaagauggu

SEQ ID NO: 1298690 - RNA, 15 nt, Human
gagucagagccaugu

SEQ ID NO: 1298691 - RNA, 23 nt, Human
gagucaggacuugaacccagguc

SEQ ID NO: 1298692 - RNA, 17 nt, Human
gaguccaucagccucca

SEQ ID NO: 1298693 - RNA, 14 nt, Human
gagugaguggcccu

SEQ ID NO: 1298694 - RNA, 19 nt, Human
gagugauagucuuuugcuu

SEQ ID NO: 1298695 - RNA, 16 nt, Human
gagugacuacacacag

SEQ ID NO: 1298696 - RNA, 15 nt, Human
gagugacucaagaag

SEQ ID NO: 1298697 - RNA, 23 nt, Human
gagugacucaagaagugaagaau

SEQ ID NO: 1298698 - RNA, 14 nt, Human
gagugcaccaaaga

SEQ ID NO: 1298699 - RNA, 17 nt, Human
gagugcaccaaagagaa

SEQ ID NO: 1298700 - RNA, 15 nt, Human
gagugcaccaaagag

SEQ ID NO: 1298701 - RNA, 21 nt, Human
gaguggagucugccacccagg

SEQ ID NO: 1298702 - RNA, 17 nt, Human
gaguugaucuggaaccc

SEQ ID NO: 1298703 - RNA, 19 nt, Human
gaguugaucuggaacccag

SEQ ID NO: 1298704 - RNA, 20 nt, Human
gaguugaucuggaacccaga

SEQ ID NO: 1298705 - RNA, 21 nt, Human
gaguugaucuggaacccagac

SEQ ID NO: 1298706 - RNA, 19 nt, Human
gaguggagucugccaccca

SEQ ID NO: 1298707 - RNA, 20 nt, Human
gaguggagucugccacccag

SEQ ID NO: 1298708 - RNA, 14 nt, Human
gaguggcagcccag

SEQ ID NO: 1298709 - RNA, 15 nt, Human
gaguggcagcccagc

SEQ ID NO: 1298710 - RNA, 16 nt, Human
gaguggcagcccagcc

SEQ ID NO: 1298711 - RNA, 18 nt, Human
gaguggcagcccagccag

SEQ ID NO: 1298712 - RNA, 21 nt, Human
gaguggcagcccagccagcgu

SEQ ID NO: 1298713 - RNA, 22 nt, Human
gaguggcagcccagccagcguc

SEQ ID NO: 1298714 - RNA, 14 nt, Human
gaguggcaggggac

SEQ ID NO: 1298715 - RNA, 16 nt, Human
gaguggcaggggacag

SEQ ID NO: 1298716 - RNA, 19 nt, Human
gaguggcaggggacaggag

SEQ ID NO: 1298717 - RNA, 23 nt, Human
gaguggcaggggacaggagucca

SEQ ID NO: 1298718 - RNA, 14 nt, Human
gaguugaucuggaa

SEQ ID NO: 1298719 - RNA, 16 nt, Human
gaguugaucuggaacc

SEQ ID NO: 1298720 - RNA, 21 nt, Human
gagguccuuaggccucugaga

SEQ ID NO: 1298721 - RNA, 19 nt, Human
gagguccuuaggccucuga

SEQ ID NO: 1298722 - RNA, 21 nt, Human
gaggucgguagguucagccaa

SEQ ID NO: 1298723 - RNA, 22 nt, Human
gaggucgguagguucagccaag

SEQ ID NO: 1298724 - RNA, 23 nt, Human
gaggucgguagguucagccaagg

SEQ ID NO: 1298725 - RNA, 13 nt, Human
gaggucuaaucua

SEQ ID NO: 1298726 - RNA, 15 nt, Human
gaggugaccccaggg

SEQ ID NO: 1298727 - RNA, 16 nt, Human
gaggugaccccagggc

SEQ ID NO: 1298728 - RNA, 21 nt, Human
gaggucucagccccuuucccu

SEQ ID NO: 1298729 - RNA, 13 nt, Human
gaggucucagccc

SEQ ID NO: 1298730 - RNA, 21 nt, Human
gauuuuuuucccaauugagaa

SEQ ID NO: 1298731 - RNA, 14 nt, Human
gauuuuuuccaaaa

SEQ ID NO: 1298732 - RNA, 18 nt, Human
gauuuuuuccuucaaagu

SEQ ID NO: 1298733 - RNA, 21 nt, Human
gauuuuuuccuucaaaguuua

SEQ ID NO: 1298734 - RNA, 15 nt, Human
gauuuuuuuuucaua

SEQ ID NO: 1298735 - RNA, 20 nt, Human
gcaaguauuagaauaccaca

SEQ ID NO: 1298736 - RNA, 18 nt, Human
gcaagucagaauagaaau

SEQ ID NO: 1298737 - RNA, 15 nt, Human
gcaaguucccaguug

SEQ ID NO: 1298738 - RNA, 13 nt, Human
gcaaguucccagu

SEQ ID NO: 1298739 - RNA, 20 nt, Human
gcaauauacuggaaagcuuu

SEQ ID NO: 1298740 - RNA, 20 nt, Human
gcacagugcaucucagccca

SEQ ID NO: 1298741 - RNA, 21 nt, Human
gcacagugcaucucagcccac

SEQ ID NO: 1298742 - RNA, 14 nt, Human
gcacaccccacucc

SEQ ID NO: 1298743 - RNA, 17 nt, Human
gcacauaguagaacgcu

SEQ ID NO: 1298744 - RNA, 23 nt, Human
gcacauauggaauuuugcaaaga

SEQ ID NO: 1298745 - RNA, 18 nt, Human
gcacaauaacuccuccca

SEQ ID NO: 1298746 - RNA, 19 nt, Human
gcacaauaacuccucccag

SEQ ID NO: 1298747 - RNA, 20 nt, Human
gcacaauaacuccucccagg

SEQ ID NO: 1298748 - RNA, 21 nt, Human
gcacaauaacuccucccaggg

SEQ ID NO: 1298749 - RNA, 22 nt, Human
gcacaauaacuccucccagggu

SEQ ID NO: 1298750 - RNA, 21 nt, Human
gcacaaguguaaugaauaccu

SEQ ID NO: 1298751 - RNA, 19 nt, Human
gcacaaguguaaugaauac

SEQ ID NO: 1298752 - RNA, 17 nt, Human
gcacaaguguaaugaau

SEQ ID NO: 1298753 - RNA, 14 nt, Human
gcacaaguguaaug

SEQ ID NO: 1298754 - RNA, 16 nt, Human
gcacaauaaaaauguu

SEQ ID NO: 1298755 - RNA, 17 nt, Human
gcacaauaaaaauguuu

SEQ ID NO: 1298756 - RNA, 17 nt, Human
gcacaaguuauuuaaau

SEQ ID NO: 1298757 - RNA, 18 nt, Human
gcacaauaaauggcugua

SEQ ID NO: 1298758 - RNA, 19 nt, Human
gcacaauaaauggcuguaa

SEQ ID NO: 1298759 - RNA, 13 nt, Human
gcacaucccugga

SEQ ID NO: 1298760 - RNA, 14 nt, Human
gcaccggggccugg

SEQ ID NO: 1298761 - RNA, 18 nt, Human
gcacaucucaacaggccu

SEQ ID NO: 1298762 - RNA, 19 nt, Human
gcacaucucaacaggccuc

SEQ ID NO: 1298763 - RNA, 22 nt, Human
gcacaucucaacaggccucagg

SEQ ID NO: 1298764 - RNA, 16 nt, Human
gcaccggggccugggc

SEQ ID NO: 1298765 - RNA, 21 nt, Human
gcaccuaccaccacgcccggc

SEQ ID NO: 1298766 - RNA, 19 nt, Human
gcaccggggccugggcagg

SEQ ID NO: 1298767 - RNA, 21 nt, Human
gcacaucucaacaggccucag

SEQ ID NO: 1298768 - RNA, 22 nt, Human
gcaccuaccaccacgcccggcu

SEQ ID NO: 1298769 - RNA, 14 nt, Human
gcaccuacuuacau

SEQ ID NO: 1298770 - RNA, 17 nt, Human
gcacucgcuagcagugg

SEQ ID NO: 1298771 - RNA, 20 nt, Human
gcacucgcuagcaguggcag

SEQ ID NO: 1298772 - RNA, 22 nt, Human
gcacuugcgguuccggcaugga

SEQ ID NO: 1298773 - RNA, 15 nt, Human
gcacuugcuggaaga

SEQ ID NO: 1298774 - RNA, 15 nt, Human
gauucugcaguaaau

SEQ ID NO: 1298775 - RNA, 16 nt, Human
gauucugcaguaaauc

SEQ ID NO: 1298776 - RNA, 16 nt, Human
gauuuaccacuugugu

SEQ ID NO: 1298777 - RNA, 15 nt, Human
gauuuacgcucauug

SEQ ID NO: 1298778 - RNA, 20 nt, Human
gauuuaggagaagccaggaa

SEQ ID NO: 1298779 - RNA, 13 nt, Human
gauuuaguuucag

SEQ ID NO: 1298780 - RNA, 14 nt, Human
gauuuaguuucagu

SEQ ID NO: 1298781 - RNA, 15 nt, Human
gauuuaguuucagua

SEQ ID NO: 1298782 - RNA, 16 nt, Human
gauuuaguuucaguag

SEQ ID NO: 1298783 - RNA, 20 nt, Human
gauuuuuuacagcugccugc

SEQ ID NO: 1298784 - RNA, 15 nt, Human
gauuuauuaaagaaa

SEQ ID NO: 1298785 - RNA, 16 nt, Human
gauuuauuaaagaaaa

SEQ ID NO: 1298786 - RNA, 19 nt, Human
gauuuauuaaagaaaaaaa

SEQ ID NO: 1298787 - RNA, 19 nt, Human
gauuuuuuaauaauuuaga

SEQ ID NO: 1298788 - RNA, 17 nt, Human
gauuuauuaaagaaaaa

SEQ ID NO: 1298789 - RNA, 11 nt, Human
gauuuuuucca

SEQ ID NO: 1298790 - RNA, 12 nt, Human
gauuuuuuccaa

SEQ ID NO: 1298791 - RNA, 13 nt, Human
gauuuuuuccaaa

SEQ ID NO: 1298792 - RNA, 15 nt, Human
gauuuaucacacaaa

SEQ ID NO: 1298793 - RNA, 17 nt, Human
gauuuaucacacaaagc

SEQ ID NO: 1298794 - RNA, 20 nt, Human
gauuuaucacacaaagcaga

SEQ ID NO: 1298795 - RNA, 19 nt, Human
gauuuaucacacaaagcag

SEQ ID NO: 1298796 - RNA, 12 nt, Human
gauuuauuaaag

SEQ ID NO: 1298797 - RNA, 13 nt, Human
gauuuauuaaaga

SEQ ID NO: 1298798 - RNA, 14 nt, Human
gauuuauuaaagaa

SEQ ID NO: 1298799 - RNA, 22 nt, Human
gauucugguuccagggucccuc

SEQ ID NO: 1298800 - RNA, 17 nt, Human
gauucugguuccagggu

SEQ ID NO: 1298801 - RNA, 18 nt, Human
gauucugcaguaaaucuu

SEQ ID NO: 1298802 - RNA, 19 nt, Human
gauucugcaguaaaucuuu

SEQ ID NO: 1298803 - RNA, 21 nt, Human
gauucugcaguaaaucuuuua

SEQ ID NO: 1298804 - RNA, 12 nt, Human
gauucugccuuu

SEQ ID NO: 1298805 - RNA, 15 nt, Human
gauucugccuuugcc

SEQ ID NO: 1298806 - RNA, 17 nt, Human
gauucugccuuugccag

SEQ ID NO: 1298807 - RNA, 17 nt, Human
gauucugcuggccucug

SEQ ID NO: 1298808 - RNA, 19 nt, Human
gauucugcuggccucugcg

SEQ ID NO: 1298809 - RNA, 22 nt, Human
gauucugcuggccucugcgagu

SEQ ID NO: 1298810 - RNA, 15 nt, Human
gauuuaccacuugug

SEQ ID NO: 1298811 - RNA, 14 nt, Human
gauucuuccaucug

SEQ ID NO: 1298812 - RNA, 14 nt, Human
gauuauauuaugaa

SEQ ID NO: 1298813 - RNA, 13 nt, Human
gauuauagauucu

SEQ ID NO: 1298814 - RNA, 14 nt, Human
gauuauagauucua

SEQ ID NO: 1298815 - RNA, 15 nt, Human
gauuauagauucuaa

SEQ ID NO: 1298816 - RNA, 17 nt, Human
gauuauagauucuaaag

SEQ ID NO: 1298817 - RNA, 18 nt, Human
gauuauagauucuaaaga

SEQ ID NO: 1298818 - RNA, 22 nt, Human
gauuauagauucuaaagauucu

SEQ ID NO: 1298819 - RNA, 20 nt, Human
gauuauaggcaccuaccacc

SEQ ID NO: 1298820 - RNA, 13 nt, Human
gauuaucguuuuc

SEQ ID NO: 1298821 - RNA, 21 nt, Human
gauuaucguuuucuuaaagug

SEQ ID NO: 1298822 - RNA, 20 nt, Human
gauuaucguuuucuuaaagu

SEQ ID NO: 1298823 - RNA, 14 nt, Human
gauuaugggucaca

SEQ ID NO: 1298824 - RNA, 20 nt, Human
gauguauguugaagccuuug

SEQ ID NO: 1298825 - RNA, 16 nt, Human
gauguaggagggacug

SEQ ID NO: 1298826 - RNA, 14 nt, Human
gauguaggagggac

SEQ ID NO: 1298827 - RNA, 13 nt, Human
gauguaguauuuu

SEQ ID NO: 1298828 - RNA, 21 nt, Human
gauguauguugaagccuuugu

SEQ ID NO: 1298829 - RNA, 15 nt, Human
gaugucaauuucugu

SEQ ID NO: 1298830 - RNA, 18 nt, Human
gaugucaauuucuguguu

SEQ ID NO: 1298831 - RNA, 13 nt, Human
gauuauucagugu

SEQ ID NO: 1298832 - RNA, 14 nt, Human
gauuauucaguguc

SEQ ID NO: 1298833 - RNA, 15 nt, Human
gauuauucaguguca

SEQ ID NO: 1298834 - RNA, 13 nt, Human
gauuaugggucac

SEQ ID NO: 1298835 - RNA, 15 nt, Human
gauggagaaggaagg

SEQ ID NO: 1298836 - RNA, 16 nt, Human
gauggagaaggaaggc

SEQ ID NO: 1298837 - RNA, 14 nt, Human
gauggagaaggaag

SEQ ID NO: 1298838 - RNA, 13 nt, Human
gauggagaaggaa

SEQ ID NO: 1298839 - RNA, 12 nt, Human
gauggagaagga

SEQ ID NO: 1298840 - RNA, 13 nt, Human
gauggacaucuug

SEQ ID NO: 1298841 - RNA, 18 nt, Human
gaugauacauccaaagca

SEQ ID NO: 1298842 - RNA, 14 nt, Human
gaugcugauggagc

SEQ ID NO: 1298843 - RNA, 12 nt, Human
gaugcugccccu

SEQ ID NO: 1298844 - RNA, 13 nt, Human
gaugcugccccuc

SEQ ID NO: 1298845 - RNA, 18 nt, Human
gauguagaggagaaacug

SEQ ID NO: 1298846 - RNA, 13 nt, Human
gauguaaagaugu

SEQ ID NO: 1298847 - RNA, 17 nt, Human
gauguaaaaucuuguca

SEQ ID NO: 1298848 - RNA, 12 nt, Human
gauguaaagaug

SEQ ID NO: 1298849 - RNA, 18 nt, Human
gauguagcagaauauuuc

SEQ ID NO: 1298850 - RNA, 13 nt, Human
gauguaggaggga

SEQ ID NO: 1298851 - RNA, 13 nt, Human
gauguaaaaucuu

SEQ ID NO: 1298852 - RNA, 14 nt, Human
gauguaaaaucuug

SEQ ID NO: 1298853 - RNA, 15 nt, Human
gauguaaaaucuugu

SEQ ID NO: 1298854 - RNA, 16 nt, Human
gauguaaaaucuuguc

SEQ ID NO: 1298855 - RNA, 20 nt, Human
gauguaaaaucuugucaugu

SEQ ID NO: 1298856 - RNA, 21 nt, Human
gaugagggcagcagccagccc

SEQ ID NO: 1298857 - RNA, 20 nt, Human
gaugagggcagcagccagcc

SEQ ID NO: 1298858 - RNA, 12 nt, Human
gaugagggcagc

SEQ ID NO: 1298859 - RNA, 13 nt, Human
gaugagggcagca

SEQ ID NO: 1298860 - RNA, 14 nt, Human
gaugagggcagcag

SEQ ID NO: 1298861 - RNA, 15 nt, Human
gaugagggcagcagc

SEQ ID NO: 1298862 - RNA, 16 nt, Human
gaugagggcagcagcc

SEQ ID NO: 1298863 - RNA, 17 nt, Human
gaugagggcagcagcca

SEQ ID NO: 1298864 - RNA, 18 nt, Human
gaugagggcagcagccag

SEQ ID NO: 1298865 - RNA, 16 nt, Human
gaugauaaacgacuuu

SEQ ID NO: 1298866 - RNA, 19 nt, Human
gaugauaaagagacaguga

SEQ ID NO: 1298867 - RNA, 13 nt, Human
cucugcagguccc

SEQ ID NO: 1298868 - RNA, 12 nt, Human
cucugcagccuc

SEQ ID NO: 1298869 - RNA, 13 nt, Human
cucugcagccuca

SEQ ID NO: 1298870 - RNA, 14 nt, Human
cucugcagccucag

SEQ ID NO: 1298871 - RNA, 15 nt, Human
cucugcagccucaga

SEQ ID NO: 1298872 - RNA, 16 nt, Human
cucugcagccucagag

SEQ ID NO: 1298873 - RNA, 19 nt, Human
cucugcagccucagagaca

SEQ ID NO: 1298874 - RNA, 12 nt, Human
cucugcucugau

SEQ ID NO: 1298875 - RNA, 13 nt, Human
cucugcucugcgu

SEQ ID NO: 1298876 - RNA, 15 nt, Human
cucugcucugaugca

SEQ ID NO: 1298877 - RNA, 14 nt, Human
cucugcucugaugc

SEQ ID NO: 1298878 - RNA, 13 nt, Human
cucugcugaccug

SEQ ID NO: 1298879 - RNA, 17 nt, Human
cucugcugaccugcuga

SEQ ID NO: 1298880 - RNA, 16 nt, Human
cucugcugaccugcug

SEQ ID NO: 1298881 - RNA, 16 nt, Human
cucugcugcugucccu

SEQ ID NO: 1298882 - RNA, 21 nt, Human
cucugcugcugucccuccccc

SEQ ID NO: 1298883 - RNA, 22 nt, Human
cucugcugcugucccucccccu

SEQ ID NO: 1298884 - RNA, 12 nt, Human
cucuguccccag

SEQ ID NO: 1298885 - RNA, 13 nt, Human
cucuguccccagc

SEQ ID NO: 1298886 - RNA, 14 nt, Human
cucuguccccagcc

SEQ ID NO: 1298887 - RNA, 16 nt, Human
cucuguccccagccug

SEQ ID NO: 1298888 - RNA, 17 nt, Human
cucuguccccagccugg

SEQ ID NO: 1298889 - RNA, 19 nt, Human
cucuguccugaaggccuga

SEQ ID NO: 1298890 - RNA, 12 nt, Human
cucuguccugaa

SEQ ID NO: 1298891 - RNA, 13 nt, Human
cucuguccugaag

SEQ ID NO: 1298892 - RNA, 17 nt, Human
cucuguccugaaggccu

SEQ ID NO: 1298893 - RNA, 22 nt, Human
cucuguccugaaggccugaggu

SEQ ID NO: 1298894 - RNA, 13 nt, Human
cucuuagcugucu

SEQ ID NO: 1298895 - RNA, 22 nt, Human
cucuuagggacagucaaaacca

SEQ ID NO: 1298896 - RNA, 18 nt, Human
cucuuagucuagguccuu

SEQ ID NO: 1298897 - RNA, 20 nt, Human
cucugcacacccuccagaga

SEQ ID NO: 1298898 - RNA, 22 nt, Human
cucugcacacccuccagagaca

SEQ ID NO: 1298899 - RNA, 16 nt, Human
cucuccccaugauguu

SEQ ID NO: 1298900 - RNA, 19 nt, Human
cucuauguucuaagaagug

SEQ ID NO: 1298901 - RNA, 19 nt, Human
cucuauggggcauccucuu

SEQ ID NO: 1298902 - RNA, 19 nt, Human
cucuccccccgccugccac

SEQ ID NO: 1298903 - RNA, 14 nt, Human
cucucccugcaugg

SEQ ID NO: 1298904 - RNA, 16 nt, Human
cucucuggccuucggc

SEQ ID NO: 1298905 - RNA, 14 nt, Human
cucucuggccuucg

SEQ ID NO: 1298906 - RNA, 19 nt, Human
cucucugugggcuggcagu

SEQ ID NO: 1298907 - RNA, 19 nt, Human
cucucuuagggacagucaa

SEQ ID NO: 1298908 - RNA, 23 nt, Human
cucucuuauugccucacuucagg

SEQ ID NO: 1298909 - RNA, 16 nt, Human
cucucuucucuccagc

SEQ ID NO: 1298910 - RNA, 17 nt, Human
cucuauguaucaaaugu

SEQ ID NO: 1298911 - RNA, 16 nt, Human
cucguggacaccugcc

SEQ ID NO: 1298912 - RNA, 15 nt, Human
cucguggacaccugc

SEQ ID NO: 1298913 - RNA, 20 nt, Human
cucuaugaacucuguuuucu

SEQ ID NO: 1298914 - RNA, 13 nt, Human
cucuaugagucua

SEQ ID NO: 1298915 - RNA, 14 nt, Human
cucuaugagucuag

SEQ ID NO: 1298916 - RNA, 15 nt, Human
cucuaugagucuaga

SEQ ID NO: 1298917 - RNA, 16 nt, Human
cucuaugagucuagau

SEQ ID NO: 1298918 - RNA, 17 nt, Human
cucuaugagucuagaug

SEQ ID NO: 1298919 - RNA, 19 nt, Human
cucuaugagucuagauguu

SEQ ID NO: 1298920 - RNA, 14 nt, Human
cucguggacaccug

SEQ ID NO: 1298921 - RNA, 12 nt, Human
cucguggacacc

SEQ ID NO: 1298922 - RNA, 17 nt, Human
cucgucucuuuuacccu

SEQ ID NO: 1298923 - RNA, 14 nt, Human
cucguccucguuug

SEQ ID NO: 1298924 - RNA, 19 nt, Human
cucguccucguuuguguuc

SEQ ID NO: 1298925 - RNA, 23 nt, Human
cucgucucuuuuacccuggcccc

SEQ ID NO: 1298926 - RNA, 20 nt, Human
cuccuuucacaaccuucugu

SEQ ID NO: 1298927 - RNA, 13 nt, Human
cuccuuuaauugu

SEQ ID NO: 1298928 - RNA, 18 nt, Human
cucccccccaugcacugu

SEQ ID NO: 1298929 - RNA, 17 nt, Human
cucccaggcaaggcugu

SEQ ID NO: 1298930 - RNA, 18 nt, Human
cucccaggcaaggcugug

SEQ ID NO: 1298931 - RNA, 22 nt, Human
cucccaggcaaggcuguggacc

SEQ ID NO: 1298932 - RNA, 16 nt, Human
cucccaggcacugucu

SEQ ID NO: 1298933 - RNA, 19 nt, Human
cucccaggagacaguucaa

SEQ ID NO: 1298934 - RNA, 15 nt, Human
cucccaggaccacag

SEQ ID NO: 1298935 - RNA, 15 nt, Human
cucccaggcaaggcu

SEQ ID NO: 1298936 - RNA, 18 nt, Human
cucccaggaacugggcca

SEQ ID NO: 1298937 - RNA, 21 nt, Human
cucccaggaccacaggcucag

SEQ ID NO: 1298938 - RNA, 16 nt, Human
cucccaggagacaguu

SEQ ID NO: 1298939 - RNA, 11 nt, Human
cucccccugcc

SEQ ID NO: 1298940 - RNA, 20 nt, Human
cucccccccaugcacuguga

SEQ ID NO: 1298941 - RNA, 21 nt, Human
cucccccccaugcacugugaa

SEQ ID NO: 1298942 - RNA, 17 nt, Human
cucccaggcacugucuu

SEQ ID NO: 1298943 - RNA, 17 nt, Human
cuccccccgccugccac

SEQ ID NO: 1298944 - RNA, 18 nt, Human
cucccucccagagcaccu

SEQ ID NO: 1298945 - RNA, 20 nt, Human
cucccucccagagcaccugc

SEQ ID NO: 1298946 - RNA, 21 nt, Human
cucccucccagagcaccugcu

SEQ ID NO: 1298947 - RNA, 16 nt, Human
cuccccuaaagccuca

SEQ ID NO: 1298948 - RNA, 23 nt, Human
cuccccuaaagccucaaaacaaa

SEQ ID NO: 1298949 - RNA, 17 nt, Human
cucccucucaggaucca

SEQ ID NO: 1298950 - RNA, 19 nt, Human
cucccucuccgacucacac

SEQ ID NO: 1298951 - RNA, 18 nt, Human
cucccucucaacacccag

SEQ ID NO: 1298952 - RNA, 19 nt, Human
cucccucucaacacccagu

SEQ ID NO: 1298953 - RNA, 20 nt, Human
cucccugaaguaagcaaaga

SEQ ID NO: 1298954 - RNA, 11 nt, Human
cucccucuccg

SEQ ID NO: 1298955 - RNA, 18 nt, Human
cucccugaagccuuugca

SEQ ID NO: 1298956 - RNA, 14 nt, Human
cuccagguggcucu

SEQ ID NO: 1298957 - RNA, 17 nt, Human
cuccagguggcucugag

SEQ ID NO: 1298958 - RNA, 15 nt, Human
cucccacaggcccuu

SEQ ID NO: 1298959 - RNA, 14 nt, Human
cucccacaggcccu

SEQ ID NO: 1298960 - RNA, 16 nt, Human
cucccacaggcccuuc

SEQ ID NO: 1298961 - RNA, 20 nt, Human
cucccacaggcccuuccucu

SEQ ID NO: 1298962 - RNA, 21 nt, Human
cucccacaggcccuuccucuc

SEQ ID NO: 1298963 - RNA, 21 nt, Human
cucccacagucccaucugcuu

SEQ ID NO: 1298964 - RNA, 20 nt, Human
cucccacagucccaucugcu

SEQ ID NO: 1298965 - RNA, 16 nt, Human
cucccacucuccuagg

SEQ ID NO: 1298966 - RNA, 17 nt, Human
cucccacucuccuaggc

SEQ ID NO: 1298967 - RNA, 21 nt, Human
cucccacucuccuaggcauuc

SEQ ID NO: 1298968 - RNA, 15 nt, Human
cucccagagcaccug

SEQ ID NO: 1298969 - RNA, 18 nt, Human
cucccagagcaccugcug

SEQ ID NO: 1298970 - RNA, 20 nt, Human
cucccagagcaccugcuguc

SEQ ID NO: 1298971 - RNA, 19 nt, Human
cucccagagcaccugcugu

SEQ ID NO: 1298972 - RNA, 15 nt, Human
cucccagaggagcca

SEQ ID NO: 1298973 - RNA, 14 nt, Human
cucaugugacucuu

SEQ ID NO: 1298974 - RNA, 16 nt, Human
cucauguacauacccu

SEQ ID NO: 1298975 - RNA, 20 nt, Human
cucauggccccucugaccug

SEQ ID NO: 1298976 - RNA, 14 nt, Human
cucauggguggcac

SEQ ID NO: 1298977 - RNA, 15 nt, Human
cucauggguggcacu

SEQ ID NO: 1298978 - RNA, 19 nt, Human
cucauggguggcacucagu

SEQ ID NO: 1298979 - RNA, 23 nt, Human
cucauggguggcacucagucucu

SEQ ID NO: 1298980 - RNA, 11 nt, Human
cuccucugcug

SEQ ID NO: 1298981 - RNA, 12 nt, Human
cuccucugcuga

SEQ ID NO: 1298982 - RNA, 14 nt, Human
cuccucugcugacc

SEQ ID NO: 1298983 - RNA, 16 nt, Human
cuccucugcugaccug

SEQ ID NO: 1298984 - RNA, 19 nt, Human
cuccucugcugaccugcug

SEQ ID NO: 1298985 - RNA, 20 nt, Human
cuccucugcugaccugcuga

SEQ ID NO: 1298986 - RNA, 21 nt, Human
cuccucugcugaccugcugac

SEQ ID NO: 1298987 - RNA, 12 nt, Human
cuccucugucca

SEQ ID NO: 1298988 - RNA, 15 nt, Human
cuccucuguccaggc

SEQ ID NO: 1298989 - RNA, 16 nt, Human
cuccucuuccaugcug

SEQ ID NO: 1298990 - RNA, 18 nt, Human
cuccucuuccaugcugug

SEQ ID NO: 1298991 - RNA, 20 nt, Human
cuccucuuccaugcugugcg

SEQ ID NO: 1298992 - RNA, 13 nt, Human
cuccucuucccca

SEQ ID NO: 1298993 - RNA, 14 nt, Human
cuccucuuccccag

SEQ ID NO: 1298994 - RNA, 15 nt, Human
cuccucuuccccaga

SEQ ID NO: 1298995 - RNA, 17 nt, Human
cuccucuuccccagacg

SEQ ID NO: 1298996 - RNA, 17 nt, Human
cuccucuucuacucacu

SEQ ID NO: 1298997 - RNA, 18 nt, Human
cuccucuugccacugccu

SEQ ID NO: 1298998 - RNA, 14 nt, Human
cuccuggcccagcc

SEQ ID NO: 1298999 - RNA, 15 nt, Human
cuccuggcccagccu

SEQ ID NO: 1299000 - RNA, 12 nt, Human
cuccucuugcca

SEQ ID NO: 1299001 - RNA, 23 nt, Human
cuccucuucuacucacuuuuccc

SEQ ID NO: 1299002 - RNA, 15 nt, Human
cuccucuugccacug

SEQ ID NO: 1299003 - RNA, 16 nt, Human
cuccucuugccacugc

SEQ ID NO: 1299004 - RNA, 18 nt, Human
cuccuggcccagccuuug

SEQ ID NO: 1299005 - RNA, 22 nt, Human
cuccuggcucuugauacccccc

SEQ ID NO: 1299006 - RNA, 15 nt, Human
cuccugggcccucuc

SEQ ID NO: 1299007 - RNA, 17 nt, Human
cuccugggcccucucug

SEQ ID NO: 1299008 - RNA, 19 nt, Human
cuccugggcccucucugcu

SEQ ID NO: 1299009 - RNA, 20 nt, Human
cuccugggcccucucugcuc

SEQ ID NO: 1299010 - RNA, 20 nt, Human
cuccuguaacauacuggccu

SEQ ID NO: 1299011 - RNA, 22 nt, Human
cuccuguaacauacuggccugg

SEQ ID NO: 1299012 - RNA, 23 nt, Human
cuccuguaacauacuggccugga

SEQ ID NO: 1299013 - RNA, 13 nt, Human
cuccuguccccug

SEQ ID NO: 1299014 - RNA, 14 nt, Human
cuccuguccccugc

SEQ ID NO: 1299015 - RNA, 15 nt, Human
cuccuguccccugcu

SEQ ID NO: 1299016 - RNA, 21 nt, Human
cuccuguccccugcuacaccu

SEQ ID NO: 1299017 - RNA, 18 nt, Human
cuccuguccccugcuaca

SEQ ID NO: 1299018 - RNA, 14 nt, Human
cuccuggggguucu

SEQ ID NO: 1299019 - RNA, 21 nt, Human
cuccugggcccucucugcucu

SEQ ID NO: 1299020 - RNA, 22 nt, Human
cuccugggcccucucugcucug

SEQ ID NO: 1299021 - RNA, 16 nt, Human
cuccuggcccagccuu

SEQ ID NO: 1299022 - RNA, 23 nt, Human
cuccuggguuuuguauucucuga

SEQ ID NO: 1299023 - RNA, 17 nt, Human
cuccuggucaccuagga

SEQ ID NO: 1299024 - RNA, 18 nt, Human
cuccuggucaccuaggaa

SEQ ID NO: 1299025 - RNA, 15 nt, Human
cuccuggugccaccu

SEQ ID NO: 1299026 - RNA, 16 nt, Human
cuccuuucacaaccuu

SEQ ID NO: 1299027 - RNA, 17 nt, Human
cuccuuucacaaccuuc

SEQ ID NO: 1299028 - RNA, 13 nt, Human
cuccuuucacaac

SEQ ID NO: 1299029 - RNA, 15 nt, Human
cuccuuuaauuguaa

SEQ ID NO: 1299030 - RNA, 18 nt, Human
cuccuugugggccugggc

SEQ ID NO: 1299031 - RNA, 19 nt, Human
cuccuugugggccugggcu

SEQ ID NO: 1299032 - RNA, 21 nt, Human
cuccuugugggccugggcucc

SEQ ID NO: 1299033 - RNA, 14 nt, Human
cuccuugugccaga

SEQ ID NO: 1299034 - RNA, 16 nt, Human
cuccuugugggccugg

SEQ ID NO: 1299035 - RNA, 16 nt, Human
cuccugucucccuccu

SEQ ID NO: 1299036 - RNA, 22 nt, Human
cuccucugcccgggagcucagg

SEQ ID NO: 1299037 - RNA, 24 nt, Human
cuccucugcccgggagcucaggaa

SEQ ID NO: 1299038 - RNA, 13 nt, Human
cuccucugacuca

SEQ ID NO: 1299039 - RNA, 18 nt, Human
cuccucugacucagggcu

SEQ ID NO: 1299040 - RNA, 19 nt, Human
cuccucugacucagggcuc

SEQ ID NO: 1299041 - RNA, 20 nt, Human
cuccucugacucagggcucc

SEQ ID NO: 1299042 - RNA, 22 nt, Human
cuccucugacucagggcuccug

SEQ ID NO: 1299043 - RNA, 12 nt, Human
cuccucugcacu

SEQ ID NO: 1299044 - RNA, 13 nt, Human
cuccucugcacuc

SEQ ID NO: 1299045 - RNA, 13 nt, Human
cuccuaccuggua

SEQ ID NO: 1299046 - RNA, 14 nt, Human
cuccuaccucugcu

SEQ ID NO: 1299047 - RNA, 23 nt, Human
cuccggaggacucaccacugccc

SEQ ID NO: 1299048 - RNA, 17 nt, Human
cuccggaggacucacca

SEQ ID NO: 1299049 - RNA, 16 nt, Human
cucagccucucgaagu

SEQ ID NO: 1299050 - RNA, 15 nt, Human
cucagccucuccccu

SEQ ID NO: 1299051 - RNA, 21 nt, Human
cucagccucuccccugccugc

SEQ ID NO: 1299052 - RNA, 19 nt, Human
cucagccugaaccccaggg

SEQ ID NO: 1299053 - RNA, 13 nt, Human
cucagccuggcca

SEQ ID NO: 1299054 - RNA, 14 nt, Human
cucagccuggccag

SEQ ID NO: 1299055 - RNA, 15 nt, Human
cucagccuggccaga

SEQ ID NO: 1299056 - RNA, 16 nt, Human
cucagccuggccagac

SEQ ID NO: 1299057 - RNA, 17 nt, Human
cucagccuggccagaca

SEQ ID NO: 1299058 - RNA, 19 nt, Human
cucagccuggccagacaca

SEQ ID NO: 1299059 - RNA, 20 nt, Human
cucagccuggccagacacag

SEQ ID NO: 1299060 - RNA, 16 nt, Human
cucagccugaacccca

SEQ ID NO: 1299061 - RNA, 11 nt, Human
cucagccuggg

SEQ ID NO: 1299062 - RNA, 12 nt, Human
cucagccugggc

SEQ ID NO: 1299063 - RNA, 14 nt, Human
cucagccugggcgc

SEQ ID NO: 1299064 - RNA, 15 nt, Human
cucagccugggcgcu

SEQ ID NO: 1299065 - RNA, 16 nt, Human
cucagccugggcgcug

SEQ ID NO: 1299066 - RNA, 21 nt, Human
cucagccugggcgcugguccu

SEQ ID NO: 1299067 - RNA, 20 nt, Human
cucaggccaagaaacgucuu

SEQ ID NO: 1299068 - RNA, 22 nt, Human
cucaggcccccaccuggcucac

SEQ ID NO: 1299069 - RNA, 17 nt, Human
cucaggcugaccacuuu

SEQ ID NO: 1299070 - RNA, 12 nt, Human
cucaggcugccu

SEQ ID NO: 1299071 - RNA, 13 nt, Human
cucaggcugccug

SEQ ID NO: 1299072 - RNA, 14 nt, Human
cucaggcugccuga

SEQ ID NO: 1299073 - RNA, 15 nt, Human
cucaggcugccugag

SEQ ID NO: 1299074 - RNA, 21 nt, Human
cucaggcugccugagucguga

SEQ ID NO: 1299075 - RNA, 16 nt, Human
cucaggcugccugagu

SEQ ID NO: 1299076 - RNA, 22 nt, Human
cucaccuugugcuggggacagg

SEQ ID NO: 1299077 - RNA, 22 nt, Human
cucacgccuguaaucccagcau

SEQ ID NO: 1299078 - RNA, 18 nt, Human
cucacggccacacagcug

SEQ ID NO: 1299079 - RNA, 21 nt, Human
cucacggccacacagcugccg

SEQ ID NO: 1299080 - RNA, 19 nt, Human
cucacggccacacagcugc

SEQ ID NO: 1299081 - RNA, 14 nt, Human
cucacgucaaaugc

SEQ ID NO: 1299082 - RNA, 14 nt, Human
cucacguccugaga

SEQ ID NO: 1299083 - RNA, 15 nt, Human
cucacguccugagaa

SEQ ID NO: 1299084 - RNA, 15 nt, Human
cucacuaauucauua

SEQ ID NO: 1299085 - RNA, 15 nt, Human
cucacuaggccccca

SEQ ID NO: 1299086 - RNA, 18 nt, Human
cucacuaggcccccacuu

SEQ ID NO: 1299087 - RNA, 22 nt, Human
cucacuaggcccccacuugccu

SEQ ID NO: 1299088 - RNA, 22 nt, Human
cucagaaagugccugacacacu

SEQ ID NO: 1299089 - RNA, 13 nt, Human
cucagaagccugg

SEQ ID NO: 1299090 - RNA, 14 nt, Human
cucagaagccuggg

SEQ ID NO: 1299091 - RNA, 15 nt, Human
cucagaagccugggg

SEQ ID NO: 1299092 - RNA, 16 nt, Human
cucagaagccuggggg

SEQ ID NO: 1299093 - RNA, 17 nt, Human
cucagaagccugggggc

SEQ ID NO: 1299094 - RNA, 20 nt, Human
cucagaagccugggggccug

SEQ ID NO: 1299095 - RNA, 21 nt, Human
cucagaagccugggggccugg

SEQ ID NO: 1299096 - RNA, 22 nt, Human
cucagaagccugggggccuggc

SEQ ID NO: 1299097 - RNA, 23 nt, Human
cucagaagccugggggccuggcu

SEQ ID NO: 1299098 - RNA, 15 nt, Human
cucagacccuuucuu

SEQ ID NO: 1299099 - RNA, 14 nt, Human
cucagacccuuucu

SEQ ID NO: 1299100 - RNA, 19 nt, Human
cucagacucuaagaaagaa

SEQ ID NO: 1299101 - RNA, 14 nt, Human
cucagacucuaaga

SEQ ID NO: 1299102 - RNA, 18 nt, Human
cucagacucuaagaaaga

SEQ ID NO: 1299103 - RNA, 14 nt, Human
cucagacuggggca

SEQ ID NO: 1299104 - RNA, 12 nt, Human
cucagcccugag

SEQ ID NO: 1299105 - RNA, 13 nt, Human
cucagcccugagg

SEQ ID NO: 1299106 - RNA, 17 nt, Human
cucagcccugaggacag

SEQ ID NO: 1299107 - RNA, 16 nt, Human
cucagcccugaggaca

SEQ ID NO: 1299108 - RNA, 15 nt, Human
cucagcccugcacca

SEQ ID NO: 1299109 - RNA, 20 nt, Human
cucagcccugcaccaugcug

SEQ ID NO: 1299110 - RNA, 16 nt, Human
cucagcccugcaccau

SEQ ID NO: 1299111 - RNA, 14 nt, Human
cucagguguugcca

SEQ ID NO: 1299112 - RNA, 22 nt, Human
cucagguugucugaagucacug

SEQ ID NO: 1299113 - RNA, 15 nt, Human
cucagguguugccaa

SEQ ID NO: 1299114 - RNA, 14 nt, Human
cucagguugucuga

SEQ ID NO: 1299115 - RNA, 16 nt, Human
cucaguagucccugca

SEQ ID NO: 1299116 - RNA, 13 nt, Human
cucaguagucccu

SEQ ID NO: 1299117 - RNA, 17 nt, Human
cucaguaugaauuauuc

SEQ ID NO: 1299118 - RNA, 16 nt, Human
cucaguccaugaagau

SEQ ID NO: 1299119 - RNA, 15 nt, Human
cucagugaagaauac

SEQ ID NO: 1299120 - RNA, 18 nt, Human
cucagugaagaauacuuc

SEQ ID NO: 1299121 - RNA, 14 nt, Human
cucagugaagacua

SEQ ID NO: 1299122 - RNA, 15 nt, Human
cucagugaaguugcu

SEQ ID NO: 1299123 - RNA, 16 nt, Human
cucagugaaguugcug

SEQ ID NO: 1299124 - RNA, 18 nt, Human
cucagugaaguugcugcu

SEQ ID NO: 1299125 - RNA, 19 nt, Human
cucagugaaguugcugcuu

SEQ ID NO: 1299126 - RNA, 20 nt, Human
cucagugaaguugcugcuuc

SEQ ID NO: 1299127 - RNA, 21 nt, Human
cucagugaaguugcugcuucu

SEQ ID NO: 1299128 - RNA, 20 nt, Human
cucagugacccuggcuccuu

SEQ ID NO: 1299129 - RNA, 19 nt, Human
cucagugacccuggcuccu

SEQ ID NO: 1299130 - RNA, 15 nt, Human
cucaugaauguaaau

SEQ ID NO: 1299131 - RNA, 16 nt, Human
cucaugaauguaaauu

SEQ ID NO: 1299132 - RNA, 22 nt, Human
cucaugaauguaaauuuguacu

SEQ ID NO: 1299133 - RNA, 21 nt, Human
cucaugaauguaaauuuguac

SEQ ID NO: 1299134 - RNA, 16 nt, Human
cucaugcaaaucaauu

SEQ ID NO: 1299135 - RNA, 19 nt, Human
cucaugcaaaucaauuacu

SEQ ID NO: 1299136 - RNA, 20 nt, Human
cucaugcaaaucaauuacug

SEQ ID NO: 1299137 - RNA, 15 nt, Human
cucauggccccucug

SEQ ID NO: 1299138 - RNA, 17 nt, Human
cucauggccccucugac

SEQ ID NO: 1299139 - RNA, 19 nt, Human
cucauggccccucugaccu

SEQ ID NO: 1299140 - RNA, 14 nt, Human
cucaauuagugugg

SEQ ID NO: 1299141 - RNA, 12 nt, Human
cucaauuccaac

SEQ ID NO: 1299142 - RNA, 16 nt, Human
cucaauuccaacaguu

SEQ ID NO: 1299143 - RNA, 21 nt, Human
cucaauuccaacaguuuaaug

SEQ ID NO: 1299144 - RNA, 19 nt, Human
cucaaugagcauguuuaga

SEQ ID NO: 1299145 - RNA, 16 nt, Human
cucaaucagucucaga

SEQ ID NO: 1299146 - RNA, 15 nt, Human
cucaaucccugagga

SEQ ID NO: 1299147 - RNA, 12 nt, Human
cucaaugagcau

SEQ ID NO: 1299148 - RNA, 13 nt, Human
cucaaugagcaug

SEQ ID NO: 1299149 - RNA, 14 nt, Human
cucaaugagcaugu

SEQ ID NO: 1299150 - RNA, 15 nt, Human
cucaaugagcauguu

SEQ ID NO: 1299151 - RNA, 14 nt, Human
cucaauggacugga

SEQ ID NO: 1299152 - RNA, 17 nt, Human
cucaauggacuggaagg

SEQ ID NO: 1299153 - RNA, 20 nt, Human
cucaauggacuggaagggga

SEQ ID NO: 1299154 - RNA, 22 nt, Human
cucaaguugauuagaaagacca

SEQ ID NO: 1299155 - RNA, 16 nt, Human
cuauuaaaagacucau

SEQ ID NO: 1299156 - RNA, 17 nt, Human
cuauuaaaagacucauc

SEQ ID NO: 1299157 - RNA, 13 nt, Human
cucaaguucuaag

SEQ ID NO: 1299158 - RNA, 14 nt, Human
cucaaguucuaaga

SEQ ID NO: 1299159 - RNA, 15 nt, Human
cucaaguucuaagau

SEQ ID NO: 1299160 - RNA, 18 nt, Human
cucaaguucuaagauucu

SEQ ID NO: 1299161 - RNA, 19 nt, Human
cucaaguucuaagauucua

SEQ ID NO: 1299162 - RNA, 20 nt, Human
cucaaguucuaagauucuaa

SEQ ID NO: 1299163 - RNA, 13 nt, Human
cuauguuuuacca

SEQ ID NO: 1299164 - RNA, 18 nt, Human
cuauguuuugacauuuuu

SEQ ID NO: 1299165 - RNA, 19 nt, Human
cuauguuuugacauuuuua

SEQ ID NO: 1299166 - RNA, 16 nt, Human
cuauguuuuuaaugua

SEQ ID NO: 1299167 - RNA, 14 nt, Human
cuauguuuuuaaug

SEQ ID NO: 1299168 - RNA, 20 nt, Human
cuauguuuuuguucaaagcc

SEQ ID NO: 1299169 - RNA, 22 nt, Human
cuauguuuuuguucaaagccag

SEQ ID NO: 1299170 - RNA, 15 nt, Human
cuauguuuuuaaugu

SEQ ID NO: 1299171 - RNA, 11 nt, Human
cuauuaaaaga

SEQ ID NO: 1299172 - RNA, 12 nt, Human
cuauuaaaagac

SEQ ID NO: 1299173 - RNA, 13 nt, Human
cuauuaaaagacu

SEQ ID NO: 1299174 - RNA, 14 nt, Human
cuauuaaaagacuc

SEQ ID NO: 1299175 - RNA, 15 nt, Human
cuauuaaaagacuca

SEQ ID NO: 1299176 - RNA, 18 nt, Human
cuauuaaaagacucaucc

SEQ ID NO: 1299177 - RNA, 17 nt, Human
cuaucguaaaauuaaga

SEQ ID NO: 1299178 - RNA, 18 nt, Human
cuaucucauuuccaagca

SEQ ID NO: 1299179 - RNA, 16 nt, Human
cuauguccuaauaaua

SEQ ID NO: 1299180 - RNA, 19 nt, Human
cuaucuccagcggcccugu

SEQ ID NO: 1299181 - RNA, 15 nt, Human
cuaugucccaggaau

SEQ ID NO: 1299182 - RNA, 21 nt, Human
cuaucuccagcggcccuguca

SEQ ID NO: 1299183 - RNA, 18 nt, Human
cuauguucuaagaaguga

SEQ ID NO: 1299184 - RNA, 18 nt, Human
cuaucaugucaaacguga

SEQ ID NO: 1299185 - RNA, 18 nt, Human
cuaucccuaggcacuuaa

SEQ ID NO: 1299186 - RNA, 20 nt, Human
cuauccggacagagcacguu

SEQ ID NO: 1299187 - RNA, 17 nt, Human
cuauccuacuuccccuu

SEQ ID NO: 1299188 - RNA, 15 nt, Human
cuauccucucuuccu

SEQ ID NO: 1299189 - RNA, 16 nt, Human
cuauccucucuuccuc

SEQ ID NO: 1299190 - RNA, 12 nt, Human
cuauccucugua

SEQ ID NO: 1299191 - RNA, 13 nt, Human
cuauccucuguaa

SEQ ID NO: 1299192 - RNA, 20 nt, Human
cuauccucucuuccucuucc

SEQ ID NO: 1299193 - RNA, 17 nt, Human
cuaucaccuauuuccau

SEQ ID NO: 1299194 - RNA, 19 nt, Human
cuaucagaguugcugcaaa

SEQ ID NO: 1299195 - RNA, 18 nt, Human
cuaucagacuaagccagc

SEQ ID NO: 1299196 - RNA, 13 nt, Human
cuacaaaacauua

SEQ ID NO: 1299197 - RNA, 23 nt, Human
cguuaucuaauagggcaauuaau

SEQ ID NO: 1299198 - RNA, 19 nt, Human
cguucaacuuuuccuuuga

SEQ ID NO: 1299199 - RNA, 14 nt, Human
cguguuucugacuc

SEQ ID NO: 1299200 - RNA, 15 nt, Human
cguguuucugacucu

SEQ ID NO: 1299201 - RNA, 20 nt, Human
cguguuucugacucugagcu

SEQ ID NO: 1299202 - RNA, 13 nt, Human
cguuagcuccugu

SEQ ID NO: 1299203 - RNA, 14 nt, Human
cguuagcuccugug

SEQ ID NO: 1299204 - RNA, 15 nt, Human
cguuagcuccugugg

SEQ ID NO: 1299205 - RNA, 16 nt, Human
cguuagcuccuguggc

SEQ ID NO: 1299206 - RNA, 17 nt, Human
cguuagcuccuguggcc

SEQ ID NO: 1299207 - RNA, 22 nt, Human
cuaaagauucuauaguucuaga

SEQ ID NO: 1299208 - RNA, 23 nt, Human
cuaaagauucuauaguucuagac

SEQ ID NO: 1299209 - RNA, 13 nt, Human
cuaaagcaggccu

SEQ ID NO: 1299210 - RNA, 11 nt, Human
cuaaagccaaa

SEQ ID NO: 1299211 - RNA, 18 nt, Human
cuaaagccaaacauauau

SEQ ID NO: 1299212 - RNA, 20 nt, Human
cgugagcugagcaggccaca

SEQ ID NO: 1299213 - RNA, 17 nt, Human
cguguguuuuucuauua

SEQ ID NO: 1299214 - RNA, 18 nt, Human
cguguguuuuucuauuaa

SEQ ID NO: 1299215 - RNA, 21 nt, Human
cguguguuuuucuauuaaaag

SEQ ID NO: 1299216 - RNA, 23 nt, Human
cguguguuuuucuauuaaaagac

SEQ ID NO: 1299217 - RNA, 15 nt, Human
cguguucaauauuuu

SEQ ID NO: 1299218 - RNA, 16 nt, Human
cguguucuccuuuucc

SEQ ID NO: 1299219 - RNA, 23 nt, Human
cuaaaguaaaaacaaagaaauua

SEQ ID NO: 1299220 - RNA, 16 nt, Human
cuaaagccucaaaaca

SEQ ID NO: 1299221 - RNA, 12 nt, Human
cuaaagccuuua

SEQ ID NO: 1299222 - RNA, 14 nt, Human
cuaaagccuuuauu

SEQ ID NO: 1299223 - RNA, 12 nt, Human
cuaaagcucuga

SEQ ID NO: 1299224 - RNA, 14 nt, Human
cuaaagcucugaca

SEQ ID NO: 1299225 - RNA, 12 nt, Human
cuaacgccugag

SEQ ID NO: 1299226 - RNA, 13 nt, Human
cuaacgccugagc

SEQ ID NO: 1299227 - RNA, 14 nt, Human
cuaacgccugagcc

SEQ ID NO: 1299228 - RNA, 15 nt, Human
cuaacgccugagccc

SEQ ID NO: 1299229 - RNA, 17 nt, Human
cuaacgccugagcccag

SEQ ID NO: 1299230 - RNA, 18 nt, Human
cuaacgccugagcccagg

SEQ ID NO: 1299231 - RNA, 19 nt, Human
cuaacgccugagcccaggg

SEQ ID NO: 1299232 - RNA, 20 nt, Human
cuaacgccugagcccaggga

SEQ ID NO: 1299233 - RNA, 21 nt, Human
cuaacgccugagcccagggag

SEQ ID NO: 1299234 - RNA, 22 nt, Human
cuaacgccugagcccagggagg

SEQ ID NO: 1299235 - RNA, 22 nt, Human
cuaacggucuguucuguuucaa

SEQ ID NO: 1299236 - RNA, 16 nt, Human
cuaacggugcucaggg

SEQ ID NO: 1299237 - RNA, 19 nt, Human
cuaacggugcucagggggc

SEQ ID NO: 1299238 - RNA, 17 nt, Human
cuaacguugagccccug

SEQ ID NO: 1299239 - RNA, 20 nt, Human
cuaacuaaaacaaagccacu

SEQ ID NO: 1299240 - RNA, 13 nt, Human
cuaacuaaaacaa

SEQ ID NO: 1299241 - RNA, 17 nt, Human
cuaacggugcucagggg

SEQ ID NO: 1299242 - RNA, 22 nt, Human
cuaacguugagccccuggaggc

SEQ ID NO: 1299243 - RNA, 19 nt, Human
cuaacuacaaagguuuaaa

SEQ ID NO: 1299244 - RNA, 15 nt, Human
cuaacuuggcucaca

SEQ ID NO: 1299245 - RNA, 20 nt, Human
cuaagaaauaugcacaauag

SEQ ID NO: 1299246 - RNA, 16 nt, Human
cuaagaaauugaauac

SEQ ID NO: 1299247 - RNA, 21 nt, Human
cuaagaaauugaauacuuuga

SEQ ID NO: 1299248 - RNA, 14 nt, Human
cuaagaaccuggaa

SEQ ID NO: 1299249 - RNA, 15 nt, Human
cuaagaaccuggaac

SEQ ID NO: 1299250 - RNA, 16 nt, Human
cuaagaaccuggaacu

SEQ ID NO: 1299251 - RNA, 13 nt, Human
cgugacacaaaca

SEQ ID NO: 1299252 - RNA, 17 nt, Human
cgugacaauaaaacauu

SEQ ID NO: 1299253 - RNA, 19 nt, Human
cgugacaauaaaacauuaa

SEQ ID NO: 1299254 - RNA, 14 nt, Human
cgugagccaccucg

SEQ ID NO: 1299255 - RNA, 14 nt, Human
cgugagcugagcag

SEQ ID NO: 1299256 - RNA, 17 nt, Human
cgugagcugagcaggcc

SEQ ID NO: 1299257 - RNA, 22 nt, Human
cgugagcuuaaaauacaagacu

SEQ ID NO: 1299258 - RNA, 19 nt, Human
cuaaguacacaauaagcaa

SEQ ID NO: 1299259 - RNA, 20 nt, Human
cuaaguacacaauaagcaaa

SEQ ID NO: 1299260 - RNA, 19 nt, Human
cuaaguccaguguuucuuu

SEQ ID NO: 1299261 - RNA, 21 nt, Human
cuaaguccaguccaguccuau

SEQ ID NO: 1299262 - RNA, 17 nt, Human
cuaagucaacuuagcau

SEQ ID NO: 1299263 - RNA, 23 nt, Human
cuaaguccaguccaguccuaucu

SEQ ID NO: 1299264 - RNA, 12 nt, Human
cuaaguuucuaa

SEQ ID NO: 1299265 - RNA, 13 nt, Human
cuaaguuucuaag

SEQ ID NO: 1299266 - RNA, 14 nt, Human
cuaaguuucuaaga

SEQ ID NO: 1299267 - RNA, 15 nt, Human
cuaaguuucuaagau

SEQ ID NO: 1299268 - RNA, 17 nt, Human
cuaaguuucuaagauuc

SEQ ID NO: 1299269 - RNA, 18 nt, Human
cuaaguuucuaagauucu

SEQ ID NO: 1299270 - RNA, 19 nt, Human
cuaaguuucuaagauucua

SEQ ID NO: 1299271 - RNA, 21 nt, Human
cuaaguuucuaagauucuaaa

SEQ ID NO: 1299272 - RNA, 22 nt, Human
cuaaguuucuaagauucuaaag

SEQ ID NO: 1299273 - RNA, 23 nt, Human
cuaaguuucuaagauucuaaagg

SEQ ID NO: 1299274 - RNA, 12 nt, Human
cuaauuugcauu

SEQ ID NO: 1299275 - RNA, 13 nt, Human
cuaauuugcauua

SEQ ID NO: 1299276 - RNA, 14 nt, Human
cuaauuugcauuaa

SEQ ID NO: 1299277 - RNA, 19 nt, Human
cuaauuugcauuaaauuca

SEQ ID NO: 1299278 - RNA, 21 nt, Human
cuaauuugcauuaaauucaca

SEQ ID NO: 1299279 - RNA, 22 nt, Human
cuaauuugcauuaaauucacaa

SEQ ID NO: 1299280 - RNA, 22 nt, Human
cuaauuuguaggaaaaagcaag

SEQ ID NO: 1299281 - RNA, 19 nt, Human
cuaauuuguuuuggauaua

SEQ ID NO: 1299282 - RNA, 12 nt, Human
cuaauuuuuaag

SEQ ID NO: 1299283 - RNA, 16 nt, Human
cuaagaauaaacauuu

SEQ ID NO: 1299284 - RNA, 17 nt, Human
cuaagaauaaacauuug

SEQ ID NO: 1299285 - RNA, 18 nt, Human
cuaagaauaaacauuugu

SEQ ID NO: 1299286 - RNA, 20 nt, Human
cuaagaauaaacauuuguua

SEQ ID NO: 1299287 - RNA, 22 nt, Human
cuaagaaguacauuguuaccuc

SEQ ID NO: 1299288 - RNA, 13 nt, Human
cuaagacucaaau

SEQ ID NO: 1299289 - RNA, 16 nt, Human
cuaagacucaaauguu

SEQ ID NO: 1299290 - RNA, 17 nt, Human
cuaagacucaaauguuc

SEQ ID NO: 1299291 - RNA, 19 nt, Human
cuaagacucaaauguucua

SEQ ID NO: 1299292 - RNA, 20 nt, Human
cuaagacucaaauguucuaa

SEQ ID NO: 1299293 - RNA, 21 nt, Human
cuaagacucaaauguucuaag

SEQ ID NO: 1299294 - RNA, 22 nt, Human
cuaagacucaaauguucuaagu

SEQ ID NO: 1299295 - RNA, 17 nt, Human
cuaagacuuacucuaag

SEQ ID NO: 1299296 - RNA, 18 nt, Human
cuaagacuuacucuaaga

SEQ ID NO: 1299297 - RNA, 19 nt, Human
cuaagacuuacucuaagau

SEQ ID NO: 1299298 - RNA, 22 nt, Human
cuaagacuuacucuaagaucuu

SEQ ID NO: 1299299 - RNA, 13 nt, Human
cuaagacuuccua

SEQ ID NO: 1299300 - RNA, 15 nt, Human
cuaagacuuuacuua

SEQ ID NO: 1299301 - RNA, 23 nt, Human
cuaagacuuacucuaagaucuua

SEQ ID NO: 1299302 - RNA, 13 nt, Human
cuaagagaaguag

SEQ ID NO: 1299303 - RNA, 15 nt, Human
cuaagagaaguagaa

SEQ ID NO: 1299304 - RNA, 17 nt, Human
cuaagagaaguagaaau

SEQ ID NO: 1299305 - RNA, 19 nt, Human
cuaagagaaguagaaauca

SEQ ID NO: 1299306 - RNA, 14 nt, Human
cgcugaguggcagg

SEQ ID NO: 1299307 - RNA, 16 nt, Human
cgcugaguggcagggg

SEQ ID NO: 1299308 - RNA, 13 nt, Human
cgcugaguggcag

SEQ ID NO: 1299309 - RNA, 20 nt, Human
cgcucugucgcccaggcugg

SEQ ID NO: 1299310 - RNA, 21 nt, Human
cgcucuuggcagguacucagc

SEQ ID NO: 1299311 - RNA, 13 nt, Human
cgcucuuugagaa

SEQ ID NO: 1299312 - RNA, 17 nt, Human
cgccugcccucauggcc

SEQ ID NO: 1299313 - RNA, 20 nt, Human
cgccugcccucauggccccu

SEQ ID NO: 1299314 - RNA, 22 nt, Human
cgccugcccucauggccccucu

SEQ ID NO: 1299315 - RNA, 20 nt, Human
cgcugaguggcaggggacag

SEQ ID NO: 1299316 - RNA, 15 nt, Human
cgagugcucauuuca

SEQ ID NO: 1299317 - RNA, 22 nt, Human
cgcaggcuggcccugcccuggu

SEQ ID NO: 1299318 - RNA, 19 nt, Human
cgcaguccacuucugacag

SEQ ID NO: 1299319 - RNA, 20 nt, Human
cgcaguccacuucugacagc

SEQ ID NO: 1299320 - RNA, 23 nt, Human
cgcaguccacuucugacagccuc

SEQ ID NO: 1299321 - RNA, 20 nt, Human
cgagucucuucuccacugga

SEQ ID NO: 1299322 - RNA, 21 nt, Human
cgagucucuucuccacuggau

SEQ ID NO: 1299323 - RNA, 14 nt, Human
cgccacagcccuuu

SEQ ID NO: 1299324 - RNA, 17 nt, Human
cgccacagcccuuuugu

SEQ ID NO: 1299325 - RNA, 19 nt, Human
cgccacagcccuuuugucu

SEQ ID NO: 1299326 - RNA, 21 nt, Human
cgccacagcccuuuugucucu

SEQ ID NO: 1299327 - RNA, 20 nt, Human
cgccacagcccuuuugucuc

SEQ ID NO: 1299328 - RNA, 22 nt, Human
cgcaguccacuucugacagccu

SEQ ID NO: 1299329 - RNA, 22 nt, Human
cgcagugggagcaaacugcaug

SEQ ID NO: 1299330 - RNA, 23 nt, Human
cgcagugggagcaaacugcaugc

SEQ ID NO: 1299331 - RNA, 16 nt, Human
cgcaguguggaggcca

SEQ ID NO: 1299332 - RNA, 17 nt, Human
cgagucucuucuccacu

SEQ ID NO: 1299333 - RNA, 18 nt, Human
cgagucucuucuccacug

SEQ ID NO: 1299334 - RNA, 18 nt, Human
cgaggggugucuugggca

SEQ ID NO: 1299335 - RNA, 19 nt, Human
cgaggggugucuugggcag

SEQ ID NO: 1299336 - RNA, 11 nt, Human
cgagggcuggc

SEQ ID NO: 1299337 - RNA, 21 nt, Human
cgagggcagggaccacacccu

SEQ ID NO: 1299338 - RNA, 14 nt, Human
cgagggcuggcugg

SEQ ID NO: 1299339 - RNA, 15 nt, Human
cgagggcuggcuggc

SEQ ID NO: 1299340 - RNA, 17 nt, Human
cgagggcuggcuggccu

SEQ ID NO: 1299341 - RNA, 19 nt, Human
cgagggcuggcuggccuca

SEQ ID NO: 1299342 - RNA, 23 nt, Human
cgagggcuggcuggccucaccca

SEQ ID NO: 1299343 - RNA, 12 nt, Human
ccuuuucccaac

SEQ ID NO: 1299344 - RNA, 11 nt, Human
ccuuuucauag

SEQ ID NO: 1299345 - RNA, 18 nt, Human
ccuuuucauaggucugaa

SEQ ID NO: 1299346 - RNA, 19 nt, Human
ccuuuucauaggucugaaa

SEQ ID NO: 1299347 - RNA, 22 nt, Human
ccuuuucauaggucugaaauuu

SEQ ID NO: 1299348 - RNA, 20 nt, Human
ccuuucccuuguagcuccuc

SEQ ID NO: 1299349 - RNA, 22 nt, Human
ccuuuccuggacacucagaccu

SEQ ID NO: 1299350 - RNA, 16 nt, Human
ccuuuucaugauuuua

SEQ ID NO: 1299351 - RNA, 12 nt, Human
ccuuuuccaugc

SEQ ID NO: 1299352 - RNA, 23 nt, Human
ccuuuucccaaaauguugaaaua

SEQ ID NO: 1299353 - RNA, 16 nt, Human
cgggcugggagcucug

SEQ ID NO: 1299354 - RNA, 20 nt, Human
cgggcugggagcucugcaga

SEQ ID NO: 1299355 - RNA, 16 nt, Human
cgggccuggagaacua

SEQ ID NO: 1299356 - RNA, 20 nt, Human
cgggccuggagaacuagaga

SEQ ID NO: 1299357 - RNA, 16 nt, Human
cgggccuguccacagg

SEQ ID NO: 1299358 - RNA, 15 nt, Human
cgggccuguccacag

SEQ ID NO: 1299359 - RNA, 18 nt, Human
cgggccacuccuuccugc

SEQ ID NO: 1299360 - RNA, 19 nt, Human
cggcuaauuuuuauauuuu

SEQ ID NO: 1299361 - RNA, 19 nt, Human
cgggccacuccuuccugcc

SEQ ID NO: 1299362 - RNA, 20 nt, Human
cgggccacuccuuccugccc

SEQ ID NO: 1299363 - RNA, 22 nt, Human
cgggccacuccuuccugcccca

SEQ ID NO: 1299364 - RNA, 21 nt, Human
cgggccacuccuuccugcccc

SEQ ID NO: 1299365 - RNA, 21 nt, Human
cgggcccuucccacaggacau

SEQ ID NO: 1299366 - RNA, 16 nt, Human
cguaaguacagagaag

SEQ ID NO: 1299367 - RNA, 17 nt, Human
cguaaguacagagaagc

SEQ ID NO: 1299368 - RNA, 18 nt, Human
cguaaguacagagaagcc

SEQ ID NO: 1299369 - RNA, 19 nt, Human
cguaaguacagagaagcca

SEQ ID NO: 1299370 - RNA, 21 nt, Human
cguaaguacagagaagccauc

SEQ ID NO: 1299371 - RNA, 20 nt, Human
cguaaguacagagaagccau

SEQ ID NO: 1299372 - RNA, 17 nt, Human
cguacguaauaagguuu

SEQ ID NO: 1299373 - RNA, 20 nt, Human
cguacguaauaagguuuuaa

SEQ ID NO: 1299374 - RNA, 14 nt, Human
cguacugcagccuc

SEQ ID NO: 1299375 - RNA, 15 nt, Human
cguacugcagccucc

SEQ ID NO: 1299376 - RNA, 20 nt, Human
cgguggcucacgccuguaau

SEQ ID NO: 1299377 - RNA, 12 nt, Human
cgggcugugccc

SEQ ID NO: 1299378 - RNA, 14 nt, Human
cguaaaguacuugu

SEQ ID NO: 1299379 - RNA, 18 nt, Human
cguaaaguacuuguaguu

SEQ ID NO: 1299380 - RNA, 16 nt, Human
cguaaaguacuuguag

SEQ ID NO: 1299381 - RNA, 14 nt, Human
cguaagauuuccuu

SEQ ID NO: 1299382 - RNA, 13 nt, Human
cguaaguacagag

SEQ ID NO: 1299383 - RNA, 14 nt, Human
cguaaguacagaga

SEQ ID NO: 1299384 - RNA, 15 nt, Human
cguaaguacagagaa

SEQ ID NO: 1299385 - RNA, 16 nt, Human
cggaggggccuggcag

SEQ ID NO: 1299386 - RNA, 15 nt, Human
cggaggggccuggca

SEQ ID NO: 1299387 - RNA, 23 nt, Human
cggaguccuguguuugugagucg

SEQ ID NO: 1299388 - RNA, 15 nt, Human
cggagucguggggug

SEQ ID NO: 1299389 - RNA, 18 nt, Human
cggcuaauuuuuguauuu

SEQ ID NO: 1299390 - RNA, 13 nt, Human
cggagagccagcu

SEQ ID NO: 1299391 - RNA, 14 nt, Human
cggagagugggggu

SEQ ID NO: 1299392 - RNA, 14 nt, Human
cggaggcggugggc

SEQ ID NO: 1299393 - RNA, 17 nt, Human
cggaggcggugggccug

SEQ ID NO: 1299394 - RNA, 14 nt, Human
ccuugcauaauggu

SEQ ID NO: 1299395 - RNA, 23 nt, Human
ccuuuauuuguuaauaguuccug

SEQ ID NO: 1299396 - RNA, 14 nt, Human
ccuuuauucuggca

SEQ ID NO: 1299397 - RNA, 19 nt, Human
ccuuuauuuccacugugca

SEQ ID NO: 1299398 - RNA, 21 nt, Human
ccuuuauuuuuggcguggcug

SEQ ID NO: 1299399 - RNA, 17 nt, Human
ccuuucccuaagccagc

SEQ ID NO: 1299400 - RNA, 15 nt, Human
ccuuucccuaagcca

SEQ ID NO: 1299401 - RNA, 19 nt, Human
ccuuucccuuguagcuccu

SEQ ID NO: 1299402 - RNA, 12 nt, Human
ccuugccagaga

SEQ ID NO: 1299403 - RNA, 13 nt, Human
ccuugccagagau

SEQ ID NO: 1299404 - RNA, 16 nt, Human
ccuugccagagaucca

SEQ ID NO: 1299405 - RNA, 11 nt, Human
ccuugccuggu

SEQ ID NO: 1299406 - RNA, 12 nt, Human
ccuugccuggua

SEQ ID NO: 1299407 - RNA, 15 nt, Human
ccuugccugguacag

SEQ ID NO: 1299408 - RNA, 14 nt, Human
ccuugccugugcca

SEQ ID NO: 1299409 - RNA, 17 nt, Human
ccuugccugguacagua

SEQ ID NO: 1299410 - RNA, 15 nt, Human
ccuugcggcuccuca

SEQ ID NO: 1299411 - RNA, 16 nt, Human
ccuugcggcuccucag

SEQ ID NO: 1299412 - RNA, 17 nt, Human
ccuugcggcuccucagg

SEQ ID NO: 1299413 - RNA, 18 nt, Human
ccuugcggcuccucaggg

SEQ ID NO: 1299414 - RNA, 19 nt, Human
ccuugcggcuccucaggga

SEQ ID NO: 1299415 - RNA, 20 nt, Human
ccuugcggcuccucagggac

SEQ ID NO: 1299416 - RNA, 21 nt, Human
ccuugcuccuccuucugcugc

SEQ ID NO: 1299417 - RNA, 13 nt, Human
ccuucccugcugu

SEQ ID NO: 1299418 - RNA, 18 nt, Human
ccuucccucucuggagaa

SEQ ID NO: 1299419 - RNA, 15 nt, Human
ccuucccucucugga

SEQ ID NO: 1299420 - RNA, 13 nt, Human
ccuucccuccaag

SEQ ID NO: 1299421 - RNA, 24 nt, Human
ccuucccucaccuuggcaccagac

SEQ ID NO: 1299422 - RNA, 14 nt, Human
ccuucccucucugg

SEQ ID NO: 1299423 - RNA, 13 nt, Human
ccuucccugugcc

SEQ ID NO: 1299424 - RNA, 17 nt, Human
ccuucccugugccuccu

SEQ ID NO: 1299425 - RNA, 20 nt, Human
ccuucccugugccuccuccc

SEQ ID NO: 1299426 - RNA, 22 nt, Human
ccuucccuguuuuccccccaag

SEQ ID NO: 1299427 - RNA, 18 nt, Human
ccuuccuaauuccacagc

SEQ ID NO: 1299428 - RNA, 22 nt, Human
ccuuccgccacuggggcucaga

SEQ ID NO: 1299429 - RNA, 16 nt, Human
ccuuccgcuuggagcu

SEQ ID NO: 1299430 - RNA, 19 nt, Human
ccuuccuaauuccacagcu

SEQ ID NO: 1299431 - RNA, 20 nt, Human
ccuuccuaauuccacagcug

SEQ ID NO: 1299432 - RNA, 22 nt, Human
ccuucccuuuucuguucuaguu

SEQ ID NO: 1299433 - RNA, 18 nt, Human
ccuucccuuuucuguucu

SEQ ID NO: 1299434 - RNA, 13 nt, Human
ccuuccgccacug

SEQ ID NO: 1299435 - RNA, 14 nt, Human
ccuuccgccacugg

SEQ ID NO: 1299436 - RNA, 16 nt, Human
ccuuccgccacugggg

SEQ ID NO: 1299437 - RNA, 18 nt, Human
ccuuccgccacuggggcu

SEQ ID NO: 1299438 - RNA, 19 nt, Human
ccuucccccuccaauccca

SEQ ID NO: 1299439 - RNA, 13 nt, Human
ccuucccauggag

SEQ ID NO: 1299440 - RNA, 16 nt, Human
ccuucccauggaggga

SEQ ID NO: 1299441 - RNA, 21 nt, Human
ccuuccccuuauccucccugu

SEQ ID NO: 1299442 - RNA, 20 nt, Human
ccuuccccuuauccucccug

SEQ ID NO: 1299443 - RNA, 23 nt, Human
ccuucccucaccuuggcaccaga

SEQ ID NO: 1299444 - RNA, 16 nt, Human
ccuuccucuccacugc

SEQ ID NO: 1299445 - RNA, 17 nt, Human
ccuuccucuccacugcc

SEQ ID NO: 1299446 - RNA, 14 nt, Human
ccuuccucuccacu

SEQ ID NO: 1299447 - RNA, 15 nt, Human
ccuuccucuccacug

SEQ ID NO: 1299448 - RNA, 12 nt, Human
ccuuccuccugg

SEQ ID NO: 1299449 - RNA, 13 nt, Human
ccuuccuccuggg

SEQ ID NO: 1299450 - RNA, 21 nt, Human
ccuuccuaauuccacagcugc

SEQ ID NO: 1299451 - RNA, 23 nt, Human
ccuuccuaaauuuuccuguccuc

SEQ ID NO: 1299452 - RNA, 16 nt, Human
ccuuccucauccaccc

SEQ ID NO: 1299453 - RNA, 17 nt, Human
ccuuccucauccacccc

SEQ ID NO: 1299454 - RNA, 18 nt, Human
ccuuccucauccacccca

SEQ ID NO: 1299455 - RNA, 19 nt, Human
ccuuccucauccaccccau

SEQ ID NO: 1299456 - RNA, 20 nt, Human
ccuuccucauccaccccauc

SEQ ID NO: 1299457 - RNA, 21 nt, Human
ccuuccucauccaccccaucc

SEQ ID NO: 1299458 - RNA, 20 nt, Human
ccuuccucuccacugccuuc

SEQ ID NO: 1299459 - RNA, 14 nt, Human
ccuucucucucccu

SEQ ID NO: 1299460 - RNA, 19 nt, Human
ccuucucuguucauuuccu

SEQ ID NO: 1299461 - RNA, 21 nt, Human
ccuucucuguucauuuccuca

SEQ ID NO: 1299462 - RNA, 17 nt, Human
ccuucucuucacaguca

SEQ ID NO: 1299463 - RNA, 13 nt, Human
ccuucucuguuca

SEQ ID NO: 1299464 - RNA, 17 nt, Human
ccuucucuguucauuuc

SEQ ID NO: 1299465 - RNA, 18 nt, Human
ccuucucuguucauuucc

SEQ ID NO: 1299466 - RNA, 18 nt, Human
ccugcugcugccugccug

SEQ ID NO: 1299467 - RNA, 17 nt, Human
ccugcugcugucugggu

SEQ ID NO: 1299468 - RNA, 19 nt, Human
ccugcugcugucugggugc

SEQ ID NO: 1299469 - RNA, 23 nt, Human
ccugcugcugucugggugcuacu

SEQ ID NO: 1299470 - RNA, 17 nt, Human
ccugcugcugccugccu

SEQ ID NO: 1299471 - RNA, 16 nt, Human
ccugcugcugccugcc

SEQ ID NO: 1299472 - RNA, 15 nt, Human
ccugcugcugccugc

SEQ ID NO: 1299473 - RNA, 14 nt, Human
ccugcugcccuccc

SEQ ID NO: 1299474 - RNA, 20 nt, Human
ccugcugcugucugggugcu

SEQ ID NO: 1299475 - RNA, 21 nt, Human
ccuguucacucuacuuagcau

SEQ ID NO: 1299476 - RNA, 15 nt, Human
ccuguuagcagacag

SEQ ID NO: 1299477 - RNA, 16 nt, Human
ccuguuagcagacagg

SEQ ID NO: 1299478 - RNA, 17 nt, Human
ccuguuaccuacuuuga

SEQ ID NO: 1299479 - RNA, 18 nt, Human
ccuguuaccuacuuugac

SEQ ID NO: 1299480 - RNA, 19 nt, Human
ccuguuaccuacuuugacu

SEQ ID NO: 1299481 - RNA, 12 nt, Human
ccuguucccauu

SEQ ID NO: 1299482 - RNA, 22 nt, Human
ccuguucaugccgacgcuugca

SEQ ID NO: 1299483 - RNA, 18 nt, Human
ccuguucauggcagaugu

SEQ ID NO: 1299484 - RNA, 13 nt, Human
ccuguuccccaga

SEQ ID NO: 1299485 - RNA, 15 nt, Human
ccuguuccccagaga

SEQ ID NO: 1299486 - RNA, 16 nt, Human
ccuguuccccagagaa

SEQ ID NO: 1299487 - RNA, 23 nt, Human
ccuguuccccagagaaaggggag

SEQ ID NO: 1299488 - RNA, 14 nt, Human
ccuguuccugcugc

SEQ ID NO: 1299489 - RNA, 15 nt, Human
ccuguuccugcugcu

SEQ ID NO: 1299490 - RNA, 16 nt, Human
ccuguucugcuuuccu

SEQ ID NO: 1299491 - RNA, 14 nt, Human
ccuguucacaccag

SEQ ID NO: 1299492 - RNA, 17 nt, Human
ccuguugagcaucacag

SEQ ID NO: 1299493 - RNA, 12 nt, Human
ccuguugggaga

SEQ ID NO: 1299494 - RNA, 13 nt, Human
ccuuagccuggac

SEQ ID NO: 1299495 - RNA, 14 nt, Human
ccuuagccuggacc

SEQ ID NO: 1299496 - RNA, 15 nt, Human
ccuuagccuggaccu

SEQ ID NO: 1299497 - RNA, 17 nt, Human
ccuuagccuggaccucu

SEQ ID NO: 1299498 - RNA, 19 nt, Human
ccuuagccuggaccucuga

SEQ ID NO: 1299499 - RNA, 21 nt, Human
ccuuagccuggaccucugaca

SEQ ID NO: 1299500 - RNA, 19 nt, Human
ccuuagcuggcauuacagc

SEQ ID NO: 1299501 - RNA, 22 nt, Human
ccuuagcuggcauuacagcugg

SEQ ID NO: 1299502 - RNA, 13 nt, Human
ccuuaucuugcac

SEQ ID NO: 1299503 - RNA, 17 nt, Human
ccuuaugacugccaaga

SEQ ID NO: 1299504 - RNA, 19 nt, Human
ccuuauccucccuguaacu

SEQ ID NO: 1299505 - RNA, 16 nt, Human
ccuuaucgaaacucau

SEQ ID NO: 1299506 - RNA, 14 nt, Human
ccuuaucaaaggac

SEQ ID NO: 1299507 - RNA, 18 nt, Human
ccuuaucaaaggacacca

SEQ ID NO: 1299508 - RNA, 14 nt, Human
ccuuauccccacuu

SEQ ID NO: 1299509 - RNA, 13 nt, Human
ccuuauccucccu

SEQ ID NO: 1299510 - RNA, 16 nt, Human
ccuuauccucccugua

SEQ ID NO: 1299511 - RNA, 17 nt, Human
ccuuauccucccuguaa

SEQ ID NO: 1299512 - RNA, 20 nt, Human
ccuuauccucccuguaacuu

SEQ ID NO: 1299513 - RNA, 20 nt, Human
ccuuaggugauccacucgcc

SEQ ID NO: 1299514 - RNA, 14 nt, Human
ccuuaggccucuga

SEQ ID NO: 1299515 - RNA, 16 nt, Human
ccuuaggccucugaga

SEQ ID NO: 1299516 - RNA, 23 nt, Human
ccuuaggaagagccuuccaccca

SEQ ID NO: 1299517 - RNA, 15 nt, Human
ccuuaggaagagccu

SEQ ID NO: 1299518 - RNA, 13 nt, Human
ccuuaucaaagga

SEQ ID NO: 1299519 - RNA, 21 nt, Human
ccuuauaguuacuguguaauu

SEQ ID NO: 1299520 - RNA, 14 nt, Human
ccuuauaguuacug

SEQ ID NO: 1299521 - RNA, 20 nt, Human
ccuuagugcaguuauuugcu

SEQ ID NO: 1299522 - RNA, 15 nt, Human
ccuuagugcaguuau

SEQ ID NO: 1299523 - RNA, 14 nt, Human
ccuuagucucaguu

SEQ ID NO: 1299524 - RNA, 20 nt, Human
ccuuagucucaguuugugug

SEQ ID NO: 1299525 - RNA, 14 nt, Human
ccuuauucagggaa

SEQ ID NO: 1299526 - RNA, 18 nt, Human
ccuuauugcuguccugga

SEQ ID NO: 1299527 - RNA, 19 nt, Human
ccuuauugcuguccuggag

SEQ ID NO: 1299528 - RNA, 23 nt, Human
ccuucccaagugagucucucugg

SEQ ID NO: 1299529 - RNA, 17 nt, Human
ccuucccaauccagugg

SEQ ID NO: 1299530 - RNA, 15 nt, Human
ccuucccaugcccug

SEQ ID NO: 1299531 - RNA, 14 nt, Human
ccuucccaucgcug

SEQ ID NO: 1299532 - RNA, 15 nt, Human
ccuucccaucgcugu

SEQ ID NO: 1299533 - RNA, 12 nt, Human
ccuucccagagg

SEQ ID NO: 1299534 - RNA, 17 nt, Human
ccuucccagaggggccu

SEQ ID NO: 1299535 - RNA, 19 nt, Human
ccuucccagaggggccugc

SEQ ID NO: 1299536 - RNA, 20 nt, Human
ccuucccagaggggccugcc

SEQ ID NO: 1299537 - RNA, 22 nt, Human
ccuucccagaggggccugccac

SEQ ID NO: 1299538 - RNA, 24 nt, Human
ccuucccagaggggccugccaccu

SEQ ID NO: 1299539 - RNA, 16 nt, Human
ccuuauuagagugucu

SEQ ID NO: 1299540 - RNA, 21 nt, Human
ccuuauuagagugucuuucca

SEQ ID NO: 1299541 - RNA, 14 nt, Human
ccagagacuuuagg

SEQ ID NO: 1299542 - RNA, 20 nt, Human
ccagagacauacuugaaggg

SEQ ID NO: 1299543 - RNA, 22 nt, Human
ccagagacauacuugaagggcc

SEQ ID NO: 1299544 - RNA, 23 nt, Human
ccagagacauacuugaagggcca

SEQ ID NO: 1299545 - RNA, 12 nt, Human
ccagagacccag

SEQ ID NO: 1299546 - RNA, 13 nt, Human
ccagagacccagc

SEQ ID NO: 1299547 - RNA, 14 nt, Human
ccagagacccagcg

SEQ ID NO: 1299548 - RNA, 21 nt, Human
ccagagacccagcggacacac

SEQ ID NO: 1299549 - RNA, 16 nt, Human
ccagagacccagcgga

SEQ ID NO: 1299550 - RNA, 19 nt, Human
ccagagacacagcccccac

SEQ ID NO: 1299551 - RNA, 17 nt, Human
ccagagacauacuugaa

SEQ ID NO: 1299552 - RNA, 18 nt, Human
ccagagacauacuugaag

SEQ ID NO: 1299553 - RNA, 23 nt, Human
ccagacuucccacggcuccucga

SEQ ID NO: 1299554 - RNA, 22 nt, Human
ccagacuagauggaccugccug

SEQ ID NO: 1299555 - RNA, 21 nt, Human
ccagacucguucuucugggaa

SEQ ID NO: 1299556 - RNA, 13 nt, Human
ccagacucuugcc

SEQ ID NO: 1299557 - RNA, 18 nt, Human
ccagacucuugccuguuu

SEQ ID NO: 1299558 - RNA, 22 nt, Human
ccagacugcuuccaauuuucug

SEQ ID NO: 1299559 - RNA, 15 nt, Human
ccagacucuugccug

SEQ ID NO: 1299560 - RNA, 18 nt, Human
ccagagaaaaagggaggg

SEQ ID NO: 1299561 - RNA, 22 nt, Human
ccagacuuguuggcguaggcua

SEQ ID NO: 1299562 - RNA, 16 nt, Human
ccagagaaaggggagc

SEQ ID NO: 1299563 - RNA, 19 nt, Human
ccagagaaaggggagccca

SEQ ID NO: 1299564 - RNA, 20 nt, Human
ccagagaaaggggagcccac

SEQ ID NO: 1299565 - RNA, 23 nt, Human
ccagagaaaggggagcccacugu

SEQ ID NO: 1299566 - RNA, 13 nt, Human
ccagagaacccag

SEQ ID NO: 1299567 - RNA, 23 nt, Human
ccagagaacccagcccacccccg

SEQ ID NO: 1299568 - RNA, 18 nt, Human
ccagaugcacaucccugg

SEQ ID NO: 1299569 - RNA, 12 nt, Human
ccagauaacuua

SEQ ID NO: 1299570 - RNA, 13 nt, Human
ccagauaacuuuu

SEQ ID NO: 1299571 - RNA, 22 nt, Human
ccagauacggacagagaccaag

SEQ ID NO: 1299572 - RNA, 17 nt, Human
ccagauaguguagcuga

SEQ ID NO: 1299573 - RNA, 18 nt, Human
ccagauaucaucuaccua

SEQ ID NO: 1299574 - RNA, 20 nt, Human
ccagauaguguagcugagga

SEQ ID NO: 1299575 - RNA, 23 nt, Human
ccagaucugauuuguaacccacu

SEQ ID NO: 1299576 - RNA, 13 nt, Human
ccagaggggccug

SEQ ID NO: 1299577 - RNA, 15 nt, Human
ccagaggggccugcc

SEQ ID NO: 1299578 - RNA, 17 nt, Human
ccagaggggccugccac

SEQ ID NO: 1299579 - RNA, 18 nt, Human
ccagaggggccugccacc

SEQ ID NO: 1299580 - RNA, 12 nt, Human
ccagagagcccg

SEQ ID NO: 1299581 - RNA, 13 nt, Human
ccagagagcccga

SEQ ID NO: 1299582 - RNA, 20 nt, Human
ccagagagcccgaggaggug

SEQ ID NO: 1299583 - RNA, 15 nt, Human
ccagagagcccgagg

SEQ ID NO: 1299584 - RNA, 19 nt, Human
ccagagagcccgaggaggu

SEQ ID NO: 1299585 - RNA, 20 nt, Human
ccagaggggccugccaccug

SEQ ID NO: 1299586 - RNA, 22 nt, Human
ccagaggggccugccaccugga

SEQ ID NO: 1299587 - RNA, 23 nt, Human
ccagaggggccugccaccuggac

SEQ ID NO: 1299588 - RNA, 14 nt, Human
ccagagggucuggg

SEQ ID NO: 1299589 - RNA, 17 nt, Human
ccagagggucugggggc

SEQ ID NO: 1299590 - RNA, 18 nt, Human
ccagagggucugggggca

SEQ ID NO: 1299591 - RNA, 15 nt, Human
ccacucuuucuuuca

SEQ ID NO: 1299592 - RNA, 15 nt, Human
ccacugaaaaaauau

SEQ ID NO: 1299593 - RNA, 17 nt, Human
ccacugaaaaaauauau

SEQ ID NO: 1299594 - RNA, 19 nt, Human
ccacugaaaaaauauaugu

SEQ ID NO: 1299595 - RNA, 21 nt, Human
ccacucuggcagccacacuuc

SEQ ID NO: 1299596 - RNA, 22 nt, Human
ccacucuggcagccacacuucu

SEQ ID NO: 1299597 - RNA, 11 nt, Human
ccacucuguaa

SEQ ID NO: 1299598 - RNA, 12 nt, Human
ccacucuguaau

SEQ ID NO: 1299599 - RNA, 13 nt, Human
ccacucuguaauu

SEQ ID NO: 1299600 - RNA, 14 nt, Human
ccacucuguaauug

SEQ ID NO: 1299601 - RNA, 19 nt, Human
ccacucuguaauugcaaaa

SEQ ID NO: 1299602 - RNA, 13 nt, Human
ccacugaccagaa

SEQ ID NO: 1299603 - RNA, 17 nt, Human
ccacugagaggacagag

SEQ ID NO: 1299604 - RNA, 18 nt, Human
ccacugagaggacagaga

SEQ ID NO: 1299605 - RNA, 13 nt, Human
ccacugagggcag

SEQ ID NO: 1299606 - RNA, 12 nt, Human
ccacucuggcag

SEQ ID NO: 1299607 - RNA, 13 nt, Human
ccacucuggcagc

SEQ ID NO: 1299608 - RNA, 14 nt, Human
ccacucuggcagcc

SEQ ID NO: 1299609 - RNA, 15 nt, Human
ccacucuggcagcca

SEQ ID NO: 1299610 - RNA, 16 nt, Human
ccacucuggcagccac

SEQ ID NO: 1299611 - RNA, 17 nt, Human
ccacucuggcagccaca

SEQ ID NO: 1299612 - RNA, 18 nt, Human
ccacucuggcagccacac

SEQ ID NO: 1299613 - RNA, 19 nt, Human
ccacucuggcagccacacu

SEQ ID NO: 1299614 - RNA, 12 nt, Human
ccacuuggucug

SEQ ID NO: 1299615 - RNA, 12 nt, Human
ccacuuggcauu

SEQ ID NO: 1299616 - RNA, 12 nt, Human
ccacuugccucu

SEQ ID NO: 1299617 - RNA, 13 nt, Human
ccacuugccucuu

SEQ ID NO: 1299618 - RNA, 16 nt, Human
ccacuugccucuuccu

SEQ ID NO: 1299619 - RNA, 17 nt, Human
ccacuugccucuuccuu

SEQ ID NO: 1299620 - RNA, 19 nt, Human
ccacuugccucuuccuuga

SEQ ID NO: 1299621 - RNA, 22 nt, Human
ccacuugccucuuccuugaaga

SEQ ID NO: 1299622 - RNA, 14 nt, Human
ccacuucugacagc

SEQ ID NO: 1299623 - RNA, 16 nt, Human
ccacuucugacagccu

SEQ ID NO: 1299624 - RNA, 18 nt, Human
ccacuucugacagccuca

SEQ ID NO: 1299625 - RNA, 19 nt, Human
ccacuucugacagccucag

SEQ ID NO: 1299626 - RNA, 13 nt, Human
ccacuucugcacu

SEQ ID NO: 1299627 - RNA, 12 nt, Human
ccacuucugcac

SEQ ID NO: 1299628 - RNA, 24 nt, Human
ccacuuucaaucuucaauccuuga

SEQ ID NO: 1299629 - RNA, 12 nt, Human
ccacuuucagcu

SEQ ID NO: 1299630 - RNA, 13 nt, Human
ccacuuucagcug

SEQ ID NO: 1299631 - RNA, 14 nt, Human
ccacuuucagcugu

SEQ ID NO: 1299632 - RNA, 20 nt, Human
ccacuuuaaaauaucuacau

SEQ ID NO: 1299633 - RNA, 15 nt, Human
ccacuuucagcuguc

SEQ ID NO: 1299634 - RNA, 16 nt, Human
ccacuuucagcugucu

SEQ ID NO: 1299635 - RNA, 17 nt, Human
ccacuuucagcugucuu

SEQ ID NO: 1299636 - RNA, 20 nt, Human
ccacuuugcacagcucuccg

SEQ ID NO: 1299637 - RNA, 13 nt, Human
ccacuuucuuucu

SEQ ID NO: 1299638 - RNA, 16 nt, Human
ccacuuucuuucuuuc

SEQ ID NO: 1299639 - RNA, 22 nt, Human
ccacuuuguuucguggggaggu

SEQ ID NO: 1299640 - RNA, 22 nt, Human
ccacuuggucugugagaugcua

SEQ ID NO: 1299641 - RNA, 20 nt, Human
ccacuuggucugugagaugc

SEQ ID NO: 1299642 - RNA, 15 nt, Human
ccacuuguccgcugg

SEQ ID NO: 1299643 - RNA, 21 nt, Human
ccacuuguccgcuggguggua

SEQ ID NO: 1299644 - RNA, 18 nt, Human
ccacuuguccuuagccug

SEQ ID NO: 1299645 - RNA, 21 nt, Human
ccacuuguccuuagccuggac

SEQ ID NO: 1299646 - RNA, 22 nt, Human
ccacuuguccuuagccuggacc

SEQ ID NO: 1299647 - RNA, 19 nt, Human
ccacuuggucugugagaug

SEQ ID NO: 1299648 - RNA, 17 nt, Human
ccacuuggucugugaga

SEQ ID NO: 1299649 - RNA, 16 nt, Human
ccacuuggucugugag

SEQ ID NO: 1299650 - RNA, 15 nt, Human
ccacuuggucuguga

SEQ ID NO: 1299651 - RNA, 13 nt, Human
ccagaccugaggc

SEQ ID NO: 1299652 - RNA, 15 nt, Human
ccagaccugauccug

SEQ ID NO: 1299653 - RNA, 16 nt, Human
ccagaccugauccugg

SEQ ID NO: 1299654 - RNA, 17 nt, Human
ccagaccugauccugga

SEQ ID NO: 1299655 - RNA, 18 nt, Human
ccagaccugauccuggag

SEQ ID NO: 1299656 - RNA, 19 nt, Human
ccagaccugauccuggagg

SEQ ID NO: 1299657 - RNA, 20 nt, Human
ccagaccugauccuggaggc

SEQ ID NO: 1299658 - RNA, 21 nt, Human
ccagaccugauccuggaggcc

SEQ ID NO: 1299659 - RNA, 23 nt, Human
ccagaccugauccuggaggccca

SEQ ID NO: 1299660 - RNA, 16 nt, Human
ccagacuacuugggag

SEQ ID NO: 1299661 - RNA, 18 nt, Human
ccagacuagauguaguau

SEQ ID NO: 1299662 - RNA, 22 nt, Human
ccagacuagauguaguauuuuu

SEQ ID NO: 1299663 - RNA, 14 nt, Human
ccagacgccuggcu

SEQ ID NO: 1299664 - RNA, 24 nt, Human
ccagaccugauccuggaggcccag

SEQ ID NO: 1299665 - RNA, 14 nt, Human
ccagaccugaggcg

SEQ ID NO: 1299666 - RNA, 20 nt, Human
ccagaccuguuagcagacag

SEQ ID NO: 1299667 - RNA, 21 nt, Human
ccagaccuguuagcagacagg

SEQ ID NO: 1299668 - RNA, 23 nt, Human
ccagaccuguuagcagacaggcc

SEQ ID NO: 1299669 - RNA, 17 nt, Human
ccagacgccuggcugcu

SEQ ID NO: 1299670 - RNA, 18 nt, Human
ccaggcaggagcccuucu

SEQ ID NO: 1299671 - RNA, 12 nt, Human
ccaggcagccuc

SEQ ID NO: 1299672 - RNA, 16 nt, Human
ccaggcagccucuggg

SEQ ID NO: 1299673 - RNA, 17 nt, Human
ccaggcagccucugggg

SEQ ID NO: 1299674 - RNA, 17 nt, Human
ccaggauacuggcacag

SEQ ID NO: 1299675 - RNA, 15 nt, Human
ccaggauacuggcac

SEQ ID NO: 1299676 - RNA, 14 nt, Human
ccaggcagccucug

SEQ ID NO: 1299677 - RNA, 20 nt, Human
ccaggcucucuuugcccagu

SEQ ID NO: 1299678 - RNA, 13 nt, Human
ccaggcugaagca

SEQ ID NO: 1299679 - RNA, 20 nt, Human
ccaggcugaagcagguuccc

SEQ ID NO: 1299680 - RNA, 15 nt, Human
ccaggcugaccacag

SEQ ID NO: 1299681 - RNA, 16 nt, Human
ccaggcugaccacagc

SEQ ID NO: 1299682 - RNA, 17 nt, Human
ccaggcugaccacagca

SEQ ID NO: 1299683 - RNA, 18 nt, Human
ccaggcugaccacagcac

SEQ ID NO: 1299684 - RNA, 19 nt, Human
ccaggcugaccacagcaca

SEQ ID NO: 1299685 - RNA, 20 nt, Human
ccaggcugaccacagcacag

SEQ ID NO: 1299686 - RNA, 13 nt, Human
ccaguccuguccu

SEQ ID NO: 1299687 - RNA, 15 nt, Human
ccaggggccaugaau

SEQ ID NO: 1299688 - RNA, 16 nt, Human
ccaggggcagccccag

SEQ ID NO: 1299689 - RNA, 19 nt, Human
ccaggggcagccccaggcc

SEQ ID NO: 1299690 - RNA, 23 nt, Human
ccaggggcagccccaggccaaag

SEQ ID NO: 1299691 - RNA, 13 nt, Human
ccaggcugagccu

SEQ ID NO: 1299692 - RNA, 21 nt, Human
ccaggcugaccacagcacagc

SEQ ID NO: 1299693 - RNA, 23 nt, Human
ccaggcugaccacagcacagcca

SEQ ID NO: 1299694 - RNA, 14 nt, Human
ccaggcugagccuc

SEQ ID NO: 1299695 - RNA, 16 nt, Human
ccaggcugagccucag

SEQ ID NO: 1299696 - RNA, 17 nt, Human
ccaggcugagccucagu

SEQ ID NO: 1299697 - RNA, 19 nt, Human
ccaggcugagccucagucu

SEQ ID NO: 1299698 - RNA, 22 nt, Human
ccaggcugagccucagucuccc

SEQ ID NO: 1299699 - RNA, 15 nt, Human
ccaggcugagguccu

SEQ ID NO: 1299700 - RNA, 12 nt, Human
ccagcagacaga

SEQ ID NO: 1299701 - RNA, 13 nt, Human
ccagcagacagag

SEQ ID NO: 1299702 - RNA, 17 nt, Human
ccagcagacagagccag

SEQ ID NO: 1299703 - RNA, 21 nt, Human
ccagcagccccacaccagggc

SEQ ID NO: 1299704 - RNA, 16 nt, Human
ccagcagacagagcca

SEQ ID NO: 1299705 - RNA, 22 nt, Human
ccagcccccuaagagagcaccu

SEQ ID NO: 1299706 - RNA, 15 nt, Human
ccagcccccuccugg

SEQ ID NO: 1299707 - RNA, 18 nt, Human
ccagcccccuccuggugc

SEQ ID NO: 1299708 - RNA, 22 nt, Human
ccagcccccuccuggugccacc

SEQ ID NO: 1299709 - RNA, 14 nt, Human
ccagcccccugacc

SEQ ID NO: 1299710 - RNA, 19 nt, Human
ccagcccccugaccacuca

SEQ ID NO: 1299711 - RNA, 23 nt, Human
ccagcccccugaccacucagaga

SEQ ID NO: 1299712 - RNA, 22 nt, Human
ccagcccccugaccacucagag

SEQ ID NO: 1299713 - RNA, 13 nt, Human
ccagcgagcgccc

SEQ ID NO: 1299714 - RNA, 20 nt, Human
ccagcgagcgcccagcuccu

SEQ ID NO: 1299715 - RNA, 22 nt, Human
ccagcgagcgcccagcuccuga

SEQ ID NO: 1299716 - RNA, 16 nt, Human
ccagcgaggaggcucc

SEQ ID NO: 1299717 - RNA, 17 nt, Human
ccagcgagggcgugucu

SEQ ID NO: 1299718 - RNA, 18 nt, Human
ccagcgauucccucuccc

SEQ ID NO: 1299719 - RNA, 19 nt, Human
ccagcgauucccucuccca

SEQ ID NO: 1299720 - RNA, 21 nt, Human
ccagcgauucccucucccagg

SEQ ID NO: 1299721 - RNA, 22 nt, Human
ccagcgauucccucucccaggc

SEQ ID NO: 1299722 - RNA, 23 nt, Human
ccagcgauucccucucccaggcc

SEQ ID NO: 1299723 - RNA, 14 nt, Human
ccagcuuguuuaca

SEQ ID NO: 1299724 - RNA, 19 nt, Human
ccagcuuguuuacaugcuu

SEQ ID NO: 1299725 - RNA, 13 nt, Human
ccagcggacacac

SEQ ID NO: 1299726 - RNA, 14 nt, Human
ccagcggacacacg

SEQ ID NO: 1299727 - RNA, 15 nt, Human
ccagcggcccuguca

SEQ ID NO: 1299728 - RNA, 15 nt, Human
ccagcggugggaccu

SEQ ID NO: 1299729 - RNA, 13 nt, Human
ccagcguccuccu

SEQ ID NO: 1299730 - RNA, 19 nt, Human
ccagcguccuccucuguga

SEQ ID NO: 1299731 - RNA, 17 nt, Human
ccagcguccuccucugu

SEQ ID NO: 1299732 - RNA, 17 nt, Human
ccccagccauccagggg

SEQ ID NO: 1299733 - RNA, 16 nt, Human
ccccagccagggcuca

SEQ ID NO: 1299734 - RNA, 16 nt, Human
ccccauucuuccuagu

SEQ ID NO: 1299735 - RNA, 21 nt, Human
ccccauucuuccuaguuuucu

SEQ ID NO: 1299736 - RNA, 23 nt, Human
ccccauucuuccuaguuuucucc

SEQ ID NO: 1299737 - RNA, 20 nt, Human
cccauucuuccuaguuuucu

SEQ ID NO: 1299738 - RNA, 11 nt, Human
ccccagcacuu

SEQ ID NO: 1299739 - RNA, 18 nt, Human
ccccagcaggugcugacu

SEQ ID NO: 1299740 - RNA, 19 nt, Human
ccccagcauuccagccccu

SEQ ID NO: 1299741 - RNA, 16 nt, Human
cccccuucaagccugu

SEQ ID NO: 1299742 - RNA, 15 nt, Human
ccccauuguggucac

SEQ ID NO: 1299743 - RNA, 18 nt, Human
ccccauuuagguuucuga

SEQ ID NO: 1299744 - RNA, 18 nt, Human
ccccgccugcccucaugg

SEQ ID NO: 1299745 - RNA, 21 nt, Human
ccccgcguggaacucgugucu

SEQ ID NO: 1299746 - RNA, 12 nt, Human
cccauucuuccu

SEQ ID NO: 1299747 - RNA, 21 nt, Human
cccauucuuccuaguuuucuc

SEQ ID NO: 1299748 - RNA, 23 nt, Human
cccagcuggggccaggcuggguc

SEQ ID NO: 1299749 - RNA, 22 nt, Human
cccagcuggggccaggcugggu

SEQ ID NO: 1299750 - RNA, 17 nt, Human
cccagcugggucaggca

SEQ ID NO: 1299751 - RNA, 19 nt, Human
cccagcugggucaggcagg

SEQ ID NO: 1299752 - RNA, 11 nt, Human
cccagggcaca

SEQ ID NO: 1299753 - RNA, 18 nt, Human
cccagggaggccgaagcu

SEQ ID NO: 1299754 - RNA, 19 nt, Human
cccaucauccucuggcuug

SEQ ID NO: 1299755 - RNA, 13 nt, Human
cccauccagggcc

SEQ ID NO: 1299756 - RNA, 14 nt, Human
cccauccaguucau

SEQ ID NO: 1299757 - RNA, 21 nt, Human
cccauccaguucaugagaauc

SEQ ID NO: 1299758 - RNA, 13 nt, Human
cccagggcacagg

SEQ ID NO: 1299759 - RNA, 14 nt, Human
cccagggcacagga

SEQ ID NO: 1299760 - RNA, 15 nt, Human
cccagggcacaggag

SEQ ID NO: 1299761 - RNA, 16 nt, Human
cccagggcacaggagc

SEQ ID NO: 1299762 - RNA, 17 nt, Human
cccagggcacaggagcu

SEQ ID NO: 1299763 - RNA, 18 nt, Human
cccagggcacaggagcua

SEQ ID NO: 1299764 - RNA, 22 nt, Human
cccagggcacaggagcuaccug

SEQ ID NO: 1299765 - RNA, 13 nt, Human
cccagggcagcca

SEQ ID NO: 1299766 - RNA, 18 nt, Human
cccagggcagccagggag

SEQ ID NO: 1299767 - RNA, 15 nt, Human
cccagggcagccagg

SEQ ID NO: 1299768 - RNA, 14 nt, Human
cccaucauccucug

SEQ ID NO: 1299769 - RNA, 16 nt, Human
cccaucauccucuggc

SEQ ID NO: 1299770 - RNA, 14 nt, Human
cccauccccagcga

SEQ ID NO: 1299771 - RNA, 14 nt, Human
cccaucccaugcug

SEQ ID NO: 1299772 - RNA, 13 nt, Human
cccauccccagcg

SEQ ID NO: 1299773 - RNA, 18 nt, Human
cccauccccagcgauucc

SEQ ID NO: 1299774 - RNA, 11 nt, Human
cccagcccaga

SEQ ID NO: 1299775 - RNA, 12 nt, Human
cccagcccagag

SEQ ID NO: 1299776 - RNA, 13 nt, Human
cccagcccagaga

SEQ ID NO: 1299777 - RNA, 14 nt, Human
cccagcccagagac

SEQ ID NO: 1299778 - RNA, 15 nt, Human
cccagcccagagaca

SEQ ID NO: 1299779 - RNA, 16 nt, Human
cccagcccagagacau

SEQ ID NO: 1299780 - RNA, 11 nt, Human
cccagcccagg

SEQ ID NO: 1299781 - RNA, 18 nt, Human
cccagcccagggcuccug

SEQ ID NO: 1299782 - RNA, 15 nt, Human
cccagcccauggaga

SEQ ID NO: 1299783 - RNA, 18 nt, Human
cccagcauuccagccccu

SEQ ID NO: 1299784 - RNA, 19 nt, Human
cccagcauuccagccccuc

SEQ ID NO: 1299785 - RNA, 20 nt, Human
cccagcauuccagccccucu

SEQ ID NO: 1299786 - RNA, 22 nt, Human
cccagcauuccagccccucugg

SEQ ID NO: 1299787 - RNA, 20 nt, Human
ccauugugccuaaguccagu

SEQ ID NO: 1299788 - RNA, 20 nt, Human
ccauuguggccuaagaggcu

SEQ ID NO: 1299789 - RNA, 17 nt, Human
ccauugugcauucuaga

SEQ ID NO: 1299790 - RNA, 12 nt, Human
ccauugugcauu

SEQ ID NO: 1299791 - RNA, 22 nt, Human
ccauuguggucacaggaaguag

SEQ ID NO: 1299792 - RNA, 19 nt, Human
ccauuguagcgucuuucuu

SEQ ID NO: 1299793 - RNA, 19 nt, Human
ccauuguccaauccuaugu

SEQ ID NO: 1299794 - RNA, 20 nt, Human
ccauuguagcgucuuucuuu

SEQ ID NO: 1299795 - RNA, 15 nt, Human
ccauugucucagagc

SEQ ID NO: 1299796 - RNA, 14 nt, Human
ccauugguccaaga

SEQ ID NO: 1299797 - RNA, 14 nt, Human
cccaaccugcucuc

SEQ ID NO: 1299798 - RNA, 21 nt, Human
cccaaccugcucuccucuugc

SEQ ID NO: 1299799 - RNA, 20 nt, Human
ccauuuaaacagauguccau

SEQ ID NO: 1299800 - RNA, 16 nt, Human
cccaaccugcucuccu

SEQ ID NO: 1299801 - RNA, 17 nt, Human
cccaaccugcucuccuc

SEQ ID NO: 1299802 - RNA, 19 nt, Human
cccaaccugcucuccucuu

SEQ ID NO: 1299803 - RNA, 15 nt, Human
ccauuguuuaaaaau

SEQ ID NO: 1299804 - RNA, 23 nt, Human
ccauuguuuaaaaaucuuaaugu

SEQ ID NO: 1299805 - RNA, 23 nt, Human
cccaaccugcucuccucuugcca

SEQ ID NO: 1299806 - RNA, 21 nt, Human
cccaaccugcucuccucuucu

SEQ ID NO: 1299807 - RNA, 20 nt, Human
cccaacucuccccugaccug

SEQ ID NO: 1299808 - RNA, 12 nt, Human
cccaacgcucca

SEQ ID NO: 1299809 - RNA, 23 nt, Human
cccaacucuugcacagucacugc

SEQ ID NO: 1299810 - RNA, 12 nt, Human
cccaacugacca

SEQ ID NO: 1299811 - RNA, 16 nt, Human
cccaagcggugucucu

SEQ ID NO: 1299812 - RNA, 17 nt, Human
cccaagcggugucucuc

SEQ ID NO: 1299813 - RNA, 12 nt, Human
cccaagcucaga

SEQ ID NO: 1299814 - RNA, 19 nt, Human
cccaagcuguuuucuucua

SEQ ID NO: 1299815 - RNA, 20 nt, Human
cccaagaauagaugcugacu

SEQ ID NO: 1299816 - RNA, 21 nt, Human
cccaagaauagaugcugacug

SEQ ID NO: 1299817 - RNA, 14 nt, Human
cccaagccagaggc

SEQ ID NO: 1299818 - RNA, 15 nt, Human
cccaagccagaggcu

SEQ ID NO: 1299819 - RNA, 23 nt, Human
cccaagccuacuuuugccauuga

SEQ ID NO: 1299820 - RNA, 16 nt, Human
cccaagccagaggcug

SEQ ID NO: 1299821 - RNA, 16 nt, Human
cccaagccuggcaagg

SEQ ID NO: 1299822 - RNA, 18 nt, Human
cccaccauuuggcauccc

SEQ ID NO: 1299823 - RNA, 23 nt, Human
cccaccauuuggcaucccugggc

SEQ ID NO: 1299824 - RNA, 20 nt, Human
cccaccauuuggcaucccug

SEQ ID NO: 1299825 - RNA, 23 nt, Human
cccacuguacuugcucuugaugc

SEQ ID NO: 1299826 - RNA, 18 nt, Human
cccacccuguuccugcug

SEQ ID NO: 1299827 - RNA, 19 nt, Human
cccacccuguuccugcugc

SEQ ID NO: 1299828 - RNA, 20 nt, Human
cccacccuguuccugcugcu

SEQ ID NO: 1299829 - RNA, 19 nt, Human
cccacuguaucuaggcaac

SEQ ID NO: 1299830 - RNA, 19 nt, Human
cccacuguacuugcucuug

SEQ ID NO: 1299831 - RNA, 18 nt, Human
cccacuguacuugcucuu

SEQ ID NO: 1299832 - RNA, 13 nt, Human
cccaccccuagga

SEQ ID NO: 1299833 - RNA, 13 nt, Human
cccacccugggcc

SEQ ID NO: 1299834 - RNA, 14 nt, Human
cccacccugggccc

SEQ ID NO: 1299835 - RNA, 18 nt, Human
cccacccuggugggccaa

SEQ ID NO: 1299836 - RNA, 12 nt, Human
cccacccuguuc

SEQ ID NO: 1299837 - RNA, 14 nt, Human
cccacccuguuccu

SEQ ID NO: 1299838 - RNA, 15 nt, Human
cccacccuguuccug

SEQ ID NO: 1299839 - RNA, 16 nt, Human
cccacccuguuccugc

SEQ ID NO: 1299840 - RNA, 17 nt, Human
cccacccuguuccugcu

SEQ ID NO: 1299841 - RNA, 22 nt, Human
cccacuguccugggccugcaga

SEQ ID NO: 1299842 - RNA, 15 nt, Human
cccacuguccugggc

SEQ ID NO: 1299843 - RNA, 16 nt, Human
cccacuguccugggcc

SEQ ID NO: 1299844 - RNA, 18 nt, Human
ccaugggcacugugggua

SEQ ID NO: 1299845 - RNA, 14 nt, Human
ccaugggcagagcc

SEQ ID NO: 1299846 - RNA, 16 nt, Human
ccaugggcagagccca

SEQ ID NO: 1299847 - RNA, 21 nt, Human
ccaugagcuccuuaaggcucu

SEQ ID NO: 1299848 - RNA, 23 nt, Human
ccaugacccugccucucccaggc

SEQ ID NO: 1299849 - RNA, 14 nt, Human
ccaugaccuccagc

SEQ ID NO: 1299850 - RNA, 15 nt, Human
ccaugaccuccagcu

SEQ ID NO: 1299851 - RNA, 20 nt, Human
ccaugaccuccagcuuuccu

SEQ ID NO: 1299852 - RNA, 22 nt, Human
ccaugaccuccagcuuuccugu

SEQ ID NO: 1299853 - RNA, 21 nt, Human
ccaugacgcaaagagagauuu

SEQ ID NO: 1299854 - RNA, 22 nt, Human
ccaugacgcaaagagagauuuu

SEQ ID NO: 1299855 - RNA, 21 nt, Human
ccaugaccuccagcuuuccug

SEQ ID NO: 1299856 - RNA, 12 nt, Human
ccaugacugcuu

SEQ ID NO: 1299857 - RNA, 13 nt, Human
ccaugacugcuug

SEQ ID NO: 1299858 - RNA, 19 nt, Human
ccaugacugcuugcccuaa

SEQ ID NO: 1299859 - RNA, 22 nt, Human
ccaugacugcuugcccuaagca

SEQ ID NO: 1299860 - RNA, 21 nt, Human
ccaugacugcuugcccuaagc

SEQ ID NO: 1299861 - RNA, 23 nt, Human
ccaugagaugauacauccaaagc

SEQ ID NO: 1299862 - RNA, 14 nt, Human
ccaugucucgacuc

SEQ ID NO: 1299863 - RNA, 15 nt, Human
ccaugucucgacuca

SEQ ID NO: 1299864 - RNA, 20 nt, Human
ccaugucucugagcauuaga

SEQ ID NO: 1299865 - RNA, 13 nt, Human
ccaugucuucucc

SEQ ID NO: 1299866 - RNA, 15 nt, Human
ccaugucuucucccu

SEQ ID NO: 1299867 - RNA, 16 nt, Human
ccaugucuucucccug

SEQ ID NO: 1299868 - RNA, 19 nt, Human
ccaugucuucucccuggaa

SEQ ID NO: 1299869 - RNA, 20 nt, Human
ccaugucuucucccuggaau

SEQ ID NO: 1299870 - RNA, 13 nt, Human
ccaugucuuucuc

SEQ ID NO: 1299871 - RNA, 17 nt, Human
ccaugggcagagcccaa

SEQ ID NO: 1299872 - RNA, 14 nt, Human
ccaugggcagagga

SEQ ID NO: 1299873 - RNA, 12 nt, Human
ccauggggaggg

SEQ ID NO: 1299874 - RNA, 18 nt, Human
ccauggggagggauucug

SEQ ID NO: 1299875 - RNA, 20 nt, Human
ccauggggagggauucuggu

SEQ ID NO: 1299876 - RNA, 16 nt, Human
ccauggguagccuggg

SEQ ID NO: 1299877 - RNA, 23 nt, Human
ccugccuggacuuggccccugcc

SEQ ID NO: 1299878 - RNA, 11 nt, Human
ccugccuggag

SEQ ID NO: 1299879 - RNA, 19 nt, Human
ccugccuggaccagccucu

SEQ ID NO: 1299880 - RNA, 12 nt, Human
ccugccuggacc

SEQ ID NO: 1299881 - RNA, 18 nt, Human
ccugccugcucgcucccu

SEQ ID NO: 1299882 - RNA, 14 nt, Human
ccugccucuuaaau

SEQ ID NO: 1299883 - RNA, 21 nt, Human
ccugccucuuaaauaaaccuu

SEQ ID NO: 1299884 - RNA, 16 nt, Human
ccugccugcccuggug

SEQ ID NO: 1299885 - RNA, 21 nt, Human
ccugccucucugcaggucccu

SEQ ID NO: 1299886 - RNA, 20 nt, Human
ccugccucucugcagguccc

SEQ ID NO: 1299887 - RNA, 23 nt, Human
ccugccuccugccggcuccuugg

SEQ ID NO: 1299888 - RNA, 22 nt, Human
ccugcugccauguggacuggug

SEQ ID NO: 1299889 - RNA, 11 nt, Human
ccugcugcccu

SEQ ID NO: 1299890 - RNA, 12 nt, Human
ccugcugcccuc

SEQ ID NO: 1299891 - RNA, 13 nt, Human
ccugcugcccucc

SEQ ID NO: 1299892 - RNA, 18 nt, Human
ccugcugcccucccccuc

SEQ ID NO: 1299893 - RNA, 17 nt, Human
ccugccucucugcaggu

SEQ ID NO: 1299894 - RNA, 19 nt, Human
ccucuuuggcuccccugua

SEQ ID NO: 1299895 - RNA, 20 nt, Human
ccucuuuggcuccccuguac

SEQ ID NO: 1299896 - RNA, 14 nt, Human
ccugaccugugagc

SEQ ID NO: 1299897 - RNA, 18 nt, Human
ccugaccugugagcccag

SEQ ID NO: 1299898 - RNA, 19 nt, Human
ccugaccugugagcccagc

SEQ ID NO: 1299899 - RNA, 20 nt, Human
ccugaccugugagcccagcu

SEQ ID NO: 1299900 - RNA, 21 nt, Human
ccugaccugugagcccagcug

SEQ ID NO: 1299901 - RNA, 22 nt, Human
ccugaccugugagcccagcugg

SEQ ID NO: 1299902 - RNA, 19 nt, Human
ccugacuagggagccaugu

SEQ ID NO: 1299903 - RNA, 13 nt, Human
ccugacucauucu

SEQ ID NO: 1299904 - RNA, 14 nt, Human
ccugaggcuguggu

SEQ ID NO: 1299905 - RNA, 15 nt, Human
ccugaggcugugguc

SEQ ID NO: 1299906 - RNA, 14 nt, Human
ccugagugcuugcu

SEQ ID NO: 1299907 - RNA, 15 nt, Human
ccugagugcuugcuu

SEQ ID NO: 1299908 - RNA, 17 nt, Human
ccugagugcuugcuuuu

SEQ ID NO: 1299909 - RNA, 19 nt, Human
ccugagugcuugcuuuuca

SEQ ID NO: 1299910 - RNA, 14 nt, Human
ccugaguggugcca

SEQ ID NO: 1299911 - RNA, 16 nt, Human
ccugaguggugccaaa

SEQ ID NO: 1299912 - RNA, 15 nt, Human
ccucugccugucucc

SEQ ID NO: 1299913 - RNA, 19 nt, Human
ccucugccugucuccccca

SEQ ID NO: 1299914 - RNA, 14 nt, Human
ccucuuuggcuccc

SEQ ID NO: 1299915 - RNA, 18 nt, Human
ccucuuuggcuccccugu

SEQ ID NO: 1299916 - RNA, 23 nt, Human
ccucuuggggaguuuaggguggg

SEQ ID NO: 1299917 - RNA, 22 nt, Human
ccucuuggggaguuuagggugg

SEQ ID NO: 1299918 - RNA, 14 nt, Human
ccucuuggagaagu

SEQ ID NO: 1299919 - RNA, 18 nt, Human
ccucuuggagaagucuca

SEQ ID NO: 1299920 - RNA, 19 nt, Human
ccucuuggagaagucucag

SEQ ID NO: 1299921 - RNA, 20 nt, Human
ccucuuggagaagucucagc

SEQ ID NO: 1299922 - RNA, 21 nt, Human
ccucuuggagaagucucagcu

SEQ ID NO: 1299923 - RNA, 22 nt, Human
ccucuuggagaagucucagcua

SEQ ID NO: 1299924 - RNA, 13 nt, Human
ccucuuggccuga

SEQ ID NO: 1299925 - RNA, 16 nt, Human
ccucuucugggccuga

SEQ ID NO: 1299926 - RNA, 13 nt, Human
ccucuugaccagg

SEQ ID NO: 1299927 - RNA, 15 nt, Human
ccucuugaccaggcu

SEQ ID NO: 1299928 - RNA, 14 nt, Human
ccucuugaccaggc

SEQ ID NO: 1299929 - RNA, 13 nt, Human
ccucuucugggag

SEQ ID NO: 1299930 - RNA, 17 nt, Human
ccucuucugggagggca

SEQ ID NO: 1299931 - RNA, 18 nt, Human
ccucuucugggagggcag

SEQ ID NO: 1299932 - RNA, 21 nt, Human
ccucuucugggagggcagcag

SEQ ID NO: 1299933 - RNA, 19 nt, Human
ccucgccggaucugaggga

SEQ ID NO: 1299934 - RNA, 13 nt, Human
ccucgccugacaa

SEQ ID NO: 1299935 - RNA, 18 nt, Human
ccucgccggaucugaggg

SEQ ID NO: 1299936 - RNA, 17 nt, Human
ccucgcuccccacucug

SEQ ID NO: 1299937 - RNA, 18 nt, Human
ccucgcuccccacucugc

SEQ ID NO: 1299938 - RNA, 19 nt, Human
ccucgcuccccacucugcu

SEQ ID NO: 1299939 - RNA, 21 nt, Human
ccucgcuccccacucugcucu

SEQ ID NO: 1299940 - RNA, 22 nt, Human
ccucgcuccccacucugcucug

SEQ ID NO: 1299941 - RNA, 23 nt, Human
ccucgcuccccacucugcucuga

SEQ ID NO: 1299942 - RNA, 13 nt, Human
ccucgcugccagc

SEQ ID NO: 1299943 - RNA, 14 nt, Human
ccucgcugccagcu

SEQ ID NO: 1299944 - RNA, 19 nt, Human
ccucgcugccagcucugua

SEQ ID NO: 1299945 - RNA, 20 nt, Human
ccucgcugccagcucuguau

SEQ ID NO: 1299946 - RNA, 13 nt, Human
ccucgggccugcu

SEQ ID NO: 1299947 - RNA, 13 nt, Human
ccucuccuuccug

SEQ ID NO: 1299948 - RNA, 15 nt, Human
ccucuccuuccugug

SEQ ID NO: 1299949 - RNA, 23 nt, Human
ccucuccuucaugacagccucca

SEQ ID NO: 1299950 - RNA, 16 nt, Human
ccucucgagggcaggg

SEQ ID NO: 1299951 - RNA, 14 nt, Human
ccucucgcggcccu

SEQ ID NO: 1299952 - RNA, 20 nt, Human
ccucucgcuccucaaccccu

SEQ ID NO: 1299953 - RNA, 23 nt, Human
ccucucgcuccucaaccccuccc

SEQ ID NO: 1299954 - RNA, 17 nt, Human
ccucucugcaggucccu

SEQ ID NO: 1299955 - RNA, 16 nt, Human
ccucucugcagguccc

SEQ ID NO: 1299956 - RNA, 23 nt, Human
ccucucguaagauuuccuucuuu

SEQ ID NO: 1299957 - RNA, 22 nt, Human
ccucucgcuccucaaccccucc

SEQ ID NO: 1299958 - RNA, 19 nt, Human
ccucucguaagauuuccuu

SEQ ID NO: 1299959 - RNA, 22 nt, Human
ccucucguaagauuuccuucuu

SEQ ID NO: 1299960 - RNA, 15 nt, Human
ccucucuacagucuc

SEQ ID NO: 1299961 - RNA, 20 nt, Human
ccucucuacagucucgucuc

SEQ ID NO: 1299962 - RNA, 17 nt, Human
ccucucuauccucucuu

SEQ ID NO: 1299963 - RNA, 19 nt, Human
ccucucuauccucucuucc

SEQ ID NO: 1299964 - RNA, 19 nt, Human
ccucucugcaggucccuaa

SEQ ID NO: 1299965 - RNA, 18 nt, Human
ccucucugcaggucccua

SEQ ID NO: 1299966 - RNA, 20 nt, Human
ccucucugcaggucccuaau

SEQ ID NO: 1299967 - RNA, 21 nt, Human
ccucugcccgggagcucagga

SEQ ID NO: 1299968 - RNA, 22 nt, Human
ccucugcccgggagcucaggaa

SEQ ID NO: 1299969 - RNA, 20 nt, Human
ccucucuauccucucuuccu

SEQ ID NO: 1299970 - RNA, 21 nt, Human
ccucucuauccucucuuccuc

SEQ ID NO: 1299971 - RNA, 15 nt, Human
ccucugcccuuccug

SEQ ID NO: 1299972 - RNA, 19 nt, Human
ccucugcccuuccugcagg

SEQ ID NO: 1299973 - RNA, 11 nt, Human
ccucugcccug

SEQ ID NO: 1299974 - RNA, 12 nt, Human
ccucugcccugc

SEQ ID NO: 1299975 - RNA, 13 nt, Human
ccucugcccugcg

SEQ ID NO: 1299976 - RNA, 14 nt, Human
ccucugcccugcgg

SEQ ID NO: 1299977 - RNA, 14 nt, Human
ccuccgccauccac

SEQ ID NO: 1299978 - RNA, 18 nt, Human
ccuccgggaccuggugcu

SEQ ID NO: 1299979 - RNA, 13 nt, Human
ccuccgccucccg

SEQ ID NO: 1299980 - RNA, 16 nt, Human
ccuccgccucccgggu

SEQ ID NO: 1299981 - RNA, 15 nt, Human
ccuccgccauccacc

SEQ ID NO: 1299982 - RNA, 12 nt, Human
ccuccgcccugc

SEQ ID NO: 1299983 - RNA, 13 nt, Human
ccuccgcccugcc

SEQ ID NO: 1299984 - RNA, 14 nt, Human
ccuccgcccugcca

SEQ ID NO: 1299985 - RNA, 15 nt, Human
ccuccgcccugccac

SEQ ID NO: 1299986 - RNA, 16 nt, Human
ccuccgcccugccacu

SEQ ID NO: 1299987 - RNA, 18 nt, Human
ccuccgcccugccacuca

SEQ ID NO: 1299988 - RNA, 18 nt, Human
ccuccguccaggagccug

SEQ ID NO: 1299989 - RNA, 15 nt, Human
ccuccguccccugcc

SEQ ID NO: 1299990 - RNA, 15 nt, Human
ccuccuuucuggcuu

SEQ ID NO: 1299991 - RNA, 12 nt, Human
ccucccuggaug

SEQ ID NO: 1299992 - RNA, 14 nt, Human
ccucccuguaacuu

SEQ ID NO: 1299993 - RNA, 11 nt, Human
ccucccuguaa

SEQ ID NO: 1299994 - RNA, 18 nt, Human
ccucccuguuccccagag

SEQ ID NO: 1299995 - RNA, 19 nt, Human
ccucccuguuccccagaga

SEQ ID NO: 1299996 - RNA, 20 nt, Human
ccucccuguuccccagagaa

SEQ ID NO: 1299997 - RNA, 15 nt, Human
ccucaugaauguaaa

SEQ ID NO: 1299998 - RNA, 16 nt, Human
ccucaugaauguaaau

SEQ ID NO: 1299999 - RNA, 17 nt, Human
ccucaugaauguaaauu

SEQ ID NO: 1300000 - RNA, 19 nt, Human
ccucaugaauguaaauuug

SEQ ID NO: 1300001 - RNA, 20 nt, Human
ccucaugaauguaaauuugu

SEQ ID NO: 1300002 - RNA, 23 nt, Human
ccucaugaauguaaauuuguacu

SEQ ID NO: 1300003 - RNA, 22 nt, Human
ccucaugaauguaaauuuguac

SEQ ID NO: 1300004 - RNA, 11 nt, Human
ccucccagaaa

SEQ ID NO: 1300005 - RNA, 19 nt, Human
ccucccagaaagcaaaccu

SEQ ID NO: 1300006 - RNA, 16 nt, Human
ccucccagagcaccug

SEQ ID NO: 1300007 - RNA, 17 nt, Human
ccucccagagcaccugc

SEQ ID NO: 1300008 - RNA, 21 nt, Human
ccucccagagcaccugcuguc

SEQ ID NO: 1300009 - RNA, 20 nt, Human
ccucccagaggagccaccag

SEQ ID NO: 1300010 - RNA, 21 nt, Human
ccucccagaggagccaccagu

SEQ ID NO: 1300011 - RNA, 23 nt, Human
ccucccagaggagccaccaguuc

SEQ ID NO: 1300012 - RNA, 20 nt, Human
ccucccagagcaccugcugu

SEQ ID NO: 1300013 - RNA, 22 nt, Human
ccuccccagcauuccagccccu

SEQ ID NO: 1300014 - RNA, 18 nt, Human
ccucagccuccugaguag

SEQ ID NO: 1300015 - RNA, 15 nt, Human
ccuaggaagccucag

SEQ ID NO: 1300016 - RNA, 17 nt, Human
ccuaggaagccucagau

SEQ ID NO: 1300017 - RNA, 22 nt, Human
ccuaggaagccucagauuccuu

SEQ ID NO: 1300018 - RNA, 12 nt, Human
ccucagccucuc

SEQ ID NO: 1300019 - RNA, 19 nt, Human
ccucagccugaaccccagg

SEQ ID NO: 1300020 - RNA, 22 nt, Human
ccucagccugaaccccagggcu

SEQ ID NO: 1300021 - RNA, 21 nt, Human
ccucagccugaaccccagggc

SEQ ID NO: 1300022 - RNA, 11 nt, Human
ccucagccugg

SEQ ID NO: 1300023 - RNA, 12 nt, Human
ccucagccuggc

SEQ ID NO: 1300024 - RNA, 13 nt, Human
ccucagccuggcc

SEQ ID NO: 1300025 - RNA, 14 nt, Human
ccucagccuggcca

SEQ ID NO: 1300026 - RNA, 15 nt, Human
ccucagccuggccag

SEQ ID NO: 1300027 - RNA, 16 nt, Human
ccucagccuggccaga

SEQ ID NO: 1300028 - RNA, 17 nt, Human
ccucagccuggccagac

SEQ ID NO: 1300029 - RNA, 18 nt, Human
ccucagccuggccagaca

SEQ ID NO: 1300030 - RNA, 19 nt, Human
ccucaggaggcaggaccuu

SEQ ID NO: 1300031 - RNA, 19 nt, Human
ccucagccuggccagacac

SEQ ID NO: 1300032 - RNA, 22 nt, Human
ccucaggcaaucugcccgccug

SEQ ID NO: 1300033 - RNA, 15 nt, Human
ccucaggcacacagc

SEQ ID NO: 1300034 - RNA, 16 nt, Human
ccucaggcacacagcu

SEQ ID NO: 1300035 - RNA, 20 nt, Human
ccucaggcacacagcuacuc

SEQ ID NO: 1300036 - RNA, 17 nt, Human
ccucaggcacacagcua

SEQ ID NO: 1300037 - RNA, 13 nt, Human
ccucaggcagcuc

SEQ ID NO: 1300038 - RNA, 14 nt, Human
ccucaggcagcuca

SEQ ID NO: 1300039 - RNA, 15 nt, Human
ccucaggcagcucaa

SEQ ID NO: 1300040 - RNA, 10 nt, Human
ccuagccuug

SEQ ID NO: 1300041 - RNA, 14 nt, Human
ccuagccuugcuug

SEQ ID NO: 1300042 - RNA, 15 nt, Human
ccuagccuugcuugu

SEQ ID NO: 1300043 - RNA, 21 nt, Human
ccuagcgcuaucucccugccu

SEQ ID NO: 1300044 - RNA, 17 nt, Human
ccuagcgggauggggcu

SEQ ID NO: 1300045 - RNA, 20 nt, Human
ccuagcgggauggggcuccc

SEQ ID NO: 1300046 - RNA, 14 nt, Human
ccuagcugaauguu

SEQ ID NO: 1300047 - RNA, 19 nt, Human
ccuagcugaauguuuuucu

SEQ ID NO: 1300048 - RNA, 20 nt, Human
ccuagcugaauguuuuucua

SEQ ID NO: 1300049 - RNA, 21 nt, Human
ccuagcugaauguuuuucuaa

SEQ ID NO: 1300050 - RNA, 22 nt, Human
ccuagcugaauguuuuucuaaa

SEQ ID NO: 1300051 - RNA, 13 nt, Human
ccuagcuggcucu

SEQ ID NO: 1300052 - RNA, 14 nt, Human
ccuagcuggcucug

SEQ ID NO: 1300053 - RNA, 15 nt, Human
ccuagcuggcucugu

SEQ ID NO: 1300054 - RNA, 17 nt, Human
ccuagcuggcucuguga

SEQ ID NO: 1300055 - RNA, 13 nt, Human
ccuagcuguccuu

SEQ ID NO: 1300056 - RNA, 18 nt, Human
ccuagcuguccuuuuucc

SEQ ID NO: 1300057 - RNA, 19 nt, Human
ccuagcuguccuuuuuccu

SEQ ID NO: 1300058 - RNA, 20 nt, Human
ccuagcuguccuuuuuccuc

SEQ ID NO: 1300059 - RNA, 21 nt, Human
ccuagcugugaccucuccccu

SEQ ID NO: 1300060 - RNA, 22 nt, Human
ccuagcuguccuuuuuccucuc

SEQ ID NO: 1300061 - RNA, 16 nt, Human
ccuagcugugugaaua

SEQ ID NO: 1300062 - RNA, 22 nt, Human
ccuagcugugugaauaccugcu

SEQ ID NO: 1300063 - RNA, 13 nt, Human
ccuaggaagccuc

SEQ ID NO: 1300064 - RNA, 18 nt, Human
cccugcccugccaccugu

SEQ ID NO: 1300065 - RNA, 17 nt, Human
cccugcccugccaccug

SEQ ID NO: 1300066 - RNA, 15 nt, Human
cccugcccugccacc

SEQ ID NO: 1300067 - RNA, 11 nt, Human
cccugcccugg

SEQ ID NO: 1300068 - RNA, 12 nt, Human
cccugcccuggu

SEQ ID NO: 1300069 - RNA, 23 nt, Human
cccugcccugguuuccugcccug

SEQ ID NO: 1300070 - RNA, 22 nt, Human
cccugcccugguuuccugcccu

SEQ ID NO: 1300071 - RNA, 15 nt, Human
cccuggaucagaaca

SEQ ID NO: 1300072 - RNA, 17 nt, Human
cccuggaucagaacagg

SEQ ID NO: 1300073 - RNA, 16 nt, Human
cccuggaucagcgugg

SEQ ID NO: 1300074 - RNA, 19 nt, Human
cccuggaucagcguggccu

SEQ ID NO: 1300075 - RNA, 20 nt, Human
cccuggaucagcguggccuu

SEQ ID NO: 1300076 - RNA, 21 nt, Human
cccuggaucagcguggccuug

SEQ ID NO: 1300077 - RNA, 19 nt, Human
cccuggauccaucaggcca

SEQ ID NO: 1300078 - RNA, 16 nt, Human
cccuggauuuuuacca

SEQ ID NO: 1300079 - RNA, 24 nt, Human
cccuggauuuuuaccagucucaca

SEQ ID NO: 1300080 - RNA, 20 nt, Human
cccuggauuuuuaccagucu

SEQ ID NO: 1300081 - RNA, 20 nt, Human
cccuggccgaguccaagcug

SEQ ID NO: 1300082 - RNA, 15 nt, Human
cccuggccgcccccu

SEQ ID NO: 1300083 - RNA, 16 nt, Human
cccuggccuagaccag

SEQ ID NO: 1300084 - RNA, 11 nt, Human
cccuggccucc

SEQ ID NO: 1300085 - RNA, 13 nt, Human
cccuggccucccc

SEQ ID NO: 1300086 - RNA, 14 nt, Human
cccuggccuccccu

SEQ ID NO: 1300087 - RNA, 20 nt, Human
cccuggcucccacaggcccu

SEQ ID NO: 1300088 - RNA, 20 nt, Human
cccuggcuccuugugccaga

SEQ ID NO: 1300089 - RNA, 19 nt, Human
cccuggccuccccugccac

SEQ ID NO: 1300090 - RNA, 20 nt, Human
cccuggccuccccugccacc

SEQ ID NO: 1300091 - RNA, 15 nt, Human
cccuggccuccccca

SEQ ID NO: 1300092 - RNA, 22 nt, Human
cccuggcuccuugugccagaga

SEQ ID NO: 1300093 - RNA, 13 nt, Human
cccugcccaugcu

SEQ ID NO: 1300094 - RNA, 14 nt, Human
cccugccccccagc

SEQ ID NO: 1300095 - RNA, 12 nt, Human
cccugcccccca

SEQ ID NO: 1300096 - RNA, 15 nt, Human
cccugccccccagcc

SEQ ID NO: 1300097 - RNA, 20 nt, Human
cccugccccccagcccuccu

SEQ ID NO: 1300098 - RNA, 17 nt, Human
cccugccccucccuuca

SEQ ID NO: 1300099 - RNA, 16 nt, Human
cccugcccccugcagg

SEQ ID NO: 1300100 - RNA, 17 nt, Human
cccugcccccugcagga

SEQ ID NO: 1300101 - RNA, 19 nt, Human
cccugcccccugcaggaag

SEQ ID NO: 1300102 - RNA, 16 nt, Human
cccugccccccagccu

SEQ ID NO: 1300103 - RNA, 19 nt, Human
cccugccccccagccucug

SEQ ID NO: 1300104 - RNA, 21 nt, Human
cccugccccccagccucuggc

SEQ ID NO: 1300105 - RNA, 14 nt, Human
cccugcccccugca

SEQ ID NO: 1300106 - RNA, 15 nt, Human
cccugcccccugcag

SEQ ID NO: 1300107 - RNA, 18 nt, Human
cccugccccucccuucaa

SEQ ID NO: 1300108 - RNA, 19 nt, Human
cccugccccucccuucaac

SEQ ID NO: 1300109 - RNA, 23 nt, Human
cccugccccucccuucaaccauu

SEQ ID NO: 1300110 - RNA, 18 nt, Human
cccugcccccugcaggaa

SEQ ID NO: 1300111 - RNA, 19 nt, Human
cccugccccuccucucccu

SEQ ID NO: 1300112 - RNA, 11 nt, Human
cccugagcuga

SEQ ID NO: 1300113 - RNA, 14 nt, Human
cccugagcugacca

SEQ ID NO: 1300114 - RNA, 13 nt, Human
cccugagcugagg

SEQ ID NO: 1300115 - RNA, 14 nt, Human
cccugagcugaggc

SEQ ID NO: 1300116 - RNA, 16 nt, Human
cccugagcugaggcag

SEQ ID NO: 1300117 - RNA, 17 nt, Human
cccugagcugaggcagc

SEQ ID NO: 1300118 - RNA, 19 nt, Human
cccugagcugaggcagcag

SEQ ID NO: 1300119 - RNA, 21 nt, Human
cccugagcugaggcagcagug

SEQ ID NO: 1300120 - RNA, 18 nt, Human
cccugagccagggucucc

SEQ ID NO: 1300121 - RNA, 19 nt, Human
cccugagccagggucucca

SEQ ID NO: 1300122 - RNA, 21 nt, Human
cccugagccagggucuccaga

SEQ ID NO: 1300123 - RNA, 20 nt, Human
cccugagccagggucuccag

SEQ ID NO: 1300124 - RNA, 12 nt, Human
cccugagccggc

SEQ ID NO: 1300125 - RNA, 19 nt, Human
cccugagcgaguggagucu

SEQ ID NO: 1300126 - RNA, 20 nt, Human
cccugagcuagaacccucug

SEQ ID NO: 1300127 - RNA, 20 nt, Human
cccugaccugugagcccagc

SEQ ID NO: 1300128 - RNA, 15 nt, Human
cccugacucauucug

SEQ ID NO: 1300129 - RNA, 19 nt, Human
cccugacucauucugaagg

SEQ ID NO: 1300130 - RNA, 21 nt, Human
cccugacucauucugaaggag

SEQ ID NO: 1300131 - RNA, 13 nt, Human
cccugacugggag

SEQ ID NO: 1300132 - RNA, 19 nt, Human
cccugaccacucagagaca

SEQ ID NO: 1300133 - RNA, 22 nt, Human
cccugaccacucagagacaugc

SEQ ID NO: 1300134 - RNA, 23 nt, Human
cccugaccacucagagacaugca

SEQ ID NO: 1300135 - RNA, 15 nt, Human
cccugaccagcuccc

SEQ ID NO: 1300136 - RNA, 20 nt, Human
cccugaccagcucccccucc

SEQ ID NO: 1300137 - RNA, 16 nt, Human
cccugaccagcucccc

SEQ ID NO: 1300138 - RNA, 16 nt, Human
cccugaccuggccccc

SEQ ID NO: 1300139 - RNA, 19 nt, Human
cccugaccuggcccccuca

SEQ ID NO: 1300140 - RNA, 16 nt, Human
cccugaccugugagcc

SEQ ID NO: 1300141 - RNA, 20 nt, Human
cccugaauuuaaauagcuuu

SEQ ID NO: 1300142 - RNA, 14 nt, Human
cccugaccacucag

SEQ ID NO: 1300143 - RNA, 15 nt, Human
cccugaccacucaga

SEQ ID NO: 1300144 - RNA, 16 nt, Human
cccugaccacucagag

SEQ ID NO: 1300145 - RNA, 17 nt, Human
cccugaccacucagaga

SEQ ID NO: 1300146 - RNA, 17 nt, Human
cccugaaggggccauga

SEQ ID NO: 1300147 - RNA, 20 nt, Human
cccugaagugagcacagccu

SEQ ID NO: 1300148 - RNA, 14 nt, Human
cccugaacaagaau

SEQ ID NO: 1300149 - RNA, 17 nt, Human
cccucggggaugugucc

SEQ ID NO: 1300150 - RNA, 18 nt, Human
cccucggggauguguccu

SEQ ID NO: 1300151 - RNA, 20 nt, Human
cccucggggauguguccuga

SEQ ID NO: 1300152 - RNA, 14 nt, Human
cccucgcugccagc

SEQ ID NO: 1300153 - RNA, 11 nt, Human
cccuccuccug

SEQ ID NO: 1300154 - RNA, 16 nt, Human
cccuccuccuggacuc

SEQ ID NO: 1300155 - RNA, 18 nt, Human
cccuccuccuggacuccu

SEQ ID NO: 1300156 - RNA, 17 nt, Human
cccuccgcucuguagug

SEQ ID NO: 1300157 - RNA, 13 nt, Human
cccuccuaaccua

SEQ ID NO: 1300158 - RNA, 14 nt, Human
cccuccucucugcc

SEQ ID NO: 1300159 - RNA, 18 nt, Human
cccuccucuagcuguggg

SEQ ID NO: 1300160 - RNA, 19 nt, Human
cccuccucuagcugugggg

SEQ ID NO: 1300161 - RNA, 17 nt, Human
cccuccucuccaccauc

SEQ ID NO: 1300162 - RNA, 14 nt, Human
cccuccgcccugcc

SEQ ID NO: 1300163 - RNA, 15 nt, Human
cccuccgcccugcca

SEQ ID NO: 1300164 - RNA, 16 nt, Human
cccuccgcccugccac

SEQ ID NO: 1300165 - RNA, 19 nt, Human
cccuccgcccugccacuca

SEQ ID NO: 1300166 - RNA, 15 nt, Human
ccuaagaauaaacau

SEQ ID NO: 1300167 - RNA, 15 nt, Human
ccuaagagagcaccu

SEQ ID NO: 1300168 - RNA, 12 nt, Human
ccuaagaggcug

SEQ ID NO: 1300169 - RNA, 13 nt, Human
ccuaagaggcugc

SEQ ID NO: 1300170 - RNA, 14 nt, Human
ccuaagaggcugcc

SEQ ID NO: 1300171 - RNA, 15 nt, Human
ccuaagaggcugccc

SEQ ID NO: 1300172 - RNA, 16 nt, Human
ccuaagaggcugcccu

SEQ ID NO: 1300173 - RNA, 20 nt, Human
ccuaaucuauggucgggaga

SEQ ID NO: 1300174 - RNA, 16 nt, Human
ccuaauccccuucucc

SEQ ID NO: 1300175 - RNA, 18 nt, Human
ccuaauccaggcagaucc

SEQ ID NO: 1300176 - RNA, 19 nt, Human
ccuaauccaggcagaucca

SEQ ID NO: 1300177 - RNA, 20 nt, Human
ccuaauccaggcagauccag

SEQ ID NO: 1300178 - RNA, 21 nt, Human
ccuaauccaggcagauccagg

SEQ ID NO: 1300179 - RNA, 18 nt, Human
ccuaauccccuucucccc

SEQ ID NO: 1300180 - RNA, 20 nt, Human
ccuagcagcaccguucugug

SEQ ID NO: 1300181 - RNA, 21 nt, Human
ccuagcagcaccguucugugc

SEQ ID NO: 1300182 - RNA, 23 nt, Human
ccuagcagcaccguucugugcac

SEQ ID NO: 1300183 - RNA, 20 nt, Human
ccuaaugcgcaggcuggccc

SEQ ID NO: 1300184 - RNA, 22 nt, Human
ccuaaugacaucaccacaguuu

SEQ ID NO: 1300185 - RNA, 12 nt, Human
ccuagcagcacc

SEQ ID NO: 1300186 - RNA, 20 nt, Human
ccuagcccucucacauuuau

SEQ ID NO: 1300187 - RNA, 16 nt, Human
ccguccugccuguggc

SEQ ID NO: 1300188 - RNA, 20 nt, Human
ccuaacgaaguauccuucag

SEQ ID NO: 1300189 - RNA, 14 nt, Human
ccuaacucuucuuu

SEQ ID NO: 1300190 - RNA, 15 nt, Human
ccuaacucuucuuuc

SEQ ID NO: 1300191 - RNA, 17 nt, Human
ccuaacucuucuuucau

SEQ ID NO: 1300192 - RNA, 17 nt, Human
ccuaagaaucuuuagag

SEQ ID NO: 1300193 - RNA, 13 nt, Human
ccggcauggacaa

SEQ ID NO: 1300194 - RNA, 17 nt, Human
ccggcauggacaaugga

SEQ ID NO: 1300195 - RNA, 18 nt, Human
ccggcauggacaauggac

SEQ ID NO: 1300196 - RNA, 22 nt, Human
ccggcauggacaauggaccgga

SEQ ID NO: 1300197 - RNA, 23 nt, Human
ccgaaggugaggagcuugaaacc

SEQ ID NO: 1300198 - RNA, 13 nt, Human
ccgaagucuuuug

SEQ ID NO: 1300199 - RNA, 15 nt, Human
ccgaccaccugccca

SEQ ID NO: 1300200 - RNA, 11 nt, Human
cccuuccugga

SEQ ID NO: 1300201 - RNA, 22 nt, Human
cccugugcagccgcugagcgag

SEQ ID NO: 1300202 - RNA, 13 nt, Human
cccuuccuggaca

SEQ ID NO: 1300203 - RNA, 14 nt, Human
cccuuccuggacag

SEQ ID NO: 1300204 - RNA, 16 nt, Human
cccuuccuggacagcu

SEQ ID NO: 1300205 - RNA, 17 nt, Human
cccuuccuggacagcug

SEQ ID NO: 1300206 - RNA, 18 nt, Human
cccuuccuggacagcugu

SEQ ID NO: 1300207 - RNA, 19 nt, Human
cccuuccuggacagcugug

SEQ ID NO: 1300208 - RNA, 20 nt, Human
cccuuccuggacagcugugc

SEQ ID NO: 1300209 - RNA, 22 nt, Human
cccuuccuggacagcugugccu

SEQ ID NO: 1300210 - RNA, 23 nt, Human
cccuuccuggacagcugugccuc

SEQ ID NO: 1300211 - RNA, 15 nt, Human
ccgaaaaucauauaa

SEQ ID NO: 1300212 - RNA, 23 nt, Human
ccgcccacaggaagccugcaguc

SEQ ID NO: 1300213 - RNA, 22 nt, Human
ccgcccagagacccaagcugcc

SEQ ID NO: 1300214 - RNA, 23 nt, Human
ccgcccagcggcuugccugccug

SEQ ID NO: 1300215 - RNA, 23 nt, Human
cccuguccuggugguauuuucaa

SEQ ID NO: 1300216 - RNA, 13 nt, Human
cccuguccuggug

SEQ ID NO: 1300217 - RNA, 14 nt, Human
cccuguccuggugg

SEQ ID NO: 1300218 - RNA, 17 nt, Human
cccuguccuuagccuag

SEQ ID NO: 1300219 - RNA, 22 nt, Human
cccugugcaaccucuuggccug

SEQ ID NO: 1300220 - RNA, 17 nt, Human
caucagaaacacccuca

SEQ ID NO: 1300221 - RNA, 19 nt, Human
caucagaaacacccucaca

SEQ ID NO: 1300222 - RNA, 20 nt, Human
caucagaaaggaaaaacaaa

SEQ ID NO: 1300223 - RNA, 18 nt, Human
caucagaaaggaaaaaca

SEQ ID NO: 1300224 - RNA, 12 nt, Human
caucagaaaggg

SEQ ID NO: 1300225 - RNA, 16 nt, Human
caucagaaagggaggg

SEQ ID NO: 1300226 - RNA, 17 nt, Human
caucagaaagggagggc

SEQ ID NO: 1300227 - RNA, 18 nt, Human
caucagaaagggagggcu

SEQ ID NO: 1300228 - RNA, 20 nt, Human
caucagaaagggagggcucu

SEQ ID NO: 1300229 - RNA, 19 nt, Human
caucacuuguacaaaauaa

SEQ ID NO: 1300230 - RNA, 15 nt, Human
caucacuuugaccua

SEQ ID NO: 1300231 - RNA, 16 nt, Human
caucuggauuccagag

SEQ ID NO: 1300232 - RNA, 20 nt, Human
caucuggcaacaucuuuauc

SEQ ID NO: 1300233 - RNA, 18 nt, Human
caucuaaccucaucuucu

SEQ ID NO: 1300234 - RNA, 19 nt, Human
caucuaaccucaucuucuu

SEQ ID NO: 1300235 - RNA, 12 nt, Human
caucuggccugg

SEQ ID NO: 1300236 - RNA, 13 nt, Human
caucuggccuggc

SEQ ID NO: 1300237 - RNA, 14 nt, Human
caucuggccuggcc

SEQ ID NO: 1300238 - RNA, 15 nt, Human
caucuggccuggcca

SEQ ID NO: 1300239 - RNA, 17 nt, Human
caucuggccuggccagu

SEQ ID NO: 1300240 - RNA, 18 nt, Human
caucuggccuggccagug

SEQ ID NO: 1300241 - RNA, 14 nt, Human
caucuggcucuaau

SEQ ID NO: 1300242 - RNA, 20 nt, Human
caucugguagaagggaaagc

SEQ ID NO: 1300243 - RNA, 22 nt, Human
caucuguaaaucuacacacggu

SEQ ID NO: 1300244 - RNA, 18 nt, Human
caucuggcucuaauucac

SEQ ID NO: 1300245 - RNA, 23 nt, Human
caucugguagaagggaaagccca

SEQ ID NO: 1300246 - RNA, 22 nt, Human
caucugguugaacucugguggc

SEQ ID NO: 1300247 - RNA, 18 nt, Human
caucuguauacccucugu

SEQ ID NO: 1300248 - RNA, 19 nt, Human
caucuguauacccucuguu

SEQ ID NO: 1300249 - RNA, 20 nt, Human
caucuguauacccucuguuu

SEQ ID NO: 1300250 - RNA, 21 nt, Human
caucuguauacccucuguuuc

SEQ ID NO: 1300251 - RNA, 19 nt, Human
cauccugaggcuccacuug

SEQ ID NO: 1300252 - RNA, 18 nt, Human
cauccugaggcuccacuu

SEQ ID NO: 1300253 - RNA, 12 nt, Human
cauccugcaggc

SEQ ID NO: 1300254 - RNA, 15 nt, Human
caucuaaacugcccc

SEQ ID NO: 1300255 - RNA, 21 nt, Human
caucuaaacugcccccucugc

SEQ ID NO: 1300256 - RNA, 17 nt, Human
caucuaaacuaagaugu

SEQ ID NO: 1300257 - RNA, 18 nt, Human
caucuaaacuaagaugug

SEQ ID NO: 1300258 - RNA, 15 nt, Human
caucuaaccucaucu

SEQ ID NO: 1300259 - RNA, 15 nt, Human
caucguugcccccau

SEQ ID NO: 1300260 - RNA, 23 nt, Human
caucuaaaaauagacuuaaaucu

SEQ ID NO: 1300261 - RNA, 20 nt, Human
cauccucuuccauauggauc

SEQ ID NO: 1300262 - RNA, 17 nt, Human
caucccagacagguccc

SEQ ID NO: 1300263 - RNA, 21 nt, Human
caucccagacaggucccuccc

SEQ ID NO: 1300264 - RNA, 23 nt, Human
caucccagacaggucccuccccu

SEQ ID NO: 1300265 - RNA, 15 nt, Human
cauccucuuuuucca

SEQ ID NO: 1300266 - RNA, 19 nt, Human
cauccugaccagcugcucc

SEQ ID NO: 1300267 - RNA, 23 nt, Human
caucccaaaaucauaagauauuu

SEQ ID NO: 1300268 - RNA, 23 nt, Human
caucccacucacaacagcugccu

SEQ ID NO: 1300269 - RNA, 13 nt, Human
caucccacugcca

SEQ ID NO: 1300270 - RNA, 16 nt, Human
cauccauucuccugag

SEQ ID NO: 1300271 - RNA, 21 nt, Human
cauccauucucacagguccca

SEQ ID NO: 1300272 - RNA, 21 nt, Human
caucagaaagggagggcucug

SEQ ID NO: 1300273 - RNA, 22 nt, Human
caucagaaagggagggcucuga

SEQ ID NO: 1300274 - RNA, 24 nt, Human
caucagaaagggagggcucugagg

SEQ ID NO: 1300275 - RNA, 23 nt, Human
caucagaaagggagggcucugag

SEQ ID NO: 1300276 - RNA, 21 nt, Human
cauauuauuuuauguugcaua

SEQ ID NO: 1300277 - RNA, 21 nt, Human
cauauguaccauguacaugaa

SEQ ID NO: 1300278 - RNA, 15 nt, Human
cauauguaccaugua

SEQ ID NO: 1300279 - RNA, 16 nt, Human
cauauguugaauacuu

SEQ ID NO: 1300280 - RNA, 17 nt, Human
cauauguugaauacuuu

SEQ ID NO: 1300281 - RNA, 18 nt, Human
cauauguugaauacuuuu

SEQ ID NO: 1300282 - RNA, 19 nt, Human
cauauguugaauacuuuuu

SEQ ID NO: 1300283 - RNA, 16 nt, Human
cauagguuuaauaauu

SEQ ID NO: 1300284 - RNA, 21 nt, Human
cauaggucugaaauuuuucuu

SEQ ID NO: 1300285 - RNA, 18 nt, Human
cauaggugauccauguaa

SEQ ID NO: 1300286 - RNA, 20 nt, Human
cauaggugauccauguaacu

SEQ ID NO: 1300287 - RNA, 23 nt, Human
cauaggugauccauguaacugcc

SEQ ID NO: 1300288 - RNA, 21 nt, Human
cauaggugauccauguaacug

SEQ ID NO: 1300289 - RNA, 20 nt, Human
cauagcagcuuauucacaag

SEQ ID NO: 1300290 - RNA, 17 nt, Human
cauagguagaauguaaa

SEQ ID NO: 1300291 - RNA, 23 nt, Human
cauagguagaauguaaagcuugu

SEQ ID NO: 1300292 - RNA, 19 nt, Human
cauagcagcuuauucacaa

SEQ ID NO: 1300293 - RNA, 18 nt, Human
cauaauuauuauuuggcc

SEQ ID NO: 1300294 - RNA, 14 nt, Human
cauaauucacucug

SEQ ID NO: 1300295 - RNA, 17 nt, Human
cauaauucacucugagu

SEQ ID NO: 1300296 - RNA, 21 nt, Human
cauaauucacucugaguguuu

SEQ ID NO: 1300297 - RNA, 23 nt, Human
cauaauucacucugaguguuuua

SEQ ID NO: 1300298 - RNA, 18 nt, Human
cauaauguuacauuauua

SEQ ID NO: 1300299 - RNA, 18 nt, Human
cauaauguuucuggauuu

SEQ ID NO: 1300300 - RNA, 21 nt, Human
cauaauguuucuggauuucau

SEQ ID NO: 1300301 - RNA, 22 nt, Human
cauaauguuucuggauuucaua

SEQ ID NO: 1300302 - RNA, 23 nt, Human
cauaauguuucuggauuucauac

SEQ ID NO: 1300303 - RNA, 21 nt, Human
cauaauuauccaggaagggaa

SEQ ID NO: 1300304 - RNA, 22 nt, Human
cauacagagaagucacagggca

SEQ ID NO: 1300305 - RNA, 14 nt, Human
caguuuuaacugug

SEQ ID NO: 1300306 - RNA, 15 nt, Human
caguuuuaacugugg

SEQ ID NO: 1300307 - RNA, 16 nt, Human
caguuuuaacugugga

SEQ ID NO: 1300308 - RNA, 17 nt, Human
caguuuuaacuguggau

SEQ ID NO: 1300309 - RNA, 18 nt, Human
caguuuuaacuguggaua

SEQ ID NO: 1300310 - RNA, 20 nt, Human
caguuuuaacuguggauauu

SEQ ID NO: 1300311 - RNA, 22 nt, Human
caguuuuaacuguggauauugu

SEQ ID NO: 1300312 - RNA, 23 nt, Human
caguuuuaacuguggauauuguu

SEQ ID NO: 1300313 - RNA, 15 nt, Human
caguuuuaucauuuu

SEQ ID NO: 1300314 - RNA, 12 nt, Human
caguuuucauaa

SEQ ID NO: 1300315 - RNA, 19 nt, Human
caguuuuccuaugcuuuga

SEQ ID NO: 1300316 - RNA, 17 nt, Human
cauaauguuacauuauu

SEQ ID NO: 1300317 - RNA, 19 nt, Human
caguuuauuugaaccaaua

SEQ ID NO: 1300318 - RNA, 18 nt, Human
caguuuauuugaaccaau

SEQ ID NO: 1300319 - RNA, 14 nt, Human
caguuuauuuguug

SEQ ID NO: 1300320 - RNA, 19 nt, Human
caguuuaucauucaagugu

SEQ ID NO: 1300321 - RNA, 12 nt, Human
caguuguucuuu

SEQ ID NO: 1300322 - RNA, 13 nt, Human
caguuguucuuuu

SEQ ID NO: 1300323 - RNA, 14 nt, Human
caguuuaucauuca

SEQ ID NO: 1300324 - RNA, 15 nt, Human
caguuuaucauucaa

SEQ ID NO: 1300325 - RNA, 16 nt, Human
caguuuaucauucaag

SEQ ID NO: 1300326 - RNA, 18 nt, Human
caguuuaucauucaagug

SEQ ID NO: 1300327 - RNA, 12 nt, Human
caguuuuaacug

SEQ ID NO: 1300328 - RNA, 13 nt, Human
caguuuuaacugu

SEQ ID NO: 1300329 - RNA, 14 nt, Human
caguuucacagaaa

SEQ ID NO: 1300330 - RNA, 15 nt, Human
caguuucacagaaaa

SEQ ID NO: 1300331 - RNA, 17 nt, Human
caguuucacagaaaaua

SEQ ID NO: 1300332 - RNA, 21 nt, Human
caguuucacagaaaauaaggc

SEQ ID NO: 1300333 - RNA, 23 nt, Human
caguuucauaaaaggagaaccag

SEQ ID NO: 1300334 - RNA, 14 nt, Human
caguuuccuuggga

SEQ ID NO: 1300335 - RNA, 17 nt, Human
caguuucuaaacuggag

SEQ ID NO: 1300336 - RNA, 18 nt, Human
caguuucuaaacuggaga

SEQ ID NO: 1300337 - RNA, 19 nt, Human
caguuucuaaacuggagac

SEQ ID NO: 1300338 - RNA, 20 nt, Human
caguuucuaaacuggagacu

SEQ ID NO: 1300339 - RNA, 13 nt, Human
caguuugaaauaa

SEQ ID NO: 1300340 - RNA, 20 nt, Human
caguuugaaauaagcuauuu

SEQ ID NO: 1300341 - RNA, 15 nt, Human
caguucaaagcagga

SEQ ID NO: 1300342 - RNA, 14 nt, Human
caguucaagaaagc

SEQ ID NO: 1300343 - RNA, 13 nt, Human
caguucacccuga

SEQ ID NO: 1300344 - RNA, 22 nt, Human
caguuauuauauuuacaaaugg

SEQ ID NO: 1300345 - RNA, 22 nt, Human
caguuaucuaaguuaauuuaaa

SEQ ID NO: 1300346 - RNA, 22 nt, Human
caguuaugauuuuuuuuucaua

SEQ ID NO: 1300347 - RNA, 23 nt, Human
caguucauauguaccauguacau

SEQ ID NO: 1300348 - RNA, 17 nt, Human
caguucauuagaaauau

SEQ ID NO: 1300349 - RNA, 20 nt, Human
caguucauuagaaauauuuu

SEQ ID NO: 1300350 - RNA, 18 nt, Human
caguucauugcacuuuga

SEQ ID NO: 1300351 - RNA, 15 nt, Human
caguucauugcacuu

SEQ ID NO: 1300352 - RNA, 18 nt, Human
caguucccacauuaaaga

SEQ ID NO: 1300353 - RNA, 19 nt, Human
caguucccacauuaaagaa

SEQ ID NO: 1300354 - RNA, 17 nt, Human
cagucucuauaccaaua

SEQ ID NO: 1300355 - RNA, 13 nt, Human
cagucucgucucu

SEQ ID NO: 1300356 - RNA, 17 nt, Human
cagucuauucacagaag

SEQ ID NO: 1300357 - RNA, 22 nt, Human
cagucucacaugauuccagcca

SEQ ID NO: 1300358 - RNA, 23 nt, Human
cagucucuauaccaauaaaguga

SEQ ID NO: 1300359 - RNA, 14 nt, Human
cagucucucuucuc

SEQ ID NO: 1300360 - RNA, 17 nt, Human
cagucucucuucucucc

SEQ ID NO: 1300361 - RNA, 22 nt, Human
cagucucuauaccaauaaagug

SEQ ID NO: 1300362 - RNA, 21 nt, Human
cagucucuauaccaauaaagu

SEQ ID NO: 1300363 - RNA, 20 nt, Human
cagucucuauaccaauaaag

SEQ ID NO: 1300364 - RNA, 19 nt, Human
cagucucuauaccaauaaa

SEQ ID NO: 1300365 - RNA, 15 nt, Human
cagucgugccugugu

SEQ ID NO: 1300366 - RNA, 17 nt, Human
cagucgugccugugucc

SEQ ID NO: 1300367 - RNA, 14 nt, Human
cagucguucccagu

SEQ ID NO: 1300368 - RNA, 16 nt, Human
cagucguucccagugu

SEQ ID NO: 1300369 - RNA, 22 nt, Human
cagucuaaagcugguuuaaugu

SEQ ID NO: 1300370 - RNA, 21 nt, Human
caguuauuauauuuacaaaug

SEQ ID NO: 1300371 - RNA, 17 nt, Human
caguuauuauauuuaca

SEQ ID NO: 1300372 - RNA, 21 nt, Human
caguuauaaguagcaggccaa

SEQ ID NO: 1300373 - RNA, 15 nt, Human
caguuauauuuugca

SEQ ID NO: 1300374 - RNA, 16 nt, Human
caguuauauuuugcag

SEQ ID NO: 1300375 - RNA, 18 nt, Human
caguuauauuuugcaguu

SEQ ID NO: 1300376 - RNA, 16 nt, Human
caguuaucuaaguuaa

SEQ ID NO: 1300377 - RNA, 22 nt, Human
cagucucucuucucuccagcug

SEQ ID NO: 1300378 - RNA, 12 nt, Human
cagucucugagc

SEQ ID NO: 1300379 - RNA, 16 nt, Human
cagugauugucuuaau

SEQ ID NO: 1300380 - RNA, 20 nt, Human
cagugauugucuuaauauug

SEQ ID NO: 1300381 - RNA, 14 nt, Human
cagugcaacacugg

SEQ ID NO: 1300382 - RNA, 15 nt, Human
cagugcaacacuggu

SEQ ID NO: 1300383 - RNA, 15 nt, Human
cagugguaaaaaggc

SEQ ID NO: 1300384 - RNA, 13 nt, Human
cagugguaagcua

SEQ ID NO: 1300385 - RNA, 21 nt, Human
ccaacuccagaaagugacaag

SEQ ID NO: 1300386 - RNA, 20 nt, Human
ccaaaucacugaacuuugcu

SEQ ID NO: 1300387 - RNA, 14 nt, Human
ccaacucaccugag

SEQ ID NO: 1300388 - RNA, 22 nt, Human
ccaacuccgugugguaagcaac

SEQ ID NO: 1300389 - RNA, 15 nt, Human
ccaacuauggccugu

SEQ ID NO: 1300390 - RNA, 14 nt, Human
ccaacuauggccug

SEQ ID NO: 1300391 - RNA, 16 nt, Human
ccaacuauggccugug

SEQ ID NO: 1300392 - RNA, 15 nt, Human
ccaaagugcugagau

SEQ ID NO: 1300393 - RNA, 16 nt, Human
ccaaaucaaaaucucu

SEQ ID NO: 1300394 - RNA, 19 nt, Human
ccaaaucaaaaucucucca

SEQ ID NO: 1300395 - RNA, 20 nt, Human
ccaaaucaaaaucucuccac

SEQ ID NO: 1300396 - RNA, 21 nt, Human
ccaauggagacugucucaaga

SEQ ID NO: 1300397 - RNA, 20 nt, Human
ccaauggaaugugauguuca

SEQ ID NO: 1300398 - RNA, 22 nt, Human
ccaauggaaugugauguucaug

SEQ ID NO: 1300399 - RNA, 22 nt, Human
ccaauuauuuucauccuugucu

SEQ ID NO: 1300400 - RNA, 14 nt, Human
ccaauucagacagg

SEQ ID NO: 1300401 - RNA, 16 nt, Human
ccaauucagacaggca

SEQ ID NO: 1300402 - RNA, 14 nt, Human
ccaaggaaaggcac

SEQ ID NO: 1300403 - RNA, 14 nt, Human
ccaaggaccugaga

SEQ ID NO: 1300404 - RNA, 17 nt, Human
ccaaggagucacugaga

SEQ ID NO: 1300405 - RNA, 19 nt, Human
ccaaggagucacugagacc

SEQ ID NO: 1300406 - RNA, 22 nt, Human
ccaaggagucacugagaccaag

SEQ ID NO: 1300407 - RNA, 19 nt, Human
ccaaaguccugggauuaca

SEQ ID NO: 1300408 - RNA, 19 nt, Human
ccaaagucauaauugcauu

SEQ ID NO: 1300409 - RNA, 14 nt, Human
ccaaagucucuaau

SEQ ID NO: 1300410 - RNA, 15 nt, Human
ccaaagucucuaauu

SEQ ID NO: 1300411 - RNA, 16 nt, Human
ccaaagucucuaauuc

SEQ ID NO: 1300412 - RNA, 18 nt, Human
ccaaagucucuaauucua

SEQ ID NO: 1300413 - RNA, 13 nt, Human
ccaaagucauaau

SEQ ID NO: 1300414 - RNA, 17 nt, Human
ccaaagucauaauugca

SEQ ID NO: 1300415 - RNA, 16 nt, Human
cauuggagauguuuag

SEQ ID NO: 1300416 - RNA, 19 nt, Human
cauuggaagagcagcaccu

SEQ ID NO: 1300417 - RNA, 16 nt, Human
cauuggaauguucuca

SEQ ID NO: 1300418 - RNA, 19 nt, Human
cauuggaauguucucagau

SEQ ID NO: 1300419 - RNA, 16 nt, Human
cauuggacccuuccau

SEQ ID NO: 1300420 - RNA, 17 nt, Human
cauuggacccuuccaug

SEQ ID NO: 1300421 - RNA, 18 nt, Human
cauuggaauguucucaga

SEQ ID NO: 1300422 - RNA, 18 nt, Human
cauuggauauuuuuuacu

SEQ ID NO: 1300423 - RNA, 11 nt, Human
cauuggauauu

SEQ ID NO: 1300424 - RNA, 20 nt, Human
cauuggaagagcagcaccuc

SEQ ID NO: 1300425 - RNA, 13 nt, Human
cauugguccaaga

SEQ ID NO: 1300426 - RNA, 14 nt, Human
cauugguccaagau

SEQ ID NO: 1300427 - RNA, 23 nt, Human
cauugggguaguuguguuucaac

SEQ ID NO: 1300428 - RNA, 15 nt, Human
cauuuagguuucuga

SEQ ID NO: 1300429 - RNA, 15 nt, Human
cauuuagucauguga

SEQ ID NO: 1300430 - RNA, 17 nt, Human
cauuuagucaugugacc

SEQ ID NO: 1300431 - RNA, 17 nt, Human
cauuuaguuugauuauu

SEQ ID NO: 1300432 - RNA, 23 nt, Human
cauuuaguuugauuauucagugu

SEQ ID NO: 1300433 - RNA, 14 nt, Human
cauuuauauugaua

SEQ ID NO: 1300434 - RNA, 20 nt, Human
cauuuauauugauaagaucu

SEQ ID NO: 1300435 - RNA, 21 nt, Human
cauuuauauugauaagaucuu

SEQ ID NO: 1300436 - RNA, 12 nt, Human
ccaaaaaacuac

SEQ ID NO: 1300437 - RNA, 23 nt, Human
cauuuuuuuucuuugaauaaaug

SEQ ID NO: 1300438 - RNA, 15 nt, Human
cauuuuuuuucuuug

SEQ ID NO: 1300439 - RNA, 17 nt, Human
cauuuuuuuucuuugaa

SEQ ID NO: 1300440 - RNA, 21 nt, Human
cauuuuuuuucuuugaauaaa

SEQ ID NO: 1300441 - RNA, 22 nt, Human
cauuuuuuuucuuugaauaaau

SEQ ID NO: 1300442 - RNA, 19 nt, Human
ccaaaaaaaaauacaugcu

SEQ ID NO: 1300443 - RNA, 14 nt, Human
ccaaaaggcagaag

SEQ ID NO: 1300444 - RNA, 17 nt, Human
ccaaaaguuacauguuu

SEQ ID NO: 1300445 - RNA, 23 nt, Human
ccaaaagguuuaagaaauagaau

SEQ ID NO: 1300446 - RNA, 15 nt, Human
ccaaaagcuuuuuau

SEQ ID NO: 1300447 - RNA, 19 nt, Human
ccaaaagguuuaagaaaua

SEQ ID NO: 1300448 - RNA, 17 nt, Human
cauuuguauaaaauaau

SEQ ID NO: 1300449 - RNA, 13 nt, Human
cauuuguagguag

SEQ ID NO: 1300450 - RNA, 18 nt, Human
cauuuguucauauuaaga

SEQ ID NO: 1300451 - RNA, 14 nt, Human
cauuuguucauauu

SEQ ID NO: 1300452 - RNA, 13 nt, Human
cauuuguucauau

SEQ ID NO: 1300453 - RNA, 14 nt, Human
cauuuguauaaaau

SEQ ID NO: 1300454 - RNA, 16 nt, Human
cauuuguauaaaauaa

SEQ ID NO: 1300455 - RNA, 23 nt, Human
cauuuguuucuuucucugaggac

SEQ ID NO: 1300456 - RNA, 15 nt, Human
cauuuguuucuacuu

SEQ ID NO: 1300457 - RNA, 19 nt, Human
cauuuguucauauuaagaa

SEQ ID NO: 1300458 - RNA, 17 nt, Human
cauuuguugguuuauca

SEQ ID NO: 1300459 - RNA, 20 nt, Human
cauuuguucauauuaagaau

SEQ ID NO: 1300460 - RNA, 16 nt, Human
cauuuguuggaaugaa

SEQ ID NO: 1300461 - RNA, 17 nt, Human
cauuuguuuauguaauu

SEQ ID NO: 1300462 - RNA, 18 nt, Human
cauuuguuuauguaauuu

SEQ ID NO: 1300463 - RNA, 19 nt, Human
cauuuguuuauguaauuuc

SEQ ID NO: 1300464 - RNA, 20 nt, Human
cauuuguuuauguaauuuca

SEQ ID NO: 1300465 - RNA, 21 nt, Human
cauuuguuucuuucucugagg

SEQ ID NO: 1300466 - RNA, 22 nt, Human
cauuuguuucuuucucugagga

SEQ ID NO: 1300467 - RNA, 14 nt, Human
cauuuggguccagg

SEQ ID NO: 1300468 - RNA, 15 nt, Human
cauuuggguccagga

SEQ ID NO: 1300469 - RNA, 16 nt, Human
cauuuggguccaggag

SEQ ID NO: 1300470 - RNA, 17 nt, Human
cauuuggguccaggagg

SEQ ID NO: 1300471 - RNA, 18 nt, Human
cauuuggguccaggagga

SEQ ID NO: 1300472 - RNA, 16 nt, Human
cauuuggcaucccugg

SEQ ID NO: 1300473 - RNA, 20 nt, Human
cauuuggcaucccugggccu

SEQ ID NO: 1300474 - RNA, 18 nt, Human
cauuugggagacauguga

SEQ ID NO: 1300475 - RNA, 20 nt, Human
cauuugggagacaugugaca

SEQ ID NO: 1300476 - RNA, 18 nt, Human
cauuuggcaucccugggc

SEQ ID NO: 1300477 - RNA, 23 nt, Human
cauuugggaguuuuuaugagaaa

SEQ ID NO: 1300478 - RNA, 14 nt, Human
cauuuaucuauaau

SEQ ID NO: 1300479 - RNA, 16 nt, Human
cauuuaucuauaauuu

SEQ ID NO: 1300480 - RNA, 21 nt, Human
cauuuaucuauaauuuaccua

SEQ ID NO: 1300481 - RNA, 22 nt, Human
cauuuaucuauaauuuaccuaa

SEQ ID NO: 1300482 - RNA, 20 nt, Human
cauuuaucuaaauauggacu

SEQ ID NO: 1300483 - RNA, 16 nt, Human
cauuuaugaagcaagc

SEQ ID NO: 1300484 - RNA, 17 nt, Human
cauuuaugagcucuuca

SEQ ID NO: 1300485 - RNA, 20 nt, Human
cauuuaugagcucuucaugu

SEQ ID NO: 1300486 - RNA, 23 nt, Human
cauuuaugagcucuucauguuuc

SEQ ID NO: 1300487 - RNA, 21 nt, Human
caugaauauuuaguguucaua

SEQ ID NO: 1300488 - RNA, 12 nt, Human
caucuguccccc

SEQ ID NO: 1300489 - RNA, 13 nt, Human
caucugucccccu

SEQ ID NO: 1300490 - RNA, 15 nt, Human
caucugucccccuuu

SEQ ID NO: 1300491 - RNA, 16 nt, Human
caucugucccuccggg

SEQ ID NO: 1300492 - RNA, 19 nt, Human
caugaaucugcacaucugu

SEQ ID NO: 1300493 - RNA, 13 nt, Human
caugaauguaaau

SEQ ID NO: 1300494 - RNA, 14 nt, Human
caugaauguaaauu

SEQ ID NO: 1300495 - RNA, 20 nt, Human
caugaauuuuagcuuuugug

SEQ ID NO: 1300496 - RNA, 16 nt, Human
caugacaacuucuaau

SEQ ID NO: 1300497 - RNA, 19 nt, Human
caugaauuuuagcuuuugu

SEQ ID NO: 1300498 - RNA, 16 nt, Human
caugaauguaaauuug

SEQ ID NO: 1300499 - RNA, 17 nt, Human
caugaauguaaauuugu

SEQ ID NO: 1300500 - RNA, 22 nt, Human
caugaauguaaauuuguacuau

SEQ ID NO: 1300501 - RNA, 19 nt, Human
caugaauguaaauuuguac

SEQ ID NO: 1300502 - RNA, 15 nt, Human
caugaauuuuagcuu

SEQ ID NO: 1300503 - RNA, 16 nt, Human
caugaauuuuagcuuu

SEQ ID NO: 1300504 - RNA, 17 nt, Human
caugaauuuuagcuuuu

SEQ ID NO: 1300505 - RNA, 18 nt, Human
caugaauuuuagcuuuug

SEQ ID NO: 1300506 - RNA, 14 nt, Human
caugcaaacucuuu

SEQ ID NO: 1300507 - RNA, 20 nt, Human
caugauggcaacagaucugg

SEQ ID NO: 1300508 - RNA, 22 nt, Human
caugaugccucugucuucugga

SEQ ID NO: 1300509 - RNA, 23 nt, Human
caugaugccucugucuucuggac

SEQ ID NO: 1300510 - RNA, 16 nt, Human
caugaugccucugucu

SEQ ID NO: 1300511 - RNA, 17 nt, Human
caugaugccucugucuu

SEQ ID NO: 1300512 - RNA, 20 nt, Human
caugaugccucugucuucug

SEQ ID NO: 1300513 - RNA, 15 nt, Human
caugauggcaacaga

SEQ ID NO: 1300514 - RNA, 19 nt, Human
caugauggcaacagaucug

SEQ ID NO: 1300515 - RNA, 16 nt, Human
cauggcccugccaugc

SEQ ID NO: 1300516 - RNA, 15 nt, Human
cauggcccugagcga

SEQ ID NO: 1300517 - RNA, 17 nt, Human
cauggcccugagcgagu

SEQ ID NO: 1300518 - RNA, 12 nt, Human
cauggccccucu

SEQ ID NO: 1300519 - RNA, 13 nt, Human
cauggccccucug

SEQ ID NO: 1300520 - RNA, 16 nt, Human
cauggccccucugacc

SEQ ID NO: 1300521 - RNA, 17 nt, Human
cauggccccucugaccu

SEQ ID NO: 1300522 - RNA, 18 nt, Human
cauggccccucugaccug

SEQ ID NO: 1300523 - RNA, 15 nt, Human
cauggccagguggcc

SEQ ID NO: 1300524 - RNA, 20 nt, Human
caugggaaaugucaacaagu

SEQ ID NO: 1300525 - RNA, 14 nt, Human
cauggccgugaacu

SEQ ID NO: 1300526 - RNA, 18 nt, Human
cauuauuacuuuugcugu

SEQ ID NO: 1300527 - RNA, 13 nt, Human
cauucugaaugcu

SEQ ID NO: 1300528 - RNA, 11 nt, Human
cauucugaaug

SEQ ID NO: 1300529 - RNA, 14 nt, Human
cauucucugucuca

SEQ ID NO: 1300530 - RNA, 19 nt, Human
cauucucugucucauccau

SEQ ID NO: 1300531 - RNA, 23 nt, Human
cauucucugucucauccaucauc

SEQ ID NO: 1300532 - RNA, 16 nt, Human
cauucugaaggagccc

SEQ ID NO: 1300533 - RNA, 23 nt, Human
cauuauuacuuuugcuguaaugu

SEQ ID NO: 1300534 - RNA, 13 nt, Human
cauuauuaucaac

SEQ ID NO: 1300535 - RNA, 21 nt, Human
cauuauuaaguaacuuauuua

SEQ ID NO: 1300536 - RNA, 12 nt, Human
cauuauuacuuu

SEQ ID NO: 1300537 - RNA, 16 nt, Human
cauuauuacuuuugcu

SEQ ID NO: 1300538 - RNA, 21 nt, Human
cauuaucgagcagcauuuuau

SEQ ID NO: 1300539 - RNA, 18 nt, Human
cauguuggccaggcuggu

SEQ ID NO: 1300540 - RNA, 14 nt, Human
cauguucugucccu

SEQ ID NO: 1300541 - RNA, 18 nt, Human
cauguucugucccuugcc

SEQ ID NO: 1300542 - RNA, 19 nt, Human
cauguugaagccacugccu

SEQ ID NO: 1300543 - RNA, 22 nt, Human
cauguugaagccacugccuuca

SEQ ID NO: 1300544 - RNA, 19 nt, Human
cauuauauuucuauuuuau

SEQ ID NO: 1300545 - RNA, 21 nt, Human
cauguccaaagaggcugcccc

SEQ ID NO: 1300546 - RNA, 17 nt, Human
cauguauugcacauugu

SEQ ID NO: 1300547 - RNA, 18 nt, Human
cauguauugcacauugua

SEQ ID NO: 1300548 - RNA, 21 nt, Human
cauguauugcacauuguaaaa

SEQ ID NO: 1300549 - RNA, 18 nt, Human
caugucauuucagaaguu

SEQ ID NO: 1300550 - RNA, 12 nt, Human
cauguccaaaga

SEQ ID NO: 1300551 - RNA, 13 nt, Human
cauguccaaagag

SEQ ID NO: 1300552 - RNA, 14 nt, Human
cauguccaaagagg

SEQ ID NO: 1300553 - RNA, 15 nt, Human
cauguccaaagaggc

SEQ ID NO: 1300554 - RNA, 16 nt, Human
cauguccaaagaggcu

SEQ ID NO: 1300555 - RNA, 17 nt, Human
cauguccaaagaggcug

SEQ ID NO: 1300556 - RNA, 18 nt, Human
cauguccaaagaggcugc

SEQ ID NO: 1300557 - RNA, 19 nt, Human
cauguccaaagaggcugcc

SEQ ID NO: 1300558 - RNA, 20 nt, Human
cauguccaaagaggcugccc

SEQ ID NO: 1300559 - RNA, 17 nt, Human
cagauuucugaggaaau

SEQ ID NO: 1300560 - RNA, 15 nt, Human
cagauuucugaggaa

SEQ ID NO: 1300561 - RNA, 14 nt, Human
cagauuucugagga

SEQ ID NO: 1300562 - RNA, 14 nt, Human
cagauuuccagccu

SEQ ID NO: 1300563 - RNA, 14 nt, Human
cagcaccagaaugu

SEQ ID NO: 1300564 - RNA, 12 nt, Human
cagcaccuccuc

SEQ ID NO: 1300565 - RNA, 14 nt, Human
cagcaccuccucag

SEQ ID NO: 1300566 - RNA, 15 nt, Human
cagcaccuccucagc

SEQ ID NO: 1300567 - RNA, 16 nt, Human
cagcaccuccucagcc

SEQ ID NO: 1300568 - RNA, 17 nt, Human
cagcaccuccucagccu

SEQ ID NO: 1300569 - RNA, 18 nt, Human
cagcaccuccucagccug

SEQ ID NO: 1300570 - RNA, 19 nt, Human
cagcaccuccucagccuga

SEQ ID NO: 1300571 - RNA, 13 nt, Human
cagcaccugcccu

SEQ ID NO: 1300572 - RNA, 13 nt, Human
cagauuuaugcau

SEQ ID NO: 1300573 - RNA, 14 nt, Human
cagauugucagcuc

SEQ ID NO: 1300574 - RNA, 13 nt, Human
cagauuguuugca

SEQ ID NO: 1300575 - RNA, 16 nt, Human
cagauuuauuccuuug

SEQ ID NO: 1300576 - RNA, 22 nt, Human
cagauuuauuccuuuguuacuu

SEQ ID NO: 1300577 - RNA, 18 nt, Human
cagcacgggggccaagga

SEQ ID NO: 1300578 - RNA, 12 nt, Human
cagcaccuggca

SEQ ID NO: 1300579 - RNA, 12 nt, Human
cagcaccugccc

SEQ ID NO: 1300580 - RNA, 15 nt, Human
cagcacuagccaaac

SEQ ID NO: 1300581 - RNA, 17 nt, Human
cagcacuagccaaaccu

SEQ ID NO: 1300582 - RNA, 21 nt, Human
cagcacuagccaaaccucacc

SEQ ID NO: 1300583 - RNA, 16 nt, Human
cagccagaccagcagg

SEQ ID NO: 1300584 - RNA, 22 nt, Human
cagccagcccugccuggaggac

SEQ ID NO: 1300585 - RNA, 21 nt, Human
cagccagcccugccuggagga

SEQ ID NO: 1300586 - RNA, 13 nt, Human
cagccaggcccag

SEQ ID NO: 1300587 - RNA, 21 nt, Human
cagccaggcccagccgacccc

SEQ ID NO: 1300588 - RNA, 15 nt, Human
cagccaggcccagcc

SEQ ID NO: 1300589 - RNA, 17 nt, Human
cagccaggcccagccga

SEQ ID NO: 1300590 - RNA, 12 nt, Human
cagccagcccug

SEQ ID NO: 1300591 - RNA, 13 nt, Human
cagccagcccugc

SEQ ID NO: 1300592 - RNA, 14 nt, Human
cagccagcccugcc

SEQ ID NO: 1300593 - RNA, 15 nt, Human
cagccagcccugccu

SEQ ID NO: 1300594 - RNA, 16 nt, Human
cagccagcccugccug

SEQ ID NO: 1300595 - RNA, 17 nt, Human
cagccagcccugccugg

SEQ ID NO: 1300596 - RNA, 18 nt, Human
cagccagcccugccugga

SEQ ID NO: 1300597 - RNA, 19 nt, Human
cagccagcccugccuggag

SEQ ID NO: 1300598 - RNA, 20 nt, Human
cagccagcccugccuggagg

SEQ ID NO: 1300599 - RNA, 13 nt, Human
cagccagcaucug

SEQ ID NO: 1300600 - RNA, 14 nt, Human
cagccagcaucugg

SEQ ID NO: 1300601 - RNA, 15 nt, Human
cagccagcaucuggg

SEQ ID NO: 1300602 - RNA, 16 nt, Human
cagccagcaucugggc

SEQ ID NO: 1300603 - RNA, 17 nt, Human
cagccagcaucugggcc

SEQ ID NO: 1300604 - RNA, 14 nt, Human
cagauaugauucaa

SEQ ID NO: 1300605 - RNA, 15 nt, Human
cagauaugauucaaa

SEQ ID NO: 1300606 - RNA, 18 nt, Human
cagauauauuuucuuucu

SEQ ID NO: 1300607 - RNA, 20 nt, Human
cagauaucuuggacaaauca

SEQ ID NO: 1300608 - RNA, 12 nt, Human
cagauccaggac

SEQ ID NO: 1300609 - RNA, 13 nt, Human
cagauccaggacu

SEQ ID NO: 1300610 - RNA, 14 nt, Human
cagauccaggagcu

SEQ ID NO: 1300611 - RNA, 17 nt, Human
cagauccaggagcucca

SEQ ID NO: 1300612 - RNA, 18 nt, Human
cagauccaggagcuccag

SEQ ID NO: 1300613 - RNA, 19 nt, Human
cagauccaggagcuccagu

SEQ ID NO: 1300614 - RNA, 13 nt, Human
cagauccagggac

SEQ ID NO: 1300615 - RNA, 14 nt, Human
cagauccagggaca

SEQ ID NO: 1300616 - RNA, 15 nt, Human
cagauccagggacag

SEQ ID NO: 1300617 - RNA, 23 nt, Human
cagauccagggacagaggcccca

SEQ ID NO: 1300618 - RNA, 14 nt, Human
cagauccccaagcc

SEQ ID NO: 1300619 - RNA, 15 nt, Human
cagauccccaagccu

SEQ ID NO: 1300620 - RNA, 20 nt, Human
cagauccaggagcuccagug

SEQ ID NO: 1300621 - RNA, 18 nt, Human
cagauaguguagcugagg

SEQ ID NO: 1300622 - RNA, 20 nt, Human
cagauaguguagcugaggag

SEQ ID NO: 1300623 - RNA, 15 nt, Human
cagauauauauucau

SEQ ID NO: 1300624 - RNA, 22 nt, Human
cagagcugauggagaaggaagg

SEQ ID NO: 1300625 - RNA, 23 nt, Human
cagaggggccugccaccuggacc

SEQ ID NO: 1300626 - RNA, 19 nt, Human
cagagcugauggagaagga

SEQ ID NO: 1300627 - RNA, 16 nt, Human
cagagcuaucauuaug

SEQ ID NO: 1300628 - RNA, 21 nt, Human
cagagcugauggagaaggaag

SEQ ID NO: 1300629 - RNA, 20 nt, Human
cagagcugauggagaaggaa

SEQ ID NO: 1300630 - RNA, 18 nt, Human
cagagagguuugcagucc

SEQ ID NO: 1300631 - RNA, 23 nt, Human
cagagagguuugcagucccaagc

SEQ ID NO: 1300632 - RNA, 20 nt, Human
cagagagguuugcaguccca

SEQ ID NO: 1300633 - RNA, 17 nt, Human
cagagacuuuagggggu

SEQ ID NO: 1300634 - RNA, 20 nt, Human
cagagagaaauaagugcccu

SEQ ID NO: 1300635 - RNA, 16 nt, Human
cagagagaauggcuuu

SEQ ID NO: 1300636 - RNA, 14 nt, Human
cagacagcccucca

SEQ ID NO: 1300637 - RNA, 13 nt, Human
cagacagagccag

SEQ ID NO: 1300638 - RNA, 14 nt, Human
cagacagagccagg

SEQ ID NO: 1300639 - RNA, 15 nt, Human
cagacagagccagga

SEQ ID NO: 1300640 - RNA, 16 nt, Human
cagacagagccaggag

SEQ ID NO: 1300641 - RNA, 17 nt, Human
cagacagagccaggaga

SEQ ID NO: 1300642 - RNA, 18 nt, Human
cagacagagccaggagaa

SEQ ID NO: 1300643 - RNA, 20 nt, Human
cagacagagccaggagaagc

SEQ ID NO: 1300644 - RNA, 14 nt, Human
cagacagagcccug

SEQ ID NO: 1300645 - RNA, 23 nt, Human
cagacagagccaggagaagcuca

SEQ ID NO: 1300646 - RNA, 11 nt, Human
cagacagauga

SEQ ID NO: 1300647 - RNA, 17 nt, Human
cagacagaugaggcuuu

SEQ ID NO: 1300648 - RNA, 18 nt, Human
cagacagaugaggcuuuc

SEQ ID NO: 1300649 - RNA, 21 nt, Human
cagacagcuccacccuggccg

SEQ ID NO: 1300650 - RNA, 18 nt, Human
cagacaggcaaauaaaag

SEQ ID NO: 1300651 - RNA, 15 nt, Human
cagacaggccccgug

SEQ ID NO: 1300652 - RNA, 20 nt, Human
cagacaggccccgugaggca

SEQ ID NO: 1300653 - RNA, 14 nt, Human
cagacaggcucuua

SEQ ID NO: 1300654 - RNA, 18 nt, Human
cagacaggcucuuagcag

SEQ ID NO: 1300655 - RNA, 20 nt, Human
cagacaggcucuuagcagcu

SEQ ID NO: 1300656 - RNA, 22 nt, Human
cagacaggcucuuagcagcuuc

SEQ ID NO: 1300657 - RNA, 22 nt, Human
cagacagggaauuaggccccca

SEQ ID NO: 1300658 - RNA, 23 nt, Human
cagacuccuucaacaauucuaaa

SEQ ID NO: 1300659 - RNA, 16 nt, Human
cagacaggucccuccc

SEQ ID NO: 1300660 - RNA, 19 nt, Human
cagacaguguuuucuggga

SEQ ID NO: 1300661 - RNA, 20 nt, Human
cagacucccauuccugaaga

SEQ ID NO: 1300662 - RNA, 18 nt, Human
cagacuccuucaacaauu

SEQ ID NO: 1300663 - RNA, 19 nt, Human
cagacucggaaucuauuuu

SEQ ID NO: 1300664 - RNA, 23 nt, Human
cagacucggaaucuauuuucuca

SEQ ID NO: 1300665 - RNA, 14 nt, Human
cagacucuaagaaa

SEQ ID NO: 1300666 - RNA, 17 nt, Human
cagacucuaagaaagaa

SEQ ID NO: 1300667 - RNA, 18 nt, Human
cagacucuaagaaagaac

SEQ ID NO: 1300668 - RNA, 13 nt, Human
cagacucuugccu

SEQ ID NO: 1300669 - RNA, 18 nt, Human
cagacucuugccuguuuc

SEQ ID NO: 1300670 - RNA, 15 nt, Human
cagacucuuuaugcu

SEQ ID NO: 1300671 - RNA, 19 nt, Human
cagacucuuuaugcuugca

SEQ ID NO: 1300672 - RNA, 18 nt, Human
cagacucuuuaugcuugc

SEQ ID NO: 1300673 - RNA, 23 nt, Human
cagacugacaguuuacagacgcu

SEQ ID NO: 1300674 - RNA, 14 nt, Human
cagacugcuuccaa

SEQ ID NO: 1300675 - RNA, 20 nt, Human
cagacugcuuccaauuuucu

SEQ ID NO: 1300676 - RNA, 18 nt, Human
cagacugcgauuuguccc

SEQ ID NO: 1300677 - RNA, 22 nt, Human
cagggagacuggguaggaaaga

SEQ ID NO: 1300678 - RNA, 10 nt, Human
caggcugggc

SEQ ID NO: 1300679 - RNA, 13 nt, Human
cagggagagccca

SEQ ID NO: 1300680 - RNA, 14 nt, Human
cagggagagcccag

SEQ ID NO: 1300681 - RNA, 15 nt, Human
cagggagagcccagg

SEQ ID NO: 1300682 - RNA, 16 nt, Human
cagggagagcccagga

SEQ ID NO: 1300683 - RNA, 20 nt, Human
cagggagagcccaggagcuc

SEQ ID NO: 1300684 - RNA, 19 nt, Human
cagggagagcccaggagcu

SEQ ID NO: 1300685 - RNA, 17 nt, Human
cagggagagggggcugg

SEQ ID NO: 1300686 - RNA, 14 nt, Human
cagggcuacccuga

SEQ ID NO: 1300687 - RNA, 16 nt, Human
cagggcuacccugagc

SEQ ID NO: 1300688 - RNA, 18 nt, Human
cagggcuacccugagcug

SEQ ID NO: 1300689 - RNA, 19 nt, Human
cagggcuacccugagcuga

SEQ ID NO: 1300690 - RNA, 22 nt, Human
cagggcuacccugagcugaggc

SEQ ID NO: 1300691 - RNA, 23 nt, Human
cagggcuacccugagcugaggca

SEQ ID NO: 1300692 - RNA, 24 nt, Human
cagggcuacccugagcugaggcag

SEQ ID NO: 1300693 - RNA, 14 nt, Human
cagggcuagugacu

SEQ ID NO: 1300694 - RNA, 15 nt, Human
cagggcuagugacuu

SEQ ID NO: 1300695 - RNA, 18 nt, Human
cagggcuagugacuugug

SEQ ID NO: 1300696 - RNA, 11 nt, Human
cagggcuccug

SEQ ID NO: 1300697 - RNA, 12 nt, Human
cagggcuccugc

SEQ ID NO: 1300698 - RNA, 14 nt, Human
cagggcuccugcac

SEQ ID NO: 1300699 - RNA, 12 nt, Human
cagggcuccugg

SEQ ID NO: 1300700 - RNA, 13 nt, Human
cagggcuccuggg

SEQ ID NO: 1300701 - RNA, 14 nt, Human
cagggcuccuugug

SEQ ID NO: 1300702 - RNA, 21 nt, Human
cagggcuccuugugggccugg

SEQ ID NO: 1300703 - RNA, 23 nt, Human
cagggcuccuugugggccugggc

SEQ ID NO: 1300704 - RNA, 14 nt, Human
cagggcucuccugg

SEQ ID NO: 1300705 - RNA, 15 nt, Human
cagggcucuccuggc

SEQ ID NO: 1300706 - RNA, 16 nt, Human
cagggcucuccuggcu

SEQ ID NO: 1300707 - RNA, 17 nt, Human
cagggcucuccuggcuu

SEQ ID NO: 1300708 - RNA, 19 nt, Human
cagggcucuccuggcuucc

SEQ ID NO: 1300709 - RNA, 18 nt, Human
cagggcucuccuggcuuc

SEQ ID NO: 1300710 - RNA, 15 nt, Human
cagggcuucuaguuu

SEQ ID NO: 1300711 - RNA, 22 nt, Human
cagggcuuuacuccguaacaga

SEQ ID NO: 1300712 - RNA, 20 nt, Human
caggccggcuugccacaccc

SEQ ID NO: 1300713 - RNA, 13 nt, Human
caggccgggaaaa

SEQ ID NO: 1300714 - RNA, 13 nt, Human
caggcuaauuuuu

SEQ ID NO: 1300715 - RNA, 22 nt, Human
caggcuaauuuuuuuguauuuu

SEQ ID NO: 1300716 - RNA, 21 nt, Human
caggcgugagccaccgugccu

SEQ ID NO: 1300717 - RNA, 18 nt, Human
caggcgugagccaccucg

SEQ ID NO: 1300718 - RNA, 18 nt, Human
caggccuuugagaaaggg

SEQ ID NO: 1300719 - RNA, 17 nt, Human
caggccuuugagcucag

SEQ ID NO: 1300720 - RNA, 16 nt, Human
caggccuuugagcuca

SEQ ID NO: 1300721 - RNA, 16 nt, Human
caggccuguguagcug

SEQ ID NO: 1300722 - RNA, 18 nt, Human
caggccuguguagcugug

SEQ ID NO: 1300723 - RNA, 19 nt, Human
caggccuguguagcuguga

SEQ ID NO: 1300724 - RNA, 20 nt, Human
caggccuguguagcugugac

SEQ ID NO: 1300725 - RNA, 21 nt, Human
caggccuguguagcugugacc

SEQ ID NO: 1300726 - RNA, 22 nt, Human
caggccuguguagcugugaccu

SEQ ID NO: 1300727 - RNA, 23 nt, Human
caggccuguguagcugugaccug

SEQ ID NO: 1300728 - RNA, 22 nt, Human
caggccucucccuccuccagga

SEQ ID NO: 1300729 - RNA, 15 nt, Human
caggccugaaagagg

SEQ ID NO: 1300730 - RNA, 20 nt, Human
caggccugaaagaggcugag

SEQ ID NO: 1300731 - RNA, 22 nt, Human
caggccugaaagaggcugaggc

SEQ ID NO: 1300732 - RNA, 15 nt, Human
caggccuguccaaca

SEQ ID NO: 1300733 - RNA, 17 nt, Human
caggccgugacgucugg

SEQ ID NO: 1300734 - RNA, 18 nt, Human
caggccgugacgucuggg

SEQ ID NO: 1300735 - RNA, 19 nt, Human
caggccgugacgucugggu

SEQ ID NO: 1300736 - RNA, 20 nt, Human
caggccgugacgucugggug

SEQ ID NO: 1300737 - RNA, 22 nt, Human
caggcacugagauaccagcgag

SEQ ID NO: 1300738 - RNA, 12 nt, Human
caggccagcugu

SEQ ID NO: 1300739 - RNA, 13 nt, Human
caggccagcugug

SEQ ID NO: 1300740 - RNA, 13 nt, Human
caggccaggacuc

SEQ ID NO: 1300741 - RNA, 14 nt, Human
caggccaggacucu

SEQ ID NO: 1300742 - RNA, 15 nt, Human
caggccaggacucug

SEQ ID NO: 1300743 - RNA, 16 nt, Human
caggccaggacucugc

SEQ ID NO: 1300744 - RNA, 17 nt, Human
caggccaggacucugca

SEQ ID NO: 1300745 - RNA, 18 nt, Human
caggccaggacucugcag

SEQ ID NO: 1300746 - RNA, 19 nt, Human
caggccaggacucugcagc

SEQ ID NO: 1300747 - RNA, 20 nt, Human
caggccaggacucugcagcc

SEQ ID NO: 1300748 - RNA, 21 nt, Human
caggccaggacucugcagccu

SEQ ID NO: 1300749 - RNA, 23 nt, Human
caggccaggacucugcagccuca

SEQ ID NO: 1300750 - RNA, 16 nt, Human
caggagggacaaagga

SEQ ID NO: 1300751 - RNA, 12 nt, Human
caggccaggcau

SEQ ID NO: 1300752 - RNA, 12 nt, Human
caggaccagcuc

SEQ ID NO: 1300753 - RNA, 14 nt, Human
caggaccagcucag

SEQ ID NO: 1300754 - RNA, 13 nt, Human
caggaccagcuca

SEQ ID NO: 1300755 - RNA, 21 nt, Human
caggaccagucaaccugggca

SEQ ID NO: 1300756 - RNA, 18 nt, Human
caggaccagucccagagc

SEQ ID NO: 1300757 - RNA, 19 nt, Human
caggaccagucccagagca

SEQ ID NO: 1300758 - RNA, 20 nt, Human
caggaccagucccagagcag

SEQ ID NO: 1300759 - RNA, 13 nt, Human
caggacccagagg

SEQ ID NO: 1300760 - RNA, 14 nt, Human
caggacccagagga

SEQ ID NO: 1300761 - RNA, 15 nt, Human
caggacccagaggaa

SEQ ID NO: 1300762 - RNA, 16 nt, Human
caggacccagaggaag

SEQ ID NO: 1300763 - RNA, 12 nt, Human
caggacauuucu

SEQ ID NO: 1300764 - RNA, 14 nt, Human
caggacauuucucu

SEQ ID NO: 1300765 - RNA, 18 nt, Human
caggacauuucucuaaga

SEQ ID NO: 1300766 - RNA, 12 nt, Human
caggaccacagg

SEQ ID NO: 1300767 - RNA, 14 nt, Human
caggaccacaggcu

SEQ ID NO: 1300768 - RNA, 15 nt, Human
caggaccacaggcuc

SEQ ID NO: 1300769 - RNA, 16 nt, Human
caggaccacaggcuca

SEQ ID NO: 1300770 - RNA, 17 nt, Human
caggaccacaggcucag

SEQ ID NO: 1300771 - RNA, 18 nt, Human
caggaccacaggcucagg

SEQ ID NO: 1300772 - RNA, 19 nt, Human
caggaccacaggcucaggc

SEQ ID NO: 1300773 - RNA, 21 nt, Human
caggaccacaggcucaggcag

SEQ ID NO: 1300774 - RNA, 23 nt, Human
caggaccacaggcucaggcaggg

SEQ ID NO: 1300775 - RNA, 15 nt, Human
caggaccagaagcuc

SEQ ID NO: 1300776 - RNA, 13 nt, Human
caggaccagaagc

SEQ ID NO: 1300777 - RNA, 19 nt, Human
caggaggacccagggcucu

SEQ ID NO: 1300778 - RNA, 16 nt, Human
caggaggaauacugaa

SEQ ID NO: 1300779 - RNA, 15 nt, Human
caggaggacccaggg

SEQ ID NO: 1300780 - RNA, 16 nt, Human
caggaggacccagggc

SEQ ID NO: 1300781 - RNA, 17 nt, Human
caggaggacccagggcu

SEQ ID NO: 1300782 - RNA, 18 nt, Human
caggaggacccagggcuc

SEQ ID NO: 1300783 - RNA, 20 nt, Human
caggaggacccagggcucug

SEQ ID NO: 1300784 - RNA, 18 nt, Human
caggagggacaaaggagc

SEQ ID NO: 1300785 - RNA, 14 nt, Human
caggaggccuagga

SEQ ID NO: 1300786 - RNA, 20 nt, Human
cagcuguaugauucccagcc

SEQ ID NO: 1300787 - RNA, 16 nt, Human
cagcugucaaggcuca

SEQ ID NO: 1300788 - RNA, 18 nt, Human
cagcugucaucaauuaaa

SEQ ID NO: 1300789 - RNA, 14 nt, Human
cagcugucccccca

SEQ ID NO: 1300790 - RNA, 15 nt, Human
cagcuguccccccac

SEQ ID NO: 1300791 - RNA, 16 nt, Human
cagcuguccccccacu

SEQ ID NO: 1300792 - RNA, 14 nt, Human
cagcuuauugucua

SEQ ID NO: 1300793 - RNA, 19 nt, Human
cagcuguccccccacuccc

SEQ ID NO: 1300794 - RNA, 17 nt, Human
cagcuguccccccacuc

SEQ ID NO: 1300795 - RNA, 20 nt, Human
cagcuuauugucuagugaaa

SEQ ID NO: 1300796 - RNA, 23 nt, Human
caggaaacaguugcauguaguaa

SEQ ID NO: 1300797 - RNA, 18 nt, Human
caggaaacuccugugacc

SEQ ID NO: 1300798 - RNA, 19 nt, Human
caggaaacuccugugacca

SEQ ID NO: 1300799 - RNA, 21 nt, Human
caggaaacuccugugaccaca

SEQ ID NO: 1300800 - RNA, 16 nt, Human
caggaaagagaacuuc

SEQ ID NO: 1300801 - RNA, 20 nt, Human
caggaaagagaacuuccaga

SEQ ID NO: 1300802 - RNA, 17 nt, Human
cagcugagagaaaauaa

SEQ ID NO: 1300803 - RNA, 14 nt, Human
cagcugagaggcug

SEQ ID NO: 1300804 - RNA, 13 nt, Human
cagcugagcaggg

SEQ ID NO: 1300805 - RNA, 14 nt, Human
cagcugagcagggc

SEQ ID NO: 1300806 - RNA, 15 nt, Human
cagcugagcagggcc

SEQ ID NO: 1300807 - RNA, 20 nt, Human
cagcugagcagggccgggga

SEQ ID NO: 1300808 - RNA, 18 nt, Human
cagcugagcgccaggaug

SEQ ID NO: 1300809 - RNA, 16 nt, Human
cagcugagcagggccg

SEQ ID NO: 1300810 - RNA, 14 nt, Human
cagcugagcgccag

SEQ ID NO: 1300811 - RNA, 16 nt, Human
cagcugagcgccagga

SEQ ID NO: 1300812 - RNA, 22 nt, Human
cagcugccggucgcccuuugcu

SEQ ID NO: 1300813 - RNA, 19 nt, Human
cagcuaaagcaauaugcau

SEQ ID NO: 1300814 - RNA, 22 nt, Human
cagcggagguguggagccgagg

SEQ ID NO: 1300815 - RNA, 14 nt, Human
cagcggcaucaggc

SEQ ID NO: 1300816 - RNA, 20 nt, Human
cagcgcugucaggauugcga

SEQ ID NO: 1300817 - RNA, 21 nt, Human
cagcgcugucaggauugcgag

SEQ ID NO: 1300818 - RNA, 12 nt, Human
cagcuaaagcaa

SEQ ID NO: 1300819 - RNA, 23 nt, Human
cagcgcuccugcuaacggugcuc

SEQ ID NO: 1300820 - RNA, 13 nt, Human
caccugcccugcc

SEQ ID NO: 1300821 - RNA, 12 nt, Human
caccugcccugc

SEQ ID NO: 1300822 - RNA, 13 nt, Human
caccugcccuacc

SEQ ID NO: 1300823 - RNA, 14 nt, Human
caccugcccuaccu

SEQ ID NO: 1300824 - RNA, 18 nt, Human
caccuaggcuaggguggg

SEQ ID NO: 1300825 - RNA, 19 nt, Human
caccuaggcuagggugggg

SEQ ID NO: 1300826 - RNA, 23 nt, Human
cacccuguacuguucugugucuu

SEQ ID NO: 1300827 - RNA, 12 nt, Human
cacccugggccc

SEQ ID NO: 1300828 - RNA, 14 nt, Human
cacccugggcccug

SEQ ID NO: 1300829 - RNA, 17 nt, Human
cacccugggcccugggc

SEQ ID NO: 1300830 - RNA, 21 nt, Human
cacccugggcccugggcugga

SEQ ID NO: 1300831 - RNA, 22 nt, Human
cacccugggcccugggcuggaa

SEQ ID NO: 1300832 - RNA, 19 nt, Human
cacccuggccuagaccagc

SEQ ID NO: 1300833 - RNA, 15 nt, Human
cacccuggugggcca

SEQ ID NO: 1300834 - RNA, 16 nt, Human
cacccuggugggccaa

SEQ ID NO: 1300835 - RNA, 16 nt, Human
cacccuguacuguucu

SEQ ID NO: 1300836 - RNA, 17 nt, Human
cacccuguacuguucug

SEQ ID NO: 1300837 - RNA, 21 nt, Human
cacccuguacuguucuguguc

SEQ ID NO: 1300838 - RNA, 20 nt, Human
cacccucguggacaccugcc

SEQ ID NO: 1300839 - RNA, 19 nt, Human
cacccucguggacaccugc

SEQ ID NO: 1300840 - RNA, 18 nt, Human
cacccucguggacaccug

SEQ ID NO: 1300841 - RNA, 17 nt, Human
cacccucguggacaccu

SEQ ID NO: 1300842 - RNA, 22 nt, Human
cacccucggggauguguccuga

SEQ ID NO: 1300843 - RNA, 12 nt, Human
cacccugagccg

SEQ ID NO: 1300844 - RNA, 14 nt, Human
cacccugagccggc

SEQ ID NO: 1300845 - RNA, 15 nt, Human
cacccugaggagucu

SEQ ID NO: 1300846 - RNA, 16 nt, Human
cacccugaggagucug

SEQ ID NO: 1300847 - RNA, 18 nt, Human
cacccugaggagucugag

SEQ ID NO: 1300848 - RNA, 21 nt, Human
cacccugaggagucugagguc

SEQ ID NO: 1300849 - RNA, 22 nt, Human
cacccugaggagucugaggucc

SEQ ID NO: 1300850 - RNA, 17 nt, Human
cacccugauaggaagag

SEQ ID NO: 1300851 - RNA, 22 nt, Human
cacccugauuuaggagaagcca

SEQ ID NO: 1300852 - RNA, 12 nt, Human
cacccugccuua

SEQ ID NO: 1300853 - RNA, 13 nt, Human
cacccugccuuau

SEQ ID NO: 1300854 - RNA, 18 nt, Human
cacccugccuuaucuugc

SEQ ID NO: 1300855 - RNA, 19 nt, Human
cacccugccuuaucuugca

SEQ ID NO: 1300856 - RNA, 15 nt, Human
cacccuggauuugca

SEQ ID NO: 1300857 - RNA, 11 nt, Human
cacccuggccu

SEQ ID NO: 1300858 - RNA, 23 nt, Human
cacccuggccuagaccagcagac

SEQ ID NO: 1300859 - RNA, 21 nt, Human
cacccuggccgaguccaagcu

SEQ ID NO: 1300860 - RNA, 22 nt, Human
cacccuggccgaguccaagcug

SEQ ID NO: 1300861 - RNA, 11 nt, Human
cacccuggagg

SEQ ID NO: 1300862 - RNA, 21 nt, Human
cacccucggggauguguccug

SEQ ID NO: 1300863 - RNA, 16 nt, Human
caccugcccugcccug

SEQ ID NO: 1300864 - RNA, 14 nt, Human
caccugcccugccc

SEQ ID NO: 1300865 - RNA, 20 nt, Human
caccugcccuaccugcccca

SEQ ID NO: 1300866 - RNA, 23 nt, Human
cacugaagaagcaccaaucauga

SEQ ID NO: 1300867 - RNA, 17 nt, Human
cacucccaccugacaca

SEQ ID NO: 1300868 - RNA, 17 nt, Human
cacucccacaugggccc

SEQ ID NO: 1300869 - RNA, 17 nt, Human
cacugaagcuuuuuagu

SEQ ID NO: 1300870 - RNA, 21 nt, Human
cacuccagugagacagcucug

SEQ ID NO: 1300871 - RNA, 12 nt, Human
cacuccagccug

SEQ ID NO: 1300872 - RNA, 17 nt, Human
cacuccagaccccuggc

SEQ ID NO: 1300873 - RNA, 15 nt, Human
cacuacauucauuua

SEQ ID NO: 1300874 - RNA, 14 nt, Human
cacuagacaagcca

SEQ ID NO: 1300875 - RNA, 16 nt, Human
cacuagacaagccaga

SEQ ID NO: 1300876 - RNA, 17 nt, Human
cacuagacaagccagaa

SEQ ID NO: 1300877 - RNA, 16 nt, Human
cacuagacccacugga

SEQ ID NO: 1300878 - RNA, 19 nt, Human
cacuagacaagccagaacu

SEQ ID NO: 1300879 - RNA, 21 nt, Human
cacuagacaagccagaacuug

SEQ ID NO: 1300880 - RNA, 12 nt, Human
cacuagccaaac

SEQ ID NO: 1300881 - RNA, 14 nt, Human
cacuccagaccccu

SEQ ID NO: 1300882 - RNA, 16 nt, Human
cacuccagaccccugg

SEQ ID NO: 1300883 - RNA, 19 nt, Human
cacuagcccaaugaaauga

SEQ ID NO: 1300884 - RNA, 14 nt, Human
cacuagccaaaccu

SEQ ID NO: 1300885 - RNA, 16 nt, Human
cacuagccaaaccuca

SEQ ID NO: 1300886 - RNA, 22 nt, Human
cacuagccaaaccucaccaacu

SEQ ID NO: 1300887 - RNA, 19 nt, Human
cacuagccaaaccucacca

SEQ ID NO: 1300888 - RNA, 16 nt, Human
cacuagcccaaugaaa

SEQ ID NO: 1300889 - RNA, 23 nt, Human
cacuagcccaaugaaaugaauua

SEQ ID NO: 1300890 - RNA, 13 nt, Human
cacgcuuuuguga

SEQ ID NO: 1300891 - RNA, 20 nt, Human
cacggaccaaagggagucug

SEQ ID NO: 1300892 - RNA, 21 nt, Human
cacggaccaaagggagucugc

SEQ ID NO: 1300893 - RNA, 23 nt, Human
cacggaccaaagggagucugcca

SEQ ID NO: 1300894 - RNA, 15 nt, Human
cacggagccacuccu

SEQ ID NO: 1300895 - RNA, 16 nt, Human
cacggagccacuccuc

SEQ ID NO: 1300896 - RNA, 17 nt, Human
cacggagccacuccucu

SEQ ID NO: 1300897 - RNA, 18 nt, Human
cacggagccacuccucug

SEQ ID NO: 1300898 - RNA, 19 nt, Human
cacggagccacuccucuga

SEQ ID NO: 1300899 - RNA, 21 nt, Human
cacggagccacuccucugacu

SEQ ID NO: 1300900 - RNA, 23 nt, Human
cacggagccacuccucugacuca

SEQ ID NO: 1300901 - RNA, 14 nt, Human
cacgcuuuccugaa

SEQ ID NO: 1300902 - RNA, 16 nt, Human
cacaugaaguccaagc

SEQ ID NO: 1300903 - RNA, 15 nt, Human
cacaugaacuuagau

SEQ ID NO: 1300904 - RNA, 21 nt, Human
cacaugaacuuagauuuuaca

SEQ ID NO: 1300905 - RNA, 23 nt, Human
cacaugaacuuagauuuuacaug

SEQ ID NO: 1300906 - RNA, 13 nt, Human
caccaggaagccg

SEQ ID NO: 1300907 - RNA, 16 nt, Human
caccaggacuagggcu

SEQ ID NO: 1300908 - RNA, 13 nt, Human
cacccagcaauag

SEQ ID NO: 1300909 - RNA, 20 nt, Human
cacccagaugccccuuucug

SEQ ID NO: 1300910 - RNA, 15 nt, Human
cacccagacauaaag

SEQ ID NO: 1300911 - RNA, 20 nt, Human
cacccagacauaaaggaaaa

SEQ ID NO: 1300912 - RNA, 21 nt, Human
cacccagacauaaaggaaaag

SEQ ID NO: 1300913 - RNA, 23 nt, Human
cacccagacauaaaggaaaagac

SEQ ID NO: 1300914 - RNA, 14 nt, Human
cacccacuucugca

SEQ ID NO: 1300915 - RNA, 16 nt, Human
cacccacuucugcacu

SEQ ID NO: 1300916 - RNA, 15 nt, Human
cacccacuucugcac

SEQ ID NO: 1300917 - RNA, 22 nt, Human
caccaggauagagacuggaaca

SEQ ID NO: 1300918 - RNA, 13 nt, Human
caccaggcagccu

SEQ ID NO: 1300919 - RNA, 14 nt, Human
caccaggcagccuc

SEQ ID NO: 1300920 - RNA, 20 nt, Human
cacccagguuggagugcagu

SEQ ID NO: 1300921 - RNA, 13 nt, Human
cacccaggggcag

SEQ ID NO: 1300922 - RNA, 14 nt, Human
cacccaggggcagc

SEQ ID NO: 1300923 - RNA, 16 nt, Human
cacccaggggcagccc

SEQ ID NO: 1300924 - RNA, 20 nt, Human
cacccaggcuggacugcaau

SEQ ID NO: 1300925 - RNA, 12 nt, Human
cacccaggccag

SEQ ID NO: 1300926 - RNA, 20 nt, Human
cacccaggcuggagugcagu

SEQ ID NO: 1300927 - RNA, 16 nt, Human
cacccagcaauagaga

SEQ ID NO: 1300928 - RNA, 16 nt, Human
cacccagugcccucuc

SEQ ID NO: 1300929 - RNA, 23 nt, Human
cacccagugcccucuccccucag

SEQ ID NO: 1300930 - RNA, 22 nt, Human
cacccaguuuccuugggaguug

SEQ ID NO: 1300931 - RNA, 11 nt, Human
cacccaucugu

SEQ ID NO: 1300932 - RNA, 18 nt, Human
cacccaucugucugccaa

SEQ ID NO: 1300933 - RNA, 21 nt, Human
caaguuccuuggccaugcaga

SEQ ID NO: 1300934 - RNA, 20 nt, Human
caaguuccucuaacuuggcu

SEQ ID NO: 1300935 - RNA, 15 nt, Human
caaguucgucuguug

SEQ ID NO: 1300936 - RNA, 16 nt, Human
caaguucgucuguugu

SEQ ID NO: 1300937 - RNA, 12 nt, Human
caaguucuaaga

SEQ ID NO: 1300938 - RNA, 13 nt, Human
caaguucuaagau

SEQ ID NO: 1300939 - RNA, 14 nt, Human
caaguucuaagauu

SEQ ID NO: 1300940 - RNA, 15 nt, Human
caaguucuaagauuc

SEQ ID NO: 1300941 - RNA, 20 nt, Human
caaguuauuuuuaauuuggu

SEQ ID NO: 1300942 - RNA, 17 nt, Human
caaguucaugcagcugu

SEQ ID NO: 1300943 - RNA, 18 nt, Human
caaguuccaaguugcuaa

SEQ ID NO: 1300944 - RNA, 19 nt, Human
caaguucccaguuggagcu

SEQ ID NO: 1300945 - RNA, 21 nt, Human
caaguuccucuaacuuggcuc

SEQ ID NO: 1300946 - RNA, 19 nt, Human
caaguauuugggaagugaa

SEQ ID NO: 1300947 - RNA, 22 nt, Human
caaguauuugggaagugaagac

SEQ ID NO: 1300948 - RNA, 16 nt, Human
caaguauuuguuaauu

SEQ ID NO: 1300949 - RNA, 19 nt, Human
caaguauuuguuaauuuag

SEQ ID NO: 1300950 - RNA, 20 nt, Human
caaguauuuguuaauuuaga

SEQ ID NO: 1300951 - RNA, 15 nt, Human
caaguuauuaauuuc

SEQ ID NO: 1300952 - RNA, 21 nt, Human
caaguuauuaauuucuucaca

SEQ ID NO: 1300953 - RNA, 15 nt, Human
caaguaaaaaggcua

SEQ ID NO: 1300954 - RNA, 10 nt, Human
caaguaaaaa

SEQ ID NO: 1300955 - RNA, 21 nt, Human
caagguuuuagguucuaaagu

SEQ ID NO: 1300956 - RNA, 23 nt, Human
caagguuuuagguucuaaaguuc

SEQ ID NO: 1300957 - RNA, 19 nt, Human
caagguuuuauaaggcuga

SEQ ID NO: 1300958 - RNA, 13 nt, Human
caagguuuuaggu

SEQ ID NO: 1300959 - RNA, 18 nt, Human
caagguuuuagguucuaa

SEQ ID NO: 1300960 - RNA, 20 nt, Human
caagguuuuagguucuaaag

SEQ ID NO: 1300961 - RNA, 14 nt, Human
caaggccaucuggg

SEQ ID NO: 1300962 - RNA, 17 nt, Human
caaggccaucugggcuc

SEQ ID NO: 1300963 - RNA, 14 nt, Human
caaguaacaaaaau

SEQ ID NO: 1300964 - RNA, 17 nt, Human
caaguaacaaaaauaaa

SEQ ID NO: 1300965 - RNA, 15 nt, Human
caaguaauacaaacu

SEQ ID NO: 1300966 - RNA, 15 nt, Human
caagcugaggugccc

SEQ ID NO: 1300967 - RNA, 17 nt, Human
caagcugaggugcccag

SEQ ID NO: 1300968 - RNA, 18 nt, Human
caagcugaggugcccagg

SEQ ID NO: 1300969 - RNA, 19 nt, Human
caagcugaggugcccagga

SEQ ID NO: 1300970 - RNA, 20 nt, Human
caagcugaggugcccaggag

SEQ ID NO: 1300971 - RNA, 21 nt, Human
caagcugaggugcccaggaga

SEQ ID NO: 1300972 - RNA, 20 nt, Human
caagcugaguauuaaaaugu

SEQ ID NO: 1300973 - RNA, 14 nt, Human
caagcugaguuucc

SEQ ID NO: 1300974 - RNA, 15 nt, Human
caagcugaguuuccu

SEQ ID NO: 1300975 - RNA, 16 nt, Human
caagcugaguuuccua

SEQ ID NO: 1300976 - RNA, 22 nt, Human
caagcugaguuuccuaugggaa

SEQ ID NO: 1300977 - RNA, 23 nt, Human
caagcugaguuuccuaugggaac

SEQ ID NO: 1300978 - RNA, 15 nt, Human
caagcugauuaaaug

SEQ ID NO: 1300979 - RNA, 19 nt, Human
caagcugauuaaaugacac

SEQ ID NO: 1300980 - RNA, 21 nt, Human
caagcuccaucuccacuccag

SEQ ID NO: 1300981 - RNA, 17 nt, Human
caagcuccaucuccacu

SEQ ID NO: 1300982 - RNA, 13 nt, Human
caagcucuuccuu

SEQ ID NO: 1300983 - RNA, 17 nt, Human
caaucagccuaguugau

SEQ ID NO: 1300984 - RNA, 15 nt, Human
caaucagcuccuucc

SEQ ID NO: 1300985 - RNA, 16 nt, Human
caaucagcuccuuccu

SEQ ID NO: 1300986 - RNA, 18 nt, Human
caaucagcuccuuccugg

SEQ ID NO: 1300987 - RNA, 13 nt, Human
caaugccaucauc

SEQ ID NO: 1300988 - RNA, 14 nt, Human
caaugccaucaucu

SEQ ID NO: 1300989 - RNA, 17 nt, Human
caaugcucaggugcugg

SEQ ID NO: 1300990 - RNA, 12 nt, Human
caauauuuuucu

SEQ ID NO: 1300991 - RNA, 17 nt, Human
caauauuuucuuuuccc

SEQ ID NO: 1300992 - RNA, 15 nt, Human
caaucaagucuguuu

SEQ ID NO: 1300993 - RNA, 18 nt, Human
caaucaagucuguuuacu

SEQ ID NO: 1300994 - RNA, 19 nt, Human
caaucaaucuugcauguaa

SEQ ID NO: 1300995 - RNA, 16 nt, Human
caaucaaucuugcaug

SEQ ID NO: 1300996 - RNA, 15 nt, Human
caauuggcaccgaag

SEQ ID NO: 1300997 - RNA, 19 nt, Human
caauuggcaccgaagccca

SEQ ID NO: 1300998 - RNA, 20 nt, Human
caauuggcaccgaagcccag

SEQ ID NO: 1300999 - RNA, 21 nt, Human
caauuggcaccgaagcccaga

SEQ ID NO: 1301000 - RNA, 17 nt, Human
caauugggagcugccaa

SEQ ID NO: 1301001 - RNA, 21 nt, Human
caauugggagcugccaagagu

SEQ ID NO: 1301002 - RNA, 20 nt, Human
caauugggagcugccaagag

SEQ ID NO: 1301003 - RNA, 14 nt, Human
caauauuuuuagau

SEQ ID NO: 1301004 - RNA, 13 nt, Human
caauuuauuugaa

SEQ ID NO: 1301005 - RNA, 15 nt, Human
caauuuauuugaaug

SEQ ID NO: 1301006 - RNA, 23 nt, Human
caauuuauuugaaugauuuuucu

SEQ ID NO: 1301007 - RNA, 15 nt, Human
caauuucaagguucu

SEQ ID NO: 1301008 - RNA, 16 nt, Human
caauuucaagguucua

SEQ ID NO: 1301009 - RNA, 11 nt, Human
caauuucaagu

SEQ ID NO: 1301010 - RNA, 19 nt, Human
caauuucaagguucuaacc

SEQ ID NO: 1301011 - RNA, 14 nt, Human
caauuucagacucc

SEQ ID NO: 1301012 - RNA, 12 nt, Human
cacaaggacuuc

SEQ ID NO: 1301013 - RNA, 14 nt, Human
cacaaggacuuccu

SEQ ID NO: 1301014 - RNA, 16 nt, Human
cacaaggacuuccugu

SEQ ID NO: 1301015 - RNA, 22 nt, Human
cacaaggacuuccuguccagcu

SEQ ID NO: 1301016 - RNA, 17 nt, Human
cacaaggauagaugcug

SEQ ID NO: 1301017 - RNA, 18 nt, Human
cacaaggauagaugcugg

SEQ ID NO: 1301018 - RNA, 21 nt, Human
cacaaggauagaugcuggccc

SEQ ID NO: 1301019 - RNA, 22 nt, Human
cacaaggauagaugcuggccca

SEQ ID NO: 1301020 - RNA, 15 nt, Human
cacaaggccaucugg

SEQ ID NO: 1301021 - RNA, 11 nt, Human
cacaaggcagc

SEQ ID NO: 1301022 - RNA, 14 nt, Human
cacaaggcagcaag

SEQ ID NO: 1301023 - RNA, 15 nt, Human
cacaaggcagcaagg

SEQ ID NO: 1301024 - RNA, 16 nt, Human
cacaaggcagcaaggc

SEQ ID NO: 1301025 - RNA, 17 nt, Human
cacaaggcagcaaggcc

SEQ ID NO: 1301026 - RNA, 18 nt, Human
cacaaggcagcaaggccc

SEQ ID NO: 1301027 - RNA, 22 nt, Human
cacaaggcagcaaggcccgagc

SEQ ID NO: 1301028 - RNA, 19 nt, Human
caacuauauuguuugcuaa

SEQ ID NO: 1301029 - RNA, 19 nt, Human
caacuaucucauuuccaag

SEQ ID NO: 1301030 - RNA, 13 nt, Human
caacuauggccug

SEQ ID NO: 1301031 - RNA, 21 nt, Human
caacuaucucauuuccaagca

SEQ ID NO: 1301032 - RNA, 21 nt, Human
caacuaucagacuaagccagc

SEQ ID NO: 1301033 - RNA, 13 nt, Human
caaccccaggcug

SEQ ID NO: 1301034 - RNA, 14 nt, Human
caacuauggccugu

SEQ ID NO: 1301035 - RNA, 16 nt, Human
caacuauggaucagaa

SEQ ID NO: 1301036 - RNA, 17 nt, Human
caacuauggaucagaau

SEQ ID NO: 1301037 - RNA, 14 nt, Human
caacuauuuucaga

SEQ ID NO: 1301038 - RNA, 12 nt, Human
caacuccagaaa

SEQ ID NO: 1301039 - RNA, 21 nt, Human
caacuauuuucagaugugaac

SEQ ID NO: 1301040 - RNA, 21 nt, Human
caacucccugccccccagccc

SEQ ID NO: 1301041 - RNA, 19 nt, Human
caacucccugccccccagc

SEQ ID NO: 1301042 - RNA, 20 nt, Human
caacucccugccccccagcc

SEQ ID NO: 1301043 - RNA, 17 nt, Human
caacuauuuucagaugu

SEQ ID NO: 1301044 - RNA, 18 nt, Human
caagaauagaugcugacu

SEQ ID NO: 1301045 - RNA, 22 nt, Human
caagaauaaucacgcuuuccug

SEQ ID NO: 1301046 - RNA, 23 nt, Human
caagaauaaucacgcuuuccuga

SEQ ID NO: 1301047 - RNA, 12 nt, Human
caagaaggauuu

SEQ ID NO: 1301048 - RNA, 16 nt, Human
caagaaggcaaaaaua

SEQ ID NO: 1301049 - RNA, 21 nt, Human
caagaauaaucacgcuuuccu

SEQ ID NO: 1301050 - RNA, 19 nt, Human
caagaauagcauuguaaaa

SEQ ID NO: 1301051 - RNA, 15 nt, Human
caagaaucagagaag

SEQ ID NO: 1301052 - RNA, 15 nt, Human
caagaauacuacuua

SEQ ID NO: 1301053 - RNA, 14 nt, Human
caagaauccacauu

SEQ ID NO: 1301054 - RNA, 18 nt, Human
caagaauccacauuucua

SEQ ID NO: 1301055 - RNA, 19 nt, Human
caagaauccacauuucuaa

SEQ ID NO: 1301056 - RNA, 21 nt, Human
caagaauccacauuucuaaaa

SEQ ID NO: 1301057 - RNA, 22 nt, Human
caagaauccacauuucuaaaau

SEQ ID NO: 1301058 - RNA, 14 nt, Human
caagacaugucugu

SEQ ID NO: 1301059 - RNA, 15 nt, Human
caagacaugucuguu

SEQ ID NO: 1301060 - RNA, 17 nt, Human
caagacaugucuguucu

SEQ ID NO: 1301061 - RNA, 19 nt, Human
caagcaaaugugaaucauu

SEQ ID NO: 1301062 - RNA, 17 nt, Human
caagcaaaugugaauca

SEQ ID NO: 1301063 - RNA, 15 nt, Human
caagcaaaugugaau

SEQ ID NO: 1301064 - RNA, 14 nt, Human
caagcaauccuccc

SEQ ID NO: 1301065 - RNA, 14 nt, Human
caagcaaguauuag

SEQ ID NO: 1301066 - RNA, 13 nt, Human
caagcaagaaaca

SEQ ID NO: 1301067 - RNA, 18 nt, Human
caagcaagaaacacuggg

SEQ ID NO: 1301068 - RNA, 15 nt, Human
caagaucccauuuga

SEQ ID NO: 1301069 - RNA, 13 nt, Human
caagaucccauuu

SEQ ID NO: 1301070 - RNA, 21 nt, Human
caagauauuuuaaaaucuguc

SEQ ID NO: 1301071 - RNA, 23 nt, Human
caagauauuuuaaaaucugucac

SEQ ID NO: 1301072 - RNA, 20 nt, Human
caagaugaaauuccauuugu

SEQ ID NO: 1301073 - RNA, 18 nt, Human
caagaugaaauuccauuu

SEQ ID NO: 1301074 - RNA, 18 nt, Human
caagaugaaggagaggca

SEQ ID NO: 1301075 - RNA, 18 nt, Human
caagcaccuagccucgcu

SEQ ID NO: 1301076 - RNA, 22 nt, Human
caagcaccaccaaacacagugu

SEQ ID NO: 1301077 - RNA, 12 nt, Human
caagcacagcag

SEQ ID NO: 1301078 - RNA, 13 nt, Human
caagcacagcagc

SEQ ID NO: 1301079 - RNA, 14 nt, Human
caagcacagcagcc

SEQ ID NO: 1301080 - RNA, 17 nt, Human
caagcacagcagccugg

SEQ ID NO: 1301081 - RNA, 14 nt, Human
caagcacagcccuu

SEQ ID NO: 1301082 - RNA, 19 nt, Human
auuuuuauauuugaaauau

SEQ ID NO: 1301083 - RNA, 15 nt, Human
auuuuuaaacaagua

SEQ ID NO: 1301084 - RNA, 16 nt, Human
auuuuuaaaauguaca

SEQ ID NO: 1301085 - RNA, 13 nt, Human
auuuuuaaacaag

SEQ ID NO: 1301086 - RNA, 14 nt, Human
auuuuuaaacaagu

SEQ ID NO: 1301087 - RNA, 17 nt, Human
auuuuuaugccaccuga

SEQ ID NO: 1301088 - RNA, 20 nt, Human
auuuuuaucaguuacacaug

SEQ ID NO: 1301089 - RNA, 16 nt, Human
auuuuuaaaacccauu

SEQ ID NO: 1301090 - RNA, 17 nt, Human
auuuuuaaaacccauuu

SEQ ID NO: 1301091 - RNA, 14 nt, Human
auuuuuaaaaugua

SEQ ID NO: 1301092 - RNA, 15 nt, Human
auuuuuuucugaauu

SEQ ID NO: 1301093 - RNA, 16 nt, Human
auuuuuuucugaaauu

SEQ ID NO: 1301094 - RNA, 17 nt, Human
auuuuuuucugaaauuu

SEQ ID NO: 1301095 - RNA, 16 nt, Human
auuuuuuuccuugcaa

SEQ ID NO: 1301096 - RNA, 19 nt, Human
auuuuuuucccaauugaga

SEQ ID NO: 1301097 - RNA, 18 nt, Human
auuuuuauuuuugcugag

SEQ ID NO: 1301098 - RNA, 13 nt, Human
auuuuuauuucuu

SEQ ID NO: 1301099 - RNA, 17 nt, Human
auuuuuauuucuuccua

SEQ ID NO: 1301100 - RNA, 22 nt, Human
auuuuuauuaauuuuaguuuuu

SEQ ID NO: 1301101 - RNA, 17 nt, Human
auuuuuauuaauuuuag

SEQ ID NO: 1301102 - RNA, 14 nt, Human
auuuuuuuuacauu

SEQ ID NO: 1301103 - RNA, 16 nt, Human
auuuuuuuuauuagua

SEQ ID NO: 1301104 - RNA, 20 nt, Human
auuuuuuuuauuaguauugu

SEQ ID NO: 1301105 - RNA, 14 nt, Human
auuuuuuuuaacau

SEQ ID NO: 1301106 - RNA, 18 nt, Human
auuuuuuuuaaguauuua

SEQ ID NO: 1301107 - RNA, 18 nt, Human
auuuuuuuuaacauuccu

SEQ ID NO: 1301108 - RNA, 16 nt, Human
auuuuuuuucuuugaa

SEQ ID NO: 1301109 - RNA, 21 nt, Human
auuuuuuuuucauacacuuau

SEQ ID NO: 1301110 - RNA, 19 nt, Human
auuuuuuuuucauacacuu

SEQ ID NO: 1301111 - RNA, 20 nt, Human
auuuuuuuuucauacacuua

SEQ ID NO: 1301112 - RNA, 22 nt, Human
caaaagauugcugaaauuuuau

SEQ ID NO: 1301113 - RNA, 20 nt, Human
auuuuuuuucuuugaauaaa

SEQ ID NO: 1301114 - RNA, 21 nt, Human
auuuuuuuucuuugaauaaau

SEQ ID NO: 1301115 - RNA, 15 nt, Human
auuuuuuuucuuuua

SEQ ID NO: 1301116 - RNA, 23 nt, Human
auuuuuuuuuaaagaagaaaaaa

SEQ ID NO: 1301117 - RNA, 19 nt, Human
auuuuuuuuuaagcucuga

SEQ ID NO: 1301118 - RNA, 20 nt, Human
auuuuuuuuuaagcucugag

SEQ ID NO: 1301119 - RNA, 21 nt, Human
auuuuuuuuuaagcucugagc

SEQ ID NO: 1301120 - RNA, 14 nt, Human
auuuuuuuuucaua

SEQ ID NO: 1301121 - RNA, 16 nt, Human
auuuuuuuuucauaca

SEQ ID NO: 1301122 - RNA, 19 nt, Human
caaaagcccauucauucca

SEQ ID NO: 1301123 - RNA, 15 nt, Human
caaaagcccauucau

SEQ ID NO: 1301124 - RNA, 21 nt, Human
caaaagguauuuuaaucacca

SEQ ID NO: 1301125 - RNA, 19 nt, Human
caaacauccucuuccauau

SEQ ID NO: 1301126 - RNA, 21 nt, Human
caaacauauauauacuauuaa

SEQ ID NO: 1301127 - RNA, 23 nt, Human
caaaccagauacggacagagacc

SEQ ID NO: 1301128 - RNA, 14 nt, Human
caaaccaggacccu

SEQ ID NO: 1301129 - RNA, 17 nt, Human
caaaccaguaucgcuca

SEQ ID NO: 1301130 - RNA, 21 nt, Human
caaacaugacccuaaaucuug

SEQ ID NO: 1301131 - RNA, 15 nt, Human
auuuugaaaaacugc

SEQ ID NO: 1301132 - RNA, 16 nt, Human
auuuucugguaaaaag

SEQ ID NO: 1301133 - RNA, 17 nt, Human
auuuucugguaaaaaga

SEQ ID NO: 1301134 - RNA, 22 nt, Human
auuuucuggauuccccaucuca

SEQ ID NO: 1301135 - RNA, 13 nt, Human
auuuugaaaaacu

SEQ ID NO: 1301136 - RNA, 18 nt, Human
auuuucuggaauacauga

SEQ ID NO: 1301137 - RNA, 19 nt, Human
auuuucuggaauacaugaa

SEQ ID NO: 1301138 - RNA, 22 nt, Human
auuuucuggaauacaugaaaua

SEQ ID NO: 1301139 - RNA, 18 nt, Human
auuuucuggccaguguuu

SEQ ID NO: 1301140 - RNA, 19 nt, Human
auuuucugcaucuccacuu

SEQ ID NO: 1301141 - RNA, 15 nt, Human
auuuucugcuacuuu

SEQ ID NO: 1301142 - RNA, 16 nt, Human
auuuucugcaucucca

SEQ ID NO: 1301143 - RNA, 15 nt, Human
auuuucugcaucucc

SEQ ID NO: 1301144 - RNA, 14 nt, Human
auuuucucccugga

SEQ ID NO: 1301145 - RNA, 18 nt, Human
auuuucucccuggauuuu

SEQ ID NO: 1301146 - RNA, 22 nt, Human
auuuucucccuggauuuuuacc

SEQ ID NO: 1301147 - RNA, 23 nt, Human
auuuucucccuggauuuuuacca

SEQ ID NO: 1301148 - RNA, 16 nt, Human
auuuucucucagguga

SEQ ID NO: 1301149 - RNA, 17 nt, Human
auuuucucucaggugaa

SEQ ID NO: 1301150 - RNA, 19 nt, Human
auuuucuauaauuuaaaua

SEQ ID NO: 1301151 - RNA, 23 nt, Human
auuuuaguuuuucauuaaauaaa

SEQ ID NO: 1301152 - RNA, 19 nt, Human
auuuuaguuuuucauuaaa

SEQ ID NO: 1301153 - RNA, 20 nt, Human
auuuuaguuuuucauuaaau

SEQ ID NO: 1301154 - RNA, 18 nt, Human
auuuucuauaauuuaaau

SEQ ID NO: 1301155 - RNA, 17 nt, Human
auuuucuauaauuuaaa

SEQ ID NO: 1301156 - RNA, 19 nt, Human
auuuguucuauagcuuuuc

SEQ ID NO: 1301157 - RNA, 13 nt, Human
auuuguucauauu

SEQ ID NO: 1301158 - RNA, 16 nt, Human
auuuguuauuuugcaa

SEQ ID NO: 1301159 - RNA, 13 nt, Human
auuuguuaaauug

SEQ ID NO: 1301160 - RNA, 18 nt, Human
auuuguuaauaguuccug

SEQ ID NO: 1301161 - RNA, 23 nt, Human
auuuguuaauuuagaaaacuuua

SEQ ID NO: 1301162 - RNA, 19 nt, Human
auuuguuaauuuagaaaac

SEQ ID NO: 1301163 - RNA, 17 nt, Human
auuuguuauuuugcaac

SEQ ID NO: 1301164 - RNA, 14 nt, Human
auuuguucccaaga

SEQ ID NO: 1301165 - RNA, 17 nt, Human
auuuguucccaagagca

SEQ ID NO: 1301166 - RNA, 13 nt, Human
auuuguucuugua

SEQ ID NO: 1301167 - RNA, 17 nt, Human
auuuguucuuguauuua

SEQ ID NO: 1301168 - RNA, 16 nt, Human
auuuguucuuguauuu

SEQ ID NO: 1301169 - RNA, 14 nt, Human
auuuguguugaaga

SEQ ID NO: 1301170 - RNA, 15 nt, Human
auuuguguugaagag

SEQ ID NO: 1301171 - RNA, 21 nt, Human
auuugcagcugagagaaaaua

SEQ ID NO: 1301172 - RNA, 18 nt, Human
auuuguguugaagagguu

SEQ ID NO: 1301173 - RNA, 22 nt, Human
auuuguguugaagagguuuuaa

SEQ ID NO: 1301174 - RNA, 13 nt, Human
auuuguguuuuaa

SEQ ID NO: 1301175 - RNA, 20 nt, Human
auuuguguuuuaauuuaaac

SEQ ID NO: 1301176 - RNA, 21 nt, Human
auuuguguuuuaauuuaaaca

SEQ ID NO: 1301177 - RNA, 20 nt, Human
auuuugaaagucuguccuug

SEQ ID NO: 1301178 - RNA, 15 nt, Human
auuuugaaagucugu

SEQ ID NO: 1301179 - RNA, 19 nt, Human
auuuugaaagucuguccuu

SEQ ID NO: 1301180 - RNA, 20 nt, Human
auuuugaaaucaugaagaua

SEQ ID NO: 1301181 - RNA, 16 nt, Human
auugagguaaguuuuu

SEQ ID NO: 1301182 - RNA, 14 nt, Human
auugagguaaguuu

SEQ ID NO: 1301183 - RNA, 21 nt, Human
auugaggcuugguuccuuccc

SEQ ID NO: 1301184 - RNA, 17 nt, Human
auugauaagaucuuuua

SEQ ID NO: 1301185 - RNA, 17 nt, Human
auuuaacuuuuaguaaa

SEQ ID NO: 1301186 - RNA, 23 nt, Human
auuuaacuuuuaguaaagucaag

SEQ ID NO: 1301187 - RNA, 15 nt, Human
auuuaagacacugaa

SEQ ID NO: 1301188 - RNA, 16 nt, Human
auuuaagacacugaaa

SEQ ID NO: 1301189 - RNA, 22 nt, Human
auuuaauagguuuggacaaaau

SEQ ID NO: 1301190 - RNA, 17 nt, Human
auuuaauagcaaagaau

SEQ ID NO: 1301191 - RNA, 18 nt, Human
auuuaauagcaaagaauu

SEQ ID NO: 1301192 - RNA, 15 nt, Human
auuuaagauaauuau

SEQ ID NO: 1301193 - RNA, 21 nt, Human
auuuaacuuuuaguaaaguca

SEQ ID NO: 1301194 - RNA, 23 nt, Human
auuuaagggggaaaaagugucaa

SEQ ID NO: 1301195 - RNA, 20 nt, Human
auuuaauagcaaagaauuga

SEQ ID NO: 1301196 - RNA, 12 nt, Human
auuuaauucaga

SEQ ID NO: 1301197 - RNA, 23 nt, Human
auuuaauauaaaguuuuauauau

SEQ ID NO: 1301198 - RNA, 18 nt, Human
auuuaauuugaaauaugg

SEQ ID NO: 1301199 - RNA, 14 nt, Human
auuuauauauguau

SEQ ID NO: 1301200 - RNA, 15 nt, Human
auuuauauauguauu

SEQ ID NO: 1301201 - RNA, 14 nt, Human
auuuauauauugaa

SEQ ID NO: 1301202 - RNA, 15 nt, Human
auuucaccuguaaac

SEQ ID NO: 1301203 - RNA, 16 nt, Human
auuucaccuguaaacc

SEQ ID NO: 1301204 - RNA, 18 nt, Human
auuucaccuguaaaccug

SEQ ID NO: 1301205 - RNA, 19 nt, Human
auuucaccuguaaaccuga

SEQ ID NO: 1301206 - RNA, 14 nt, Human
auuucaccuguaaa

SEQ ID NO: 1301207 - RNA, 19 nt, Human
auuucaggaggaauacuga

SEQ ID NO: 1301208 - RNA, 20 nt, Human
auuucaggaggaauacugaa

SEQ ID NO: 1301209 - RNA, 22 nt, Human
auuucaggaggaauacugaaca

SEQ ID NO: 1301210 - RNA, 19 nt, Human
auuucaggcauuggauauu

SEQ ID NO: 1301211 - RNA, 18 nt, Human
auuuauccugaaauuuca

SEQ ID NO: 1301212 - RNA, 19 nt, Human
auuuauccugaaauuucag

SEQ ID NO: 1301213 - RNA, 20 nt, Human
auuuauccugaaauuucaga

SEQ ID NO: 1301214 - RNA, 21 nt, Human
auuuauccugaaauuucagau

SEQ ID NO: 1301215 - RNA, 17 nt, Human
auuuaucgcagaccuuu

SEQ ID NO: 1301216 - RNA, 19 nt, Human
auuuaucgcugggaaauga

SEQ ID NO: 1301217 - RNA, 21 nt, Human
auuuaucgcugggaaaugaga

SEQ ID NO: 1301218 - RNA, 17 nt, Human
auuuaucuaaauaugga

SEQ ID NO: 1301219 - RNA, 10 nt, Human
auuuaucuau

SEQ ID NO: 1301220 - RNA, 11 nt, Human
auuuaucuaua

SEQ ID NO: 1301221 - RNA, 15 nt, Human
auuuaucuauaauuu

SEQ ID NO: 1301222 - RNA, 15 nt, Human
auuuaucuaaauaug

SEQ ID NO: 1301223 - RNA, 19 nt, Human
auuucacaacagccugaca

SEQ ID NO: 1301224 - RNA, 13 nt, Human
auuucugcauaug

SEQ ID NO: 1301225 - RNA, 14 nt, Human
auuucuuaacuucu

SEQ ID NO: 1301226 - RNA, 14 nt, Human
auuucuuaaacacu

SEQ ID NO: 1301227 - RNA, 21 nt, Human
auuucugaggugcacugggag

SEQ ID NO: 1301228 - RNA, 20 nt, Human
auuaaauuuuuuuuacauuu

SEQ ID NO: 1301229 - RNA, 18 nt, Human
auuaacaaaauguauguc

SEQ ID NO: 1301230 - RNA, 19 nt, Human
auuaacaaaauguaugucu

SEQ ID NO: 1301231 - RNA, 19 nt, Human
auuaaauuuuuuuuacauu

SEQ ID NO: 1301232 - RNA, 18 nt, Human
auuaaauuuuuuuuacau

SEQ ID NO: 1301233 - RNA, 17 nt, Human
auuaaauuuuuuuuaca

SEQ ID NO: 1301234 - RNA, 20 nt, Human
auuaaauuuuuuaaaaagca

SEQ ID NO: 1301235 - RNA, 17 nt, Human
auuaaauuuuuuguuga

SEQ ID NO: 1301236 - RNA, 18 nt, Human
auuaaauuuuuuguugac

SEQ ID NO: 1301237 - RNA, 19 nt, Human
auuaaauuuuuuguugaca

SEQ ID NO: 1301238 - RNA, 21 nt, Human
auuaacaugaauauuuagugu

SEQ ID NO: 1301239 - RNA, 12 nt, Human
auuaacauaccu

SEQ ID NO: 1301240 - RNA, 23 nt, Human
auuaacauaccuaagaaguacau

SEQ ID NO: 1301241 - RNA, 24 nt, Human
auuaacauaccuaagaaguacauu

SEQ ID NO: 1301242 - RNA, 18 nt, Human
auuaacauaggugaaagu

SEQ ID NO: 1301243 - RNA, 19 nt, Human
auuaacaauuaggcagacu

SEQ ID NO: 1301244 - RNA, 15 nt, Human
auuaauggaaauguu

SEQ ID NO: 1301245 - RNA, 14 nt, Human
auuaaugcccagac

SEQ ID NO: 1301246 - RNA, 13 nt, Human
auuaaugcccaga

SEQ ID NO: 1301247 - RNA, 13 nt, Human
auuaaugcacuuu

SEQ ID NO: 1301248 - RNA, 14 nt, Human
auuaaugcacuuuc

SEQ ID NO: 1301249 - RNA, 15 nt, Human
auuaaugcacuuucu

SEQ ID NO: 1301250 - RNA, 16 nt, Human
auuaaugcacuuucua

SEQ ID NO: 1301251 - RNA, 19 nt, Human
auuaauugggccagcuuuu

SEQ ID NO: 1301252 - RNA, 22 nt, Human
auuaauugggccagcuuuucaa

SEQ ID NO: 1301253 - RNA, 13 nt, Human
auuaauuguaauc

SEQ ID NO: 1301254 - RNA, 20 nt, Human
auuaauuguaaucugaauaa

SEQ ID NO: 1301255 - RNA, 16 nt, Human
auuaauuuaugcagaa

SEQ ID NO: 1301256 - RNA, 14 nt, Human
auuaauuucuucac

SEQ ID NO: 1301257 - RNA, 17 nt, Human
auuaauuuaugcagaau

SEQ ID NO: 1301258 - RNA, 15 nt, Human
auuacaggcuccugc

SEQ ID NO: 1301259 - RNA, 16 nt, Human
auuacaggcuccugcc

SEQ ID NO: 1301260 - RNA, 14 nt, Human
auuacacuugguaa

SEQ ID NO: 1301261 - RNA, 13 nt, Human
auuacagaaauuu

SEQ ID NO: 1301262 - RNA, 19 nt, Human
auuacacuugguaauugua

SEQ ID NO: 1301263 - RNA, 17 nt, Human
auuacaggcuccugcca

SEQ ID NO: 1301264 - RNA, 19 nt, Human
auuacaggcuccugccacc

SEQ ID NO: 1301265 - RNA, 13 nt, Human
auuacagguguga

SEQ ID NO: 1301266 - RNA, 15 nt, Human
auuacaggcuugagc

SEQ ID NO: 1301267 - RNA, 18 nt, Human
auuaauuuuaguuuuuca

SEQ ID NO: 1301268 - RNA, 19 nt, Human
auuacaaguauuuuuaauu

SEQ ID NO: 1301269 - RNA, 14 nt, Human
auuacaaguauuuu

SEQ ID NO: 1301270 - RNA, 14 nt, Human
auuacacccaaaga

SEQ ID NO: 1301271 - RNA, 22 nt, Human
auugaggacacugauauggguc

SEQ ID NO: 1301272 - RNA, 21 nt, Human
auugagcuggaccucaccaag

SEQ ID NO: 1301273 - RNA, 14 nt, Human
auugagcuugcaug

SEQ ID NO: 1301274 - RNA, 17 nt, Human
auucguuaucuaauagg

SEQ ID NO: 1301275 - RNA, 13 nt, Human
auucguucugugg

SEQ ID NO: 1301276 - RNA, 21 nt, Human
auucgguauccccccaucuug

SEQ ID NO: 1301277 - RNA, 21 nt, Human
auucggugugcaccaggguug

SEQ ID NO: 1301278 - RNA, 22 nt, Human
auucguagauauuggacaaaga

SEQ ID NO: 1301279 - RNA, 12 nt, Human
auucgugaaaac

SEQ ID NO: 1301280 - RNA, 19 nt, Human
auucgugaaaacacauuug

SEQ ID NO: 1301281 - RNA, 16 nt, Human
auucguguguuuuuuu

SEQ ID NO: 1301282 - RNA, 14 nt, Human
auucauuguguuac

SEQ ID NO: 1301283 - RNA, 14 nt, Human
auucauuuaaguca

SEQ ID NO: 1301284 - RNA, 22 nt, Human
auuccuuuguuacuucucuaau

SEQ ID NO: 1301285 - RNA, 16 nt, Human
auucgaaugacacugu

SEQ ID NO: 1301286 - RNA, 17 nt, Human
auucgccacacaguauu

SEQ ID NO: 1301287 - RNA, 18 nt, Human
auucgccacacaguauuu

SEQ ID NO: 1301288 - RNA, 19 nt, Human
auucgccacacaguauuuu

SEQ ID NO: 1301289 - RNA, 21 nt, Human
auucgcuacuaugauuuaauu

SEQ ID NO: 1301290 - RNA, 22 nt, Human
auucucugugucuaagauucua

SEQ ID NO: 1301291 - RNA, 23 nt, Human
auucucugugucuaagauucuag

SEQ ID NO: 1301292 - RNA, 15 nt, Human
auucucuuguauaag

SEQ ID NO: 1301293 - RNA, 18 nt, Human
auucucuuguauaagauc

SEQ ID NO: 1301294 - RNA, 13 nt, Human
auucuuucccaac

SEQ ID NO: 1301295 - RNA, 20 nt, Human
auucuuuccauuugcauuug

SEQ ID NO: 1301296 - RNA, 22 nt, Human
auucuuuccauuugcauuuguu

SEQ ID NO: 1301297 - RNA, 15 nt, Human
auucuuuccauuugc

SEQ ID NO: 1301298 - RNA, 16 nt, Human
auucuuuccauuugca

SEQ ID NO: 1301299 - RNA, 17 nt, Human
auucuuuccauuugcau

SEQ ID NO: 1301300 - RNA, 19 nt, Human
auucuuuccauuugcauuu

SEQ ID NO: 1301301 - RNA, 13 nt, Human
auucuuucaauac

SEQ ID NO: 1301302 - RNA, 16 nt, Human
auucuuucaauacaga

SEQ ID NO: 1301303 - RNA, 18 nt, Human
auucuuucaauacagaua

SEQ ID NO: 1301304 - RNA, 19 nt, Human
auucuuucaauacagauau

SEQ ID NO: 1301305 - RNA, 20 nt, Human
auucuuucaauacagauaua

SEQ ID NO: 1301306 - RNA, 22 nt, Human
auucuuucaauacagauauauu

SEQ ID NO: 1301307 - RNA, 21 nt, Human
auucuuucaauacagauauau

SEQ ID NO: 1301308 - RNA, 18 nt, Human
auucauuccauucuggaa

SEQ ID NO: 1301309 - RNA, 19 nt, Human
auucauuccauucuggaag

SEQ ID NO: 1301310 - RNA, 17 nt, Human
auucauuccauucugga

SEQ ID NO: 1301311 - RNA, 12 nt, Human
auucauuccauu

SEQ ID NO: 1301312 - RNA, 15 nt, Human
auucauuagucaugu

SEQ ID NO: 1301313 - RNA, 16 nt, Human
auucauuagucauguu

SEQ ID NO: 1301314 - RNA, 16 nt, Human
auucauaugcauauuu

SEQ ID NO: 1301315 - RNA, 18 nt, Human
auucauaugcauauuuuu

SEQ ID NO: 1301316 - RNA, 15 nt, Human
auucauaugcauauu

SEQ ID NO: 1301317 - RNA, 14 nt, Human
auucauaugcauau

SEQ ID NO: 1301318 - RNA, 13 nt, Human
auucauaugcaua

SEQ ID NO: 1301319 - RNA, 20 nt, Human
auucauagucuuuggagaaa

SEQ ID NO: 1301320 - RNA, 19 nt, Human
auucauaguaacuucuuau

SEQ ID NO: 1301321 - RNA, 13 nt, Human
auucaauaaagcu

SEQ ID NO: 1301322 - RNA, 12 nt, Human
auucaauaaagc

SEQ ID NO: 1301323 - RNA, 20 nt, Human
auucaaguguaaaauauuuu

SEQ ID NO: 1301324 - RNA, 21 nt, Human
auucaaguguaaaauauuuug

SEQ ID NO: 1301325 - RNA, 20 nt, Human
auuaugugacauuuuacauu

SEQ ID NO: 1301326 - RNA, 22 nt, Human
auucaaggaauuucuuaacuuc

SEQ ID NO: 1301327 - RNA, 23 nt, Human
auuaugugccagauuuaugcaua

SEQ ID NO: 1301328 - RNA, 21 nt, Human
auuaugugccagauuuaugca

SEQ ID NO: 1301329 - RNA, 13 nt, Human
auuaugugccaga

SEQ ID NO: 1301330 - RNA, 19 nt, Human
auuaugugacauuuuacau

SEQ ID NO: 1301331 - RNA, 13 nt, Human
auuaugugacauu

SEQ ID NO: 1301332 - RNA, 12 nt, Human
auuauguaaauu

SEQ ID NO: 1301333 - RNA, 12 nt, Human
auuauguagcuc

SEQ ID NO: 1301334 - RNA, 14 nt, Human
auuauguagcucuu

SEQ ID NO: 1301335 - RNA, 15 nt, Human
auuauguagcucuuu

SEQ ID NO: 1301336 - RNA, 19 nt, Human
auuauguagcucuuuguca

SEQ ID NO: 1301337 - RNA, 16 nt, Human
auuauguagcucuuug

SEQ ID NO: 1301338 - RNA, 21 nt, Human
auuagagggaggagaaugagc

SEQ ID NO: 1301339 - RNA, 16 nt, Human
auuagagugucuuucc

SEQ ID NO: 1301340 - RNA, 17 nt, Human
auuagagugucuuucca

SEQ ID NO: 1301341 - RNA, 23 nt, Human
auuagagugucuuuccacggagc

SEQ ID NO: 1301342 - RNA, 18 nt, Human
auuagauaaauguccauu

SEQ ID NO: 1301343 - RNA, 15 nt, Human
auuuaccacuugugu

SEQ ID NO: 1301344 - RNA, 16 nt, Human
auuuacaucauuucuu

SEQ ID NO: 1301345 - RNA, 22 nt, Human
auuuaccacuuguguuuugcaa

SEQ ID NO: 1301346 - RNA, 19 nt, Human
auuuacauguuuuaaagaa

SEQ ID NO: 1301347 - RNA, 15 nt, Human
auuuacauuuaauag

SEQ ID NO: 1301348 - RNA, 19 nt, Human
auuuaaauguaaagacaaa

SEQ ID NO: 1301349 - RNA, 13 nt, Human
auuuaaaucuguu

SEQ ID NO: 1301350 - RNA, 15 nt, Human
auuuacaggaacuuc

SEQ ID NO: 1301351 - RNA, 16 nt, Human
auuuacaggaacuuca

SEQ ID NO: 1301352 - RNA, 16 nt, Human
auuuaaauagcuuuuu

SEQ ID NO: 1301353 - RNA, 23 nt, Human
auuuaaaauagcaaaagaagaag

SEQ ID NO: 1301354 - RNA, 21 nt, Human
auuuaaauacagucuuccauu

SEQ ID NO: 1301355 - RNA, 16 nt, Human
auuguaguccuguaau

SEQ ID NO: 1301356 - RNA, 17 nt, Human
auuguagcauccuggaa

SEQ ID NO: 1301357 - RNA, 20 nt, Human
auuguagcauccuggaauau

SEQ ID NO: 1301358 - RNA, 21 nt, Human
auuguacuaaagccaaacaua

SEQ ID NO: 1301359 - RNA, 20 nt, Human
auuguagcgucuuucuuuuu

SEQ ID NO: 1301360 - RNA, 13 nt, Human
auuguaguaaucu

SEQ ID NO: 1301361 - RNA, 14 nt, Human
auuguagugcuuug

SEQ ID NO: 1301362 - RNA, 23 nt, Human
auuguagugcuuugagagagaaa

SEQ ID NO: 1301363 - RNA, 19 nt, Human
auuguuuuaucugaauuuu

SEQ ID NO: 1301364 - RNA, 17 nt, Human
auuuaaaaaaaaaccug

SEQ ID NO: 1301365 - RNA, 14 nt, Human
auuuaaaagccugc

SEQ ID NO: 1301366 - RNA, 15 nt, Human
auuuaaaagccugcu

SEQ ID NO: 1301367 - RNA, 17 nt, Human
auuuaaaagccugcuca

SEQ ID NO: 1301368 - RNA, 15 nt, Human
auuuaaaagugucaa

SEQ ID NO: 1301369 - RNA, 16 nt, Human
auuuaaaauaauuaua

SEQ ID NO: 1301370 - RNA, 13 nt, Human
auuuaaaauagca

SEQ ID NO: 1301371 - RNA, 15 nt, Human
auuuaaaauagcaaa

SEQ ID NO: 1301372 - RNA, 18 nt, Human
auuuaaaauagcaaaaga

SEQ ID NO: 1301373 - RNA, 20 nt, Human
auuuaaaauagcaaaagaag

SEQ ID NO: 1301374 - RNA, 21 nt, Human
auuuaaaauagcaaaagaaga

SEQ ID NO: 1301375 - RNA, 22 nt, Human
auuuaaaauagcaaaagaagaa

SEQ ID NO: 1301376 - RNA, 15 nt, Human
auuuauaaacuuuuu

SEQ ID NO: 1301377 - RNA, 22 nt, Human
auuuauaaauauauuuaagaua

SEQ ID NO: 1301378 - RNA, 20 nt, Human
auuuauaacguguucaauau

SEQ ID NO: 1301379 - RNA, 15 nt, Human
auuuaugguuguuaa

SEQ ID NO: 1301380 - RNA, 23 nt, Human
auuuaugguuguuaaaaauguca

SEQ ID NO: 1301381 - RNA, 14 nt, Human
auuuauguauggug

SEQ ID NO: 1301382 - RNA, 12 nt, Human
auuuauguauug

SEQ ID NO: 1301383 - RNA, 14 nt, Human
auuuauguauugug

SEQ ID NO: 1301384 - RNA, 17 nt, Human
auuuauguauugugcaa

SEQ ID NO: 1301385 - RNA, 18 nt, Human
auuuauguauugugcaau

SEQ ID NO: 1301386 - RNA, 19 nt, Human
auuuauguauugugcaaug

SEQ ID NO: 1301387 - RNA, 15 nt, Human
auuuauguccaggug

SEQ ID NO: 1301388 - RNA, 22 nt, Human
auuuauguauugugcaaugugu

SEQ ID NO: 1301389 - RNA, 17 nt, Human
auuuaguguucauaaau

SEQ ID NO: 1301390 - RNA, 13 nt, Human
auuuagaaaacuu

SEQ ID NO: 1301391 - RNA, 14 nt, Human
auuuagaaaacuuu

SEQ ID NO: 1301392 - RNA, 17 nt, Human
auuuagaaaacuuuaaa

SEQ ID NO: 1301393 - RNA, 16 nt, Human
auuuaguuguaaacca

SEQ ID NO: 1301394 - RNA, 15 nt, Human
auuuaguuguuguag

SEQ ID NO: 1301395 - RNA, 20 nt, Human
auuuaguuguuguagagaaa

SEQ ID NO: 1301396 - RNA, 19 nt, Human
auuuaguuguuguagagaa

SEQ ID NO: 1301397 - RNA, 18 nt, Human
auuuaguuguuguagaga

SEQ ID NO: 1301398 - RNA, 16 nt, Human
auuuaguguucauaaa

SEQ ID NO: 1301399 - RNA, 21 nt, Human
auuuauugcaggauggugucu

SEQ ID NO: 1301400 - RNA, 19 nt, Human
auuuauuacuguaagaaaa

SEQ ID NO: 1301401 - RNA, 20 nt, Human
auuuauuacuguaagaaaau

SEQ ID NO: 1301402 - RNA, 14 nt, Human
auuuauugguuuug

SEQ ID NO: 1301403 - RNA, 15 nt, Human
auuuauugguuuugc

SEQ ID NO: 1301404 - RNA, 16 nt, Human
auuuauuguauucugg

SEQ ID NO: 1301405 - RNA, 12 nt, Human
auuuauuuugac

SEQ ID NO: 1301406 - RNA, 13 nt, Human
auuuauuuugaca

SEQ ID NO: 1301407 - RNA, 14 nt, Human
auuuauuuugacau

SEQ ID NO: 1301408 - RNA, 21 nt, Human
auuuauuuugacauaaaguug

SEQ ID NO: 1301409 - RNA, 17 nt, Human
auuuauuuuuucuuuuc

SEQ ID NO: 1301410 - RNA, 22 nt, Human
auuuauuuuuucuuuucuuuac

SEQ ID NO: 1301411 - RNA, 20 nt, Human
auuucauguacugcauuauu

SEQ ID NO: 1301412 - RNA, 21 nt, Human
auuucauguacugcauuauuu

SEQ ID NO: 1301413 - RNA, 16 nt, Human
auuucauguuuuugau

SEQ ID NO: 1301414 - RNA, 16 nt, Human
auuucauguacugcau

SEQ ID NO: 1301415 - RNA, 12 nt, Human
auuucauguacu

SEQ ID NO: 1301416 - RNA, 15 nt, Human
auuucaugauuucau

SEQ ID NO: 1301417 - RNA, 18 nt, Human
auuucaugcuaucucugu

SEQ ID NO: 1301418 - RNA, 14 nt, Human
auuucaugaaaauu

SEQ ID NO: 1301419 - RNA, 15 nt, Human
auuucaugauuagaa

SEQ ID NO: 1301420 - RNA, 19 nt, Human
auuuccucuguaaucuauu

SEQ ID NO: 1301421 - RNA, 23 nt, Human
auuuccuugaauguggcuugaga

SEQ ID NO: 1301422 - RNA, 20 nt, Human
auuuccuaugauguauacug

SEQ ID NO: 1301423 - RNA, 21 nt, Human
auuuccuaugauguauacugc

SEQ ID NO: 1301424 - RNA, 19 nt, Human
auuuccuauuuuuggaaga

SEQ ID NO: 1301425 - RNA, 16 nt, Human
auuuccuccacaaauu

SEQ ID NO: 1301426 - RNA, 20 nt, Human
auuuccuccgucaccucaga

SEQ ID NO: 1301427 - RNA, 19 nt, Human
auuuccuuuuuuguuauua

SEQ ID NO: 1301428 - RNA, 17 nt, Human
auuucggauuuuuucca

SEQ ID NO: 1301429 - RNA, 19 nt, Human
auuucggauuuuuuccaaa

SEQ ID NO: 1301430 - RNA, 20 nt, Human
auuucggauuuuuuccaaaa

SEQ ID NO: 1301431 - RNA, 21 nt, Human
auuucgucuguuuauaaacau

SEQ ID NO: 1301432 - RNA, 14 nt, Human
auuucuaaaaucuu

SEQ ID NO: 1301433 - RNA, 17 nt, Human
auuucuuaacuucuugc

SEQ ID NO: 1301434 - RNA, 19 nt, Human
auuucuuaacuucuugcuu

SEQ ID NO: 1301435 - RNA, 21 nt, Human
auuuccuaaauauauuuuaag

SEQ ID NO: 1301436 - RNA, 17 nt, Human
auuuccuaauacuguca

SEQ ID NO: 1301437 - RNA, 21 nt, Human
auuuccuaauacugucauccu

SEQ ID NO: 1301438 - RNA, 16 nt, Human
auuuccuaugauguau

SEQ ID NO: 1301439 - RNA, 15 nt, Human
auuuccuaugaugua

SEQ ID NO: 1301440 - RNA, 14 nt, Human
auuuccuaugaugu

SEQ ID NO: 1301441 - RNA, 18 nt, Human
auuuccuaucaccuauuu

SEQ ID NO: 1301442 - RNA, 19 nt, Human
auuuccuaauuuugagaaa

SEQ ID NO: 1301443 - RNA, 14 nt, Human
auuuccuaaauaua

SEQ ID NO: 1301444 - RNA, 12 nt, Human
auuugguuuuca

SEQ ID NO: 1301445 - RNA, 14 nt, Human
auuugguuuucaca

SEQ ID NO: 1301446 - RNA, 15 nt, Human
auuugguuuucacau

SEQ ID NO: 1301447 - RNA, 17 nt, Human
auuuguaauagauguuu

SEQ ID NO: 1301448 - RNA, 22 nt, Human
auuuguaauagauguuugauag

SEQ ID NO: 1301449 - RNA, 19 nt, Human
auuuguaaugucuugagcu

SEQ ID NO: 1301450 - RNA, 20 nt, Human
auuuguaaugucuugagcuc

SEQ ID NO: 1301451 - RNA, 23 nt, Human
auuuguaaugucuugagcucuau

SEQ ID NO: 1301452 - RNA, 13 nt, Human
auuuguaauuaaa

SEQ ID NO: 1301453 - RNA, 19 nt, Human
auuuguaauuaaaagcaaa

SEQ ID NO: 1301454 - RNA, 21 nt, Human
auuuguaauuaaaagcaaauc

SEQ ID NO: 1301455 - RNA, 22 nt, Human
auuuguaauuaaaagcaaauca

SEQ ID NO: 1301456 - RNA, 23 nt, Human
auuuguaauuaaaagcaaaucau

SEQ ID NO: 1301457 - RNA, 21 nt, Human
auuuguacauaguuauuuauu

SEQ ID NO: 1301458 - RNA, 20 nt, Human
auuuggaucucuucuuaaug

SEQ ID NO: 1301459 - RNA, 15 nt, Human
auuuggauccugugu

SEQ ID NO: 1301460 - RNA, 18 nt, Human
auuuggauuuaaaagccu

SEQ ID NO: 1301461 - RNA, 20 nt, Human
auuuggauuuaaaagccugc

SEQ ID NO: 1301462 - RNA, 23 nt, Human
auuuggauuuaaaagccugcuca

SEQ ID NO: 1301463 - RNA, 20 nt, Human
auuuggcaucccugggccuu

SEQ ID NO: 1301464 - RNA, 19 nt, Human
auuuggcaaugccaucauc

SEQ ID NO: 1301465 - RNA, 14 nt, Human
auuuggcaucccug

SEQ ID NO: 1301466 - RNA, 16 nt, Human
auuuggcaucccuggg

SEQ ID NO: 1301467 - RNA, 16 nt, Human
auuugguucauuaauu

SEQ ID NO: 1301468 - RNA, 21 nt, Human
auuugguucauuaauucuaua

SEQ ID NO: 1301469 - RNA, 17 nt, Human
auuuggcaucccugggc

SEQ ID NO: 1301470 - RNA, 18 nt, Human
auuugauaugugaacagu

SEQ ID NO: 1301471 - RNA, 19 nt, Human
auuugauaugugaacaguu

SEQ ID NO: 1301472 - RNA, 17 nt, Human
auuugauauuuuuuaaa

SEQ ID NO: 1301473 - RNA, 18 nt, Human
auuugagagaaauaugaa

SEQ ID NO: 1301474 - RNA, 20 nt, Human
auuugauguggugaaaagca

SEQ ID NO: 1301475 - RNA, 13 nt, Human
auuugauguaaua

SEQ ID NO: 1301476 - RNA, 17 nt, Human
auuugauguaauacuuc

SEQ ID NO: 1301477 - RNA, 18 nt, Human
auuugauguaauacuucu

SEQ ID NO: 1301478 - RNA, 19 nt, Human
auuuggagggaagcucuug

SEQ ID NO: 1301479 - RNA, 23 nt, Human
auuuggagggaagcucuuggagc

SEQ ID NO: 1301480 - RNA, 21 nt, Human
auuuggaguguuccccuucca

SEQ ID NO: 1301481 - RNA, 16 nt, Human
auuucuuugaaaaaaa

SEQ ID NO: 1301482 - RNA, 18 nt, Human
auuugagaagcugcucaa

SEQ ID NO: 1301483 - RNA, 20 nt, Human
auuugagaagcugcucaacu

SEQ ID NO: 1301484 - RNA, 17 nt, Human
auuugagagaaauauga

SEQ ID NO: 1301485 - RNA, 12 nt, Human
auuucuuugaaa

SEQ ID NO: 1301486 - RNA, 15 nt, Human
auuucuuugaaaaaa

SEQ ID NO: 1301487 - RNA, 22 nt, Human
auuucuuugaaaaaaaauaaau

SEQ ID NO: 1301488 - RNA, 14 nt, Human
auuggaaacaaguc

SEQ ID NO: 1301489 - RNA, 19 nt, Human
auugcgagagauguguguu

SEQ ID NO: 1301490 - RNA, 17 nt, Human
auugccuuuuuucugua

SEQ ID NO: 1301491 - RNA, 18 nt, Human
auugccuuuuuucuguau

SEQ ID NO: 1301492 - RNA, 23 nt, Human
auugccuuuuuucuguauaaaug

SEQ ID NO: 1301493 - RNA, 13 nt, Human
auugcgagagaug

SEQ ID NO: 1301494 - RNA, 14 nt, Human
auugcgagagaugu

SEQ ID NO: 1301495 - RNA, 15 nt, Human
auugcgagagaugug

SEQ ID NO: 1301496 - RNA, 16 nt, Human
auugcgagagaugugu

SEQ ID NO: 1301497 - RNA, 17 nt, Human
auugcgagagaugugug

SEQ ID NO: 1301498 - RNA, 18 nt, Human
auugcgagagaugugugu

SEQ ID NO: 1301499 - RNA, 16 nt, Human
auuggaaauuuagcau

SEQ ID NO: 1301500 - RNA, 14 nt, Human
auuggaacuggagg

SEQ ID NO: 1301501 - RNA, 18 nt, Human
auuggaacuggaggcagg

SEQ ID NO: 1301502 - RNA, 15 nt, Human
auuggaacuggaggc

SEQ ID NO: 1301503 - RNA, 21 nt, Human
auuggaagagcagcaccuccu

SEQ ID NO: 1301504 - RNA, 22 nt, Human
auuggaagagcagcaccuccuc

SEQ ID NO: 1301505 - RNA, 24 nt, Human
auuggaagagcagcaccuccucag

SEQ ID NO: 1301506 - RNA, 15 nt, Human
auuggacccuuccau

SEQ ID NO: 1301507 - RNA, 16 nt, Human
auugcauuuccugaca

SEQ ID NO: 1301508 - RNA, 11 nt, Human
auugcauugac

SEQ ID NO: 1301509 - RNA, 14 nt, Human
auugcauugacuuu

SEQ ID NO: 1301510 - RNA, 15 nt, Human
auugcauugacuuuc

SEQ ID NO: 1301511 - RNA, 16 nt, Human
auugcaucaaagcauc

SEQ ID NO: 1301512 - RNA, 15 nt, Human
auugcaucucccaga

SEQ ID NO: 1301513 - RNA, 22 nt, Human
auugcaucucccagauaaugug

SEQ ID NO: 1301514 - RNA, 23 nt, Human
auugcaucucccagauaauguga

SEQ ID NO: 1301515 - RNA, 23 nt, Human
auuggggaagagagccugcagga

SEQ ID NO: 1301516 - RNA, 15 nt, Human
auuguacuaaagcca

SEQ ID NO: 1301517 - RNA, 22 nt, Human
auuguacuaaagccaaacauau

SEQ ID NO: 1301518 - RNA, 23 nt, Human
auuggccuguagaguugcugaga

SEQ ID NO: 1301519 - RNA, 16 nt, Human
auuggggaagagagcc

SEQ ID NO: 1301520 - RNA, 22 nt, Human
auuggggaagagagccugcagg

SEQ ID NO: 1301521 - RNA, 12 nt, Human
auuggccuguag

SEQ ID NO: 1301522 - RNA, 20 nt, Human
auuggccuguagaguugcug

SEQ ID NO: 1301523 - RNA, 21 nt, Human
auuggccuguagaguugcuga

SEQ ID NO: 1301524 - RNA, 22 nt, Human
auuggccuguagaguugcugag

SEQ ID NO: 1301525 - RNA, 17 nt, Human
auuggcuauuuaaaacu

SEQ ID NO: 1301526 - RNA, 18 nt, Human
auuggcuauuuaaaacuu

SEQ ID NO: 1301527 - RNA, 16 nt, Human
auuggagcucguggaa

SEQ ID NO: 1301528 - RNA, 17 nt, Human
auuggagcucgugggac

SEQ ID NO: 1301529 - RNA, 19 nt, Human
auuggagcucgugggacag

SEQ ID NO: 1301530 - RNA, 15 nt, Human
auuggcauggaaauu

SEQ ID NO: 1301531 - RNA, 21 nt, Human
auuggcauggaaauuuaaagc

SEQ ID NO: 1301532 - RNA, 23 nt, Human
auuggcauggaaauuuaaagcag

SEQ ID NO: 1301533 - RNA, 22 nt, Human
auuggcauggaaauuuaaagca

SEQ ID NO: 1301534 - RNA, 15 nt, Human
auugcacauuguaaa

SEQ ID NO: 1301535 - RNA, 15 nt, Human
auugcacguggccuc

SEQ ID NO: 1301536 - RNA, 16 nt, Human
auugcacguggccucu

SEQ ID NO: 1301537 - RNA, 17 nt, Human
auugcacguggccucuu

SEQ ID NO: 1301538 - RNA, 19 nt, Human
auugcacguggccucuuga

SEQ ID NO: 1301539 - RNA, 23 nt, Human
auugcacguggccucuugagcag

SEQ ID NO: 1301540 - RNA, 19 nt, Human
auugacaaaauguuauuuc

SEQ ID NO: 1301541 - RNA, 22 nt, Human
auugacaaaauguuauuucccu

SEQ ID NO: 1301542 - RNA, 17 nt, Human
auugacaaaauguuauu

SEQ ID NO: 1301543 - RNA, 16 nt, Human
auugacaaaauguuau

SEQ ID NO: 1301544 - RNA, 14 nt, Human
auugauuugaagaa

SEQ ID NO: 1301545 - RNA, 16 nt, Human
auugauuugaagaaca

SEQ ID NO: 1301546 - RNA, 12 nt, Human
auugauuugcau

SEQ ID NO: 1301547 - RNA, 13 nt, Human
auugauuugcauu

SEQ ID NO: 1301548 - RNA, 15 nt, Human
auugauuugcauuga

SEQ ID NO: 1301549 - RNA, 16 nt, Human
auugauuugcauugaa

SEQ ID NO: 1301550 - RNA, 20 nt, Human
auugauuugcauugaacaca

SEQ ID NO: 1301551 - RNA, 12 nt, Human
auugauuuuugg

SEQ ID NO: 1301552 - RNA, 12 nt, Human
auugauuuugaa

SEQ ID NO: 1301553 - RNA, 13 nt, Human
auugauuuugaac

SEQ ID NO: 1301554 - RNA, 19 nt, Human
auugauuuuuauaaauacu

SEQ ID NO: 1301555 - RNA, 15 nt, Human
auugacaaaauguua

SEQ ID NO: 1301556 - RNA, 14 nt, Human
auugacaaaauguu

SEQ ID NO: 1301557 - RNA, 13 nt, Human
auugacaaaaugu

SEQ ID NO: 1301558 - RNA, 21 nt, Human
auugaauuaucuugguugaaa

SEQ ID NO: 1301559 - RNA, 17 nt, Human
auugaauucauuucacu

SEQ ID NO: 1301560 - RNA, 18 nt, Human
auugaauucauuucacug

SEQ ID NO: 1301561 - RNA, 20 nt, Human
auugaauucuugguugagga

SEQ ID NO: 1301562 - RNA, 22 nt, Human
auugaauucuugguugaggaaa

SEQ ID NO: 1301563 - RNA, 23 nt, Human
auugaauucuugguugaggaaac

SEQ ID NO: 1301564 - RNA, 21 nt, Human
auugaauggcuauguuuuuaa

SEQ ID NO: 1301565 - RNA, 22 nt, Human
auugaauggcuauguuuuuaau

SEQ ID NO: 1301566 - RNA, 23 nt, Human
auugaauggcuauguuuuuaaug

SEQ ID NO: 1301567 - RNA, 13 nt, Human
auugaauuaucuu

SEQ ID NO: 1301568 - RNA, 15 nt, Human
auugaaguaaacuuu

SEQ ID NO: 1301569 - RNA, 22 nt, Human
auugaaguaaacuuuuuguucu

SEQ ID NO: 1301570 - RNA, 19 nt, Human
auugaaguauuuugcugga

SEQ ID NO: 1301571 - RNA, 16 nt, Human
auugaaguaaacuuuu

SEQ ID NO: 1301572 - RNA, 20 nt, Human
auugaagucaauuacucuau

SEQ ID NO: 1301573 - RNA, 13 nt, Human
auugaauacuuug

SEQ ID NO: 1301574 - RNA, 14 nt, Human
auugaauacuuuga

SEQ ID NO: 1301575 - RNA, 15 nt, Human
auugaauacuuugaa

SEQ ID NO: 1301576 - RNA, 16 nt, Human
auugaauacuuugaau

SEQ ID NO: 1301577 - RNA, 20 nt, Human
auugaauacuuugaaugugu

SEQ ID NO: 1301578 - RNA, 18 nt, Human
auugaauacuuugaaugu

SEQ ID NO: 1301579 - RNA, 21 nt, Human
auuccuauacgcagcgugcuu

SEQ ID NO: 1301580 - RNA, 14 nt, Human
auugaacacaaacu

SEQ ID NO: 1301581 - RNA, 15 nt, Human
auugaacacaaacug

SEQ ID NO: 1301582 - RNA, 16 nt, Human
auugaacacaaacugu

SEQ ID NO: 1301583 - RNA, 17 nt, Human
auugaacacaaacugua

SEQ ID NO: 1301584 - RNA, 18 nt, Human
auugaacacaaacuguaa

SEQ ID NO: 1301585 - RNA, 19 nt, Human
auugaacacaaacuguaaa

SEQ ID NO: 1301586 - RNA, 20 nt, Human
auugaacacaaacuguaaau

SEQ ID NO: 1301587 - RNA, 15 nt, Human
auugaaggcuuaaac

SEQ ID NO: 1301588 - RNA, 19 nt, Human
auugaaggcuuaaacccau

SEQ ID NO: 1301589 - RNA, 15 nt, Human
auguguguuuuaaaa

SEQ ID NO: 1301590 - RNA, 17 nt, Human
auguguuucacaguuug

SEQ ID NO: 1301591 - RNA, 18 nt, Human
auguguuucacaguuuga

SEQ ID NO: 1301592 - RNA, 20 nt, Human
auguguuucacaguuugaaa

SEQ ID NO: 1301593 - RNA, 21 nt, Human
auguguuucacaguuugaaau

SEQ ID NO: 1301594 - RNA, 22 nt, Human
auguguuucacaguuugaaaua

SEQ ID NO: 1301595 - RNA, 23 nt, Human
auguguguccacgacugucucca

SEQ ID NO: 1301596 - RNA, 15 nt, Human
auguguguugauacu

SEQ ID NO: 1301597 - RNA, 16 nt, Human
auguguguugauacug

SEQ ID NO: 1301598 - RNA, 17 nt, Human
auguguguugauacugu

SEQ ID NO: 1301599 - RNA, 18 nt, Human
auguguguugauacuguu

SEQ ID NO: 1301600 - RNA, 19 nt, Human
auguguguugauacuguug

SEQ ID NO: 1301601 - RNA, 20 nt, Human
auguguguugauacuguugc

SEQ ID NO: 1301602 - RNA, 21 nt, Human
auguguguugauacuguugca

SEQ ID NO: 1301603 - RNA, 23 nt, Human
auguguguugauacuguugcacg

SEQ ID NO: 1301604 - RNA, 22 nt, Human
auguguguugauacuguugcac

SEQ ID NO: 1301605 - RNA, 23 nt, Human
auguguuucacaguuugaaauaa

SEQ ID NO: 1301606 - RNA, 12 nt, Human
auguguuugcuu

SEQ ID NO: 1301607 - RNA, 15 nt, Human
auguguuugcuuucu

SEQ ID NO: 1301608 - RNA, 16 nt, Human
auguguuugcuuucug

SEQ ID NO: 1301609 - RNA, 17 nt, Human
auguguuugcuuucuga

SEQ ID NO: 1301610 - RNA, 15 nt, Human
auguuaaaaaaauaa

SEQ ID NO: 1301611 - RNA, 23 nt, Human
auguuaaacuuauaacccacuuu

SEQ ID NO: 1301612 - RNA, 21 nt, Human
auguguguccacgacugucuc

SEQ ID NO: 1301613 - RNA, 22 nt, Human
auguguguccacgacugucucc

SEQ ID NO: 1301614 - RNA, 15 nt, Human
auguguguauaugga

SEQ ID NO: 1301615 - RNA, 16 nt, Human
auguguguauauggac

SEQ ID NO: 1301616 - RNA, 21 nt, Human
augugcuuaacagggaacgug

SEQ ID NO: 1301617 - RNA, 16 nt, Human
augugcuuaacaggga

SEQ ID NO: 1301618 - RNA, 14 nt, Human
augugcuuugagaa

SEQ ID NO: 1301619 - RNA, 15 nt, Human
auguggaacugcugc

SEQ ID NO: 1301620 - RNA, 16 nt, Human
auguggaacugcugcc

SEQ ID NO: 1301621 - RNA, 17 nt, Human
auguggaacugcugcca

SEQ ID NO: 1301622 - RNA, 18 nt, Human
auguggaacugcugccac

SEQ ID NO: 1301623 - RNA, 19 nt, Human
auguggaacugcugccacu

SEQ ID NO: 1301624 - RNA, 23 nt, Human
auguggaacugcugccacugagg

SEQ ID NO: 1301625 - RNA, 21 nt, Human
augugcuaguaauuggaaagg

SEQ ID NO: 1301626 - RNA, 19 nt, Human
augugcuauacugcauacu

SEQ ID NO: 1301627 - RNA, 18 nt, Human
augugcuauacugcauac

SEQ ID NO: 1301628 - RNA, 17 nt, Human
augugcauucuccagcc

SEQ ID NO: 1301629 - RNA, 20 nt, Human
augugccagggcaaugauga

SEQ ID NO: 1301630 - RNA, 21 nt, Human
augugccagggcaaugaugaa

SEQ ID NO: 1301631 - RNA, 13 nt, Human
augugcagcauuu

SEQ ID NO: 1301632 - RNA, 17 nt, Human
augugcagcauuucacu

SEQ ID NO: 1301633 - RNA, 12 nt, Human
uuuguuuugcac

SEQ ID NO: 1301634 - RNA, 13 nt, Human
uuuguuuuguguc

SEQ ID NO: 1301635 - RNA, 15 nt, Human
uuuguuuugugucuc

SEQ ID NO: 1301636 - RNA, 14 nt, Human
uuuguuuugugucu

SEQ ID NO: 1301637 - RNA, 15 nt, Human
uuuguuuuguuuaca

SEQ ID NO: 1301638 - RNA, 17 nt, Human
uuuguuuuguuuuuaca

SEQ ID NO: 1301639 - RNA, 16 nt, Human
uuuguuuuuaaacugu

SEQ ID NO: 1301640 - RNA, 19 nt, Human
uuuguuuuuaaacuguaca

SEQ ID NO: 1301641 - RNA, 20 nt, Human
uuuguuuuuaaacuguacag

SEQ ID NO: 1301642 - RNA, 21 nt, Human
uuuguuuuuaaacuguacagu

SEQ ID NO: 1301643 - RNA, 23 nt, Human
uuuguuuuuaaacuguacagugu

SEQ ID NO: 1301644 - RNA, 12 nt, Human
uuuguuuuucau

SEQ ID NO: 1301645 - RNA, 17 nt, Human
uuuguuuuuccuuccaa

SEQ ID NO: 1301646 - RNA, 24 nt, Human
auguuaugacuauguaaacuacuu

SEQ ID NO: 1301647 - RNA, 18 nt, Human
auguuaugacuauguaaa

SEQ ID NO: 1301648 - RNA, 20 nt, Human
auguuaucuucucaaguucu

SEQ ID NO: 1301649 - RNA, 21 nt, Human
auguuaucuucucaaguucua

SEQ ID NO: 1301650 - RNA, 22 nt, Human
auguuaucuucucaaguucuaa

SEQ ID NO: 1301651 - RNA, 18 nt, Human
auguuaagacuugacagu

SEQ ID NO: 1301652 - RNA, 14 nt, Human
auguuacauuauua

SEQ ID NO: 1301653 - RNA, 12 nt, Human
auguuauuuccc

SEQ ID NO: 1301654 - RNA, 15 nt, Human
auguuauuuguaaua

SEQ ID NO: 1301655 - RNA, 19 nt, Human
auguuauuuguaauagaug

SEQ ID NO: 1301656 - RNA, 17 nt, Human
auguuauuuuuuaauua

SEQ ID NO: 1301657 - RNA, 19 nt, Human
auguuauuuuuuaauuauu

SEQ ID NO: 1301658 - RNA, 13 nt, Human
auguuauuaucug

SEQ ID NO: 1301659 - RNA, 23 nt, Human
auguuaacugacaagcuccauuu

SEQ ID NO: 1301660 - RNA, 16 nt, Human
auguuaagacuugaca

SEQ ID NO: 1301661 - RNA, 20 nt, Human
auguuaagacuugacagugg

SEQ ID NO: 1301662 - RNA, 24 nt, Human
auguuaaauaggcggggcuugccu

SEQ ID NO: 1301663 - RNA, 20 nt, Human
auguucuuuuaaaugauuga

SEQ ID NO: 1301664 - RNA, 19 nt, Human
auguucuuuggaaaguaca

SEQ ID NO: 1301665 - RNA, 13 nt, Human
auguucuuuggaa

SEQ ID NO: 1301666 - RNA, 14 nt, Human
auguucuuuggaaa

SEQ ID NO: 1301667 - RNA, 16 nt, Human
auguucuuuggaaagu

SEQ ID NO: 1301668 - RNA, 20 nt, Human
auguuauuuuuuaauuauua

SEQ ID NO: 1301669 - RNA, 14 nt, Human
auguucaaagucaa

SEQ ID NO: 1301670 - RNA, 23 nt, Human
auguucaaagucaaauaacuccu

SEQ ID NO: 1301671 - RNA, 14 nt, Human
auguucacuuuuga

SEQ ID NO: 1301672 - RNA, 18 nt, Human
auguucacuuuugacaaa

SEQ ID NO: 1301673 - RNA, 20 nt, Human
auguucacuuuugacaaagg

SEQ ID NO: 1301674 - RNA, 15 nt, Human
auguugaagccuuug

SEQ ID NO: 1301675 - RNA, 22 nt, Human
auguugaaauaugauguuaaaa

SEQ ID NO: 1301676 - RNA, 20 nt, Human
auguugcugaaaaaugggca

SEQ ID NO: 1301677 - RNA, 15 nt, Human
auguugcuggacugu

SEQ ID NO: 1301678 - RNA, 19 nt, Human
auguugcuggacugucaua

SEQ ID NO: 1301679 - RNA, 17 nt, Human
auguuggacaccuuuag

SEQ ID NO: 1301680 - RNA, 19 nt, Human
auguuggacaccuuuaggu

SEQ ID NO: 1301681 - RNA, 22 nt, Human
auguuggacaccuuuagguucu

SEQ ID NO: 1301682 - RNA, 23 nt, Human
auguuggacaccuuuagguucuu

SEQ ID NO: 1301683 - RNA, 16 nt, Human
uuuucuauaauuuaaa

SEQ ID NO: 1301684 - RNA, 22 nt, Human
uuuucuaguguaucaaaaugcu

SEQ ID NO: 1301685 - RNA, 17 nt, Human
uuuucuaguguaucaaa

SEQ ID NO: 1301686 - RNA, 13 nt, Human
uuuucuaguguau

SEQ ID NO: 1301687 - RNA, 12 nt, Human
uuuucuagugua

SEQ ID NO: 1301688 - RNA, 20 nt, Human
uuuuccagcuggaugagaau

SEQ ID NO: 1301689 - RNA, 21 nt, Human
uuuuccaggacuguuucaaac

SEQ ID NO: 1301690 - RNA, 17 nt, Human
uuuucucugauacagaa

SEQ ID NO: 1301691 - RNA, 21 nt, Human
uuuucucucaacaccaugauu

SEQ ID NO: 1301692 - RNA, 17 nt, Human
uuuucucugaacacauu

SEQ ID NO: 1301693 - RNA, 20 nt, Human
uuuucuaguguaucaaaaug

SEQ ID NO: 1301694 - RNA, 20 nt, Human
uuuucucuaggaaauauacu

SEQ ID NO: 1301695 - RNA, 10 nt, Human
uuuucucuca

SEQ ID NO: 1301696 - RNA, 15 nt, Human
uuuucucucaacacc

SEQ ID NO: 1301697 - RNA, 14 nt, Human
uuuucucugguaau

SEQ ID NO: 1301698 - RNA, 16 nt, Human
uuuucucugguaauau

SEQ ID NO: 1301699 - RNA, 21 nt, Human
uuuucucugguaauauugacu

SEQ ID NO: 1301700 - RNA, 20 nt, Human
uuuucaggcuagauguaugu

SEQ ID NO: 1301701 - RNA, 19 nt, Human
uuuucaguauuauauguac

SEQ ID NO: 1301702 - RNA, 19 nt, Human
uuuuccaaagagugauagu

SEQ ID NO: 1301703 - RNA, 11 nt, Human
uuuuccaaaug

SEQ ID NO: 1301704 - RNA, 22 nt, Human
uuuuccaaauguaauaaacuuu

SEQ ID NO: 1301705 - RNA, 14 nt, Human
uuuuccaacuacua

SEQ ID NO: 1301706 - RNA, 18 nt, Human
uuuuccaacuacuaauag

SEQ ID NO: 1301707 - RNA, 21 nt, Human
uuuuccaacuuggcugcagga

SEQ ID NO: 1301708 - RNA, 19 nt, Human
uuuuaguugcaacuuugua

SEQ ID NO: 1301709 - RNA, 20 nt, Human
uuuuaguuccugugcacagc

SEQ ID NO: 1301710 - RNA, 18 nt, Human
uuuuaguuccugugcaca

SEQ ID NO: 1301711 - RNA, 21 nt, Human
uuuuagacagucucacuuugu

SEQ ID NO: 1301712 - RNA, 12 nt, Human
uuuuagagaaaa

SEQ ID NO: 1301713 - RNA, 19 nt, Human
uuuuagugaacuugaaaua

SEQ ID NO: 1301714 - RNA, 18 nt, Human
uuuuagugauuuuaauaa

SEQ ID NO: 1301715 - RNA, 12 nt, Human
uuuuaguugaau

SEQ ID NO: 1301716 - RNA, 12 nt, Human
uuuuauuaauaa

SEQ ID NO: 1301717 - RNA, 19 nt, Human
uuuuauuaauaaacauucu

SEQ ID NO: 1301718 - RNA, 22 nt, Human
uuuuauuaauaaacauucuauc

SEQ ID NO: 1301719 - RNA, 11 nt, Human
uuuuauuaaug

SEQ ID NO: 1301720 - RNA, 13 nt, Human
uuuuauuaaugca

SEQ ID NO: 1301721 - RNA, 16 nt, Human
uuuuauugacacagaa

SEQ ID NO: 1301722 - RNA, 18 nt, Human
uuuuauugacacagaaaa

SEQ ID NO: 1301723 - RNA, 15 nt, Human
auguuuuuuuuuaaa

SEQ ID NO: 1301724 - RNA, 14 nt, Human
auguuuuucuaaag

SEQ ID NO: 1301725 - RNA, 12 nt, Human
auguuuuuugcc

SEQ ID NO: 1301726 - RNA, 18 nt, Human
auguuuuuugccacagcu

SEQ ID NO: 1301727 - RNA, 19 nt, Human
auguuuuuugccacagcuu

SEQ ID NO: 1301728 - RNA, 21 nt, Human
auguuuuuugccacagcuuuu

SEQ ID NO: 1301729 - RNA, 14 nt, Human
auuaaaaaaaaaga

SEQ ID NO: 1301730 - RNA, 20 nt, Human
auuaaaaaaaaagaucuguu

SEQ ID NO: 1301731 - RNA, 22 nt, Human
auguuuuuugccacagcuuuug

SEQ ID NO: 1301732 - RNA, 13 nt, Human
auuaaaaaagaua

SEQ ID NO: 1301733 - RNA, 14 nt, Human
auuaaaaaagauaa

SEQ ID NO: 1301734 - RNA, 17 nt, Human
auuaaaaaagauaaaca

SEQ ID NO: 1301735 - RNA, 15 nt, Human
auuaaaaaagauaaa

SEQ ID NO: 1301736 - RNA, 22 nt, Human
auguuuacacucuuuguaagag

SEQ ID NO: 1301737 - RNA, 16 nt, Human
auguuuuucuaaagga

SEQ ID NO: 1301738 - RNA, 15 nt, Human
auguuuuuaauaaaa

SEQ ID NO: 1301739 - RNA, 16 nt, Human
auguuuuuaauaaaag

SEQ ID NO: 1301740 - RNA, 19 nt, Human
auguuuuuaauaaaagaaa

SEQ ID NO: 1301741 - RNA, 12 nt, Human
auguuuuuaaug

SEQ ID NO: 1301742 - RNA, 13 nt, Human
auguuuuuaaugu

SEQ ID NO: 1301743 - RNA, 14 nt, Human
auguuuuuaaugua

SEQ ID NO: 1301744 - RNA, 19 nt, Human
auguuuuuaauguauagua

SEQ ID NO: 1301745 - RNA, 16 nt, Human
auguuuuuaauguaua

SEQ ID NO: 1301746 - RNA, 21 nt, Human
uuuucuuaaccagaucauugu

SEQ ID NO: 1301747 - RNA, 18 nt, Human
uuuucuuaaagugccagu

SEQ ID NO: 1301748 - RNA, 13 nt, Human
uuuucuuaaagug

SEQ ID NO: 1301749 - RNA, 16 nt, Human
uuuucuuaaagugcca

SEQ ID NO: 1301750 - RNA, 19 nt, Human
uuuucugcacuauaugcaa

SEQ ID NO: 1301751 - RNA, 13 nt, Human
uuuucugcacuau

SEQ ID NO: 1301752 - RNA, 12 nt, Human
uuuucugcacua

SEQ ID NO: 1301753 - RNA, 17 nt, Human
uuuucuggaauacauga

SEQ ID NO: 1301754 - RNA, 21 nt, Human
uuuucuggaauacaugaaaua

SEQ ID NO: 1301755 - RNA, 18 nt, Human
uuuucuggaauguaauca

SEQ ID NO: 1301756 - RNA, 19 nt, Human
auguuuacacucuuuguaa

SEQ ID NO: 1301757 - RNA, 21 nt, Human
auguuuacacucuuuguaaga

SEQ ID NO: 1301758 - RNA, 16 nt, Human
auguuuaaucauauaa

SEQ ID NO: 1301759 - RNA, 17 nt, Human
auguuuaaucauauaaa

SEQ ID NO: 1301760 - RNA, 16 nt, Human
auguuuacacucuuug

SEQ ID NO: 1301761 - RNA, 18 nt, Human
auguuuacacucuuugua

SEQ ID NO: 1301762 - RNA, 15 nt, Human
auguuuaaucauaua

SEQ ID NO: 1301763 - RNA, 14 nt, Human
auguuuaaucauau

SEQ ID NO: 1301764 - RNA, 14 nt, Human
auguuuaaaccuuu

SEQ ID NO: 1301765 - RNA, 17 nt, Human
auguuggccaggcuggu

SEQ ID NO: 1301766 - RNA, 19 nt, Human
auguuggccaggcuggucu

SEQ ID NO: 1301767 - RNA, 21 nt, Human
auguuggccaggcuggucuaa

SEQ ID NO: 1301768 - RNA, 19 nt, Human
auguugggaaacuuggcuc

SEQ ID NO: 1301769 - RNA, 20 nt, Human
auguugggaaacuuggcucg

SEQ ID NO: 1301770 - RNA, 12 nt, Human
auguugggacug

SEQ ID NO: 1301771 - RNA, 14 nt, Human
auguuuaaaacauc

SEQ ID NO: 1301772 - RNA, 18 nt, Human
auguuggucauuuuaugu

SEQ ID NO: 1301773 - RNA, 15 nt, Human
uuuguaguagcguuu

SEQ ID NO: 1301774 - RNA, 16 nt, Human
uuuguaggguuucuag

SEQ ID NO: 1301775 - RNA, 19 nt, Human
uuuguacauaguuauuuau

SEQ ID NO: 1301776 - RNA, 15 nt, Human
uuuguaggguuucua

SEQ ID NO: 1301777 - RNA, 19 nt, Human
uuuguaguagcguuuuuua

SEQ ID NO: 1301778 - RNA, 15 nt, Human
uuuguagugauuuuu

SEQ ID NO: 1301779 - RNA, 17 nt, Human
uuuguaguguuggagaa

SEQ ID NO: 1301780 - RNA, 17 nt, Human
uuuguaguagcguuuuu

SEQ ID NO: 1301781 - RNA, 22 nt, Human
uuuguagugauuuuuaugccac

SEQ ID NO: 1301782 - RNA, 17 nt, Human
augugaugaauacugua

SEQ ID NO: 1301783 - RNA, 19 nt, Human
augugaugaauacuguauu

SEQ ID NO: 1301784 - RNA, 18 nt, Human
uuuguaagguuuuuguag

SEQ ID NO: 1301785 - RNA, 22 nt, Human
uuuguaaguuagguaacuguau

SEQ ID NO: 1301786 - RNA, 16 nt, Human
uuuguaaguugaagca

SEQ ID NO: 1301787 - RNA, 20 nt, Human
uuuguaaguugaagcaaauc

SEQ ID NO: 1301788 - RNA, 18 nt, Human
augugauccuuuuggagu

SEQ ID NO: 1301789 - RNA, 16 nt, Human
augugauauucuaaga

SEQ ID NO: 1301790 - RNA, 19 nt, Human
augugaucauguguggaag

SEQ ID NO: 1301791 - RNA, 20 nt, Human
augugaucauguguggaagu

SEQ ID NO: 1301792 - RNA, 16 nt, Human
augugauauauaagug

SEQ ID NO: 1301793 - RNA, 17 nt, Human
augugauauauaagugu

SEQ ID NO: 1301794 - RNA, 19 nt, Human
augugauauauaaguguac

SEQ ID NO: 1301795 - RNA, 21 nt, Human
augugauauauaaguguacau

SEQ ID NO: 1301796 - RNA, 22 nt, Human
augugauauauaaguguacaua

SEQ ID NO: 1301797 - RNA, 23 nt, Human
augugauauauaaguguacauau

SEQ ID NO: 1301798 - RNA, 14 nt, Human
augugauauucuaa

SEQ ID NO: 1301799 - RNA, 15 nt, Human
augugauauucuaag

SEQ ID NO: 1301800 - RNA, 18 nt, Human
augugauauucuaagacu

SEQ ID NO: 1301801 - RNA, 20 nt, Human
uuugugauaugcacaaugua

SEQ ID NO: 1301802 - RNA, 22 nt, Human
uuugugauaugcacaauguaga

SEQ ID NO: 1301803 - RNA, 18 nt, Human
uuugugauggagugcugu

SEQ ID NO: 1301804 - RNA, 21 nt, Human
uuugugauggagugcuguuuu

SEQ ID NO: 1301805 - RNA, 15 nt, Human
uuugugauucaaucu

SEQ ID NO: 1301806 - RNA, 20 nt, Human
uuugugauucaaucuguaaa

SEQ ID NO: 1301807 - RNA, 13 nt, Human
uuugugcauucug

SEQ ID NO: 1301808 - RNA, 19 nt, Human
uuugugauggagugcuguu

SEQ ID NO: 1301809 - RNA, 22 nt, Human
uuugugcugaauguugggacug

SEQ ID NO: 1301810 - RNA, 22 nt, Human
uuuguuucaaugagguguccaa

SEQ ID NO: 1301811 - RNA, 12 nt, Human
uuugugcccuau

SEQ ID NO: 1301812 - RNA, 17 nt, Human
uuuguuucaaugaggug

SEQ ID NO: 1301813 - RNA, 12 nt, Human
uuuguuuccucu

SEQ ID NO: 1301814 - RNA, 17 nt, Human
uuuguuuccucuguuca

SEQ ID NO: 1301815 - RNA, 14 nt, Human
uuuguuuccuuugu

SEQ ID NO: 1301816 - RNA, 15 nt, Human
uuuguuuccuuuguu

SEQ ID NO: 1301817 - RNA, 11 nt, Human
uuuguuuguuu

SEQ ID NO: 1301818 - RNA, 15 nt, Human
uuuguuuguuuaauu

SEQ ID NO: 1301819 - RNA, 23 nt, Human
augucgucaaagcugaaauggac

SEQ ID NO: 1301820 - RNA, 19 nt, Human
augucguggacacacacag

SEQ ID NO: 1301821 - RNA, 20 nt, Human
augucguggacacacacaga

SEQ ID NO: 1301822 - RNA, 16 nt, Human
augugacagguaaacu

SEQ ID NO: 1301823 - RNA, 14 nt, Human
augugacaguggcg

SEQ ID NO: 1301824 - RNA, 13 nt, Human
augugacauuuau

SEQ ID NO: 1301825 - RNA, 14 nt, Human
augugacauuuaua

SEQ ID NO: 1301826 - RNA, 19 nt, Human
augugacauuuauauauug

SEQ ID NO: 1301827 - RNA, 16 nt, Human
augugagagguuugac

SEQ ID NO: 1301828 - RNA, 17 nt, Human
augugagagguuugacu

SEQ ID NO: 1301829 - RNA, 17 nt, Human
augugauaaggaaauca

SEQ ID NO: 1301830 - RNA, 20 nt, Human
augugauaaggaaaucaacu

SEQ ID NO: 1301831 - RNA, 18 nt, Human
augugauaaggaaaucaa

SEQ ID NO: 1301832 - RNA, 13 nt, Human
augugauauauaa

SEQ ID NO: 1301833 - RNA, 15 nt, Human
augugauauauaagu

SEQ ID NO: 1301834 - RNA, 13 nt, Human
augucauacagag

SEQ ID NO: 1301835 - RNA, 14 nt, Human
auguaucaaacugu

SEQ ID NO: 1301836 - RNA, 17 nt, Human
auguaucaaauacauuu

SEQ ID NO: 1301837 - RNA, 19 nt, Human
auguauauuuuauaucaau

SEQ ID NO: 1301838 - RNA, 14 nt, Human
augucauacagaga

SEQ ID NO: 1301839 - RNA, 15 nt, Human
augucauacagagaa

SEQ ID NO: 1301840 - RNA, 16 nt, Human
augucauacagagaag

SEQ ID NO: 1301841 - RNA, 17 nt, Human
augucauacagagaagu

SEQ ID NO: 1301842 - RNA, 18 nt, Human
augucauacagagaaguc

SEQ ID NO: 1301843 - RNA, 20 nt, Human
augucauacagagaagucac

SEQ ID NO: 1301844 - RNA, 22 nt, Human
augucaucacucuagguuuuac

SEQ ID NO: 1301845 - RNA, 13 nt, Human
augucaugcugcc

SEQ ID NO: 1301846 - RNA, 14 nt, Human
augucaugcugccu

SEQ ID NO: 1301847 - RNA, 15 nt, Human
augucaugcugccuu

SEQ ID NO: 1301848 - RNA, 21 nt, Human
augucauguguacaaaaguuu

SEQ ID NO: 1301849 - RNA, 13 nt, Human
augucauuaaaug

SEQ ID NO: 1301850 - RNA, 16 nt, Human
augucaugcugccuua

SEQ ID NO: 1301851 - RNA, 16 nt, Human
augucauuucagaagu

SEQ ID NO: 1301852 - RNA, 17 nt, Human
augucauuucagaaguu

SEQ ID NO: 1301853 - RNA, 15 nt, Human
augucauuucauuuc

SEQ ID NO: 1301854 - RNA, 18 nt, Human
augucauuucauuuccua

SEQ ID NO: 1301855 - RNA, 12 nt, Human
auguccaaagag

SEQ ID NO: 1301856 - RNA, 15 nt, Human
auguccaaagaggcu

SEQ ID NO: 1301857 - RNA, 16 nt, Human
auguccaaagaggcug

SEQ ID NO: 1301858 - RNA, 18 nt, Human
auguccaaagaggcugcc

SEQ ID NO: 1301859 - RNA, 19 nt, Human
auguccaaagaggcugccc

SEQ ID NO: 1301860 - RNA, 20 nt, Human
auguccaaagaggcugcccc

SEQ ID NO: 1301861 - RNA, 21 nt, Human
auguccaaagaggcugccccu

SEQ ID NO: 1301862 - RNA, 22 nt, Human
auguccaaagaggcugccccuc

SEQ ID NO: 1301863 - RNA, 16 nt, Human
auguccaacccgucug

SEQ ID NO: 1301864 - RNA, 19 nt, Human
auguauacuauaguaccag

SEQ ID NO: 1301865 - RNA, 21 nt, Human
auguauacugccacuaaccuu

SEQ ID NO: 1301866 - RNA, 15 nt, Human
auguauacugccacu

SEQ ID NO: 1301867 - RNA, 14 nt, Human
uuuggguccaggag

SEQ ID NO: 1301868 - RNA, 18 nt, Human
uuuggggugccccucucc

SEQ ID NO: 1301869 - RNA, 13 nt, Human
uuuggguccagga

SEQ ID NO: 1301870 - RNA, 15 nt, Human
uuuggguccaggagg

SEQ ID NO: 1301871 - RNA, 12 nt, Human
auguauaguaaa

SEQ ID NO: 1301872 - RNA, 15 nt, Human
auguauaguaaauca

SEQ ID NO: 1301873 - RNA, 16 nt, Human
auguauaguaaaucac

SEQ ID NO: 1301874 - RNA, 16 nt, Human
uuugggcuucagcugc

SEQ ID NO: 1301875 - RNA, 15 nt, Human
uuugggcuugggccu

SEQ ID NO: 1301876 - RNA, 20 nt, Human
uuugggcuucagcugccagu

SEQ ID NO: 1301877 - RNA, 20 nt, Human
uuugggggguuuucuugccu

SEQ ID NO: 1301878 - RNA, 21 nt, Human
uuugggcagcaauuuaaaugu

SEQ ID NO: 1301879 - RNA, 23 nt, Human
uuugggaguuuuuaugagaaacu

SEQ ID NO: 1301880 - RNA, 14 nt, Human
uuugggcugcccug

SEQ ID NO: 1301881 - RNA, 22 nt, Human
uuuggcugaaauucuccuggag

SEQ ID NO: 1301882 - RNA, 13 nt, Human
uuuggcuuucagg

SEQ ID NO: 1301883 - RNA, 15 nt, Human
uuugggaguuuuuau

SEQ ID NO: 1301884 - RNA, 20 nt, Human
uuuggcugaaauucuccugg

SEQ ID NO: 1301885 - RNA, 21 nt, Human
uuuggcugaaauucuccugga

SEQ ID NO: 1301886 - RNA, 14 nt, Human
uuuggauuugacau

SEQ ID NO: 1301887 - RNA, 20 nt, Human
uuuggauuuaaaagccugcu

SEQ ID NO: 1301888 - RNA, 19 nt, Human
uuugcuaagcauuccaacu

SEQ ID NO: 1301889 - RNA, 20 nt, Human
uuugcuggagcucugcccau

SEQ ID NO: 1301890 - RNA, 22 nt, Human
uuuggauuggacaaaaugacuu

SEQ ID NO: 1301891 - RNA, 14 nt, Human
uuuggauuguauau

SEQ ID NO: 1301892 - RNA, 16 nt, Human
uuuggauuugacauug

SEQ ID NO: 1301893 - RNA, 15 nt, Human
uuugcuaaagacaug

SEQ ID NO: 1301894 - RNA, 19 nt, Human
uuugcgugggagugugugc

SEQ ID NO: 1301895 - RNA, 14 nt, Human
uuugcuaaagacau

SEQ ID NO: 1301896 - RNA, 22 nt, Human
uuugcuguaauguuaauauuga

SEQ ID NO: 1301897 - RNA, 15 nt, Human
uuugauugauuugaa

SEQ ID NO: 1301898 - RNA, 14 nt, Human
uuugauuuaauguu

SEQ ID NO: 1301899 - RNA, 14 nt, Human
uuugauuucauuaa

SEQ ID NO: 1301900 - RNA, 20 nt, Human
uuugcaaaaaauguuuuugg

SEQ ID NO: 1301901 - RNA, 18 nt, Human
uuugcaaaaaauguuuuu

SEQ ID NO: 1301902 - RNA, 19 nt, Human
uuugcaaagaaagaaaaaa

SEQ ID NO: 1301903 - RNA, 15 nt, Human
uuugcgcuccuggcc

SEQ ID NO: 1301904 - RNA, 21 nt, Human
uuugcgcuccuggcccagccu

SEQ ID NO: 1301905 - RNA, 20 nt, Human
uuugagacagagucuuccuc

SEQ ID NO: 1301906 - RNA, 21 nt, Human
uuugagagaaauaugaagaac

SEQ ID NO: 1301907 - RNA, 13 nt, Human
uuugaccuuuuau

SEQ ID NO: 1301908 - RNA, 13 nt, Human
uuugagaaaguca

SEQ ID NO: 1301909 - RNA, 16 nt, Human
uuugacuuuucuguaa

SEQ ID NO: 1301910 - RNA, 17 nt, Human
uuugacuuuucuguaau

SEQ ID NO: 1301911 - RNA, 21 nt, Human
uuugagaaacaacaauuucua

SEQ ID NO: 1301912 - RNA, 12 nt, Human
uuugacuuuucu

SEQ ID NO: 1301913 - RNA, 13 nt, Human
uuugacuuuucug

SEQ ID NO: 1301914 - RNA, 14 nt, Human
uuugacuuuucugu

SEQ ID NO: 1301915 - RNA, 15 nt, Human
uuugacuuuucugua

SEQ ID NO: 1301916 - RNA, 15 nt, Human
uuugaugaguuguga

SEQ ID NO: 1301917 - RNA, 12 nt, Human
uuugaugauaaa

SEQ ID NO: 1301918 - RNA, 18 nt, Human
uuugaugaggcccuccac

SEQ ID NO: 1301919 - RNA, 19 nt, Human
uuucccuuccuuccucucc

SEQ ID NO: 1301920 - RNA, 19 nt, Human
uuucccuucaguacccucu

SEQ ID NO: 1301921 - RNA, 20 nt, Human
uuucccuucaguacccucuc

SEQ ID NO: 1301922 - RNA, 16 nt, Human
uuucccuacccucuag

SEQ ID NO: 1301923 - RNA, 17 nt, Human
uuucccuacugaagccc

SEQ ID NO: 1301924 - RNA, 23 nt, Human
uuucccuacugaagcccuuguga

SEQ ID NO: 1301925 - RNA, 11 nt, Human
uuucccuccuu

SEQ ID NO: 1301926 - RNA, 13 nt, Human
uuucccuccuugg

SEQ ID NO: 1301927 - RNA, 14 nt, Human
uuucccuccuuggu

SEQ ID NO: 1301928 - RNA, 16 nt, Human
uuucccugccucucau

SEQ ID NO: 1301929 - RNA, 12 nt, Human
uuucccuggucc

SEQ ID NO: 1301930 - RNA, 16 nt, Human
uuucccuucaguaccc

SEQ ID NO: 1301931 - RNA, 18 nt, Human
uuugacaaagguaaauca

SEQ ID NO: 1301932 - RNA, 20 nt, Human
uuugacaacguuucagcgac

SEQ ID NO: 1301933 - RNA, 20 nt, Human
uuugacaccucuuuuuucgu

SEQ ID NO: 1301934 - RNA, 15 nt, Human
uuugacacugcucua

SEQ ID NO: 1301935 - RNA, 15 nt, Human
auucagccuggcuuc

SEQ ID NO: 1301936 - RNA, 23 nt, Human
auucaaaaauuaucuauagcuaa

SEQ ID NO: 1301937 - RNA, 16 nt, Human
auucaaaaauuaucua

SEQ ID NO: 1301938 - RNA, 11 nt, Human
auucaaaacau

SEQ ID NO: 1301939 - RNA, 13 nt, Human
auucaaaaguucc

SEQ ID NO: 1301940 - RNA, 14 nt, Human
auucaaaaguucca

SEQ ID NO: 1301941 - RNA, 16 nt, Human
auucaaaaguuccaag

SEQ ID NO: 1301942 - RNA, 15 nt, Human
auuauucagugucac

SEQ ID NO: 1301943 - RNA, 20 nt, Human
auuauuggaauauaauuguu

SEQ ID NO: 1301944 - RNA, 18 nt, Human
auuauuguugcauuaaaa

SEQ ID NO: 1301945 - RNA, 11 nt, Human
auuauuuaaac

SEQ ID NO: 1301946 - RNA, 12 nt, Human
auuauuuaaaca

SEQ ID NO: 1301947 - RNA, 22 nt, Human
auuauuuaaaccgcuaaaagaa

SEQ ID NO: 1301948 - RNA, 17 nt, Human
auucaaaaguuccaaga

SEQ ID NO: 1301949 - RNA, 13 nt, Human
auucaaagguucu

SEQ ID NO: 1301950 - RNA, 14 nt, Human
auucaaagguucua

SEQ ID NO: 1301951 - RNA, 15 nt, Human
auucaaagguucuag

SEQ ID NO: 1301952 - RNA, 16 nt, Human
auucaaagguucuagg

SEQ ID NO: 1301953 - RNA, 17 nt, Human
auucaaagguucuaggu

SEQ ID NO: 1301954 - RNA, 18 nt, Human
auucaaagguucuagguu

SEQ ID NO: 1301955 - RNA, 21 nt, Human
auucaaagguucuagguuuca

SEQ ID NO: 1301956 - RNA, 22 nt, Human
auucacccccuuuccuggacac

SEQ ID NO: 1301957 - RNA, 16 nt, Human
auucacccccuuuccu

SEQ ID NO: 1301958 - RNA, 19 nt, Human
auucaccugccccaacucu

SEQ ID NO: 1301959 - RNA, 21 nt, Human
auucacucugaguguuuuaug

SEQ ID NO: 1301960 - RNA, 19 nt, Human
auuauaucaauuuccucau

SEQ ID NO: 1301961 - RNA, 13 nt, Human
auuaguuuugauu

SEQ ID NO: 1301962 - RNA, 15 nt, Human
auuauaaaugacaac

SEQ ID NO: 1301963 - RNA, 22 nt, Human
auuauaaccuuaauuuauuauu

SEQ ID NO: 1301964 - RNA, 14 nt, Human
auuauaaccuuaau

SEQ ID NO: 1301965 - RNA, 17 nt, Human
auuauaacuggaaagaa

SEQ ID NO: 1301966 - RNA, 12 nt, Human
auuauaacugua

SEQ ID NO: 1301967 - RNA, 14 nt, Human
auuauucacuagua

SEQ ID NO: 1301968 - RNA, 13 nt, Human
auuauucaguguc

SEQ ID NO: 1301969 - RNA, 14 nt, Human
auuauucaguguca

SEQ ID NO: 1301970 - RNA, 18 nt, Human
auuauauggaaauauaua

SEQ ID NO: 1301971 - RNA, 20 nt, Human
auuauauggaaauauauauu

SEQ ID NO: 1301972 - RNA, 21 nt, Human
auuauauggaaauauauauua

SEQ ID NO: 1301973 - RNA, 22 nt, Human
auuauauguacccucugaaaua

SEQ ID NO: 1301974 - RNA, 16 nt, Human
auuauauggaaauaua

SEQ ID NO: 1301975 - RNA, 17 nt, Human
auuauauggaaauauau

SEQ ID NO: 1301976 - RNA, 20 nt, Human
auuauauggcuugaguuuaa

SEQ ID NO: 1301977 - RNA, 14 nt, Human
auucagccuggcuu

SEQ ID NO: 1301978 - RNA, 20 nt, Human
auucagaaaauguucuguuu

SEQ ID NO: 1301979 - RNA, 13 nt, Human
auucagaaaugag

SEQ ID NO: 1301980 - RNA, 20 nt, Human
auucacuucacugugcuguu

SEQ ID NO: 1301981 - RNA, 18 nt, Human
auucacuucacugugcug

SEQ ID NO: 1301982 - RNA, 18 nt, Human
auucagaaaauguucugu

SEQ ID NO: 1301983 - RNA, 19 nt, Human
auucagaaaauguucuguu

SEQ ID NO: 1301984 - RNA, 22 nt, Human
auucagaaaauguucuguuugc

SEQ ID NO: 1301985 - RNA, 23 nt, Human
auucacuucacugugcuguuguu

SEQ ID NO: 1301986 - RNA, 17 nt, Human
auucacuucacugugcu

SEQ ID NO: 1301987 - RNA, 16 nt, Human
auucacuucacugugc

SEQ ID NO: 1301988 - RNA, 15 nt, Human
auucacuucacugug

SEQ ID NO: 1301989 - RNA, 16 nt, Human
auuccaagacucuaga

SEQ ID NO: 1301990 - RNA, 17 nt, Human
auuccaagacucuagag

SEQ ID NO: 1301991 - RNA, 18 nt, Human
auuccaagacucuagagu

SEQ ID NO: 1301992 - RNA, 14 nt, Human
auucagugucacug

SEQ ID NO: 1301993 - RNA, 19 nt, Human
auucaguguuaaaugugau

SEQ ID NO: 1301994 - RNA, 18 nt, Human
auucaggacuugaaagaa

SEQ ID NO: 1301995 - RNA, 22 nt, Human
auucaggcuacugcuucaaucu

SEQ ID NO: 1301996 - RNA, 19 nt, Human
auucaggacuugaaagaaa

SEQ ID NO: 1301997 - RNA, 20 nt, Human
auucagggaaagugggacag

SEQ ID NO: 1301998 - RNA, 14 nt, Human
auucagggaaggag

SEQ ID NO: 1301999 - RNA, 20 nt, Human
auucagggaaggaggagccu

SEQ ID NO: 1302000 - RNA, 23 nt, Human
auucagggaaggaggagccuguc

SEQ ID NO: 1302001 - RNA, 15 nt, Human
auucagguaauacaa

SEQ ID NO: 1302002 - RNA, 16 nt, Human
auucagguaauacaaa

SEQ ID NO: 1302003 - RNA, 17 nt, Human
auucagguaauacaaac

SEQ ID NO: 1302004 - RNA, 17 nt, Human
auuccaagugauugaaa

SEQ ID NO: 1302005 - RNA, 12 nt, Human
auuccacagcug

SEQ ID NO: 1302006 - RNA, 14 nt, Human
auuccaagucucca

SEQ ID NO: 1302007 - RNA, 13 nt, Human
auuccacagcugc

SEQ ID NO: 1302008 - RNA, 18 nt, Human
auuccagagaguggcucc

SEQ ID NO: 1302009 - RNA, 18 nt, Human
auuccagaccugaagaau

SEQ ID NO: 1302010 - RNA, 23 nt, Human
auuccagacugcuuccaauuuuc

SEQ ID NO: 1302011 - RNA, 14 nt, Human
auuccagaaugcug

SEQ ID NO: 1302012 - RNA, 15 nt, Human
auuccagaaugcugu

SEQ ID NO: 1302013 - RNA, 19 nt, Human
auuccagaaugcuguacau

SEQ ID NO: 1302014 - RNA, 20 nt, Human
auuccagaaugcuguacauc

SEQ ID NO: 1302015 - RNA, 23 nt, Human
auuccagaaugcuguacaucuau

SEQ ID NO: 1302016 - RNA, 17 nt, Human
auuccagaccugaagaa

SEQ ID NO: 1302017 - RNA, 22 nt, Human
auucccacccaauucaaaacau

SEQ ID NO: 1302018 - RNA, 16 nt, Human
auuccccaucucaggc

SEQ ID NO: 1302019 - RNA, 18 nt, Human
auuccccaucucaggcca

SEQ ID NO: 1302020 - RNA, 14 nt, Human
auuccccauucuuc

SEQ ID NO: 1302021 - RNA, 15 nt, Human
auuccccauucuucc

SEQ ID NO: 1302022 - RNA, 15 nt, Human
auuacuguaagaaaa

SEQ ID NO: 1302023 - RNA, 16 nt, Human
auuacuguaagaaaau

SEQ ID NO: 1302024 - RNA, 16 nt, Human
auuaaucaguucauua

SEQ ID NO: 1302025 - RNA, 15 nt, Human
auuacugguccaaaa

SEQ ID NO: 1302026 - RNA, 24 nt, Human
auuaagucugugagauucauucau

SEQ ID NO: 1302027 - RNA, 13 nt, Human
auuaaguucuuua

SEQ ID NO: 1302028 - RNA, 17 nt, Human
auuaauauuccucaguu

SEQ ID NO: 1302029 - RNA, 13 nt, Human
auuacuuguaaau

SEQ ID NO: 1302030 - RNA, 15 nt, Human
auuacuuguaaauau

SEQ ID NO: 1302031 - RNA, 16 nt, Human
auuacuuguaaauaua

SEQ ID NO: 1302032 - RNA, 17 nt, Human
auuacuuguaaauauaa

SEQ ID NO: 1302033 - RNA, 18 nt, Human
auuacuuguaaauauaaa

SEQ ID NO: 1302034 - RNA, 20 nt, Human
auuacuuguaaauauaaaga

SEQ ID NO: 1302035 - RNA, 21 nt, Human
auuacuuguaaauauaaagac

SEQ ID NO: 1302036 - RNA, 20 nt, Human
auuagacuggacagcuugug

SEQ ID NO: 1302037 - RNA, 19 nt, Human
auuagacuggacagcuugu

SEQ ID NO: 1302038 - RNA, 14 nt, Human
auuagacugugauu

SEQ ID NO: 1302039 - RNA, 18 nt, Human
auuagacugugauucaga

SEQ ID NO: 1302040 - RNA, 18 nt, Human
auuagacacuuuggaaga

SEQ ID NO: 1302041 - RNA, 13 nt, Human
auuagacagaaca

SEQ ID NO: 1302042 - RNA, 14 nt, Human
auuagacagaacac

SEQ ID NO: 1302043 - RNA, 17 nt, Human
auuagacagaacaccua

SEQ ID NO: 1302044 - RNA, 15 nt, Human
auuagacagaacacc

SEQ ID NO: 1302045 - RNA, 15 nt, Human
auuagacuggaacuu

SEQ ID NO: 1302046 - RNA, 22 nt, Human
auuagacuggaacuugaacuga

SEQ ID NO: 1302047 - RNA, 14 nt, Human
auuagacuggacag

SEQ ID NO: 1302048 - RNA, 15 nt, Human
auuagacuggacagc

SEQ ID NO: 1302049 - RNA, 16 nt, Human
auuagacuggacagcu

SEQ ID NO: 1302050 - RNA, 15 nt, Human
uuuuuauauaugugu

SEQ ID NO: 1302051 - RNA, 11 nt, Human
uuuuuacauuu

SEQ ID NO: 1302052 - RNA, 12 nt, Human
uuuuuacauuuu

SEQ ID NO: 1302053 - RNA, 17 nt, Human
uuuuuacaauguaauua

SEQ ID NO: 1302054 - RNA, 17 nt, Human
uuuuguuuuucauucag

SEQ ID NO: 1302055 - RNA, 12 nt, Human
uuuuuaauuauu

SEQ ID NO: 1302056 - RNA, 14 nt, Human
uuuuuaauuaauug

SEQ ID NO: 1302057 - RNA, 23 nt, Human
uuuuuaauuuacaaaaauauaaa

SEQ ID NO: 1302058 - RNA, 15 nt, Human
uuuuuacaaagcccu

SEQ ID NO: 1302059 - RNA, 22 nt, Human
uuuuuacaaauguuaaaaugug

SEQ ID NO: 1302060 - RNA, 23 nt, Human
uuuuuacaaauguuaaaaugugu

SEQ ID NO: 1302061 - RNA, 19 nt, Human
uuuuguuguuucuuaaaua

SEQ ID NO: 1302062 - RNA, 15 nt, Human
uuuuguuuuggcuga

SEQ ID NO: 1302063 - RNA, 21 nt, Human
uuuuguuggcauagcucuggg

SEQ ID NO: 1302064 - RNA, 21 nt, Human
uuuuguuguuucuuaaauaag

SEQ ID NO: 1302065 - RNA, 18 nt, Human
uuuuguuaucagucaaua

SEQ ID NO: 1302066 - RNA, 23 nt, Human
uuuuguucgcauggucacacacu

SEQ ID NO: 1302067 - RNA, 12 nt, Human
uuuuguugacau

SEQ ID NO: 1302068 - RNA, 13 nt, Human
uuuuguugacauu

SEQ ID NO: 1302069 - RNA, 18 nt, Human
uuuuguugacauucugaa

SEQ ID NO: 1302070 - RNA, 20 nt, Human
uuuuguugacauucugaaug

SEQ ID NO: 1302071 - RNA, 19 nt, Human
uuuuguugacauucugaau

SEQ ID NO: 1302072 - RNA, 13 nt, Human
uuuuguuggcaua

SEQ ID NO: 1302073 - RNA, 14 nt, Human
uuuugugaagcaaa

SEQ ID NO: 1302074 - RNA, 14 nt, Human
uuuugugaauuagg

SEQ ID NO: 1302075 - RNA, 20 nt, Human
uuuugugaugcaaauaaaua

SEQ ID NO: 1302076 - RNA, 21 nt, Human
uuuugugggggacuguaaguu

SEQ ID NO: 1302077 - RNA, 21 nt, Human
uuuugugucucuuauggaugu

SEQ ID NO: 1302078 - RNA, 20 nt, Human
uuuuguguguauuugcuaau

SEQ ID NO: 1302079 - RNA, 17 nt, Human
uuuuguguguauuugcu

SEQ ID NO: 1302080 - RNA, 16 nt, Human
uuuuguguuuguugua

SEQ ID NO: 1302081 - RNA, 13 nt, Human
uuuuggaauuugc

SEQ ID NO: 1302082 - RNA, 15 nt, Human
uuuuggacuucuggg

SEQ ID NO: 1302083 - RNA, 14 nt, Human
auuaaacaugacuc

SEQ ID NO: 1302084 - RNA, 21 nt, Human
uuuugcuuucgaacugcuagu

SEQ ID NO: 1302085 - RNA, 21 nt, Human
uuuugcuuuuggcaaaacucu

SEQ ID NO: 1302086 - RNA, 14 nt, Human
auuaaaauccucaa

SEQ ID NO: 1302087 - RNA, 16 nt, Human
auuaaaauccucaauc

SEQ ID NO: 1302088 - RNA, 21 nt, Human
auuaaaaugcuuacauuugaa

SEQ ID NO: 1302089 - RNA, 14 nt, Human
auuaaaaugcuucc

SEQ ID NO: 1302090 - RNA, 11 nt, Human
auuaaaaugua

SEQ ID NO: 1302091 - RNA, 23 nt, Human
auuaaaauguaugcauguugucu

SEQ ID NO: 1302092 - RNA, 15 nt, Human
auuaaaauguaugca

SEQ ID NO: 1302093 - RNA, 17 nt, Human
auuaaaauguaugcaug

SEQ ID NO: 1302094 - RNA, 16 nt, Human
uuuuugagacagaguc

SEQ ID NO: 1302095 - RNA, 13 nt, Human
uuuuugaggcaaa

SEQ ID NO: 1302096 - RNA, 15 nt, Human
uuuuugauaaagccu

SEQ ID NO: 1302097 - RNA, 13 nt, Human
uuuuugauacuaa

SEQ ID NO: 1302098 - RNA, 15 nt, Human
uuuuugauacuaagc

SEQ ID NO: 1302099 - RNA, 12 nt, Human
uuuuugauauag

SEQ ID NO: 1302100 - RNA, 16 nt, Human
uuuuugaucaaaaacu

SEQ ID NO: 1302101 - RNA, 20 nt, Human
uuuuugcacauguuuccucu

SEQ ID NO: 1302102 - RNA, 9 nt, Human
uuuuugcag

SEQ ID NO: 1302103 - RNA, 14 nt, Human
uuuuugcaguaacu

SEQ ID NO: 1302104 - RNA, 16 nt, Human
uuuuugcaguaacugu

SEQ ID NO: 1302105 - RNA, 17 nt, Human
uuuuugcauuuaaaaca

SEQ ID NO: 1302106 - RNA, 16 nt, Human
uuuuugccacagcuuu

SEQ ID NO: 1302107 - RNA, 22 nt, Human
uuuuuggaagaggacuccuuaa

SEQ ID NO: 1302108 - RNA, 15 nt, Human
uuuuuggaagugaaa

SEQ ID NO: 1302109 - RNA, 19 nt, Human
uuuuuggaagugaaaacuu

SEQ ID NO: 1302110 - RNA, 13 nt, Human
uuuuucaaaagaa

SEQ ID NO: 1302111 - RNA, 15 nt, Human
uuuuuauuucuuccu

SEQ ID NO: 1302112 - RNA, 19 nt, Human
uuuuuauuuccuaugaugu

SEQ ID NO: 1302113 - RNA, 12 nt, Human
uuuuuauuucug

SEQ ID NO: 1302114 - RNA, 17 nt, Human
uuuuuauauuugaaaua

SEQ ID NO: 1302115 - RNA, 12 nt, Human
uuuuuauuucuu

SEQ ID NO: 1302116 - RNA, 11 nt, Human
uuuuuguagua

SEQ ID NO: 1302117 - RNA, 18 nt, Human
uuuuuguauaaaauagac

SEQ ID NO: 1302118 - RNA, 21 nt, Human
uuuuuguauaguuaacacacu

SEQ ID NO: 1302119 - RNA, 22 nt, Human
uuuuuggucgaggaguaacaau

SEQ ID NO: 1302120 - RNA, 23 nt, Human
uuuuugggcagcaauuuaaaugu

SEQ ID NO: 1302121 - RNA, 21 nt, Human
uuuuugggcagcaauuuaaau

SEQ ID NO: 1302122 - RNA, 20 nt, Human
uuuuugggcagcaauuuaaa

SEQ ID NO: 1302123 - RNA, 22 nt, Human
uuuuugggggguuuucuugccu

SEQ ID NO: 1302124 - RNA, 21 nt, Human
uuuuugggggguuuucuugcc

SEQ ID NO: 1302125 - RNA, 22 nt, Human
uuuuugggaaaagaaaagucaa

SEQ ID NO: 1302126 - RNA, 20 nt, Human
uuuuuggcguggcugacuua

SEQ ID NO: 1302127 - RNA, 11 nt, Human
uuuuuguauuu

SEQ ID NO: 1302128 - RNA, 18 nt, Human
uuuuuguauaguuaacac

SEQ ID NO: 1302129 - RNA, 20 nt, Human
auuaagggccgauuuaauua

SEQ ID NO: 1302130 - RNA, 17 nt, Human
auuaagguaguuauuca

SEQ ID NO: 1302131 - RNA, 20 nt, Human
uugucaauaaaauccauaca

SEQ ID NO: 1302132 - RNA, 18 nt, Human
augaguuccagaaaguaa

SEQ ID NO: 1302133 - RNA, 18 nt, Human
augaguagcuuauacaau

SEQ ID NO: 1302134 - RNA, 22 nt, Human
uugucaaugcaguugucucugu

SEQ ID NO: 1302135 - RNA, 14 nt, Human
uugucacuuuuucu

SEQ ID NO: 1302136 - RNA, 16 nt, Human
uugucacuuuuucuga

SEQ ID NO: 1302137 - RNA, 23 nt, Human
uugucagggaguguucccuaucc

SEQ ID NO: 1302138 - RNA, 17 nt, Human
uugucaggagugugugu

SEQ ID NO: 1302139 - RNA, 19 nt, Human
uugucauuuuuuuucuuug

SEQ ID NO: 1302140 - RNA, 16 nt, Human
uuguagcauccuggaa

SEQ ID NO: 1302141 - RNA, 18 nt, Human
uuguagcauccuggaaua

SEQ ID NO: 1302142 - RNA, 13 nt, Human
uuguaauuuuaca

SEQ ID NO: 1302143 - RNA, 15 nt, Human
uuguaauuuuacacg

SEQ ID NO: 1302144 - RNA, 23 nt, Human
uuguaauuuuuuuaauuuacaaa

SEQ ID NO: 1302145 - RNA, 12 nt, Human
uuguacaaaaua

SEQ ID NO: 1302146 - RNA, 14 nt, Human
uuguacaaaauaaa

SEQ ID NO: 1302147 - RNA, 12 nt, Human
uuguagccagcc

SEQ ID NO: 1302148 - RNA, 15 nt, Human
uuguagccagccggg

SEQ ID NO: 1302149 - RNA, 21 nt, Human
uuguagcgucuuucuuuuuug

SEQ ID NO: 1302150 - RNA, 12 nt, Human
uuguagcuccuc

SEQ ID NO: 1302151 - RNA, 15 nt, Human
uuguagcuccucccc

SEQ ID NO: 1302152 - RNA, 14 nt, Human
uuguagcuggggcu

SEQ ID NO: 1302153 - RNA, 18 nt, Human
uuguagcuggggcuuuga

SEQ ID NO: 1302154 - RNA, 19 nt, Human
uuguagcuggggcuuugau

SEQ ID NO: 1302155 - RNA, 18 nt, Human
augagguacugagaguga

SEQ ID NO: 1302156 - RNA, 17 nt, Human
augagguacugagagug

SEQ ID NO: 1302157 - RNA, 15 nt, Human
augagguacugagag

SEQ ID NO: 1302158 - RNA, 21 nt, Human
augagguacaaccuguucugc

SEQ ID NO: 1302159 - RNA, 17 nt, Human
augaguaacauuugcug

SEQ ID NO: 1302160 - RNA, 16 nt, Human
augaguaacauuugcu

SEQ ID NO: 1302161 - RNA, 13 nt, Human
uuguccauugucc

SEQ ID NO: 1302162 - RNA, 19 nt, Human
uuguccagcugagcgccag

SEQ ID NO: 1302163 - RNA, 23 nt, Human
uugugaaucaagggucaggccuu

SEQ ID NO: 1302164 - RNA, 20 nt, Human
uugugaaucaagggucaggc

SEQ ID NO: 1302165 - RNA, 21 nt, Human
uugugaaucaagggucaggcc

SEQ ID NO: 1302166 - RNA, 21 nt, Human
uugugacagggcggggguggc

SEQ ID NO: 1302167 - RNA, 18 nt, Human
uugugaauuaggcuguaa

SEQ ID NO: 1302168 - RNA, 19 nt, Human
uugugaauuaggcuguaac

SEQ ID NO: 1302169 - RNA, 23 nt, Human
uugugaauuaggcuguaacuacu

SEQ ID NO: 1302170 - RNA, 13 nt, Human
uugugacaaaaaa

SEQ ID NO: 1302171 - RNA, 14 nt, Human
uugugacaaaaaau

SEQ ID NO: 1302172 - RNA, 16 nt, Human
uugugacaaaaaauua

SEQ ID NO: 1302173 - RNA, 22 nt, Human
uugugacaaaaaauuaaagcau

SEQ ID NO: 1302174 - RNA, 18 nt, Human
uugugaugucauacagag

SEQ ID NO: 1302175 - RNA, 20 nt, Human
uugugaugucauacagagaa

SEQ ID NO: 1302176 - RNA, 18 nt, Human
uugugaugugaguugcac

SEQ ID NO: 1302177 - RNA, 18 nt, Human
uugugaugucccaacuug

SEQ ID NO: 1302178 - RNA, 22 nt, Human
uugugaugucccaacuuguaaa

SEQ ID NO: 1302179 - RNA, 13 nt, Human
uugugauaugcac

SEQ ID NO: 1302180 - RNA, 21 nt, Human
uugugauaugcacaauguaga

SEQ ID NO: 1302181 - RNA, 16 nt, Human
uugugauaugcacaau

SEQ ID NO: 1302182 - RNA, 23 nt, Human
uugugaucagaccauaauguuac

SEQ ID NO: 1302183 - RNA, 16 nt, Human
uugugauggagugcug

SEQ ID NO: 1302184 - RNA, 17 nt, Human
uugugauggagugcugu

SEQ ID NO: 1302185 - RNA, 21 nt, Human
uugugaugucauacagagaag

SEQ ID NO: 1302186 - RNA, 17 nt, Human
uugugaugugcacguaa

SEQ ID NO: 1302187 - RNA, 19 nt, Human
uugugauuagacagaacac

SEQ ID NO: 1302188 - RNA, 18 nt, Human
uugugauuagacagaaca

SEQ ID NO: 1302189 - RNA, 19 nt, Human
uugugauucaaucuguaaa

SEQ ID NO: 1302190 - RNA, 23 nt, Human
uugugauucaaucuguaaacugu

SEQ ID NO: 1302191 - RNA, 14 nt, Human
uugugauucugccu

SEQ ID NO: 1302192 - RNA, 15 nt, Human
uugugauuggccugu

SEQ ID NO: 1302193 - RNA, 16 nt, Human
uugugauuggccugua

SEQ ID NO: 1302194 - RNA, 13 nt, Human
uuguguagccuuu

SEQ ID NO: 1302195 - RNA, 14 nt, Human
uuguguagccuuuu

SEQ ID NO: 1302196 - RNA, 16 nt, Human
uuguguauagaacugg

SEQ ID NO: 1302197 - RNA, 15 nt, Human
uuguguagccuuuuu

SEQ ID NO: 1302198 - RNA, 19 nt, Human
uuguguauuuacgcuuuga

SEQ ID NO: 1302199 - RNA, 20 nt, Human
uuguguauuuacgcuuugau

SEQ ID NO: 1302200 - RNA, 22 nt, Human
uuguguauuuacgcuuugauuc

SEQ ID NO: 1302201 - RNA, 23 nt, Human
uuguguauuuacgcuuugauuca

SEQ ID NO: 1302202 - RNA, 19 nt, Human
uugugucauguuuaagaaa

SEQ ID NO: 1302203 - RNA, 9 nt, Human
uuguguccc

SEQ ID NO: 1302204 - RNA, 18 nt, Human
uugugucccaugaucccu

SEQ ID NO: 1302205 - RNA, 18 nt, Human
uugugucccauuccccca

SEQ ID NO: 1302206 - RNA, 22 nt, Human
uugugucccauucccccagugc

SEQ ID NO: 1302207 - RNA, 16 nt, Human
uugugucccuaaugug

SEQ ID NO: 1302208 - RNA, 15 nt, Human
uugugucucuuaugg

SEQ ID NO: 1302209 - RNA, 19 nt, Human
uugugucuggcaguuuaua

SEQ ID NO: 1302210 - RNA, 19 nt, Human
uuguucaccauuauaauga

SEQ ID NO: 1302211 - RNA, 15 nt, Human
uuguucagcaugcaa

SEQ ID NO: 1302212 - RNA, 20 nt, Human
uuuaaaaaagaaacauuugg

SEQ ID NO: 1302213 - RNA, 21 nt, Human
uuuaaaaaacuaaaaacuaga

SEQ ID NO: 1302214 - RNA, 15 nt, Human
uuuaaaaaacuaaaa

SEQ ID NO: 1302215 - RNA, 23 nt, Human
uuuaaaaaaccacauggcacaga

SEQ ID NO: 1302216 - RNA, 14 nt, Human
uuuaaaaaacuaaa

SEQ ID NO: 1302217 - RNA, 11 nt, Human
uuuaaaaauaa

SEQ ID NO: 1302218 - RNA, 18 nt, Human
uuuaaaaauaagucaaca

SEQ ID NO: 1302219 - RNA, 20 nt, Human
uuuaaaaauaagucaacagu

SEQ ID NO: 1302220 - RNA, 21 nt, Human
uuuaaaaauaagucaacagua

SEQ ID NO: 1302221 - RNA, 22 nt, Human
uuuaaaaauaagucaacaguaa

SEQ ID NO: 1302222 - RNA, 15 nt, Human
uuuaaaaaccuugua

SEQ ID NO: 1302223 - RNA, 14 nt, Human
uuuaaaaagccagu

SEQ ID NO: 1302224 - RNA, 12 nt, Human
uuuaaaaaguaa

SEQ ID NO: 1302225 - RNA, 21 nt, Human
uuuaaauauaugcuaagucuu

SEQ ID NO: 1302226 - RNA, 23 nt, Human
uuuaaaaauaagucaacaguaaa

SEQ ID NO: 1302227 - RNA, 20 nt, Human
uuuaaaucuguuuuucuaac

SEQ ID NO: 1302228 - RNA, 13 nt, Human
uuuaaauguauac

SEQ ID NO: 1302229 - RNA, 12 nt, Human
uuuaaauguaua

SEQ ID NO: 1302230 - RNA, 15 nt, Human
uuuaaauguaaagau

SEQ ID NO: 1302231 - RNA, 18 nt, Human
uuuaaauguaaagauauu

SEQ ID NO: 1302232 - RNA, 12 nt, Human
uuuaaaucuguu

SEQ ID NO: 1302233 - RNA, 21 nt, Human
uuuaaaugaacaagagaagca

SEQ ID NO: 1302234 - RNA, 14 nt, Human
uuuaaaugaagaaa

SEQ ID NO: 1302235 - RNA, 18 nt, Human
uuuaaaugcauaaaugca

SEQ ID NO: 1302236 - RNA, 14 nt, Human
uuuaagagacagcc

SEQ ID NO: 1302237 - RNA, 23 nt, Human
uuuaaaugaacaagagaagcauu

SEQ ID NO: 1302238 - RNA, 22 nt, Human
uuuaaggguuuguggaaaauga

SEQ ID NO: 1302239 - RNA, 17 nt, Human
uuuaaggguuuguggaa

SEQ ID NO: 1302240 - RNA, 20 nt, Human
uuuaaggguuuguggaaaau

SEQ ID NO: 1302241 - RNA, 18 nt, Human
uuuaaaaaaauuccaagu

SEQ ID NO: 1302242 - RNA, 17 nt, Human
augcagagguccacaac

SEQ ID NO: 1302243 - RNA, 18 nt, Human
augcagagguccacaaca

SEQ ID NO: 1302244 - RNA, 15 nt, Human
augcagaaagcaucc

SEQ ID NO: 1302245 - RNA, 15 nt, Human
augcagaacaaauga

SEQ ID NO: 1302246 - RNA, 16 nt, Human
augcacugauguugug

SEQ ID NO: 1302247 - RNA, 19 nt, Human
augcagaacaaaugaagac

SEQ ID NO: 1302248 - RNA, 18 nt, Human
augcagaacaaaugaaga

SEQ ID NO: 1302249 - RNA, 19 nt, Human
augcagaacacauuucaaa

SEQ ID NO: 1302250 - RNA, 12 nt, Human
augcagaauguu

SEQ ID NO: 1302251 - RNA, 21 nt, Human
augcagaauguugauuacagu

SEQ ID NO: 1302252 - RNA, 19 nt, Human
augcagaauguugauuaca

SEQ ID NO: 1302253 - RNA, 16 nt, Human
augcagaaagcauccc

SEQ ID NO: 1302254 - RNA, 22 nt, Human
augcacuguucccccugugcag

SEQ ID NO: 1302255 - RNA, 12 nt, Human
augcacugugaa

SEQ ID NO: 1302256 - RNA, 13 nt, Human
augcacugugaag

SEQ ID NO: 1302257 - RNA, 18 nt, Human
augcacugugaaggaccc

SEQ ID NO: 1302258 - RNA, 19 nt, Human
augcacugugaaggacccu

SEQ ID NO: 1302259 - RNA, 20 nt, Human
augcacugugaaggacccuu

SEQ ID NO: 1302260 - RNA, 21 nt, Human
augcacuguucccccugugca

SEQ ID NO: 1302261 - RNA, 16 nt, Human
uuguucagcaugcaau

SEQ ID NO: 1302262 - RNA, 15 nt, Human
uuguucauagcccag

SEQ ID NO: 1302263 - RNA, 16 nt, Human
uuguucuguuaacuga

SEQ ID NO: 1302264 - RNA, 18 nt, Human
uuguucuguuaacugaau

SEQ ID NO: 1302265 - RNA, 17 nt, Human
uuguucuguuaacugaa

SEQ ID NO: 1302266 - RNA, 14 nt, Human
uuguucuucuuaaa

SEQ ID NO: 1302267 - RNA, 17 nt, Human
augauuuaauuugaaau

SEQ ID NO: 1302268 - RNA, 13 nt, Human
augauuuacauuu

SEQ ID NO: 1302269 - RNA, 18 nt, Human
augauuuagagugcuguc

SEQ ID NO: 1302270 - RNA, 13 nt, Human
augauuucauuca

SEQ ID NO: 1302271 - RNA, 14 nt, Human
augauuucauuuca

SEQ ID NO: 1302272 - RNA, 13 nt, Human
augauuuccuuga

SEQ ID NO: 1302273 - RNA, 15 nt, Human
augauuuccuugaau

SEQ ID NO: 1302274 - RNA, 16 nt, Human
augauuuccuugaaug

SEQ ID NO: 1302275 - RNA, 17 nt, Human
augauuuccuugaaugu

SEQ ID NO: 1302276 - RNA, 18 nt, Human
augauuuccuugaaugug

SEQ ID NO: 1302277 - RNA, 19 nt, Human
augauuuccuugaaugugg

SEQ ID NO: 1302278 - RNA, 20 nt, Human
augauuuccuugaauguggc

SEQ ID NO: 1302279 - RNA, 19 nt, Human
augauuuuucuuuacaaaa

SEQ ID NO: 1302280 - RNA, 15 nt, Human
augauuuuucuuuac

SEQ ID NO: 1302281 - RNA, 17 nt, Human
augauuuuuuuuucaua

SEQ ID NO: 1302282 - RNA, 21 nt, Human
augauuuuuuuuucauacacu

SEQ ID NO: 1302283 - RNA, 17 nt, Human
augauuuuucuuuacaa

SEQ ID NO: 1302284 - RNA, 17 nt, Human
augcaaaaacucuuuga

SEQ ID NO: 1302285 - RNA, 23 nt, Human
augcaaaaacucuuugagagggu

SEQ ID NO: 1302286 - RNA, 13 nt, Human
augcaaaagcaag

SEQ ID NO: 1302287 - RNA, 15 nt, Human
augccccugaauuua

SEQ ID NO: 1302288 - RNA, 20 nt, Human
augccccugaauuuaaauag

SEQ ID NO: 1302289 - RNA, 21 nt, Human
augccccgucccccucuggcu

SEQ ID NO: 1302290 - RNA, 14 nt, Human
augccaucaucucc

SEQ ID NO: 1302291 - RNA, 15 nt, Human
augccaucaucuccu

SEQ ID NO: 1302292 - RNA, 16 nt, Human
augccaucaucuccug

SEQ ID NO: 1302293 - RNA, 17 nt, Human
augccaguaacaggcuc

SEQ ID NO: 1302294 - RNA, 22 nt, Human
augccaguaacgcgucuuccug

SEQ ID NO: 1302295 - RNA, 23 nt, Human
augccaguaacgcgucuuccuga

SEQ ID NO: 1302296 - RNA, 16 nt, Human
augccagcuacuuccu

SEQ ID NO: 1302297 - RNA, 16 nt, Human
augccaggaccagucc

SEQ ID NO: 1302298 - RNA, 18 nt, Human
augccacugccuucgcuu

SEQ ID NO: 1302299 - RNA, 17 nt, Human
augccacugccuucgcu

SEQ ID NO: 1302300 - RNA, 17 nt, Human
augccagccaagcucug

SEQ ID NO: 1302301 - RNA, 18 nt, Human
augccagccaagcucugc

SEQ ID NO: 1302302 - RNA, 21 nt, Human
augccagccaagcucugcagu

SEQ ID NO: 1302303 - RNA, 22 nt, Human
augccagccaagcucugcaguc

SEQ ID NO: 1302304 - RNA, 20 nt, Human
augccuuuucccaacuccag

SEQ ID NO: 1302305 - RNA, 22 nt, Human
augccuuuucccaacuccagaa

SEQ ID NO: 1302306 - RNA, 16 nt, Human
augccccuggcuggga

SEQ ID NO: 1302307 - RNA, 14 nt, Human
augccccuuucugg

SEQ ID NO: 1302308 - RNA, 17 nt, Human
augcccggcuaauuuuu

SEQ ID NO: 1302309 - RNA, 14 nt, Human
augccuccuuccuc

SEQ ID NO: 1302310 - RNA, 16 nt, Human
augccuccuuccucuu

SEQ ID NO: 1302311 - RNA, 19 nt, Human
augcgagugcucauuucag

SEQ ID NO: 1302312 - RNA, 13 nt, Human
augcgcaggcugg

SEQ ID NO: 1302313 - RNA, 21 nt, Human
augccuuuucccaaaauguug

SEQ ID NO: 1302314 - RNA, 23 nt, Human
augccuuuucccaaaauguugaa

SEQ ID NO: 1302315 - RNA, 14 nt, Human
augcgcaggcuggc

SEQ ID NO: 1302316 - RNA, 18 nt, Human
augcgcaggcuggcccug

SEQ ID NO: 1302317 - RNA, 20 nt, Human
augcgcaggcuggcccugcc

SEQ ID NO: 1302318 - RNA, 22 nt, Human
augcgcaggcuggcccugcccu

SEQ ID NO: 1302319 - RNA, 12 nt, Human
augcgugugugu

SEQ ID NO: 1302320 - RNA, 23 nt, Human
uuuagugacuaaaccauugugca

SEQ ID NO: 1302321 - RNA, 16 nt, Human
uuuagugaacuugaaa

SEQ ID NO: 1302322 - RNA, 12 nt, Human
uuuagugacuaa

SEQ ID NO: 1302323 - RNA, 24 nt, Human
uuuagugguagcauauagauuguc

SEQ ID NO: 1302324 - RNA, 21 nt, Human
uuuauauguaccguaggcuuu

SEQ ID NO: 1302325 - RNA, 17 nt, Human
uuuauauguacaugaga

SEQ ID NO: 1302326 - RNA, 13 nt, Human
uuuaucacuuaaa

SEQ ID NO: 1302327 - RNA, 21 nt, Human
uuuauaugcuucuguuuuaua

SEQ ID NO: 1302328 - RNA, 13 nt, Human
uuuauauguacau

SEQ ID NO: 1302329 - RNA, 14 nt, Human
uuuauauguacaug

SEQ ID NO: 1302330 - RNA, 17 nt, Human
uuuagggguagcauuug

SEQ ID NO: 1302331 - RNA, 16 nt, Human
uuuagggaacaauuug

SEQ ID NO: 1302332 - RNA, 23 nt, Human
uuuaggagcuaaggcucuaugag

SEQ ID NO: 1302333 - RNA, 17 nt, Human
uuuaggauaaaauaaug

SEQ ID NO: 1302334 - RNA, 18 nt, Human
uuuaggcuauuuguaaau

SEQ ID NO: 1302335 - RNA, 17 nt, Human
uuuagggaacaauuugg

SEQ ID NO: 1302336 - RNA, 13 nt, Human
uuuaggagcagug

SEQ ID NO: 1302337 - RNA, 12 nt, Human
uuuaccucagcc

SEQ ID NO: 1302338 - RNA, 13 nt, Human
uuuaccucagccu

SEQ ID NO: 1302339 - RNA, 13 nt, Human
uuuacccuucagg

SEQ ID NO: 1302340 - RNA, 15 nt, Human
uuuaccuaagauuac

SEQ ID NO: 1302341 - RNA, 16 nt, Human
augcgugugugugugu

SEQ ID NO: 1302342 - RNA, 16 nt, Human
augcguguuucugacu

SEQ ID NO: 1302343 - RNA, 17 nt, Human
augcguguuucugacuc

SEQ ID NO: 1302344 - RNA, 14 nt, Human
augcuaaaaccuga

SEQ ID NO: 1302345 - RNA, 13 nt, Human
augcuaccaccag

SEQ ID NO: 1302346 - RNA, 14 nt, Human
augcuaccaccagc

SEQ ID NO: 1302347 - RNA, 15 nt, Human
augcuaccaccagcu

SEQ ID NO: 1302348 - RNA, 16 nt, Human
augcuaccaccagcug

SEQ ID NO: 1302349 - RNA, 22 nt, Human
augcuaccaccagcugugucca

SEQ ID NO: 1302350 - RNA, 17 nt, Human
augcuaccaccagcugu

SEQ ID NO: 1302351 - RNA, 15 nt, Human
uuuaccucagccugg

SEQ ID NO: 1302352 - RNA, 17 nt, Human
uuuacuccguaacagau

SEQ ID NO: 1302353 - RNA, 12 nt, Human
uuuacucugccu

SEQ ID NO: 1302354 - RNA, 13 nt, Human
uuuacucugccua

SEQ ID NO: 1302355 - RNA, 15 nt, Human
uuuacugcucugaga

SEQ ID NO: 1302356 - RNA, 17 nt, Human
uuuacugcucugagaau

SEQ ID NO: 1302357 - RNA, 13 nt, Human
uuucacauuggaa

SEQ ID NO: 1302358 - RNA, 17 nt, Human
uuucacauuagaagaca

SEQ ID NO: 1302359 - RNA, 18 nt, Human
uuucacauuagaagacaa

SEQ ID NO: 1302360 - RNA, 19 nt, Human
uuucacauuagaagacaau

SEQ ID NO: 1302361 - RNA, 14 nt, Human
uuucacauuggaaa

SEQ ID NO: 1302362 - RNA, 19 nt, Human
uuucacauuggaaacaagu

SEQ ID NO: 1302363 - RNA, 18 nt, Human
uuucaccuggaagcauuu

SEQ ID NO: 1302364 - RNA, 22 nt, Human
uuucaccuggaagcauuuguuu

SEQ ID NO: 1302365 - RNA, 13 nt, Human
uuucaccuguaaa

SEQ ID NO: 1302366 - RNA, 14 nt, Human
uuucaccuguaaac

SEQ ID NO: 1302367 - RNA, 17 nt, Human
uuucaccuguaaaccug

SEQ ID NO: 1302368 - RNA, 18 nt, Human
uuucaccuguaaaccuga

SEQ ID NO: 1302369 - RNA, 21 nt, Human
uuucagaaagaaguggggaca

SEQ ID NO: 1302370 - RNA, 16 nt, Human
uuucacuacucagcau

SEQ ID NO: 1302371 - RNA, 20 nt, Human
uuucacgccugaggcaauua

SEQ ID NO: 1302372 - RNA, 19 nt, Human
uuucaaacauauauaacaa

SEQ ID NO: 1302373 - RNA, 13 nt, Human
auggaauugauuu

SEQ ID NO: 1302374 - RNA, 14 nt, Human
auggaauugauuug

SEQ ID NO: 1302375 - RNA, 15 nt, Human
auggaauugauuugc

SEQ ID NO: 1302376 - RNA, 16 nt, Human
auggaauugauuugca

SEQ ID NO: 1302377 - RNA, 17 nt, Human
auggaauugauuugcau

SEQ ID NO: 1302378 - RNA, 21 nt, Human
uuucaugcuguucaugaaaga

SEQ ID NO: 1302379 - RNA, 15 nt, Human
uuucauccuugucuu

SEQ ID NO: 1302380 - RNA, 24 nt, Human
uuucaucauucacuucacugugcu

SEQ ID NO: 1302381 - RNA, 13 nt, Human
uuucaucauuuuu

SEQ ID NO: 1302382 - RNA, 16 nt, Human
uuucauccauaacuga

SEQ ID NO: 1302383 - RNA, 17 nt, Human
uuucauccauaacugaa

SEQ ID NO: 1302384 - RNA, 19 nt, Human
uuucauccauaacugaaca

SEQ ID NO: 1302385 - RNA, 20 nt, Human
uuucauccauaacugaacau

SEQ ID NO: 1302386 - RNA, 19 nt, Human
uuucauccuaaagaacaaa

SEQ ID NO: 1302387 - RNA, 22 nt, Human
uuucauccuaaagaacaaagua

SEQ ID NO: 1302388 - RNA, 12 nt, Human
uuucccaauuca

SEQ ID NO: 1302389 - RNA, 15 nt, Human
uuucccaauucacau

SEQ ID NO: 1302390 - RNA, 11 nt, Human
uuucccuaagc

SEQ ID NO: 1302391 - RNA, 20 nt, Human
uuucccuaagccagcugccc

SEQ ID NO: 1302392 - RNA, 22 nt, Human
uuucccuaagccagcugccccc

SEQ ID NO: 1302393 - RNA, 22 nt, Human
uuuccauucgugaaaacacauu

SEQ ID NO: 1302394 - RNA, 21 nt, Human
uuuccauuugcauuuguuuau

SEQ ID NO: 1302395 - RNA, 14 nt, Human
uuuccauuugcauu

SEQ ID NO: 1302396 - RNA, 22 nt, Human
uuucccaaagcaucccucuuag

SEQ ID NO: 1302397 - RNA, 20 nt, Human
uuuccauggcaggaaggcuu

SEQ ID NO: 1302398 - RNA, 12 nt, Human
uuucauguacug

SEQ ID NO: 1302399 - RNA, 11 nt, Human
uuucauguacu

SEQ ID NO: 1302400 - RNA, 21 nt, Human
uuuccauggcaggaaggcuug

SEQ ID NO: 1302401 - RNA, 19 nt, Human
uuuccaugggaccacaacu

SEQ ID NO: 1302402 - RNA, 22 nt, Human
uuuccaugggaccacaacuauu

SEQ ID NO: 1302403 - RNA, 15 nt, Human
uuuccauuacaagua

SEQ ID NO: 1302404 - RNA, 18 nt, Human
uuuccauuacaaguauuu

SEQ ID NO: 1302405 - RNA, 18 nt, Human
uuucauguaaacugugca

SEQ ID NO: 1302406 - RNA, 19 nt, Human
uuucauguaaacugugcac

SEQ ID NO: 1302407 - RNA, 12 nt, Human
uuucauguacaa

SEQ ID NO: 1302408 - RNA, 18 nt, Human
uuucauguacaagaugaa

SEQ ID NO: 1302409 - RNA, 23 nt, Human
augcuguauuuuaaaagaaugau

SEQ ID NO: 1302410 - RNA, 16 nt, Human
augcuuaaaauaagca

SEQ ID NO: 1302411 - RNA, 17 nt, Human
augcuuaaaauaagcag

SEQ ID NO: 1302412 - RNA, 22 nt, Human
augcuguauuuuaaaagaauga

SEQ ID NO: 1302413 - RNA, 21 nt, Human
augcuucuguuuuauaauuuu

SEQ ID NO: 1302414 - RNA, 20 nt, Human
augcuuaaagaauucaaauu

SEQ ID NO: 1302415 - RNA, 21 nt, Human
augcuuaaagaauucaaauuu

SEQ ID NO: 1302416 - RNA, 19 nt, Human
augcuuaaagaauucaaau

SEQ ID NO: 1302417 - RNA, 18 nt, Human
augcuuaaagaauucaaa

SEQ ID NO: 1302418 - RNA, 14 nt, Human
auggaaggggcuga

SEQ ID NO: 1302419 - RNA, 23 nt, Human
uuuaucagacucggaaucuauuu

SEQ ID NO: 1302420 - RNA, 18 nt, Human
augcucaggugcuggggc

SEQ ID NO: 1302421 - RNA, 19 nt, Human
augcucaggugcuggggcc

SEQ ID NO: 1302422 - RNA, 13 nt, Human
augcucaucugcu

SEQ ID NO: 1302423 - RNA, 14 nt, Human
augcucaucugcug

SEQ ID NO: 1302424 - RNA, 16 nt, Human
augcucaucugcuggu

SEQ ID NO: 1302425 - RNA, 15 nt, Human
augcuccaagauucu

SEQ ID NO: 1302426 - RNA, 13 nt, Human
augcuccucuucc

SEQ ID NO: 1302427 - RNA, 14 nt, Human
augcuccucuuccc

SEQ ID NO: 1302428 - RNA, 16 nt, Human
augcuccucuucccca

SEQ ID NO: 1302429 - RNA, 18 nt, Human
augcuccucuuccccaga

SEQ ID NO: 1302430 - RNA, 19 nt, Human
augcuccucuuccccagac

SEQ ID NO: 1302431 - RNA, 20 nt, Human
augcuccucuuccccagacg

SEQ ID NO: 1302432 - RNA, 23 nt, Human
augcuccucuuccccagacgccu

SEQ ID NO: 1302433 - RNA, 12 nt, Human
uuguaaugaaaa

SEQ ID NO: 1302434 - RNA, 14 nt, Human
uuguaaucacuguu

SEQ ID NO: 1302435 - RNA, 15 nt, Human
uuguaaucugaauaa

SEQ ID NO: 1302436 - RNA, 17 nt, Human
uuguaaucugaauaaag

SEQ ID NO: 1302437 - RNA, 14 nt, Human
uuguaauucuaaau

SEQ ID NO: 1302438 - RNA, 17 nt, Human
uuguaauucuaaaugaa

SEQ ID NO: 1302439 - RNA, 23 nt, Human
uuguaauucuaaaugaauguuua

SEQ ID NO: 1302440 - RNA, 16 nt, Human
uuguaauuuaaaauaa

SEQ ID NO: 1302441 - RNA, 22 nt, Human
uuguaauuuuacacgcuuuugu

SEQ ID NO: 1302442 - RNA, 22 nt, Human
uuguaagcaugcacaaauucug

SEQ ID NO: 1302443 - RNA, 14 nt, Human
uuguaauaaaaugu

SEQ ID NO: 1302444 - RNA, 15 nt, Human
uuguaauaauaaaga

SEQ ID NO: 1302445 - RNA, 21 nt, Human
uuguaauagauguuugauaga

SEQ ID NO: 1302446 - RNA, 14 nt, Human
uuguaauauguaaa

SEQ ID NO: 1302447 - RNA, 15 nt, Human
uuguaauauguaaau

SEQ ID NO: 1302448 - RNA, 20 nt, Human
uugguuuucacauuggaaac

SEQ ID NO: 1302449 - RNA, 13 nt, Human
uugguuuucuucu

SEQ ID NO: 1302450 - RNA, 14 nt, Human
uugguuuucuucuu

SEQ ID NO: 1302451 - RNA, 13 nt, Human
uuguaaauuguca

SEQ ID NO: 1302452 - RNA, 16 nt, Human
uugguuuugcuacaua

SEQ ID NO: 1302453 - RNA, 14 nt, Human
uuguaacccacuga

SEQ ID NO: 1302454 - RNA, 12 nt, Human
uuguaaccugcu

SEQ ID NO: 1302455 - RNA, 18 nt, Human
uuguaagacaaagguuuu

SEQ ID NO: 1302456 - RNA, 21 nt, Human
uuguaagacaaagguuuuccu

SEQ ID NO: 1302457 - RNA, 22 nt, Human
uuguaagacaaagguuuuccuc

SEQ ID NO: 1302458 - RNA, 20 nt, Human
uuguaagaguggaaccaaca

SEQ ID NO: 1302459 - RNA, 22 nt, Human
uuggggugccccucuccuucuu

SEQ ID NO: 1302460 - RNA, 17 nt, Human
uuggguaaaauacuuuu

SEQ ID NO: 1302461 - RNA, 23 nt, Human
uuggguagaaagagauacagagg

SEQ ID NO: 1302462 - RNA, 14 nt, Human
uuggguccaggagg

SEQ ID NO: 1302463 - RNA, 12 nt, Human
uuggguccagga

SEQ ID NO: 1302464 - RNA, 13 nt, Human
uuggguccaggag

SEQ ID NO: 1302465 - RNA, 14 nt, Human
uugguggccacaua

SEQ ID NO: 1302466 - RNA, 14 nt, Human
uugguuugccuucc

SEQ ID NO: 1302467 - RNA, 12 nt, Human
uugguguuuuuu

SEQ ID NO: 1302468 - RNA, 19 nt, Human
uuggccaugcagaaagcau

SEQ ID NO: 1302469 - RNA, 13 nt, Human
uuggccaugcaga

SEQ ID NO: 1302470 - RNA, 22 nt, Human
uuggccauauuuaccucagccu

SEQ ID NO: 1302471 - RNA, 21 nt, Human
uuggccauauuuaccucagcc

SEQ ID NO: 1302472 - RNA, 12 nt, Human
uuggccaucugc

SEQ ID NO: 1302473 - RNA, 14 nt, Human
uuggccaugggagg

SEQ ID NO: 1302474 - RNA, 14 nt, Human
uuggagcuucaugg

SEQ ID NO: 1302475 - RNA, 14 nt, Human
uuggaggaaguugg

SEQ ID NO: 1302476 - RNA, 13 nt, Human
augaaauauuaug

SEQ ID NO: 1302477 - RNA, 17 nt, Human
augaaauacuauuuaaa

SEQ ID NO: 1302478 - RNA, 18 nt, Human
augaaauauauuuaaaau

SEQ ID NO: 1302479 - RNA, 21 nt, Human
augaacagaacauagacagaa

SEQ ID NO: 1302480 - RNA, 12 nt, Human
augaacaaaugg

SEQ ID NO: 1302481 - RNA, 14 nt, Human
augaacaagagaag

SEQ ID NO: 1302482 - RNA, 18 nt, Human
augaacaagagaagcauu

SEQ ID NO: 1302483 - RNA, 14 nt, Human
augaagcaaugcuu

SEQ ID NO: 1302484 - RNA, 15 nt, Human
augaagaacugagga

SEQ ID NO: 1302485 - RNA, 19 nt, Human
augaagaaaaucacuuagg

SEQ ID NO: 1302486 - RNA, 14 nt, Human
augaagaaagugga

SEQ ID NO: 1302487 - RNA, 14 nt, Human
augaagaacugagg

SEQ ID NO: 1302488 - RNA, 16 nt, Human
augaacacuuaauaaa

SEQ ID NO: 1302489 - RNA, 16 nt, Human
augaacagaacauaga

SEQ ID NO: 1302490 - RNA, 18 nt, Human
augaacccgaggcugaga

SEQ ID NO: 1302491 - RNA, 23 nt, Human
augaaccucaagcugcaucuaga

SEQ ID NO: 1302492 - RNA, 15 nt, Human
augaagcaaugcuuc

SEQ ID NO: 1302493 - RNA, 21 nt, Human
augaagcaaaugucaugcugc

SEQ ID NO: 1302494 - RNA, 22 nt, Human
augaagcaaaugucaugcugcc

SEQ ID NO: 1302495 - RNA, 18 nt, Human
augaaucugcacaucugu

SEQ ID NO: 1302496 - RNA, 13 nt, Human
augaaugaauggc

SEQ ID NO: 1302497 - RNA, 15 nt, Human
aucuuauaauuuaaa

SEQ ID NO: 1302498 - RNA, 16 nt, Human
aucuuauaauuuaaaa

SEQ ID NO: 1302499 - RNA, 15 nt, Human
aucuuaauguaucaa

SEQ ID NO: 1302500 - RNA, 18 nt, Human
aucuuaauguaucaaacu

SEQ ID NO: 1302501 - RNA, 20 nt, Human
aucuuaauguaucaaacugu

SEQ ID NO: 1302502 - RNA, 16 nt, Human
aucuuaauuauuguac

SEQ ID NO: 1302503 - RNA, 22 nt, Human
aucuuggacaaaucacauauuu

SEQ ID NO: 1302504 - RNA, 16 nt, Human
aucuuggacaaaucac

SEQ ID NO: 1302505 - RNA, 16 nt, Human
aucuuggggggguggc

SEQ ID NO: 1302506 - RNA, 20 nt, Human
aucuuggggggguggccgcu

SEQ ID NO: 1302507 - RNA, 23 nt, Human
aucuuggggggguggccgcugag

SEQ ID NO: 1302508 - RNA, 13 nt, Human
uugcccccauuuc

SEQ ID NO: 1302509 - RNA, 14 nt, Human
uugccccccuggcc

SEQ ID NO: 1302510 - RNA, 15 nt, Human
uugccccccuggccu

SEQ ID NO: 1302511 - RNA, 16 nt, Human
uugccccccuggccuc

SEQ ID NO: 1302512 - RNA, 21 nt, Human
uugcccccgugagccaauccc

SEQ ID NO: 1302513 - RNA, 14 nt, Human
uugcccuaagcaga

SEQ ID NO: 1302514 - RNA, 15 nt, Human
uugcccuaagcagaa

SEQ ID NO: 1302515 - RNA, 16 nt, Human
uugcccuaagcagaaa

SEQ ID NO: 1302516 - RNA, 18 nt, Human
uugcccuaagcagaaagu

SEQ ID NO: 1302517 - RNA, 19 nt, Human
uugcccuaagcagaaagug

SEQ ID NO: 1302518 - RNA, 12 nt, Human
aucugucaguuc

SEQ ID NO: 1302519 - RNA, 16 nt, Human
aucugugcacugccca

SEQ ID NO: 1302520 - RNA, 16 nt, Human
aucugugcuguuucaa

SEQ ID NO: 1302521 - RNA, 21 nt, Human
aucugugcuguuucaaaguuc

SEQ ID NO: 1302522 - RNA, 23 nt, Human
aucugugggucugggagucacac

SEQ ID NO: 1302523 - RNA, 12 nt, Human
aucugugucuug

SEQ ID NO: 1302524 - RNA, 13 nt, Human
aucugugucuugu

SEQ ID NO: 1302525 - RNA, 14 nt, Human
aucugugucuuguu

SEQ ID NO: 1302526 - RNA, 14 nt, Human
aucuguuuuucuaa

SEQ ID NO: 1302527 - RNA, 19 nt, Human
aucuuaaaccuuaagauac

SEQ ID NO: 1302528 - RNA, 17 nt, Human
uuggagaagaacugaaa

SEQ ID NO: 1302529 - RNA, 22 nt, Human
uuggagaagaacugaaaucaua

SEQ ID NO: 1302530 - RNA, 15 nt, Human
uuggagaagaacuga

SEQ ID NO: 1302531 - RNA, 16 nt, Human
uuggacuugucccggg

SEQ ID NO: 1302532 - RNA, 20 nt, Human
uuggagauaaucuagaacac

SEQ ID NO: 1302533 - RNA, 22 nt, Human
uugcuuuguaagugaaaaacau

SEQ ID NO: 1302534 - RNA, 20 nt, Human
uuggagaagcccgugugaga

SEQ ID NO: 1302535 - RNA, 18 nt, Human
uuggagaagucucagcua

SEQ ID NO: 1302536 - RNA, 16 nt, Human
uuggagaagucucagc

SEQ ID NO: 1302537 - RNA, 21 nt, Human
uuggagaguuuccugaaacaa

SEQ ID NO: 1302538 - RNA, 16 nt, Human
uugcuuuuaaaaucca

SEQ ID NO: 1302539 - RNA, 20 nt, Human
uugcuuuguauuguauauua

SEQ ID NO: 1302540 - RNA, 13 nt, Human
uugcuuugcccuu

SEQ ID NO: 1302541 - RNA, 16 nt, Human
uugcuuuguaugcacu

SEQ ID NO: 1302542 - RNA, 12 nt, Human
uuggaaaauaaa

SEQ ID NO: 1302543 - RNA, 15 nt, Human
uuggaaaauaaauca

SEQ ID NO: 1302544 - RNA, 13 nt, Human
uuggacuucuggg

SEQ ID NO: 1302545 - RNA, 18 nt, Human
uugcucuugaugccuggc

SEQ ID NO: 1302546 - RNA, 17 nt, Human
uugcugaaaaaugggca

SEQ ID NO: 1302547 - RNA, 13 nt, Human
uugcugaaaaaug

SEQ ID NO: 1302548 - RNA, 17 nt, Human
uugcucuugaugccugg

SEQ ID NO: 1302549 - RNA, 14 nt, Human
uugcucuugaugcc

SEQ ID NO: 1302550 - RNA, 21 nt, Human
aucuuuaaaagaugcuuuuaa

SEQ ID NO: 1302551 - RNA, 14 nt, Human
aucuuuaaaccaau

SEQ ID NO: 1302552 - RNA, 20 nt, Human
aucuuuaaaagaugcuuuua

SEQ ID NO: 1302553 - RNA, 13 nt, Human
uugcuuuguaugc

SEQ ID NO: 1302554 - RNA, 17 nt, Human
uugcuuuggaaguuuua

SEQ ID NO: 1302555 - RNA, 21 nt, Human
uugcuuugaaguagcucuuuu

SEQ ID NO: 1302556 - RNA, 19 nt, Human
uugcuuaucaacuuccuaa

SEQ ID NO: 1302557 - RNA, 13 nt, Human
uugcuuaugacau

SEQ ID NO: 1302558 - RNA, 20 nt, Human
uugcuuauuuauuguauucu

SEQ ID NO: 1302559 - RNA, 13 nt, Human
uugcuucaugugu

SEQ ID NO: 1302560 - RNA, 18 nt, Human
uugcuucaugugucccag

SEQ ID NO: 1302561 - RNA, 20 nt, Human
uugcuucaugugucccagaa

SEQ ID NO: 1302562 - RNA, 19 nt, Human
uugcuucaugugucccaga

SEQ ID NO: 1302563 - RNA, 14 nt, Human
uugcuuccuccucc

SEQ ID NO: 1302564 - RNA, 15 nt, Human
uugcuuccuccuccc

SEQ ID NO: 1302565 - RNA, 17 nt, Human
uugcuuccuccucccca

SEQ ID NO: 1302566 - RNA, 15 nt, Human
uugcuuuauuccaga

SEQ ID NO: 1302567 - RNA, 17 nt, Human
uugcaacuuuguauaaa

SEQ ID NO: 1302568 - RNA, 16 nt, Human
uugcaacuuuguauaa

SEQ ID NO: 1302569 - RNA, 18 nt, Human
uugcaacuuuguauaaaa

SEQ ID NO: 1302570 - RNA, 22 nt, Human
uugcaagccagauuuuccugaa

SEQ ID NO: 1302571 - RNA, 14 nt, Human
uugauguuccuucc

SEQ ID NO: 1302572 - RNA, 19 nt, Human
uugauguuccuuccagugu

SEQ ID NO: 1302573 - RNA, 22 nt, Human
aucugagaaaagcuuugaaccc

SEQ ID NO: 1302574 - RNA, 15 nt, Human
aucucaaacaauuga

SEQ ID NO: 1302575 - RNA, 20 nt, Human
aucugacccagugcccccac

SEQ ID NO: 1302576 - RNA, 21 nt, Human
aucugacccagugcccccacu

SEQ ID NO: 1302577 - RNA, 21 nt, Human
aucugacccuaugggucuagg

SEQ ID NO: 1302578 - RNA, 18 nt, Human
aucugagaaaagcuuuga

SEQ ID NO: 1302579 - RNA, 21 nt, Human
aucugaauaaaguguaacaau

SEQ ID NO: 1302580 - RNA, 14 nt, Human
aucugacccagugc

SEQ ID NO: 1302581 - RNA, 18 nt, Human
aucugacccagugccccc

SEQ ID NO: 1302582 - RNA, 15 nt, Human
aucugaagcccuccc

SEQ ID NO: 1302583 - RNA, 18 nt, Human
aucugaagcccucccagg

SEQ ID NO: 1302584 - RNA, 16 nt, Human
aucucuuguuuaaauu

SEQ ID NO: 1302585 - RNA, 18 nt, Human
aucucaccaggcagccuc

SEQ ID NO: 1302586 - RNA, 19 nt, Human
aucucuuuuugcuuucgaa

SEQ ID NO: 1302587 - RNA, 15 nt, Human
aucucaacaggccuc

SEQ ID NO: 1302588 - RNA, 19 nt, Human
aucucaacaggccucaggg

SEQ ID NO: 1302589 - RNA, 20 nt, Human
aucucaacaggccucagggc

SEQ ID NO: 1302590 - RNA, 11 nt, Human
aucucacacuc

SEQ ID NO: 1302591 - RNA, 20 nt, Human
aucucacacucaugcauugu

SEQ ID NO: 1302592 - RNA, 22 nt, Human
aucucaacaggccucagggcuc

SEQ ID NO: 1302593 - RNA, 22 nt, Human
aucucacacucaugcauugucc

SEQ ID NO: 1302594 - RNA, 16 nt, Human
aucucacauauacaag

SEQ ID NO: 1302595 - RNA, 18 nt, Human
aucucacauauacaagua

SEQ ID NO: 1302596 - RNA, 15 nt, Human
aucucaccaggcagc

SEQ ID NO: 1302597 - RNA, 22 nt, Human
aucucaccaggcagccucuggg

SEQ ID NO: 1302598 - RNA, 15 nt, Human
uugcaauaucugaag

SEQ ID NO: 1302599 - RNA, 22 nt, Human
uugcaauaucugaagcccuccc

SEQ ID NO: 1302600 - RNA, 18 nt, Human
uugcaaucccuuaauauc

SEQ ID NO: 1302601 - RNA, 21 nt, Human
uugcaccccaaagcuuuccug

SEQ ID NO: 1302602 - RNA, 22 nt, Human
uugcaccccaaagcuuuccugc

SEQ ID NO: 1302603 - RNA, 13 nt, Human
uugcauguaguaa

SEQ ID NO: 1302604 - RNA, 17 nt, Human
uugcauguaguaacacu

SEQ ID NO: 1302605 - RNA, 19 nt, Human
uugcauguaguaacacuaa

SEQ ID NO: 1302606 - RNA, 21 nt, Human
uugcauguaguaacacuaaua

SEQ ID NO: 1302607 - RNA, 16 nt, Human
uugccaaauauguccu

SEQ ID NO: 1302608 - RNA, 17 nt, Human
uugccaaauauguccug

SEQ ID NO: 1302609 - RNA, 18 nt, Human
uugccaaauauguccugg

SEQ ID NO: 1302610 - RNA, 22 nt, Human
uugccaagcuccaagccccauc

SEQ ID NO: 1302611 - RNA, 16 nt, Human
uugccaaggcagaggc

SEQ ID NO: 1302612 - RNA, 21 nt, Human
uugccaagggcauaaauuauu

SEQ ID NO: 1302613 - RNA, 18 nt, Human
uugccaauagugucaucc

SEQ ID NO: 1302614 - RNA, 12 nt, Human
uugccacagcuu

SEQ ID NO: 1302615 - RNA, 13 nt, Human
uugccacagcuuu

SEQ ID NO: 1302616 - RNA, 18 nt, Human
uugccacagcuuuugcaa

SEQ ID NO: 1302617 - RNA, 14 nt, Human
uugccacagcuuuu

SEQ ID NO: 1302618 - RNA, 13 nt, Human
uugacaugggaca

SEQ ID NO: 1302619 - RNA, 23 nt, Human
uugacacuagcccaaugaaauga

SEQ ID NO: 1302620 - RNA, 20 nt, Human
aucccuuaauauccuaaaca

SEQ ID NO: 1302621 - RNA, 21 nt, Human
aucccuuaauauccuaaacau

SEQ ID NO: 1302622 - RNA, 16 nt, Human
aucccuucauacuuga

SEQ ID NO: 1302623 - RNA, 20 nt, Human
aucccuucauacuugaacgu

SEQ ID NO: 1302624 - RNA, 15 nt, Human
aucccuuuuucaaug

SEQ ID NO: 1302625 - RNA, 14 nt, Human
auccgaaucucuuu

SEQ ID NO: 1302626 - RNA, 16 nt, Human
uugacaauugggagcu

SEQ ID NO: 1302627 - RNA, 16 nt, Human
uugacacagaaaaugu

SEQ ID NO: 1302628 - RNA, 12 nt, Human
uugacaccugcu

SEQ ID NO: 1302629 - RNA, 19 nt, Human
uugagaaaaauauauacua

SEQ ID NO: 1302630 - RNA, 11 nt, Human
uugagaaaaau

SEQ ID NO: 1302631 - RNA, 17 nt, Human
uugacuuuuugcauuua

SEQ ID NO: 1302632 - RNA, 19 nt, Human
uugacuuuucuguaauuca

SEQ ID NO: 1302633 - RNA, 16 nt, Human
uugacuuuuugcauuu

SEQ ID NO: 1302634 - RNA, 12 nt, Human
uugacuuuuuau

SEQ ID NO: 1302635 - RNA, 13 nt, Human
uugacuuuucugu

SEQ ID NO: 1302636 - RNA, 18 nt, Human
uugacuuuucuguaauuc

SEQ ID NO: 1302637 - RNA, 13 nt, Human
uugacauucugaa

SEQ ID NO: 1302638 - RNA, 14 nt, Human
uugacauucugaau

SEQ ID NO: 1302639 - RNA, 15 nt, Human
uugacauucugaaug

SEQ ID NO: 1302640 - RNA, 16 nt, Human
uugacauucugaaugc

SEQ ID NO: 1302641 - RNA, 18 nt, Human
uugacauucugaaugcuu

SEQ ID NO: 1302642 - RNA, 20 nt, Human
uugacauucugaaugcuucu

SEQ ID NO: 1302643 - RNA, 14 nt, Human
uugacauugcguuu

SEQ ID NO: 1302644 - RNA, 18 nt, Human
uugacauugcguuugacc

SEQ ID NO: 1302645 - RNA, 10 nt, Human
uugagacaga

SEQ ID NO: 1302646 - RNA, 23 nt, Human
uugagaaucccaaauuugauuga

SEQ ID NO: 1302647 - RNA, 19 nt, Human
uugagcaguggcuggucca

SEQ ID NO: 1302648 - RNA, 15 nt, Human
uugagcaucacagaa

SEQ ID NO: 1302649 - RNA, 15 nt, Human
uugagcaucuguccc

SEQ ID NO: 1302650 - RNA, 16 nt, Human
uugagcaucacagaau

SEQ ID NO: 1302651 - RNA, 14 nt, Human
uugagugcucugau

SEQ ID NO: 1302652 - RNA, 15 nt, Human
uugagugcucugauc

SEQ ID NO: 1302653 - RNA, 23 nt, Human
uugagugggguuaucucuguguu

SEQ ID NO: 1302654 - RNA, 13 nt, Human
uugaguguuuaaa

SEQ ID NO: 1302655 - RNA, 13 nt, Human
uugauacuguugc

SEQ ID NO: 1302656 - RNA, 14 nt, Human
uugauacuguugca

SEQ ID NO: 1302657 - RNA, 15 nt, Human
uugauagaaaugcca

SEQ ID NO: 1302658 - RNA, 13 nt, Human
uugauagaaccau

SEQ ID NO: 1302659 - RNA, 15 nt, Human
uugauacuguugcac

SEQ ID NO: 1302660 - RNA, 16 nt, Human
uugauacuguugcacg

SEQ ID NO: 1302661 - RNA, 17 nt, Human
uugauacuguugcacgu

SEQ ID NO: 1302662 - RNA, 18 nt, Human
uugauacuguugcacgug

SEQ ID NO: 1302663 - RNA, 20 nt, Human
uugauacuguugcacgugug

SEQ ID NO: 1302664 - RNA, 13 nt, Human
aucuaauuuauaa

SEQ ID NO: 1302665 - RNA, 14 nt, Human
aucuaauuuauaaa

SEQ ID NO: 1302666 - RNA, 15 nt, Human
aucuaauuuauaaaa

SEQ ID NO: 1302667 - RNA, 19 nt, Human
aucuaauuuauaaaaaggu

SEQ ID NO: 1302668 - RNA, 23 nt, Human
aucuaauuuauaaaaagguguuu

SEQ ID NO: 1302669 - RNA, 15 nt, Human
aucuacuaauuccac

SEQ ID NO: 1302670 - RNA, 19 nt, Human
aucuacuaauuccacaccu

SEQ ID NO: 1302671 - RNA, 14 nt, Human
aucuaccccagacu

SEQ ID NO: 1302672 - RNA, 20 nt, Human
aucuaccccagacuagaugu

SEQ ID NO: 1302673 - RNA, 21 nt, Human
aucuaccccagacuagaugua

SEQ ID NO: 1302674 - RNA, 22 nt, Human
aucuaccccagacuagauguag

SEQ ID NO: 1302675 - RNA, 15 nt, Human
aucuaccuagauuua

SEQ ID NO: 1302676 - RNA, 21 nt, Human
aucuaccuagauuuaauauaa

SEQ ID NO: 1302677 - RNA, 15 nt, Human
aucuacucaaagcau

SEQ ID NO: 1302678 - RNA, 16 nt, Human
aucuagauaucgacuu

SEQ ID NO: 1302679 - RNA, 13 nt, Human
aucuauuuuugga

SEQ ID NO: 1302680 - RNA, 15 nt, Human
aucuauuuuuggagg

SEQ ID NO: 1302681 - RNA, 19 nt, Human
aucuauuuuuggcagucug

SEQ ID NO: 1302682 - RNA, 23 nt, Human
aucuauuuuuggcagucugaauu

SEQ ID NO: 1302683 - RNA, 21 nt, Human
aucuauuuuuggagguuuauu

SEQ ID NO: 1302684 - RNA, 14 nt, Human
auauuugaaauauu

SEQ ID NO: 1302685 - RNA, 19 nt, Human
auauuugaaauauugacuu

SEQ ID NO: 1302686 - RNA, 23 nt, Human
auauuugaaauauugacuuuuua

SEQ ID NO: 1302687 - RNA, 23 nt, Human
auauuucuguaauuauaucuaaa

SEQ ID NO: 1302688 - RNA, 16 nt, Human
auauuuguaaaaugac

SEQ ID NO: 1302689 - RNA, 17 nt, Human
auauuuguaaaaugaca

SEQ ID NO: 1302690 - RNA, 19 nt, Human
auauuuguaaaaugacaau

SEQ ID NO: 1302691 - RNA, 13 nt, Human
auauuuguaaaau

SEQ ID NO: 1302692 - RNA, 15 nt, Human
auauuuguaaaauga

SEQ ID NO: 1302693 - RNA, 13 nt, Human
auauuuguacaua

SEQ ID NO: 1302694 - RNA, 12 nt, Human
auauuuguacau

SEQ ID NO: 1302695 - RNA, 21 nt, Human
auauuugucaugcugggauuu

SEQ ID NO: 1302696 - RNA, 18 nt, Human
auauuugugacaaaaaau

SEQ ID NO: 1302697 - RNA, 15 nt, Human
auauuuguuauguag

SEQ ID NO: 1302698 - RNA, 16 nt, Human
auauuuguuuauggua

SEQ ID NO: 1302699 - RNA, 13 nt, Human
auauuuuaaaauu

SEQ ID NO: 1302700 - RNA, 15 nt, Human
auauuuuaaaauuug

SEQ ID NO: 1302701 - RNA, 17 nt, Human
auauuuuaaaauuuguu

SEQ ID NO: 1302702 - RNA, 18 nt, Human
auauuuuaaaauuuguuc

SEQ ID NO: 1302703 - RNA, 14 nt, Human
auauuuuaaacaga

SEQ ID NO: 1302704 - RNA, 14 nt, Human
auauuuuaaagaau

SEQ ID NO: 1302705 - RNA, 15 nt, Human
auauuuuaaagaauu

SEQ ID NO: 1302706 - RNA, 16 nt, Human
auauuuuaaagaauug

SEQ ID NO: 1302707 - RNA, 20 nt, Human
auauuuuaaagaauuguguc

SEQ ID NO: 1302708 - RNA, 13 nt, Human
auauuugaaauau

SEQ ID NO: 1302709 - RNA, 13 nt, Human
auauuucuauuuu

SEQ ID NO: 1302710 - RNA, 15 nt, Human
auauuucuauuuuau

SEQ ID NO: 1302711 - RNA, 21 nt, Human
auauuucuauuuuauuaugaa

SEQ ID NO: 1302712 - RNA, 23 nt, Human
auauuucuauuuuauuaugaaga

SEQ ID NO: 1302713 - RNA, 16 nt, Human
auauuuaaaaauaagu

SEQ ID NO: 1302714 - RNA, 16 nt, Human
auauuuaaaaguguca

SEQ ID NO: 1302715 - RNA, 16 nt, Human
auauuguugcauugcu

SEQ ID NO: 1302716 - RNA, 13 nt, Human
auauuuaaaaaua

SEQ ID NO: 1302717 - RNA, 14 nt, Human
auauuuaaaaauaa

SEQ ID NO: 1302718 - RNA, 17 nt, Human
auauuguguuuguguau

SEQ ID NO: 1302719 - RNA, 21 nt, Human
auauuguguuuguguauuuac

SEQ ID NO: 1302720 - RNA, 20 nt, Human
auauuguugcauugcuuuuu

SEQ ID NO: 1302721 - RNA, 18 nt, Human
auauugcugaaugcaaga

SEQ ID NO: 1302722 - RNA, 23 nt, Human
auauugccuaagaauaaacauuu

SEQ ID NO: 1302723 - RNA, 21 nt, Human
auauuguggguguuaauuuuu

SEQ ID NO: 1302724 - RNA, 13 nt, Human
auauuguguuugu

SEQ ID NO: 1302725 - RNA, 13 nt, Human
auauugauuuauu

SEQ ID NO: 1302726 - RNA, 15 nt, Human
auauugauuuauuaa

SEQ ID NO: 1302727 - RNA, 17 nt, Human
auauugccauuaugcuu

SEQ ID NO: 1302728 - RNA, 22 nt, Human
auauucucacagcuccaagaau

SEQ ID NO: 1302729 - RNA, 23 nt, Human
auauucucacagcuccaagaauu

SEQ ID NO: 1302730 - RNA, 17 nt, Human
auauuccuauugugcaa

SEQ ID NO: 1302731 - RNA, 22 nt, Human
auauuccuauugugcaauguaa

SEQ ID NO: 1302732 - RNA, 23 nt, Human
auauuccuauugugcaauguaaa

SEQ ID NO: 1302733 - RNA, 17 nt, Human
auauucccuagaaacuu

SEQ ID NO: 1302734 - RNA, 23 nt, Human
auauucccuagaaacuuccaaau

SEQ ID NO: 1302735 - RNA, 22 nt, Human
auauugauccagaaagaaaacu

SEQ ID NO: 1302736 - RNA, 15 nt, Human
auauugauccagaaa

SEQ ID NO: 1302737 - RNA, 16 nt, Human
auauugaaaaaauaga

SEQ ID NO: 1302738 - RNA, 12 nt, Human
auauuaaaucug

SEQ ID NO: 1302739 - RNA, 13 nt, Human
auauuaaaucugc

SEQ ID NO: 1302740 - RNA, 16 nt, Human
auauuaaauuuuuugu

SEQ ID NO: 1302741 - RNA, 18 nt, Human
auauuaaauuuuuuguug

SEQ ID NO: 1302742 - RNA, 18 nt, Human
auauuaaccagauauaua

SEQ ID NO: 1302743 - RNA, 19 nt, Human
auauuaaccagauauauau

SEQ ID NO: 1302744 - RNA, 14 nt, Human
auauuaagaaugau

SEQ ID NO: 1302745 - RNA, 13 nt, Human
auauuaagaauga

SEQ ID NO: 1302746 - RNA, 17 nt, Human
auauuaagaaugaucug

SEQ ID NO: 1302747 - RNA, 17 nt, Human
auauuaagguaguuauu

SEQ ID NO: 1302748 - RNA, 14 nt, Human
auauuaauauuccu

SEQ ID NO: 1302749 - RNA, 16 nt, Human
auauuaaugcccagac

SEQ ID NO: 1302750 - RNA, 16 nt, Human
uucaugucugcuauca

SEQ ID NO: 1302751 - RNA, 15 nt, Human
uucaugugucccaga

SEQ ID NO: 1302752 - RNA, 16 nt, Human
uucaugugucccagaa

SEQ ID NO: 1302753 - RNA, 13 nt, Human
uucauguuaguua

SEQ ID NO: 1302754 - RNA, 16 nt, Human
uucauguuaguuaccu

SEQ ID NO: 1302755 - RNA, 18 nt, Human
uucauguuaguuaccuua

SEQ ID NO: 1302756 - RNA, 22 nt, Human
uucauguuaguuaccuuauagu

SEQ ID NO: 1302757 - RNA, 18 nt, Human
uucaugugucccagaaga

SEQ ID NO: 1302758 - RNA, 18 nt, Human
auauuuucaugcuguuca

SEQ ID NO: 1302759 - RNA, 21 nt, Human
auauuuucaugcuguucauga

SEQ ID NO: 1302760 - RNA, 21 nt, Human
auauuuucaccauuugauuau

SEQ ID NO: 1302761 - RNA, 16 nt, Human
uuccuucagcacuuua

SEQ ID NO: 1302762 - RNA, 19 nt, Human
auauuuucaacgcagcccu

SEQ ID NO: 1302763 - RNA, 20 nt, Human
auauuuucaacgcagcccug

SEQ ID NO: 1302764 - RNA, 19 nt, Human
uuccuucagcacuuuagaa

SEQ ID NO: 1302765 - RNA, 17 nt, Human
uuccuguugucaagaau

SEQ ID NO: 1302766 - RNA, 16 nt, Human
uuccugggagcuuuug

SEQ ID NO: 1302767 - RNA, 16 nt, Human
uuccugggaacaucac

SEQ ID NO: 1302768 - RNA, 16 nt, Human
uuccuggguggcuacu

SEQ ID NO: 1302769 - RNA, 17 nt, Human
uuccuggguggcuacuc

SEQ ID NO: 1302770 - RNA, 23 nt, Human
uuccuggguggcuacucugugcc

SEQ ID NO: 1302771 - RNA, 15 nt, Human
uuccugggagcuuuu

SEQ ID NO: 1302772 - RNA, 22 nt, Human
uuccuguguguccaaaacugcc

SEQ ID NO: 1302773 - RNA, 11 nt, Human
uuccuggugcu

SEQ ID NO: 1302774 - RNA, 22 nt, Human
uuccuggguggcuacucugugc

SEQ ID NO: 1302775 - RNA, 22 nt, Human
uuccugguagaccacugccaua

SEQ ID NO: 1302776 - RNA, 19 nt, Human
uuccuggugccaauuucaa

SEQ ID NO: 1302777 - RNA, 20 nt, Human
uuccuggugccaauuucaag

SEQ ID NO: 1302778 - RNA, 21 nt, Human
uuccuguguguccaaaacugc

SEQ ID NO: 1302779 - RNA, 18 nt, Human
uuccucugucuccuaagc

SEQ ID NO: 1302780 - RNA, 22 nt, Human
uuccucuguucaaagcugccug

SEQ ID NO: 1302781 - RNA, 20 nt, Human
uuccucuucuauuuuguaaa

SEQ ID NO: 1302782 - RNA, 17 nt, Human
uuccucuaguucuuugu

SEQ ID NO: 1302783 - RNA, 22 nt, Human
uuccuaauaaaguucuguacuc

SEQ ID NO: 1302784 - RNA, 11 nt, Human
uuccuccuggg

SEQ ID NO: 1302785 - RNA, 14 nt, Human
uuccuccugggccc

SEQ ID NO: 1302786 - RNA, 15 nt, Human
uuccuccugggcccu

SEQ ID NO: 1302787 - RNA, 21 nt, Human
uuccuccugggcccucucugc

SEQ ID NO: 1302788 - RNA, 23 nt, Human
uuccuccugggcccucucugcuc

SEQ ID NO: 1302789 - RNA, 22 nt, Human
uuccucuaacuuggcucacacu

SEQ ID NO: 1302790 - RNA, 14 nt, Human
auauuuuaagacga

SEQ ID NO: 1302791 - RNA, 12 nt, Human
auauuuuaaaua

SEQ ID NO: 1302792 - RNA, 15 nt, Human
uuccuaauaaaguuc

SEQ ID NO: 1302793 - RNA, 16 nt, Human
uuccuaauaaaguucu

SEQ ID NO: 1302794 - RNA, 19 nt, Human
uuccuaauaaaguucugua

SEQ ID NO: 1302795 - RNA, 12 nt, Human
auauuuucuuuc

SEQ ID NO: 1302796 - RNA, 13 nt, Human
auauuuucuuucu

SEQ ID NO: 1302797 - RNA, 12 nt, Human
auauuuugaauc

SEQ ID NO: 1302798 - RNA, 13 nt, Human
auauuuugaauca

SEQ ID NO: 1302799 - RNA, 19 nt, Human
auauuuugaaucaauaaua

SEQ ID NO: 1302800 - RNA, 14 nt, Human
auauuuugaaucaa

SEQ ID NO: 1302801 - RNA, 13 nt, Human
auauuuucuuuuc

SEQ ID NO: 1302802 - RNA, 12 nt, Human
auauuuugcagu

SEQ ID NO: 1302803 - RNA, 13 nt, Human
aucaagagacuga

SEQ ID NO: 1302804 - RNA, 16 nt, Human
aucaaguauuugggaa

SEQ ID NO: 1302805 - RNA, 18 nt, Human
aucaauaauauauuuucu

SEQ ID NO: 1302806 - RNA, 20 nt, Human
aucaauaauauauuuucugu

SEQ ID NO: 1302807 - RNA, 21 nt, Human
aucaauaauauauuuucuguu

SEQ ID NO: 1302808 - RNA, 13 nt, Human
aucaaucaacuua

SEQ ID NO: 1302809 - RNA, 16 nt, Human
aucacaagauggaauu

SEQ ID NO: 1302810 - RNA, 13 nt, Human
aucacacaaagca

SEQ ID NO: 1302811 - RNA, 17 nt, Human
aucacuagcccuccuuu

SEQ ID NO: 1302812 - RNA, 14 nt, Human
aucacaaaguggaa

SEQ ID NO: 1302813 - RNA, 24 nt, Human
aucacaaaguggaacgaaaaugaa

SEQ ID NO: 1302814 - RNA, 15 nt, Human
aucacaaaguggaac

SEQ ID NO: 1302815 - RNA, 20 nt, Human
uuccuuuuaaaacacuucca

SEQ ID NO: 1302816 - RNA, 13 nt, Human
uuccuuugugcuu

SEQ ID NO: 1302817 - RNA, 21 nt, Human
uuccuuuuaaaacacuuccau

SEQ ID NO: 1302818 - RNA, 22 nt, Human
uuccuuuuaaaacacuuccaua

SEQ ID NO: 1302819 - RNA, 12 nt, Human
uuccuuuuaauu

SEQ ID NO: 1302820 - RNA, 12 nt, Human
uuccuuuuacuu

SEQ ID NO: 1302821 - RNA, 22 nt, Human
uuccuuuuacuuuucuucuauu

SEQ ID NO: 1302822 - RNA, 12 nt, Human
uuccuuuuauca

SEQ ID NO: 1302823 - RNA, 18 nt, Human
uuccuuuuacuuuucuuc

SEQ ID NO: 1302824 - RNA, 12 nt, Human
uuccuuuucacu

SEQ ID NO: 1302825 - RNA, 13 nt, Human
uuccuuuucacug

SEQ ID NO: 1302826 - RNA, 16 nt, Human
uuccuuuucacugcug

SEQ ID NO: 1302827 - RNA, 22 nt, Human
aucacuagcccuccuuuuucca

SEQ ID NO: 1302828 - RNA, 20 nt, Human
aucacuguuuagaacacaca

SEQ ID NO: 1302829 - RNA, 18 nt, Human
aucacuguuuagaacaca

SEQ ID NO: 1302830 - RNA, 14 nt, Human
aucauucauuuucu

SEQ ID NO: 1302831 - RNA, 22 nt, Human
aucauucacuucacugugcugu

SEQ ID NO: 1302832 - RNA, 19 nt, Human
aucauucacuucacugugc

SEQ ID NO: 1302833 - RNA, 17 nt, Human
aucauucacuucacugu

SEQ ID NO: 1302834 - RNA, 15 nt, Human
aucauuauuuaugua

SEQ ID NO: 1302835 - RNA, 17 nt, Human
aucauuauuuauguauu

SEQ ID NO: 1302836 - RNA, 12 nt, Human
aucauucaagug

SEQ ID NO: 1302837 - RNA, 14 nt, Human
aucauuauuuaugu

SEQ ID NO: 1302838 - RNA, 21 nt, Human
aucauucacuucacugugcug

SEQ ID NO: 1302839 - RNA, 15 nt, Human
aucauucauuuuugu

SEQ ID NO: 1302840 - RNA, 15 nt, Human
aucaucaagagaauu

SEQ ID NO: 1302841 - RNA, 16 nt, Human
aucaucaaguaauaca

SEQ ID NO: 1302842 - RNA, 21 nt, Human
aucaucaaguaauacaaacua

SEQ ID NO: 1302843 - RNA, 20 nt, Human
aucaucagaaaggaaaaaca

SEQ ID NO: 1302844 - RNA, 18 nt, Human
aucaucaaguaauacaaa

SEQ ID NO: 1302845 - RNA, 21 nt, Human
aucagaugcuccaagauucua

SEQ ID NO: 1302846 - RNA, 12 nt, Human
aucagaugacaa

SEQ ID NO: 1302847 - RNA, 20 nt, Human
aucagagugacauccaggag

SEQ ID NO: 1302848 - RNA, 17 nt, Human
aucagaguugcugcaaa

SEQ ID NO: 1302849 - RNA, 16 nt, Human
aucagagugacaucca

SEQ ID NO: 1302850 - RNA, 15 nt, Human
aucagauagcaucuu

SEQ ID NO: 1302851 - RNA, 20 nt, Human
aucagaugcuccaagauucu

SEQ ID NO: 1302852 - RNA, 13 nt, Human
aucagucaauauu

SEQ ID NO: 1302853 - RNA, 19 nt, Human
aucagucauaacuaaauaa

SEQ ID NO: 1302854 - RNA, 19 nt, Human
aucaguguaccauuugccu

SEQ ID NO: 1302855 - RNA, 13 nt, Human
aucauaaggcuuc

SEQ ID NO: 1302856 - RNA, 12 nt, Human
aucauagaaaug

SEQ ID NO: 1302857 - RNA, 15 nt, Human
aucauagaaauguaa

SEQ ID NO: 1302858 - RNA, 14 nt, Human
uucucaacuccaaa

SEQ ID NO: 1302859 - RNA, 18 nt, Human
uucucaacuccaaacuga

SEQ ID NO: 1302860 - RNA, 14 nt, Human
uucuaguuucucuu

SEQ ID NO: 1302861 - RNA, 13 nt, Human
uucuauaaggcca

SEQ ID NO: 1302862 - RNA, 14 nt, Human
uucuauaaggccau

SEQ ID NO: 1302863 - RNA, 21 nt, Human
uucuauaaggccauaaaacag

SEQ ID NO: 1302864 - RNA, 23 nt, Human
uucuauaaggccauaaaacaggu

SEQ ID NO: 1302865 - RNA, 21 nt, Human
uucuauaaguuuuauguuaaa

SEQ ID NO: 1302866 - RNA, 13 nt, Human
uucucaaguucua

SEQ ID NO: 1302867 - RNA, 14 nt, Human
uucucaaguucuaa

SEQ ID NO: 1302868 - RNA, 16 nt, Human
uucucaaguucuaaga

SEQ ID NO: 1302869 - RNA, 17 nt, Human
uucucaaguucuaagau

SEQ ID NO: 1302870 - RNA, 18 nt, Human
uucucaaguucuaagauu

SEQ ID NO: 1302871 - RNA, 20 nt, Human
uucucaaguucuaagauucu

SEQ ID NO: 1302872 - RNA, 22 nt, Human
uucucaaguucuaagauucuaa

SEQ ID NO: 1302873 - RNA, 23 nt, Human
uucucaaguucuaagauucuaau

SEQ ID NO: 1302874 - RNA, 13 nt, Human
uucucaauuccaa

SEQ ID NO: 1302875 - RNA, 14 nt, Human
uucucaauuccaac

SEQ ID NO: 1302876 - RNA, 17 nt, Human
uuccuuuugccgacccc

SEQ ID NO: 1302877 - RNA, 20 nt, Human
uuccuuuuuaauaugcuuaa

SEQ ID NO: 1302878 - RNA, 14 nt, Human
uuccuuuuucagau

SEQ ID NO: 1302879 - RNA, 17 nt, Human
uucuaguucugccagga

SEQ ID NO: 1302880 - RNA, 14 nt, Human
uucuaguugaaaau

SEQ ID NO: 1302881 - RNA, 17 nt, Human
uucuagguuucaaagau

SEQ ID NO: 1302882 - RNA, 15 nt, Human
uucuagguucuaaaa

SEQ ID NO: 1302883 - RNA, 13 nt, Human
uucuagguuucaa

SEQ ID NO: 1302884 - RNA, 20 nt, Human
uucuagguuucaaagaugcu

SEQ ID NO: 1302885 - RNA, 23 nt, Human
uucuaggcacuguaguucuaaga

SEQ ID NO: 1302886 - RNA, 21 nt, Human
uucuaggcacuguaguucuaa

SEQ ID NO: 1302887 - RNA, 14 nt, Human
uucuagguaggaaa

SEQ ID NO: 1302888 - RNA, 18 nt, Human
uucuagguaggaaaugug

SEQ ID NO: 1302889 - RNA, 20 nt, Human
uucucacagcuccaagaauu

SEQ ID NO: 1302890 - RNA, 17 nt, Human
uucucaauuccaacagu

SEQ ID NO: 1302891 - RNA, 18 nt, Human
uucucaauuccaacaguu

SEQ ID NO: 1302892 - RNA, 20 nt, Human
uucucaauuccaacaguuua

SEQ ID NO: 1302893 - RNA, 21 nt, Human
uucucacacuggucugcuguc

SEQ ID NO: 1302894 - RNA, 14 nt, Human
uucucaguuuucau

SEQ ID NO: 1302895 - RNA, 15 nt, Human
uucucaguuuucaua

SEQ ID NO: 1302896 - RNA, 12 nt, Human
uucucauaacuu

SEQ ID NO: 1302897 - RNA, 13 nt, Human
uucucaucaguag

SEQ ID NO: 1302898 - RNA, 12 nt, Human
uucucaucagua

SEQ ID NO: 1302899 - RNA, 15 nt, Human
uucucauccugcagg

SEQ ID NO: 1302900 - RNA, 19 nt, Human
aucagaaagggagggcucu

SEQ ID NO: 1302901 - RNA, 20 nt, Human
aucagaaagggagggcucug

SEQ ID NO: 1302902 - RNA, 21 nt, Human
aucagaaagggagggcucuga

SEQ ID NO: 1302903 - RNA, 23 nt, Human
aucagaaagggagggcucugagg

SEQ ID NO: 1302904 - RNA, 22 nt, Human
aucagaaagggagggcucugag

SEQ ID NO: 1302905 - RNA, 12 nt, Human
aucagaacagga

SEQ ID NO: 1302906 - RNA, 22 nt, Human
aucagaacucaaauggggccag

SEQ ID NO: 1302907 - RNA, 23 nt, Human
aucagaacucaaauggggccaga

SEQ ID NO: 1302908 - RNA, 18 nt, Human
aucagaagucaucuugcu

SEQ ID NO: 1302909 - RNA, 22 nt, Human
aucagagaugcaccaccaagcc

SEQ ID NO: 1302910 - RNA, 17 nt, Human
aucagagcgcacaggga

SEQ ID NO: 1302911 - RNA, 22 nt, Human
uucugguaugaacuugaggaca

SEQ ID NO: 1302912 - RNA, 22 nt, Human
uucugguaggaauagcauguca

SEQ ID NO: 1302913 - RNA, 14 nt, Human
uucugguccuuuuu

SEQ ID NO: 1302914 - RNA, 16 nt, Human
uucugguccuuuuugg

SEQ ID NO: 1302915 - RNA, 21 nt, Human
uucugguaugaacuugaggac

SEQ ID NO: 1302916 - RNA, 20 nt, Human
uucugguaggaauagcaugu

SEQ ID NO: 1302917 - RNA, 12 nt, Human
uucugccugcca

SEQ ID NO: 1302918 - RNA, 16 nt, Human
uucugguaaaaagaaa

SEQ ID NO: 1302919 - RNA, 19 nt, Human
uucuguaagaaaccuacug

SEQ ID NO: 1302920 - RNA, 14 nt, Human
uucuguaaagcaaa

SEQ ID NO: 1302921 - RNA, 22 nt, Human
uucuguaaauaaugugcacuga

SEQ ID NO: 1302922 - RNA, 15 nt, Human
uucuguaagaaaccu

SEQ ID NO: 1302923 - RNA, 23 nt, Human
uucuguaauuauaucuaaaauau

SEQ ID NO: 1302924 - RNA, 11 nt, Human
uucuguaauuc

SEQ ID NO: 1302925 - RNA, 16 nt, Human
uucuguaauucagguu

SEQ ID NO: 1302926 - RNA, 21 nt, Human
uucuguaauucagguuuuucc

SEQ ID NO: 1302927 - RNA, 22 nt, Human
uucuguaauucagguuuuuccu

SEQ ID NO: 1302928 - RNA, 13 nt, Human
uucuguaauugug

SEQ ID NO: 1302929 - RNA, 22 nt, Human
uucuguacaugcauugagcucu

SEQ ID NO: 1302930 - RNA, 11 nt, Human
uucuguaccag

SEQ ID NO: 1302931 - RNA, 12 nt, Human
uucuguaccagu

SEQ ID NO: 1302932 - RNA, 13 nt, Human
uucuguaccaguu

SEQ ID NO: 1302933 - RNA, 14 nt, Human
uucuguaccaguua

SEQ ID NO: 1302934 - RNA, 17 nt, Human
uucugccucucuaggac

SEQ ID NO: 1302935 - RNA, 18 nt, Human
uucugccucucuaggacc

SEQ ID NO: 1302936 - RNA, 12 nt, Human
uucugccaggag

SEQ ID NO: 1302937 - RNA, 14 nt, Human
uucugccuccccuu

SEQ ID NO: 1302938 - RNA, 14 nt, Human
uucugaagaagaug

SEQ ID NO: 1302939 - RNA, 16 nt, Human
uucugcaucuccacuu

SEQ ID NO: 1302940 - RNA, 23 nt, Human
uucugaacagcugguguagcuac

SEQ ID NO: 1302941 - RNA, 13 nt, Human
uucugaacuaaag

SEQ ID NO: 1302942 - RNA, 12 nt, Human
uucugaagaaga

SEQ ID NO: 1302943 - RNA, 13 nt, Human
uucugaagaagau

SEQ ID NO: 1302944 - RNA, 21 nt, Human
uucugaaauuuccugggagcu

SEQ ID NO: 1302945 - RNA, 12 nt, Human
uucugaacagcu

SEQ ID NO: 1302946 - RNA, 13 nt, Human
uucugaacagcug

SEQ ID NO: 1302947 - RNA, 14 nt, Human
uucugaacagcugg

SEQ ID NO: 1302948 - RNA, 15 nt, Human
uucugaacagcuggu

SEQ ID NO: 1302949 - RNA, 16 nt, Human
uucugaacagcuggug

SEQ ID NO: 1302950 - RNA, 18 nt, Human
uucugaacagcuggugua

SEQ ID NO: 1302951 - RNA, 22 nt, Human
uucugaacagcugguguagcua

SEQ ID NO: 1302952 - RNA, 22 nt, Human
uucugaacuaaagugcugcacu

SEQ ID NO: 1302953 - RNA, 17 nt, Human
uucucugucucauccau

SEQ ID NO: 1302954 - RNA, 18 nt, Human
uucucuguggcaaagcag

SEQ ID NO: 1302955 - RNA, 16 nt, Human
uucucugugucuaaga

SEQ ID NO: 1302956 - RNA, 17 nt, Human
uucucugugucuaagau

SEQ ID NO: 1302957 - RNA, 18 nt, Human
uucucugugucuaagauu

SEQ ID NO: 1302958 - RNA, 20 nt, Human
uucucugugucuaagauucu

SEQ ID NO: 1302959 - RNA, 21 nt, Human
uucucugugucuaagauucua

SEQ ID NO: 1302960 - RNA, 22 nt, Human
uucucugugucuaagauucuag

SEQ ID NO: 1302961 - RNA, 23 nt, Human
uucucugugucuaagauucuaga

SEQ ID NO: 1302962 - RNA, 20 nt, Human
uucucuguugucguaaagau

SEQ ID NO: 1302963 - RNA, 15 nt, Human
uucugaaaauauaac

SEQ ID NO: 1302964 - RNA, 22 nt, Human
uucucuguugucguaaagauuu

SEQ ID NO: 1302965 - RNA, 23 nt, Human
uucucuguugucguaaagauuug

SEQ ID NO: 1302966 - RNA, 20 nt, Human
aucauuuuaccuuugacaaa

SEQ ID NO: 1302967 - RNA, 18 nt, Human
aucauuuguuuaaaaagg

SEQ ID NO: 1302968 - RNA, 16 nt, Human
auccauguaacugccu

SEQ ID NO: 1302969 - RNA, 13 nt, Human
auccauguaacug

SEQ ID NO: 1302970 - RNA, 15 nt, Human
auccauucuccugag

SEQ ID NO: 1302971 - RNA, 11 nt, Human
aucccaacacu

SEQ ID NO: 1302972 - RNA, 15 nt, Human
aucccaacacugcca

SEQ ID NO: 1302973 - RNA, 16 nt, Human
aucccaacacugccag

SEQ ID NO: 1302974 - RNA, 17 nt, Human
aucccaacacugccagc

SEQ ID NO: 1302975 - RNA, 17 nt, Human
aucccaggauguacaag

SEQ ID NO: 1302976 - RNA, 17 nt, Human
aucccaaguagaaucuc

SEQ ID NO: 1302977 - RNA, 21 nt, Human
uucuguaccaguuaauuuuuc

SEQ ID NO: 1302978 - RNA, 18 nt, Human
uucuguacucaaauguag

SEQ ID NO: 1302979 - RNA, 23 nt, Human
aucauuucuuuuugggagagacu

SEQ ID NO: 1302980 - RNA, 18 nt, Human
aucauuuguuggaaugaa

SEQ ID NO: 1302981 - RNA, 13 nt, Human
aucauuuguuuaa

SEQ ID NO: 1302982 - RNA, 14 nt, Human
aucauuuguuuaaa

SEQ ID NO: 1302983 - RNA, 15 nt, Human
aucauuuguuuaaaa

SEQ ID NO: 1302984 - RNA, 17 nt, Human
auccaggguggugguga

SEQ ID NO: 1302985 - RNA, 14 nt, Human
aucauuuuaauuau

SEQ ID NO: 1302986 - RNA, 15 nt, Human
aucauuuuaauuauu

SEQ ID NO: 1302987 - RNA, 14 nt, Human
auccagguaaucca

SEQ ID NO: 1302988 - RNA, 13 nt, Human
aucccucaucugu

SEQ ID NO: 1302989 - RNA, 17 nt, Human
aucccucaucugucccu

SEQ ID NO: 1302990 - RNA, 15 nt, Human
aucccuccccaguuc

SEQ ID NO: 1302991 - RNA, 16 nt, Human
aucccuccccaguuca

SEQ ID NO: 1302992 - RNA, 18 nt, Human
aucccucccccccaugca

SEQ ID NO: 1302993 - RNA, 19 nt, Human
aucccucccccccaugcac

SEQ ID NO: 1302994 - RNA, 21 nt, Human
aucccucccccccaugcacug

SEQ ID NO: 1302995 - RNA, 22 nt, Human
aucccucccccccaugcacugu

SEQ ID NO: 1302996 - RNA, 12 nt, Human
aucccuccuguu

SEQ ID NO: 1302997 - RNA, 15 nt, Human
aucccuccuguuggg

SEQ ID NO: 1302998 - RNA, 13 nt, Human
aucccuccuguug

SEQ ID NO: 1302999 - RNA, 17 nt, Human
aucccucuacagagcuu

SEQ ID NO: 1303000 - RNA, 19 nt, Human
aucccuggcugggauccac

SEQ ID NO: 1303001 - RNA, 12 nt, Human
aucccuggcccc

SEQ ID NO: 1303002 - RNA, 16 nt, Human
aucccuggcccccucc

SEQ ID NO: 1303003 - RNA, 22 nt, Human
aucccuggcccccucccuggau

SEQ ID NO: 1303004 - RNA, 13 nt, Human
aucccugggccug

SEQ ID NO: 1303005 - RNA, 10 nt, Human
aucccuggcc

SEQ ID NO: 1303006 - RNA, 11 nt, Human
aucccuggccc

SEQ ID NO: 1303007 - RNA, 20 nt, Human
aucccucuacagagcuuccc

SEQ ID NO: 1303008 - RNA, 21 nt, Human
aucccucuacagagcuucccu

SEQ ID NO: 1303009 - RNA, 22 nt, Human
aucccucuacagagcuucccug

SEQ ID NO: 1303010 - RNA, 23 nt, Human
aucccucuacagagcuucccuga

SEQ ID NO: 1303011 - RNA, 14 nt, Human
aucccucuccuccc

SEQ ID NO: 1303012 - RNA, 14 nt, Human
aucccugggccugc

SEQ ID NO: 1303013 - RNA, 15 nt, Human
aucccugggccugcu

SEQ ID NO: 1303014 - RNA, 16 nt, Human
aucccugggccugcug

SEQ ID NO: 1303015 - RNA, 17 nt, Human
aucccugggccugcugc

SEQ ID NO: 1303016 - RNA, 18 nt, Human
aucccugggccugcugcu

SEQ ID NO: 1303017 - RNA, 20 nt, Human
aucccugggccugcugcuga

SEQ ID NO: 1303018 - RNA, 21 nt, Human
aucccugggccugcugcugag

SEQ ID NO: 1303019 - RNA, 22 nt, Human
aucccugggccugcugcugaga

SEQ ID NO: 1303020 - RNA, 20 nt, Human
aucccugggccuugggcucc

SEQ ID NO: 1303021 - RNA, 15 nt, Human
aucccugggccuugg

SEQ ID NO: 1303022 - RNA, 18 nt, Human
aucccuguguugucucua

SEQ ID NO: 1303023 - RNA, 16 nt, Human
uucaaaauuguuacaa

SEQ ID NO: 1303024 - RNA, 16 nt, Human
uucaaaauggagggaa

SEQ ID NO: 1303025 - RNA, 19 nt, Human
uucaaaauaggguauauuu

SEQ ID NO: 1303026 - RNA, 15 nt, Human
uucaaaauguuaucu

SEQ ID NO: 1303027 - RNA, 23 nt, Human
uucaaaauguuaucuucucaagu

SEQ ID NO: 1303028 - RNA, 20 nt, Human
uucaaaauaggguauauuuu

SEQ ID NO: 1303029 - RNA, 13 nt, Human
uucaaaaugauuu

SEQ ID NO: 1303030 - RNA, 19 nt, Human
uucaaaaugauuuccucug

SEQ ID NO: 1303031 - RNA, 22 nt, Human
uucaaaaugauuuccucuguaa

SEQ ID NO: 1303032 - RNA, 23 nt, Human
uucaaaaugauuuccucuguaau

SEQ ID NO: 1303033 - RNA, 17 nt, Human
uucaaaaugcuuuuuau

SEQ ID NO: 1303034 - RNA, 20 nt, Human
uucaaaaugcuuuuuauuau

SEQ ID NO: 1303035 - RNA, 15 nt, Human
uucaaacauauauaa

SEQ ID NO: 1303036 - RNA, 12 nt, Human
uucaaacuacuu

SEQ ID NO: 1303037 - RNA, 13 nt, Human
uucaaacuacuuu

SEQ ID NO: 1303038 - RNA, 22 nt, Human
uucaaacuacuuugcugcuaau

SEQ ID NO: 1303039 - RNA, 14 nt, Human
uucaacuuaacuau

SEQ ID NO: 1303040 - RNA, 19 nt, Human
uucaacuuauuaacaauua

SEQ ID NO: 1303041 - RNA, 20 nt, Human
uuauuuccuaugauguauac

SEQ ID NO: 1303042 - RNA, 22 nt, Human
uuauuuccuaugauguauacug

SEQ ID NO: 1303043 - RNA, 17 nt, Human
uuauuuccuaugaugua

SEQ ID NO: 1303044 - RNA, 11 nt, Human
uuauuuccuau

SEQ ID NO: 1303045 - RNA, 12 nt, Human
uuauuucugcau

SEQ ID NO: 1303046 - RNA, 13 nt, Human
uuauuucugcaua

SEQ ID NO: 1303047 - RNA, 15 nt, Human
uuauuucugcauaug

SEQ ID NO: 1303048 - RNA, 20 nt, Human
uuauuucugcauauguugaa

SEQ ID NO: 1303049 - RNA, 22 nt, Human
uuauuucugcauauguugaaua

SEQ ID NO: 1303050 - RNA, 18 nt, Human
uucaagugcuucuccagc

SEQ ID NO: 1303051 - RNA, 19 nt, Human
uucaaguguaaaauauuuu

SEQ ID NO: 1303052 - RNA, 23 nt, Human
uucaaguuccaaguugcuaauac

SEQ ID NO: 1303053 - RNA, 20 nt, Human
uucaagugauucucaugccu

SEQ ID NO: 1303054 - RNA, 22 nt, Human
uucaagugauucucaugccuca

SEQ ID NO: 1303055 - RNA, 17 nt, Human
uucaaggaauuucuuaa

SEQ ID NO: 1303056 - RNA, 19 nt, Human
uucaaggaauuucuuaacu

SEQ ID NO: 1303057 - RNA, 19 nt, Human
uucaaggaguaugcaggga

SEQ ID NO: 1303058 - RNA, 14 nt, Human
uucaaggcacucua

SEQ ID NO: 1303059 - RNA, 16 nt, Human
uucaaggcacucuaga

SEQ ID NO: 1303060 - RNA, 17 nt, Human
uucaaggcacucuagau

SEQ ID NO: 1303061 - RNA, 18 nt, Human
uucaaggcacucuagauu

SEQ ID NO: 1303062 - RNA, 19 nt, Human
uucaaggcacucuagauuc

SEQ ID NO: 1303063 - RNA, 21 nt, Human
uucaaggcacucuagauucca

SEQ ID NO: 1303064 - RNA, 22 nt, Human
uucaaggcacucuagauuccau

SEQ ID NO: 1303065 - RNA, 23 nt, Human
uucaagaaacugaggaauuuucu

SEQ ID NO: 1303066 - RNA, 22 nt, Human
uucaagaaagcuucaaacugca

SEQ ID NO: 1303067 - RNA, 12 nt, Human
uucaacuuuucc

SEQ ID NO: 1303068 - RNA, 12 nt, Human
uucaagaaacug

SEQ ID NO: 1303069 - RNA, 13 nt, Human
uucaagaaacuga

SEQ ID NO: 1303070 - RNA, 20 nt, Human
uucaagaaacugaggaauuu

SEQ ID NO: 1303071 - RNA, 23 nt, Human
auagggcaauuaauuccuucagc

SEQ ID NO: 1303072 - RNA, 22 nt, Human
auagggcaauuaauuccuucag

SEQ ID NO: 1303073 - RNA, 21 nt, Human
auagggcaauuaauuccuuca

SEQ ID NO: 1303074 - RNA, 22 nt, Human
auagggaaaauucuaacccagg

SEQ ID NO: 1303075 - RNA, 17 nt, Human
auagggcugagcucucu

SEQ ID NO: 1303076 - RNA, 14 nt, Human
auagggcugagcuc

SEQ ID NO: 1303077 - RNA, 14 nt, Human
auagggucuaacuc

SEQ ID NO: 1303078 - RNA, 22 nt, Human
auaggauuuauuuaaaauagca

SEQ ID NO: 1303079 - RNA, 13 nt, Human
auaggcaggaagc

SEQ ID NO: 1303080 - RNA, 20 nt, Human
auaggcaggaagcccaauug

SEQ ID NO: 1303081 - RNA, 12 nt, Human
auaggccagccg

SEQ ID NO: 1303082 - RNA, 16 nt, Human
auagggaaaauucuaa

SEQ ID NO: 1303083 - RNA, 17 nt, Human
auaggcacaggaaacca

SEQ ID NO: 1303084 - RNA, 22 nt, Human
auaggcaccuaccaccacgccc

SEQ ID NO: 1303085 - RNA, 23 nt, Human
auaggauuuauuuaaaauagcaa

SEQ ID NO: 1303086 - RNA, 22 nt, Human
auaggaauugacccacaagaaa

SEQ ID NO: 1303087 - RNA, 23 nt, Human
auaggaucauuuguuggaaugaa

SEQ ID NO: 1303088 - RNA, 16 nt, Human
auaggauuuauuuaaa

SEQ ID NO: 1303089 - RNA, 21 nt, Human
auaggauuuauuuaaaauagc

SEQ ID NO: 1303090 - RNA, 21 nt, Human
auaggaauugacccacaagaa

SEQ ID NO: 1303091 - RNA, 22 nt, Human
uucaccauguuggccaggcugc

SEQ ID NO: 1303092 - RNA, 22 nt, Human
uucaccauguuggccaggcugg

SEQ ID NO: 1303093 - RNA, 15 nt, Human
uucaccauuauaaug

SEQ ID NO: 1303094 - RNA, 20 nt, Human
uucaccauuauaaugaauuu

SEQ ID NO: 1303095 - RNA, 24 nt, Human
uucaccauuuggcaaugccaucau

SEQ ID NO: 1303096 - RNA, 18 nt, Human
uucaccauuauaaugaau

SEQ ID NO: 1303097 - RNA, 18 nt, Human
auagcuuaugaaaagaau

SEQ ID NO: 1303098 - RNA, 14 nt, Human
uucacauuggaaac

SEQ ID NO: 1303099 - RNA, 19 nt, Human
uucacauuuuccuuuucaa

SEQ ID NO: 1303100 - RNA, 17 nt, Human
uucacauuuuuguauuu

SEQ ID NO: 1303101 - RNA, 14 nt, Human
uucaccaaaucuug

SEQ ID NO: 1303102 - RNA, 18 nt, Human
uucaccagauuugcuaau

SEQ ID NO: 1303103 - RNA, 19 nt, Human
uucacauuguauucagagu

SEQ ID NO: 1303104 - RNA, 23 nt, Human
uucacauagcccacuuacauuua

SEQ ID NO: 1303105 - RNA, 13 nt, Human
uucacauuggaaa

SEQ ID NO: 1303106 - RNA, 12 nt, Human
uucaauaaagcu

SEQ ID NO: 1303107 - RNA, 13 nt, Human
uucaauaaagcug

SEQ ID NO: 1303108 - RNA, 13 nt, Human
uucacagcuccuc

SEQ ID NO: 1303109 - RNA, 15 nt, Human
uucacagcuccuccc

SEQ ID NO: 1303110 - RNA, 17 nt, Human
uucacagcuccucccac

SEQ ID NO: 1303111 - RNA, 12 nt, Human
uucacaggcagc

SEQ ID NO: 1303112 - RNA, 13 nt, Human
uucacaggcagcc

SEQ ID NO: 1303113 - RNA, 14 nt, Human
uucacaggcagcca

SEQ ID NO: 1303114 - RNA, 16 nt, Human
uucacaggcagccagu

SEQ ID NO: 1303115 - RNA, 19 nt, Human
uucacaggcagccagugcc

SEQ ID NO: 1303116 - RNA, 19 nt, Human
uucacaguacccaaacugc

SEQ ID NO: 1303117 - RNA, 23 nt, Human
uucacaguacccaaacugcuuuu

SEQ ID NO: 1303118 - RNA, 15 nt, Human
uucacagugcucuuu

SEQ ID NO: 1303119 - RNA, 18 nt, Human
auagcuaaguacacaaua

SEQ ID NO: 1303120 - RNA, 15 nt, Human
auagcuaaguacaca

SEQ ID NO: 1303121 - RNA, 14 nt, Human
auagcuaaguacac

SEQ ID NO: 1303122 - RNA, 13 nt, Human
auagcuaaguaca

SEQ ID NO: 1303123 - RNA, 18 nt, Human
auagcguucuuguaauuu

SEQ ID NO: 1303124 - RNA, 13 nt, Human
auagcuaaauacc

SEQ ID NO: 1303125 - RNA, 13 nt, Human
auagcguucuugu

SEQ ID NO: 1303126 - RNA, 14 nt, Human
auagcguucuugua

SEQ ID NO: 1303127 - RNA, 15 nt, Human
auagcguucuuguaa

SEQ ID NO: 1303128 - RNA, 17 nt, Human
auagcguucuuguaauu

SEQ ID NO: 1303129 - RNA, 17 nt, Human
auagcuacuaauuuuaa

SEQ ID NO: 1303130 - RNA, 14 nt, Human
auagcuacuaauuu

SEQ ID NO: 1303131 - RNA, 16 nt, Human
auaagaguagaaacug

SEQ ID NO: 1303132 - RNA, 16 nt, Human
auaagaguuggcuggu

SEQ ID NO: 1303133 - RNA, 15 nt, Human
auaagauauuuuuca

SEQ ID NO: 1303134 - RNA, 16 nt, Human
auaagauauuuuucau

SEQ ID NO: 1303135 - RNA, 12 nt, Human
uuagacagaggc

SEQ ID NO: 1303136 - RNA, 14 nt, Human
auaacuuccacagg

SEQ ID NO: 1303137 - RNA, 18 nt, Human
auaacuuccacagggucc

SEQ ID NO: 1303138 - RNA, 19 nt, Human
auaacuugagaccuaaucu

SEQ ID NO: 1303139 - RNA, 21 nt, Human
auaacuugagaccuaaucucu

SEQ ID NO: 1303140 - RNA, 16 nt, Human
auaacuuuaacuucug

SEQ ID NO: 1303141 - RNA, 17 nt, Human
auaacuuuaacuucugu

SEQ ID NO: 1303142 - RNA, 22 nt, Human
auaacuuuaacuucuguuuuac

SEQ ID NO: 1303143 - RNA, 15 nt, Human
auaagagcucaggau

SEQ ID NO: 1303144 - RNA, 18 nt, Human
auagcuacuaauuuuaaa

SEQ ID NO: 1303145 - RNA, 19 nt, Human
auagcucuggggugggcag

SEQ ID NO: 1303146 - RNA, 22 nt, Human
auagcucuggggugggcaguuu

SEQ ID NO: 1303147 - RNA, 22 nt, Human
auagcucuaauguuugcauaua

SEQ ID NO: 1303148 - RNA, 21 nt, Human
auagcucuaauguuugcauau

SEQ ID NO: 1303149 - RNA, 20 nt, Human
auagcucuaauguuugcaua

SEQ ID NO: 1303150 - RNA, 19 nt, Human
auagcucuaauguuugcau

SEQ ID NO: 1303151 - RNA, 12 nt, Human
auagcucugggg

SEQ ID NO: 1303152 - RNA, 13 nt, Human
auagcucuggggu

SEQ ID NO: 1303153 - RNA, 18 nt, Human
auagcucuaauguuugca

SEQ ID NO: 1303154 - RNA, 17 nt, Human
auagcucuaauguuugc

SEQ ID NO: 1303155 - RNA, 16 nt, Human
auagcucuaauguuug

SEQ ID NO: 1303156 - RNA, 15 nt, Human
auagcucuaauguuu

SEQ ID NO: 1303157 - RNA, 15 nt, Human
auagcucaugugcau

SEQ ID NO: 1303158 - RNA, 12 nt, Human
uuauuucaauau

SEQ ID NO: 1303159 - RNA, 22 nt, Human
uuauuucccuacauuaaacaug

SEQ ID NO: 1303160 - RNA, 19 nt, Human
uuauuucccuacauuaaac

SEQ ID NO: 1303161 - RNA, 15 nt, Human
uuauuucaugaaaau

SEQ ID NO: 1303162 - RNA, 19 nt, Human
uuauuucaugauuagaaau

SEQ ID NO: 1303163 - RNA, 12 nt, Human
uuauuuauguau

SEQ ID NO: 1303164 - RNA, 15 nt, Human
uuauuuauguauggu

SEQ ID NO: 1303165 - RNA, 21 nt, Human
uuauuuauguauggugcaaug

SEQ ID NO: 1303166 - RNA, 13 nt, Human
uuauuuauguauu

SEQ ID NO: 1303167 - RNA, 14 nt, Human
uuauuuauguauug

SEQ ID NO: 1303168 - RNA, 15 nt, Human
uuauuuauguauugu

SEQ ID NO: 1303169 - RNA, 21 nt, Human
uuauuuauguauugugcaaug

SEQ ID NO: 1303170 - RNA, 15 nt, Human
uuauuuauuggagau

SEQ ID NO: 1303171 - RNA, 15 nt, Human
uuauuuagauucacu

SEQ ID NO: 1303172 - RNA, 15 nt, Human
uuauuuaguauuuau

SEQ ID NO: 1303173 - RNA, 17 nt, Human
uuauuuagcaccaggga

SEQ ID NO: 1303174 - RNA, 16 nt, Human
uuauuuacauuuaaua

SEQ ID NO: 1303175 - RNA, 13 nt, Human
uuauuuacauuua

SEQ ID NO: 1303176 - RNA, 15 nt, Human
uuauuuacauuuaau

SEQ ID NO: 1303177 - RNA, 17 nt, Human
uuauuuaccccuccccu

SEQ ID NO: 1303178 - RNA, 14 nt, Human
auagcugaucaguu

SEQ ID NO: 1303179 - RNA, 17 nt, Human
auagcugcuuccagugu

SEQ ID NO: 1303180 - RNA, 15 nt, Human
auagcuguaaacuuc

SEQ ID NO: 1303181 - RNA, 15 nt, Human
auagcugcuuccagu

SEQ ID NO: 1303182 - RNA, 12 nt, Human
auagcugugacu

SEQ ID NO: 1303183 - RNA, 22 nt, Human
uuauuuaaaauagcaaaagaag

SEQ ID NO: 1303184 - RNA, 21 nt, Human
uuauuuaaaauagcaaaagaa

SEQ ID NO: 1303185 - RNA, 23 nt, Human
uuauuuaaaccgcuaaaagaaac

SEQ ID NO: 1303186 - RNA, 20 nt, Human
uuauuuaaacucuguugcaa

SEQ ID NO: 1303187 - RNA, 17 nt, Human
uuauuuaaaaaacuaaa

SEQ ID NO: 1303188 - RNA, 15 nt, Human
uuauuuaaaauagca

SEQ ID NO: 1303189 - RNA, 16 nt, Human
uuauuuaaaauagcaa

SEQ ID NO: 1303190 - RNA, 14 nt, Human
uuauuuaaaucugu

SEQ ID NO: 1303191 - RNA, 18 nt, Human
auauauucagccuggcuu

SEQ ID NO: 1303192 - RNA, 16 nt, Human
auauauuaucuuuuca

SEQ ID NO: 1303193 - RNA, 14 nt, Human
auauauuauuacuu

SEQ ID NO: 1303194 - RNA, 18 nt, Human
auauauuauuacuuguaa

SEQ ID NO: 1303195 - RNA, 13 nt, Human
auauauuauuaua

SEQ ID NO: 1303196 - RNA, 14 nt, Human
auauauuauuauaa

SEQ ID NO: 1303197 - RNA, 16 nt, Human
auauauuauuauaauc

SEQ ID NO: 1303198 - RNA, 18 nt, Human
auauauuauuauaaucuu

SEQ ID NO: 1303199 - RNA, 17 nt, Human
auaucgacuuguuuuug

SEQ ID NO: 1303200 - RNA, 14 nt, Human
auaucuaaaauauu

SEQ ID NO: 1303201 - RNA, 21 nt, Human
auaucuaaaauauuauuuuau

SEQ ID NO: 1303202 - RNA, 17 nt, Human
auaucuauauuuuacau

SEQ ID NO: 1303203 - RNA, 16 nt, Human
auaucuauauuuuaca

SEQ ID NO: 1303204 - RNA, 20 nt, Human
auaucuauauuuuacauaaa

SEQ ID NO: 1303205 - RNA, 22 nt, Human
auaucuauauuuuacauaaauu

SEQ ID NO: 1303206 - RNA, 16 nt, Human
auaucuagguuuauga

SEQ ID NO: 1303207 - RNA, 23 nt, Human
auaucuaccccagacuagaugua

SEQ ID NO: 1303208 - RNA, 21 nt, Human
auaucuaccccagacuagaug

SEQ ID NO: 1303209 - RNA, 20 nt, Human
uucaucauucacuucacugu

SEQ ID NO: 1303210 - RNA, 17 nt, Human
uucauauuuuaaacaga

SEQ ID NO: 1303211 - RNA, 22 nt, Human
uucauauuuuaaacagaggaua

SEQ ID NO: 1303212 - RNA, 19 nt, Human
uucaucauucacuucacug

SEQ ID NO: 1303213 - RNA, 17 nt, Human
uucauccaaguuaaaug

SEQ ID NO: 1303214 - RNA, 20 nt, Human
uucauccaaguuaaauguag

SEQ ID NO: 1303215 - RNA, 21 nt, Human
uucauauuuuaaacagaggau

SEQ ID NO: 1303216 - RNA, 14 nt, Human
uucaucauuuuuua

SEQ ID NO: 1303217 - RNA, 14 nt, Human
auauauuauacuug

SEQ ID NO: 1303218 - RNA, 17 nt, Human
auauauuauacuuguaa

SEQ ID NO: 1303219 - RNA, 19 nt, Human
auauauuauacuuguaauu

SEQ ID NO: 1303220 - RNA, 22 nt, Human
auauauuauacuuguaauuaug

SEQ ID NO: 1303221 - RNA, 14 nt, Human
auauauuauaugga

SEQ ID NO: 1303222 - RNA, 15 nt, Human
auauauuauauggaa

SEQ ID NO: 1303223 - RNA, 16 nt, Human
auauauuauauggaaa

SEQ ID NO: 1303224 - RNA, 20 nt, Human
auauauuauauggaaauaua

SEQ ID NO: 1303225 - RNA, 13 nt, Human
auauauuaucuuu

SEQ ID NO: 1303226 - RNA, 14 nt, Human
auauauuaucuuuu

SEQ ID NO: 1303227 - RNA, 15 nt, Human
auauauuaucuuuuc

SEQ ID NO: 1303228 - RNA, 21 nt, Human
uucaguacccucucagcucca

SEQ ID NO: 1303229 - RNA, 22 nt, Human
uucaguacccucucagcuccag

SEQ ID NO: 1303230 - RNA, 13 nt, Human
uucauacuugaac

SEQ ID NO: 1303231 - RNA, 18 nt, Human
uucauagagacuugggaa

SEQ ID NO: 1303232 - RNA, 13 nt, Human
uucauagcccagu

SEQ ID NO: 1303233 - RNA, 17 nt, Human
uucaguauuauauguac

SEQ ID NO: 1303234 - RNA, 22 nt, Human
uucauacuguaacauucaggaa

SEQ ID NO: 1303235 - RNA, 15 nt, Human
uucauacuugaacgu

SEQ ID NO: 1303236 - RNA, 15 nt, Human
auaucuauguuuuac

SEQ ID NO: 1303237 - RNA, 16 nt, Human
auaucuauguuuuacc

SEQ ID NO: 1303238 - RNA, 17 nt, Human
auaucuauguuuuacca

SEQ ID NO: 1303239 - RNA, 13 nt, Human
auaugauucaaau

SEQ ID NO: 1303240 - RNA, 22 nt, Human
auaugauucaaaugucuauaaa

SEQ ID NO: 1303241 - RNA, 19 nt, Human
auaucuuggacaaaucaca

SEQ ID NO: 1303242 - RNA, 20 nt, Human
auaucuuggacaaaucacau

SEQ ID NO: 1303243 - RNA, 15 nt, Human
auaucugaagcccuc

SEQ ID NO: 1303244 - RNA, 13 nt, Human
auaucuggccucu

SEQ ID NO: 1303245 - RNA, 19 nt, Human
auaucuggccucugcuuuc

SEQ ID NO: 1303246 - RNA, 16 nt, Human
auaucuguaaugguac

SEQ ID NO: 1303247 - RNA, 15 nt, Human
auaucuguaauggua

SEQ ID NO: 1303248 - RNA, 13 nt, Human
auaugugaacagu

SEQ ID NO: 1303249 - RNA, 11 nt, Human
auauguccugg

SEQ ID NO: 1303250 - RNA, 22 nt, Human
auaugucaagugcugugcaagg

SEQ ID NO: 1303251 - RNA, 14 nt, Human
auaugucagugcug

SEQ ID NO: 1303252 - RNA, 18 nt, Human
auaugucagugcugaugu

SEQ ID NO: 1303253 - RNA, 17 nt, Human
uucauggcagaaggcaa

SEQ ID NO: 1303254 - RNA, 23 nt, Human
uucauggcagauguaggagggac

SEQ ID NO: 1303255 - RNA, 14 nt, Human
uucauguaaacugu

SEQ ID NO: 1303256 - RNA, 17 nt, Human
uucauguaaacugugca

SEQ ID NO: 1303257 - RNA, 18 nt, Human
uucauguaaacugugcac

SEQ ID NO: 1303258 - RNA, 19 nt, Human
uucauguaaacugugcacc

SEQ ID NO: 1303259 - RNA, 18 nt, Human
uucauguaauccucaaga

SEQ ID NO: 1303260 - RNA, 21 nt, Human
uucauguacaagaugaaggag

SEQ ID NO: 1303261 - RNA, 17 nt, Human
uucauguacaagaugaa

SEQ ID NO: 1303262 - RNA, 12 nt, Human
auauguaugggu

SEQ ID NO: 1303263 - RNA, 17 nt, Human
auauguauggguagggu

SEQ ID NO: 1303264 - RNA, 23 nt, Human
auauguauggguaggguaaauca

SEQ ID NO: 1303265 - RNA, 14 nt, Human
auauguaugguuuu

SEQ ID NO: 1303266 - RNA, 15 nt, Human
auaugcacaauagca

SEQ ID NO: 1303267 - RNA, 17 nt, Human
auauaacaaugcuguau

SEQ ID NO: 1303268 - RNA, 19 nt, Human
auauaagcuuguauuccuu

SEQ ID NO: 1303269 - RNA, 22 nt, Human
auauaagggaaguaguuaucau

SEQ ID NO: 1303270 - RNA, 14 nt, Human
auauaagggaagua

SEQ ID NO: 1303271 - RNA, 23 nt, Human
auauaagggaaguaguuaucaug

SEQ ID NO: 1303272 - RNA, 12 nt, Human
auauaagcuuuu

SEQ ID NO: 1303273 - RNA, 12 nt, Human
auauaacaaugc

SEQ ID NO: 1303274 - RNA, 15 nt, Human
auauaacaaugcugu

SEQ ID NO: 1303275 - RNA, 17 nt, Human
auauauaacaaugcugu

SEQ ID NO: 1303276 - RNA, 18 nt, Human
auauauaacaaugcugua

SEQ ID NO: 1303277 - RNA, 19 nt, Human
auauauaacaaugcuguau

SEQ ID NO: 1303278 - RNA, 22 nt, Human
auauaguuagcuaauaaaaagc

SEQ ID NO: 1303279 - RNA, 17 nt, Human
auauaguuagcuaauaa

SEQ ID NO: 1303280 - RNA, 12 nt, Human
auauaguuuuac

SEQ ID NO: 1303281 - RNA, 13 nt, Human
auauaguuuuacu

SEQ ID NO: 1303282 - RNA, 16 nt, Human
auauaguuuuacuuuu

SEQ ID NO: 1303283 - RNA, 18 nt, Human
auauaguuuuacuuuuaa

SEQ ID NO: 1303284 - RNA, 23 nt, Human
auauaguuuuacuuuuaaacugu

SEQ ID NO: 1303285 - RNA, 18 nt, Human
auagucaaauugugugaa

SEQ ID NO: 1303286 - RNA, 23 nt, Human
auagguagaauguaaagcuuguc

SEQ ID NO: 1303287 - RNA, 20 nt, Human
auaggguuugugacagggcg

SEQ ID NO: 1303288 - RNA, 18 nt, Human
auagguagaauguaaagc

SEQ ID NO: 1303289 - RNA, 20 nt, Human
auagguagaauguaaagcuu

SEQ ID NO: 1303290 - RNA, 22 nt, Human
auagucauguaagcugaaaaua

SEQ ID NO: 1303291 - RNA, 17 nt, Human
auaguccagcuuuguuc

SEQ ID NO: 1303292 - RNA, 13 nt, Human
auaguuucugagg

SEQ ID NO: 1303293 - RNA, 14 nt, Human
auaguuucugaggc

SEQ ID NO: 1303294 - RNA, 19 nt, Human
auaguuucugaggcuuuau

SEQ ID NO: 1303295 - RNA, 18 nt, Human
auaguuuggauauguaaa

SEQ ID NO: 1303296 - RNA, 23 nt, Human
auaguuuggauauguaaaacauu

SEQ ID NO: 1303297 - RNA, 19 nt, Human
auaguuuggauauguaaaa

SEQ ID NO: 1303298 - RNA, 15 nt, Human
auaguuuuacuuuua

SEQ ID NO: 1303299 - RNA, 21 nt, Human
auaguuuuacuuuuaaacugu

SEQ ID NO: 1303300 - RNA, 22 nt, Human
auaguuuuacuuuuaaacugug

SEQ ID NO: 1303301 - RNA, 23 nt, Human
auaguuuuacuuuuaaacugugu

SEQ ID NO: 1303302 - RNA, 16 nt, Human
auaguuuuauuaauaa

SEQ ID NO: 1303303 - RNA, 14 nt, Human
auauaaaauaugaa

SEQ ID NO: 1303304 - RNA, 16 nt, Human
auauaaagacguuuua

SEQ ID NO: 1303305 - RNA, 22 nt, Human
auauaaagacguuuuauaagca

SEQ ID NO: 1303306 - RNA, 20 nt, Human
auauaaagacguuuuauaag

SEQ ID NO: 1303307 - RNA, 16 nt, Human
auauaaauauauauuc

SEQ ID NO: 1303308 - RNA, 16 nt, Human
auauaaauauuagaaa

SEQ ID NO: 1303309 - RNA, 22 nt, Human
auauaaauauuagaaacagcuu

SEQ ID NO: 1303310 - RNA, 16 nt, Human
auauaaauauauuauu

SEQ ID NO: 1303311 - RNA, 12 nt, Human
auauaaaugcaa

SEQ ID NO: 1303312 - RNA, 14 nt, Human
auauaaaugcaaau

SEQ ID NO: 1303313 - RNA, 15 nt, Human
auauaaaugcaaaua

SEQ ID NO: 1303314 - RNA, 17 nt, Human
auauaaaugcaaauaac

SEQ ID NO: 1303315 - RNA, 18 nt, Human
auauaaaugcaaauaaca

SEQ ID NO: 1303316 - RNA, 23 nt, Human
auauaaaugcaaauaacaaaugc

SEQ ID NO: 1303317 - RNA, 18 nt, Human
uucagaugugaaccauua

SEQ ID NO: 1303318 - RNA, 20 nt, Human
uucagcaaacucuuuuccca

SEQ ID NO: 1303319 - RNA, 19 nt, Human
uucagcaaagugguucccu

SEQ ID NO: 1303320 - RNA, 18 nt, Human
uucagcaagacuucucuu

SEQ ID NO: 1303321 - RNA, 18 nt, Human
uucagcaagauaaacauu

SEQ ID NO: 1303322 - RNA, 19 nt, Human
uucagcaagauaaacauua

SEQ ID NO: 1303323 - RNA, 15 nt, Human
uucagaugugaacca

SEQ ID NO: 1303324 - RNA, 16 nt, Human
uucagaugugaaccau

SEQ ID NO: 1303325 - RNA, 16 nt, Human
uucagaauuaaacuuu

SEQ ID NO: 1303326 - RNA, 17 nt, Human
uucagaauuaaacuuuu

SEQ ID NO: 1303327 - RNA, 13 nt, Human
uucagaauuuagu

SEQ ID NO: 1303328 - RNA, 15 nt, Human
uucagaauuuagugu

SEQ ID NO: 1303329 - RNA, 23 nt, Human
uucagaauuuuauacuuucccua

SEQ ID NO: 1303330 - RNA, 21 nt, Human
uucagaauuuaguguauccau

SEQ ID NO: 1303331 - RNA, 21 nt, Human
uucagcacuagccaaaccuca

SEQ ID NO: 1303332 - RNA, 23 nt, Human
uucagcacuagccaaaccucacc

SEQ ID NO: 1303333 - RNA, 13 nt, Human
uucagcacugucc

SEQ ID NO: 1303334 - RNA, 19 nt, Human
uucagcaaguuagaacuag

SEQ ID NO: 1303335 - RNA, 17 nt, Human
uucagcaccaagcaugu

SEQ ID NO: 1303336 - RNA, 22 nt, Human
uucagcaccaagcaugucccag

SEQ ID NO: 1303337 - RNA, 16 nt, Human
uucagcacuagccaaa

SEQ ID NO: 1303338 - RNA, 17 nt, Human
uucagcacuagccaaac

SEQ ID NO: 1303339 - RNA, 19 nt, Human
uucagcacuagccaaaccu

SEQ ID NO: 1303340 - RNA, 11 nt, Human
uucagccaagg

SEQ ID NO: 1303341 - RNA, 13 nt, Human
uucagcccaucuc

SEQ ID NO: 1303342 - RNA, 13 nt, Human
uucacugcuggcu

SEQ ID NO: 1303343 - RNA, 15 nt, Human
uucacugcuggcugc

SEQ ID NO: 1303344 - RNA, 16 nt, Human
uucacugcuggcugcc

SEQ ID NO: 1303345 - RNA, 17 nt, Human
uucacugcuggcugccu

SEQ ID NO: 1303346 - RNA, 18 nt, Human
uucacugcuggcugccuu

SEQ ID NO: 1303347 - RNA, 19 nt, Human
uucacugcuggcugccuua

SEQ ID NO: 1303348 - RNA, 15 nt, Human
uucacugcuguuaua

SEQ ID NO: 1303349 - RNA, 23 nt, Human
uucacugcuguuauauuucauca

SEQ ID NO: 1303350 - RNA, 14 nt, Human
uucacuggagcaca

SEQ ID NO: 1303351 - RNA, 15 nt, Human
uucacuggagcacaa

SEQ ID NO: 1303352 - RNA, 17 nt, Human
uucacuggagcacaaua

SEQ ID NO: 1303353 - RNA, 19 nt, Human
auauauacucaagaguggu

SEQ ID NO: 1303354 - RNA, 14 nt, Human
auauauacuauuaa

SEQ ID NO: 1303355 - RNA, 15 nt, Human
uucagaaagaagugg

SEQ ID NO: 1303356 - RNA, 16 nt, Human
uucagaaagacuuggu

SEQ ID NO: 1303357 - RNA, 15 nt, Human
uucagaaaauguucu

SEQ ID NO: 1303358 - RNA, 19 nt, Human
uucagaaaauguucuguuu

SEQ ID NO: 1303359 - RNA, 15 nt, Human
uucagaaguuaguuu

SEQ ID NO: 1303360 - RNA, 20 nt, Human
uucagaaguuaguuuguaua

SEQ ID NO: 1303361 - RNA, 21 nt, Human
uucagaauaugucagugcuga

SEQ ID NO: 1303362 - RNA, 15 nt, Human
uucacuguagaauga

SEQ ID NO: 1303363 - RNA, 22 nt, Human
uucacuguagaaugauuucaug

SEQ ID NO: 1303364 - RNA, 17 nt, Human
uucacuguagcucuaaa

SEQ ID NO: 1303365 - RNA, 15 nt, Human
uuacuguaagaaaau

SEQ ID NO: 1303366 - RNA, 18 nt, Human
uuacugguccaaaagauu

SEQ ID NO: 1303367 - RNA, 14 nt, Human
uuacugguccaaaa

SEQ ID NO: 1303368 - RNA, 15 nt, Human
uuacugguccaaaag

SEQ ID NO: 1303369 - RNA, 17 nt, Human
uuacugguccaaaagau

SEQ ID NO: 1303370 - RNA, 15 nt, Human
uuacuguaacugauu

SEQ ID NO: 1303371 - RNA, 15 nt, Human
uuacuguaauuccuc

SEQ ID NO: 1303372 - RNA, 17 nt, Human
uuagaaauaaagcaucu

SEQ ID NO: 1303373 - RNA, 22 nt, Human
uuagaaauaaagcaucucauuu

SEQ ID NO: 1303374 - RNA, 14 nt, Human
uuagacagaacacc

SEQ ID NO: 1303375 - RNA, 22 nt, Human
uuagacagaacaccuaugcaaa

SEQ ID NO: 1303376 - RNA, 17 nt, Human
uuagaagacaauugaca

SEQ ID NO: 1303377 - RNA, 13 nt, Human
uuagaagccugca

SEQ ID NO: 1303378 - RNA, 23 nt, Human
uuagaagccugcauaauguuucu

SEQ ID NO: 1303379 - RNA, 13 nt, Human
uuagaaccuuucu

SEQ ID NO: 1303380 - RNA, 12 nt, Human
uuacucacugcu

SEQ ID NO: 1303381 - RNA, 14 nt, Human
uuacugauauauuu

SEQ ID NO: 1303382 - RNA, 23 nt, Human
uuacugauauauuuuacaauuuu

SEQ ID NO: 1303383 - RNA, 20 nt, Human
uuacauaauucacucugagu

SEQ ID NO: 1303384 - RNA, 13 nt, Human
uuacaucauuucu

SEQ ID NO: 1303385 - RNA, 14 nt, Human
uuacaucauuucuu

SEQ ID NO: 1303386 - RNA, 18 nt, Human
uuaccugggcauucuugu

SEQ ID NO: 1303387 - RNA, 12 nt, Human
uuaccuguggau

SEQ ID NO: 1303388 - RNA, 13 nt, Human
uuaccuguggaua

SEQ ID NO: 1303389 - RNA, 20 nt, Human
uuaccuguggauauuuguau

SEQ ID NO: 1303390 - RNA, 18 nt, Human
auaaacacucuugaaaaa

SEQ ID NO: 1303391 - RNA, 22 nt, Human
auaaacacaucacagaugaaua

SEQ ID NO: 1303392 - RNA, 19 nt, Human
auaaaguguaacaauugug

SEQ ID NO: 1303393 - RNA, 14 nt, Human
auaaaguguaacaa

SEQ ID NO: 1303394 - RNA, 15 nt, Human
auaaaguucuguacu

SEQ ID NO: 1303395 - RNA, 16 nt, Human
auaaaguugauaaaga

SEQ ID NO: 1303396 - RNA, 21 nt, Human
auaaaguugauaaagauuuuu

SEQ ID NO: 1303397 - RNA, 17 nt, Human
auaaaguugauaaagau

SEQ ID NO: 1303398 - RNA, 20 nt, Human
auaaaguugauaaagauuuu

SEQ ID NO: 1303399 - RNA, 19 nt, Human
auaaauagaauguaaaugu

SEQ ID NO: 1303400 - RNA, 20 nt, Human
auaaauagaauguaaauguc

SEQ ID NO: 1303401 - RNA, 16 nt, Human
auaaauagaauguaaa

SEQ ID NO: 1303402 - RNA, 14 nt, Human
auaaauagaaugua

SEQ ID NO: 1303403 - RNA, 18 nt, Human
auaaauacugcaaaucag

SEQ ID NO: 1303404 - RNA, 13 nt, Human
auaaauauaucua

SEQ ID NO: 1303405 - RNA, 21 nt, Human
auaaauauaucuaccccagac

SEQ ID NO: 1303406 - RNA, 12 nt, Human
auaaauauauua

SEQ ID NO: 1303407 - RNA, 14 nt, Human
auaaauauauuauu

SEQ ID NO: 1303408 - RNA, 18 nt, Human
auaaauauauuauuacuu

SEQ ID NO: 1303409 - RNA, 22 nt, Human
auaaauauauuauuacuuguaa

SEQ ID NO: 1303410 - RNA, 23 nt, Human
auaaauauauuauuacuuguaaa

SEQ ID NO: 1303411 - RNA, 21 nt, Human
auaaauauccuuuaauugauc

SEQ ID NO: 1303412 - RNA, 14 nt, Human
auaaauauccuuua

SEQ ID NO: 1303413 - RNA, 19 nt, Human
uuacaguaggagcccagcu

SEQ ID NO: 1303414 - RNA, 15 nt, Human
uuacaggaacuucau

SEQ ID NO: 1303415 - RNA, 14 nt, Human
uuacagcugccugc

SEQ ID NO: 1303416 - RNA, 13 nt, Human
uuacagcugccug

SEQ ID NO: 1303417 - RNA, 18 nt, Human
auaaauguaccagagaga

SEQ ID NO: 1303418 - RNA, 15 nt, Human
auaaauguacauuaa

SEQ ID NO: 1303419 - RNA, 13 nt, Human
auaaauguaucau

SEQ ID NO: 1303420 - RNA, 17 nt, Human
auaaauguaucauagaa

SEQ ID NO: 1303421 - RNA, 21 nt, Human
auaaauguaucauagaaaugu

SEQ ID NO: 1303422 - RNA, 12 nt, Human
auaaaugucacu

SEQ ID NO: 1303423 - RNA, 19 nt, Human
auaaaugucacuuuuugag

SEQ ID NO: 1303424 - RNA, 14 nt, Human
auaacuaaauaaag

SEQ ID NO: 1303425 - RNA, 23 nt, Human
auaaaugucacuuuuugaggcaa

SEQ ID NO: 1303426 - RNA, 21 nt, Human
auaacuaacaaccaaagacua

SEQ ID NO: 1303427 - RNA, 15 nt, Human
auaacuaacaugucc

SEQ ID NO: 1303428 - RNA, 20 nt, Human
auaaaaggucggaccagcuu

SEQ ID NO: 1303429 - RNA, 16 nt, Human
auaaaauaauuuuuau

SEQ ID NO: 1303430 - RNA, 21 nt, Human
auaaaauaauuuuuauauuug

SEQ ID NO: 1303431 - RNA, 22 nt, Human
auaaaauaauuuuuauauuuga

SEQ ID NO: 1303432 - RNA, 18 nt, Human
auaaaauccauacauuug

SEQ ID NO: 1303433 - RNA, 19 nt, Human
auaaaauccauacauuugu

SEQ ID NO: 1303434 - RNA, 17 nt, Human
auaaaaugcuagguucu

SEQ ID NO: 1303435 - RNA, 19 nt, Human
auaaaaugcuagguucuac

SEQ ID NO: 1303436 - RNA, 18 nt, Human
auaaaaugcuagguucua

SEQ ID NO: 1303437 - RNA, 16 nt, Human
auaaaauguaaacugu

SEQ ID NO: 1303438 - RNA, 18 nt, Human
auaaaauguaaacuguuu

SEQ ID NO: 1303439 - RNA, 23 nt, Human
auaaaauguaaacuguuucuuua

SEQ ID NO: 1303440 - RNA, 11 nt, Human
auaaaauguac

SEQ ID NO: 1303441 - RNA, 18 nt, Human
uuaaguaaugauaacugg

SEQ ID NO: 1303442 - RNA, 17 nt, Human
uuaagugaaaauauagc

SEQ ID NO: 1303443 - RNA, 18 nt, Human
uuaaguaaggaauuuuau

SEQ ID NO: 1303444 - RNA, 22 nt, Human
uuaagaagacugcauuauauuu

SEQ ID NO: 1303445 - RNA, 12 nt, Human
uuaagaaggcaa

SEQ ID NO: 1303446 - RNA, 14 nt, Human
uuaagaaggcaaaa

SEQ ID NO: 1303447 - RNA, 20 nt, Human
uuaauuccuucagcacuuua

SEQ ID NO: 1303448 - RNA, 19 nt, Human
uuaauuccuucagcacuuu

SEQ ID NO: 1303449 - RNA, 17 nt, Human
uuaauuccuucagcacu

SEQ ID NO: 1303450 - RNA, 14 nt, Human
uuaaugaacaaaug

SEQ ID NO: 1303451 - RNA, 14 nt, Human
uuaaugaagaaagu

SEQ ID NO: 1303452 - RNA, 18 nt, Human
uuaaugaagaaaguggaa

SEQ ID NO: 1303453 - RNA, 23 nt, Human
uuaaugaagaaaguggaaaacaa

SEQ ID NO: 1303454 - RNA, 15 nt, Human
uuaaugaagaucuaa

SEQ ID NO: 1303455 - RNA, 17 nt, Human
uuaaugaagaucuaaau

SEQ ID NO: 1303456 - RNA, 18 nt, Human
uuaaugaagaucuaaaua

SEQ ID NO: 1303457 - RNA, 18 nt, Human
uuaauuuaaacaccuccu

SEQ ID NO: 1303458 - RNA, 17 nt, Human
uuaauaaacacucuuga

SEQ ID NO: 1303459 - RNA, 22 nt, Human
uuaaguugagauaguuuucauc

SEQ ID NO: 1303460 - RNA, 23 nt, Human
uuaaguugagauaguuuucaucc

SEQ ID NO: 1303461 - RNA, 18 nt, Human
uuaaguugcugaugaacu

SEQ ID NO: 1303462 - RNA, 13 nt, Human
uuaauaaacacuc

SEQ ID NO: 1303463 - RNA, 20 nt, Human
uuaaguuaguuccacugaga

SEQ ID NO: 1303464 - RNA, 22 nt, Human
uuaaguuauagugaauacugcu

SEQ ID NO: 1303465 - RNA, 11 nt, Human
uuaaguugaga

SEQ ID NO: 1303466 - RNA, 21 nt, Human
uuaaguugagauaguuuucau

SEQ ID NO: 1303467 - RNA, 20 nt, Human
auaaaauuuuuaaucuuuaa

SEQ ID NO: 1303468 - RNA, 19 nt, Human
auaaaauuauagcucuaau

SEQ ID NO: 1303469 - RNA, 13 nt, Human
auaaaauuuguug

SEQ ID NO: 1303470 - RNA, 16 nt, Human
auaaaauuuguugcau

SEQ ID NO: 1303471 - RNA, 13 nt, Human
auaaacaagaaaa

SEQ ID NO: 1303472 - RNA, 16 nt, Human
auaaacaagaaaaaua

SEQ ID NO: 1303473 - RNA, 17 nt, Human
auaaacaagaaaaauaa

SEQ ID NO: 1303474 - RNA, 19 nt, Human
auaaacaagaaaaauaaag

SEQ ID NO: 1303475 - RNA, 20 nt, Human
auaaacaagaaaaauaaaga

SEQ ID NO: 1303476 - RNA, 21 nt, Human
auaaacaagaaaaauaaagaa

SEQ ID NO: 1303477 - RNA, 22 nt, Human
auaaacaagaaaaauaaagaaa

SEQ ID NO: 1303478 - RNA, 18 nt, Human
uuacaaaaauauaaaaua

SEQ ID NO: 1303479 - RNA, 17 nt, Human
uuaauuuaauauuuacu

SEQ ID NO: 1303480 - RNA, 14 nt, Human
uuaauuuacaaaaa

SEQ ID NO: 1303481 - RNA, 22 nt, Human
uuaauuuacaaaaauauaaaau

SEQ ID NO: 1303482 - RNA, 23 nt, Human
uuaauuuacaaaaauauaaaaua

SEQ ID NO: 1303483 - RNA, 15 nt, Human
uuaauuuagaaaacu

SEQ ID NO: 1303484 - RNA, 16 nt, Human
uuaauuuagaaaacuu

SEQ ID NO: 1303485 - RNA, 17 nt, Human
uuaauuuaguaaaccaa

SEQ ID NO: 1303486 - RNA, 16 nt, Human
auaaaauuaaagcuga

SEQ ID NO: 1303487 - RNA, 17 nt, Human
uuacaaaacaaacucau

SEQ ID NO: 1303488 - RNA, 18 nt, Human
uuacaaaacaaacucauu

SEQ ID NO: 1303489 - RNA, 17 nt, Human
uuacaaaacuacaugag

SEQ ID NO: 1303490 - RNA, 18 nt, Human
uuacaaaacuacaugaga

SEQ ID NO: 1303491 - RNA, 20 nt, Human
uuacaaaacuacaugagaac

SEQ ID NO: 1303492 - RNA, 21 nt, Human
auaaaauuauagcucuaaugu

SEQ ID NO: 1303493 - RNA, 17 nt, Human
auaaaauuauagcucua

SEQ ID NO: 1303494 - RNA, 12 nt, Human
auaaaauuauag

SEQ ID NO: 1303495 - RNA, 16 nt, Human
uuaaaauuacaacuaa

SEQ ID NO: 1303496 - RNA, 13 nt, Human
uuaaaauguucac

SEQ ID NO: 1303497 - RNA, 20 nt, Human
uuaaaaaggcaguuugcaaa

SEQ ID NO: 1303498 - RNA, 22 nt, Human
uuaaaaaggcaguuugcaaaaa

SEQ ID NO: 1303499 - RNA, 16 nt, Human
uuaaaaagguuuacag

SEQ ID NO: 1303500 - RNA, 20 nt, Human
uuaaaaaguaauaaaauuca

SEQ ID NO: 1303501 - RNA, 18 nt, Human
uuaaaaaccuguucaagu

SEQ ID NO: 1303502 - RNA, 14 nt, Human
uuaaaaacugagug

SEQ ID NO: 1303503 - RNA, 21 nt, Human
uuaaaaaccuguucaagucua

SEQ ID NO: 1303504 - RNA, 13 nt, Human
uuaaaaagccagu

SEQ ID NO: 1303505 - RNA, 24 nt, Human
aguuuagggaacaauuuggcaauu

SEQ ID NO: 1303506 - RNA, 19 nt, Human
uuaaaauuuguucuuguau

SEQ ID NO: 1303507 - RNA, 12 nt, Human
uuaaaauuuguu

SEQ ID NO: 1303508 - RNA, 21 nt, Human
uuaaaggggagaccucagaag

SEQ ID NO: 1303509 - RNA, 23 nt, Human
uuaaaggggagaccucagaagua

SEQ ID NO: 1303510 - RNA, 13 nt, Human
uuaaauaaauuug

SEQ ID NO: 1303511 - RNA, 16 nt, Human
uuaaauaaauuugacu

SEQ ID NO: 1303512 - RNA, 17 nt, Human
uuaaauaaauuugacuu

SEQ ID NO: 1303513 - RNA, 14 nt, Human
uuaacaacauguuu

SEQ ID NO: 1303514 - RNA, 19 nt, Human
uuaacaacauguuuccagc

SEQ ID NO: 1303515 - RNA, 14 nt, Human
uuaacaacuugucu

SEQ ID NO: 1303516 - RNA, 14 nt, Human
uuaacaagaacuuu

SEQ ID NO: 1303517 - RNA, 22 nt, Human
uuaacaacauguuuccagcauu

SEQ ID NO: 1303518 - RNA, 19 nt, Human
uuaacagagucugaaccua

SEQ ID NO: 1303519 - RNA, 16 nt, Human
uuaacaguaucucaaa

SEQ ID NO: 1303520 - RNA, 18 nt, Human
uuaacaguuccuuucaaa

SEQ ID NO: 1303521 - RNA, 22 nt, Human
uuaacaguuccuuucaaaggag

SEQ ID NO: 1303522 - RNA, 13 nt, Human
uuaacaguuguau

SEQ ID NO: 1303523 - RNA, 15 nt, Human
uuaacaguuguauuu

SEQ ID NO: 1303524 - RNA, 13 nt, Human
uuaacauaagcua

SEQ ID NO: 1303525 - RNA, 14 nt, Human
uuaacauaagcuau

SEQ ID NO: 1303526 - RNA, 15 nt, Human
uuaacauaagcuauu

SEQ ID NO: 1303527 - RNA, 16 nt, Human
uuaacauaagcuauuu

SEQ ID NO: 1303528 - RNA, 18 nt, Human
uuaacauaagcuauuuuu

SEQ ID NO: 1303529 - RNA, 21 nt, Human
uuaacauaagcuauuuuucua

SEQ ID NO: 1303530 - RNA, 12 nt, Human
uuaacauaccua

SEQ ID NO: 1303531 - RNA, 22 nt, Human
uuaacauaccuaagaaguacau

SEQ ID NO: 1303532 - RNA, 17 nt, Human
uuaacauaccuaagaag

SEQ ID NO: 1303533 - RNA, 22 nt, Human
aguuucacagaaaauaaggcac

SEQ ID NO: 1303534 - RNA, 14 nt, Human
aguuucaauuuguu

SEQ ID NO: 1303535 - RNA, 17 nt, Human
aguuucacagaaaauaa

SEQ ID NO: 1303536 - RNA, 20 nt, Human
uuaaauuuuuuuuacauuuu

SEQ ID NO: 1303537 - RNA, 19 nt, Human
uuaaauuuuuuuuacauuu

SEQ ID NO: 1303538 - RNA, 18 nt, Human
uuaaauuuuuuuuacauu

SEQ ID NO: 1303539 - RNA, 18 nt, Human
uuaacaaauguaucacua

SEQ ID NO: 1303540 - RNA, 15 nt, Human
uuaaauuguguuuua

SEQ ID NO: 1303541 - RNA, 22 nt, Human
uuaaauaaauuugacuuuucug

SEQ ID NO: 1303542 - RNA, 15 nt, Human
uuaaauaagaaacuu

SEQ ID NO: 1303543 - RNA, 17 nt, Human
uuaaauaagaaacuuuu

SEQ ID NO: 1303544 - RNA, 13 nt, Human
uuaaauaagauuc

SEQ ID NO: 1303545 - RNA, 14 nt, Human
uuaaauaagauucu

SEQ ID NO: 1303546 - RNA, 15 nt, Human
uuaaauaagauucua

SEQ ID NO: 1303547 - RNA, 16 nt, Human
uuaaauaagauucuaa

SEQ ID NO: 1303548 - RNA, 17 nt, Human
uuaaauaagauucuaac

SEQ ID NO: 1303549 - RNA, 18 nt, Human
uuaaauaagauucuaacg

SEQ ID NO: 1303550 - RNA, 16 nt, Human
uuaaauuggaaagcag

SEQ ID NO: 1303551 - RNA, 17 nt, Human
uuaaauuggaaagcagg

SEQ ID NO: 1303552 - RNA, 15 nt, Human
aguuguuugugccuu

SEQ ID NO: 1303553 - RNA, 17 nt, Human
aguuuaauaaauuuauu

SEQ ID NO: 1303554 - RNA, 16 nt, Human
aguuuaaucagaggaa

SEQ ID NO: 1303555 - RNA, 22 nt, Human
aguuuaauggugccuucauuug

SEQ ID NO: 1303556 - RNA, 20 nt, Human
aguuuaauggugccuucauu

SEQ ID NO: 1303557 - RNA, 16 nt, Human
aguuuaggauaaaaua

SEQ ID NO: 1303558 - RNA, 12 nt, Human
aguuuagggugg

SEQ ID NO: 1303559 - RNA, 12 nt, Human
aguuuaaugaag

SEQ ID NO: 1303560 - RNA, 18 nt, Human
aguuuagggaacaauuug

SEQ ID NO: 1303561 - RNA, 21 nt, Human
aguuuagggaacaauuuggca

SEQ ID NO: 1303562 - RNA, 23 nt, Human
aguuuagggaacaauuuggcaau

SEQ ID NO: 1303563 - RNA, 13 nt, Human
aguuuaggguggg

SEQ ID NO: 1303564 - RNA, 14 nt, Human
aguuuagggugggg

SEQ ID NO: 1303565 - RNA, 13 nt, Human
aguugguaacuuu

SEQ ID NO: 1303566 - RNA, 12 nt, Human
aguuguaaagua

SEQ ID NO: 1303567 - RNA, 13 nt, Human
aguuguaaaguau

SEQ ID NO: 1303568 - RNA, 18 nt, Human
aguuguaaaguauguauu

SEQ ID NO: 1303569 - RNA, 18 nt, Human
aguuguaccgcaauguga

SEQ ID NO: 1303570 - RNA, 17 nt, Human
aguugcagucacucuag

SEQ ID NO: 1303571 - RNA, 13 nt, Human
aguugccuuuuau

SEQ ID NO: 1303572 - RNA, 10 nt, Human
aguugcagcc

SEQ ID NO: 1303573 - RNA, 14 nt, Human
aguugcagcuguuu

SEQ ID NO: 1303574 - RNA, 15 nt, Human
aguugcagcuguuuu

SEQ ID NO: 1303575 - RNA, 17 nt, Human
aguugcagcuguuuugu

SEQ ID NO: 1303576 - RNA, 21 nt, Human
aguugcagcuguuuuguugac

SEQ ID NO: 1303577 - RNA, 22 nt, Human
aguugcagcuguuuuguugaca

SEQ ID NO: 1303578 - RNA, 22 nt, Human
aguugcauagguuuaauaauuu

SEQ ID NO: 1303579 - RNA, 19 nt, Human
aguucuucgacuguuguua

SEQ ID NO: 1303580 - RNA, 18 nt, Human
aguucuucgacuguuguu

SEQ ID NO: 1303581 - RNA, 17 nt, Human
aguucuucgacuguugu

SEQ ID NO: 1303582 - RNA, 15 nt, Human
aguucuucgacuguu

SEQ ID NO: 1303583 - RNA, 15 nt, Human
aguugcacucaggug

SEQ ID NO: 1303584 - RNA, 18 nt, Human
aguugggacuacaggcgu

SEQ ID NO: 1303585 - RNA, 13 nt, Human
aguuggcuucuaa

SEQ ID NO: 1303586 - RNA, 17 nt, Human
aguuggcuuaccuggcc

SEQ ID NO: 1303587 - RNA, 18 nt, Human
aguuggcuuaccuggccc

SEQ ID NO: 1303588 - RNA, 22 nt, Human
aguuggccauauuuaccucagc

SEQ ID NO: 1303589 - RNA, 23 nt, Human
aguuggccauauuuaccucagcc

SEQ ID NO: 1303590 - RNA, 15 nt, Human
aguuggcuuaccugg

SEQ ID NO: 1303591 - RNA, 15 nt, Human
aguugcuauuugaac

SEQ ID NO: 1303592 - RNA, 12 nt, Human
aguugcugagag

SEQ ID NO: 1303593 - RNA, 16 nt, Human
aguugcugcaaaccug

SEQ ID NO: 1303594 - RNA, 17 nt, Human
aguugcugcaaaccuga

SEQ ID NO: 1303595 - RNA, 14 nt, Human
uguuuauuaaucuu

SEQ ID NO: 1303596 - RNA, 15 nt, Human
uguuuauuaaucuua

SEQ ID NO: 1303597 - RNA, 17 nt, Human
uguuuauuaaucuuagu

SEQ ID NO: 1303598 - RNA, 17 nt, Human
uguuuauguaauuucag

SEQ ID NO: 1303599 - RNA, 16 nt, Human
uguuuauaaacauugu

SEQ ID NO: 1303600 - RNA, 19 nt, Human
uguugccuugcauaauggu

SEQ ID NO: 1303601 - RNA, 14 nt, Human
uguugcguuccuuu

SEQ ID NO: 1303602 - RNA, 19 nt, Human
uguuucuuuguaaugaaaa

SEQ ID NO: 1303603 - RNA, 18 nt, Human
uguuucuuuguaaugaaa

SEQ ID NO: 1303604 - RNA, 12 nt, Human
uguuucuugccu

SEQ ID NO: 1303605 - RNA, 15 nt, Human
uguuucuuuaaaauu

SEQ ID NO: 1303606 - RNA, 20 nt, Human
uguuucuuucucugaggaca

SEQ ID NO: 1303607 - RNA, 21 nt, Human
uguuucuuucucugaggacaa

SEQ ID NO: 1303608 - RNA, 14 nt, Human
uguuucuugccuca

SEQ ID NO: 1303609 - RNA, 13 nt, Human
uguuuauuucagg

SEQ ID NO: 1303610 - RNA, 13 nt, Human
uguuucuguucca

SEQ ID NO: 1303611 - RNA, 16 nt, Human
uguuucuguuccaaau

SEQ ID NO: 1303612 - RNA, 15 nt, Human
uguuucuguuccaaa

SEQ ID NO: 1303613 - RNA, 15 nt, Human
uguuucuugccucau

SEQ ID NO: 1303614 - RNA, 15 nt, Human
uguuugaggaaagca

SEQ ID NO: 1303615 - RNA, 13 nt, Human
uguuugauagauu

SEQ ID NO: 1303616 - RNA, 14 nt, Human
uguuugacaccucu

SEQ ID NO: 1303617 - RNA, 18 nt, Human
uguuugagauucucaaag

SEQ ID NO: 1303618 - RNA, 14 nt, Human
uguuuugcaagcca

SEQ ID NO: 1303619 - RNA, 18 nt, Human
uguuuugcacagccaaau

SEQ ID NO: 1303620 - RNA, 12 nt, Human
aguucugccagg

SEQ ID NO: 1303621 - RNA, 21 nt, Human
aguucugcagauaaacaguag

SEQ ID NO: 1303622 - RNA, 16 nt, Human
aguucugcagauaaac

SEQ ID NO: 1303623 - RNA, 23 nt, Human
aguucuuacugcuuaauucaaau

SEQ ID NO: 1303624 - RNA, 19 nt, Human
aguucuuacugcuuaauuc

SEQ ID NO: 1303625 - RNA, 23 nt, Human
aguucuguacucaaauguagcca

SEQ ID NO: 1303626 - RNA, 13 nt, Human
aguucugccagga

SEQ ID NO: 1303627 - RNA, 14 nt, Human
aguucugccaggag

SEQ ID NO: 1303628 - RNA, 20 nt, Human
aguucugccaggagacaggu

SEQ ID NO: 1303629 - RNA, 12 nt, Human
aguucugcucca

SEQ ID NO: 1303630 - RNA, 14 nt, Human
aguucugcuccaga

SEQ ID NO: 1303631 - RNA, 15 nt, Human
aguucugcuccagac

SEQ ID NO: 1303632 - RNA, 17 nt, Human
aguucugcuccagacag

SEQ ID NO: 1303633 - RNA, 18 nt, Human
aguucugcuccagacagg

SEQ ID NO: 1303634 - RNA, 19 nt, Human
aguucugcuccagacaggg

SEQ ID NO: 1303635 - RNA, 16 nt, Human
aguucugcucugguug

SEQ ID NO: 1303636 - RNA, 13 nt, Human
uguuuggagacag

SEQ ID NO: 1303637 - RNA, 12 nt, Human
uguuuggaaaua

SEQ ID NO: 1303638 - RNA, 21 nt, Human
uguuuuauuuaaccucuaaau

SEQ ID NO: 1303639 - RNA, 14 nt, Human
uguuuuaugagaaa

SEQ ID NO: 1303640 - RNA, 15 nt, Human
uguuuuaugagaaag

SEQ ID NO: 1303641 - RNA, 19 nt, Human
uguuuuaugagaaagccuu

SEQ ID NO: 1303642 - RNA, 18 nt, Human
uguuugcaccuuucuagu

SEQ ID NO: 1303643 - RNA, 20 nt, Human
uguuugcaccuuucuaguug

SEQ ID NO: 1303644 - RNA, 23 nt, Human
uguuugcaccuuucuaguugaaa

SEQ ID NO: 1303645 - RNA, 22 nt, Human
uguuugcaccuuucuaguugaa

SEQ ID NO: 1303646 - RNA, 15 nt, Human
uguuugcuucaacug

SEQ ID NO: 1303647 - RNA, 21 nt, Human
uguuugcuucaugugucccag

SEQ ID NO: 1303648 - RNA, 22 nt, Human
uguuugcuucaugugucccaga

SEQ ID NO: 1303649 - RNA, 23 nt, Human
uguuugcuucaugugucccagaa

SEQ ID NO: 1303650 - RNA, 12 nt, Human
uguuugcuuucu

SEQ ID NO: 1303651 - RNA, 22 nt, Human
uguuugcuuucugaucaaggcc

SEQ ID NO: 1303652 - RNA, 13 nt, Human
uguuugcuuucug

SEQ ID NO: 1303653 - RNA, 18 nt, Human
uguuuggaauauugucca

SEQ ID NO: 1303654 - RNA, 16 nt, Human
uguuuucccacgagga

SEQ ID NO: 1303655 - RNA, 16 nt, Human
uguuuuaugagaaagc

SEQ ID NO: 1303656 - RNA, 11 nt, Human
uguuuucuucu

SEQ ID NO: 1303657 - RNA, 17 nt, Human
uguuuucuuuugguaaa

SEQ ID NO: 1303658 - RNA, 17 nt, Human
uguuuugaaggcaaaau

SEQ ID NO: 1303659 - RNA, 13 nt, Human
uguguugaagagg

SEQ ID NO: 1303660 - RNA, 15 nt, Human
uguguugauacauuc

SEQ ID NO: 1303661 - RNA, 15 nt, Human
uguguugauacuguu

SEQ ID NO: 1303662 - RNA, 16 nt, Human
uguguugauacuguug

SEQ ID NO: 1303663 - RNA, 17 nt, Human
uguguugauacuguugc

SEQ ID NO: 1303664 - RNA, 18 nt, Human
uguguugauacuguugca

SEQ ID NO: 1303665 - RNA, 19 nt, Human
uguguugauacuguugcac

SEQ ID NO: 1303666 - RNA, 20 nt, Human
uguguugauacuguugcacg

SEQ ID NO: 1303667 - RNA, 21 nt, Human
uguguugauacuguugcacgu

SEQ ID NO: 1303668 - RNA, 22 nt, Human
uguguugauacuguugcacgug

SEQ ID NO: 1303669 - RNA, 16 nt, Human
uguuaaauacaggaaa

SEQ ID NO: 1303670 - RNA, 21 nt, Human
uguguuaagcucugcuauuag

SEQ ID NO: 1303671 - RNA, 13 nt, Human
uguguguuuggaa

SEQ ID NO: 1303672 - RNA, 19 nt, Human
uguguuaagcucugcuauu

SEQ ID NO: 1303673 - RNA, 19 nt, Human
uguguucccauuucagcug

SEQ ID NO: 1303674 - RNA, 18 nt, Human
uguuaaauacaggaaaca

SEQ ID NO: 1303675 - RNA, 13 nt, Human
uguuaagcucugc

SEQ ID NO: 1303676 - RNA, 14 nt, Human
uguuaagcucugcu

SEQ ID NO: 1303677 - RNA, 20 nt, Human
uguuaagggaagaauuccag

SEQ ID NO: 1303678 - RNA, 15 nt, Human
uguuaaguauuuuca

SEQ ID NO: 1303679 - RNA, 17 nt, Human
uguuaaguauuuucaua

SEQ ID NO: 1303680 - RNA, 15 nt, Human
uguuaauuuagaaaa

SEQ ID NO: 1303681 - RNA, 17 nt, Human
uguuaauuuagaaaacu

SEQ ID NO: 1303682 - RNA, 18 nt, Human
uguuaauuuagaaaacuu

SEQ ID NO: 1303683 - RNA, 20 nt, Human
uguuaauuuagaaaacuuua

SEQ ID NO: 1303684 - RNA, 22 nt, Human
uguuaauuuagaaaacuuuaaa

SEQ ID NO: 1303685 - RNA, 13 nt, Human
uguuaauuuuuga

SEQ ID NO: 1303686 - RNA, 15 nt, Human
uguuaauuuuugaua

SEQ ID NO: 1303687 - RNA, 16 nt, Human
uguuaauuuuugauac

SEQ ID NO: 1303688 - RNA, 20 nt, Human
ugugugaaagguacuucaaa

SEQ ID NO: 1303689 - RNA, 18 nt, Human
ugugucuuucacagcucc

SEQ ID NO: 1303690 - RNA, 22 nt, Human
ugugucuuucacagcuccuccc

SEQ ID NO: 1303691 - RNA, 17 nt, Human
ugugugaaacuuucauu

SEQ ID NO: 1303692 - RNA, 11 nt, Human
ugugugugugc

SEQ ID NO: 1303693 - RNA, 13 nt, Human
ugugugugugaau

SEQ ID NO: 1303694 - RNA, 13 nt, Human
uguguaaguagau

SEQ ID NO: 1303695 - RNA, 17 nt, Human
uguguaagaaauacaga

SEQ ID NO: 1303696 - RNA, 12 nt, Human
uguguaagauuu

SEQ ID NO: 1303697 - RNA, 13 nt, Human
uguguaagauuug

SEQ ID NO: 1303698 - RNA, 14 nt, Human
ugugucuuuagaua

SEQ ID NO: 1303699 - RNA, 18 nt, Human
uguguaagacaaaaagcu

SEQ ID NO: 1303700 - RNA, 18 nt, Human
uguguaacugcccaaagc

SEQ ID NO: 1303701 - RNA, 21 nt, Human
uguguaacugcccaaagcagc

SEQ ID NO: 1303702 - RNA, 14 nt, Human
uguggguguuaauu

SEQ ID NO: 1303703 - RNA, 22 nt, Human
uguggguguuaauuuuugauac

SEQ ID NO: 1303704 - RNA, 15 nt, Human
uguggguuccacaga

SEQ ID NO: 1303705 - RNA, 16 nt, Human
uguggguuccacagac

SEQ ID NO: 1303706 - RNA, 15 nt, Human
uguggguuuuuauuu

SEQ ID NO: 1303707 - RNA, 23 nt, Human
uguggugugucccccucugucca

SEQ ID NO: 1303708 - RNA, 16 nt, Human
agugcuguuuuguuau

SEQ ID NO: 1303709 - RNA, 23 nt, Human
agugcugucuuaaacuaaaugug

SEQ ID NO: 1303710 - RNA, 18 nt, Human
agugcugugcaagguauu

SEQ ID NO: 1303711 - RNA, 17 nt, Human
agugcugugcugugcua

SEQ ID NO: 1303712 - RNA, 20 nt, Human
agugcuguuuauuaaucuua

SEQ ID NO: 1303713 - RNA, 21 nt, Human
agugcuguuuauuaaucuuag

SEQ ID NO: 1303714 - RNA, 22 nt, Human
agugcuguuuauuaaucuuagu

SEQ ID NO: 1303715 - RNA, 12 nt, Human
agugcugugcug

SEQ ID NO: 1303716 - RNA, 15 nt, Human
agugcuguuuuguua

SEQ ID NO: 1303717 - RNA, 19 nt, Human
agugcuguuuuguuauaua

SEQ ID NO: 1303718 - RNA, 19 nt, Human
agugcugaauuucccucuc

SEQ ID NO: 1303719 - RNA, 15 nt, Human
agugcugagauuaca

SEQ ID NO: 1303720 - RNA, 15 nt, Human
agugcugcacucaaa

SEQ ID NO: 1303721 - RNA, 15 nt, Human
agugcugaauuuccc

SEQ ID NO: 1303722 - RNA, 20 nt, Human
agugaguaauuuuggauuuu

SEQ ID NO: 1303723 - RNA, 17 nt, Human
agugaguaauuuuggau

SEQ ID NO: 1303724 - RNA, 16 nt, Human
agugaggugugucaca

SEQ ID NO: 1303725 - RNA, 22 nt, Human
agugaggugugucacaaugaga

SEQ ID NO: 1303726 - RNA, 20 nt, Human
agugcugagauuacaggcau

SEQ ID NO: 1303727 - RNA, 21 nt, Human
agugcugagauuacaggcaug

SEQ ID NO: 1303728 - RNA, 15 nt, Human
uguuauaaucuuuca

SEQ ID NO: 1303729 - RNA, 16 nt, Human
uguuauauauaaauau

SEQ ID NO: 1303730 - RNA, 17 nt, Human
uguuauauauaaauaua

SEQ ID NO: 1303731 - RNA, 18 nt, Human
uguuauauauaaauauau

SEQ ID NO: 1303732 - RNA, 22 nt, Human
uguuauauccugacaagauuau

SEQ ID NO: 1303733 - RNA, 16 nt, Human
uguuauacaauacaga

SEQ ID NO: 1303734 - RNA, 15 nt, Human
uguuauauaaucauu

SEQ ID NO: 1303735 - RNA, 16 nt, Human
uguuauauaaucauua

SEQ ID NO: 1303736 - RNA, 12 nt, Human
uguuauauaauu

SEQ ID NO: 1303737 - RNA, 15 nt, Human
uguuauauaauuuag

SEQ ID NO: 1303738 - RNA, 13 nt, Human
uguuauauauaaa

SEQ ID NO: 1303739 - RNA, 15 nt, Human
uguuauauauaaaua

SEQ ID NO: 1303740 - RNA, 13 nt, Human
uguucugucacca

SEQ ID NO: 1303741 - RNA, 23 nt, Human
uguucccaagagcaucaugccuc

SEQ ID NO: 1303742 - RNA, 18 nt, Human
uguuccaguaaucuaaua

SEQ ID NO: 1303743 - RNA, 15 nt, Human
uguuccauuaaacga

SEQ ID NO: 1303744 - RNA, 16 nt, Human
uguucccaagagcauc

SEQ ID NO: 1303745 - RNA, 22 nt, Human
uguucccaagagcaucaugccu

SEQ ID NO: 1303746 - RNA, 18 nt, Human
uguucugugauauaagug

SEQ ID NO: 1303747 - RNA, 15 nt, Human
uguucugugauauaa

SEQ ID NO: 1303748 - RNA, 16 nt, Human
uguucugucccuugcc

SEQ ID NO: 1303749 - RNA, 18 nt, Human
uguucugucccuugcccc

SEQ ID NO: 1303750 - RNA, 13 nt, Human
uguucugugucuu

SEQ ID NO: 1303751 - RNA, 14 nt, Human
uguucugugucuuu

SEQ ID NO: 1303752 - RNA, 16 nt, Human
uguucuguuaacugaa

SEQ ID NO: 1303753 - RNA, 17 nt, Human
uguucuguuaacugaau

SEQ ID NO: 1303754 - RNA, 18 nt, Human
uguucuguuaacugaaua

SEQ ID NO: 1303755 - RNA, 19 nt, Human
uguucuguuaacugaauac

SEQ ID NO: 1303756 - RNA, 21 nt, Human
uguucuguuaacugaauacca

SEQ ID NO: 1303757 - RNA, 23 nt, Human
uguucuguuaacugaauaccacu

SEQ ID NO: 1303758 - RNA, 22 nt, Human
uguucuguuaacugaauaccac

SEQ ID NO: 1303759 - RNA, 14 nt, Human
uguucuguuucaag

SEQ ID NO: 1303760 - RNA, 13 nt, Human
uguucuguuuugu

SEQ ID NO: 1303761 - RNA, 16 nt, Human
uguucuguuuuguuuc

SEQ ID NO: 1303762 - RNA, 17 nt, Human
uguugcaagugcaauaa

SEQ ID NO: 1303763 - RNA, 13 nt, Human
aguggacaggagu

SEQ ID NO: 1303764 - RNA, 19 nt, Human
aguggacaaauuuugaguu

SEQ ID NO: 1303765 - RNA, 14 nt, Human
uguuacaaauugua

SEQ ID NO: 1303766 - RNA, 13 nt, Human
agugugcaaggca

SEQ ID NO: 1303767 - RNA, 15 nt, Human
agugugcaaggcagc

SEQ ID NO: 1303768 - RNA, 15 nt, Human
aguggugugaucuca

SEQ ID NO: 1303769 - RNA, 14 nt, Human
aguguaaaauauuu

SEQ ID NO: 1303770 - RNA, 18 nt, Human
aguguaaaauauuuugaa

SEQ ID NO: 1303771 - RNA, 21 nt, Human
aguguaaaauauuuugaauca

SEQ ID NO: 1303772 - RNA, 15 nt, Human
aguguaacaauugug

SEQ ID NO: 1303773 - RNA, 18 nt, Human
aguguaacaauuguguag

SEQ ID NO: 1303774 - RNA, 23 nt, Human
aguguaacaauuguguagccuuu

SEQ ID NO: 1303775 - RNA, 22 nt, Human
aguguaacaauuguguagccuu

SEQ ID NO: 1303776 - RNA, 23 nt, Human
aguguaccgcgucuacccuggga

SEQ ID NO: 1303777 - RNA, 15 nt, Human
aguguagaaccuaau

SEQ ID NO: 1303778 - RNA, 20 nt, Human
aguguagaaccuaauucaau

SEQ ID NO: 1303779 - RNA, 21 nt, Human
ugugcugggagcuccacucug

SEQ ID NO: 1303780 - RNA, 21 nt, Human
uguggcagaguuacaguucug

SEQ ID NO: 1303781 - RNA, 23 nt, Human
uguggcagggguuagagcaggac

SEQ ID NO: 1303782 - RNA, 16 nt, Human
uguggcauccagaguc

SEQ ID NO: 1303783 - RNA, 20 nt, Human
uguggcagggguuagagcag

SEQ ID NO: 1303784 - RNA, 21 nt, Human
uguggcagggguuagagcagg

SEQ ID NO: 1303785 - RNA, 18 nt, Human
ugugcuggaauucuaaca

SEQ ID NO: 1303786 - RNA, 13 nt, Human
ugugcuggccagc

SEQ ID NO: 1303787 - RNA, 10 nt, Human
ugugcuggga

SEQ ID NO: 1303788 - RNA, 12 nt, Human
ugugcugggagc

SEQ ID NO: 1303789 - RNA, 17 nt, Human
ugugcugggagcuccac

SEQ ID NO: 1303790 - RNA, 12 nt, Human
ugugcccaguua

SEQ ID NO: 1303791 - RNA, 21 nt, Human
ugugcccaguuaaucuugcuu

SEQ ID NO: 1303792 - RNA, 22 nt, Human
ugugcccaguuaaucuugcuuu

SEQ ID NO: 1303793 - RNA, 18 nt, Human
ugugcccccaaccauuuc

SEQ ID NO: 1303794 - RNA, 23 nt, Human
ugugcccccaaccauuuccucag

SEQ ID NO: 1303795 - RNA, 16 nt, Human
ugugcccccagggucc

SEQ ID NO: 1303796 - RNA, 22 nt, Human
ugugcccccaggguccugggag

SEQ ID NO: 1303797 - RNA, 14 nt, Human
agugagggauuauc

SEQ ID NO: 1303798 - RNA, 21 nt, Human
uguggccaugacccugccucu

SEQ ID NO: 1303799 - RNA, 19 nt, Human
agugagggagggcugucau

SEQ ID NO: 1303800 - RNA, 23 nt, Human
uguggccaugacccugccucucc

SEQ ID NO: 1303801 - RNA, 19 nt, Human
uguggcauccagagucccu

SEQ ID NO: 1303802 - RNA, 21 nt, Human
uguggcauccagagucccugc

SEQ ID NO: 1303803 - RNA, 17 nt, Human
uguggcaugggugaaga

SEQ ID NO: 1303804 - RNA, 11 nt, Human
uguggccagga

SEQ ID NO: 1303805 - RNA, 12 nt, Human
uguggccaggag

SEQ ID NO: 1303806 - RNA, 14 nt, Human
uguggccaggaggu

SEQ ID NO: 1303807 - RNA, 13 nt, Human
uguggccaggagg

SEQ ID NO: 1303808 - RNA, 18 nt, Human
ugugccagauuuaugcau

SEQ ID NO: 1303809 - RNA, 18 nt, Human
ugugccagagccuggggc

SEQ ID NO: 1303810 - RNA, 20 nt, Human
ugugccagagccuggggcuc

SEQ ID NO: 1303811 - RNA, 22 nt, Human
ugugccagagccuggggcucua

SEQ ID NO: 1303812 - RNA, 21 nt, Human
ugugccagagccuggggcucu

SEQ ID NO: 1303813 - RNA, 20 nt, Human
ugugccagagaacccagccc

SEQ ID NO: 1303814 - RNA, 23 nt, Human
ugugccagagaacccagcccacc

SEQ ID NO: 1303815 - RNA, 12 nt, Human
ugugccagagcc

SEQ ID NO: 1303816 - RNA, 13 nt, Human
ugugccagagccu

SEQ ID NO: 1303817 - RNA, 14 nt, Human
ugugccagagccug

SEQ ID NO: 1303818 - RNA, 15 nt, Human
ugugccagagccugg

SEQ ID NO: 1303819 - RNA, 16 nt, Human
ugugccagagccuggg

SEQ ID NO: 1303820 - RNA, 17 nt, Human
ugugccagagccugggg

SEQ ID NO: 1303821 - RNA, 20 nt, Human
ugugccagauuuaugcauau

SEQ ID NO: 1303822 - RNA, 18 nt, Human
ugugccagggcaaugaug

SEQ ID NO: 1303823 - RNA, 21 nt, Human
ugugccagggcaaugaugaau

SEQ ID NO: 1303824 - RNA, 16 nt, Human
ugugccaugucaaaca

SEQ ID NO: 1303825 - RNA, 21 nt, Human
ugugccaugucaaacaaauag

SEQ ID NO: 1303826 - RNA, 17 nt, Human
agugaaagaaaauaaca

SEQ ID NO: 1303827 - RNA, 20 nt, Human
agugaaaggaagauaaacgu

SEQ ID NO: 1303828 - RNA, 13 nt, Human
agugaaauaaugu

SEQ ID NO: 1303829 - RNA, 15 nt, Human
agugaaauaaugugu

SEQ ID NO: 1303830 - RNA, 19 nt, Human
agugaaauaauguguaguu

SEQ ID NO: 1303831 - RNA, 16 nt, Human
agugaaauaaugugua

SEQ ID NO: 1303832 - RNA, 15 nt, Human
agugaaagaaaauaa

SEQ ID NO: 1303833 - RNA, 20 nt, Human
agugaacaaauuuacagaga

SEQ ID NO: 1303834 - RNA, 16 nt, Human
agugaacaaauuuaca

SEQ ID NO: 1303835 - RNA, 18 nt, Human
ugugaucauguguggaag

SEQ ID NO: 1303836 - RNA, 13 nt, Human
ugugaucgucuga

SEQ ID NO: 1303837 - RNA, 18 nt, Human
ugugaucugggucucuaa

SEQ ID NO: 1303838 - RNA, 14 nt, Human
ugugaugaauacug

SEQ ID NO: 1303839 - RNA, 16 nt, Human
ugugaugaauacugua

SEQ ID NO: 1303840 - RNA, 18 nt, Human
ugugaugaauacuguauu

SEQ ID NO: 1303841 - RNA, 14 nt, Human
ugugauuguggaau

SEQ ID NO: 1303842 - RNA, 17 nt, Human
ugugauuguggaaugga

SEQ ID NO: 1303843 - RNA, 20 nt, Human
ugugaacaguuguguuugaa

SEQ ID NO: 1303844 - RNA, 13 nt, Human
ugugaccugcuga

SEQ ID NO: 1303845 - RNA, 14 nt, Human
ugugaccugcugag

SEQ ID NO: 1303846 - RNA, 15 nt, Human
ugugaccugcugagc

SEQ ID NO: 1303847 - RNA, 16 nt, Human
ugugaccugcugagcu

SEQ ID NO: 1303848 - RNA, 17 nt, Human
ugugaccugcugagcuc

SEQ ID NO: 1303849 - RNA, 18 nt, Human
ugugaccugcugagcucu

SEQ ID NO: 1303850 - RNA, 22 nt, Human
ugugaccugcugagcucugaga

SEQ ID NO: 1303851 - RNA, 12 nt, Human
ugugacucuuuc

SEQ ID NO: 1303852 - RNA, 14 nt, Human
ugugacucuuucca

SEQ ID NO: 1303853 - RNA, 12 nt, Human
ugugaaauuauu

SEQ ID NO: 1303854 - RNA, 14 nt, Human
ugugaaauuuacau

SEQ ID NO: 1303855 - RNA, 20 nt, Human
ugugaaagggagaagugaca

SEQ ID NO: 1303856 - RNA, 18 nt, Human
agucacgcaugcaguguu

SEQ ID NO: 1303857 - RNA, 21 nt, Human
agucacggcugcgcacugugu

SEQ ID NO: 1303858 - RNA, 16 nt, Human
ugucacuuuuucugau

SEQ ID NO: 1303859 - RNA, 20 nt, Human
agucacggcugcgcacugug

SEQ ID NO: 1303860 - RNA, 12 nt, Human
ugucacuuuuug

SEQ ID NO: 1303861 - RNA, 15 nt, Human
ugucacuuuuugagg

SEQ ID NO: 1303862 - RNA, 17 nt, Human
ugucacuuuuugaggca

SEQ ID NO: 1303863 - RNA, 18 nt, Human
ugucacuuuuugaggcaa

SEQ ID NO: 1303864 - RNA, 19 nt, Human
ugucacuuuuugaggcaaa

SEQ ID NO: 1303865 - RNA, 21 nt, Human
ugucacuuuuugaggcaaaag

SEQ ID NO: 1303866 - RNA, 21 nt, Human
ugucagaacuagaauuugauu

SEQ ID NO: 1303867 - RNA, 15 nt, Human
ugucagacccuggag

SEQ ID NO: 1303868 - RNA, 17 nt, Human
ugucagacccuggaggc

SEQ ID NO: 1303869 - RNA, 16 nt, Human
ugucagacccuggagg

SEQ ID NO: 1303870 - RNA, 12 nt, Human
ugucuugggcag

SEQ ID NO: 1303871 - RNA, 13 nt, Human
ugucuugggcaga

SEQ ID NO: 1303872 - RNA, 16 nt, Human
ugucuugggcagagcu

SEQ ID NO: 1303873 - RNA, 21 nt, Human
ugucuugggcagagcuggcuc

SEQ ID NO: 1303874 - RNA, 22 nt, Human
ugucuugggcagagcuggcucu

SEQ ID NO: 1303875 - RNA, 22 nt, Human
agucucuauaccaauaaaguga

SEQ ID NO: 1303876 - RNA, 21 nt, Human
agucucuauaccaauaaagug

SEQ ID NO: 1303877 - RNA, 20 nt, Human
agucucuauaccaauaaagu

SEQ ID NO: 1303878 - RNA, 19 nt, Human
agucucuauaccaauaaag

SEQ ID NO: 1303879 - RNA, 17 nt, Human
agucucuauaccaauaa

SEQ ID NO: 1303880 - RNA, 15 nt, Human
agucucuauaccaau

SEQ ID NO: 1303881 - RNA, 19 nt, Human
agucucagugaagacuaug

SEQ ID NO: 1303882 - RNA, 10 nt, Human
agucucaguu

SEQ ID NO: 1303883 - RNA, 18 nt, Human
agucucaguuuguguguc

SEQ ID NO: 1303884 - RNA, 20 nt, Human
agucucaguuugugugucuu

SEQ ID NO: 1303885 - RNA, 21 nt, Human
agucucaguuugugugucuua

SEQ ID NO: 1303886 - RNA, 13 nt, Human
agucucuucucca

SEQ ID NO: 1303887 - RNA, 14 nt, Human
agucucuucuccac

SEQ ID NO: 1303888 - RNA, 15 nt, Human
agucucucuucucuc

SEQ ID NO: 1303889 - RNA, 16 nt, Human
agucucucuucucucc

SEQ ID NO: 1303890 - RNA, 18 nt, Human
agucucucuucucuccag

SEQ ID NO: 1303891 - RNA, 21 nt, Human
agucucucuucucuccagcug

SEQ ID NO: 1303892 - RNA, 14 nt, Human
agucucucuucucu

SEQ ID NO: 1303893 - RNA, 15 nt, Human
ugugagagguuugac

SEQ ID NO: 1303894 - RNA, 16 nt, Human
ugugagagguuugacu

SEQ ID NO: 1303895 - RNA, 15 nt, Human
ugugacucuuuccaa

SEQ ID NO: 1303896 - RNA, 17 nt, Human
ugugacucuuuccaacc

SEQ ID NO: 1303897 - RNA, 22 nt, Human
ugugagaugcuagaacucccuu

SEQ ID NO: 1303898 - RNA, 19 nt, Human
ugugagaugcuagaacucc

SEQ ID NO: 1303899 - RNA, 15 nt, Human
ugugagaugcuagaa

SEQ ID NO: 1303900 - RNA, 17 nt, Human
agucuuuggaacccuaa

SEQ ID NO: 1303901 - RNA, 15 nt, Human
agucuuugguucuaa

SEQ ID NO: 1303902 - RNA, 16 nt, Human
agucuuugguucuaag

SEQ ID NO: 1303903 - RNA, 20 nt, Human
agucuuucucuuucccuggu

SEQ ID NO: 1303904 - RNA, 17 nt, Human
agucuuugguucuaagg

SEQ ID NO: 1303905 - RNA, 18 nt, Human
agucuuugguucuaagga

SEQ ID NO: 1303906 - RNA, 14 nt, Human
agucuuucucuuuc

SEQ ID NO: 1303907 - RNA, 15 nt, Human
agucuuucucuuucc

SEQ ID NO: 1303908 - RNA, 17 nt, Human
agucuuucucuuucccu

SEQ ID NO: 1303909 - RNA, 19 nt, Human
agucuuucucuuucccugg

SEQ ID NO: 1303910 - RNA, 23 nt, Human
agucuuucucuuucccugguccc

SEQ ID NO: 1303911 - RNA, 15 nt, Human
agucucuucuccacu

SEQ ID NO: 1303912 - RNA, 16 nt, Human
agucucuucuccacug

SEQ ID NO: 1303913 - RNA, 18 nt, Human
agucucuucuccacugga

SEQ ID NO: 1303914 - RNA, 17 nt, Human
agucucuucuccacugg

SEQ ID NO: 1303915 - RNA, 14 nt, Human
uguaguguuggaga

SEQ ID NO: 1303916 - RNA, 18 nt, Human
uguaguauggccuguguc

SEQ ID NO: 1303917 - RNA, 15 nt, Human
uguagugcuacaggg

SEQ ID NO: 1303918 - RNA, 22 nt, Human
uguagugcuuugagagagaaag

SEQ ID NO: 1303919 - RNA, 15 nt, Human
uguagugcuuugaga

SEQ ID NO: 1303920 - RNA, 15 nt, Human
uguaguguuggagaa

SEQ ID NO: 1303921 - RNA, 16 nt, Human
uguaguguuggagaag

SEQ ID NO: 1303922 - RNA, 22 nt, Human
uguauauuuuaagaaauaacag

SEQ ID NO: 1303923 - RNA, 23 nt, Human
uguaucaaaaugcucuuauuuca

SEQ ID NO: 1303924 - RNA, 18 nt, Human
uguaucaaaaugcucuua

SEQ ID NO: 1303925 - RNA, 15 nt, Human
uguaucaaaaugcuc

SEQ ID NO: 1303926 - RNA, 14 nt, Human
uguaucaaaaugcu

SEQ ID NO: 1303927 - RNA, 13 nt, Human
uguaucaaaaugc

SEQ ID NO: 1303928 - RNA, 15 nt, Human
uguaugucuuaaaac

SEQ ID NO: 1303929 - RNA, 17 nt, Human
uguaugucuuaaaaccu

SEQ ID NO: 1303930 - RNA, 20 nt, Human
uguaucaaacuguauaacuu

SEQ ID NO: 1303931 - RNA, 14 nt, Human
uguaucaaauacau

SEQ ID NO: 1303932 - RNA, 21 nt, Human
uguaucaaauacauuuaaaac

SEQ ID NO: 1303933 - RNA, 23 nt, Human
uguaucaaauacauuuaaaacau

SEQ ID NO: 1303934 - RNA, 15 nt, Human
uguaucauagaaaug

SEQ ID NO: 1303935 - RNA, 16 nt, Human
uguaucauagaaaugu

SEQ ID NO: 1303936 - RNA, 17 nt, Human
uguaucauagaaaugua

SEQ ID NO: 1303937 - RNA, 22 nt, Human
uguauuacaaauccaaugaaau

SEQ ID NO: 1303938 - RNA, 18 nt, Human
uguauuccaagcauauaa

SEQ ID NO: 1303939 - RNA, 13 nt, Human
uguauuacaaauc

SEQ ID NO: 1303940 - RNA, 22 nt, Human
ugucaagggcagcuuugcucau

SEQ ID NO: 1303941 - RNA, 21 nt, Human
ugucaagggcagcuuugcuca

SEQ ID NO: 1303942 - RNA, 21 nt, Human
ugucaaggguucaagauuguu

SEQ ID NO: 1303943 - RNA, 18 nt, Human
ugucaagccauuuuuaca

SEQ ID NO: 1303944 - RNA, 20 nt, Human
ugucaagccauuuuuacauc

SEQ ID NO: 1303945 - RNA, 23 nt, Human
ugucaagccauuuuuacaucuaa

SEQ ID NO: 1303946 - RNA, 13 nt, Human
ugucaaacaaaua

SEQ ID NO: 1303947 - RNA, 21 nt, Human
ugucaaacaaauagucuauca

SEQ ID NO: 1303948 - RNA, 18 nt, Human
aguauuagaauaccacag

SEQ ID NO: 1303949 - RNA, 21 nt, Human
ugucaauaaaauccauacauu

SEQ ID NO: 1303950 - RNA, 23 nt, Human
ugucaaugcaguugucucuguuu

SEQ ID NO: 1303951 - RNA, 20 nt, Human
ugucaaugcaguugucucug

SEQ ID NO: 1303952 - RNA, 23 nt, Human
ugucaagggcagcuuugcucaua

SEQ ID NO: 1303953 - RNA, 17 nt, Human
aguauuucuaugaaaua

SEQ ID NO: 1303954 - RNA, 21 nt, Human
aguauugacaaaauguuauuu

SEQ ID NO: 1303955 - RNA, 18 nt, Human
aguauuucuaugaaauau

SEQ ID NO: 1303956 - RNA, 22 nt, Human
aguauuucuaugaaauauuaug

SEQ ID NO: 1303957 - RNA, 21 nt, Human
aguauuagaauaccacaggaa

SEQ ID NO: 1303958 - RNA, 12 nt, Human
aguauucuucuc

SEQ ID NO: 1303959 - RNA, 14 nt, Human
aguauucuucucuu

SEQ ID NO: 1303960 - RNA, 18 nt, Human
aguauugacaaaauguua

SEQ ID NO: 1303961 - RNA, 17 nt, Human
aguauugacaaaauguu

SEQ ID NO: 1303962 - RNA, 16 nt, Human
aguauugacaaaaugu

SEQ ID NO: 1303963 - RNA, 15 nt, Human
aguauugacaaaaug

SEQ ID NO: 1303964 - RNA, 14 nt, Human
aguauugacaaaau

SEQ ID NO: 1303965 - RNA, 13 nt, Human
aguauugacaaaa

SEQ ID NO: 1303966 - RNA, 12 nt, Human
aguauugacaaa

SEQ ID NO: 1303967 - RNA, 14 nt, Human
agucaccucaugga

SEQ ID NO: 1303968 - RNA, 15 nt, Human
agucaccucauggaa

SEQ ID NO: 1303969 - RNA, 17 nt, Human
agucaccucauggaauu

SEQ ID NO: 1303970 - RNA, 20 nt, Human
agucacccuaccugugccug

SEQ ID NO: 1303971 - RNA, 20 nt, Human
aguauugacaaaauguuauu

SEQ ID NO: 1303972 - RNA, 19 nt, Human
aguauugacaaaauguuau

SEQ ID NO: 1303973 - RNA, 17 nt, Human
agucacacaguguugga

SEQ ID NO: 1303974 - RNA, 19 nt, Human
agucacccuaccugugccu

SEQ ID NO: 1303975 - RNA, 23 nt, Human
uguacuugcucuugaugccuggc

SEQ ID NO: 1303976 - RNA, 22 nt, Human
uguacuugcucuugaugccugg

SEQ ID NO: 1303977 - RNA, 16 nt, Human
agguuuaugacaguaa

SEQ ID NO: 1303978 - RNA, 12 nt, Human
agguuuaugaca

SEQ ID NO: 1303979 - RNA, 21 nt, Human
agguuuaugaaaaagaagaau

SEQ ID NO: 1303980 - RNA, 14 nt, Human
agguuuaugaaaaa

SEQ ID NO: 1303981 - RNA, 16 nt, Human
agguuuaugaaaaaga

SEQ ID NO: 1303982 - RNA, 14 nt, Human
agguuuacagaauu

SEQ ID NO: 1303983 - RNA, 14 nt, Human
agguuuaugacagu

SEQ ID NO: 1303984 - RNA, 22 nt, Human
uguacuuggaguauuggggucu

SEQ ID NO: 1303985 - RNA, 23 nt, Human
uguagaaaauuuguuauuuugca

SEQ ID NO: 1303986 - RNA, 14 nt, Human
uguagaacacuaau

SEQ ID NO: 1303987 - RNA, 15 nt, Human
uguagaacacuaauu

SEQ ID NO: 1303988 - RNA, 17 nt, Human
uguagaacacuaauuca

SEQ ID NO: 1303989 - RNA, 14 nt, Human
uguagagcuucugg

SEQ ID NO: 1303990 - RNA, 16 nt, Human
uguagaggagaaacug

SEQ ID NO: 1303991 - RNA, 18 nt, Human
uguagaacacuaauucau

SEQ ID NO: 1303992 - RNA, 16 nt, Human
agguuuuaauuuagua

SEQ ID NO: 1303993 - RNA, 17 nt, Human
agguuuuaauuuaguaa

SEQ ID NO: 1303994 - RNA, 20 nt, Human
agguuuuaauuuaguaaacc

SEQ ID NO: 1303995 - RNA, 13 nt, Human
agguuuuacagau

SEQ ID NO: 1303996 - RNA, 14 nt, Human
agguuuuacagauu

SEQ ID NO: 1303997 - RNA, 14 nt, Human
agguuuuagguucu

SEQ ID NO: 1303998 - RNA, 22 nt, Human
agguuuuaauuuaguaaaccaa

SEQ ID NO: 1303999 - RNA, 15 nt, Human
agguuuuagguucua

SEQ ID NO: 1304000 - RNA, 13 nt, Human
aguaaaauccaca

SEQ ID NO: 1304001 - RNA, 19 nt, Human
agguuuuuguagugauuuu

SEQ ID NO: 1304002 - RNA, 19 nt, Human
agguuuuuguuuguuuccu

SEQ ID NO: 1304003 - RNA, 16 nt, Human
aguaaaagcaaaaaag

SEQ ID NO: 1304004 - RNA, 16 nt, Human
agguuuuagguucuaa

SEQ ID NO: 1304005 - RNA, 17 nt, Human
agguuuuagguucuaaa

SEQ ID NO: 1304006 - RNA, 18 nt, Human
agguuuuagguucuaaag

SEQ ID NO: 1304007 - RNA, 19 nt, Human
agguuuuagguucuaaagu

SEQ ID NO: 1304008 - RNA, 17 nt, Human
agguuuuauaaggcuga

SEQ ID NO: 1304009 - RNA, 23 nt, Human
agguuuuagguucuaaaguucua

SEQ ID NO: 1304010 - RNA, 20 nt, Human
agguuuuauuucauuuuuca

SEQ ID NO: 1304011 - RNA, 12 nt, Human
agguuuuuccuu

SEQ ID NO: 1304012 - RNA, 18 nt, Human
aguaaugauaacuggaaa

SEQ ID NO: 1304013 - RNA, 20 nt, Human
aguaaugauaacuggaaacu

SEQ ID NO: 1304014 - RNA, 17 nt, Human
aguaaugauaacuggaa

SEQ ID NO: 1304015 - RNA, 17 nt, Human
aguaaaauaauaauuuu

SEQ ID NO: 1304016 - RNA, 12 nt, Human
aguaaaagcaaa

SEQ ID NO: 1304017 - RNA, 14 nt, Human
aguaauagccuggg

SEQ ID NO: 1304018 - RNA, 22 nt, Human
aguacaugauaaaugauagaca

SEQ ID NO: 1304019 - RNA, 19 nt, Human
aguacauuguuaccucuau

SEQ ID NO: 1304020 - RNA, 14 nt, Human
aguacauuguuacc

SEQ ID NO: 1304021 - RNA, 14 nt, Human
aguaaugguguaga

SEQ ID NO: 1304022 - RNA, 15 nt, Human
aguaaugguguagaa

SEQ ID NO: 1304023 - RNA, 16 nt, Human
aguaaugguguagaac

SEQ ID NO: 1304024 - RNA, 18 nt, Human
aguaaugguguagaacac

SEQ ID NO: 1304025 - RNA, 19 nt, Human
aguaaugguguagaacacu

SEQ ID NO: 1304026 - RNA, 22 nt, Human
aguaaugguguagaacacuaau

SEQ ID NO: 1304027 - RNA, 23 nt, Human
aguaaugguguagaacacuaauu

SEQ ID NO: 1304028 - RNA, 21 nt, Human
aguagaaucucaguugauuuu

SEQ ID NO: 1304029 - RNA, 12 nt, Human
aguaccauuuaa

SEQ ID NO: 1304030 - RNA, 23 nt, Human
aguaccauuuaauggggaggaca

SEQ ID NO: 1304031 - RNA, 23 nt, Human
aguacccacucuggagcauuucu

SEQ ID NO: 1304032 - RNA, 19 nt, Human
aguacccguucacauuuuu

SEQ ID NO: 1304033 - RNA, 16 nt, Human
aguacccucucagcuc

SEQ ID NO: 1304034 - RNA, 18 nt, Human
aguacccucucagcucca

SEQ ID NO: 1304035 - RNA, 19 nt, Human
aguacccucucagcuccag

SEQ ID NO: 1304036 - RNA, 21 nt, Human
aguaccuagcuggcucuguga

SEQ ID NO: 1304037 - RNA, 23 nt, Human
uguaguagcguuuuuuaaaugua

SEQ ID NO: 1304038 - RNA, 20 nt, Human
uguaguaggcauuuuuacca

SEQ ID NO: 1304039 - RNA, 22 nt, Human
uguaguagcguuuuuuaaaugu

SEQ ID NO: 1304040 - RNA, 21 nt, Human
uguaguagcguuuuuuaaaug

SEQ ID NO: 1304041 - RNA, 16 nt, Human
uguaguagcguuuuuu

SEQ ID NO: 1304042 - RNA, 18 nt, Human
uguaguauuuuuuguaua

SEQ ID NO: 1304043 - RNA, 19 nt, Human
uguaguauuuuuuguauaa

SEQ ID NO: 1304044 - RNA, 20 nt, Human
uguaguauuuuuuguauaau

SEQ ID NO: 1304045 - RNA, 22 nt, Human
uguaggccaguaguucucaaag

SEQ ID NO: 1304046 - RNA, 17 nt, Human
uguaggcuuaguuugug

SEQ ID NO: 1304047 - RNA, 13 nt, Human
uguagggagggcg

SEQ ID NO: 1304048 - RNA, 19 nt, Human
uguaguaauugacaugugc

SEQ ID NO: 1304049 - RNA, 20 nt, Human
aguagcguuuuuuaaaugua

SEQ ID NO: 1304050 - RNA, 19 nt, Human
aguagcguuuuuuaaaugu

SEQ ID NO: 1304051 - RNA, 19 nt, Human
uguaggagggacugucgcu

SEQ ID NO: 1304052 - RNA, 14 nt, Human
uguaggagggacug

SEQ ID NO: 1304053 - RNA, 18 nt, Human
aguagcguuuuuuaaaug

SEQ ID NO: 1304054 - RNA, 23 nt, Human
aguagaccuuguuacuucugagg

SEQ ID NO: 1304055 - RNA, 15 nt, Human
aguagaauugcauug

SEQ ID NO: 1304056 - RNA, 14 nt, Human
aguagaauugcauu

SEQ ID NO: 1304057 - RNA, 14 nt, Human
aguagaaucucagu

SEQ ID NO: 1304058 - RNA, 20 nt, Human
aguagaccuuguuacuucug

SEQ ID NO: 1304059 - RNA, 21 nt, Human
aguagaccuuguuacuucuga

SEQ ID NO: 1304060 - RNA, 23 nt, Human
uguaaauaauacauuauauuucu

SEQ ID NO: 1304061 - RNA, 22 nt, Human
uguaaauaauacauuauauuuc

SEQ ID NO: 1304062 - RNA, 19 nt, Human
uguaaauaaagaacuagca

SEQ ID NO: 1304063 - RNA, 14 nt, Human
uguaaauaaaaaga

SEQ ID NO: 1304064 - RNA, 13 nt, Human
uguaaauauaaag

SEQ ID NO: 1304065 - RNA, 12 nt, Human
uguaaauauaaa

SEQ ID NO: 1304066 - RNA, 16 nt, Human
uguaaaggagucaaaa

SEQ ID NO: 1304067 - RNA, 19 nt, Human
uguaaaggagucaaaacua

SEQ ID NO: 1304068 - RNA, 21 nt, Human
uguaaaggagucaaaacuaca

SEQ ID NO: 1304069 - RNA, 19 nt, Human
uguaaaguauguauuauuu

SEQ ID NO: 1304070 - RNA, 22 nt, Human
uguaaacuguguauuccaagac

SEQ ID NO: 1304071 - RNA, 19 nt, Human
uguaaacuguuucuuuaaa

SEQ ID NO: 1304072 - RNA, 22 nt, Human
uguaaacuguuucuuuaaaauu

SEQ ID NO: 1304073 - RNA, 17 nt, Human
uguaaacuuuaucacuu

SEQ ID NO: 1304074 - RNA, 19 nt, Human
uguaaacuuuaucacuuaa

SEQ ID NO: 1304075 - RNA, 18 nt, Human
uguaaacuuuaucacuua

SEQ ID NO: 1304076 - RNA, 13 nt, Human
uguaaacuuuuug

SEQ ID NO: 1304077 - RNA, 12 nt, Human
ugguuuccugcc

SEQ ID NO: 1304078 - RNA, 13 nt, Human
ugguuuccugccc

SEQ ID NO: 1304079 - RNA, 17 nt, Human
ugguuaugaauacuuug

SEQ ID NO: 1304080 - RNA, 13 nt, Human
ugguuucccaaga

SEQ ID NO: 1304081 - RNA, 17 nt, Human
ugguuucccaagagcua

SEQ ID NO: 1304082 - RNA, 18 nt, Human
ugguuucccaagagcuac

SEQ ID NO: 1304083 - RNA, 14 nt, Human
ugguuuccugcccu

SEQ ID NO: 1304084 - RNA, 15 nt, Human
ugguuuccugcccug

SEQ ID NO: 1304085 - RNA, 20 nt, Human
ugguuuccugcccugggagg

SEQ ID NO: 1304086 - RNA, 18 nt, Human
ugguuugcagcgacuggc

SEQ ID NO: 1304087 - RNA, 15 nt, Human
ugguuugcagguggc

SEQ ID NO: 1304088 - RNA, 19 nt, Human
ugguuugcagcgacuggca

SEQ ID NO: 1304089 - RNA, 16 nt, Human
ugguuugccuuccaga

SEQ ID NO: 1304090 - RNA, 17 nt, Human
ugguuugccuuccagaa

SEQ ID NO: 1304091 - RNA, 14 nt, Human
agguguccuacaga

SEQ ID NO: 1304092 - RNA, 15 nt, Human
agguguccuacagaa

SEQ ID NO: 1304093 - RNA, 16 nt, Human
agguguccuacagaaa

SEQ ID NO: 1304094 - RNA, 17 nt, Human
agguguccuacagaaaa

SEQ ID NO: 1304095 - RNA, 18 nt, Human
agguguccuacagaaaaa

SEQ ID NO: 1304096 - RNA, 19 nt, Human
agguguccuacagaaaaac

SEQ ID NO: 1304097 - RNA, 20 nt, Human
agguguccuacagaaaaacc

SEQ ID NO: 1304098 - RNA, 13 nt, Human
aggugucucaggc

SEQ ID NO: 1304099 - RNA, 14 nt, Human
aggugucucaggcu

SEQ ID NO: 1304100 - RNA, 16 nt, Human
aggugucucaggcugc

SEQ ID NO: 1304101 - RNA, 17 nt, Human
aggugucucaggcugcc

SEQ ID NO: 1304102 - RNA, 18 nt, Human
aggugucucaggcugccu

SEQ ID NO: 1304103 - RNA, 19 nt, Human
aggugucucaggcugccug

SEQ ID NO: 1304104 - RNA, 20 nt, Human
aggugucucaggcugccuga

SEQ ID NO: 1304105 - RNA, 22 nt, Human
aggugucucaggcugccugagu

SEQ ID NO: 1304106 - RNA, 22 nt, Human
agguucuccaacaucacagccc

SEQ ID NO: 1304107 - RNA, 16 nt, Human
agguucuuacugcuug

SEQ ID NO: 1304108 - RNA, 14 nt, Human
agguucuuacugcu

SEQ ID NO: 1304109 - RNA, 20 nt, Human
agguguggagccgaggccua

SEQ ID NO: 1304110 - RNA, 23 nt, Human
agguguggcuuuaggagcagugg

SEQ ID NO: 1304111 - RNA, 17 nt, Human
agguguuaacauuccaa

SEQ ID NO: 1304112 - RNA, 17 nt, Human
agguucuagguuucaaa

SEQ ID NO: 1304113 - RNA, 19 nt, Human
agguucuagguuucaaaga

SEQ ID NO: 1304114 - RNA, 13 nt, Human
agguucuccaaca

SEQ ID NO: 1304115 - RNA, 21 nt, Human
agguucuccaacaucacagcc

SEQ ID NO: 1304116 - RNA, 19 nt, Human
agguucuccguuagcuccu

SEQ ID NO: 1304117 - RNA, 20 nt, Human
agguucuccguuagcuccug

SEQ ID NO: 1304118 - RNA, 21 nt, Human
agguucuccguuagcuccugu

SEQ ID NO: 1304119 - RNA, 22 nt, Human
agguucuccguuagcuccugug

SEQ ID NO: 1304120 - RNA, 17 nt, Human
aggugccugucccaccc

SEQ ID NO: 1304121 - RNA, 18 nt, Human
aggugccugucccacccc

SEQ ID NO: 1304122 - RNA, 15 nt, Human
aggugcauuuuuacu

SEQ ID NO: 1304123 - RNA, 13 nt, Human
aggugccacugga

SEQ ID NO: 1304124 - RNA, 12 nt, Human
aggugcccagga

SEQ ID NO: 1304125 - RNA, 13 nt, Human
aggugcccaggag

SEQ ID NO: 1304126 - RNA, 15 nt, Human
aggugcccaggagaa

SEQ ID NO: 1304127 - RNA, 14 nt, Human
aggugcccaggaga

SEQ ID NO: 1304128 - RNA, 18 nt, Human
aggugccacuggagugug

SEQ ID NO: 1304129 - RNA, 21 nt, Human
aggugcccagaauaaguuauu

SEQ ID NO: 1304130 - RNA, 16 nt, Human
aggugagaccaccucu

SEQ ID NO: 1304131 - RNA, 13 nt, Human
aggugagaaauuu

SEQ ID NO: 1304132 - RNA, 15 nt, Human
aggugagaccaccuc

SEQ ID NO: 1304133 - RNA, 14 nt, Human
aggugagaccaccu

SEQ ID NO: 1304134 - RNA, 14 nt, Human
aggugacugucugg

SEQ ID NO: 1304135 - RNA, 15 nt, Human
aggugacugucuggg

SEQ ID NO: 1304136 - RNA, 17 nt, Human
aggugacugucugggga

SEQ ID NO: 1304137 - RNA, 18 nt, Human
aggugacugucuggggag

SEQ ID NO: 1304138 - RNA, 21 nt, Human
aggugacugucuggggagcgg

SEQ ID NO: 1304139 - RNA, 19 nt, Human
aggugaccaaaucagugug

SEQ ID NO: 1304140 - RNA, 14 nt, Human
aggugaccccaggg

SEQ ID NO: 1304141 - RNA, 15 nt, Human
aggugaccccagggc

SEQ ID NO: 1304142 - RNA, 16 nt, Human
aggugaccccagggca

SEQ ID NO: 1304143 - RNA, 17 nt, Human
aggugaccccagggcac

SEQ ID NO: 1304144 - RNA, 18 nt, Human
aggugaccccagggcaca

SEQ ID NO: 1304145 - RNA, 19 nt, Human
aggugaccccagggcacag

SEQ ID NO: 1304146 - RNA, 24 nt, Human
aggugaccccagggcacaggagcu

SEQ ID NO: 1304147 - RNA, 21 nt, Human
aggugaccccagggcacagga

SEQ ID NO: 1304148 - RNA, 19 nt, Human
aggucuucuuaauauguuc

SEQ ID NO: 1304149 - RNA, 19 nt, Human
aggugaauagccauauuug

SEQ ID NO: 1304150 - RNA, 22 nt, Human
aggugaauagccauauuuguaa

SEQ ID NO: 1304151 - RNA, 21 nt, Human
aggugaauagccauauuugua

SEQ ID NO: 1304152 - RNA, 13 nt, Human
aggugaccccagg

SEQ ID NO: 1304153 - RNA, 19 nt, Human
aggugacaucggaaaaaua

SEQ ID NO: 1304154 - RNA, 20 nt, Human
aggucuucaucgaaucuacu

SEQ ID NO: 1304155 - RNA, 21 nt, Human
aggucuucaucgaaucuacua

SEQ ID NO: 1304156 - RNA, 15 nt, Human
agguccagcucugga

SEQ ID NO: 1304157 - RNA, 16 nt, Human
agguccagcucuggag

SEQ ID NO: 1304158 - RNA, 17 nt, Human
agguccagcucuggagg

SEQ ID NO: 1304159 - RNA, 18 nt, Human
agguccagcucuggaggg

SEQ ID NO: 1304160 - RNA, 13 nt, Human
agguccagcucug

SEQ ID NO: 1304161 - RNA, 14 nt, Human
agguccagcucugg

SEQ ID NO: 1304162 - RNA, 21 nt, Human
aggucagcacaucucaacagg

SEQ ID NO: 1304163 - RNA, 15 nt, Human
aggucagcaugucua

SEQ ID NO: 1304164 - RNA, 16 nt, Human
aggucagcaugucuau

SEQ ID NO: 1304165 - RNA, 15 nt, Human
aggucagccacuguu

SEQ ID NO: 1304166 - RNA, 14 nt, Human
agguccacaggucu

SEQ ID NO: 1304167 - RNA, 15 nt, Human
agguccacaggucua

SEQ ID NO: 1304168 - RNA, 18 nt, Human
agguccacaggucuagac

SEQ ID NO: 1304169 - RNA, 19 nt, Human
agguccacaggucuagacu

SEQ ID NO: 1304170 - RNA, 20 nt, Human
agguccacaggucuagacua

SEQ ID NO: 1304171 - RNA, 23 nt, Human
uggugcuucucagauuucugagg

SEQ ID NO: 1304172 - RNA, 13 nt, Human
uggugcugggaga

SEQ ID NO: 1304173 - RNA, 20 nt, Human
uggugcugggagaggcagcc

SEQ ID NO: 1304174 - RNA, 21 nt, Human
ugguggagaggcccggccucu

SEQ ID NO: 1304175 - RNA, 13 nt, Human
ugguggagggcca

SEQ ID NO: 1304176 - RNA, 21 nt, Human
ugguggaugauccccacgcca

SEQ ID NO: 1304177 - RNA, 15 nt, Human
ugguuaccaugucuu

SEQ ID NO: 1304178 - RNA, 13 nt, Human
ugguuagaaaagu

SEQ ID NO: 1304179 - RNA, 13 nt, Human
ugguuagaaaugc

SEQ ID NO: 1304180 - RNA, 14 nt, Human
ugguuagaaaugca

SEQ ID NO: 1304181 - RNA, 23 nt, Human
uggugugaccacugcagaagaca

SEQ ID NO: 1304182 - RNA, 15 nt, Human
ugguggcacaggccc

SEQ ID NO: 1304183 - RNA, 17 nt, Human
uggugucucuucuuuag

SEQ ID NO: 1304184 - RNA, 23 nt, Human
uggugucucuucuuuagaacagg

SEQ ID NO: 1304185 - RNA, 17 nt, Human
aggugaggucagcacau

SEQ ID NO: 1304186 - RNA, 17 nt, Human
aggugaggucuguuccu

SEQ ID NO: 1304187 - RNA, 24 nt, Human
uggugccuaguauugacaaaaugu

SEQ ID NO: 1304188 - RNA, 13 nt, Human
uggugccuccaga

SEQ ID NO: 1304189 - RNA, 22 nt, Human
uggugccuaguauugacaaaau

SEQ ID NO: 1304190 - RNA, 19 nt, Human
uggugccuaguauugacaa

SEQ ID NO: 1304191 - RNA, 15 nt, Human
uggugccuaguauug

SEQ ID NO: 1304192 - RNA, 12 nt, Human
uggugccuucau

SEQ ID NO: 1304193 - RNA, 14 nt, Human
uggugccuucauuu

SEQ ID NO: 1304194 - RNA, 14 nt, Human
uggugcggcuggcc

SEQ ID NO: 1304195 - RNA, 16 nt, Human
uggugcggcuggccau

SEQ ID NO: 1304196 - RNA, 22 nt, Human
uggugcggcuggccauggagaa

SEQ ID NO: 1304197 - RNA, 17 nt, Human
uggugcggcuggccaug

SEQ ID NO: 1304198 - RNA, 13 nt, Human
uggugcugccaca

SEQ ID NO: 1304199 - RNA, 18 nt, Human
uggugcugccacacuuca

SEQ ID NO: 1304200 - RNA, 21 nt, Human
ugggucgcccuggacugugug

SEQ ID NO: 1304201 - RNA, 12 nt, Human
ugggugacauuu

SEQ ID NO: 1304202 - RNA, 22 nt, Human
ugggugaggaucccugaaggcc

SEQ ID NO: 1304203 - RNA, 16 nt, Human
ugggugccuaggccug

SEQ ID NO: 1304204 - RNA, 17 nt, Human
ugggugccuaggccugg

SEQ ID NO: 1304205 - RNA, 21 nt, Human
ugggugccuaggccugggcag

SEQ ID NO: 1304206 - RNA, 23 nt, Human
ugggugccuaggccugggcagug

SEQ ID NO: 1304207 - RNA, 18 nt, Human
ugggucgcccuggacugu

SEQ ID NO: 1304208 - RNA, 16 nt, Human
ugggucgcccuggacu

SEQ ID NO: 1304209 - RNA, 13 nt, Human
ugggucccaggac

SEQ ID NO: 1304210 - RNA, 17 nt, Human
agggugggcuugugggg

SEQ ID NO: 1304211 - RNA, 22 nt, Human
agggugggcuuguggggccugg

SEQ ID NO: 1304212 - RNA, 18 nt, Human
uggguccaugggcagagc

SEQ ID NO: 1304213 - RNA, 21 nt, Human
aggguggggggggggcgcggc

SEQ ID NO: 1304214 - RNA, 23 nt, Human
agggugggcuuguggggccuggg

SEQ ID NO: 1304215 - RNA, 13 nt, Human
agggucugcucuu

SEQ ID NO: 1304216 - RNA, 14 nt, Human
agggucugcucuuu

SEQ ID NO: 1304217 - RNA, 17 nt, Human
agggucugcucuuucuc

SEQ ID NO: 1304218 - RNA, 20 nt, Human
agggucugcucuuucucugc

SEQ ID NO: 1304219 - RNA, 21 nt, Human
agggucugcucuuucucugcc

SEQ ID NO: 1304220 - RNA, 22 nt, Human
agggucugcucuuucucugcca

SEQ ID NO: 1304221 - RNA, 23 nt, Human
agggucugcucuuucucugccag

SEQ ID NO: 1304222 - RNA, 22 nt, Human
agggucugggggcacaagacug

SEQ ID NO: 1304223 - RNA, 23 nt, Human
agggucugggggcacaagacuga

SEQ ID NO: 1304224 - RNA, 19 nt, Human
agggucuguagguugcaca

SEQ ID NO: 1304225 - RNA, 20 nt, Human
agggucuguagguugcacac

SEQ ID NO: 1304226 - RNA, 22 nt, Human
agggucuguagguugcacacuu

SEQ ID NO: 1304227 - RNA, 21 nt, Human
agggucuguagguugcacacu

SEQ ID NO: 1304228 - RNA, 20 nt, Human
uggucacguuuggugcuucu

SEQ ID NO: 1304229 - RNA, 17 nt, Human
ugguagcuuuucccuuc

SEQ ID NO: 1304230 - RNA, 17 nt, Human
ugguagaccaaaauaaa

SEQ ID NO: 1304231 - RNA, 23 nt, Human
ugguagaccacugccauaugauu

SEQ ID NO: 1304232 - RNA, 17 nt, Human
ugguagaccacugccau

SEQ ID NO: 1304233 - RNA, 13 nt, Human
ugguaccagauaa

SEQ ID NO: 1304234 - RNA, 14 nt, Human
ugguaccagauaac

SEQ ID NO: 1304235 - RNA, 18 nt, Human
ugguaccagauaacuuuu

SEQ ID NO: 1304236 - RNA, 13 nt, Human
ugguaccagaugc

SEQ ID NO: 1304237 - RNA, 15 nt, Human
ugguacccuccuggc

SEQ ID NO: 1304238 - RNA, 16 nt, Human
ugguacccuccuggcu

SEQ ID NO: 1304239 - RNA, 21 nt, Human
ugguacccuccuggcucuuga

SEQ ID NO: 1304240 - RNA, 14 nt, Human
ugguacccucugga

SEQ ID NO: 1304241 - RNA, 17 nt, Human
ugggugcuacuggggaa

SEQ ID NO: 1304242 - RNA, 14 nt, Human
ugguaacugcuuuc

SEQ ID NO: 1304243 - RNA, 22 nt, Human
ugguaacugcuuucuguuccaa

SEQ ID NO: 1304244 - RNA, 14 nt, Human
ugguaacuuuugug

SEQ ID NO: 1304245 - RNA, 16 nt, Human
ugguaacuuuugugaa

SEQ ID NO: 1304246 - RNA, 24 nt, Human
ugguaacuuuugugaauuaggcug

SEQ ID NO: 1304247 - RNA, 16 nt, Human
aggggaauugaggaca

SEQ ID NO: 1304248 - RNA, 18 nt, Human
aggggagcaugggaagug

SEQ ID NO: 1304249 - RNA, 15 nt, Human
aggggaaucagaacu

SEQ ID NO: 1304250 - RNA, 16 nt, Human
aggggaaucagaacuc

SEQ ID NO: 1304251 - RNA, 13 nt, Human
aggggagcagagg

SEQ ID NO: 1304252 - RNA, 16 nt, Human
aggggagcagaggggc

SEQ ID NO: 1304253 - RNA, 20 nt, Human
aggggagcagaggggcagag

SEQ ID NO: 1304254 - RNA, 22 nt, Human
aggggagcagaggggcagaggc

SEQ ID NO: 1304255 - RNA, 12 nt, Human
aggggagcccac

SEQ ID NO: 1304256 - RNA, 13 nt, Human
aggggagcccacu

SEQ ID NO: 1304257 - RNA, 17 nt, Human
aggggagcccacugucc

SEQ ID NO: 1304258 - RNA, 21 nt, Human
aggggagcccacuguccuggg

SEQ ID NO: 1304259 - RNA, 24 nt, Human
aggggagcccacuguccugggccu

SEQ ID NO: 1304260 - RNA, 16 nt, Human
aggggcuccuuuccau

SEQ ID NO: 1304261 - RNA, 15 nt, Human
aggggcugcuuccuc

SEQ ID NO: 1304262 - RNA, 16 nt, Human
aggggcugcuuccucc

SEQ ID NO: 1304263 - RNA, 18 nt, Human
aggggcugcuuccuccug

SEQ ID NO: 1304264 - RNA, 20 nt, Human
aggggcugcuuccuccugga

SEQ ID NO: 1304265 - RNA, 21 nt, Human
aggggcugcuuccuccuggaa

SEQ ID NO: 1304266 - RNA, 23 nt, Human
agggggccccuuugcugacccuc

SEQ ID NO: 1304267 - RNA, 15 nt, Human
agggggcgccugugg

SEQ ID NO: 1304268 - RNA, 20 nt, Human
agggggcgccugugguucug

SEQ ID NO: 1304269 - RNA, 12 nt, Human
agggggcggccu

SEQ ID NO: 1304270 - RNA, 15 nt, Human
agggggcggccuaug

SEQ ID NO: 1304271 - RNA, 16 nt, Human
agggggcuaagacuuc

SEQ ID NO: 1304272 - RNA, 13 nt, Human
agggggcugcugc

SEQ ID NO: 1304273 - RNA, 14 nt, Human
agggggcugcugcu

SEQ ID NO: 1304274 - RNA, 19 nt, Human
agggggcugcugcugggcu

SEQ ID NO: 1304275 - RNA, 20 nt, Human
agggggcugcugcugggcuc

SEQ ID NO: 1304276 - RNA, 12 nt, Human
agggggcuggag

SEQ ID NO: 1304277 - RNA, 13 nt, Human
agggggcuggagg

SEQ ID NO: 1304278 - RNA, 18 nt, Human
aggguaacuaacuaaaac

SEQ ID NO: 1304279 - RNA, 11 nt, Human
aggguaaauca

SEQ ID NO: 1304280 - RNA, 13 nt, Human
aggguaaacaaua

SEQ ID NO: 1304281 - RNA, 14 nt, Human
aggguaaacaauau

SEQ ID NO: 1304282 - RNA, 23 nt, Human
aggguaaaucaguaagagguguu

SEQ ID NO: 1304283 - RNA, 16 nt, Human
agggguuggggaaaca

SEQ ID NO: 1304284 - RNA, 21 nt, Human
agggguugcuccgccuggccu

SEQ ID NO: 1304285 - RNA, 19 nt, Human
agggggcuggaggagccca

SEQ ID NO: 1304286 - RNA, 14 nt, Human
agggggcuggagga

SEQ ID NO: 1304287 - RNA, 16 nt, Human
agggggcuggaggagc

SEQ ID NO: 1304288 - RNA, 17 nt, Human
agggggcuggaggagcc

SEQ ID NO: 1304289 - RNA, 18 nt, Human
agggggcuggaggagccc

SEQ ID NO: 1304290 - RNA, 14 nt, Human
agggguaggggcug

SEQ ID NO: 1304291 - RNA, 15 nt, Human
agggguaggggcugg

SEQ ID NO: 1304292 - RNA, 16 nt, Human
agggguaggggcuggg

SEQ ID NO: 1304293 - RNA, 18 nt, Human
agggguaggggcugggaa

SEQ ID NO: 1304294 - RNA, 19 nt, Human
agggguaggggcugggaac

SEQ ID NO: 1304295 - RNA, 21 nt, Human
aggggucaaguuauuaauuuc

SEQ ID NO: 1304296 - RNA, 15 nt, Human
aggggucaaguuauu

SEQ ID NO: 1304297 - RNA, 23 nt, Human
uggggcuccuccaggguggcagc

SEQ ID NO: 1304298 - RNA, 21 nt, Human
uggggcucuaacgccugagcc

SEQ ID NO: 1304299 - RNA, 18 nt, Human
uggggccuguacugccug

SEQ ID NO: 1304300 - RNA, 19 nt, Human
uggggccuguacugccugc

SEQ ID NO: 1304301 - RNA, 20 nt, Human
uggggccuguacugccugcu

SEQ ID NO: 1304302 - RNA, 17 nt, Human
uggggcucacacaccug

SEQ ID NO: 1304303 - RNA, 13 nt, Human
uggggcucagagc

SEQ ID NO: 1304304 - RNA, 17 nt, Human
uggggcucagagccggg

SEQ ID NO: 1304305 - RNA, 12 nt, Human
uggggccuggga

SEQ ID NO: 1304306 - RNA, 13 nt, Human
uggggccugggac

SEQ ID NO: 1304307 - RNA, 14 nt, Human
uggggccugggaca

SEQ ID NO: 1304308 - RNA, 22 nt, Human
uggggccugggacaacugcucc

SEQ ID NO: 1304309 - RNA, 13 nt, Human
uggggccugggag

SEQ ID NO: 1304310 - RNA, 14 nt, Human
uggggccugggagg

SEQ ID NO: 1304311 - RNA, 14 nt, Human
uggggccugguucc

SEQ ID NO: 1304312 - RNA, 11 nt, Human
uggggccugua

SEQ ID NO: 1304313 - RNA, 22 nt, Human
uggggagggauucugguuccag

SEQ ID NO: 1304314 - RNA, 15 nt, Human
uggggaggggcugug

SEQ ID NO: 1304315 - RNA, 19 nt, Human
agggcuccuugugggccug

SEQ ID NO: 1304316 - RNA, 20 nt, Human
agggcuccuugugggccugg

SEQ ID NO: 1304317 - RNA, 21 nt, Human
agggcuccuugugggccuggg

SEQ ID NO: 1304318 - RNA, 22 nt, Human
agggcuccuugugggccugggc

SEQ ID NO: 1304319 - RNA, 23 nt, Human
agggcuccuugugggccugggcu

SEQ ID NO: 1304320 - RNA, 20 nt, Human
agggcucgaggggugggcug

SEQ ID NO: 1304321 - RNA, 18 nt, Human
agggcucgaggggugggc

SEQ ID NO: 1304322 - RNA, 12 nt, Human
agggcucuccug

SEQ ID NO: 1304323 - RNA, 14 nt, Human
agggcucuccuggc

SEQ ID NO: 1304324 - RNA, 15 nt, Human
agggcucuccuggcu

SEQ ID NO: 1304325 - RNA, 16 nt, Human
agggcucuccuggcuu

SEQ ID NO: 1304326 - RNA, 17 nt, Human
agggcucuccuggcuuc

SEQ ID NO: 1304327 - RNA, 11 nt, Human
agggcucugag

SEQ ID NO: 1304328 - RNA, 12 nt, Human
agggcucugagg

SEQ ID NO: 1304329 - RNA, 13 nt, Human
agggcucugaggc

SEQ ID NO: 1304330 - RNA, 16 nt, Human
agggcucugaggcgcc

SEQ ID NO: 1304331 - RNA, 13 nt, Human
uggggagagacgg

SEQ ID NO: 1304332 - RNA, 21 nt, Human
uggggagacugggcugaggga

SEQ ID NO: 1304333 - RNA, 14 nt, Human
agggcucugaggcg

SEQ ID NO: 1304334 - RNA, 17 nt, Human
uggggagacugggcuga

SEQ ID NO: 1304335 - RNA, 12 nt, Human
uggggaggagga

SEQ ID NO: 1304336 - RNA, 18 nt, Human
uggggagggauucugguu

SEQ ID NO: 1304337 - RNA, 19 nt, Human
uggggagcgggucugcucc

SEQ ID NO: 1304338 - RNA, 20 nt, Human
uggggagcgggucugcuccc

SEQ ID NO: 1304339 - RNA, 12 nt, Human
uggggaggacaa

SEQ ID NO: 1304340 - RNA, 13 nt, Human
uggggaggaggag

SEQ ID NO: 1304341 - RNA, 17 nt, Human
uggggagcaggcagcca

SEQ ID NO: 1304342 - RNA, 18 nt, Human
uggggagcccgucucagu

SEQ ID NO: 1304343 - RNA, 19 nt, Human
uggggagcccgucucagug

SEQ ID NO: 1304344 - RNA, 21 nt, Human
uggggagcccgucucaguguu

SEQ ID NO: 1304345 - RNA, 16 nt, Human
uggggagcaggcagcc

SEQ ID NO: 1304346 - RNA, 17 nt, Human
uggggagcgggucugcu

SEQ ID NO: 1304347 - RNA, 21 nt, Human
aggggaauaaacuguugaguc

SEQ ID NO: 1304348 - RNA, 21 nt, Human
aggggaagcagaaauccaagc

SEQ ID NO: 1304349 - RNA, 15 nt, Human
aggggaagaggccug

SEQ ID NO: 1304350 - RNA, 13 nt, Human
aggggaagagaag

SEQ ID NO: 1304351 - RNA, 14 nt, Human
aggggaagaggccu

SEQ ID NO: 1304352 - RNA, 18 nt, Human
agggcuuuguuuugcaca

SEQ ID NO: 1304353 - RNA, 12 nt, Human
ugggguggcugc

SEQ ID NO: 1304354 - RNA, 13 nt, Human
ugggguggcugca

SEQ ID NO: 1304355 - RNA, 14 nt, Human
ugggguggcugcag

SEQ ID NO: 1304356 - RNA, 16 nt, Human
ugggguggcugcagcc

SEQ ID NO: 1304357 - RNA, 18 nt, Human
ugggguggcugcagccuc

SEQ ID NO: 1304358 - RNA, 19 nt, Human
ugggguggcugcagccuca

SEQ ID NO: 1304359 - RNA, 20 nt, Human
ugggguggcugcagccucag

SEQ ID NO: 1304360 - RNA, 14 nt, Human
uggggucugacccc

SEQ ID NO: 1304361 - RNA, 21 nt, Human
uggggucuggaguugaucugg

SEQ ID NO: 1304362 - RNA, 14 nt, Human
uggggucuggcagc

SEQ ID NO: 1304363 - RNA, 17 nt, Human
uggggucuggcagccuc

SEQ ID NO: 1304364 - RNA, 18 nt, Human
uggggucuggcagccucc

SEQ ID NO: 1304365 - RNA, 22 nt, Human
uggggugacccggcacccccug

SEQ ID NO: 1304366 - RNA, 23 nt, Human
uggggugacccggcacccccugc

SEQ ID NO: 1304367 - RNA, 11 nt, Human
uggggugcagg

SEQ ID NO: 1304368 - RNA, 15 nt, Human
uggggugcagggaug

SEQ ID NO: 1304369 - RNA, 18 nt, Human
uggggugcagggaugugg

SEQ ID NO: 1304370 - RNA, 19 nt, Human
uggggugcagggauguggg

SEQ ID NO: 1304371 - RNA, 17 nt, Human
uggggcucuaacgccug

SEQ ID NO: 1304372 - RNA, 18 nt, Human
uggggcucuaacgccuga

SEQ ID NO: 1304373 - RNA, 19 nt, Human
uggggcucuaacgccugag

SEQ ID NO: 1304374 - RNA, 20 nt, Human
uggggcucuaacgccugagc

SEQ ID NO: 1304375 - RNA, 17 nt, Human
uggggcuggagaggaca

SEQ ID NO: 1304376 - RNA, 14 nt, Human
uggggcuggccucc

SEQ ID NO: 1304377 - RNA, 14 nt, Human
uggggucccagcag

SEQ ID NO: 1304378 - RNA, 15 nt, Human
uggggucccagcagc

SEQ ID NO: 1304379 - RNA, 21 nt, Human
uggggucccagcagcugccag

SEQ ID NO: 1304380 - RNA, 20 nt, Human
ugggguccuggagcagacca

SEQ ID NO: 1304381 - RNA, 20 nt, Human
agggaggaggcagagaagaa

SEQ ID NO: 1304382 - RNA, 23 nt, Human
agggaggacgcucucuggccuuc

SEQ ID NO: 1304383 - RNA, 22 nt, Human
agggaggacgcucucuggccuu

SEQ ID NO: 1304384 - RNA, 21 nt, Human
agggaggacgcucucuggccu

SEQ ID NO: 1304385 - RNA, 19 nt, Human
agggacaaguggacucagg

SEQ ID NO: 1304386 - RNA, 21 nt, Human
agggacaccugggagaaaucu

SEQ ID NO: 1304387 - RNA, 14 nt, Human
agggacaccuggga

SEQ ID NO: 1304388 - RNA, 16 nt, Human
agggacagaggcccca

SEQ ID NO: 1304389 - RNA, 12 nt, Human
agggagagccca

SEQ ID NO: 1304390 - RNA, 13 nt, Human
agggagagcccag

SEQ ID NO: 1304391 - RNA, 14 nt, Human
agggagagcccagg

SEQ ID NO: 1304392 - RNA, 18 nt, Human
agggagagcccaggagcu

SEQ ID NO: 1304393 - RNA, 21 nt, Human
agggagagcccaggagcuccc

SEQ ID NO: 1304394 - RNA, 19 nt, Human
agggagagcccaggagcuc

SEQ ID NO: 1304395 - RNA, 13 nt, Human
agggagagggggc

SEQ ID NO: 1304396 - RNA, 16 nt, Human
agggagagggggcugg

SEQ ID NO: 1304397 - RNA, 18 nt, Human
ugggagacugcugaguca

SEQ ID NO: 1304398 - RNA, 23 nt, Human
ugggagaccggccugccaggagg

SEQ ID NO: 1304399 - RNA, 12 nt, Human
ugggagagacuu

SEQ ID NO: 1304400 - RNA, 14 nt, Human
ugggagagacuugu

SEQ ID NO: 1304401 - RNA, 15 nt, Human
ugggagagacuuguu

SEQ ID NO: 1304402 - RNA, 21 nt, Human
ugggagagacuuguuuuggau

SEQ ID NO: 1304403 - RNA, 14 nt, Human
ugggagacauguga

SEQ ID NO: 1304404 - RNA, 15 nt, Human
ugggagacaugugac

SEQ ID NO: 1304405 - RNA, 16 nt, Human
ugggagacaugugaca

SEQ ID NO: 1304406 - RNA, 20 nt, Human
ugggagaccggccugccagg

SEQ ID NO: 1304407 - RNA, 21 nt, Human
ugggagaccggccugccagga

SEQ ID NO: 1304408 - RNA, 22 nt, Human
ugggagaccggccugccaggag

SEQ ID NO: 1304409 - RNA, 18 nt, Human
ugggagaccuguaaucau

SEQ ID NO: 1304410 - RNA, 21 nt, Human
ugggacguggcucagccagca

SEQ ID NO: 1304411 - RNA, 15 nt, Human
ugggacuaaaugccc

SEQ ID NO: 1304412 - RNA, 13 nt, Human
ugggacucagccu

SEQ ID NO: 1304413 - RNA, 17 nt, Human
ugggacucagccuucag

SEQ ID NO: 1304414 - RNA, 23 nt, Human
ugggacucagccuucagacagag

SEQ ID NO: 1304415 - RNA, 18 nt, Human
ugggacuaaaugcccugc

SEQ ID NO: 1304416 - RNA, 17 nt, Human
ugggacugcuaaauaaa

SEQ ID NO: 1304417 - RNA, 18 nt, Human
ugggacugcuaaauaaaa

SEQ ID NO: 1304418 - RNA, 13 nt, Human
ugggacuggccuc

SEQ ID NO: 1304419 - RNA, 23 nt, Human
ugggagaaucgcuccugcagccc

SEQ ID NO: 1304420 - RNA, 20 nt, Human
aggcccgcucuacaucuucu

SEQ ID NO: 1304421 - RNA, 18 nt, Human
aggcccucaagucuuucu

SEQ ID NO: 1304422 - RNA, 23 nt, Human
aggcccucaagucuuucucuuuc

SEQ ID NO: 1304423 - RNA, 16 nt, Human
aggcccuccacaccug

SEQ ID NO: 1304424 - RNA, 17 nt, Human
aggcccuccacaccugc

SEQ ID NO: 1304425 - RNA, 18 nt, Human
aggcccuccacaccugcg

SEQ ID NO: 1304426 - RNA, 19 nt, Human
aggcccuccacaccugcgg

SEQ ID NO: 1304427 - RNA, 20 nt, Human
aggcccuccacaccugcggc

SEQ ID NO: 1304428 - RNA, 21 nt, Human
aggcccuccacaccugcggcc

SEQ ID NO: 1304429 - RNA, 23 nt, Human
aggcccuccacaccugcggccca

SEQ ID NO: 1304430 - RNA, 20 nt, Human
aggcccucccuguuccccag

SEQ ID NO: 1304431 - RNA, 22 nt, Human
aggcccucccuguuccccagag

SEQ ID NO: 1304432 - RNA, 23 nt, Human
aggcccucccuguuccccagaga

SEQ ID NO: 1304433 - RNA, 15 nt, Human
aggcccucgcugcca

SEQ ID NO: 1304434 - RNA, 18 nt, Human
agggaacgugauuaguga

SEQ ID NO: 1304435 - RNA, 23 nt, Human
agggaacccagcucuaauacauu

SEQ ID NO: 1304436 - RNA, 22 nt, Human
agggaacccagcucuaauacau

SEQ ID NO: 1304437 - RNA, 14 nt, Human
agggaaccuguguc

SEQ ID NO: 1304438 - RNA, 21 nt, Human
agggaacaauuuggcaauuuu

SEQ ID NO: 1304439 - RNA, 23 nt, Human
agggaacaauuuggcaauuuugu

SEQ ID NO: 1304440 - RNA, 17 nt, Human
agggaaccacuuucuua

SEQ ID NO: 1304441 - RNA, 19 nt, Human
agggaagagacagcccagg

SEQ ID NO: 1304442 - RNA, 14 nt, Human
agggaagagacagc

SEQ ID NO: 1304443 - RNA, 18 nt, Human
agggaagcagcagccucg

SEQ ID NO: 1304444 - RNA, 17 nt, Human
agggaagcagcagccuc

SEQ ID NO: 1304445 - RNA, 14 nt, Human
agggaagcucuugg

SEQ ID NO: 1304446 - RNA, 15 nt, Human
agggaaggaucccau

SEQ ID NO: 1304447 - RNA, 22 nt, Human
agggaaggaucccaugagcucc

SEQ ID NO: 1304448 - RNA, 23 nt, Human
agggaaggaucccaugagcuccu

SEQ ID NO: 1304449 - RNA, 17 nt, Human
agggaaggaggagccug

SEQ ID NO: 1304450 - RNA, 19 nt, Human
agggaaggaggagccuguc

SEQ ID NO: 1304451 - RNA, 12 nt, Human
agggaaggcagg

SEQ ID NO: 1304452 - RNA, 14 nt, Human
agggaaggcaggca

SEQ ID NO: 1304453 - RNA, 15 nt, Human
agggaaggcaggcag

SEQ ID NO: 1304454 - RNA, 16 nt, Human
agggaaggcaggcagg

SEQ ID NO: 1304455 - RNA, 20 nt, Human
agggaaggcaggcagggcuc

SEQ ID NO: 1304456 - RNA, 18 nt, Human
agggaaggcaggcagggc

SEQ ID NO: 1304457 - RNA, 13 nt, Human
agggaaggggaca

SEQ ID NO: 1304458 - RNA, 22 nt, Human
agggaaggggacaaggacuagg

SEQ ID NO: 1304459 - RNA, 18 nt, Human
agggaagggccugccaca

SEQ ID NO: 1304460 - RNA, 20 nt, Human
agggaagggagccaagggau

SEQ ID NO: 1304461 - RNA, 19 nt, Human
agggaaggcuggacuaggc

SEQ ID NO: 1304462 - RNA, 12 nt, Human
agggaagggagc

SEQ ID NO: 1304463 - RNA, 13 nt, Human
agggaagggagcc

SEQ ID NO: 1304464 - RNA, 14 nt, Human
agggaagggagcca

SEQ ID NO: 1304465 - RNA, 15 nt, Human
agggaagggagccaa

SEQ ID NO: 1304466 - RNA, 16 nt, Human
agggaagggagccaag

SEQ ID NO: 1304467 - RNA, 19 nt, Human
agggaagggagccaaggga

SEQ ID NO: 1304468 - RNA, 13 nt, Human
agggaagggccug

SEQ ID NO: 1304469 - RNA, 14 nt, Human
agggaagggccugc

SEQ ID NO: 1304470 - RNA, 16 nt, Human
agggaagggccugcca

SEQ ID NO: 1304471 - RNA, 21 nt, Human
agggaauuucuucaacucccu

SEQ ID NO: 1304472 - RNA, 14 nt, Human
agggaaugugaaau

SEQ ID NO: 1304473 - RNA, 16 nt, Human
agggaauugcagagua

SEQ ID NO: 1304474 - RNA, 13 nt, Human
agggaaugugaaa

SEQ ID NO: 1304475 - RNA, 14 nt, Human
agggacaaaggagc

SEQ ID NO: 1304476 - RNA, 15 nt, Human
agggacaaaggagcc

SEQ ID NO: 1304477 - RNA, 16 nt, Human
agggacaaaggagccu

SEQ ID NO: 1304478 - RNA, 17 nt, Human
agggacaaaggagccug

SEQ ID NO: 1304479 - RNA, 18 nt, Human
agggacaaaggagccugu

SEQ ID NO: 1304480 - RNA, 19 nt, Human
agggacaaaggagccugug

SEQ ID NO: 1304481 - RNA, 20 nt, Human
agggacaaaggagccuguga

SEQ ID NO: 1304482 - RNA, 21 nt, Human
agggacaaaggagccugugaa

SEQ ID NO: 1304483 - RNA, 22 nt, Human
agggacaaguggacucagggca

SEQ ID NO: 1304484 - RNA, 20 nt, Human
agggaaguaguuaucauguu

SEQ ID NO: 1304485 - RNA, 17 nt, Human
agggaaguaguuaucau

SEQ ID NO: 1304486 - RNA, 15 nt, Human
agggaaguaguuauc

SEQ ID NO: 1304487 - RNA, 19 nt, Human
agggaauaagguacaagaa

SEQ ID NO: 1304488 - RNA, 19 nt, Human
ugggccccugccucucugc

SEQ ID NO: 1304489 - RNA, 15 nt, Human
ugggccccugccucu

SEQ ID NO: 1304490 - RNA, 20 nt, Human
ugggccccugccucucugca

SEQ ID NO: 1304491 - RNA, 17 nt, Human
agggaggcauggucugc

SEQ ID NO: 1304492 - RNA, 14 nt, Human
agggaggccgaagc

SEQ ID NO: 1304493 - RNA, 16 nt, Human
agggaggccgaagcua

SEQ ID NO: 1304494 - RNA, 23 nt, Human
agggaggccgaagcuaacaggga

SEQ ID NO: 1304495 - RNA, 15 nt, Human
agggaggcugcugcu

SEQ ID NO: 1304496 - RNA, 22 nt, Human
agggaggcugcugcugcucuug

SEQ ID NO: 1304497 - RNA, 14 nt, Human
agggaggcuggucc

SEQ ID NO: 1304498 - RNA, 15 nt, Human
agggaggcugguccu

SEQ ID NO: 1304499 - RNA, 19 nt, Human
ugggccccauguuaacccc

SEQ ID NO: 1304500 - RNA, 22 nt, Human
ugggccccaguuguauuuauuu

SEQ ID NO: 1304501 - RNA, 21 nt, Human
ugggccccaggggaacacugg

SEQ ID NO: 1304502 - RNA, 18 nt, Human
ugggccccaguuguauuu

SEQ ID NO: 1304503 - RNA, 24 nt, Human
ugggccauguccaaagaggcugcc

SEQ ID NO: 1304504 - RNA, 17 nt, Human
ugggccauguccaaaga

SEQ ID NO: 1304505 - RNA, 18 nt, Human
ugggccauguccaaagag

SEQ ID NO: 1304506 - RNA, 19 nt, Human
ugggccauguccaaagagg

SEQ ID NO: 1304507 - RNA, 23 nt, Human
ugggccauguccaaagaggcugc

SEQ ID NO: 1304508 - RNA, 16 nt, Human
ugggccagucugugga

SEQ ID NO: 1304509 - RNA, 20 nt, Human
ugggccagucuguggaucag

SEQ ID NO: 1304510 - RNA, 14 nt, Human
ugggccauguccaa

SEQ ID NO: 1304511 - RNA, 16 nt, Human
ugggcacuggauuagu

SEQ ID NO: 1304512 - RNA, 14 nt, Human
agggcaccaggggu

SEQ ID NO: 1304513 - RNA, 14 nt, Human
agggcacugguggc

SEQ ID NO: 1304514 - RNA, 19 nt, Human
agggcaccagggguuucuc

SEQ ID NO: 1304515 - RNA, 21 nt, Human
agggcaccagggguuucucgc

SEQ ID NO: 1304516 - RNA, 21 nt, Human
agggcacccuaguucuaccuc

SEQ ID NO: 1304517 - RNA, 18 nt, Human
agggcacugacggacuca

SEQ ID NO: 1304518 - RNA, 16 nt, Human
agggcacugguggccc

SEQ ID NO: 1304519 - RNA, 17 nt, Human
agggcagcgccaggcug

SEQ ID NO: 1304520 - RNA, 17 nt, Human
agggcauggccaggugg

SEQ ID NO: 1304521 - RNA, 20 nt, Human
agggccacaugggaggcuca

SEQ ID NO: 1304522 - RNA, 21 nt, Human
agggccacaugggaggcucac

SEQ ID NO: 1304523 - RNA, 15 nt, Human
agggccacgcuccag

SEQ ID NO: 1304524 - RNA, 16 nt, Human
agggccacgcuccagc

SEQ ID NO: 1304525 - RNA, 20 nt, Human
agggccacgcuccagcugcc

SEQ ID NO: 1304526 - RNA, 17 nt, Human
agggccacgcuccagcu

SEQ ID NO: 1304527 - RNA, 16 nt, Human
agggcaucucugggcu

SEQ ID NO: 1304528 - RNA, 17 nt, Human
agggcaucucugggcug

SEQ ID NO: 1304529 - RNA, 18 nt, Human
agggcaucucugggcugg

SEQ ID NO: 1304530 - RNA, 22 nt, Human
agggcaugccacgugggcucau

SEQ ID NO: 1304531 - RNA, 16 nt, Human
agggcagcuuugcuca

SEQ ID NO: 1304532 - RNA, 17 nt, Human
agggcagcuuugcucau

SEQ ID NO: 1304533 - RNA, 14 nt, Human
agggcaucucuggg

SEQ ID NO: 1304534 - RNA, 15 nt, Human
agggcaucucugggc

SEQ ID NO: 1304535 - RNA, 15 nt, Human
agggcccuccuuccu

SEQ ID NO: 1304536 - RNA, 18 nt, Human
agggcccugggccugccu

SEQ ID NO: 1304537 - RNA, 16 nt, Human
agggcccugggccugc

SEQ ID NO: 1304538 - RNA, 15 nt, Human
agggcccugugucug

SEQ ID NO: 1304539 - RNA, 20 nt, Human
agggccgacuaagagaaguu

SEQ ID NO: 1304540 - RNA, 19 nt, Human
agggccgacuaagagaagu

SEQ ID NO: 1304541 - RNA, 11 nt, Human
agggccagagc

SEQ ID NO: 1304542 - RNA, 12 nt, Human
agggccagagcc

SEQ ID NO: 1304543 - RNA, 13 nt, Human
agggccagagcca

SEQ ID NO: 1304544 - RNA, 14 nt, Human
agggccagagccag

SEQ ID NO: 1304545 - RNA, 15 nt, Human
agggccagagccagg

SEQ ID NO: 1304546 - RNA, 16 nt, Human
agggccagagccaggg

SEQ ID NO: 1304547 - RNA, 19 nt, Human
agggccaugcugaggccug

SEQ ID NO: 1304548 - RNA, 20 nt, Human
agggccaugcugaggccugg

SEQ ID NO: 1304549 - RNA, 21 nt, Human
agggccaugcugaggccuggg

SEQ ID NO: 1304550 - RNA, 22 nt, Human
agggccaugcugaggccugggc

SEQ ID NO: 1304551 - RNA, 23 nt, Human
agggccaugcugaggccugggcc

SEQ ID NO: 1304552 - RNA, 13 nt, Human
ugcuauuugaagu

SEQ ID NO: 1304553 - RNA, 14 nt, Human
ugcuauuuuucauc

SEQ ID NO: 1304554 - RNA, 19 nt, Human
ugcuauuuuucauccuaaa

SEQ ID NO: 1304555 - RNA, 17 nt, Human
ugcucaacuugcaaaau

SEQ ID NO: 1304556 - RNA, 20 nt, Human
ugcucaacuugcaaaaucag

SEQ ID NO: 1304557 - RNA, 16 nt, Human
ugcucaacuugcaaaa

SEQ ID NO: 1304558 - RNA, 13 nt, Human
ugcucaacuugca

SEQ ID NO: 1304559 - RNA, 23 nt, Human
aggaaaccaguuaggucucaaua

SEQ ID NO: 1304560 - RNA, 16 nt, Human
aggaaaauugaaugca

SEQ ID NO: 1304561 - RNA, 21 nt, Human
aggaaaauuuuagcgugcuca

SEQ ID NO: 1304562 - RNA, 19 nt, Human
aggaaacaaccaugucauu

SEQ ID NO: 1304563 - RNA, 14 nt, Human
aggaaaauugaaug

SEQ ID NO: 1304564 - RNA, 17 nt, Human
aggaaacaguugcaugu

SEQ ID NO: 1304565 - RNA, 19 nt, Human
aggaaacaguugcauguag

SEQ ID NO: 1304566 - RNA, 20 nt, Human
aggaaacaguugcauguagu

SEQ ID NO: 1304567 - RNA, 21 nt, Human
aggaaacaguugcauguagua

SEQ ID NO: 1304568 - RNA, 22 nt, Human
aggaaacaguugcauguaguaa

SEQ ID NO: 1304569 - RNA, 17 nt, Human
ugcucuugaugccuggc

SEQ ID NO: 1304570 - RNA, 15 nt, Human
ugcugagaaaacaug

SEQ ID NO: 1304571 - RNA, 17 nt, Human
ugcugagaaccuggccu

SEQ ID NO: 1304572 - RNA, 18 nt, Human
ugcugagaaccuggccuu

SEQ ID NO: 1304573 - RNA, 19 nt, Human
ugcugagaaccuggccuuc

SEQ ID NO: 1304574 - RNA, 20 nt, Human
ugcugagaaccuggccuuca

SEQ ID NO: 1304575 - RNA, 21 nt, Human
ugcugagaaccuggccuucag

SEQ ID NO: 1304576 - RNA, 15 nt, Human
ugcucuugaacuccu

SEQ ID NO: 1304577 - RNA, 14 nt, Human
ugcucuuauuucau

SEQ ID NO: 1304578 - RNA, 20 nt, Human
ugcucuugaacuccugaccu

SEQ ID NO: 1304579 - RNA, 22 nt, Human
ugcucuugaacuccugaccuca

SEQ ID NO: 1304580 - RNA, 22 nt, Human
ugcucugcgugucaccugugcu

SEQ ID NO: 1304581 - RNA, 23 nt, Human
ugcucugcgugucaccugugcuu

SEQ ID NO: 1304582 - RNA, 13 nt, Human
ugcucuuauuuca

SEQ ID NO: 1304583 - RNA, 14 nt, Human
ugcucuucaagaaa

SEQ ID NO: 1304584 - RNA, 18 nt, Human
ugcucuuagcugucugcu

SEQ ID NO: 1304585 - RNA, 21 nt, Human
ugcucccaaggggccugagca

SEQ ID NO: 1304586 - RNA, 22 nt, Human
ugcucccaaggggccugagcag

SEQ ID NO: 1304587 - RNA, 12 nt, Human
ugcucccaccuc

SEQ ID NO: 1304588 - RNA, 14 nt, Human
ugcucccaccuccu

SEQ ID NO: 1304589 - RNA, 15 nt, Human
ugcucccaccuccug

SEQ ID NO: 1304590 - RNA, 18 nt, Human
ugcucccaccuccugaca

SEQ ID NO: 1304591 - RNA, 23 nt, Human
ugcucccaccuccugacacccuu

SEQ ID NO: 1304592 - RNA, 11 nt, Human
ugcucugagaa

SEQ ID NO: 1304593 - RNA, 20 nt, Human
ugcucugagaauuguugaga

SEQ ID NO: 1304594 - RNA, 15 nt, Human
ugcucucuuucuguc

SEQ ID NO: 1304595 - RNA, 18 nt, Human
ugcucugaacacgaagcu

SEQ ID NO: 1304596 - RNA, 16 nt, Human
aggaagaucccccaga

SEQ ID NO: 1304597 - RNA, 14 nt, Human
aggaagagggacag

SEQ ID NO: 1304598 - RNA, 20 nt, Human
aggaagaggggaagcagaaa

SEQ ID NO: 1304599 - RNA, 15 nt, Human
aggaagagccuucca

SEQ ID NO: 1304600 - RNA, 17 nt, Human
aggaagagccuuccacc

SEQ ID NO: 1304601 - RNA, 19 nt, Human
aggaagagccuuccaccca

SEQ ID NO: 1304602 - RNA, 21 nt, Human
aggaagagccuuccacccagg

SEQ ID NO: 1304603 - RNA, 23 nt, Human
ugcugagccuguaaaauaaaagg

SEQ ID NO: 1304604 - RNA, 20 nt, Human
ugcugagauacauacagaau

SEQ ID NO: 1304605 - RNA, 10 nt, Human
ugcugagacu

SEQ ID NO: 1304606 - RNA, 22 nt, Human
ugcugagagggcucgaggggug

SEQ ID NO: 1304607 - RNA, 18 nt, Human
ugcugagauacauacaga

SEQ ID NO: 1304608 - RNA, 19 nt, Human
ugcugagauacauacagaa

SEQ ID NO: 1304609 - RNA, 20 nt, Human
ugcugagauuacagguguga

SEQ ID NO: 1304610 - RNA, 13 nt, Human
ugcugagcucuga

SEQ ID NO: 1304611 - RNA, 14 nt, Human
ugcugagcucugag

SEQ ID NO: 1304612 - RNA, 15 nt, Human
ugcugagcucugaga

SEQ ID NO: 1304613 - RNA, 17 nt, Human
ugcugagcucugagagg

SEQ ID NO: 1304614 - RNA, 21 nt, Human
ugcugagcucugagaggcccu

SEQ ID NO: 1304615 - RNA, 22 nt, Human
ugcugagcucugagaggcccug

SEQ ID NO: 1304616 - RNA, 23 nt, Human
ugcugagcucugagaggcccugg

SEQ ID NO: 1304617 - RNA, 13 nt, Human
ugcugaggccugg

SEQ ID NO: 1304618 - RNA, 14 nt, Human
ugcugaggccuggg

SEQ ID NO: 1304619 - RNA, 15 nt, Human
ugcugaggccugggc

SEQ ID NO: 1304620 - RNA, 16 nt, Human
ugcugaggccugggcc

SEQ ID NO: 1304621 - RNA, 17 nt, Human
ugcugaggccugggccg

SEQ ID NO: 1304622 - RNA, 16 nt, Human
aggaauuacgugcucu

SEQ ID NO: 1304623 - RNA, 22 nt, Human
aggaaggcagggaggaggcaga

SEQ ID NO: 1304624 - RNA, 20 nt, Human
aggaaggcagggaggaggca

SEQ ID NO: 1304625 - RNA, 18 nt, Human
aggaaggcagggaggagg

SEQ ID NO: 1304626 - RNA, 16 nt, Human
aggaaggcagggagga

SEQ ID NO: 1304627 - RNA, 15 nt, Human
aggaaggcugagagg

SEQ ID NO: 1304628 - RNA, 22 nt, Human
aggaaggaggacccaggacagg

SEQ ID NO: 1304629 - RNA, 17 nt, Human
aggaagaucccccagaa

SEQ ID NO: 1304630 - RNA, 18 nt, Human
aggaagaucccccagaaa

SEQ ID NO: 1304631 - RNA, 17 nt, Human
aggaagauuacucagua

SEQ ID NO: 1304632 - RNA, 19 nt, Human
aggaagcaaauagaagaga

SEQ ID NO: 1304633 - RNA, 18 nt, Human
aggaagcagcuuucccca

SEQ ID NO: 1304634 - RNA, 14 nt, Human
aggaagcagccaag

SEQ ID NO: 1304635 - RNA, 15 nt, Human
aggaagcauuguaaa

SEQ ID NO: 1304636 - RNA, 16 nt, Human
aggaagcauuguaaaa

SEQ ID NO: 1304637 - RNA, 17 nt, Human
aggaagcauuguaaaau

SEQ ID NO: 1304638 - RNA, 19 nt, Human
aggaagcauuguaaaauaa

SEQ ID NO: 1304639 - RNA, 21 nt, Human
aggaagcauuguaaaauaauu

SEQ ID NO: 1304640 - RNA, 22 nt, Human
aggaagcauuguaaaauaauuc

SEQ ID NO: 1304641 - RNA, 15 nt, Human
aggaagccaaagagu

SEQ ID NO: 1304642 - RNA, 20 nt, Human
ugcuaauuuugaaaaacugc

SEQ ID NO: 1304643 - RNA, 19 nt, Human
ugcuaauuuugaaaaacug

SEQ ID NO: 1304644 - RNA, 18 nt, Human
ugcuaauuuugaaaaacu

SEQ ID NO: 1304645 - RNA, 16 nt, Human
ugcuaauuuugaaaaa

SEQ ID NO: 1304646 - RNA, 22 nt, Human
ugcuacaccuauuaucccagcu

SEQ ID NO: 1304647 - RNA, 20 nt, Human
ugcuacaggguccaacauag

SEQ ID NO: 1304648 - RNA, 18 nt, Human
ugcuacaggguccaacau

SEQ ID NO: 1304649 - RNA, 13 nt, Human
ugcuaccaaagca

SEQ ID NO: 1304650 - RNA, 13 nt, Human
ugcuaccaccagc

SEQ ID NO: 1304651 - RNA, 14 nt, Human
ugcuaccaccagcu

SEQ ID NO: 1304652 - RNA, 15 nt, Human
ugcuaccaccagcug

SEQ ID NO: 1304653 - RNA, 16 nt, Human
ugcuaccaccagcugu

SEQ ID NO: 1304654 - RNA, 13 nt, Human
agcuuaacagugu

SEQ ID NO: 1304655 - RNA, 17 nt, Human
ugcuaccaccagcugug

SEQ ID NO: 1304656 - RNA, 18 nt, Human
ugcuaccaccagcugugu

SEQ ID NO: 1304657 - RNA, 20 nt, Human
ugcuaccaccagcugugucc

SEQ ID NO: 1304658 - RNA, 21 nt, Human
ugcuaccaccagcugugucca

SEQ ID NO: 1304659 - RNA, 22 nt, Human
ugcuaccaccagcuguguccaa

SEQ ID NO: 1304660 - RNA, 15 nt, Human
ugcuaccaguauuua

SEQ ID NO: 1304661 - RNA, 18 nt, Human
ugcuaccaguauuuagaa

SEQ ID NO: 1304662 - RNA, 22 nt, Human
ugcuaccaguauuuagaagcca

SEQ ID NO: 1304663 - RNA, 16 nt, Human
agcuguuuacuaggga

SEQ ID NO: 1304664 - RNA, 22 nt, Human
agcuguuuacuagggaucccuc

SEQ ID NO: 1304665 - RNA, 19 nt, Human
ugccuuuucccaacuccag

SEQ ID NO: 1304666 - RNA, 15 nt, Human
ugccuugucacgcca

SEQ ID NO: 1304667 - RNA, 19 nt, Human
ugccuuuugcaaccaggaa

SEQ ID NO: 1304668 - RNA, 13 nt, Human
ugccuugguuuuu

SEQ ID NO: 1304669 - RNA, 23 nt, Human
ugccuugguuuuuacugcucuga

SEQ ID NO: 1304670 - RNA, 15 nt, Human
ugcgguagccagcac

SEQ ID NO: 1304671 - RNA, 16 nt, Human
ugcgguagccagcaca

SEQ ID NO: 1304672 - RNA, 17 nt, Human
ugcgguagccagcacac

SEQ ID NO: 1304673 - RNA, 18 nt, Human
ugcgguagccagcacaca

SEQ ID NO: 1304674 - RNA, 18 nt, Human
ugcuaauauuuuccuccu

SEQ ID NO: 1304675 - RNA, 20 nt, Human
ugcuaauauuuuccuccuga

SEQ ID NO: 1304676 - RNA, 22 nt, Human
ugcuaaucagggaggucauuuu

SEQ ID NO: 1304677 - RNA, 23 nt, Human
ugcuaaucagggaggucauuuug

SEQ ID NO: 1304678 - RNA, 13 nt, Human
ugcuaaucuucuu

SEQ ID NO: 1304679 - RNA, 20 nt, Human
ugcuaaucuucuuaugcaau

SEQ ID NO: 1304680 - RNA, 22 nt, Human
ugcuaaucuucuuaugcaauuu

SEQ ID NO: 1304681 - RNA, 16 nt, Human
ugcuaaugucaaacca

SEQ ID NO: 1304682 - RNA, 18 nt, Human
ugcuaauuuauccugaaa

SEQ ID NO: 1304683 - RNA, 13 nt, Human
ugcuaauuuguuu

SEQ ID NO: 1304684 - RNA, 19 nt, Human
agcuuaauggcugauaauu

SEQ ID NO: 1304685 - RNA, 22 nt, Human
agcuuaauggcugauaauuuua

SEQ ID NO: 1304686 - RNA, 22 nt, Human
agcuuacaaauacuaaaaagaa

SEQ ID NO: 1304687 - RNA, 14 nt, Human
agcuugaccugagg

SEQ ID NO: 1304688 - RNA, 16 nt, Human
agcuugaccugaggcu

SEQ ID NO: 1304689 - RNA, 20 nt, Human
agcuugcccuggugccucac

SEQ ID NO: 1304690 - RNA, 22 nt, Human
agcuugauguuggaucucaaga

SEQ ID NO: 1304691 - RNA, 14 nt, Human
agcuuguagccagc

SEQ ID NO: 1304692 - RNA, 15 nt, Human
agcuuguagccagcc

SEQ ID NO: 1304693 - RNA, 16 nt, Human
agcuuguagccagccg

SEQ ID NO: 1304694 - RNA, 18 nt, Human
agcuuguggcaagugaau

SEQ ID NO: 1304695 - RNA, 17 nt, Human
agcuuguggcaagugaa

SEQ ID NO: 1304696 - RNA, 14 nt, Human
aggaaaagacacau

SEQ ID NO: 1304697 - RNA, 22 nt, Human
agcuuuggaaguuuagcucuga

SEQ ID NO: 1304698 - RNA, 19 nt, Human
agcuuuggaccuaauccaa

SEQ ID NO: 1304699 - RNA, 23 nt, Human
agcuuuggaaguuuagcucugag

SEQ ID NO: 1304700 - RNA, 18 nt, Human
agcuuuggaaguuuagcu

SEQ ID NO: 1304701 - RNA, 18 nt, Human
agcuuuggaccuaaucca

SEQ ID NO: 1304702 - RNA, 21 nt, Human
agcuuugcucauauuucccau

SEQ ID NO: 1304703 - RNA, 20 nt, Human
agcuuugcucauauuuccca

SEQ ID NO: 1304704 - RNA, 19 nt, Human
agcuuugcucauauuuccc

SEQ ID NO: 1304705 - RNA, 13 nt, Human
agcuuugcucaua

SEQ ID NO: 1304706 - RNA, 18 nt, Human
agcuuugcucuuugguag

SEQ ID NO: 1304707 - RNA, 21 nt, Human
agcuuugcucuuugguagaaa

SEQ ID NO: 1304708 - RNA, 23 nt, Human
agcuuugcucuuugguagaaaag

SEQ ID NO: 1304709 - RNA, 20 nt, Human
agcuuuccugccccaggccu

SEQ ID NO: 1304710 - RNA, 21 nt, Human
agcuuuccugccccaggccug

SEQ ID NO: 1304711 - RNA, 22 nt, Human
agcuuuccugccccaggccuga

SEQ ID NO: 1304712 - RNA, 23 nt, Human
agcuuuccugccccaggccugaa

SEQ ID NO: 1304713 - RNA, 10 nt, Human
agcuuugcua

SEQ ID NO: 1304714 - RNA, 16 nt, Human
agcuuugcuaccaaag

SEQ ID NO: 1304715 - RNA, 21 nt, Human
agcuuugcuaccaaagcaccu

SEQ ID NO: 1304716 - RNA, 10 nt, Human
agcuuugcuc

SEQ ID NO: 1304717 - RNA, 22 nt, Human
agcuuuccccaugucucgacuc

SEQ ID NO: 1304718 - RNA, 12 nt, Human
agcuuucccugc

SEQ ID NO: 1304719 - RNA, 16 nt, Human
agcuuucccugccucu

SEQ ID NO: 1304720 - RNA, 12 nt, Human
agcuuuccugcc

SEQ ID NO: 1304721 - RNA, 13 nt, Human
agcuuuccugccc

SEQ ID NO: 1304722 - RNA, 14 nt, Human
agcuuuccugcccc

SEQ ID NO: 1304723 - RNA, 15 nt, Human
agcuuuccugcccca

SEQ ID NO: 1304724 - RNA, 13 nt, Human
agcuuguuuacau

SEQ ID NO: 1304725 - RNA, 16 nt, Human
agcuuguuuacaugcu

SEQ ID NO: 1304726 - RNA, 18 nt, Human
agcuuguuuacaugcuua

SEQ ID NO: 1304727 - RNA, 19 nt, Human
agcuuguuuacaugcuuau

SEQ ID NO: 1304728 - RNA, 23 nt, Human
agcuuguuuacaugcuuauucca

SEQ ID NO: 1304729 - RNA, 16 nt, Human
agcuuucagaauaugu

SEQ ID NO: 1304730 - RNA, 17 nt, Human
agcuuucagaauauguc

SEQ ID NO: 1304731 - RNA, 22 nt, Human
agcuuucauguaaacugugcac

SEQ ID NO: 1304732 - RNA, 15 nt, Human
agcuuuccccagccc

SEQ ID NO: 1304733 - RNA, 13 nt, Human
ugccaucaucucc

SEQ ID NO: 1304734 - RNA, 15 nt, Human
ugccaucaucuccug

SEQ ID NO: 1304735 - RNA, 16 nt, Human
ugccaucaucuccugc

SEQ ID NO: 1304736 - RNA, 23 nt, Human
ugccaucaucuccugccuuccuc

SEQ ID NO: 1304737 - RNA, 14 nt, Human
agcuccaguguccu

SEQ ID NO: 1304738 - RNA, 15 nt, Human
agcuccaguguccug

SEQ ID NO: 1304739 - RNA, 16 nt, Human
agcuccaguguccuga

SEQ ID NO: 1304740 - RNA, 18 nt, Human
agcuccaguguccugagc

SEQ ID NO: 1304741 - RNA, 19 nt, Human
agcuccaguguccugagcu

SEQ ID NO: 1304742 - RNA, 20 nt, Human
agcuccaguguccugagcuc

SEQ ID NO: 1304743 - RNA, 21 nt, Human
agcuccaguguccugagcuca

SEQ ID NO: 1304744 - RNA, 22 nt, Human
agcuccaguguccugagcucag

SEQ ID NO: 1304745 - RNA, 13 nt, Human
ugccauauuuuca

SEQ ID NO: 1304746 - RNA, 14 nt, Human
ugccauauuuucac

SEQ ID NO: 1304747 - RNA, 17 nt, Human
ugccauauuuucaccau

SEQ ID NO: 1304748 - RNA, 16 nt, Human
agcuccaucuccacuc

SEQ ID NO: 1304749 - RNA, 13 nt, Human
agcuccaucucca

SEQ ID NO: 1304750 - RNA, 15 nt, Human
agcuccaucuccacu

SEQ ID NO: 1304751 - RNA, 23 nt, Human
agcuccaguguccugagcucagc

SEQ ID NO: 1304752 - RNA, 23 nt, Human
agcucccaggaccacaggcucag

SEQ ID NO: 1304753 - RNA, 22 nt, Human
agcuccuuugggcuucagcugc

SEQ ID NO: 1304754 - RNA, 23 nt, Human
agcucgauguggucacagcugua

SEQ ID NO: 1304755 - RNA, 22 nt, Human
agcucgauguggucacagcugu

SEQ ID NO: 1304756 - RNA, 13 nt, Human
agcucucugcccu

SEQ ID NO: 1304757 - RNA, 18 nt, Human
agcucugaaaccaguguu

SEQ ID NO: 1304758 - RNA, 19 nt, Human
agcucuggggugggcaguu

SEQ ID NO: 1304759 - RNA, 20 nt, Human
agcucuggggugggcaguuu

SEQ ID NO: 1304760 - RNA, 21 nt, Human
agcucuggggugggcaguuuu

SEQ ID NO: 1304761 - RNA, 22 nt, Human
agcucuggggugggcaguuuuu

SEQ ID NO: 1304762 - RNA, 19 nt, Human
agcucugaaaccaguguua

SEQ ID NO: 1304763 - RNA, 15 nt, Human
agcucugaaagagaa

SEQ ID NO: 1304764 - RNA, 22 nt, Human
agcucugaaagagaaacacgua

SEQ ID NO: 1304765 - RNA, 16 nt, Human
agcucugaaagagaaa

SEQ ID NO: 1304766 - RNA, 21 nt, Human
agcucugaagaacucucugga

SEQ ID NO: 1304767 - RNA, 22 nt, Human
agcucugaagaacucucuggaa

SEQ ID NO: 1304768 - RNA, 20 nt, Human
agcucugacauucugauucg

SEQ ID NO: 1304769 - RNA, 10 nt, Human
agcucugaga

SEQ ID NO: 1304770 - RNA, 13 nt, Human
agcucugagaggc

SEQ ID NO: 1304771 - RNA, 15 nt, Human
agcucugagaggccc

SEQ ID NO: 1304772 - RNA, 16 nt, Human
agcucugagaggcccu

SEQ ID NO: 1304773 - RNA, 17 nt, Human
agcucugagaggcccug

SEQ ID NO: 1304774 - RNA, 18 nt, Human
agcucugagaggcccugg

SEQ ID NO: 1304775 - RNA, 19 nt, Human
agcucugagaggcccugga

SEQ ID NO: 1304776 - RNA, 20 nt, Human
agcucugagaggcccuggau

SEQ ID NO: 1304777 - RNA, 21 nt, Human
agcucugagaggcccuggauc

SEQ ID NO: 1304778 - RNA, 14 nt, Human
agcucugggguggg

SEQ ID NO: 1304779 - RNA, 21 nt, Human
agcugcaagguacucugguga

SEQ ID NO: 1304780 - RNA, 23 nt, Human
agcugcaagguacucuggugagu

SEQ ID NO: 1304781 - RNA, 17 nt, Human
agcugcacugaugcugc

SEQ ID NO: 1304782 - RNA, 19 nt, Human
agcugcacugaugcugccc

SEQ ID NO: 1304783 - RNA, 20 nt, Human
agcugcacugaugcugcccc

SEQ ID NO: 1304784 - RNA, 22 nt, Human
agcugcacugaugcugccccuc

SEQ ID NO: 1304785 - RNA, 23 nt, Human
agcugccaggagcacggcucugu

SEQ ID NO: 1304786 - RNA, 15 nt, Human
agcugccaguguccu

SEQ ID NO: 1304787 - RNA, 24 nt, Human
agcugccaguguccugagccccag

SEQ ID NO: 1304788 - RNA, 14 nt, Human
agcugcccccagag

SEQ ID NO: 1304789 - RNA, 16 nt, Human
agcugcccccagagcc

SEQ ID NO: 1304790 - RNA, 17 nt, Human
agcugcccccagagcca

SEQ ID NO: 1304791 - RNA, 19 nt, Human
agcugcccccagagccaca

SEQ ID NO: 1304792 - RNA, 20 nt, Human
agcugcccccagagccacag

SEQ ID NO: 1304793 - RNA, 21 nt, Human
agcugcccccagagccacagu

SEQ ID NO: 1304794 - RNA, 16 nt, Human
agcugccccggccccu

SEQ ID NO: 1304795 - RNA, 17 nt, Human
agcugccccggccccuc

SEQ ID NO: 1304796 - RNA, 19 nt, Human
agcugccccggccccuccc

SEQ ID NO: 1304797 - RNA, 22 nt, Human
ugccgagaguccaucagccucc

SEQ ID NO: 1304798 - RNA, 15 nt, Human
ugccgagcaaccgug

SEQ ID NO: 1304799 - RNA, 17 nt, Human
ugccgagcaaccguggc

SEQ ID NO: 1304800 - RNA, 19 nt, Human
ugccgagcaaccguggccc

SEQ ID NO: 1304801 - RNA, 21 nt, Human
ugccgagcaaccguggcccuu

SEQ ID NO: 1304802 - RNA, 20 nt, Human
ugccgagcaaccguggcccu

SEQ ID NO: 1304803 - RNA, 21 nt, Human
ugccgauauacucuagaugaa

SEQ ID NO: 1304804 - RNA, 21 nt, Human
ugccugcuuuuuauggccugu

SEQ ID NO: 1304805 - RNA, 20 nt, Human
ugccugcuuuuuauggccug

SEQ ID NO: 1304806 - RNA, 22 nt, Human
ugccugcuuuuuauggccugug

SEQ ID NO: 1304807 - RNA, 18 nt, Human
ugccuggaagagcagccc

SEQ ID NO: 1304808 - RNA, 12 nt, Human
ugccucugccug

SEQ ID NO: 1304809 - RNA, 15 nt, Human
agcugcuuccagugu

SEQ ID NO: 1304810 - RNA, 14 nt, Human
agcugcuuccagug

SEQ ID NO: 1304811 - RNA, 11 nt, Human
ugccuggaccc

SEQ ID NO: 1304812 - RNA, 18 nt, Human
agcuggccgggagccuga

SEQ ID NO: 1304813 - RNA, 19 nt, Human
agcuggccgggagccugau

SEQ ID NO: 1304814 - RNA, 23 nt, Human
agcuggcggcuggggucccagca

SEQ ID NO: 1304815 - RNA, 22 nt, Human
agcuggcggcuggggucccagc

SEQ ID NO: 1304816 - RNA, 19 nt, Human
ugccuggaagagcagcccu

SEQ ID NO: 1304817 - RNA, 20 nt, Human
ugccuggaagagcagcccua

SEQ ID NO: 1304818 - RNA, 21 nt, Human
agcugugugaauaccugcuca

SEQ ID NO: 1304819 - RNA, 12 nt, Human
ugccugugccag

SEQ ID NO: 1304820 - RNA, 16 nt, Human
ugccugugccagguga

SEQ ID NO: 1304821 - RNA, 23 nt, Human
ugccugugccaggugaggucagc

SEQ ID NO: 1304822 - RNA, 19 nt, Human
ugccugugcuacaauucau

SEQ ID NO: 1304823 - RNA, 14 nt, Human
ugccuguucccauu

SEQ ID NO: 1304824 - RNA, 21 nt, Human
ugccuguguccaugcgcucag

SEQ ID NO: 1304825 - RNA, 22 nt, Human
ugccuguguccaugcgcucagg

SEQ ID NO: 1304826 - RNA, 14 nt, Human
ugccuguggccaug

SEQ ID NO: 1304827 - RNA, 11 nt, Human
ugccuguggcg

SEQ ID NO: 1304828 - RNA, 21 nt, Human
ugccuguggcgccgucuccag

SEQ ID NO: 1304829 - RNA, 22 nt, Human
ugccuguggcgccgucuccagg

SEQ ID NO: 1304830 - RNA, 23 nt, Human
ugccuguggcgccgucuccaggg

SEQ ID NO: 1304831 - RNA, 15 nt, Human
ugccuguguccaugc

SEQ ID NO: 1304832 - RNA, 19 nt, Human
ugccuguguccaugcgcuc

SEQ ID NO: 1304833 - RNA, 23 nt, Human
agcuggggugcagggaugugggu

SEQ ID NO: 1304834 - RNA, 14 nt, Human
agcugggucaggca

SEQ ID NO: 1304835 - RNA, 15 nt, Human
agcugggucaggcag

SEQ ID NO: 1304836 - RNA, 16 nt, Human
agcugugcgugugugu

SEQ ID NO: 1304837 - RNA, 17 nt, Human
agcugugcgugugugug

SEQ ID NO: 1304838 - RNA, 22 nt, Human
agcugugcuuaugguaccagau

SEQ ID NO: 1304839 - RNA, 18 nt, Human
agcuguggcagaguuaca

SEQ ID NO: 1304840 - RNA, 21 nt, Human
agcuguggcagaguuacaguu

SEQ ID NO: 1304841 - RNA, 22 nt, Human
agcuguggcagaguuacaguuc

SEQ ID NO: 1304842 - RNA, 19 nt, Human
agcugugcuuaugguacca

SEQ ID NO: 1304843 - RNA, 15 nt, Human
agcugugguuuucuu

SEQ ID NO: 1304844 - RNA, 21 nt, Human
agcuguguccaaaaccgccag

SEQ ID NO: 1304845 - RNA, 22 nt, Human
agcugugguuuucuuuugccau

SEQ ID NO: 1304846 - RNA, 17 nt, Human
uggagcucguggaacag

SEQ ID NO: 1304847 - RNA, 21 nt, Human
uggagcucguggaacaguuac

SEQ ID NO: 1304848 - RNA, 21 nt, Human
uggagcucgugggacagucac

SEQ ID NO: 1304849 - RNA, 17 nt, Human
uggagccaauggagacu

SEQ ID NO: 1304850 - RNA, 22 nt, Human
uggagccagccgagcaggaggc

SEQ ID NO: 1304851 - RNA, 17 nt, Human
uggagcagaggggcuga

SEQ ID NO: 1304852 - RNA, 17 nt, Human
uggagcauuucucauca

SEQ ID NO: 1304853 - RNA, 21 nt, Human
uggagcauuucucaucaguag

SEQ ID NO: 1304854 - RNA, 23 nt, Human
aggcacacaccaccacgccuggc

SEQ ID NO: 1304855 - RNA, 21 nt, Human
uggagccagccgagcaggagg

SEQ ID NO: 1304856 - RNA, 21 nt, Human
aggauugcgagagaugugugu

SEQ ID NO: 1304857 - RNA, 23 nt, Human
aggauugcgagagauguguguug

SEQ ID NO: 1304858 - RNA, 17 nt, Human
uggacuguuuucucucg

SEQ ID NO: 1304859 - RNA, 20 nt, Human
uggacuguuuucucucggcu

SEQ ID NO: 1304860 - RNA, 22 nt, Human
uggacuguuuucucucggcucc

SEQ ID NO: 1304861 - RNA, 19 nt, Human
uggacuuaagcaucuggcu

SEQ ID NO: 1304862 - RNA, 15 nt, Human
uggacuucuggggua

SEQ ID NO: 1304863 - RNA, 13 nt, Human
uggagaaaauggg

SEQ ID NO: 1304864 - RNA, 22 nt, Human
uggagaaaauggguuuauucac

SEQ ID NO: 1304865 - RNA, 13 nt, Human
uggagaaagcuga

SEQ ID NO: 1304866 - RNA, 15 nt, Human
uggagaaagcugacu

SEQ ID NO: 1304867 - RNA, 18 nt, Human
uggagaaagcugacuugg

SEQ ID NO: 1304868 - RNA, 23 nt, Human
uggagaaagcugacuuggcuggu

SEQ ID NO: 1304869 - RNA, 13 nt, Human
uggagaaagggcc

SEQ ID NO: 1304870 - RNA, 21 nt, Human
uggagaaagggcccugggccu

SEQ ID NO: 1304871 - RNA, 22 nt, Human
uggagaaagggcccugggccug

SEQ ID NO: 1304872 - RNA, 19 nt, Human
uggagcacaaagacccugg

SEQ ID NO: 1304873 - RNA, 20 nt, Human
uggagcacaauaaauggcug

SEQ ID NO: 1304874 - RNA, 22 nt, Human
uggagcacaauaaauggcugua

SEQ ID NO: 1304875 - RNA, 15 nt, Human
uggagcagaagcagc

SEQ ID NO: 1304876 - RNA, 14 nt, Human
uggagcagaagcag

SEQ ID NO: 1304877 - RNA, 13 nt, Human
uggagcagaccac

SEQ ID NO: 1304878 - RNA, 17 nt, Human
uggagcagaccaccccg

SEQ ID NO: 1304879 - RNA, 12 nt, Human
uggagcagaggg

SEQ ID NO: 1304880 - RNA, 13 nt, Human
uggagcagagggg

SEQ ID NO: 1304881 - RNA, 16 nt, Human
uggagcagaggggcug

SEQ ID NO: 1304882 - RNA, 19 nt, Human
aggcaguaauaaaaagauu

SEQ ID NO: 1304883 - RNA, 12 nt, Human
aggcaguuuucu

SEQ ID NO: 1304884 - RNA, 13 nt, Human
aggcaguuuucua

SEQ ID NO: 1304885 - RNA, 14 nt, Human
aggcaguuuucuaa

SEQ ID NO: 1304886 - RNA, 14 nt, Human
aggcaguuugcaaa

SEQ ID NO: 1304887 - RNA, 20 nt, Human
aggcauacgagagcagaggu

SEQ ID NO: 1304888 - RNA, 21 nt, Human
aggcauacgagagcagagguc

SEQ ID NO: 1304889 - RNA, 13 nt, Human
aggcauugccaag

SEQ ID NO: 1304890 - RNA, 14 nt, Human
aggcauugccaagg

SEQ ID NO: 1304891 - RNA, 16 nt, Human
aggcauugccaagggc

SEQ ID NO: 1304892 - RNA, 18 nt, Human
aggcauugccaagggcuu

SEQ ID NO: 1304893 - RNA, 20 nt, Human
aggcauugccaagggcuuug

SEQ ID NO: 1304894 - RNA, 21 nt, Human
aggcauugccaagggcuuugu

SEQ ID NO: 1304895 - RNA, 20 nt, Human
aggcauuuaggccaugggac

SEQ ID NO: 1304896 - RNA, 13 nt, Human
aggcauuggauau

SEQ ID NO: 1304897 - RNA, 14 nt, Human
aggcauuggauauu

SEQ ID NO: 1304898 - RNA, 12 nt, Human
aggcauuuccua

SEQ ID NO: 1304899 - RNA, 13 nt, Human
aggcauuuccugg

SEQ ID NO: 1304900 - RNA, 14 nt, Human
aggcauuuccuggg

SEQ ID NO: 1304901 - RNA, 15 nt, Human
aggcauuuccugggu

SEQ ID NO: 1304902 - RNA, 16 nt, Human
aggcauuuccugggug

SEQ ID NO: 1304903 - RNA, 17 nt, Human
aggcauuuccugggugg

SEQ ID NO: 1304904 - RNA, 20 nt, Human
aggcauuuccuggguggcua

SEQ ID NO: 1304905 - RNA, 18 nt, Human
aggcauuugcaggguccu

SEQ ID NO: 1304906 - RNA, 21 nt, Human
aggcauuugcaggguccucuu

SEQ ID NO: 1304907 - RNA, 11 nt, Human
aggcacacagc

SEQ ID NO: 1304908 - RNA, 15 nt, Human
aggcacacagcuacu

SEQ ID NO: 1304909 - RNA, 13 nt, Human
aggcacacagcua

SEQ ID NO: 1304910 - RNA, 20 nt, Human
aggcagcuuuuucucuccca

SEQ ID NO: 1304911 - RNA, 13 nt, Human
aggcaggaagccc

SEQ ID NO: 1304912 - RNA, 19 nt, Human
aggcaggaacaaacagggc

SEQ ID NO: 1304913 - RNA, 14 nt, Human
aggcaggauugaaa

SEQ ID NO: 1304914 - RNA, 16 nt, Human
aggcaggauugaaaau

SEQ ID NO: 1304915 - RNA, 18 nt, Human
aggcaggauugaaaaugu

SEQ ID NO: 1304916 - RNA, 22 nt, Human
aggcaggauugaaaauguccag

SEQ ID NO: 1304917 - RNA, 16 nt, Human
aggcaggauuggggaa

SEQ ID NO: 1304918 - RNA, 19 nt, Human
aggcaggauuggggaagag

SEQ ID NO: 1304919 - RNA, 23 nt, Human
aggcaggauuggggaagagagcc

SEQ ID NO: 1304920 - RNA, 20 nt, Human
aggcaggauuggggaagaga

SEQ ID NO: 1304921 - RNA, 13 nt, Human
aggcaggcagggc

SEQ ID NO: 1304922 - RNA, 14 nt, Human
aggcaggcagggcu

SEQ ID NO: 1304923 - RNA, 15 nt, Human
aggcaggcagggcuc

SEQ ID NO: 1304924 - RNA, 16 nt, Human
aggcaggcagggcucu

SEQ ID NO: 1304925 - RNA, 18 nt, Human
aggcaggcagggcucucc

SEQ ID NO: 1304926 - RNA, 20 nt, Human
aggcaggcagggcucuccug

SEQ ID NO: 1304927 - RNA, 15 nt, Human
aggcaggcucccagg

SEQ ID NO: 1304928 - RNA, 16 nt, Human
aggcaggcucccaggg

SEQ ID NO: 1304929 - RNA, 21 nt, Human
aggcagggaacauggggagga

SEQ ID NO: 1304930 - RNA, 12 nt, Human
aggcagggcucu

SEQ ID NO: 1304931 - RNA, 13 nt, Human
aggcagggcucuc

SEQ ID NO: 1304932 - RNA, 14 nt, Human
aggcagggcucucc

SEQ ID NO: 1304933 - RNA, 15 nt, Human
aggcagggcucuccu

SEQ ID NO: 1304934 - RNA, 17 nt, Human
aggcagggcucuccugg

SEQ ID NO: 1304935 - RNA, 18 nt, Human
aggcagggcucuccuggc

SEQ ID NO: 1304936 - RNA, 19 nt, Human
aggcagggcucuccuggcu

SEQ ID NO: 1304937 - RNA, 21 nt, Human
aggcagggcucuccuggcuuc

SEQ ID NO: 1304938 - RNA, 22 nt, Human
aggcagggcucuccuggcuucc

SEQ ID NO: 1304939 - RNA, 23 nt, Human
aggcagggcucuccuggcuuccc

SEQ ID NO: 1304940 - RNA, 16 nt, Human
aggcaggggccuccau

SEQ ID NO: 1304941 - RNA, 15 nt, Human
aggcaggggccucca

SEQ ID NO: 1304942 - RNA, 14 nt, Human
aggcaggggcuucc

SEQ ID NO: 1304943 - RNA, 15 nt, Human
aggcaggggcuuccu

SEQ ID NO: 1304944 - RNA, 16 nt, Human
aggcaggggcuuccug

SEQ ID NO: 1304945 - RNA, 17 nt, Human
aggcaggggcuuccugg

SEQ ID NO: 1304946 - RNA, 18 nt, Human
aggcaggggcuuccuggu

SEQ ID NO: 1304947 - RNA, 23 nt, Human
aggcagggggaaggugggguccu

SEQ ID NO: 1304948 - RNA, 12 nt, Human
uggauuccagag

SEQ ID NO: 1304949 - RNA, 18 nt, Human
uggauuccccaucucagg

SEQ ID NO: 1304950 - RNA, 22 nt, Human
uggauuccccaucucaggccag

SEQ ID NO: 1304951 - RNA, 19 nt, Human
uggauuccccaucucaggc

SEQ ID NO: 1304952 - RNA, 15 nt, Human
uggauucuaaaaugc

SEQ ID NO: 1304953 - RNA, 13 nt, Human
uggauucuaaaau

SEQ ID NO: 1304954 - RNA, 14 nt, Human
uggauucuuuccau

SEQ ID NO: 1304955 - RNA, 19 nt, Human
uggauugcaauaucugaag

SEQ ID NO: 1304956 - RNA, 20 nt, Human
uggauuggacaaaaugacuu

SEQ ID NO: 1304957 - RNA, 17 nt, Human
uggauugcacguggccu

SEQ ID NO: 1304958 - RNA, 21 nt, Human
uggauugcacguggccucuug

SEQ ID NO: 1304959 - RNA, 19 nt, Human
uggauuggacaaaaugacu

SEQ ID NO: 1304960 - RNA, 15 nt, Human
uggauuggacaaaau

SEQ ID NO: 1304961 - RNA, 13 nt, Human
uggauuggacaaa

SEQ ID NO: 1304962 - RNA, 15 nt, Human
uggaguugaucugga

SEQ ID NO: 1304963 - RNA, 17 nt, Human
uggaguugaucuggaac

SEQ ID NO: 1304964 - RNA, 19 nt, Human
uggaguugaucuggaaccc

SEQ ID NO: 1304965 - RNA, 13 nt, Human
uggauggaagggg

SEQ ID NO: 1304966 - RNA, 22 nt, Human
uggaguugaucuggaacccaga

SEQ ID NO: 1304967 - RNA, 13 nt, Human
uggagugcagugg

SEQ ID NO: 1304968 - RNA, 16 nt, Human
uggagugcaccaaaga

SEQ ID NO: 1304969 - RNA, 18 nt, Human
uggagugcaccaaagaga

SEQ ID NO: 1304970 - RNA, 16 nt, Human
uggagugcuguuuugu

SEQ ID NO: 1304971 - RNA, 17 nt, Human
uggagugcuguuuuguu

SEQ ID NO: 1304972 - RNA, 13 nt, Human
uggaguggcagcc

SEQ ID NO: 1304973 - RNA, 16 nt, Human
uggaguggcagcccag

SEQ ID NO: 1304974 - RNA, 17 nt, Human
uggaguggcagcccagc

SEQ ID NO: 1304975 - RNA, 18 nt, Human
uggaguggcagcccagcc

SEQ ID NO: 1304976 - RNA, 19 nt, Human
uggaguggcagcccagcca

SEQ ID NO: 1304977 - RNA, 20 nt, Human
uggaguggcagcccagccag

SEQ ID NO: 1304978 - RNA, 14 nt, Human
uggaguguaugacu

SEQ ID NO: 1304979 - RNA, 17 nt, Human
uggaguguaugacugca

SEQ ID NO: 1304980 - RNA, 19 nt, Human
uggaguguaugacugcaca

SEQ ID NO: 1304981 - RNA, 14 nt, Human
uggaguugaaaauc

SEQ ID NO: 1304982 - RNA, 19 nt, Human
uggaguguuccccuuccac

SEQ ID NO: 1304983 - RNA, 22 nt, Human
uggaguguuccccuuccacuga

SEQ ID NO: 1304984 - RNA, 20 nt, Human
uggaggucgguagguucagc

SEQ ID NO: 1304985 - RNA, 23 nt, Human
uggagguggaaaagcaacauuca

SEQ ID NO: 1304986 - RNA, 22 nt, Human
uggagucugccacccaggaucc

SEQ ID NO: 1304987 - RNA, 18 nt, Human
uggagucugccacccagg

SEQ ID NO: 1304988 - RNA, 16 nt, Human
uggagguuaaggcaua

SEQ ID NO: 1304989 - RNA, 17 nt, Human
uggagucugccacccag

SEQ ID NO: 1304990 - RNA, 15 nt, Human
aggcccggccucuca

SEQ ID NO: 1304991 - RNA, 15 nt, Human
aggcccgagcagcug

SEQ ID NO: 1304992 - RNA, 18 nt, Human
aggcccgagcagcugagc

SEQ ID NO: 1304993 - RNA, 19 nt, Human
aggcccgagcagcugagca

SEQ ID NO: 1304994 - RNA, 21 nt, Human
aggcccgagcagcugagcagg

SEQ ID NO: 1304995 - RNA, 22 nt, Human
aggcccgagcagcugagcaggg

SEQ ID NO: 1304996 - RNA, 13 nt, Human
aggcccggccucu

SEQ ID NO: 1304997 - RNA, 14 nt, Human
aggcccggccucuc

SEQ ID NO: 1304998 - RNA, 19 nt, Human
aggcccccgccuuggccug

SEQ ID NO: 1304999 - RNA, 23 nt, Human
aggcccccagcccagggcuccug

SEQ ID NO: 1305000 - RNA, 19 nt, Human
aggcccccaccuggcucac

SEQ ID NO: 1305001 - RNA, 18 nt, Human
aggcccccaucauccucu

SEQ ID NO: 1305002 - RNA, 19 nt, Human
aggcccccaucauccucug

SEQ ID NO: 1305003 - RNA, 20 nt, Human
aggcccccaucauccucugg

SEQ ID NO: 1305004 - RNA, 21 nt, Human
aggcccccaucauccucuggc

SEQ ID NO: 1305005 - RNA, 18 nt, Human
aggcccccgccuuggccu

SEQ ID NO: 1305006 - RNA, 16 nt, Human
aggcccacugugccuc

SEQ ID NO: 1305007 - RNA, 15 nt, Human
aggcccaaggcuccc

SEQ ID NO: 1305008 - RNA, 17 nt, Human
aggcccaaggcucccgg

SEQ ID NO: 1305009 - RNA, 19 nt, Human
aggcccacauuggaagagc

SEQ ID NO: 1305010 - RNA, 17 nt, Human
aggcccacauuggaaga

SEQ ID NO: 1305011 - RNA, 16 nt, Human
aggccccaugaccucc

SEQ ID NO: 1305012 - RNA, 17 nt, Human
aggccccaugaccucca

SEQ ID NO: 1305013 - RNA, 20 nt, Human
aggccccaugaccuccagcu

SEQ ID NO: 1305014 - RNA, 17 nt, Human
aggcccccaccuggcuc

SEQ ID NO: 1305015 - RNA, 18 nt, Human
aggcccccaccuggcuca

SEQ ID NO: 1305016 - RNA, 13 nt, Human
aggcccccacuug

SEQ ID NO: 1305017 - RNA, 17 nt, Human
aggcccccacuugccuc

SEQ ID NO: 1305018 - RNA, 18 nt, Human
aggcccccacuugccucu

SEQ ID NO: 1305019 - RNA, 20 nt, Human
aggcccccacuugccucuuc

SEQ ID NO: 1305020 - RNA, 14 nt, Human
aggcccccagccca

SEQ ID NO: 1305021 - RNA, 17 nt, Human
aggcccccagcccaggg

SEQ ID NO: 1305022 - RNA, 18 nt, Human
aggcccccagcccagggc

SEQ ID NO: 1305023 - RNA, 19 nt, Human
aggcccccagcccagggcu

SEQ ID NO: 1305024 - RNA, 22 nt, Human
aggcccccagcccagggcuccu

SEQ ID NO: 1305025 - RNA, 14 nt, Human
uggcaccagacacc

SEQ ID NO: 1305026 - RNA, 16 nt, Human
uggcaccagacaccca

SEQ ID NO: 1305027 - RNA, 17 nt, Human
uggcaccagacacccag

SEQ ID NO: 1305028 - RNA, 14 nt, Human
aggccaccucccca

SEQ ID NO: 1305029 - RNA, 15 nt, Human
aggccaccuccccag

SEQ ID NO: 1305030 - RNA, 14 nt, Human
aggccagccuggcc

SEQ ID NO: 1305031 - RNA, 15 nt, Human
aggccagccuggccu

SEQ ID NO: 1305032 - RNA, 16 nt, Human
aggccagccuggccuc

SEQ ID NO: 1305033 - RNA, 17 nt, Human
aggccagccuggccucc

SEQ ID NO: 1305034 - RNA, 18 nt, Human
aggccagccuggccuccu

SEQ ID NO: 1305035 - RNA, 19 nt, Human
aggccagccuggccuccug

SEQ ID NO: 1305036 - RNA, 20 nt, Human
aggccagccuggccuccugc

SEQ ID NO: 1305037 - RNA, 21 nt, Human
aggccagccuggccuccugcc

SEQ ID NO: 1305038 - RNA, 22 nt, Human
aggccagccuggccuccugccu

SEQ ID NO: 1305039 - RNA, 23 nt, Human
aggccagccuggccuccugccuc

SEQ ID NO: 1305040 - RNA, 17 nt, Human
aggccaccuccccagca

SEQ ID NO: 1305041 - RNA, 16 nt, Human
ugcuuuuuauggccug

SEQ ID NO: 1305042 - RNA, 15 nt, Human
ugcuuuuuauuucug

SEQ ID NO: 1305043 - RNA, 18 nt, Human
ugcuuuuuauuucugcau

SEQ ID NO: 1305044 - RNA, 19 nt, Human
ugcuuuuuauuucugcaua

SEQ ID NO: 1305045 - RNA, 15 nt, Human
ugcuuuuucaccaga

SEQ ID NO: 1305046 - RNA, 14 nt, Human
ugcuuuuuccaacu

SEQ ID NO: 1305047 - RNA, 21 nt, Human
ugcuuuuuccaacucagaaau

SEQ ID NO: 1305048 - RNA, 16 nt, Human
ugcuuuuuguguuuuu

SEQ ID NO: 1305049 - RNA, 12 nt, Human
uggaaauaaagu

SEQ ID NO: 1305050 - RNA, 14 nt, Human
uggaaauaaaguca

SEQ ID NO: 1305051 - RNA, 16 nt, Human
uggaaauaaagucaga

SEQ ID NO: 1305052 - RNA, 13 nt, Human
uggaaauaaaugu

SEQ ID NO: 1305053 - RNA, 15 nt, Human
uggaaauaaauguau

SEQ ID NO: 1305054 - RNA, 23 nt, Human
uggaaauaaauguaucauagaaa

SEQ ID NO: 1305055 - RNA, 16 nt, Human
uggaaauuggaagagc

SEQ ID NO: 1305056 - RNA, 17 nt, Human
uggaaauuggaagagca

SEQ ID NO: 1305057 - RNA, 18 nt, Human
uggaaauaaaucuuccua

SEQ ID NO: 1305058 - RNA, 12 nt, Human
uggaaauuuaaa

SEQ ID NO: 1305059 - RNA, 13 nt, Human
uggaaauuuaaag

SEQ ID NO: 1305060 - RNA, 14 nt, Human
uggaaauuuaaagc

SEQ ID NO: 1305061 - RNA, 16 nt, Human
uggaaauuuaaagcag

SEQ ID NO: 1305062 - RNA, 21 nt, Human
uggaaauuuaaagcagguucu

SEQ ID NO: 1305063 - RNA, 22 nt, Human
uggaaauuuaaagcagguucuu

SEQ ID NO: 1305064 - RNA, 15 nt, Human
uggaaauuuagcauu

SEQ ID NO: 1305065 - RNA, 18 nt, Human
uggaaauuuagcauugua

SEQ ID NO: 1305066 - RNA, 17 nt, Human
uggaaauuuagcauugu

SEQ ID NO: 1305067 - RNA, 22 nt, Human
uggaagagcagcaccuccucag

SEQ ID NO: 1305068 - RNA, 23 nt, Human
uggaagacgcaagggccugaugg

SEQ ID NO: 1305069 - RNA, 17 nt, Human
uggaagacgcaagggcc

SEQ ID NO: 1305070 - RNA, 16 nt, Human
uggaagagcagcaccu

SEQ ID NO: 1305071 - RNA, 20 nt, Human
uggaagagcagcaccuccuc

SEQ ID NO: 1305072 - RNA, 14 nt, Human
ugcuuugggcugcc

SEQ ID NO: 1305073 - RNA, 15 nt, Human
ugcuuugggcugccc

SEQ ID NO: 1305074 - RNA, 21 nt, Human
ugcuuuggaccuaaauggccu

SEQ ID NO: 1305075 - RNA, 22 nt, Human
ugcuuuggaccuaaauggccuc

SEQ ID NO: 1305076 - RNA, 23 nt, Human
ugcuuuggaccuaaauggccuca

SEQ ID NO: 1305077 - RNA, 15 nt, Human
ugcuuugggaagccg

SEQ ID NO: 1305078 - RNA, 21 nt, Human
ugcuugagccaggaggccugc

SEQ ID NO: 1305079 - RNA, 12 nt, Human
ugcuugaggaaa

SEQ ID NO: 1305080 - RNA, 16 nt, Human
ugcuugaggaaaacaa

SEQ ID NO: 1305081 - RNA, 13 nt, Human
ugcuugaggaaaa

SEQ ID NO: 1305082 - RNA, 18 nt, Human
ugcuuuggaccuaaaugg

SEQ ID NO: 1305083 - RNA, 16 nt, Human
ugcuuugggcugcccu

SEQ ID NO: 1305084 - RNA, 17 nt, Human
ugcuuugggcugcccug

SEQ ID NO: 1305085 - RNA, 18 nt, Human
aggaggacccaggacagg

SEQ ID NO: 1305086 - RNA, 16 nt, Human
aggaggacccagggcu

SEQ ID NO: 1305087 - RNA, 17 nt, Human
aggaggacccagggcuc

SEQ ID NO: 1305088 - RNA, 17 nt, Human
aggaggacccaggacag

SEQ ID NO: 1305089 - RNA, 16 nt, Human
aggaggacccaggaca

SEQ ID NO: 1305090 - RNA, 15 nt, Human
aggaggacccaggac

SEQ ID NO: 1305091 - RNA, 14 nt, Human
aggaggacccagga

SEQ ID NO: 1305092 - RNA, 13 nt, Human
aggaggacccagg

SEQ ID NO: 1305093 - RNA, 12 nt, Human
aggaggacccag

SEQ ID NO: 1305094 - RNA, 21 nt, Human
aggaggaauaagcucccaggg

SEQ ID NO: 1305095 - RNA, 14 nt, Human
aggaggaauacuga

SEQ ID NO: 1305096 - RNA, 18 nt, Human
aggaggaauacugaacau

SEQ ID NO: 1305097 - RNA, 15 nt, Human
aggaggaauacugaa

SEQ ID NO: 1305098 - RNA, 15 nt, Human
uggaagccagcuuuc

SEQ ID NO: 1305099 - RNA, 16 nt, Human
uggaagccagcuuucc

SEQ ID NO: 1305100 - RNA, 18 nt, Human
uggaagccagcuuucccu

SEQ ID NO: 1305101 - RNA, 16 nt, Human
uggaagccccugggcc

SEQ ID NO: 1305102 - RNA, 20 nt, Human
uggaagccccugggcccagu

SEQ ID NO: 1305103 - RNA, 18 nt, Human
aggaggacccagggcucu

SEQ ID NO: 1305104 - RNA, 13 nt, Human
aggaggagccugu

SEQ ID NO: 1305105 - RNA, 14 nt, Human
aggaggagccuguc

SEQ ID NO: 1305106 - RNA, 20 nt, Human
aggaggagccuguccugccu

SEQ ID NO: 1305107 - RNA, 21 nt, Human
aggaggagccuguccugccug

SEQ ID NO: 1305108 - RNA, 13 nt, Human
aggaggcuccaga

SEQ ID NO: 1305109 - RNA, 16 nt, Human
aggaggcuccagaggg

SEQ ID NO: 1305110 - RNA, 17 nt, Human
aggaggcuccagagggc

SEQ ID NO: 1305111 - RNA, 18 nt, Human
aggaggcuccagagggca

SEQ ID NO: 1305112 - RNA, 19 nt, Human
aggaggcuccagagggcac

SEQ ID NO: 1305113 - RNA, 15 nt, Human
aggauagaugcuggc

SEQ ID NO: 1305114 - RNA, 18 nt, Human
aggauagaugcuggccca

SEQ ID NO: 1305115 - RNA, 19 nt, Human
aggauagaugcuggcccag

SEQ ID NO: 1305116 - RNA, 20 nt, Human
aggauagaugcuggcccagg

SEQ ID NO: 1305117 - RNA, 21 nt, Human
aggauagaugcuggcccaggg

SEQ ID NO: 1305118 - RNA, 22 nt, Human
aggauagaugcuggcccagggc

SEQ ID NO: 1305119 - RNA, 11 nt, Human
aggauccaggc

SEQ ID NO: 1305120 - RNA, 21 nt, Human
aggaucauuuguuggaaugaa

SEQ ID NO: 1305121 - RNA, 18 nt, Human
aggaugaagggcccgaga

SEQ ID NO: 1305122 - RNA, 17 nt, Human
aggaucaguuaacuauu

SEQ ID NO: 1305123 - RNA, 20 nt, Human
aggaucauuuguuggaauga

SEQ ID NO: 1305124 - RNA, 23 nt, Human
aggaucaguuaacuauugcauuu

SEQ ID NO: 1305125 - RNA, 15 nt, Human
aggaucaguuaacua

SEQ ID NO: 1305126 - RNA, 17 nt, Human
aggauaucggcauuugu

SEQ ID NO: 1305127 - RNA, 21 nt, Human
aggauaucggcauuuguuucu

SEQ ID NO: 1305128 - RNA, 21 nt, Human
aggauugaaaauguccaggaa

SEQ ID NO: 1305129 - RNA, 24 nt, Human
aggauugaaaauguccaggaaagu

SEQ ID NO: 1305130 - RNA, 15 nt, Human
aggauugcgagagau

SEQ ID NO: 1305131 - RNA, 16 nt, Human
aggauugcgagagaug

SEQ ID NO: 1305132 - RNA, 17 nt, Human
aggauugcgagagaugu

SEQ ID NO: 1305133 - RNA, 18 nt, Human
aggauugcgagagaugug

SEQ ID NO: 1305134 - RNA, 19 nt, Human
aggauugcgagagaugugu

SEQ ID NO: 1305135 - RNA, 20 nt, Human
aggauugcgagagaugugug

SEQ ID NO: 1305136 - RNA, 13 nt, Human
aggacaagcaugg

SEQ ID NO: 1305137 - RNA, 11 nt, Human
aggacacaggc

SEQ ID NO: 1305138 - RNA, 12 nt, Human
aggacacaggcc

SEQ ID NO: 1305139 - RNA, 13 nt, Human
aggacacaggccu

SEQ ID NO: 1305140 - RNA, 14 nt, Human
aggacacaggccug

SEQ ID NO: 1305141 - RNA, 15 nt, Human
aggacacaggccugu

SEQ ID NO: 1305142 - RNA, 16 nt, Human
aggacacaggccugug

SEQ ID NO: 1305143 - RNA, 15 nt, Human
aggacacaguuccug

SEQ ID NO: 1305144 - RNA, 16 nt, Human
aggacacaguuccugg

SEQ ID NO: 1305145 - RNA, 21 nt, Human
aggacacaguuccugggaaca

SEQ ID NO: 1305146 - RNA, 18 nt, Human
aggacacaguuccuggga

SEQ ID NO: 1305147 - RNA, 18 nt, Human
aggaccuucgggcugugc

SEQ ID NO: 1305148 - RNA, 19 nt, Human
aggaccuucgggcugugcc

SEQ ID NO: 1305149 - RNA, 20 nt, Human
aggacgcucucuggccuucg

SEQ ID NO: 1305150 - RNA, 19 nt, Human
aggacgcucucuggccuuc

SEQ ID NO: 1305151 - RNA, 17 nt, Human
aggacgcucucuggccu

SEQ ID NO: 1305152 - RNA, 16 nt, Human
aggacgcucucuggcc

SEQ ID NO: 1305153 - RNA, 14 nt, Human
aggacgcucucugg

SEQ ID NO: 1305154 - RNA, 13 nt, Human
aggacgcucucug

SEQ ID NO: 1305155 - RNA, 20 nt, Human
aggaccuucgggcugugccc

SEQ ID NO: 1305156 - RNA, 21 nt, Human
aggaccuuuccaccacagcca

SEQ ID NO: 1305157 - RNA, 22 nt, Human
aggaccuuuccaccacagccag

SEQ ID NO: 1305158 - RNA, 14 nt, Human
aggacgcacugagc

SEQ ID NO: 1305159 - RNA, 15 nt, Human
aggacuaggguccug

SEQ ID NO: 1305160 - RNA, 17 nt, Human
aggacuaauagaaaagu

SEQ ID NO: 1305161 - RNA, 16 nt, Human
aggacuaggguccugg

SEQ ID NO: 1305162 - RNA, 18 nt, Human
aggacuaggguccugggg

SEQ ID NO: 1305163 - RNA, 19 nt, Human
aggacuaggguccugggga

SEQ ID NO: 1305164 - RNA, 20 nt, Human
aggacuauauuugggccugc

SEQ ID NO: 1305165 - RNA, 17 nt, Human
aggacucaccacugccc

SEQ ID NO: 1305166 - RNA, 14 nt, Human
aggacguacguaau

SEQ ID NO: 1305167 - RNA, 17 nt, Human
aggacuaacacucagaa

SEQ ID NO: 1305168 - RNA, 18 nt, Human
aggacuaacacucagaag

SEQ ID NO: 1305169 - RNA, 20 nt, Human
aggacuaacacucagaagcc

SEQ ID NO: 1305170 - RNA, 21 nt, Human
aggacuaacacucagaagccu

SEQ ID NO: 1305171 - RNA, 22 nt, Human
aggacuaacacucagaagccug

SEQ ID NO: 1305172 - RNA, 23 nt, Human
aggacuaacacucagaagccugg

SEQ ID NO: 1305173 - RNA, 14 nt, Human
aggacuaaccaugu

SEQ ID NO: 1305174 - RNA, 13 nt, Human
aggacuaauagaa

SEQ ID NO: 1305175 - RNA, 15 nt, Human
aggacuccaggccca

SEQ ID NO: 1305176 - RNA, 16 nt, Human
aggacuccaggcccaa

SEQ ID NO: 1305177 - RNA, 23 nt, Human
aggacuccaggcccaaggcuccc

SEQ ID NO: 1305178 - RNA, 20 nt, Human
aggacuccaggcccaaggcu

SEQ ID NO: 1305179 - RNA, 19 nt, Human
aggacuccuccuuuuucca

SEQ ID NO: 1305180 - RNA, 17 nt, Human
aggacuccuuaaauuug

SEQ ID NO: 1305181 - RNA, 21 nt, Human
aggacuccuccuuuuuccaug

SEQ ID NO: 1305182 - RNA, 14 nt, Human
aggacuccugaaaa

SEQ ID NO: 1305183 - RNA, 17 nt, Human
aggacuccugaaaaaaa

SEQ ID NO: 1305184 - RNA, 12 nt, Human
aggacucucagg

SEQ ID NO: 1305185 - RNA, 13 nt, Human
aggacucugcagc

SEQ ID NO: 1305186 - RNA, 14 nt, Human
aggacucugcagcc

SEQ ID NO: 1305187 - RNA, 15 nt, Human
aggacucugcagccu

SEQ ID NO: 1305188 - RNA, 16 nt, Human
aggacucugcagccuc

SEQ ID NO: 1305189 - RNA, 19 nt, Human
aggacucugcagccucaga

SEQ ID NO: 1305190 - RNA, 17 nt, Human
aggacucugcagccuca

SEQ ID NO: 1305191 - RNA, 23 nt, Human
aggagcccuucuauacccaccca

SEQ ID NO: 1305192 - RNA, 19 nt, Human
aggagcccccacccuguuc

SEQ ID NO: 1305193 - RNA, 22 nt, Human
aggagcccccacccuguuccug

SEQ ID NO: 1305194 - RNA, 16 nt, Human
aggagcacggcucugu

SEQ ID NO: 1305195 - RNA, 20 nt, Human
aggagcagcaggagggggga

SEQ ID NO: 1305196 - RNA, 15 nt, Human
aggagcacggcucug

SEQ ID NO: 1305197 - RNA, 23 nt, Human
aggagcacggcucuguccccagc

SEQ ID NO: 1305198 - RNA, 10 nt, Human
aggagcccag

SEQ ID NO: 1305199 - RNA, 13 nt, Human
aggagcccaggcc

SEQ ID NO: 1305200 - RNA, 14 nt, Human
aggagcccaggcca

SEQ ID NO: 1305201 - RNA, 15 nt, Human
aggagcccaggccag

SEQ ID NO: 1305202 - RNA, 16 nt, Human
aggagcccaggccagg

SEQ ID NO: 1305203 - RNA, 17 nt, Human
aggagcccaggccagga

SEQ ID NO: 1305204 - RNA, 18 nt, Human
aggagcccaggccaggac

SEQ ID NO: 1305205 - RNA, 19 nt, Human
aggagcccaggccaggacu

SEQ ID NO: 1305206 - RNA, 20 nt, Human
aggagcccaggccaggacuc

SEQ ID NO: 1305207 - RNA, 22 nt, Human
aggagcccaggccaggacucug

SEQ ID NO: 1305208 - RNA, 14 nt, Human
aggagccccagcua

SEQ ID NO: 1305209 - RNA, 15 nt, Human
aggagccccauuccu

SEQ ID NO: 1305210 - RNA, 16 nt, Human
aggagccccauuccug

SEQ ID NO: 1305211 - RNA, 18 nt, Human
aggagccccauuccuggg

SEQ ID NO: 1305212 - RNA, 19 nt, Human
aggagccccauuccuggga

SEQ ID NO: 1305213 - RNA, 21 nt, Human
aggagccccauuccugggaaa

SEQ ID NO: 1305214 - RNA, 12 nt, Human
aggagcccccac

SEQ ID NO: 1305215 - RNA, 17 nt, Human
aggagaugcuccuuggg

SEQ ID NO: 1305216 - RNA, 18 nt, Human
aggagaugcuccuugggc

SEQ ID NO: 1305217 - RNA, 22 nt, Human
aggagaugcuccuugggcccuu

SEQ ID NO: 1305218 - RNA, 13 nt, Human
aggacuugaaaga

SEQ ID NO: 1305219 - RNA, 16 nt, Human
aggacuugaaagaaau

SEQ ID NO: 1305220 - RNA, 13 nt, Human
aggacuugcccuc

SEQ ID NO: 1305221 - RNA, 23 nt, Human
aggacuugcccucgugguggaaa

SEQ ID NO: 1305222 - RNA, 22 nt, Human
aggagauccagggcaaggccau

SEQ ID NO: 1305223 - RNA, 16 nt, Human
aggagaugcuccuugg

SEQ ID NO: 1305224 - RNA, 22 nt, Human
aggacuuccuguccagcuccaa

SEQ ID NO: 1305225 - RNA, 23 nt, Human
aggacugggagcccccagccugu

SEQ ID NO: 1305226 - RNA, 20 nt, Human
aggacugcugguuuguaguu

SEQ ID NO: 1305227 - RNA, 16 nt, Human
aggacugggagccccc

SEQ ID NO: 1305228 - RNA, 18 nt, Human
aggacugggagcccccag

SEQ ID NO: 1305229 - RNA, 19 nt, Human
aggacugggagcccccagc

SEQ ID NO: 1305230 - RNA, 20 nt, Human
aggacugggagcccccagcc

SEQ ID NO: 1305231 - RNA, 21 nt, Human
aggacugggagcccccagccu

SEQ ID NO: 1305232 - RNA, 22 nt, Human
aggacugggagcccccagccug

SEQ ID NO: 1305233 - RNA, 12 nt, Human
aggacucugccu

SEQ ID NO: 1305234 - RNA, 13 nt, Human
aggacucugccuc

SEQ ID NO: 1305235 - RNA, 14 nt, Human
aggacucugccucc

SEQ ID NO: 1305236 - RNA, 16 nt, Human
aggacucugccuccuc

SEQ ID NO: 1305237 - RNA, 17 nt, Human
aggacucugccuccucu

SEQ ID NO: 1305238 - RNA, 18 nt, Human
aggacucugccuccucuu

SEQ ID NO: 1305239 - RNA, 19 nt, Human
aggacucugccuccucuuc

SEQ ID NO: 1305240 - RNA, 16 nt, Human
aggacugaugucuccu

SEQ ID NO: 1305241 - RNA, 17 nt, Human
aggacugaugucuccua

SEQ ID NO: 1305242 - RNA, 20 nt, Human
aggacugaugucuccuaagc

SEQ ID NO: 1305243 - RNA, 18 nt, Human
aggacugauuucagagug

SEQ ID NO: 1305244 - RNA, 19 nt, Human
aggagaaacuggaacucuc

SEQ ID NO: 1305245 - RNA, 18 nt, Human
aggagaaacuggaacucu

SEQ ID NO: 1305246 - RNA, 15 nt, Human
ugauuaaguaaugau

SEQ ID NO: 1305247 - RNA, 13 nt, Human
ugauuaaaugaca

SEQ ID NO: 1305248 - RNA, 14 nt, Human
ugauuaaaugacac

SEQ ID NO: 1305249 - RNA, 16 nt, Human
ugauuaaguaaugaua

SEQ ID NO: 1305250 - RNA, 18 nt, Human
ugauuaaauaagauucua

SEQ ID NO: 1305251 - RNA, 19 nt, Human
ugauuaaauaagauucuaa

SEQ ID NO: 1305252 - RNA, 20 nt, Human
ugauuaaauaagauucuaac

SEQ ID NO: 1305253 - RNA, 22 nt, Human
ugauuaaauaagauucuaacgg

SEQ ID NO: 1305254 - RNA, 17 nt, Human
ugauuaaauaagauucu

SEQ ID NO: 1305255 - RNA, 19 nt, Human
ugauggguuaguggaugga

SEQ ID NO: 1305256 - RNA, 23 nt, Human
ugauggguuaguggauggaaggg

SEQ ID NO: 1305257 - RNA, 21 nt, Human
ugaucuacuucuguaauugug

SEQ ID NO: 1305258 - RNA, 18 nt, Human
ugauggcaacagaucugg

SEQ ID NO: 1305259 - RNA, 19 nt, Human
ugauggcaacagaucugga

SEQ ID NO: 1305260 - RNA, 20 nt, Human
ugauggcagccauagugcau

SEQ ID NO: 1305261 - RNA, 23 nt, Human
ugauggcaacagaucuggaaccu

SEQ ID NO: 1305262 - RNA, 15 nt, Human
ugauggcaauuuugu

SEQ ID NO: 1305263 - RNA, 17 nt, Human
ugauggcaauuuuguaa

SEQ ID NO: 1305264 - RNA, 19 nt, Human
ugauggcuaacuuacaaag

SEQ ID NO: 1305265 - RNA, 17 nt, Human
ugauggcuuaugauagc

SEQ ID NO: 1305266 - RNA, 18 nt, Human
ugaugaaauguaaauacu

SEQ ID NO: 1305267 - RNA, 18 nt, Human
ugaucuacuucuguaauu

SEQ ID NO: 1305268 - RNA, 20 nt, Human
ugaucuacuucuguaauugu

SEQ ID NO: 1305269 - RNA, 17 nt, Human
ugaucuagagccaguua

SEQ ID NO: 1305270 - RNA, 17 nt, Human
ugauccauguaacugcc

SEQ ID NO: 1305271 - RNA, 18 nt, Human
ugauccauguaacugccu

SEQ ID NO: 1305272 - RNA, 19 nt, Human
ugauccauguaacugccua

SEQ ID NO: 1305273 - RNA, 20 nt, Human
ugauccauguaacugccuag

SEQ ID NO: 1305274 - RNA, 14 nt, Human
ugauccauuucuaa

SEQ ID NO: 1305275 - RNA, 15 nt, Human
ugauccauuucuaau

SEQ ID NO: 1305276 - RNA, 16 nt, Human
ugauccauuucuaauu

SEQ ID NO: 1305277 - RNA, 17 nt, Human
ugauccauuucuaauua

SEQ ID NO: 1305278 - RNA, 18 nt, Human
ugauccauuucuaauuau

SEQ ID NO: 1305279 - RNA, 21 nt, Human
ugauccauuucuaauuaugua

SEQ ID NO: 1305280 - RNA, 13 nt, Human
agccaccccugag

SEQ ID NO: 1305281 - RNA, 23 nt, Human
ugauccagaaagaaaacuuguau

SEQ ID NO: 1305282 - RNA, 13 nt, Human
ugauccagaaaga

SEQ ID NO: 1305283 - RNA, 18 nt, Human
ugauccacucgccuucau

SEQ ID NO: 1305284 - RNA, 14 nt, Human
ugauccacucgccu

SEQ ID NO: 1305285 - RNA, 22 nt, Human
ugauccuaaugaaugcauaaaa

SEQ ID NO: 1305286 - RNA, 15 nt, Human
ugaucuaauauccca

SEQ ID NO: 1305287 - RNA, 20 nt, Human
ugaucccuguguugucucua

SEQ ID NO: 1305288 - RNA, 19 nt, Human
ugaucccagagagcccgag

SEQ ID NO: 1305289 - RNA, 13 nt, Human
ugauccccacgcc

SEQ ID NO: 1305290 - RNA, 18 nt, Human
ugauccccacgccacagc

SEQ ID NO: 1305291 - RNA, 20 nt, Human
ugauccccacgccacagccc

SEQ ID NO: 1305292 - RNA, 19 nt, Human
ugauccccacgccacagcc

SEQ ID NO: 1305293 - RNA, 19 nt, Human
ugaucccuguguugucucu

SEQ ID NO: 1305294 - RNA, 21 nt, Human
agccaaacauauauauacuau

SEQ ID NO: 1305295 - RNA, 15 nt, Human
agccaaaccucacca

SEQ ID NO: 1305296 - RNA, 17 nt, Human
agccaaaccucaccaac

SEQ ID NO: 1305297 - RNA, 23 nt, Human
agccaaucccucaccuucugagu

SEQ ID NO: 1305298 - RNA, 16 nt, Human
agccaauucagacagg

SEQ ID NO: 1305299 - RNA, 17 nt, Human
agccaauucagacaggc

SEQ ID NO: 1305300 - RNA, 18 nt, Human
agccaauucagacaggca

SEQ ID NO: 1305301 - RNA, 13 nt, Human
agccacaccagga

SEQ ID NO: 1305302 - RNA, 14 nt, Human
agccacaccaggau

SEQ ID NO: 1305303 - RNA, 24 nt, Human
agccacaccaggauagagacugga

SEQ ID NO: 1305304 - RNA, 17 nt, Human
agccacaccaggauaga

SEQ ID NO: 1305305 - RNA, 17 nt, Human
agccacacuucucagga

SEQ ID NO: 1305306 - RNA, 18 nt, Human
agccacacuucucaggac

SEQ ID NO: 1305307 - RNA, 19 nt, Human
agccacacuucucaggaca

SEQ ID NO: 1305308 - RNA, 23 nt, Human
agccacacuucucaggacacagg

SEQ ID NO: 1305309 - RNA, 20 nt, Human
agccacacuucucaggacac

SEQ ID NO: 1305310 - RNA, 13 nt, Human
agccaccacgccc

SEQ ID NO: 1305311 - RNA, 12 nt, Human
agccaccaguuc

SEQ ID NO: 1305312 - RNA, 14 nt, Human
agccaccaguucuc

SEQ ID NO: 1305313 - RNA, 20 nt, Human
agccacaguuccccuaugug

SEQ ID NO: 1305314 - RNA, 15 nt, Human
agcaucccucaccca

SEQ ID NO: 1305315 - RNA, 17 nt, Human
agcauccccuugaacuc

SEQ ID NO: 1305316 - RNA, 20 nt, Human
agcauccccuugaacucuuc

SEQ ID NO: 1305317 - RNA, 15 nt, Human
agcaucaugccucug

SEQ ID NO: 1305318 - RNA, 16 nt, Human
agcaucaugccucuga

SEQ ID NO: 1305319 - RNA, 18 nt, Human
agcaucaugccucugagg

SEQ ID NO: 1305320 - RNA, 19 nt, Human
agcaucaugccucugaggc

SEQ ID NO: 1305321 - RNA, 21 nt, Human
agcaucaugccucugaggcca

SEQ ID NO: 1305322 - RNA, 22 nt, Human
agcaucaugccucugaggccag

SEQ ID NO: 1305323 - RNA, 23 nt, Human
agcaucaugccucugaggccagc

SEQ ID NO: 1305324 - RNA, 18 nt, Human
agcaucauuauuuaugua

SEQ ID NO: 1305325 - RNA, 19 nt, Human
agcaucauuauuuauguau

SEQ ID NO: 1305326 - RNA, 21 nt, Human
agcaucauuauuuauguauug

SEQ ID NO: 1305327 - RNA, 22 nt, Human
agcaucauuauuuauguauugu

SEQ ID NO: 1305328 - RNA, 14 nt, Human
agcauccuggaaua

SEQ ID NO: 1305329 - RNA, 15 nt, Human
agcauccuggaauau

SEQ ID NO: 1305330 - RNA, 13 nt, Human
agcauccuggaau

SEQ ID NO: 1305331 - RNA, 16 nt, Human
agcauccgcaggugcu

SEQ ID NO: 1305332 - RNA, 18 nt, Human
agcauccccuugaacucu

SEQ ID NO: 1305333 - RNA, 21 nt, Human
agcauccgcaggugcuggucc

SEQ ID NO: 1305334 - RNA, 21 nt, Human
agcaucaggccuagaggccug

SEQ ID NO: 1305335 - RNA, 22 nt, Human
agcaucaggguuaagaagacuu

SEQ ID NO: 1305336 - RNA, 16 nt, Human
agcaucaggccuagag

SEQ ID NO: 1305337 - RNA, 20 nt, Human
agcaucaucugggaacuugu

SEQ ID NO: 1305338 - RNA, 13 nt, Human
agcaucaugccuc

SEQ ID NO: 1305339 - RNA, 19 nt, Human
ugaucaccgacugaaaaua

SEQ ID NO: 1305340 - RNA, 17 nt, Human
ugaucaccgacugaaaa

SEQ ID NO: 1305341 - RNA, 21 nt, Human
ugaucaauuauaguuucugag

SEQ ID NO: 1305342 - RNA, 18 nt, Human
ugaucaauuauaguuucu

SEQ ID NO: 1305343 - RNA, 20 nt, Human
ugaucaauuauaguuucuga

SEQ ID NO: 1305344 - RNA, 22 nt, Human
ugaucaauuauaguuucugagg

SEQ ID NO: 1305345 - RNA, 17 nt, Human
ugauaccccccucuguc

SEQ ID NO: 1305346 - RNA, 18 nt, Human
ugauaccccccucugucu

SEQ ID NO: 1305347 - RNA, 19 nt, Human
ugauaccccccucugucuu

SEQ ID NO: 1305348 - RNA, 15 nt, Human
ugauacgaugcuuca

SEQ ID NO: 1305349 - RNA, 16 nt, Human
ugauacauccaaagca

SEQ ID NO: 1305350 - RNA, 22 nt, Human
ugauacauccaaagcagacagc

SEQ ID NO: 1305351 - RNA, 13 nt, Human
ugauacauuccca

SEQ ID NO: 1305352 - RNA, 14 nt, Human
ugauacauuuuugu

SEQ ID NO: 1305353 - RNA, 14 nt, Human
ugauaccagcugga

SEQ ID NO: 1305354 - RNA, 15 nt, Human
ugauaccccccucug

SEQ ID NO: 1305355 - RNA, 14 nt, Human
ugaucaccugcccu

SEQ ID NO: 1305356 - RNA, 17 nt, Human
agcauuuguguugaaga

SEQ ID NO: 1305357 - RNA, 18 nt, Human
agcauuuguguugaagag

SEQ ID NO: 1305358 - RNA, 14 nt, Human
agcauuuguuucua

SEQ ID NO: 1305359 - RNA, 19 nt, Human
agcauuuguuucuacuuug

SEQ ID NO: 1305360 - RNA, 17 nt, Human
agcauuuguuucuacuu

SEQ ID NO: 1305361 - RNA, 15 nt, Human
agcauuuagaaaacu

SEQ ID NO: 1305362 - RNA, 21 nt, Human
agcauuugacccuugcuguga

SEQ ID NO: 1305363 - RNA, 20 nt, Human
agcauuuucugcaucuccac

SEQ ID NO: 1305364 - RNA, 13 nt, Human
agcauuuuguaau

SEQ ID NO: 1305365 - RNA, 19 nt, Human
agcauuuucugcaucucca

SEQ ID NO: 1305366 - RNA, 18 nt, Human
agcauuuucugcaucucc

SEQ ID NO: 1305367 - RNA, 15 nt, Human
agcauuuucugcauc

SEQ ID NO: 1305368 - RNA, 18 nt, Human
agccaaacauccuacaag

SEQ ID NO: 1305369 - RNA, 12 nt, Human
agccaaaccagg

SEQ ID NO: 1305370 - RNA, 17 nt, Human
agcauuuuguaaguuga

SEQ ID NO: 1305371 - RNA, 14 nt, Human
agccaaaaauagcu

SEQ ID NO: 1305372 - RNA, 15 nt, Human
agccaaaaauagcua

SEQ ID NO: 1305373 - RNA, 18 nt, Human
agccaaaaauagcuaaau

SEQ ID NO: 1305374 - RNA, 22 nt, Human
agccaaaaauagcuaaauaccu

SEQ ID NO: 1305375 - RNA, 17 nt, Human
agccaaaauguaggcuu

SEQ ID NO: 1305376 - RNA, 22 nt, Human
agccaaaauguaggcuuaguuu

SEQ ID NO: 1305377 - RNA, 22 nt, Human
agcauuuagauguauagguuga

SEQ ID NO: 1305378 - RNA, 21 nt, Human
agcauuuaaccccccuguaca

SEQ ID NO: 1305379 - RNA, 22 nt, Human
agcauuuaaccccccuguacac

SEQ ID NO: 1305380 - RNA, 23 nt, Human
agcauuuaaccccccuguacaca

SEQ ID NO: 1305381 - RNA, 22 nt, Human
agcauucucacuccuaccuggu

SEQ ID NO: 1305382 - RNA, 14 nt, Human
agcauucucauugg

SEQ ID NO: 1305383 - RNA, 22 nt, Human
agcauucucauuggaaauuuag

SEQ ID NO: 1305384 - RNA, 12 nt, Human
agcauucugucu

SEQ ID NO: 1305385 - RNA, 18 nt, Human
agcauucucacuccuacc

SEQ ID NO: 1305386 - RNA, 20 nt, Human
agcauucucacuccuaccug

SEQ ID NO: 1305387 - RNA, 16 nt, Human
agcauuccagccccuc

SEQ ID NO: 1305388 - RNA, 19 nt, Human
agcauuccagccccucugg

SEQ ID NO: 1305389 - RNA, 20 nt, Human
agcauuccagccccucuggu

SEQ ID NO: 1305390 - RNA, 12 nt, Human
agcauucccagg

SEQ ID NO: 1305391 - RNA, 13 nt, Human
agcauucccaggu

SEQ ID NO: 1305392 - RNA, 19 nt, Human
agcauucccagguaggcca

SEQ ID NO: 1305393 - RNA, 21 nt, Human
agcauggucccacaucccugg

SEQ ID NO: 1305394 - RNA, 23 nt, Human
agcauggucccacaucccugggc

SEQ ID NO: 1305395 - RNA, 22 nt, Human
agcauggucccacaucccuggg

SEQ ID NO: 1305396 - RNA, 17 nt, Human
agcauuagauuucucau

SEQ ID NO: 1305397 - RNA, 18 nt, Human
agcauucacaacuuguuu

SEQ ID NO: 1305398 - RNA, 14 nt, Human
agcauucagaagaa

SEQ ID NO: 1305399 - RNA, 15 nt, Human
agcauucagaagaaa

SEQ ID NO: 1305400 - RNA, 17 nt, Human
agcauucagaagaaaaa

SEQ ID NO: 1305401 - RNA, 19 nt, Human
agcauucagaagaaaaaga

SEQ ID NO: 1305402 - RNA, 21 nt, Human
agcauucagaagaaaaagaag

SEQ ID NO: 1305403 - RNA, 15 nt, Human
agcauauagauuguc

SEQ ID NO: 1305404 - RNA, 15 nt, Human
ugaguaaugguguag

SEQ ID NO: 1305405 - RNA, 17 nt, Human
ugaguaaugguguagaa

SEQ ID NO: 1305406 - RNA, 18 nt, Human
ugaguaaugguguagaac

SEQ ID NO: 1305407 - RNA, 17 nt, Human
ugaguaauuuuggauuu

SEQ ID NO: 1305408 - RNA, 19 nt, Human
ugaguaaugguguagaaca

SEQ ID NO: 1305409 - RNA, 23 nt, Human
ugaguacagaguguggacucugg

SEQ ID NO: 1305410 - RNA, 20 nt, Human
agcauaggugauccauguaa

SEQ ID NO: 1305411 - RNA, 23 nt, Human
agcauaggugauccauguaacug

SEQ ID NO: 1305412 - RNA, 15 nt, Human
agcauaaaagaugaa

SEQ ID NO: 1305413 - RNA, 23 nt, Human
agcauaaaagaugaaagagcagu

SEQ ID NO: 1305414 - RNA, 17 nt, Human
agcauaaaagaugaaag

SEQ ID NO: 1305415 - RNA, 17 nt, Human
agcagucaggaaagaga

SEQ ID NO: 1305416 - RNA, 18 nt, Human
agcagucaggaaagagaa

SEQ ID NO: 1305417 - RNA, 12 nt, Human
agcaguauuuuu

SEQ ID NO: 1305418 - RNA, 18 nt, Human
agcagguugauaaaucau

SEQ ID NO: 1305419 - RNA, 14 nt, Human
agcagguuucaagg

SEQ ID NO: 1305420 - RNA, 23 nt, Human
agcagguucccaagcucagaggc

SEQ ID NO: 1305421 - RNA, 14 nt, Human
agcagguucuuguu

SEQ ID NO: 1305422 - RNA, 16 nt, Human
agcagguucccaagcu

SEQ ID NO: 1305423 - RNA, 17 nt, Human
agcagguucccaagcuc

SEQ ID NO: 1305424 - RNA, 18 nt, Human
agcagguucccaagcuca

SEQ ID NO: 1305425 - RNA, 19 nt, Human
agcagucaggaaagagaac

SEQ ID NO: 1305426 - RNA, 15 nt, Human
agcaguccccuuccc

SEQ ID NO: 1305427 - RNA, 16 nt, Human
agcaguccccuucccu

SEQ ID NO: 1305428 - RNA, 18 nt, Human
agcaguccccuucccucc

SEQ ID NO: 1305429 - RNA, 22 nt, Human
agcaguccccuucccuccaaga

SEQ ID NO: 1305430 - RNA, 12 nt, Human
agcaguccuugg

SEQ ID NO: 1305431 - RNA, 13 nt, Human
agcaguccuuggc

SEQ ID NO: 1305432 - RNA, 15 nt, Human
agcaguccuuggccu

SEQ ID NO: 1305433 - RNA, 16 nt, Human
agcaguccuuggccug

SEQ ID NO: 1305434 - RNA, 18 nt, Human
agcaguccuuggccugcu

SEQ ID NO: 1305435 - RNA, 14 nt, Human
agcagucgugccug

SEQ ID NO: 1305436 - RNA, 16 nt, Human
agcagucgugccugug

SEQ ID NO: 1305437 - RNA, 17 nt, Human
agcagucgugccugugu

SEQ ID NO: 1305438 - RNA, 22 nt, Human
agcaguccuuggccugcuaagg

SEQ ID NO: 1305439 - RNA, 19 nt, Human
agcagucgugccugugucc

SEQ ID NO: 1305440 - RNA, 14 nt, Human
agcaguuugcuuug

SEQ ID NO: 1305441 - RNA, 15 nt, Human
agcaguuugaaauug

SEQ ID NO: 1305442 - RNA, 20 nt, Human
ugagucacccuaccugugcc

SEQ ID NO: 1305443 - RNA, 22 nt, Human
ugagucacccuaccugugccug

SEQ ID NO: 1305444 - RNA, 19 nt, Human
ugaguaccccugcuuuggg

SEQ ID NO: 1305445 - RNA, 21 nt, Human
ugaguaccccugcuuugggcu

SEQ ID NO: 1305446 - RNA, 21 nt, Human
ugagucagagccaugucuucu

SEQ ID NO: 1305447 - RNA, 15 nt, Human
ugagugcaguccuga

SEQ ID NO: 1305448 - RNA, 13 nt, Human
ugaguggcagggg

SEQ ID NO: 1305449 - RNA, 21 nt, Human
ugaguggcaggggacaggagu

SEQ ID NO: 1305450 - RNA, 12 nt, Human
ugaguggcccuu

SEQ ID NO: 1305451 - RNA, 12 nt, Human
ugagugggaagc

SEQ ID NO: 1305452 - RNA, 13 nt, Human
ugagugggaagcc

SEQ ID NO: 1305453 - RNA, 14 nt, Human
ugagugggaagccc

SEQ ID NO: 1305454 - RNA, 15 nt, Human
ugauaauagauucuc

SEQ ID NO: 1305455 - RNA, 14 nt, Human
ugauaauagauucu

SEQ ID NO: 1305456 - RNA, 14 nt, Human
ugauaauuuuaaau

SEQ ID NO: 1305457 - RNA, 13 nt, Human
ugauaauuuuaaa

SEQ ID NO: 1305458 - RNA, 19 nt, Human
ugagugugcggcugugugu

SEQ ID NO: 1305459 - RNA, 22 nt, Human
ugagugugcggcugugugugca

SEQ ID NO: 1305460 - RNA, 18 nt, Human
ugaguuccagaaaguaaa

SEQ ID NO: 1305461 - RNA, 17 nt, Human
ugaguuccagaaaguaa

SEQ ID NO: 1305462 - RNA, 21 nt, Human
ugaguguuuuaugagaaagcc

SEQ ID NO: 1305463 - RNA, 19 nt, Human
ugaguguuuuaugagaaag

SEQ ID NO: 1305464 - RNA, 14 nt, Human
ugaguuacagaaau

SEQ ID NO: 1305465 - RNA, 17 nt, Human
ugacccagaggacagca

SEQ ID NO: 1305466 - RNA, 19 nt, Human
agcagcaccguucugugca

SEQ ID NO: 1305467 - RNA, 20 nt, Human
agcagcaccguucugugcac

SEQ ID NO: 1305468 - RNA, 13 nt, Human
agcagcaccuccu

SEQ ID NO: 1305469 - RNA, 14 nt, Human
agcagcaccuccuc

SEQ ID NO: 1305470 - RNA, 17 nt, Human
agcagcaccuccucagc

SEQ ID NO: 1305471 - RNA, 20 nt, Human
agcagcaccuccucagccug

SEQ ID NO: 1305472 - RNA, 21 nt, Human
agcagcaccuccucagccuga

SEQ ID NO: 1305473 - RNA, 14 nt, Human
agcagcaccugccc

SEQ ID NO: 1305474 - RNA, 16 nt, Human
agcagcaccugcccua

SEQ ID NO: 1305475 - RNA, 17 nt, Human
agcagcaccugcccuac

SEQ ID NO: 1305476 - RNA, 19 nt, Human
agcagcaccugcccuaccu

SEQ ID NO: 1305477 - RNA, 20 nt, Human
agcagcaccugcccuaccug

SEQ ID NO: 1305478 - RNA, 22 nt, Human
agcagcaccugcccuaccugcc

SEQ ID NO: 1305479 - RNA, 14 nt, Human
agcagcacuuauaa

SEQ ID NO: 1305480 - RNA, 15 nt, Human
agcagcacuuauaaa

SEQ ID NO: 1305481 - RNA, 18 nt, Human
agcagcacuuauaaauca

SEQ ID NO: 1305482 - RNA, 13 nt, Human
agcagcagccucg

SEQ ID NO: 1305483 - RNA, 15 nt, Human
agcagcaggaggggg

SEQ ID NO: 1305484 - RNA, 17 nt, Human
agcagcaggagggggga

SEQ ID NO: 1305485 - RNA, 18 nt, Human
agcagcaggaggggggag

SEQ ID NO: 1305486 - RNA, 21 nt, Human
agcagcaggaggggggaggga

SEQ ID NO: 1305487 - RNA, 22 nt, Human
agcagcaggaggggggagggaa

SEQ ID NO: 1305488 - RNA, 11 nt, Human
agcagcaucuc

SEQ ID NO: 1305489 - RNA, 20 nt, Human
agcagcaucucuaccuucuc

SEQ ID NO: 1305490 - RNA, 19 nt, Human
agcagcaucucuaccuucu

SEQ ID NO: 1305491 - RNA, 17 nt, Human
agcaggaaugggaagga

SEQ ID NO: 1305492 - RNA, 14 nt, Human
agcaggacuccagg

SEQ ID NO: 1305493 - RNA, 15 nt, Human
agcaggacuccaggc

SEQ ID NO: 1305494 - RNA, 18 nt, Human
agcaggacuccaggccca

SEQ ID NO: 1305495 - RNA, 19 nt, Human
agcaggacuccaggcccaa

SEQ ID NO: 1305496 - RNA, 23 nt, Human
agcaggacuccaggcccaaggcu

SEQ ID NO: 1305497 - RNA, 22 nt, Human
agcaggacuccaggcccaaggc

SEQ ID NO: 1305498 - RNA, 16 nt, Human
agcaggacugaugucu

SEQ ID NO: 1305499 - RNA, 22 nt, Human
agcaggacugaugucuccuaag

SEQ ID NO: 1305500 - RNA, 19 nt, Human
agcaggacugaugucuccu

SEQ ID NO: 1305501 - RNA, 16 nt, Human
agcaggaggccuagga

SEQ ID NO: 1305502 - RNA, 14 nt, Human
agcaggagggggga

SEQ ID NO: 1305503 - RNA, 16 nt, Human
agcaggaggggggagg

SEQ ID NO: 1305504 - RNA, 21 nt, Human
agcaggaggggggagggaagg

SEQ ID NO: 1305505 - RNA, 11 nt, Human
agcaggcagcc

SEQ ID NO: 1305506 - RNA, 12 nt, Human
agcaggcagcca

SEQ ID NO: 1305507 - RNA, 14 nt, Human
agcaggcagccagc

SEQ ID NO: 1305508 - RNA, 15 nt, Human
agcaggcagccagca

SEQ ID NO: 1305509 - RNA, 16 nt, Human
agcaggcagccagcau

SEQ ID NO: 1305510 - RNA, 17 nt, Human
agcaggcagccagcauc

SEQ ID NO: 1305511 - RNA, 19 nt, Human
agcaggcagccagcaucug

SEQ ID NO: 1305512 - RNA, 13 nt, Human
agcaggccacacu

SEQ ID NO: 1305513 - RNA, 23 nt, Human
agcaggccacacuucaaacuacu

SEQ ID NO: 1305514 - RNA, 24 nt, Human
agcaggccacacuucaaacuacuu

SEQ ID NO: 1305515 - RNA, 21 nt, Human
agcaggccuuuugauauuaaa

SEQ ID NO: 1305516 - RNA, 15 nt, Human
agcaggcugugaguu

SEQ ID NO: 1305517 - RNA, 16 nt, Human
agcagggacuguaaac

SEQ ID NO: 1305518 - RNA, 19 nt, Human
agcagggauuaaccucugc

SEQ ID NO: 1305519 - RNA, 20 nt, Human
agcagggauuaaccucugca

SEQ ID NO: 1305520 - RNA, 21 nt, Human
agcagggauuaaccucugcac

SEQ ID NO: 1305521 - RNA, 22 nt, Human
agcagggauuaaccucugcacu

SEQ ID NO: 1305522 - RNA, 14 nt, Human
agcagggccgggga

SEQ ID NO: 1305523 - RNA, 22 nt, Human
agcagggccggggaacuggcca

SEQ ID NO: 1305524 - RNA, 23 nt, Human
agcagggccggggaacuggccaa

SEQ ID NO: 1305525 - RNA, 23 nt, Human
agcagggcuacccugagcugagg

SEQ ID NO: 1305526 - RNA, 19 nt, Human
agcagggugggcuuguggg

SEQ ID NO: 1305527 - RNA, 13 nt, Human
agcaggugcugac

SEQ ID NO: 1305528 - RNA, 17 nt, Human
agccuccuuagaaaaaa

SEQ ID NO: 1305529 - RNA, 16 nt, Human
agccuccuuucuggcu

SEQ ID NO: 1305530 - RNA, 18 nt, Human
agccucgcaacccgugcc

SEQ ID NO: 1305531 - RNA, 19 nt, Human
agccucgcaacccgugcca

SEQ ID NO: 1305532 - RNA, 21 nt, Human
agccucgcaacccgugccaag

SEQ ID NO: 1305533 - RNA, 23 nt, Human
agccucgcaacccgugccaaguc

SEQ ID NO: 1305534 - RNA, 20 nt, Human
agccucgcccauccccuuga

SEQ ID NO: 1305535 - RNA, 14 nt, Human
agccucgccccugg

SEQ ID NO: 1305536 - RNA, 15 nt, Human
agccucgccccuggc

SEQ ID NO: 1305537 - RNA, 16 nt, Human
agccucgccccuggca

SEQ ID NO: 1305538 - RNA, 20 nt, Human
agccucgccccuggcagaga

SEQ ID NO: 1305539 - RNA, 16 nt, Human
agccucuccacucaug

SEQ ID NO: 1305540 - RNA, 22 nt, Human
agccucuagagcagacuacagc

SEQ ID NO: 1305541 - RNA, 18 nt, Human
agccucgccccuggcaga

SEQ ID NO: 1305542 - RNA, 19 nt, Human
agccucgccccuggcagag

SEQ ID NO: 1305543 - RNA, 19 nt, Human
agccucuagagcagacuac

SEQ ID NO: 1305544 - RNA, 23 nt, Human
agccucuagagcagacuacagcu

SEQ ID NO: 1305545 - RNA, 16 nt, Human
agccucuccccagguc

SEQ ID NO: 1305546 - RNA, 18 nt, Human
agccucuccccaggucca

SEQ ID NO: 1305547 - RNA, 22 nt, Human
agccucuccccagguccagcuc

SEQ ID NO: 1305548 - RNA, 23 nt, Human
agccucuccccagguccagcucu

SEQ ID NO: 1305549 - RNA, 13 nt, Human
ugcagacaggaau

SEQ ID NO: 1305550 - RNA, 15 nt, Human
ugcagacaggaaucu

SEQ ID NO: 1305551 - RNA, 16 nt, Human
ugcagacaggaaucuu

SEQ ID NO: 1305552 - RNA, 18 nt, Human
ugcagacaggaaucuuaa

SEQ ID NO: 1305553 - RNA, 20 nt, Human
ugcagacaggaaucuuaagg

SEQ ID NO: 1305554 - RNA, 22 nt, Human
ugcaggucccuaauaaagcugu

SEQ ID NO: 1305555 - RNA, 11 nt, Human
ugcaggucccu

SEQ ID NO: 1305556 - RNA, 19 nt, Human
ugcagguggccaaguuccu

SEQ ID NO: 1305557 - RNA, 13 nt, Human
ugcagguggggag

SEQ ID NO: 1305558 - RNA, 13 nt, Human
ugcagccucagga

SEQ ID NO: 1305559 - RNA, 16 nt, Human
ugcagccucaggacug

SEQ ID NO: 1305560 - RNA, 17 nt, Human
ugcagccucaggacugg

SEQ ID NO: 1305561 - RNA, 18 nt, Human
ugcagccucaggacuggg

SEQ ID NO: 1305562 - RNA, 19 nt, Human
ugcagccucaggacuggga

SEQ ID NO: 1305563 - RNA, 20 nt, Human
ugcagccucaggacugggag

SEQ ID NO: 1305564 - RNA, 22 nt, Human
ugcagccucaggacugggagcc

SEQ ID NO: 1305565 - RNA, 21 nt, Human
ugcagccucaggacugggagc

SEQ ID NO: 1305566 - RNA, 19 nt, Human
ugcagggggugugucugcu

SEQ ID NO: 1305567 - RNA, 22 nt, Human
ugcagggggugugucugcucag

SEQ ID NO: 1305568 - RNA, 15 nt, Human
ugcaggguccucuuc

SEQ ID NO: 1305569 - RNA, 19 nt, Human
ugcaggguccucuucuggg

SEQ ID NO: 1305570 - RNA, 22 nt, Human
ugcaggguccucuucugggccu

SEQ ID NO: 1305571 - RNA, 12 nt, Human
ugcagccucaga

SEQ ID NO: 1305572 - RNA, 14 nt, Human
ugcagccucagaga

SEQ ID NO: 1305573 - RNA, 20 nt, Human
ugcagccucagagacaucag

SEQ ID NO: 1305574 - RNA, 14 nt, Human
agccucuccccugc

SEQ ID NO: 1305575 - RNA, 19 nt, Human
agccucuccccugccugcc

SEQ ID NO: 1305576 - RNA, 21 nt, Human
agccucuccccugccugcccu

SEQ ID NO: 1305577 - RNA, 20 nt, Human
agccucuccccugccugccc

SEQ ID NO: 1305578 - RNA, 14 nt, Human
agccucugucuggc

SEQ ID NO: 1305579 - RNA, 17 nt, Human
agccucugucuggcaau

SEQ ID NO: 1305580 - RNA, 17 nt, Human
ugcauagaauaaaauuu

SEQ ID NO: 1305581 - RNA, 18 nt, Human
ugcauacuuuuuaaaugu

SEQ ID NO: 1305582 - RNA, 19 nt, Human
ugcauacuuuuuaaaugua

SEQ ID NO: 1305583 - RNA, 22 nt, Human
ugcauacuuuuuaaauguaaag

SEQ ID NO: 1305584 - RNA, 23 nt, Human
ugcauacuuuuuaaauguaaaga

SEQ ID NO: 1305585 - RNA, 19 nt, Human
ugcauacucauuaggaugg

SEQ ID NO: 1305586 - RNA, 20 nt, Human
ugcaguaucggcacuguaca

SEQ ID NO: 1305587 - RNA, 21 nt, Human
ugcaguaucggcacuguacaa

SEQ ID NO: 1305588 - RNA, 15 nt, Human
ugcaguaugaaaaua

SEQ ID NO: 1305589 - RNA, 16 nt, Human
ugcaguaugaaaauaa

SEQ ID NO: 1305590 - RNA, 16 nt, Human
ugcaguaucaugcccu

SEQ ID NO: 1305591 - RNA, 21 nt, Human
ugcaguaucaugcccugugca

SEQ ID NO: 1305592 - RNA, 20 nt, Human
ugcagguggccaaguuccuc

SEQ ID NO: 1305593 - RNA, 12 nt, Human
ugcagguuccca

SEQ ID NO: 1305594 - RNA, 13 nt, Human
ugcaguaaaucuu

SEQ ID NO: 1305595 - RNA, 11 nt, Human
ugcauggaaau

SEQ ID NO: 1305596 - RNA, 19 nt, Human
ugcaugcacuguucccccu

SEQ ID NO: 1305597 - RNA, 22 nt, Human
ugcaugcacuguucccccugug

SEQ ID NO: 1305598 - RNA, 14 nt, Human
ugcaugcccagaga

SEQ ID NO: 1305599 - RNA, 18 nt, Human
ugcaugcccagagaccca

SEQ ID NO: 1305600 - RNA, 23 nt, Human
ugcaugcccagagacccagcgga

SEQ ID NO: 1305601 - RNA, 20 nt, Human
ugcaugcccagagacccagc

SEQ ID NO: 1305602 - RNA, 13 nt, Human
ugcaucucagccc

SEQ ID NO: 1305603 - RNA, 14 nt, Human
ugcaucucagccca

SEQ ID NO: 1305604 - RNA, 15 nt, Human
ugcaucucagcccac

SEQ ID NO: 1305605 - RNA, 21 nt, Human
ugcaucuagaggcuuccuuca

SEQ ID NO: 1305606 - RNA, 23 nt, Human
ugcauggaaauucccuucaucug

SEQ ID NO: 1305607 - RNA, 19 nt, Human
ugcauggaaauucccuuca

SEQ ID NO: 1305608 - RNA, 14 nt, Human
ugcauggauuucuu

SEQ ID NO: 1305609 - RNA, 16 nt, Human
ugcauggauuucuuug

SEQ ID NO: 1305610 - RNA, 20 nt, Human
ugcauggauuucuuugaaaa

SEQ ID NO: 1305611 - RNA, 19 nt, Human
ugcauggcagggggcugcu

SEQ ID NO: 1305612 - RNA, 20 nt, Human
ugcauggcagggggcugcug

SEQ ID NO: 1305613 - RNA, 21 nt, Human
ugcauggcagggggcugcugc

SEQ ID NO: 1305614 - RNA, 22 nt, Human
ugcauggcagggggcugcugcu

SEQ ID NO: 1305615 - RNA, 23 nt, Human
ugcauggcagggggcugcugcug

SEQ ID NO: 1305616 - RNA, 11 nt, Human
ugcauggcauc

SEQ ID NO: 1305617 - RNA, 18 nt, Human
ugcauggcauccuccagc

SEQ ID NO: 1305618 - RNA, 20 nt, Human
ugcauggcauccuccagccc

SEQ ID NO: 1305619 - RNA, 21 nt, Human
ugcauggcauccuccagcccc

SEQ ID NO: 1305620 - RNA, 14 nt, Human
agccugagggaaag

SEQ ID NO: 1305621 - RNA, 15 nt, Human
agccugagggaaagg

SEQ ID NO: 1305622 - RNA, 19 nt, Human
agccugagggaaaggccag

SEQ ID NO: 1305623 - RNA, 20 nt, Human
agccugagggaaaggccagc

SEQ ID NO: 1305624 - RNA, 21 nt, Human
agccugagggaaaggccagca

SEQ ID NO: 1305625 - RNA, 22 nt, Human
agccugagggaaaggccagcac

SEQ ID NO: 1305626 - RNA, 23 nt, Human
agccugagggaaaggccagcacu

SEQ ID NO: 1305627 - RNA, 22 nt, Human
agccugaguacuccacacugca

SEQ ID NO: 1305628 - RNA, 16 nt, Human
agccugagucaccugc

SEQ ID NO: 1305629 - RNA, 19 nt, Human
agccugagucaccugcaga

SEQ ID NO: 1305630 - RNA, 19 nt, Human
agccugaguacuccacacu

SEQ ID NO: 1305631 - RNA, 18 nt, Human
agccugugaacccaggac

SEQ ID NO: 1305632 - RNA, 19 nt, Human
agccugugaacccaggaca

SEQ ID NO: 1305633 - RNA, 20 nt, Human
agccugugaacccaggacaa

SEQ ID NO: 1305634 - RNA, 22 nt, Human
agccugugaacccaggacaagc

SEQ ID NO: 1305635 - RNA, 22 nt, Human
agccugugacauacccccuccc

SEQ ID NO: 1305636 - RNA, 22 nt, Human
agccuguaaacuuuaucacuua

SEQ ID NO: 1305637 - RNA, 20 nt, Human
agccugucagauccaggagc

SEQ ID NO: 1305638 - RNA, 21 nt, Human
agccugucagauccaggagcu

SEQ ID NO: 1305639 - RNA, 22 nt, Human
agccugucagauccaggagcuc

SEQ ID NO: 1305640 - RNA, 14 nt, Human
agccuguccugccu

SEQ ID NO: 1305641 - RNA, 15 nt, Human
agccuguccugccug

SEQ ID NO: 1305642 - RNA, 16 nt, Human
agccuguccugccugu

SEQ ID NO: 1305643 - RNA, 17 nt, Human
agccuguccugccugug

SEQ ID NO: 1305644 - RNA, 24 nt, Human
agccuguccugccuguggccauga

SEQ ID NO: 1305645 - RNA, 20 nt, Human
agccuguccugccuguggcc

SEQ ID NO: 1305646 - RNA, 12 nt, Human
agccuguccugu

SEQ ID NO: 1305647 - RNA, 13 nt, Human
agccuguccuguc

SEQ ID NO: 1305648 - RNA, 14 nt, Human
agccuguccuguca

SEQ ID NO: 1305649 - RNA, 18 nt, Human
agccuguccugucaucau

SEQ ID NO: 1305650 - RNA, 15 nt, Human
agccugugaacccag

SEQ ID NO: 1305651 - RNA, 17 nt, Human
agccugugaacccagga

SEQ ID NO: 1305652 - RNA, 12 nt, Human
agccuugcuugu

SEQ ID NO: 1305653 - RNA, 16 nt, Human
agccuugggaccccug

SEQ ID NO: 1305654 - RNA, 19 nt, Human
agccuuggccucuuuccuc

SEQ ID NO: 1305655 - RNA, 16 nt, Human
agccuuggggauucuu

SEQ ID NO: 1305656 - RNA, 23 nt, Human
agccuuggggauucuuccaucug

SEQ ID NO: 1305657 - RNA, 12 nt, Human
agcgcccugcag

SEQ ID NO: 1305658 - RNA, 13 nt, Human
agcgcccugcaga

SEQ ID NO: 1305659 - RNA, 14 nt, Human
agcgcccugcagac

SEQ ID NO: 1305660 - RNA, 12 nt, Human
agccugugccuc

SEQ ID NO: 1305661 - RNA, 19 nt, Human
agccugugacauacccccu

SEQ ID NO: 1305662 - RNA, 18 nt, Human
agccuuaaucagguccuc

SEQ ID NO: 1305663 - RNA, 15 nt, Human
agccuucucuguuca

SEQ ID NO: 1305664 - RNA, 19 nt, Human
agccuucucuguucauuuc

SEQ ID NO: 1305665 - RNA, 20 nt, Human
agccuucucuguucauuucc

SEQ ID NO: 1305666 - RNA, 21 nt, Human
agccuucucuguucauuuccu

SEQ ID NO: 1305667 - RNA, 22 nt, Human
agccuucucuguucauuuccuc

SEQ ID NO: 1305668 - RNA, 23 nt, Human
agccuucucuguucauuuccuca

SEQ ID NO: 1305669 - RNA, 20 nt, Human
ugcauuuaaaacagacacug

SEQ ID NO: 1305670 - RNA, 22 nt, Human
ugcauuuaaaacagacacuggc

SEQ ID NO: 1305671 - RNA, 17 nt, Human
ugcauugugauuggccu

SEQ ID NO: 1305672 - RNA, 19 nt, Human
ugcauugugauuggccugu

SEQ ID NO: 1305673 - RNA, 15 nt, Human
ugcauuuaaaacaga

SEQ ID NO: 1305674 - RNA, 17 nt, Human
ugcauuuaaaacagaca

SEQ ID NO: 1305675 - RNA, 19 nt, Human
ugcauuuaaaacagacacu

SEQ ID NO: 1305676 - RNA, 16 nt, Human
agcgcccugcagaccc

SEQ ID NO: 1305677 - RNA, 17 nt, Human
agcgcccugcagacccu

SEQ ID NO: 1305678 - RNA, 18 nt, Human
agcgcccugcagacccug

SEQ ID NO: 1305679 - RNA, 19 nt, Human
agcgcccugcagacccugc

SEQ ID NO: 1305680 - RNA, 20 nt, Human
agcgcccugcagacccugcc

SEQ ID NO: 1305681 - RNA, 21 nt, Human
agcgcccugcagacccugccc

SEQ ID NO: 1305682 - RNA, 23 nt, Human
agcgcccugcagacccugcccuu

SEQ ID NO: 1305683 - RNA, 12 nt, Human
ugccacagcccu

SEQ ID NO: 1305684 - RNA, 14 nt, Human
ugccacagcccugu

SEQ ID NO: 1305685 - RNA, 16 nt, Human
ugccacagcccuguca

SEQ ID NO: 1305686 - RNA, 23 nt, Human
ugccaagccauggguagccuggg

SEQ ID NO: 1305687 - RNA, 13 nt, Human
ugccaagcuccaa

SEQ ID NO: 1305688 - RNA, 15 nt, Human
ugccaagcuccaagc

SEQ ID NO: 1305689 - RNA, 16 nt, Human
ugccaagcuccaagcc

SEQ ID NO: 1305690 - RNA, 23 nt, Human
ugccaagcuccaagccccaucuu

SEQ ID NO: 1305691 - RNA, 16 nt, Human
ugccaaggcagaggcc

SEQ ID NO: 1305692 - RNA, 17 nt, Human
ugccaaggcagaggccu

SEQ ID NO: 1305693 - RNA, 18 nt, Human
ugccaaggcagaggccug

SEQ ID NO: 1305694 - RNA, 19 nt, Human
ugccaaggcagaggccugg

SEQ ID NO: 1305695 - RNA, 22 nt, Human
ugccaaggcagaggccugggcu

SEQ ID NO: 1305696 - RNA, 21 nt, Human
ugccaauauuaaaucugcugg

SEQ ID NO: 1305697 - RNA, 11 nt, Human
ugccagccccu

SEQ ID NO: 1305698 - RNA, 19 nt, Human
ugccagccccugccauugu

SEQ ID NO: 1305699 - RNA, 17 nt, Human
ugccacagcccugucag

SEQ ID NO: 1305700 - RNA, 21 nt, Human
ugccacagcccugucagcaug

SEQ ID NO: 1305701 - RNA, 13 nt, Human
ugccacagccucc

SEQ ID NO: 1305702 - RNA, 17 nt, Human
ugccacagccuccccug

SEQ ID NO: 1305703 - RNA, 21 nt, Human
ugccacagccuccccugccag

SEQ ID NO: 1305704 - RNA, 22 nt, Human
ugccacagccuccccugccagg

SEQ ID NO: 1305705 - RNA, 22 nt, Human
ugccacagcccugucagcauga

SEQ ID NO: 1305706 - RNA, 11 nt, Human
ugccacagcuu

SEQ ID NO: 1305707 - RNA, 17 nt, Human
ugccacagcuuuugcaa

SEQ ID NO: 1305708 - RNA, 16 nt, Human
ugccacagcuuuugca

SEQ ID NO: 1305709 - RNA, 13 nt, Human
ugccauaauuacu

SEQ ID NO: 1305710 - RNA, 22 nt, Human
ugccaguuguccuccuuccggg

SEQ ID NO: 1305711 - RNA, 23 nt, Human
ugccaguguccugagccccaggg

SEQ ID NO: 1305712 - RNA, 16 nt, Human
ugccaguguccugagc

SEQ ID NO: 1305713 - RNA, 15 nt, Human
ugccaguuguccucc

SEQ ID NO: 1305714 - RNA, 19 nt, Human
ugccagcuacuuccuccuc

SEQ ID NO: 1305715 - RNA, 22 nt, Human
ugccagcucuguaucaggaccc

SEQ ID NO: 1305716 - RNA, 20 nt, Human
agcccugggaggcucuggag

SEQ ID NO: 1305717 - RNA, 18 nt, Human
agcccugggaggcucugg

SEQ ID NO: 1305718 - RNA, 22 nt, Human
agcccugcaccaugcugcuggg

SEQ ID NO: 1305719 - RNA, 12 nt, Human
agcccugccugg

SEQ ID NO: 1305720 - RNA, 13 nt, Human
agcccugccugga

SEQ ID NO: 1305721 - RNA, 14 nt, Human
agcccugccuggag

SEQ ID NO: 1305722 - RNA, 19 nt, Human
agcccugccuggaggaccu

SEQ ID NO: 1305723 - RNA, 15 nt, Human
agcccugccuggagg

SEQ ID NO: 1305724 - RNA, 16 nt, Human
agcccugccuggagga

SEQ ID NO: 1305725 - RNA, 17 nt, Human
agcccugccuggaggac

SEQ ID NO: 1305726 - RNA, 13 nt, Human
ugcacauguuucc

SEQ ID NO: 1305727 - RNA, 14 nt, Human
ugcacauguuuccu

SEQ ID NO: 1305728 - RNA, 16 nt, Human
ugcacauguuuccucu

SEQ ID NO: 1305729 - RNA, 17 nt, Human
ugcacauguuuccucua

SEQ ID NO: 1305730 - RNA, 18 nt, Human
ugcacauguuuccucuag

SEQ ID NO: 1305731 - RNA, 13 nt, Human
ugcacauuuauuu

SEQ ID NO: 1305732 - RNA, 22 nt, Human
ugcacauuuauuuccucccucu

SEQ ID NO: 1305733 - RNA, 16 nt, Human
ugcaccaaagagaaug

SEQ ID NO: 1305734 - RNA, 23 nt, Human
ugcaccaggguugaccccagagg

SEQ ID NO: 1305735 - RNA, 18 nt, Human
ugcaccccaaagcuuucc

SEQ ID NO: 1305736 - RNA, 19 nt, Human
ugcaccccaaagcuuuccu

SEQ ID NO: 1305737 - RNA, 20 nt, Human
ugcaccccaaagcuuuccug

SEQ ID NO: 1305738 - RNA, 21 nt, Human
ugcaccccaaagcuuuccugc

SEQ ID NO: 1305739 - RNA, 22 nt, Human
ugcaccccaaagcuuuccugcc

SEQ ID NO: 1305740 - RNA, 23 nt, Human
ugcaccccaaagcuuuccugccc

SEQ ID NO: 1305741 - RNA, 15 nt, Human
ugcacuccagccuga

SEQ ID NO: 1305742 - RNA, 17 nt, Human
ugcacuccagccugagc

SEQ ID NO: 1305743 - RNA, 16 nt, Human
agccccuuagacagag

SEQ ID NO: 1305744 - RNA, 12 nt, Human
agcccugcacca

SEQ ID NO: 1305745 - RNA, 13 nt, Human
agcccugcaccau

SEQ ID NO: 1305746 - RNA, 14 nt, Human
agcccugcaccaug

SEQ ID NO: 1305747 - RNA, 20 nt, Human
agcccugcaccaugcugcug

SEQ ID NO: 1305748 - RNA, 23 nt, Human
agccccgcguggaacucgugucu

SEQ ID NO: 1305749 - RNA, 18 nt, Human
agccccgugggguuccuc

SEQ ID NO: 1305750 - RNA, 12 nt, Human
agccccucuggu

SEQ ID NO: 1305751 - RNA, 13 nt, Human
agccccucugguc

SEQ ID NO: 1305752 - RNA, 16 nt, Human
agccccucuggucgcu

SEQ ID NO: 1305753 - RNA, 20 nt, Human
agccccucuggucgcuccug

SEQ ID NO: 1305754 - RNA, 16 nt, Human
agccccugggcccagu

SEQ ID NO: 1305755 - RNA, 14 nt, Human
agccccugggccca

SEQ ID NO: 1305756 - RNA, 21 nt, Human
agccccugggguggccaccag

SEQ ID NO: 1305757 - RNA, 22 nt, Human
agccccugggguggccaccagu

SEQ ID NO: 1305758 - RNA, 15 nt, Human
agccccugucauggu

SEQ ID NO: 1305759 - RNA, 23 nt, Human
ugcaaggccugguguuucuugau

SEQ ID NO: 1305760 - RNA, 21 nt, Human
ugcaaggccugguguuucuug

SEQ ID NO: 1305761 - RNA, 11 nt, Human
ugcaagggaaa

SEQ ID NO: 1305762 - RNA, 13 nt, Human
ugcaaggcaaaga

SEQ ID NO: 1305763 - RNA, 17 nt, Human
ugcaaggaccuaaaaca

SEQ ID NO: 1305764 - RNA, 14 nt, Human
ugcaaggcagccgu

SEQ ID NO: 1305765 - RNA, 15 nt, Human
ugcaaggcagccgug

SEQ ID NO: 1305766 - RNA, 16 nt, Human
ugcaaggcagccgugg

SEQ ID NO: 1305767 - RNA, 18 nt, Human
ugcaaggcagccgugggc

SEQ ID NO: 1305768 - RNA, 16 nt, Human
ugcaagguacucuggu

SEQ ID NO: 1305769 - RNA, 18 nt, Human
ugcaagguacucugguga

SEQ ID NO: 1305770 - RNA, 21 nt, Human
ugcaagguauuacacucugua

SEQ ID NO: 1305771 - RNA, 22 nt, Human
ugcaagguauuacacucuguaa

SEQ ID NO: 1305772 - RNA, 16 nt, Human
ugcaaggucuuugguu

SEQ ID NO: 1305773 - RNA, 17 nt, Human
ugcaaguauacuaggga

SEQ ID NO: 1305774 - RNA, 20 nt, Human
ugcaaguauacuagggagcc

SEQ ID NO: 1305775 - RNA, 11 nt, Human
ugcaaugaaca

SEQ ID NO: 1305776 - RNA, 23 nt, Human
agcccaggccaggacucugcagc

SEQ ID NO: 1305777 - RNA, 15 nt, Human
ugcaauaucugaagc

SEQ ID NO: 1305778 - RNA, 14 nt, Human
ugcaauaucugaag

SEQ ID NO: 1305779 - RNA, 15 nt, Human
ugcaaucccuuaaua

SEQ ID NO: 1305780 - RNA, 17 nt, Human
ugcaaguuaugaaauau

SEQ ID NO: 1305781 - RNA, 13 nt, Human
ugcaaguugagga

SEQ ID NO: 1305782 - RNA, 18 nt, Human
ugcaaguugaggacuucu

SEQ ID NO: 1305783 - RNA, 16 nt, Human
ugcaaguuuaucagua

SEQ ID NO: 1305784 - RNA, 19 nt, Human
ugcaaguugaggacuucuu

SEQ ID NO: 1305785 - RNA, 19 nt, Human
ugcaauaaaucugacccag

SEQ ID NO: 1305786 - RNA, 15 nt, Human
ugcaagccagauuuu

SEQ ID NO: 1305787 - RNA, 21 nt, Human
ugcaagccagauuuuccugaa

SEQ ID NO: 1305788 - RNA, 15 nt, Human
ugcaagcacagcccu

SEQ ID NO: 1305789 - RNA, 16 nt, Human
ugcaagcacagcccuu

SEQ ID NO: 1305790 - RNA, 12 nt, Human
ugcaaauuucau

SEQ ID NO: 1305791 - RNA, 13 nt, Human
ugcaacaaaauuc

SEQ ID NO: 1305792 - RNA, 12 nt, Human
ugcaacacuggu

SEQ ID NO: 1305793 - RNA, 22 nt, Human
ugcaacacuggucugcuguucc

SEQ ID NO: 1305794 - RNA, 16 nt, Human
ugcaacagacuugaau

SEQ ID NO: 1305795 - RNA, 17 nt, Human
ugcaaauaacaaaugcc

SEQ ID NO: 1305796 - RNA, 13 nt, Human
ugcaaauaacaaa

SEQ ID NO: 1305797 - RNA, 23 nt, Human
ugcaaauacuguauauucaggac

SEQ ID NO: 1305798 - RNA, 20 nt, Human
ugcaaaucaggcuuuuguuu

SEQ ID NO: 1305799 - RNA, 14 nt, Human
ugcaaaucuugaaa

SEQ ID NO: 1305800 - RNA, 21 nt, Human
ugcaaaugcuaugagaugcau

SEQ ID NO: 1305801 - RNA, 15 nt, Human
agccacgguguucug

SEQ ID NO: 1305802 - RNA, 19 nt, Human
agccacggggacucagccc

SEQ ID NO: 1305803 - RNA, 18 nt, Human
agccacgggugccagaag

SEQ ID NO: 1305804 - RNA, 16 nt, Human
ugauuuaucacacaaa

SEQ ID NO: 1305805 - RNA, 18 nt, Human
ugauuuaucacacaaagc

SEQ ID NO: 1305806 - RNA, 22 nt, Human
ugauuuaucugagucaacuccu

SEQ ID NO: 1305807 - RNA, 23 nt, Human
ugauuuauuaauauauauuaucu

SEQ ID NO: 1305808 - RNA, 13 nt, Human
ugauuucauuuca

SEQ ID NO: 1305809 - RNA, 17 nt, Human
ugauuucauuucaacug

SEQ ID NO: 1305810 - RNA, 12 nt, Human
ugauuugcauug

SEQ ID NO: 1305811 - RNA, 12 nt, Human
ugauuuggaaaa

SEQ ID NO: 1305812 - RNA, 15 nt, Human
ugauuugcauugaac

SEQ ID NO: 1305813 - RNA, 13 nt, Human
ugauuugcauuga

SEQ ID NO: 1305814 - RNA, 14 nt, Human
ugauuugcauugaa

SEQ ID NO: 1305815 - RNA, 18 nt, Human
ugauuugcauugaacaca

SEQ ID NO: 1305816 - RNA, 14 nt, Human
ugcaaagcccagcu

SEQ ID NO: 1305817 - RNA, 15 nt, Human
ugcaaagcccagcuu

SEQ ID NO: 1305818 - RNA, 17 nt, Human
ugcaaagcccagcuuga

SEQ ID NO: 1305819 - RNA, 23 nt, Human
ugcaaaguucccuacuuccugug

SEQ ID NO: 1305820 - RNA, 13 nt, Human
ugcaaauaaauau

SEQ ID NO: 1305821 - RNA, 23 nt, Human
ugcaaauaaauauccuuuaauug

SEQ ID NO: 1305822 - RNA, 17 nt, Human
ugcaaagucaggaauca

SEQ ID NO: 1305823 - RNA, 18 nt, Human
ugcaaagucaggaaucau

SEQ ID NO: 1305824 - RNA, 16 nt, Human
ugcaaagaaagaaaaa

SEQ ID NO: 1305825 - RNA, 22 nt, Human
ugcaaagaaagaaaaaaaacca

SEQ ID NO: 1305826 - RNA, 23 nt, Human
ugcaaagaaagaaaaaaaaccau

SEQ ID NO: 1305827 - RNA, 23 nt, Human
ugcaaagaucuguccucagccuu

SEQ ID NO: 1305828 - RNA, 12 nt, Human
ugcaaagaucug

SEQ ID NO: 1305829 - RNA, 18 nt, Human
agaugcaguucugaagaa

SEQ ID NO: 1305830 - RNA, 19 nt, Human
agaugcaguucugaagaag

SEQ ID NO: 1305831 - RNA, 20 nt, Human
agaugcaguucugaagaaga

SEQ ID NO: 1305832 - RNA, 13 nt, Human
agaugccucccug

SEQ ID NO: 1305833 - RNA, 13 nt, Human
agaugccuccuuc

SEQ ID NO: 1305834 - RNA, 16 nt, Human
agaugccuccuuccuc

SEQ ID NO: 1305835 - RNA, 15 nt, Human
agaugcuagaacucc

SEQ ID NO: 1305836 - RNA, 14 nt, Human
agaugcuagaacuc

SEQ ID NO: 1305837 - RNA, 20 nt, Human
agaugcuggcccagggccca

SEQ ID NO: 1305838 - RNA, 21 nt, Human
agaugcuggcccagggcccag

SEQ ID NO: 1305839 - RNA, 22 nt, Human
agaugcuggcccagggcccaga

SEQ ID NO: 1305840 - RNA, 23 nt, Human
agaugcuggcccagggcccagag

SEQ ID NO: 1305841 - RNA, 17 nt, Human
agaugcuggcuugggca

SEQ ID NO: 1305842 - RNA, 19 nt, Human
agaugcuggcuugggcagc

SEQ ID NO: 1305843 - RNA, 18 nt, Human
agaugcuggcuugggcag

SEQ ID NO: 1305844 - RNA, 15 nt, Human
agaugcacuuugcuu

SEQ ID NO: 1305845 - RNA, 22 nt, Human
agaugcacuuugcuuuaauaua

SEQ ID NO: 1305846 - RNA, 19 nt, Human
agaugcacuuugcuuuaau

SEQ ID NO: 1305847 - RNA, 18 nt, Human
agaucccaacacugccag

SEQ ID NO: 1305848 - RNA, 17 nt, Human
agauccaggagcuccag

SEQ ID NO: 1305849 - RNA, 14 nt, Human
agauccaggagcuc

SEQ ID NO: 1305850 - RNA, 15 nt, Human
agauccaggagcucc

SEQ ID NO: 1305851 - RNA, 16 nt, Human
agauccaggagcucca

SEQ ID NO: 1305852 - RNA, 19 nt, Human
agauccagggacagaggcc

SEQ ID NO: 1305853 - RNA, 22 nt, Human
agauccagggacagaggcccca

SEQ ID NO: 1305854 - RNA, 19 nt, Human
agaucccaacacugccagc

SEQ ID NO: 1305855 - RNA, 20 nt, Human
agaucccaacacugccagca

SEQ ID NO: 1305856 - RNA, 10 nt, Human
agaucccaaa

SEQ ID NO: 1305857 - RNA, 22 nt, Human
agaucccaaguagaaucucagu

SEQ ID NO: 1305858 - RNA, 23 nt, Human
agaugcaccaccaagccaaggga

SEQ ID NO: 1305859 - RNA, 15 nt, Human
ugacccacaugccau

SEQ ID NO: 1305860 - RNA, 14 nt, Human
ugacccacaugcca

SEQ ID NO: 1305861 - RNA, 17 nt, Human
ugacccacaagaaauga

SEQ ID NO: 1305862 - RNA, 20 nt, Human
agauguucuaagucuuucca

SEQ ID NO: 1305863 - RNA, 21 nt, Human
agauguucuaagucuuuccau

SEQ ID NO: 1305864 - RNA, 22 nt, Human
agauguucuaagucuuuccauu

SEQ ID NO: 1305865 - RNA, 16 nt, Human
agaugcugugagucuu

SEQ ID NO: 1305866 - RNA, 20 nt, Human
agaugcugugagucuuuggu

SEQ ID NO: 1305867 - RNA, 15 nt, Human
agaugugauauucua

SEQ ID NO: 1305868 - RNA, 16 nt, Human
agaugugauauucuaa

SEQ ID NO: 1305869 - RNA, 17 nt, Human
agaugugauauucuaag

SEQ ID NO: 1305870 - RNA, 18 nt, Human
agaugugauauucuaaga

SEQ ID NO: 1305871 - RNA, 19 nt, Human
agaugugauauucuaagac

SEQ ID NO: 1305872 - RNA, 20 nt, Human
agaugugauauucuaagacu

SEQ ID NO: 1305873 - RNA, 19 nt, Human
agaugugcagcauuucacu

SEQ ID NO: 1305874 - RNA, 15 nt, Human
agauguucacccaac

SEQ ID NO: 1305875 - RNA, 17 nt, Human
agauguucuaagucuuu

SEQ ID NO: 1305876 - RNA, 12 nt, Human
agaucauuguga

SEQ ID NO: 1305877 - RNA, 18 nt, Human
agaucaguguaccauuug

SEQ ID NO: 1305878 - RNA, 21 nt, Human
agaucaguguaccauuugccu

SEQ ID NO: 1305879 - RNA, 15 nt, Human
agaucaguaaagaac

SEQ ID NO: 1305880 - RNA, 13 nt, Human
agaucauaaggcu

SEQ ID NO: 1305881 - RNA, 16 nt, Human
agaucauaaggcuuca

SEQ ID NO: 1305882 - RNA, 19 nt, Human
agaucaggaagagaaggag

SEQ ID NO: 1305883 - RNA, 18 nt, Human
agaucaggaagagaagga

SEQ ID NO: 1305884 - RNA, 15 nt, Human
ugaccaaugucuuga

SEQ ID NO: 1305885 - RNA, 13 nt, Human
agaucaguaaaga

SEQ ID NO: 1305886 - RNA, 15 nt, Human
agaucaguguaccau

SEQ ID NO: 1305887 - RNA, 17 nt, Human
agaucaggaagagaagg

SEQ ID NO: 1305888 - RNA, 13 nt, Human
agaucaggaagag

SEQ ID NO: 1305889 - RNA, 13 nt, Human
ugaccaaugucuu

SEQ ID NO: 1305890 - RNA, 14 nt, Human
ugaccaaugucuug

SEQ ID NO: 1305891 - RNA, 16 nt, Human
ugacauaaaguugaua

SEQ ID NO: 1305892 - RNA, 14 nt, Human
ugacauaaaguuga

SEQ ID NO: 1305893 - RNA, 15 nt, Human
ugacauuuauauauu

SEQ ID NO: 1305894 - RNA, 16 nt, Human
ugacauuuauauauug

SEQ ID NO: 1305895 - RNA, 19 nt, Human
ugacauuuauauauugaau

SEQ ID NO: 1305896 - RNA, 16 nt, Human
ugacacaccaggcgcu

SEQ ID NO: 1305897 - RNA, 22 nt, Human
ugacacaccaggcgcuaauuca

SEQ ID NO: 1305898 - RNA, 23 nt, Human
ugacacaccaggcgcuaauucaa

SEQ ID NO: 1305899 - RNA, 12 nt, Human
ugacacacuaac

SEQ ID NO: 1305900 - RNA, 20 nt, Human
ugacacacuaaccaagcuga

SEQ ID NO: 1305901 - RNA, 18 nt, Human
ugacacagaaaauguuga

SEQ ID NO: 1305902 - RNA, 19 nt, Human
ugacacagaaaauguugag

SEQ ID NO: 1305903 - RNA, 23 nt, Human
ugacacagaaaauguugagaauc

SEQ ID NO: 1305904 - RNA, 22 nt, Human
ugacagcuaggaugugcauucu

SEQ ID NO: 1305905 - RNA, 20 nt, Human
ugacagcuaggaugugcauu

SEQ ID NO: 1305906 - RNA, 14 nt, Human
ugacaggccugucc

SEQ ID NO: 1305907 - RNA, 18 nt, Human
ugacaguggaacuacauu

SEQ ID NO: 1305908 - RNA, 16 nt, Human
ugacaguggaacuaca

SEQ ID NO: 1305909 - RNA, 16 nt, Human
ugacaguguugaaaau

SEQ ID NO: 1305910 - RNA, 19 nt, Human
ugacaguguugaaaauguu

SEQ ID NO: 1305911 - RNA, 14 nt, Human
ugacaguguuuuua

SEQ ID NO: 1305912 - RNA, 18 nt, Human
ugacaguggcguuuguaa

SEQ ID NO: 1305913 - RNA, 16 nt, Human
agaguuuagcuggaaa

SEQ ID NO: 1305914 - RNA, 17 nt, Human
agaguuuagcuggaaaa

SEQ ID NO: 1305915 - RNA, 14 nt, Human
agaguuuaaaauca

SEQ ID NO: 1305916 - RNA, 20 nt, Human
agaguugaugguuguacaua

SEQ ID NO: 1305917 - RNA, 21 nt, Human
agaguugcugagagggcucga

SEQ ID NO: 1305918 - RNA, 13 nt, Human
agaguuggccaua

SEQ ID NO: 1305919 - RNA, 15 nt, Human
agaguuggccauauu

SEQ ID NO: 1305920 - RNA, 14 nt, Human
agagugaacaaauu

SEQ ID NO: 1305921 - RNA, 23 nt, Human
agagucuggugaagcucacuucu

SEQ ID NO: 1305922 - RNA, 12 nt, Human
agagucugaaca

SEQ ID NO: 1305923 - RNA, 13 nt, Human
agagucugaacag

SEQ ID NO: 1305924 - RNA, 16 nt, Human
agagucugaacagcug

SEQ ID NO: 1305925 - RNA, 17 nt, Human
agagucugaacagcugu

SEQ ID NO: 1305926 - RNA, 16 nt, Human
agagucugaaccuauu

SEQ ID NO: 1305927 - RNA, 23 nt, Human
agagucuggauaacuuccacagg

SEQ ID NO: 1305928 - RNA, 18 nt, Human
agagucuggugaagcuca

SEQ ID NO: 1305929 - RNA, 21 nt, Human
ugaagcaaaugucaugcugcc

SEQ ID NO: 1305930 - RNA, 22 nt, Human
ugaagcaaaugucaugcugccu

SEQ ID NO: 1305931 - RNA, 15 nt, Human
ugaauguaaauuugu

SEQ ID NO: 1305932 - RNA, 16 nt, Human
ugaauguaaauuugua

SEQ ID NO: 1305933 - RNA, 18 nt, Human
ugaauguaaauuuguacu

SEQ ID NO: 1305934 - RNA, 19 nt, Human
ugaauguaaauuuguacua

SEQ ID NO: 1305935 - RNA, 20 nt, Human
ugaauguaaauuuguacuau

SEQ ID NO: 1305936 - RNA, 13 nt, Human
ugaaugugaagcc

SEQ ID NO: 1305937 - RNA, 14 nt, Human
ugaaugugaagccu

SEQ ID NO: 1305938 - RNA, 15 nt, Human
ugaaugugaagccuu

SEQ ID NO: 1305939 - RNA, 16 nt, Human
ugaaugugaagccuuc

SEQ ID NO: 1305940 - RNA, 17 nt, Human
ugaaugugaagccuucc

SEQ ID NO: 1305941 - RNA, 23 nt, Human
agaguccaucagccuccauccua

SEQ ID NO: 1305942 - RNA, 19 nt, Human
agaguccaagguuuaaaga

SEQ ID NO: 1305943 - RNA, 21 nt, Human
agaguccaagguuuaaagagu

SEQ ID NO: 1305944 - RNA, 14 nt, Human
agagucccugccug

SEQ ID NO: 1305945 - RNA, 17 nt, Human
agagucccugccuggac

SEQ ID NO: 1305946 - RNA, 19 nt, Human
agagucccagguuggcucu

SEQ ID NO: 1305947 - RNA, 20 nt, Human
agagucccagguuggcucug

SEQ ID NO: 1305948 - RNA, 18 nt, Human
ugaauguggcuugagaaa

SEQ ID NO: 1305949 - RNA, 16 nt, Human
ugaauguguuucacag

SEQ ID NO: 1305950 - RNA, 20 nt, Human
ugaauguguuucacaguuug

SEQ ID NO: 1305951 - RNA, 17 nt, Human
ugaauguguuucacagu

SEQ ID NO: 1305952 - RNA, 12 nt, Human
agauacugaaau

SEQ ID NO: 1305953 - RNA, 18 nt, Human
agauacuaaggacguugu

SEQ ID NO: 1305954 - RNA, 13 nt, Human
agauacugaaaua

SEQ ID NO: 1305955 - RNA, 15 nt, Human
agauacugaaauaaa

SEQ ID NO: 1305956 - RNA, 17 nt, Human
agauaaagguucaugca

SEQ ID NO: 1305957 - RNA, 17 nt, Human
agauaugggacauuuuu

SEQ ID NO: 1305958 - RNA, 11 nt, Human
agauauuaaug

SEQ ID NO: 1305959 - RNA, 15 nt, Human
agauauuaccaguuu

SEQ ID NO: 1305960 - RNA, 17 nt, Human
agauauuaaugcccaga

SEQ ID NO: 1305961 - RNA, 18 nt, Human
agauauuaaugcccagac

SEQ ID NO: 1305962 - RNA, 18 nt, Human
agauauuccuauugugca

SEQ ID NO: 1305963 - RNA, 14 nt, Human
agauauuggacaaa

SEQ ID NO: 1305964 - RNA, 17 nt, Human
agauauuggacaaagaa

SEQ ID NO: 1305965 - RNA, 16 nt, Human
agauauuggacaaaga

SEQ ID NO: 1305966 - RNA, 11 nt, Human
ugaauuucauc

SEQ ID NO: 1305967 - RNA, 16 nt, Human
ugaauuuuacauggcu

SEQ ID NO: 1305968 - RNA, 13 nt, Human
ugaauuucacugu

SEQ ID NO: 1305969 - RNA, 13 nt, Human
ugaauuuuagcuu

SEQ ID NO: 1305970 - RNA, 21 nt, Human
agaucaccaguguguggcuuu

SEQ ID NO: 1305971 - RNA, 14 nt, Human
ugaauuuuagcuuu

SEQ ID NO: 1305972 - RNA, 15 nt, Human
ugaauuuuagcuuuu

SEQ ID NO: 1305973 - RNA, 19 nt, Human
ugaauuuuagcuuuugugg

SEQ ID NO: 1305974 - RNA, 16 nt, Human
ugaauuuuagcuuuug

SEQ ID NO: 1305975 - RNA, 18 nt, Human
agauacucuuauuuuacu

SEQ ID NO: 1305976 - RNA, 15 nt, Human
ugaauuuuuuuuaac

SEQ ID NO: 1305977 - RNA, 16 nt, Human
ugaauuuuuuuuaaca

SEQ ID NO: 1305978 - RNA, 17 nt, Human
ugaauuuuuuuuaacau

SEQ ID NO: 1305979 - RNA, 18 nt, Human
ugaauuuuuuuuaacauu

SEQ ID NO: 1305980 - RNA, 19 nt, Human
ugaauuuuuuuuaacauuc

SEQ ID NO: 1305981 - RNA, 20 nt, Human
ugaauuuuuuuuaacauucc

SEQ ID NO: 1305982 - RNA, 21 nt, Human
ugaauuuuuuuuaacauuccu

SEQ ID NO: 1305983 - RNA, 16 nt, Human
ugaauuuuuuuuuccu

SEQ ID NO: 1305984 - RNA, 19 nt, Human
ugaauuuuuuuuuccuagc

SEQ ID NO: 1305985 - RNA, 20 nt, Human
ugaauuuuuuuuuccuagcc

SEQ ID NO: 1305986 - RNA, 22 nt, Human
ugaauuuuuuuuaacauuccuc

SEQ ID NO: 1305987 - RNA, 19 nt, Human
ugacaaaaaauuaaagcau

SEQ ID NO: 1305988 - RNA, 12 nt, Human
agagguuuuaaa

SEQ ID NO: 1305989 - RNA, 22 nt, Human
agagguuugacuagaugaugga

SEQ ID NO: 1305990 - RNA, 15 nt, Human
agagguuugcagucc

SEQ ID NO: 1305991 - RNA, 17 nt, Human
agagguuugcaguccca

SEQ ID NO: 1305992 - RNA, 20 nt, Human
agagguuugcagucccaagc

SEQ ID NO: 1305993 - RNA, 15 nt, Human
agaguagaauugcau

SEQ ID NO: 1305994 - RNA, 16 nt, Human
agaguagaauugcauu

SEQ ID NO: 1305995 - RNA, 22 nt, Human
ugaagcacagugaucaaguuau

SEQ ID NO: 1305996 - RNA, 23 nt, Human
ugaagcaaaugucaugcugccuu

SEQ ID NO: 1305997 - RNA, 20 nt, Human
ugaagcaaaucgaaugaaau

SEQ ID NO: 1305998 - RNA, 20 nt, Human
ugaagcaaaugucaugcugc

SEQ ID NO: 1305999 - RNA, 17 nt, Human
agaguagaauugcauug

SEQ ID NO: 1306000 - RNA, 18 nt, Human
agaguagaauugcauuga

SEQ ID NO: 1306001 - RNA, 22 nt, Human
ugaagcaaacucuaaaauuaua

SEQ ID NO: 1306002 - RNA, 15 nt, Human
agagguugcagugag

SEQ ID NO: 1306003 - RNA, 14 nt, Human
agagguugucugug

SEQ ID NO: 1306004 - RNA, 19 nt, Human
agagguccacaacacacag

SEQ ID NO: 1306005 - RNA, 13 nt, Human
agaggcugaggac

SEQ ID NO: 1306006 - RNA, 14 nt, Human
agaggcugaggccu

SEQ ID NO: 1306007 - RNA, 17 nt, Human
agaggcugaggccugga

SEQ ID NO: 1306008 - RNA, 18 nt, Human
agaggcugaggccuggac

SEQ ID NO: 1306009 - RNA, 19 nt, Human
agaggcugaggccuggacu

SEQ ID NO: 1306010 - RNA, 16 nt, Human
agaggcugaggcuggc

SEQ ID NO: 1306011 - RNA, 17 nt, Human
agagguauuuaucuuua

SEQ ID NO: 1306012 - RNA, 11 nt, Human
agaggcagccc

SEQ ID NO: 1306013 - RNA, 13 nt, Human
agaggcagcccag

SEQ ID NO: 1306014 - RNA, 14 nt, Human
agaggcagcccagg

SEQ ID NO: 1306015 - RNA, 16 nt, Human
agaggcagcccgcaca

SEQ ID NO: 1306016 - RNA, 19 nt, Human
agaggcagcccaggaaguc

SEQ ID NO: 1306017 - RNA, 21 nt, Human
agaggccauucuuucccaaca

SEQ ID NO: 1306018 - RNA, 15 nt, Human
agaggcccaggcugc

SEQ ID NO: 1306019 - RNA, 16 nt, Human
agaggcccaggcugcc

SEQ ID NO: 1306020 - RNA, 17 nt, Human
agaggcccaggcugccg

SEQ ID NO: 1306021 - RNA, 18 nt, Human
agaggcccaggcugccgu

SEQ ID NO: 1306022 - RNA, 19 nt, Human
agaggcccaggcugccguc

SEQ ID NO: 1306023 - RNA, 19 nt, Human
agaggcuauuauuuucacu

SEQ ID NO: 1306024 - RNA, 10 nt, Human
agaggcucag

SEQ ID NO: 1306025 - RNA, 18 nt, Human
agaggcucagauuguaau

SEQ ID NO: 1306026 - RNA, 22 nt, Human
agaggcucguugacuggcugug

SEQ ID NO: 1306027 - RNA, 22 nt, Human
agagcuggagaugaggccagac

SEQ ID NO: 1306028 - RNA, 23 nt, Human
agagcuggagaugaggccagacc

SEQ ID NO: 1306029 - RNA, 12 nt, Human
agagcuggcucu

SEQ ID NO: 1306030 - RNA, 21 nt, Human
agagcuggagaugaggccaga

SEQ ID NO: 1306031 - RNA, 15 nt, Human
agagcuuaacagugu

SEQ ID NO: 1306032 - RNA, 12 nt, Human
agagcuucccug

SEQ ID NO: 1306033 - RNA, 16 nt, Human
ugaacuuugcugagcc

SEQ ID NO: 1306034 - RNA, 17 nt, Human
ugaacuuuuuauugauu

SEQ ID NO: 1306035 - RNA, 15 nt, Human
ugaagaaaaucacuu

SEQ ID NO: 1306036 - RNA, 21 nt, Human
ugaagaaaaucacuuaggaaa

SEQ ID NO: 1306037 - RNA, 15 nt, Human
ugaacuuugcugagc

SEQ ID NO: 1306038 - RNA, 11 nt, Human
ugaacuuugcu

SEQ ID NO: 1306039 - RNA, 21 nt, Human
ugaacuaggauuguaguccca

SEQ ID NO: 1306040 - RNA, 17 nt, Human
ugaaccuuugugcccua

SEQ ID NO: 1306041 - RNA, 21 nt, Human
ugaaccuuugugcccuaucac

SEQ ID NO: 1306042 - RNA, 18 nt, Human
ugaaccuuugugcccuau

SEQ ID NO: 1306043 - RNA, 17 nt, Human
ugaacuaggcugagcaa

SEQ ID NO: 1306044 - RNA, 18 nt, Human
ugaacuaggcugagcaau

SEQ ID NO: 1306045 - RNA, 23 nt, Human
ugaacuaggguggugcauuuuug

SEQ ID NO: 1306046 - RNA, 14 nt, Human
ugaacucaaacuga

SEQ ID NO: 1306047 - RNA, 16 nt, Human
ugaacucaaacugagg

SEQ ID NO: 1306048 - RNA, 17 nt, Human
ugaacucaaacugagga

SEQ ID NO: 1306049 - RNA, 18 nt, Human
ugaacucaaacugaggaa

SEQ ID NO: 1306050 - RNA, 17 nt, Human
ugaacucaacuuugaca

SEQ ID NO: 1306051 - RNA, 18 nt, Human
ugaacucacuuuccuccu

SEQ ID NO: 1306052 - RNA, 20 nt, Human
ugaacaaauuuacagagaca

SEQ ID NO: 1306053 - RNA, 19 nt, Human
ugaacaaauuuacagagac

SEQ ID NO: 1306054 - RNA, 12 nt, Human
ugaaccugaaua

SEQ ID NO: 1306055 - RNA, 18 nt, Human
ugaaccugaugaaaauaa

SEQ ID NO: 1306056 - RNA, 23 nt, Human
ugaaccugaugaaaauaaagaau

SEQ ID NO: 1306057 - RNA, 12 nt, Human
ugaaccugcccu

SEQ ID NO: 1306058 - RNA, 16 nt, Human
agagcacugcuccagu

SEQ ID NO: 1306059 - RNA, 12 nt, Human
agagcacugcuc

SEQ ID NO: 1306060 - RNA, 15 nt, Human
agagcacugccacca

SEQ ID NO: 1306061 - RNA, 18 nt, Human
agagcacugccaccagua

SEQ ID NO: 1306062 - RNA, 17 nt, Human
agagcaccugcugucug

SEQ ID NO: 1306063 - RNA, 17 nt, Human
agagauuuuuuuuuaaa

SEQ ID NO: 1306064 - RNA, 20 nt, Human
agagauuuuuuuuuaaagaa

SEQ ID NO: 1306065 - RNA, 21 nt, Human
agagauuuuuuuuuaaagaag

SEQ ID NO: 1306066 - RNA, 18 nt, Human
agagcaaaauaauuuuaa

SEQ ID NO: 1306067 - RNA, 15 nt, Human
agagauuuucaacau

SEQ ID NO: 1306068 - RNA, 21 nt, Human
agagauuuucaacauuucaaa

SEQ ID NO: 1306069 - RNA, 13 nt, Human
agagauuuuucau

SEQ ID NO: 1306070 - RNA, 16 nt, Human
agagacagcccaggau

SEQ ID NO: 1306071 - RNA, 18 nt, Human
agagacagcccaggauac

SEQ ID NO: 1306072 - RNA, 22 nt, Human
ucuuuggagaaaugcuuagaaa

SEQ ID NO: 1306073 - RNA, 14 nt, Human
ucuuuggcuccccu

SEQ ID NO: 1306074 - RNA, 22 nt, Human
ucuuuggcuccccuguaccuuu

SEQ ID NO: 1306075 - RNA, 12 nt, Human
agagcagagguc

SEQ ID NO: 1306076 - RNA, 17 nt, Human
agagcagacuacagcug

SEQ ID NO: 1306077 - RNA, 22 nt, Human
agagcagggauuaaccucugca

SEQ ID NO: 1306078 - RNA, 24 nt, Human
agagcagggauuaaccucugcacu

SEQ ID NO: 1306079 - RNA, 18 nt, Human
agagcaggugcuggcucu

SEQ ID NO: 1306080 - RNA, 17 nt, Human
agagcaggugagauggg

SEQ ID NO: 1306081 - RNA, 20 nt, Human
agagcagugaagacuagaaa

SEQ ID NO: 1306082 - RNA, 15 nt, Human
agagccacugccauu

SEQ ID NO: 1306083 - RNA, 12 nt, Human
agagcagugcuu

SEQ ID NO: 1306084 - RNA, 13 nt, Human
agagcagugcuuu

SEQ ID NO: 1306085 - RNA, 15 nt, Human
agagcagugcuuuug

SEQ ID NO: 1306086 - RNA, 11 nt, Human
agagccacagu

SEQ ID NO: 1306087 - RNA, 15 nt, Human
agagccaccaagagg

SEQ ID NO: 1306088 - RNA, 19 nt, Human
agagccaccaagagggacg

SEQ ID NO: 1306089 - RNA, 19 nt, Human
ugaaauuuuaaaaauuguu

SEQ ID NO: 1306090 - RNA, 14 nt, Human
ugaaauuuuaaccu

SEQ ID NO: 1306091 - RNA, 20 nt, Human
ugaaauuuuaaccuaugaua

SEQ ID NO: 1306092 - RNA, 22 nt, Human
ugaaauuuuaaccuaugauauu

SEQ ID NO: 1306093 - RNA, 16 nt, Human
ugaaauuuuauaugcu

SEQ ID NO: 1306094 - RNA, 18 nt, Human
ugaaauuuuauaugcuua

SEQ ID NO: 1306095 - RNA, 22 nt, Human
ugaaauuuuauaugcuuacuga

SEQ ID NO: 1306096 - RNA, 15 nt, Human
ugaaauuguauuaca

SEQ ID NO: 1306097 - RNA, 18 nt, Human
ugaaauauuauguuaaaa

SEQ ID NO: 1306098 - RNA, 20 nt, Human
ugaaauaugauguuaaaaaa

SEQ ID NO: 1306099 - RNA, 16 nt, Human
ugaaauaugauguuaa

SEQ ID NO: 1306100 - RNA, 17 nt, Human
ugaaauauguauaacuu

SEQ ID NO: 1306101 - RNA, 23 nt, Human
ugaaauauguauaacuuuaacuu

SEQ ID NO: 1306102 - RNA, 22 nt, Human
ugaaauaagcuauuugauguaa

SEQ ID NO: 1306103 - RNA, 13 nt, Human
ugaaauaagcuau

SEQ ID NO: 1306104 - RNA, 14 nt, Human
ugaaauaagcuauu

SEQ ID NO: 1306105 - RNA, 16 nt, Human
ugaaauaagcuauuug

SEQ ID NO: 1306106 - RNA, 13 nt, Human
ugaaauaaugugu

SEQ ID NO: 1306107 - RNA, 14 nt, Human
ugaaauaaugugua

SEQ ID NO: 1306108 - RNA, 16 nt, Human
ugaaauaauguguagu

SEQ ID NO: 1306109 - RNA, 23 nt, Human
ugaaauaauguguaguucaugua

SEQ ID NO: 1306110 - RNA, 22 nt, Human
ugaaauaauguguaguucaugu

SEQ ID NO: 1306111 - RNA, 14 nt, Human
ugaaauauauuuaa

SEQ ID NO: 1306112 - RNA, 15 nt, Human
ugaaauauccugcuu

SEQ ID NO: 1306113 - RNA, 17 nt, Human
ugaaauauccugcuuga

SEQ ID NO: 1306114 - RNA, 18 nt, Human
agagcgugagcugagcag

SEQ ID NO: 1306115 - RNA, 19 nt, Human
agagcgagagaucaaagau

SEQ ID NO: 1306116 - RNA, 14 nt, Human
agagcgcacaggga

SEQ ID NO: 1306117 - RNA, 16 nt, Human
agagcgugagcugagc

SEQ ID NO: 1306118 - RNA, 20 nt, Human
agagcgugagcugagcaggc

SEQ ID NO: 1306119 - RNA, 23 nt, Human
ugaaauaagccagacaucaacag

SEQ ID NO: 1306120 - RNA, 20 nt, Human
ugaaauaagccagacaucaa

SEQ ID NO: 1306121 - RNA, 18 nt, Human
ugaaauaagccagacauc

SEQ ID NO: 1306122 - RNA, 17 nt, Human
ugaaauaagccagacau

SEQ ID NO: 1306123 - RNA, 15 nt, Human
ugaaaguuaauccac

SEQ ID NO: 1306124 - RNA, 19 nt, Human
ugaaagugggcaaaagcuu

SEQ ID NO: 1306125 - RNA, 22 nt, Human
ucugucccccuuuagaucucug

SEQ ID NO: 1306126 - RNA, 19 nt, Human
ucugugaagugagaccuuc

SEQ ID NO: 1306127 - RNA, 20 nt, Human
ucugugaagugagaccuucc

SEQ ID NO: 1306128 - RNA, 16 nt, Human
ucugugaccaaugucu

SEQ ID NO: 1306129 - RNA, 18 nt, Human
ucugugaccaaugucuug

SEQ ID NO: 1306130 - RNA, 20 nt, Human
ucuguauuuccccaacaugu

SEQ ID NO: 1306131 - RNA, 23 nt, Human
ucuguauuuccccaacauguaau

SEQ ID NO: 1306132 - RNA, 15 nt, Human
ucuguccccagccug

SEQ ID NO: 1306133 - RNA, 16 nt, Human
ucuguccccagccugg

SEQ ID NO: 1306134 - RNA, 23 nt, Human
ucugucccccuuuagaucucuga

SEQ ID NO: 1306135 - RNA, 23 nt, Human
ucugguaugaacuugaggacaca

SEQ ID NO: 1306136 - RNA, 22 nt, Human
ucugguaugaacuugaggacac

SEQ ID NO: 1306137 - RNA, 20 nt, Human
ucugguaggaauagcauguc

SEQ ID NO: 1306138 - RNA, 23 nt, Human
ucugguagaagggaaagcccaua

SEQ ID NO: 1306139 - RNA, 17 nt, Human
ucuguacugauucaauu

SEQ ID NO: 1306140 - RNA, 16 nt, Human
ucuguacugauucaau

SEQ ID NO: 1306141 - RNA, 15 nt, Human
ucuguacugauucaa

SEQ ID NO: 1306142 - RNA, 23 nt, Human
ucuguacugauucaauuugaugu

SEQ ID NO: 1306143 - RNA, 15 nt, Human
ucuguauauacuuuu

SEQ ID NO: 1306144 - RNA, 20 nt, Human
ucuguaucaggacccagagg

SEQ ID NO: 1306145 - RNA, 19 nt, Human
ucuguucuuccucagccag

SEQ ID NO: 1306146 - RNA, 18 nt, Human
ucuguucuuccucagcca

SEQ ID NO: 1306147 - RNA, 17 nt, Human
ucuguucugcacacagc

SEQ ID NO: 1306148 - RNA, 18 nt, Human
ucuguucugcacacagca

SEQ ID NO: 1306149 - RNA, 19 nt, Human
ucuguucugcacacagcac

SEQ ID NO: 1306150 - RNA, 16 nt, Human
ucuguucuguuucaag

SEQ ID NO: 1306151 - RNA, 15 nt, Human
ucuguucuuccucag

SEQ ID NO: 1306152 - RNA, 17 nt, Human
ucuguucuuccucagcc

SEQ ID NO: 1306153 - RNA, 19 nt, Human
ucugugaccaaugucuuga

SEQ ID NO: 1306154 - RNA, 13 nt, Human
ucugugccagagc

SEQ ID NO: 1306155 - RNA, 15 nt, Human
ucugugccagagccu

SEQ ID NO: 1306156 - RNA, 16 nt, Human
ucugugccagagccug

SEQ ID NO: 1306157 - RNA, 17 nt, Human
ucugugccagagccugg

SEQ ID NO: 1306158 - RNA, 18 nt, Human
ucugugccagagccuggg

SEQ ID NO: 1306159 - RNA, 19 nt, Human
ucugugccagagccugggg

SEQ ID NO: 1306160 - RNA, 20 nt, Human
ucugugccagagccuggggc

SEQ ID NO: 1306161 - RNA, 23 nt, Human
ucugugccagagccuggggcucu

SEQ ID NO: 1306162 - RNA, 22 nt, Human
ucugugccagagccuggggcuc

SEQ ID NO: 1306163 - RNA, 14 nt, Human
ucugugcuguuuca

SEQ ID NO: 1306164 - RNA, 18 nt, Human
ucugugcuguuucaaagu

SEQ ID NO: 1306165 - RNA, 19 nt, Human
ucuguggagguggaaaagc

SEQ ID NO: 1306166 - RNA, 23 nt, Human
ucugugggaugggaugguggagg

SEQ ID NO: 1306167 - RNA, 14 nt, Human
agaauuacuguaac

SEQ ID NO: 1306168 - RNA, 20 nt, Human
agaauuccaggguauggcca

SEQ ID NO: 1306169 - RNA, 12 nt, Human
ucugggcucuga

SEQ ID NO: 1306170 - RNA, 14 nt, Human
ucugggcucugagu

SEQ ID NO: 1306171 - RNA, 11 nt, Human
ucugggcugga

SEQ ID NO: 1306172 - RNA, 19 nt, Human
ucugggcuggaugagcucc

SEQ ID NO: 1306173 - RNA, 20 nt, Human
ucugggcuggaugagcuccc

SEQ ID NO: 1306174 - RNA, 19 nt, Human
ucugggcugucuauucuag

SEQ ID NO: 1306175 - RNA, 14 nt, Human
ucugggcugugggc

SEQ ID NO: 1306176 - RNA, 20 nt, Human
ucugggcuuauaucuggccu

SEQ ID NO: 1306177 - RNA, 21 nt, Human
ucugggcuuauaucuggccuc

SEQ ID NO: 1306178 - RNA, 13 nt, Human
ucugggcuuccug

SEQ ID NO: 1306179 - RNA, 14 nt, Human
ucugggcuuccugg

SEQ ID NO: 1306180 - RNA, 15 nt, Human
ucugggcuuccugga

SEQ ID NO: 1306181 - RNA, 22 nt, Human
ucuggguuccuuccucugagcc

SEQ ID NO: 1306182 - RNA, 23 nt, Human
ucuggguuccuuccucugagccu

SEQ ID NO: 1306183 - RNA, 15 nt, Human
ucuggguugccuuua

SEQ ID NO: 1306184 - RNA, 21 nt, Human
ucugguaauauugacuuguau

SEQ ID NO: 1306185 - RNA, 22 nt, Human
ucugguaauauugacuuguaua

SEQ ID NO: 1306186 - RNA, 18 nt, Human
ucugguagaagggaaagc

SEQ ID NO: 1306187 - RNA, 21 nt, Human
ucugguagaagggaaagccca

SEQ ID NO: 1306188 - RNA, 16 nt, Human
ucugggcuuccuggag

SEQ ID NO: 1306189 - RNA, 17 nt, Human
ucugggcuuccuggagc

SEQ ID NO: 1306190 - RNA, 19 nt, Human
ucugggcuuccuggagcag

SEQ ID NO: 1306191 - RNA, 18 nt, Human
ucugggcuuccuggagca

SEQ ID NO: 1306192 - RNA, 18 nt, Human
ucugggggcacaagacug

SEQ ID NO: 1306193 - RNA, 19 nt, Human
ucugggggcacaagacuga

SEQ ID NO: 1306194 - RNA, 15 nt, Human
ucugggggcugagga

SEQ ID NO: 1306195 - RNA, 19 nt, Human
ucugggggcugaggagcag

SEQ ID NO: 1306196 - RNA, 15 nt, Human
ucugggggcugcagu

SEQ ID NO: 1306197 - RNA, 13 nt, Human
ucugggggguggc

SEQ ID NO: 1306198 - RNA, 17 nt, Human
ucugggggguggccagg

SEQ ID NO: 1306199 - RNA, 18 nt, Human
ucugggggguggccaggc

SEQ ID NO: 1306200 - RNA, 19 nt, Human
ucugggggguggccaggcc

SEQ ID NO: 1306201 - RNA, 20 nt, Human
ucugggggguggccaggccg

SEQ ID NO: 1306202 - RNA, 21 nt, Human
ucugggguauggcguaaguac

SEQ ID NO: 1306203 - RNA, 17 nt, Human
ucuggggugggcaguuu

SEQ ID NO: 1306204 - RNA, 13 nt, Human
agaauuacuguaa

SEQ ID NO: 1306205 - RNA, 20 nt, Human
agaauuacuguaacugauua

SEQ ID NO: 1306206 - RNA, 16 nt, Human
agaaugucauuuuggu

SEQ ID NO: 1306207 - RNA, 20 nt, Human
agaaugucauuuugguacuu

SEQ ID NO: 1306208 - RNA, 23 nt, Human
agaaugucauuuugguacuuugg

SEQ ID NO: 1306209 - RNA, 21 nt, Human
agaaugugugucaauuuauaa

SEQ ID NO: 1306210 - RNA, 14 nt, Human
agaauguuaagacu

SEQ ID NO: 1306211 - RNA, 19 nt, Human
agaauguuaagacuugaca

SEQ ID NO: 1306212 - RNA, 21 nt, Human
agaauguuaagacuugacagu

SEQ ID NO: 1306213 - RNA, 14 nt, Human
agaaauuucacaua

SEQ ID NO: 1306214 - RNA, 19 nt, Human
agaacccagcccacccccg

SEQ ID NO: 1306215 - RNA, 19 nt, Human
agaaauucaauuuggauuu

SEQ ID NO: 1306216 - RNA, 22 nt, Human
agaaauucaauuuggauuuaaa

SEQ ID NO: 1306217 - RNA, 17 nt, Human
agaacccagcccacccc

SEQ ID NO: 1306218 - RNA, 17 nt, Human
agaaccccuacaugaaa

SEQ ID NO: 1306219 - RNA, 19 nt, Human
agaaccccuacaugaaaca

SEQ ID NO: 1306220 - RNA, 18 nt, Human
agaacccagcccaccccc

SEQ ID NO: 1306221 - RNA, 12 nt, Human
agacagaaaaaa

SEQ ID NO: 1306222 - RNA, 12 nt, Human
agacagaacacc

SEQ ID NO: 1306223 - RNA, 14 nt, Human
agacagaacaccua

SEQ ID NO: 1306224 - RNA, 18 nt, Human
agacagaacaccuaugca

SEQ ID NO: 1306225 - RNA, 15 nt, Human
agacagaaccacagg

SEQ ID NO: 1306226 - RNA, 19 nt, Human
agacagaaccacagggcua

SEQ ID NO: 1306227 - RNA, 22 nt, Human
agacacgcacggcagccacagc

SEQ ID NO: 1306228 - RNA, 12 nt, Human
agacaccaaagu

SEQ ID NO: 1306229 - RNA, 13 nt, Human
agacacuuuggaa

SEQ ID NO: 1306230 - RNA, 21 nt, Human
agacacgcacggcagccacag

SEQ ID NO: 1306231 - RNA, 20 nt, Human
agacacgcacggcagccaca

SEQ ID NO: 1306232 - RNA, 15 nt, Human
agacacgcacggcag

SEQ ID NO: 1306233 - RNA, 13 nt, Human
agacacgcacggc

SEQ ID NO: 1306234 - RNA, 17 nt, Human
agacagaaccccuacau

SEQ ID NO: 1306235 - RNA, 12 nt, Human
agacagaagaaa

SEQ ID NO: 1306236 - RNA, 14 nt, Human
agacagaagaaaca

SEQ ID NO: 1306237 - RNA, 15 nt, Human
agacagaagaaacaa

SEQ ID NO: 1306238 - RNA, 16 nt, Human
agacagaagaaacaag

SEQ ID NO: 1306239 - RNA, 17 nt, Human
agacagaagaaacaagg

SEQ ID NO: 1306240 - RNA, 13 nt, Human
agacacacuuguc

SEQ ID NO: 1306241 - RNA, 13 nt, Human
agacacaggcccu

SEQ ID NO: 1306242 - RNA, 17 nt, Human
agacacauuuuuuagga

SEQ ID NO: 1306243 - RNA, 20 nt, Human
agacacauuuuuuaggaaau

SEQ ID NO: 1306244 - RNA, 22 nt, Human
agacaccuuggacauccuccuc

SEQ ID NO: 1306245 - RNA, 16 nt, Human
agacacacugaagaag

SEQ ID NO: 1306246 - RNA, 13 nt, Human
agacacaccugag

SEQ ID NO: 1306247 - RNA, 14 nt, Human
agacacaccugagg

SEQ ID NO: 1306248 - RNA, 17 nt, Human
agacacacugaagaagc

SEQ ID NO: 1306249 - RNA, 12 nt, Human
ucuguuucaagg

SEQ ID NO: 1306250 - RNA, 23 nt, Human
ucuguuucaaggcacucuagauu

SEQ ID NO: 1306251 - RNA, 19 nt, Human
ucuuacugucuuuuuucua

SEQ ID NO: 1306252 - RNA, 12 nt, Human
ucuuacugcuug

SEQ ID NO: 1306253 - RNA, 20 nt, Human
ucuuacuuauuaucuucagg

SEQ ID NO: 1306254 - RNA, 15 nt, Human
ucuuacuuggaacug

SEQ ID NO: 1306255 - RNA, 22 nt, Human
ucuuacugcuuaauucaaauaa

SEQ ID NO: 1306256 - RNA, 15 nt, Human
ucuuacuauuucaca

SEQ ID NO: 1306257 - RNA, 13 nt, Human
ucuuacagcaggc

SEQ ID NO: 1306258 - RNA, 22 nt, Human
ucuuaccagaugcuuuccuguu

SEQ ID NO: 1306259 - RNA, 21 nt, Human
ucuuaccuguaugucuccagu

SEQ ID NO: 1306260 - RNA, 23 nt, Human
ucuuaccuguaugucuccaguau

SEQ ID NO: 1306261 - RNA, 23 nt, Human
ucuuagaugcaguucugaagaag

SEQ ID NO: 1306262 - RNA, 13 nt, Human
agacagugauauu

SEQ ID NO: 1306263 - RNA, 19 nt, Human
agacagugauauuggaacu

SEQ ID NO: 1306264 - RNA, 19 nt, Human
ucuuaauguacauagugcu

SEQ ID NO: 1306265 - RNA, 11 nt, Human
ucuuaauugcc

SEQ ID NO: 1306266 - RNA, 14 nt, Human
ucuuaauguacaua

SEQ ID NO: 1306267 - RNA, 13 nt, Human
ucuuaauguacau

SEQ ID NO: 1306268 - RNA, 15 nt, Human
ucuuaauguaucaaa

SEQ ID NO: 1306269 - RNA, 17 nt, Human
ucuuaauguaucaaacu

SEQ ID NO: 1306270 - RNA, 18 nt, Human
ucuuaauguaucaaacug

SEQ ID NO: 1306271 - RNA, 19 nt, Human
ucuuaauugccaccucuaa

SEQ ID NO: 1306272 - RNA, 19 nt, Human
ucuuacaauaauucuauga

SEQ ID NO: 1306273 - RNA, 14 nt, Human
agacaguucaagaa

SEQ ID NO: 1306274 - RNA, 15 nt, Human
agacaguucaagaaa

SEQ ID NO: 1306275 - RNA, 22 nt, Human
agacauuuuaaaaaauggucac

SEQ ID NO: 1306276 - RNA, 19 nt, Human
agacauuuuaaaaaauggu

SEQ ID NO: 1306277 - RNA, 15 nt, Human
agacauggagguucu

SEQ ID NO: 1306278 - RNA, 16 nt, Human
agacauggagguucua

SEQ ID NO: 1306279 - RNA, 17 nt, Human
agacauggagguucuaa

SEQ ID NO: 1306280 - RNA, 19 nt, Human
agacauggagguucuaagg

SEQ ID NO: 1306281 - RNA, 20 nt, Human
agacauggagguucuaaggc

SEQ ID NO: 1306282 - RNA, 21 nt, Human
agacauggagguucuaaggcc

SEQ ID NO: 1306283 - RNA, 14 nt, Human
agacauagaauuaa

SEQ ID NO: 1306284 - RNA, 20 nt, Human
agacauacuugaagggccag

SEQ ID NO: 1306285 - RNA, 21 nt, Human
agacauacuugaagggccaga

SEQ ID NO: 1306286 - RNA, 23 nt, Human
agacauacuugaagggccagagc

SEQ ID NO: 1306287 - RNA, 13 nt, Human
agacaugaagcca

SEQ ID NO: 1306288 - RNA, 15 nt, Human
agacaugauuuccuu

SEQ ID NO: 1306289 - RNA, 22 nt, Human
agacaugauuuccuugaaugug

SEQ ID NO: 1306290 - RNA, 14 nt, Human
agacaugcagagau

SEQ ID NO: 1306291 - RNA, 15 nt, Human
agacaugcagagauu

SEQ ID NO: 1306292 - RNA, 23 nt, Human
agacaugccacaaggacuuccug

SEQ ID NO: 1306293 - RNA, 24 nt, Human
ucuucuuaauguacauagugcuaa

SEQ ID NO: 1306294 - RNA, 16 nt, Human
ucuucuuaauguacau

SEQ ID NO: 1306295 - RNA, 17 nt, Human
ucuucuuaauguacaua

SEQ ID NO: 1306296 - RNA, 12 nt, Human
ucuucuuaugca

SEQ ID NO: 1306297 - RNA, 13 nt, Human
ucuucuucaccau

SEQ ID NO: 1306298 - RNA, 14 nt, Human
ucuucuucaccauu

SEQ ID NO: 1306299 - RNA, 15 nt, Human
ucuucuucaccauuu

SEQ ID NO: 1306300 - RNA, 14 nt, Human
ucuucuuccaggua

SEQ ID NO: 1306301 - RNA, 22 nt, Human
ucuucuucucguccucguuugu

SEQ ID NO: 1306302 - RNA, 13 nt, Human
ucuucuugaaauu

SEQ ID NO: 1306303 - RNA, 17 nt, Human
ucuucuugaaauuuuaa

SEQ ID NO: 1306304 - RNA, 13 nt, Human
agacauacuugaa

SEQ ID NO: 1306305 - RNA, 14 nt, Human
agacauacuugaag

SEQ ID NO: 1306306 - RNA, 16 nt, Human
agacauacuugaaggg

SEQ ID NO: 1306307 - RNA, 17 nt, Human
agacauacuugaagggc

SEQ ID NO: 1306308 - RNA, 19 nt, Human
agacauacuugaagggcca

SEQ ID NO: 1306309 - RNA, 18 nt, Human
ucuucugaauaaagcaau

SEQ ID NO: 1306310 - RNA, 15 nt, Human
ucuucugagcacugu

SEQ ID NO: 1306311 - RNA, 19 nt, Human
ucuucugagcuauuucauc

SEQ ID NO: 1306312 - RNA, 21 nt, Human
ucuucugagcuauuucaucua

SEQ ID NO: 1306313 - RNA, 16 nt, Human
ucuucugagcacuguu

SEQ ID NO: 1306314 - RNA, 17 nt, Human
ucuucugaauaaagcaa

SEQ ID NO: 1306315 - RNA, 16 nt, Human
ucuuauuucaugaaaa

SEQ ID NO: 1306316 - RNA, 18 nt, Human
ucuuauuucaugaaaauu

SEQ ID NO: 1306317 - RNA, 15 nt, Human
ucuuauucauuuucu

SEQ ID NO: 1306318 - RNA, 16 nt, Human
ucuuauucauuuucuc

SEQ ID NO: 1306319 - RNA, 20 nt, Human
ucuuauucccuuccugccag

SEQ ID NO: 1306320 - RNA, 14 nt, Human
ucuuauuucaugaa

SEQ ID NO: 1306321 - RNA, 23 nt, Human
ucuucugcauuuuucagagaaua

SEQ ID NO: 1306322 - RNA, 18 nt, Human
ucuucuggacugguuuuc

SEQ ID NO: 1306323 - RNA, 17 nt, Human
ucuucugggagggcagc

SEQ ID NO: 1306324 - RNA, 20 nt, Human
ucuucugggagggcagcagg

SEQ ID NO: 1306325 - RNA, 15 nt, Human
agaccgaucggcggc

SEQ ID NO: 1306326 - RNA, 17 nt, Human
agacccuuuuggguuuc

SEQ ID NO: 1306327 - RNA, 19 nt, Human
agacccuuuuggguuucug

SEQ ID NO: 1306328 - RNA, 15 nt, Human
agaccggccugccag

SEQ ID NO: 1306329 - RNA, 17 nt, Human
agaccggccugccagga

SEQ ID NO: 1306330 - RNA, 18 nt, Human
agaccggccugccaggag

SEQ ID NO: 1306331 - RNA, 19 nt, Human
agaccggccugccaggagg

SEQ ID NO: 1306332 - RNA, 20 nt, Human
agaccggccugccaggagga

SEQ ID NO: 1306333 - RNA, 23 nt, Human
agaccggccugccaggaggaccc

SEQ ID NO: 1306334 - RNA, 20 nt, Human
agacauuuuaaaaaaugguc

SEQ ID NO: 1306335 - RNA, 13 nt, Human
agaccaaaauaaa

SEQ ID NO: 1306336 - RNA, 15 nt, Human
agaccccuggcuuuu

SEQ ID NO: 1306337 - RNA, 21 nt, Human
agaccccuggcuuuucacugc

SEQ ID NO: 1306338 - RNA, 17 nt, Human
agacccuaaacauccau

SEQ ID NO: 1306339 - RNA, 20 nt, Human
agaccuacuguucuaaagcu

SEQ ID NO: 1306340 - RNA, 21 nt, Human
agaccuacuguucuaaagcuc

SEQ ID NO: 1306341 - RNA, 22 nt, Human
agaccuacuguucuaaagcucu

SEQ ID NO: 1306342 - RNA, 14 nt, Human
agaccucagaagua

SEQ ID NO: 1306343 - RNA, 15 nt, Human
agaccucagaaguaa

SEQ ID NO: 1306344 - RNA, 18 nt, Human
agaccucagugccuuccu

SEQ ID NO: 1306345 - RNA, 20 nt, Human
agaccucagugccuuccugu

SEQ ID NO: 1306346 - RNA, 19 nt, Human
agaccucuacugccuugga

SEQ ID NO: 1306347 - RNA, 18 nt, Human
agaccucugugcacuuau

SEQ ID NO: 1306348 - RNA, 13 nt, Human
agaccugaagaau

SEQ ID NO: 1306349 - RNA, 21 nt, Human
agacucaguggggaggggcug

SEQ ID NO: 1306350 - RNA, 21 nt, Human
ucuugaguuugucgcucaugu

SEQ ID NO: 1306351 - RNA, 18 nt, Human
ucuugaguuuuucaggua

SEQ ID NO: 1306352 - RNA, 22 nt, Human
ucuugaguuugucgcucaugug

SEQ ID NO: 1306353 - RNA, 16 nt, Human
agaccugccccuccuc

SEQ ID NO: 1306354 - RNA, 15 nt, Human
agaccugaauucuuu

SEQ ID NO: 1306355 - RNA, 22 nt, Human
agaccugccccuccucucugcc

SEQ ID NO: 1306356 - RNA, 23 nt, Human
agaccugccccuccucucugccc

SEQ ID NO: 1306357 - RNA, 14 nt, Human
agacuauuuuuaga

SEQ ID NO: 1306358 - RNA, 21 nt, Human
agacuauuuuuagauuuucuu

SEQ ID NO: 1306359 - RNA, 15 nt, Human
agacucaaauguucu

SEQ ID NO: 1306360 - RNA, 16 nt, Human
agacucaaauguucua

SEQ ID NO: 1306361 - RNA, 17 nt, Human
agacucaaauguucuaa

SEQ ID NO: 1306362 - RNA, 20 nt, Human
agacucaaauguucuaaguu

SEQ ID NO: 1306363 - RNA, 23 nt, Human
agacucaaauguucuaaguuucu

SEQ ID NO: 1306364 - RNA, 22 nt, Human
agacuggguaggaaagaggaag

SEQ ID NO: 1306365 - RNA, 18 nt, Human
agacuggguaggaaagag

SEQ ID NO: 1306366 - RNA, 17 nt, Human
agacuuagggcaccagg

SEQ ID NO: 1306367 - RNA, 19 nt, Human
agacuucccacggcuccuc

SEQ ID NO: 1306368 - RNA, 14 nt, Human
agacuucccagcua

SEQ ID NO: 1306369 - RNA, 14 nt, Human
agacuuccuagacu

SEQ ID NO: 1306370 - RNA, 14 nt, Human
agacugucucaaga

SEQ ID NO: 1306371 - RNA, 18 nt, Human
agacuuaagcccagugca

SEQ ID NO: 1306372 - RNA, 20 nt, Human
agacuuacagcaaauccuuu

SEQ ID NO: 1306373 - RNA, 18 nt, Human
agacuuacagcaaauccu

SEQ ID NO: 1306374 - RNA, 23 nt, Human
agacuuacagggauaaggccugu

SEQ ID NO: 1306375 - RNA, 15 nt, Human
agacuuacagcaaau

SEQ ID NO: 1306376 - RNA, 14 nt, Human
agacuuacucuaag

SEQ ID NO: 1306377 - RNA, 15 nt, Human
agacuuacucuaaga

SEQ ID NO: 1306378 - RNA, 16 nt, Human
agacuuacucuaagau

SEQ ID NO: 1306379 - RNA, 18 nt, Human
agacuuacucuaagaucu

SEQ ID NO: 1306380 - RNA, 16 nt, Human
agacuuagggcaccag

SEQ ID NO: 1306381 - RNA, 19 nt, Human
agacuuuuuuuaaauagua

SEQ ID NO: 1306382 - RNA, 16 nt, Human
agacuuuauguaguuu

SEQ ID NO: 1306383 - RNA, 22 nt, Human
agacuuuccauuacaaguauuu

SEQ ID NO: 1306384 - RNA, 17 nt, Human
agacuuuauguaguuuu

SEQ ID NO: 1306385 - RNA, 15 nt, Human
agacuuuccauuaca

SEQ ID NO: 1306386 - RNA, 18 nt, Human
agacuuguaugaaagaug

SEQ ID NO: 1306387 - RNA, 11 nt, Human
agacuuguugg

SEQ ID NO: 1306388 - RNA, 16 nt, Human
agacuuguuggcguag

SEQ ID NO: 1306389 - RNA, 21 nt, Human
agacuuguuggcguaggcuac

SEQ ID NO: 1306390 - RNA, 12 nt, Human
agacuuuaacau

SEQ ID NO: 1306391 - RNA, 21 nt, Human
agacuuuaacauaagcuauuu

SEQ ID NO: 1306392 - RNA, 17 nt, Human
agacuuuaacauaagcu

SEQ ID NO: 1306393 - RNA, 16 nt, Human
agacuucucuuugccu

SEQ ID NO: 1306394 - RNA, 17 nt, Human
agacuucucuuugccuc

SEQ ID NO: 1306395 - RNA, 18 nt, Human
agacuucucuuugccuca

SEQ ID NO: 1306396 - RNA, 20 nt, Human
agacuucucuuugccucaaa

SEQ ID NO: 1306397 - RNA, 19 nt, Human
agacuucucuuugccucaa

SEQ ID NO: 1306398 - RNA, 21 nt, Human
agacuugguugguaggguggg

SEQ ID NO: 1306399 - RNA, 22 nt, Human
agacuugguugguaggguggga

SEQ ID NO: 1306400 - RNA, 24 nt, Human
agagacagaaagcagaacagugau

SEQ ID NO: 1306401 - RNA, 20 nt, Human
agagacaaacaccucccagg

SEQ ID NO: 1306402 - RNA, 14 nt, Human
agagacagcccagg

SEQ ID NO: 1306403 - RNA, 15 nt, Human
agagacagcccagga

SEQ ID NO: 1306404 - RNA, 14 nt, Human
agagaaaaaagcca

SEQ ID NO: 1306405 - RNA, 22 nt, Human
agagaauuucuaccauuucaga

SEQ ID NO: 1306406 - RNA, 23 nt, Human
agagaauuucuaccauuucagag

SEQ ID NO: 1306407 - RNA, 19 nt, Human
agagacaaacaccucccag

SEQ ID NO: 1306408 - RNA, 21 nt, Human
agagacaaacaccucccagga

SEQ ID NO: 1306409 - RNA, 12 nt, Human
agagacaaagcu

SEQ ID NO: 1306410 - RNA, 13 nt, Human
ucuuuaauucugu

SEQ ID NO: 1306411 - RNA, 19 nt, Human
ucuuguaauccgaaucucu

SEQ ID NO: 1306412 - RNA, 12 nt, Human
ucuuuauaagaa

SEQ ID NO: 1306413 - RNA, 13 nt, Human
ucuuuauaagaaa

SEQ ID NO: 1306414 - RNA, 14 nt, Human
ucuuuaauuuuaca

SEQ ID NO: 1306415 - RNA, 20 nt, Human
ucuugguuuucccuuugccu

SEQ ID NO: 1306416 - RNA, 23 nt, Human
ucuugguugaaaauaaaaagauc

SEQ ID NO: 1306417 - RNA, 13 nt, Human
ucuugguugagga

SEQ ID NO: 1306418 - RNA, 15 nt, Human
ucuugguugaggaaa

SEQ ID NO: 1306419 - RNA, 19 nt, Human
ucuugguugaaaauaaaaa

SEQ ID NO: 1306420 - RNA, 16 nt, Human
ucuugaucaguuaaga

SEQ ID NO: 1306421 - RNA, 17 nt, Human
ucuugaucaguuaagaa

SEQ ID NO: 1306422 - RNA, 17 nt, Human
ucuugauaccccccucu

SEQ ID NO: 1306423 - RNA, 20 nt, Human
ucuugauaccccccucuguc

SEQ ID NO: 1306424 - RNA, 21 nt, Human
ucuugauaccccccucugucu

SEQ ID NO: 1306425 - RNA, 22 nt, Human
ucuugauaccccccucugucuu

SEQ ID NO: 1306426 - RNA, 15 nt, Human
ucuuucuuccucugc

SEQ ID NO: 1306427 - RNA, 16 nt, Human
ucuuucuuccucugcu

SEQ ID NO: 1306428 - RNA, 17 nt, Human
ucuuucuuccucugcug

SEQ ID NO: 1306429 - RNA, 17 nt, Human
agacuccuucaacaauu

SEQ ID NO: 1306430 - RNA, 21 nt, Human
agacuccuucaacaauucuaa

SEQ ID NO: 1306431 - RNA, 14 nt, Human
ucuuuauaagaaag

SEQ ID NO: 1306432 - RNA, 15 nt, Human
ucuuuauaagaaagc

SEQ ID NO: 1306433 - RNA, 16 nt, Human
ucuuuauaagaaagcc

SEQ ID NO: 1306434 - RNA, 17 nt, Human
ucuuuauaagaaagccu

SEQ ID NO: 1306435 - RNA, 19 nt, Human
ucuuuauaagaaagccuga

SEQ ID NO: 1306436 - RNA, 14 nt, Human
ucuuuauacagcug

SEQ ID NO: 1306437 - RNA, 15 nt, Human
ucuuuauacagcugu

SEQ ID NO: 1306438 - RNA, 16 nt, Human
ucuuuauacagcugua

SEQ ID NO: 1306439 - RNA, 13 nt, Human
ucuuucuuccaaa

SEQ ID NO: 1306440 - RNA, 14 nt, Human
ucuuucuuccucug

SEQ ID NO: 1306441 - RNA, 13 nt, Human
ucugauacagaaa

SEQ ID NO: 1306442 - RNA, 19 nt, Human
ucugauaagagaaucaaca

SEQ ID NO: 1306443 - RNA, 15 nt, Human
ucugauaaugaaaau

SEQ ID NO: 1306444 - RNA, 14 nt, Human
ucugaguuuuacca

SEQ ID NO: 1306445 - RNA, 16 nt, Human
ucugaguuuuaccaaa

SEQ ID NO: 1306446 - RNA, 14 nt, Human
ucugaguuuugugu

SEQ ID NO: 1306447 - RNA, 20 nt, Human
ucugaguuuuguguuuguug

SEQ ID NO: 1306448 - RNA, 23 nt, Human
ucugaugcaagcaagaaacacug

SEQ ID NO: 1306449 - RNA, 13 nt, Human
ucugaugcagcuu

SEQ ID NO: 1306450 - RNA, 17 nt, Human
ucugaugcagcuuauac

SEQ ID NO: 1306451 - RNA, 16 nt, Human
ucugaugcagcuuaua

SEQ ID NO: 1306452 - RNA, 15 nt, Human
ucugauguacucuaa

SEQ ID NO: 1306453 - RNA, 16 nt, Human
ucugauguacucuaaa

SEQ ID NO: 1306454 - RNA, 17 nt, Human
ucugauguacucuaaau

SEQ ID NO: 1306455 - RNA, 19 nt, Human
ucugauuaaaaugcuuccu

SEQ ID NO: 1306456 - RNA, 14 nt, Human
ucugaccuuaaaug

SEQ ID NO: 1306457 - RNA, 14 nt, Human
ucugagagaggcca

SEQ ID NO: 1306458 - RNA, 20 nt, Human
ucugagagaggccauucuuu

SEQ ID NO: 1306459 - RNA, 17 nt, Human
ucugaguuccugcaugc

SEQ ID NO: 1306460 - RNA, 17 nt, Human
agaaauuuauaaacuuu

SEQ ID NO: 1306461 - RNA, 16 nt, Human
agaaauuuauaaacuu

SEQ ID NO: 1306462 - RNA, 22 nt, Human
agaaauuaugugccagauuuau

SEQ ID NO: 1306463 - RNA, 21 nt, Human
agaaauuaugugccagauuua

SEQ ID NO: 1306464 - RNA, 13 nt, Human
agaaauuaugugc

SEQ ID NO: 1306465 - RNA, 19 nt, Human
ucugcaggucccuaauaaa

SEQ ID NO: 1306466 - RNA, 18 nt, Human
ucugcaggucccuaauaa

SEQ ID NO: 1306467 - RNA, 17 nt, Human
ucugcaggucccuaaua

SEQ ID NO: 1306468 - RNA, 16 nt, Human
ucugcaggucccuaau

SEQ ID NO: 1306469 - RNA, 15 nt, Human
ucugcaggucccuaa

SEQ ID NO: 1306470 - RNA, 11 nt, Human
ucugcagccuc

SEQ ID NO: 1306471 - RNA, 13 nt, Human
ucugcagccucag

SEQ ID NO: 1306472 - RNA, 14 nt, Human
ucugcagccucaga

SEQ ID NO: 1306473 - RNA, 17 nt, Human
agaaaugaaaaaauaua

SEQ ID NO: 1306474 - RNA, 15 nt, Human
agaaaucuaaaaaac

SEQ ID NO: 1306475 - RNA, 22 nt, Human
agaaaucauuuugcaaucccuu

SEQ ID NO: 1306476 - RNA, 12 nt, Human
agaaaucuaaaa

SEQ ID NO: 1306477 - RNA, 14 nt, Human
agaaaucauagcug

SEQ ID NO: 1306478 - RNA, 14 nt, Human
agaaagaaaaucag

SEQ ID NO: 1306479 - RNA, 15 nt, Human
agaaacuuucuuucu

SEQ ID NO: 1306480 - RNA, 15 nt, Human
agaaacuuuuuuauu

SEQ ID NO: 1306481 - RNA, 19 nt, Human
agaaacuuuuuuauuuaaa

SEQ ID NO: 1306482 - RNA, 19 nt, Human
agaaagccugggugacauu

SEQ ID NO: 1306483 - RNA, 20 nt, Human
agaaagccugggugacauuu

SEQ ID NO: 1306484 - RNA, 21 nt, Human
agaaagccugggugacauuug

SEQ ID NO: 1306485 - RNA, 19 nt, Human
agaaacuuccaaauccccu

SEQ ID NO: 1306486 - RNA, 13 nt, Human
agaaagccuucuu

SEQ ID NO: 1306487 - RNA, 15 nt, Human
agaaagccuucuuuu

SEQ ID NO: 1306488 - RNA, 11 nt, Human
agaaagcucaa

SEQ ID NO: 1306489 - RNA, 13 nt, Human
agaaagcugacuu

SEQ ID NO: 1306490 - RNA, 15 nt, Human
agaaagcugacuugg

SEQ ID NO: 1306491 - RNA, 16 nt, Human
agaaagcugacuuggc

SEQ ID NO: 1306492 - RNA, 17 nt, Human
agaaagcugacuuggcu

SEQ ID NO: 1306493 - RNA, 20 nt, Human
agaaagcugacuuggcuggu

SEQ ID NO: 1306494 - RNA, 21 nt, Human
agaaagcugacuuggcuggug

SEQ ID NO: 1306495 - RNA, 22 nt, Human
agaaagcugacuuggcuggugu

SEQ ID NO: 1306496 - RNA, 23 nt, Human
agaaagcugacuuggcuggugug

SEQ ID NO: 1306497 - RNA, 13 nt, Human
agaaagcugccug

SEQ ID NO: 1306498 - RNA, 18 nt, Human
agaaaggaaaaacaaacu

SEQ ID NO: 1306499 - RNA, 15 nt, Human
agaaaggaagcauug

SEQ ID NO: 1306500 - RNA, 17 nt, Human
agaaaggaagcauugua

SEQ ID NO: 1306501 - RNA, 18 nt, Human
agaaaggaagcauuguaa

SEQ ID NO: 1306502 - RNA, 23 nt, Human
agaaaugaaaaaauauauaucaa

SEQ ID NO: 1306503 - RNA, 18 nt, Human
agaaaugaaaaaauauau

SEQ ID NO: 1306504 - RNA, 14 nt, Human
agaaaugaaagcag

SEQ ID NO: 1306505 - RNA, 12 nt, Human
ucugaagaagau

SEQ ID NO: 1306506 - RNA, 17 nt, Human
agaaaucauuuugcaau

SEQ ID NO: 1306507 - RNA, 16 nt, Human
ucugaagcccucccag

SEQ ID NO: 1306508 - RNA, 17 nt, Human
ucugaagcccucccagg

SEQ ID NO: 1306509 - RNA, 15 nt, Human
ucugaauuuuuaaac

SEQ ID NO: 1306510 - RNA, 18 nt, Human
ucugaagucacugcacag

SEQ ID NO: 1306511 - RNA, 15 nt, Human
ucugaagucacugca

SEQ ID NO: 1306512 - RNA, 16 nt, Human
ucugaagucacugcac

SEQ ID NO: 1306513 - RNA, 16 nt, Human
ucugacaacagacuuc

SEQ ID NO: 1306514 - RNA, 15 nt, Human
ucugacaacagacuu

SEQ ID NO: 1306515 - RNA, 16 nt, Human
ucugaauuuuuaaaca

SEQ ID NO: 1306516 - RNA, 17 nt, Human
ucugaauuuuuaaacaa

SEQ ID NO: 1306517 - RNA, 19 nt, Human
ucugaauuuuuaaacaagu

SEQ ID NO: 1306518 - RNA, 17 nt, Human
ucucucacuuguuuuau

SEQ ID NO: 1306519 - RNA, 21 nt, Human
ucucucacuuguuuuauuuaa

SEQ ID NO: 1306520 - RNA, 18 nt, Human
acuuucucaguuuucaua

SEQ ID NO: 1306521 - RNA, 15 nt, Human
ucucucauacccucc

SEQ ID NO: 1306522 - RNA, 12 nt, Human
ucucucagguga

SEQ ID NO: 1306523 - RNA, 13 nt, Human
ucucucaggugaa

SEQ ID NO: 1306524 - RNA, 23 nt, Human
ucucucacucccucccuuucuau

SEQ ID NO: 1306525 - RNA, 16 nt, Human
ucucucagggccaggc

SEQ ID NO: 1306526 - RNA, 12 nt, Human
ucucucaugaac

SEQ ID NO: 1306527 - RNA, 15 nt, Human
ucucucaugaaccuc

SEQ ID NO: 1306528 - RNA, 17 nt, Human
ucucucaugaaccucaa

SEQ ID NO: 1306529 - RNA, 22 nt, Human
ucucucaugaaccucaagcugc

SEQ ID NO: 1306530 - RNA, 16 nt, Human
ucucucauugucugug

SEQ ID NO: 1306531 - RNA, 16 nt, Human
ucucuccacuuucagc

SEQ ID NO: 1306532 - RNA, 17 nt, Human
ucucuccacuuucagcu

SEQ ID NO: 1306533 - RNA, 20 nt, Human
ucucuccacuuucagcuguc

SEQ ID NO: 1306534 - RNA, 15 nt, Human
ucucuggaauuugaa

SEQ ID NO: 1306535 - RNA, 19 nt, Human
ucucuggaauuugaaacac

SEQ ID NO: 1306536 - RNA, 19 nt, Human
ucucuggaagccccugggc

SEQ ID NO: 1306537 - RNA, 20 nt, Human
ucucuggaagccccugggcc

SEQ ID NO: 1306538 - RNA, 12 nt, Human
ucucuggccuuc

SEQ ID NO: 1306539 - RNA, 18 nt, Human
ucucuccacuuucagcug

SEQ ID NO: 1306540 - RNA, 19 nt, Human
ucucuccacuuucagcugu

SEQ ID NO: 1306541 - RNA, 15 nt, Human
ucucuccagcugacu

SEQ ID NO: 1306542 - RNA, 21 nt, Human
agaaaacuuguauuaugugug

SEQ ID NO: 1306543 - RNA, 14 nt, Human
agaaaaagaagcaa

SEQ ID NO: 1306544 - RNA, 23 nt, Human
agaaacacguaucccaccugaca

SEQ ID NO: 1306545 - RNA, 13 nt, Human
agaaacacucaag

SEQ ID NO: 1306546 - RNA, 17 nt, Human
agaaacaguugguaacu

SEQ ID NO: 1306547 - RNA, 18 nt, Human
agaaacaguugguaacuu

SEQ ID NO: 1306548 - RNA, 19 nt, Human
agaaacaguugguaacuuu

SEQ ID NO: 1306549 - RNA, 18 nt, Human
agaaaccuuuuuaaaaau

SEQ ID NO: 1306550 - RNA, 15 nt, Human
agaaacgucuucuaa

SEQ ID NO: 1306551 - RNA, 16 nt, Human
agaaacgucuucuaaa

SEQ ID NO: 1306552 - RNA, 18 nt, Human
agaaacgucuucuaaacu

SEQ ID NO: 1306553 - RNA, 21 nt, Human
agaaacgucuucuaaacuucc

SEQ ID NO: 1306554 - RNA, 14 nt, Human
agaaacuuccaaau

SEQ ID NO: 1306555 - RNA, 21 nt, Human
ucucuuuaaaaggaaagaaaa

SEQ ID NO: 1306556 - RNA, 19 nt, Human
ucucuuuaaaaggaaagaa

SEQ ID NO: 1306557 - RNA, 18 nt, Human
ucucuuuaaaaggaaaga

SEQ ID NO: 1306558 - RNA, 21 nt, Human
ucucuugccucaaccucccaa

SEQ ID NO: 1306559 - RNA, 13 nt, Human
ucucuugccucaa

SEQ ID NO: 1306560 - RNA, 16 nt, Human
ucucuugggaacugaa

SEQ ID NO: 1306561 - RNA, 23 nt, Human
ucucuugggaacugaacucacuu

SEQ ID NO: 1306562 - RNA, 14 nt, Human
ucucuugaguuugu

SEQ ID NO: 1306563 - RNA, 15 nt, Human
ucucuugaguuuguc

SEQ ID NO: 1306564 - RNA, 12 nt, Human
ucucuugauuuu

SEQ ID NO: 1306565 - RNA, 12 nt, Human
ucucuugccuca

SEQ ID NO: 1306566 - RNA, 13 nt, Human
ucucuggccuucg

SEQ ID NO: 1306567 - RNA, 23 nt, Human
ucucuggccuucggccuccaucc

SEQ ID NO: 1306568 - RNA, 22 nt, Human
ucucuggccuucggccuccauc

SEQ ID NO: 1306569 - RNA, 21 nt, Human
ucucuggccuucggccuccau

SEQ ID NO: 1306570 - RNA, 16 nt, Human
ucucagcucacugcaa

SEQ ID NO: 1306571 - RNA, 15 nt, Human
ucucagcucacugca

SEQ ID NO: 1306572 - RNA, 18 nt, Human
ucucagcucacugcaacc

SEQ ID NO: 1306573 - RNA, 16 nt, Human
ucucagcucaucuuca

SEQ ID NO: 1306574 - RNA, 15 nt, Human
ucucagcuaagcuca

SEQ ID NO: 1306575 - RNA, 20 nt, Human
ucucagcucaucuucacugc

SEQ ID NO: 1306576 - RNA, 16 nt, Human
ucucagcuccaggugg

SEQ ID NO: 1306577 - RNA, 21 nt, Human
ucucagcuccagguggcucug

SEQ ID NO: 1306578 - RNA, 13 nt, Human
ucucaggcugccu

SEQ ID NO: 1306579 - RNA, 14 nt, Human
ucucaggcugccug

SEQ ID NO: 1306580 - RNA, 15 nt, Human
ucucaggcugccuga

SEQ ID NO: 1306581 - RNA, 16 nt, Human
ucucaggcugccugag

SEQ ID NO: 1306582 - RNA, 17 nt, Human
ucucaggcugccugagu

SEQ ID NO: 1306583 - RNA, 14 nt, Human
ucucagggccaggc

SEQ ID NO: 1306584 - RNA, 17 nt, Human
ucucagggccaggccuc

SEQ ID NO: 1306585 - RNA, 15 nt, Human
ucucauuaaaagaau

SEQ ID NO: 1306586 - RNA, 16 nt, Human
ucucauuaaaagaaua

SEQ ID NO: 1306587 - RNA, 20 nt, Human
ucucauuaaaagaauaucug

SEQ ID NO: 1306588 - RNA, 14 nt, Human
ucucauugcucuga

SEQ ID NO: 1306589 - RNA, 15 nt, Human
ucucauugcuuacaa

SEQ ID NO: 1306590 - RNA, 14 nt, Human
ucucauuggaaauu

SEQ ID NO: 1306591 - RNA, 17 nt, Human
ucucauuggaaauuuag

SEQ ID NO: 1306592 - RNA, 19 nt, Human
ucucauuggaaauuuagca

SEQ ID NO: 1306593 - RNA, 20 nt, Human
ucucauuggaaauuuagcau

SEQ ID NO: 1306594 - RNA, 21 nt, Human
ucucauuggaaauuuagcauu

SEQ ID NO: 1306595 - RNA, 23 nt, Human
ucucauuggaaauuuagcauugu

SEQ ID NO: 1306596 - RNA, 19 nt, Human
ucucauuggacccuuccau

SEQ ID NO: 1306597 - RNA, 14 nt, Human
ucuccaaaccacuu

SEQ ID NO: 1306598 - RNA, 22 nt, Human
ucuccaaacugaagcagccucu

SEQ ID NO: 1306599 - RNA, 20 nt, Human
ucucauuggacccuuccaug

SEQ ID NO: 1306600 - RNA, 20 nt, Human
ucuccaacaucacagcccag

SEQ ID NO: 1306601 - RNA, 23 nt, Human
ucuccaaacugaagcagccucuc

SEQ ID NO: 1306602 - RNA, 24 nt, Human
ucucauuggaaauuuagcauugua

SEQ ID NO: 1306603 - RNA, 17 nt, Human
ucuccaacaucacagcc

SEQ ID NO: 1306604 - RNA, 19 nt, Human
ucuccaacaucacagccca

SEQ ID NO: 1306605 - RNA, 21 nt, Human
ucuccaacaucacagcccagc

SEQ ID NO: 1306606 - RNA, 13 nt, Human
ucuccaagcagcu

SEQ ID NO: 1306607 - RNA, 19 nt, Human
ucuccaagcagcuuagagu

SEQ ID NO: 1306608 - RNA, 17 nt, Human
ucuccaggggcugcuuc

SEQ ID NO: 1306609 - RNA, 18 nt, Human
ucuccaggggcugcuucc

SEQ ID NO: 1306610 - RNA, 20 nt, Human
ucuccaggggcugcuuccuc

SEQ ID NO: 1306611 - RNA, 22 nt, Human
ucuccaggggcugcuuccuccu

SEQ ID NO: 1306612 - RNA, 23 nt, Human
ucuccaggggcugcuuccuccug

SEQ ID NO: 1306613 - RNA, 19 nt, Human
ucuccaguauccacuuugc

SEQ ID NO: 1306614 - RNA, 15 nt, Human
ucuccagugcaccug

SEQ ID NO: 1306615 - RNA, 18 nt, Human
ucuccaguggauucccag

SEQ ID NO: 1306616 - RNA, 13 nt, Human
ucuccauccacau

SEQ ID NO: 1306617 - RNA, 19 nt, Human
ucuccauccacaugggagc

SEQ ID NO: 1306618 - RNA, 16 nt, Human
acuuguguuuugcaag

SEQ ID NO: 1306619 - RNA, 20 nt, Human
ucuccuccaugggagaaaau

SEQ ID NO: 1306620 - RNA, 12 nt, Human
ucuccucccagg

SEQ ID NO: 1306621 - RNA, 17 nt, Human
acuuucuauccucugua

SEQ ID NO: 1306622 - RNA, 13 nt, Human
acuuucucaguuu

SEQ ID NO: 1306623 - RNA, 14 nt, Human
acuuucucaguuuu

SEQ ID NO: 1306624 - RNA, 17 nt, Human
acuuucucaguuuucau

SEQ ID NO: 1306625 - RNA, 12 nt, Human
acuuuaaagcgu

SEQ ID NO: 1306626 - RNA, 13 nt, Human
acuuuaaauugug

SEQ ID NO: 1306627 - RNA, 14 nt, Human
acuuuaacauaagc

SEQ ID NO: 1306628 - RNA, 16 nt, Human
acuuuaacauaagcua

SEQ ID NO: 1306629 - RNA, 18 nt, Human
acuuuaacauaagcuauu

SEQ ID NO: 1306630 - RNA, 19 nt, Human
acuuuaacauaagcuauuu

SEQ ID NO: 1306631 - RNA, 23 nt, Human
acuuuaacauaagcuauuuuucu

SEQ ID NO: 1306632 - RNA, 16 nt, Human
acuuuaacuucuguuu

SEQ ID NO: 1306633 - RNA, 20 nt, Human
acuuuaacuucuguuuuacc

SEQ ID NO: 1306634 - RNA, 19 nt, Human
acuuuaauuaccaaccugu

SEQ ID NO: 1306635 - RNA, 19 nt, Human
ucuccuaagcuggagugca

SEQ ID NO: 1306636 - RNA, 22 nt, Human
ucuccguuagcuccuguggccc

SEQ ID NO: 1306637 - RNA, 23 nt, Human
ucuccguuagcuccuguggcccc

SEQ ID NO: 1306638 - RNA, 21 nt, Human
ucuccguuagcuccuguggcc

SEQ ID NO: 1306639 - RNA, 23 nt, Human
ucuccuaagcaccuguaaugugc

SEQ ID NO: 1306640 - RNA, 14 nt, Human
ucuccuagccccug

SEQ ID NO: 1306641 - RNA, 15 nt, Human
ucuccuaggcauucu

SEQ ID NO: 1306642 - RNA, 19 nt, Human
ucuccuaggcauucuggac

SEQ ID NO: 1306643 - RNA, 23 nt, Human
ucuccuaggcauucuggaccucu

SEQ ID NO: 1306644 - RNA, 21 nt, Human
ucuccuaggcauucuggaccu

SEQ ID NO: 1306645 - RNA, 13 nt, Human
ucucccaguuguc

SEQ ID NO: 1306646 - RNA, 23 nt, Human
ucucccauuuuggaauuugccug

SEQ ID NO: 1306647 - RNA, 17 nt, Human
ucuccauggcccugcca

SEQ ID NO: 1306648 - RNA, 16 nt, Human
ucuccauggcccugcc

SEQ ID NO: 1306649 - RNA, 15 nt, Human
ucuccauggcccugc

SEQ ID NO: 1306650 - RNA, 18 nt, Human
ucuccauggcccugcaaa

SEQ ID NO: 1306651 - RNA, 14 nt, Human
ucuccauggcccug

SEQ ID NO: 1306652 - RNA, 24 nt, Human
ucuccauggcccugccaugcucuc

SEQ ID NO: 1306653 - RNA, 20 nt, Human
ucuccauggcccugccaugc

SEQ ID NO: 1306654 - RNA, 15 nt, Human
ucuccauucugcucc

SEQ ID NO: 1306655 - RNA, 16 nt, Human
ucuccauucugcuccu

SEQ ID NO: 1306656 - RNA, 12 nt, Human
ucucccacccuc

SEQ ID NO: 1306657 - RNA, 13 nt, Human
ucucccacccucu

SEQ ID NO: 1306658 - RNA, 14 nt, Human
ucucccacccucuu

SEQ ID NO: 1306659 - RNA, 15 nt, Human
ucucccacccucuuc

SEQ ID NO: 1306660 - RNA, 16 nt, Human
ucucccacccucuucc

SEQ ID NO: 1306661 - RNA, 17 nt, Human
ucucccacccucuuccu

SEQ ID NO: 1306662 - RNA, 20 nt, Human
ucucccacccucuuccuacu

SEQ ID NO: 1306663 - RNA, 14 nt, Human
ucucccaccuagca

SEQ ID NO: 1306664 - RNA, 19 nt, Human
ucucccacccucuuccuac

SEQ ID NO: 1306665 - RNA, 19 nt, Human
ucucccacuagacaagucc

SEQ ID NO: 1306666 - RNA, 14 nt, Human
ucucccacucuccu

SEQ ID NO: 1306667 - RNA, 15 nt, Human
ucucccacucuccua

SEQ ID NO: 1306668 - RNA, 16 nt, Human
ucucccacucuccuag

SEQ ID NO: 1306669 - RNA, 16 nt, Human
ucucccagauaaugug

SEQ ID NO: 1306670 - RNA, 18 nt, Human
ucucccagauaaugugaa

SEQ ID NO: 1306671 - RNA, 21 nt, Human
ucucccagauaaugugaaaau

SEQ ID NO: 1306672 - RNA, 23 nt, Human
ucucccagauaaugugaaaaugg

SEQ ID NO: 1306673 - RNA, 14 nt, Human
acuugcucuugaug

SEQ ID NO: 1306674 - RNA, 17 nt, Human
acuuggaguggagagga

SEQ ID NO: 1306675 - RNA, 18 nt, Human
acuuggauacuuggauuu

SEQ ID NO: 1306676 - RNA, 16 nt, Human
acuuggauucuuucca

SEQ ID NO: 1306677 - RNA, 17 nt, Human
acuuggauucuuuccau

SEQ ID NO: 1306678 - RNA, 18 nt, Human
acuuggauucuuuccauu

SEQ ID NO: 1306679 - RNA, 22 nt, Human
acuuggauucuuuccauuugca

SEQ ID NO: 1306680 - RNA, 20 nt, Human
acuuggauuuaguuucagua

SEQ ID NO: 1306681 - RNA, 13 nt, Human
acuuggcagccuu

SEQ ID NO: 1306682 - RNA, 14 nt, Human
acuuggcagccuug

SEQ ID NO: 1306683 - RNA, 15 nt, Human
acuuggcagccuugu

SEQ ID NO: 1306684 - RNA, 17 nt, Human
acuuggcagccuuguga

SEQ ID NO: 1306685 - RNA, 15 nt, Human
acuuggccucucucu

SEQ ID NO: 1306686 - RNA, 16 nt, Human
acuugaggacacaugu

SEQ ID NO: 1306687 - RNA, 15 nt, Human
acuugaggacacaug

SEQ ID NO: 1306688 - RNA, 17 nt, Human
acuugccucuuccuuga

SEQ ID NO: 1306689 - RNA, 13 nt, Human
acuugccugccuu

SEQ ID NO: 1306690 - RNA, 14 nt, Human
acuugccugccuuu

SEQ ID NO: 1306691 - RNA, 18 nt, Human
acuugccugccuuuccau

SEQ ID NO: 1306692 - RNA, 21 nt, Human
acuugccugccuuuccaucca

SEQ ID NO: 1306693 - RNA, 17 nt, Human
acuugcgagaaauucgu

SEQ ID NO: 1306694 - RNA, 22 nt, Human
acuugcgagaaauucguguguu

SEQ ID NO: 1306695 - RNA, 20 nt, Human
acuugcgguuccggcaugga

SEQ ID NO: 1306696 - RNA, 22 nt, Human
acuugcucagguacuuguaaau

SEQ ID NO: 1306697 - RNA, 20 nt, Human
acuugcucagguacuuguaa

SEQ ID NO: 1306698 - RNA, 23 nt, Human
acuugucccgggacaccuaggcu

SEQ ID NO: 1306699 - RNA, 24 nt, Human
acuugucauuguuauauaaucauu

SEQ ID NO: 1306700 - RNA, 19 nt, Human
acuuggcucacacucgaca

SEQ ID NO: 1306701 - RNA, 18 nt, Human
acuuggcucgaaucucug

SEQ ID NO: 1306702 - RNA, 19 nt, Human
acuuggcucgaaucucugu

SEQ ID NO: 1306703 - RNA, 20 nt, Human
acuuggcucgaaucucugug

SEQ ID NO: 1306704 - RNA, 21 nt, Human
acuuggcucgaaucucugugc

SEQ ID NO: 1306705 - RNA, 20 nt, Human
acuugucacagaugcagauu

SEQ ID NO: 1306706 - RNA, 19 nt, Human
acuugucaggagugugugu

SEQ ID NO: 1306707 - RNA, 13 nt, Human
acuugucauguga

SEQ ID NO: 1306708 - RNA, 21 nt, Human
acuugucaggaguguguguga

SEQ ID NO: 1306709 - RNA, 23 nt, Human
acuugucauuguuauauaaucau

SEQ ID NO: 1306710 - RNA, 14 nt, Human
acuugaggacacau

SEQ ID NO: 1306711 - RNA, 13 nt, Human
acuugaggacaca

SEQ ID NO: 1306712 - RNA, 12 nt, Human
acuugaggacac

SEQ ID NO: 1306713 - RNA, 11 nt, Human
acuugaggaca

SEQ ID NO: 1306714 - RNA, 14 nt, Human
acuugagaccuaau

SEQ ID NO: 1306715 - RNA, 12 nt, Human
acuugagcaugu

SEQ ID NO: 1306716 - RNA, 13 nt, Human
acuugaaugaaaa

SEQ ID NO: 1306717 - RNA, 20 nt, Human
acuugaaugaaaauguccau

SEQ ID NO: 1306718 - RNA, 24 nt, Human
acuugaaugcuaguuauacuuauu

SEQ ID NO: 1306719 - RNA, 21 nt, Human
acuugagaccuaaucucugua

SEQ ID NO: 1306720 - RNA, 21 nt, Human
acuugaacccgggaggcagag

SEQ ID NO: 1306721 - RNA, 15 nt, Human
acuugaagggccaga

SEQ ID NO: 1306722 - RNA, 17 nt, Human
acuugaagggccagagc

SEQ ID NO: 1306723 - RNA, 18 nt, Human
acuugaagggccagagcc

SEQ ID NO: 1306724 - RNA, 19 nt, Human
acuugaagggccagagcca

SEQ ID NO: 1306725 - RNA, 20 nt, Human
acuugaagggccagagccag

SEQ ID NO: 1306726 - RNA, 21 nt, Human
acuugaagggccagagccagg

SEQ ID NO: 1306727 - RNA, 22 nt, Human
acuugaagggccagagccaggg

SEQ ID NO: 1306728 - RNA, 20 nt, Human
acuugaacccgggaggcaga

SEQ ID NO: 1306729 - RNA, 19 nt, Human
acuugaacccgggaggcag

SEQ ID NO: 1306730 - RNA, 21 nt, Human
acuugaacccauauuuguaca

SEQ ID NO: 1306731 - RNA, 20 nt, Human
acuucucauuuuuuaaaaaa

SEQ ID NO: 1306732 - RNA, 21 nt, Human
ucucacagcuccaagaauuuc

SEQ ID NO: 1306733 - RNA, 14 nt, Human
ucucaccucuaggu

SEQ ID NO: 1306734 - RNA, 21 nt, Human
ucucaccucuagguccccaua

SEQ ID NO: 1306735 - RNA, 19 nt, Human
ucucacacuggucugcugu

SEQ ID NO: 1306736 - RNA, 14 nt, Human
ucucacuaaaucuu

SEQ ID NO: 1306737 - RNA, 13 nt, Human
ucucaccuggacu

SEQ ID NO: 1306738 - RNA, 24 nt, Human
ucucaccuggacuuaagcaucugg

SEQ ID NO: 1306739 - RNA, 12 nt, Human
ucucaccuggcc

SEQ ID NO: 1306740 - RNA, 14 nt, Human
ucucaccuggcccu

SEQ ID NO: 1306741 - RNA, 16 nt, Human
ucucaccuggcccugc

SEQ ID NO: 1306742 - RNA, 19 nt, Human
ucucaccuggcccugcuuc

SEQ ID NO: 1306743 - RNA, 21 nt, Human
ucucaccuggcccugcuuccu

SEQ ID NO: 1306744 - RNA, 20 nt, Human
ucucacggccacacagcugc

SEQ ID NO: 1306745 - RNA, 21 nt, Human
ucucacggccacacagcugcc

SEQ ID NO: 1306746 - RNA, 22 nt, Human
ucucacggccacacagcugccg

SEQ ID NO: 1306747 - RNA, 14 nt, Human
acuucaggcucuuc

SEQ ID NO: 1306748 - RNA, 16 nt, Human
acuucaggcucuucuc

SEQ ID NO: 1306749 - RNA, 16 nt, Human
ucuauuucauaccaug

SEQ ID NO: 1306750 - RNA, 17 nt, Human
ucuauuucacuggagca

SEQ ID NO: 1306751 - RNA, 14 nt, Human
ucuauuucacugga

SEQ ID NO: 1306752 - RNA, 16 nt, Human
ucuauuucauguuuuu

SEQ ID NO: 1306753 - RNA, 14 nt, Human
ucuauuucauguuu

SEQ ID NO: 1306754 - RNA, 14 nt, Human
ucuauuucuccucc

SEQ ID NO: 1306755 - RNA, 15 nt, Human
ucuauuucuccucca

SEQ ID NO: 1306756 - RNA, 16 nt, Human
ucuauuucuccuccau

SEQ ID NO: 1306757 - RNA, 20 nt, Human
ucuauuucuccuccauggga

SEQ ID NO: 1306758 - RNA, 16 nt, Human
ucuauuucugccuccc

SEQ ID NO: 1306759 - RNA, 16 nt, Human
ucucacuauaccagua

SEQ ID NO: 1306760 - RNA, 18 nt, Human
acuuccuguccagcucca

SEQ ID NO: 1306761 - RNA, 22 nt, Human
acuuccuguccagcuccaaccu

SEQ ID NO: 1306762 - RNA, 15 nt, Human
acuuccugugacuuc

SEQ ID NO: 1306763 - RNA, 23 nt, Human
acuuccuguccagcuccaaccug

SEQ ID NO: 1306764 - RNA, 14 nt, Human
acuucgacacuguu

SEQ ID NO: 1306765 - RNA, 16 nt, Human
acuucgacacuguucu

SEQ ID NO: 1306766 - RNA, 23 nt, Human
acuucgacacuguucuuagcuca

SEQ ID NO: 1306767 - RNA, 21 nt, Human
acuucgacacuguucuuagcu

SEQ ID NO: 1306768 - RNA, 17 nt, Human
acuucucacuaauuugu

SEQ ID NO: 1306769 - RNA, 17 nt, Human
acuucucaggacacagg

SEQ ID NO: 1306770 - RNA, 18 nt, Human
acuucucaggacacaggc

SEQ ID NO: 1306771 - RNA, 20 nt, Human
acuucucaggacacaggccu

SEQ ID NO: 1306772 - RNA, 22 nt, Human
acuucucaggacacaggccugu

SEQ ID NO: 1306773 - RNA, 21 nt, Human
acuucucaggacacaggccug

SEQ ID NO: 1306774 - RNA, 19 nt, Human
acuucucauuuuuuaaaaa

SEQ ID NO: 1306775 - RNA, 17 nt, Human
acuucuaagacuuuacu

SEQ ID NO: 1306776 - RNA, 17 nt, Human
acuucuaauugccaugu

SEQ ID NO: 1306777 - RNA, 14 nt, Human
acuucuaauugcca

SEQ ID NO: 1306778 - RNA, 21 nt, Human
acuucuauuuuaaagacaaug

SEQ ID NO: 1306779 - RNA, 18 nt, Human
acuucguuuaaugaaugc

SEQ ID NO: 1306780 - RNA, 20 nt, Human
acuucguuuaaugaaugcuu

SEQ ID NO: 1306781 - RNA, 17 nt, Human
acuucguuuaaugaaug

SEQ ID NO: 1306782 - RNA, 17 nt, Human
acuucggggcugggaag

SEQ ID NO: 1306783 - RNA, 13 nt, Human
acuggccccaccc

SEQ ID NO: 1306784 - RNA, 12 nt, Human
acuggccccacc

SEQ ID NO: 1306785 - RNA, 21 nt, Human
acuggccauggccugcaaacu

SEQ ID NO: 1306786 - RNA, 16 nt, Human
acuggccauggccugc

SEQ ID NO: 1306787 - RNA, 22 nt, Human
acuggccagggccacgcuccag

SEQ ID NO: 1306788 - RNA, 15 nt, Human
acuggccauggccug

SEQ ID NO: 1306789 - RNA, 11 nt, Human
acuggccaggg

SEQ ID NO: 1306790 - RNA, 16 nt, Human
acuggccucugcugau

SEQ ID NO: 1306791 - RNA, 14 nt, Human
acuggccucugcug

SEQ ID NO: 1306792 - RNA, 17 nt, Human
acuggccucaaagcaag

SEQ ID NO: 1306793 - RNA, 15 nt, Human
acuggccucaaagca

SEQ ID NO: 1306794 - RNA, 22 nt, Human
acuggccucaaagcaagcauuc

SEQ ID NO: 1306795 - RNA, 15 nt, Human
uccuuccaccaaguu

SEQ ID NO: 1306796 - RNA, 16 nt, Human
uccuuccagcuaguga

SEQ ID NO: 1306797 - RNA, 22 nt, Human
uccuuccagcuagugacccaca

SEQ ID NO: 1306798 - RNA, 24 nt, Human
uccuuccagugucauuucucaucc

SEQ ID NO: 1306799 - RNA, 10 nt, Human
uccuucccaa

SEQ ID NO: 1306800 - RNA, 12 nt, Human
uccuucccagag

SEQ ID NO: 1306801 - RNA, 22 nt, Human
uccuucccagaggggccugcca

SEQ ID NO: 1306802 - RNA, 23 nt, Human
uccuucccagaggggccugccac

SEQ ID NO: 1306803 - RNA, 21 nt, Human
uccuuguuguuucuugccuga

SEQ ID NO: 1306804 - RNA, 11 nt, Human
uccuuuaacaa

SEQ ID NO: 1306805 - RNA, 13 nt, Human
uccuuuaauugua

SEQ ID NO: 1306806 - RNA, 15 nt, Human
uccuuuaauuguaaa

SEQ ID NO: 1306807 - RNA, 15 nt, Human
uccuucuauucuagc

SEQ ID NO: 1306808 - RNA, 18 nt, Human
uccuucugagcuccuguc

SEQ ID NO: 1306809 - RNA, 24 nt, Human
uccuucugagcccgguaagagcaa

SEQ ID NO: 1306810 - RNA, 16 nt, Human
uccuucugagcuccug

SEQ ID NO: 1306811 - RNA, 13 nt, Human
uccuugucacugg

SEQ ID NO: 1306812 - RNA, 17 nt, Human
uccuugugaugugcacg

SEQ ID NO: 1306813 - RNA, 20 nt, Human
uccuugugaugugcacguaa

SEQ ID NO: 1306814 - RNA, 19 nt, Human
uccuugugaugugcacgua

SEQ ID NO: 1306815 - RNA, 16 nt, Human
uccuugugccagagaa

SEQ ID NO: 1306816 - RNA, 15 nt, Human
uccuugugccagaga

SEQ ID NO: 1306817 - RNA, 16 nt, Human
uccuugugggccuggg

SEQ ID NO: 1306818 - RNA, 18 nt, Human
uccuugugggccugggcu

SEQ ID NO: 1306819 - RNA, 19 nt, Human
uccuugugggccugggcuc

SEQ ID NO: 1306820 - RNA, 23 nt, Human
uccuugugggccugggcuccugg

SEQ ID NO: 1306821 - RNA, 13 nt, Human
ucgaagugcugag

SEQ ID NO: 1306822 - RNA, 12 nt, Human
ucgaagugcuga

SEQ ID NO: 1306823 - RNA, 13 nt, Human
uccuuucuuuucc

SEQ ID NO: 1306824 - RNA, 13 nt, Human
uccuuucuggcuu

SEQ ID NO: 1306825 - RNA, 20 nt, Human
uccuuucuuccggccccucc

SEQ ID NO: 1306826 - RNA, 12 nt, Human
uccuuucuuccg

SEQ ID NO: 1306827 - RNA, 12 nt, Human
uccuuucuuuuc

SEQ ID NO: 1306828 - RNA, 20 nt, Human
uccuuucuagagcacugcca

SEQ ID NO: 1306829 - RNA, 19 nt, Human
uccuuucuagagcacugcc

SEQ ID NO: 1306830 - RNA, 17 nt, Human
ucgagaucccaacacug

SEQ ID NO: 1306831 - RNA, 21 nt, Human
ucgagaaagaggcaccaggaa

SEQ ID NO: 1306832 - RNA, 15 nt, Human
ucgacuguuguuauc

SEQ ID NO: 1306833 - RNA, 19 nt, Human
ucgagaaagaggcaccagg

SEQ ID NO: 1306834 - RNA, 20 nt, Human
ucgagaaagaggcaccagga

SEQ ID NO: 1306835 - RNA, 17 nt, Human
ucgacuguuguuaucug

SEQ ID NO: 1306836 - RNA, 14 nt, Human
ucgacuguuguuau

SEQ ID NO: 1306837 - RNA, 20 nt, Human
ucgaaucuacuaauuccaca

SEQ ID NO: 1306838 - RNA, 14 nt, Human
ucgaaucucugugc

SEQ ID NO: 1306839 - RNA, 16 nt, Human
ucgaaucucugugccu

SEQ ID NO: 1306840 - RNA, 17 nt, Human
ucgaaucucugugccuu

SEQ ID NO: 1306841 - RNA, 22 nt, Human
ucgaaucucugugccuucgucu

SEQ ID NO: 1306842 - RNA, 12 nt, Human
ucgaaugaaauu

SEQ ID NO: 1306843 - RNA, 17 nt, Human
ucgaaugaaauuaacug

SEQ ID NO: 1306844 - RNA, 15 nt, Human
ucgaaugacacuguu

SEQ ID NO: 1306845 - RNA, 14 nt, Human
ucgaaugacacugu

SEQ ID NO: 1306846 - RNA, 15 nt, Human
ucgagcgcccugcag

SEQ ID NO: 1306847 - RNA, 16 nt, Human
ucgagcgcccugcaga

SEQ ID NO: 1306848 - RNA, 17 nt, Human
ucgagcgcccugcagac

SEQ ID NO: 1306849 - RNA, 18 nt, Human
ucgagcgcccugcagacc

SEQ ID NO: 1306850 - RNA, 19 nt, Human
ucgagcgcccugcagaccc

SEQ ID NO: 1306851 - RNA, 23 nt, Human
ucgagaggggccgaugcccagag

SEQ ID NO: 1306852 - RNA, 14 nt, Human
ucgagcgcccugca

SEQ ID NO: 1306853 - RNA, 18 nt, Human
ucgagaucccaacacugc

SEQ ID NO: 1306854 - RNA, 21 nt, Human
ucgagaucccaacacugccag

SEQ ID NO: 1306855 - RNA, 18 nt, Human
ucgcuauugucaccaggg

SEQ ID NO: 1306856 - RNA, 22 nt, Human
ucgcuagcaguggcaggcagag

SEQ ID NO: 1306857 - RNA, 21 nt, Human
ucgcuagcaguggcaggcaga

SEQ ID NO: 1306858 - RNA, 23 nt, Human
ucgcuagcauuucccaacacaaa

SEQ ID NO: 1306859 - RNA, 17 nt, Human
ucgcggcccucaguagu

SEQ ID NO: 1306860 - RNA, 22 nt, Human
ucgcggcccucaguagucccug

SEQ ID NO: 1306861 - RNA, 14 nt, Human
ucgcuccccacucu

SEQ ID NO: 1306862 - RNA, 15 nt, Human
ucgcuccccacucug

SEQ ID NO: 1306863 - RNA, 18 nt, Human
ucgcuccccacucugcuc

SEQ ID NO: 1306864 - RNA, 13 nt, Human
acuggcuucagca

SEQ ID NO: 1306865 - RNA, 15 nt, Human
acuggcuucagcaag

SEQ ID NO: 1306866 - RNA, 14 nt, Human
acuggcuuuuauua

SEQ ID NO: 1306867 - RNA, 18 nt, Human
acuggcuuuuauuaaugc

SEQ ID NO: 1306868 - RNA, 19 nt, Human
acuggcuuuuauuaaugca

SEQ ID NO: 1306869 - RNA, 13 nt, Human
acugccuucucaa

SEQ ID NO: 1306870 - RNA, 19 nt, Human
acugccuucucaacuccaa

SEQ ID NO: 1306871 - RNA, 20 nt, Human
acugccuucucaacuccaaa

SEQ ID NO: 1306872 - RNA, 23 nt, Human
acugccuucgcuucuugccucug

SEQ ID NO: 1306873 - RNA, 13 nt, Human
acugcuaaauaaa

SEQ ID NO: 1306874 - RNA, 14 nt, Human
acugcuaaauaaaa

SEQ ID NO: 1306875 - RNA, 15 nt, Human
acugcuaaauaaaau

SEQ ID NO: 1306876 - RNA, 16 nt, Human
acugcuaaauaaaauu

SEQ ID NO: 1306877 - RNA, 17 nt, Human
acugcuaaauaaaauuu

SEQ ID NO: 1306878 - RNA, 19 nt, Human
acugcuaaauaaaauuugu

SEQ ID NO: 1306879 - RNA, 20 nt, Human
acugcuaaauaaaauuuguu

SEQ ID NO: 1306880 - RNA, 14 nt, Human
acugcuacagcaau

SEQ ID NO: 1306881 - RNA, 16 nt, Human
acugcuacagcaauuu

SEQ ID NO: 1306882 - RNA, 15 nt, Human
acugcuggcugccuu

SEQ ID NO: 1306883 - RNA, 18 nt, Human
acugcucuaacagcccuc

SEQ ID NO: 1306884 - RNA, 13 nt, Human
acugcuccuccuc

SEQ ID NO: 1306885 - RNA, 14 nt, Human
acugcuguggccag

SEQ ID NO: 1306886 - RNA, 15 nt, Human
acugcuguggccagg

SEQ ID NO: 1306887 - RNA, 16 nt, Human
acugcuguggccagga

SEQ ID NO: 1306888 - RNA, 17 nt, Human
acugcuguggccaggag

SEQ ID NO: 1306889 - RNA, 13 nt, Human
acugcuuaauuca

SEQ ID NO: 1306890 - RNA, 16 nt, Human
acugcuuaauucaaau

SEQ ID NO: 1306891 - RNA, 18 nt, Human
acugcuguggccaggagg

SEQ ID NO: 1306892 - RNA, 19 nt, Human
acugcuguggccaggaggu

SEQ ID NO: 1306893 - RNA, 20 nt, Human
acugcuguggccaggaggug

SEQ ID NO: 1306894 - RNA, 15 nt, Human
acugcuguuauauuu

SEQ ID NO: 1306895 - RNA, 18 nt, Human
acugcuguuauauuucau

SEQ ID NO: 1306896 - RNA, 20 nt, Human
acugcuguuauauuucauca

SEQ ID NO: 1306897 - RNA, 22 nt, Human
acuggagugugcgugguggucc

SEQ ID NO: 1306898 - RNA, 22 nt, Human
acugcuucaaucucaauugcuu

SEQ ID NO: 1306899 - RNA, 12 nt, Human
acugcuuucugu

SEQ ID NO: 1306900 - RNA, 14 nt, Human
acugcuuucuguuc

SEQ ID NO: 1306901 - RNA, 16 nt, Human
acugcuuucuguucca

SEQ ID NO: 1306902 - RNA, 17 nt, Human
acugcuuucuguuccaa

SEQ ID NO: 1306903 - RNA, 18 nt, Human
acugcuuucuguuccaaa

SEQ ID NO: 1306904 - RNA, 19 nt, Human
acugcuuucuguuccaaau

SEQ ID NO: 1306905 - RNA, 14 nt, Human
acuggcacagaggu

SEQ ID NO: 1306906 - RNA, 12 nt, Human
acuggcacagag

SEQ ID NO: 1306907 - RNA, 14 nt, Human
acuggccaagcuga

SEQ ID NO: 1306908 - RNA, 16 nt, Human
acuggccaagcugagg

SEQ ID NO: 1306909 - RNA, 17 nt, Human
acuggccaagcugaggu

SEQ ID NO: 1306910 - RNA, 18 nt, Human
acuggccaagcugaggug

SEQ ID NO: 1306911 - RNA, 19 nt, Human
acuggccaagcugaggugc

SEQ ID NO: 1306912 - RNA, 21 nt, Human
acuggccaagcugaggugccc

SEQ ID NO: 1306913 - RNA, 21 nt, Human
acugccuauuuuaauaaacac

SEQ ID NO: 1306914 - RNA, 16 nt, Human
acugccuauuuuaaua

SEQ ID NO: 1306915 - RNA, 17 nt, Human
acugccucgaaacacag

SEQ ID NO: 1306916 - RNA, 19 nt, Human
acugccucgaaacacagaa

SEQ ID NO: 1306917 - RNA, 15 nt, Human
acugcauuauauuua

SEQ ID NO: 1306918 - RNA, 17 nt, Human
acugcauuauuugagaa

SEQ ID NO: 1306919 - RNA, 23 nt, Human
acugcauucuucugagcacuguu

SEQ ID NO: 1306920 - RNA, 14 nt, Human
acugcauuauuuga

SEQ ID NO: 1306921 - RNA, 14 nt, Human
acugcauuauauuu

SEQ ID NO: 1306922 - RNA, 14 nt, Human
acugccucuuccuc

SEQ ID NO: 1306923 - RNA, 15 nt, Human
acugccucuuccucc

SEQ ID NO: 1306924 - RNA, 9 nt, Human
acugccugc

SEQ ID NO: 1306925 - RNA, 11 nt, Human
acugccugcuc

SEQ ID NO: 1306926 - RNA, 13 nt, Human
acugccugcuccc

SEQ ID NO: 1306927 - RNA, 15 nt, Human
acugccugcucccau

SEQ ID NO: 1306928 - RNA, 19 nt, Human
acugccugcucccauccug

SEQ ID NO: 1306929 - RNA, 14 nt, Human
acugccugcuuggg

SEQ ID NO: 1306930 - RNA, 15 nt, Human
acugccuucgcuucu

SEQ ID NO: 1306931 - RNA, 16 nt, Human
acugccuucgcuucuu

SEQ ID NO: 1306932 - RNA, 17 nt, Human
acugccuucgcuucuug

SEQ ID NO: 1306933 - RNA, 21 nt, Human
acugccuucgcuucuugccuc

SEQ ID NO: 1306934 - RNA, 22 nt, Human
acugccuucgcuucuugccucu

SEQ ID NO: 1306935 - RNA, 15 nt, Human
acugcauccagccug

SEQ ID NO: 1306936 - RNA, 14 nt, Human
acugcauccagccu

SEQ ID NO: 1306937 - RNA, 20 nt, Human
acugcauacuuuuuaaaugu

SEQ ID NO: 1306938 - RNA, 23 nt, Human
acugcauacuuuuuaaauguaaa

SEQ ID NO: 1306939 - RNA, 17 nt, Human
acugcauccuccgccuc

SEQ ID NO: 1306940 - RNA, 20 nt, Human
acugcauccuccgccucccg

SEQ ID NO: 1306941 - RNA, 23 nt, Human
acugcauccuccgccucccgggu

SEQ ID NO: 1306942 - RNA, 12 nt, Human
acugcaugcacu

SEQ ID NO: 1306943 - RNA, 14 nt, Human
acugcaugcacuuc

SEQ ID NO: 1306944 - RNA, 18 nt, Human
acugcaugcacuucuuac

SEQ ID NO: 1306945 - RNA, 14 nt, Human
acugcaugcccaga

SEQ ID NO: 1306946 - RNA, 17 nt, Human
acugcaugcccagagac

SEQ ID NO: 1306947 - RNA, 22 nt, Human
acugcaugcccagagacccagc

SEQ ID NO: 1306948 - RNA, 16 nt, Human
uccuacuggucucucu

SEQ ID NO: 1306949 - RNA, 17 nt, Human
uccuacuggucucucua

SEQ ID NO: 1306950 - RNA, 19 nt, Human
uccuacuggucucucuaug

SEQ ID NO: 1306951 - RNA, 18 nt, Human
uccuagagaagacaggcu

SEQ ID NO: 1306952 - RNA, 13 nt, Human
acugcauacuuuu

SEQ ID NO: 1306953 - RNA, 16 nt, Human
acugcauacuuuuuaa

SEQ ID NO: 1306954 - RNA, 17 nt, Human
acugcauacuuuuuaaa

SEQ ID NO: 1306955 - RNA, 18 nt, Human
acugcauacuuuuuaaau

SEQ ID NO: 1306956 - RNA, 20 nt, Human
uccuagagaagacaggcugg

SEQ ID NO: 1306957 - RNA, 19 nt, Human
uccuagagaagacaggcug

SEQ ID NO: 1306958 - RNA, 20 nt, Human
ucuaaagccauuguaguccu

SEQ ID NO: 1306959 - RNA, 12 nt, Human
ucuaaagcaaau

SEQ ID NO: 1306960 - RNA, 12 nt, Human
ucuaaagcucug

SEQ ID NO: 1306961 - RNA, 14 nt, Human
ucuaaagcucugac

SEQ ID NO: 1306962 - RNA, 17 nt, Human
ucuaaggaccugaaauu

SEQ ID NO: 1306963 - RNA, 21 nt, Human
ucuaaggaccugaaauuccaa

SEQ ID NO: 1306964 - RNA, 23 nt, Human
ucuaaggaccugaaauuccaaag

SEQ ID NO: 1306965 - RNA, 18 nt, Human
ucuaaggccuaggauucu

SEQ ID NO: 1306966 - RNA, 19 nt, Human
ucuaaggccuaggauucua

SEQ ID NO: 1306967 - RNA, 20 nt, Human
ucuaaggccuaggauucuaa

SEQ ID NO: 1306968 - RNA, 21 nt, Human
ucuaaggccuaggauucuaaa

SEQ ID NO: 1306969 - RNA, 22 nt, Human
ucuaaggccuaggauucuaaaa

SEQ ID NO: 1306970 - RNA, 13 nt, Human
ucuaaggcucuga

SEQ ID NO: 1306971 - RNA, 14 nt, Human
ucuaaggcucugag

SEQ ID NO: 1306972 - RNA, 15 nt, Human
ucuaaggcucugaga

SEQ ID NO: 1306973 - RNA, 16 nt, Human
ucuaaggcucugagag

SEQ ID NO: 1306974 - RNA, 17 nt, Human
ucuaaggcucugagagu

SEQ ID NO: 1306975 - RNA, 20 nt, Human
ucuaaggcucugagagucua

SEQ ID NO: 1306976 - RNA, 23 nt, Human
ucuaaggcucugagagucuagau

SEQ ID NO: 1306977 - RNA, 22 nt, Human
ucuaaggcucugagagucuaga

SEQ ID NO: 1306978 - RNA, 20 nt, Human
ucuaagguccgguguucuaa

SEQ ID NO: 1306979 - RNA, 22 nt, Human
ucuaagguccgguguucuaaga

SEQ ID NO: 1306980 - RNA, 23 nt, Human
ucuaagguccgguguucuaagau

SEQ ID NO: 1306981 - RNA, 14 nt, Human
ucuaaguaaauaca

SEQ ID NO: 1306982 - RNA, 15 nt, Human
ucuaaguaaauacaa

SEQ ID NO: 1306983 - RNA, 16 nt, Human
ucuaaguaaauacaau

SEQ ID NO: 1306984 - RNA, 18 nt, Human
ucuacagucucgucucuu

SEQ ID NO: 1306985 - RNA, 21 nt, Human
acuguucuaaagcucugacau

SEQ ID NO: 1306986 - RNA, 13 nt, Human
acuguucuaaagc

SEQ ID NO: 1306987 - RNA, 14 nt, Human
acuguucuaaagcu

SEQ ID NO: 1306988 - RNA, 16 nt, Human
acuguucuaaagcucu

SEQ ID NO: 1306989 - RNA, 17 nt, Human
acuguucuaaagcucug

SEQ ID NO: 1306990 - RNA, 18 nt, Human
acuguucuaaagcucuga

SEQ ID NO: 1306991 - RNA, 17 nt, Human
ucuaccaaccuguucaa

SEQ ID NO: 1306992 - RNA, 14 nt, Human
ucuaccauuucaga

SEQ ID NO: 1306993 - RNA, 15 nt, Human
ucuaccauuucagag

SEQ ID NO: 1306994 - RNA, 18 nt, Human
ucuaccauuucagagagg

SEQ ID NO: 1306995 - RNA, 17 nt, Human
ucuaccauuuucugguu

SEQ ID NO: 1306996 - RNA, 20 nt, Human
ucuaccauuuucugguucuu

SEQ ID NO: 1306997 - RNA, 19 nt, Human
acuguuguagaagacaaaa

SEQ ID NO: 1306998 - RNA, 20 nt, Human
acuuaagcaucuggcucuaa

SEQ ID NO: 1306999 - RNA, 21 nt, Human
acuuaagcaucuggcucuaau

SEQ ID NO: 1307000 - RNA, 21 nt, Human
acuuaagcccagugcacugaa

SEQ ID NO: 1307001 - RNA, 16 nt, Human
acuuaaggcauuuguu

SEQ ID NO: 1307002 - RNA, 17 nt, Human
acuuaauacuaccuuga

SEQ ID NO: 1307003 - RNA, 18 nt, Human
acuuaauacuaccuugaa

SEQ ID NO: 1307004 - RNA, 19 nt, Human
acuuaauacuaccuugaaa

SEQ ID NO: 1307005 - RNA, 21 nt, Human
acuuaauacuaccuugaaaau

SEQ ID NO: 1307006 - RNA, 13 nt, Human
acuguucuguguc

SEQ ID NO: 1307007 - RNA, 15 nt, Human
acuguucugugucuu

SEQ ID NO: 1307008 - RNA, 16 nt, Human
acuguucugugucuuu

SEQ ID NO: 1307009 - RNA, 17 nt, Human
acuguucugugucuuuc

SEQ ID NO: 1307010 - RNA, 19 nt, Human
acuguucuuagcucaauga

SEQ ID NO: 1307011 - RNA, 13 nt, Human
acuguucuuagcu

SEQ ID NO: 1307012 - RNA, 12 nt, Human
acuguuggaaug

SEQ ID NO: 1307013 - RNA, 21 nt, Human
acuguuggaauggauuuuucu

SEQ ID NO: 1307014 - RNA, 18 nt, Human
acuuauaguacaugauaa

SEQ ID NO: 1307015 - RNA, 17 nt, Human
acuuauaguacaugaua

SEQ ID NO: 1307016 - RNA, 15 nt, Human
acuuauaguacauga

SEQ ID NO: 1307017 - RNA, 14 nt, Human
acuuauaguacaug

SEQ ID NO: 1307018 - RNA, 14 nt, Human
acuucagcucuguu

SEQ ID NO: 1307019 - RNA, 18 nt, Human
acuuauauggaaauucug

SEQ ID NO: 1307020 - RNA, 17 nt, Human
acuuauaauuuuccuaa

SEQ ID NO: 1307021 - RNA, 13 nt, Human
acuuauagccucu

SEQ ID NO: 1307022 - RNA, 14 nt, Human
acuuauagccucug

SEQ ID NO: 1307023 - RNA, 15 nt, Human
acuuauagccucugu

SEQ ID NO: 1307024 - RNA, 21 nt, Human
acuuauagccucugucuggca

SEQ ID NO: 1307025 - RNA, 16 nt, Human
acuuagaaauugcauu

SEQ ID NO: 1307026 - RNA, 16 nt, Human
acuuacuugcuuauuu

SEQ ID NO: 1307027 - RNA, 13 nt, Human
acuuacuuuuucu

SEQ ID NO: 1307028 - RNA, 21 nt, Human
acuuacuuuuucuggucucua

SEQ ID NO: 1307029 - RNA, 20 nt, Human
acuuagaaaaccagcucagc

SEQ ID NO: 1307030 - RNA, 21 nt, Human
acuuagaaaaccagcucagca

SEQ ID NO: 1307031 - RNA, 20 nt, Human
acuuaguauugcaaagucag

SEQ ID NO: 1307032 - RNA, 19 nt, Human
acuuaguauugcaaaguca

SEQ ID NO: 1307033 - RNA, 19 nt, Human
acuuaauacucaaaugagu

SEQ ID NO: 1307034 - RNA, 16 nt, Human
acuuaaucaaaacuca

SEQ ID NO: 1307035 - RNA, 19 nt, Human
acuuacaugauucauuuua

SEQ ID NO: 1307036 - RNA, 17 nt, Human
acuuacaugauucauuu

SEQ ID NO: 1307037 - RNA, 18 nt, Human
acuuacaugauucauuuu

SEQ ID NO: 1307038 - RNA, 21 nt, Human
acuuaccaggcaccaaaagaa

SEQ ID NO: 1307039 - RNA, 22 nt, Human
acuuaccaggcaccaaaagaag

SEQ ID NO: 1307040 - RNA, 14 nt, Human
acuuacauuuacaa

SEQ ID NO: 1307041 - RNA, 15 nt, Human
acuuacauuuacaaa

SEQ ID NO: 1307042 - RNA, 19 nt, Human
acuuacauuuacaaacuga

SEQ ID NO: 1307043 - RNA, 18 nt, Human
acuuaccaggcaccaaaa

SEQ ID NO: 1307044 - RNA, 15 nt, Human
acuuacuugcuuauu

SEQ ID NO: 1307045 - RNA, 21 nt, Human
acugugugcucaggagcccug

SEQ ID NO: 1307046 - RNA, 20 nt, Human
acugugugcucaggagcccu

SEQ ID NO: 1307047 - RNA, 19 nt, Human
acugugugcucaggagccc

SEQ ID NO: 1307048 - RNA, 15 nt, Human
acugugugcucagga

SEQ ID NO: 1307049 - RNA, 12 nt, Human
acugugugcuca

SEQ ID NO: 1307050 - RNA, 21 nt, Human
acuguguccaggugguacuuu

SEQ ID NO: 1307051 - RNA, 21 nt, Human
acuguguauuccaagacaugu

SEQ ID NO: 1307052 - RNA, 17 nt, Human
acuguguacauaacuga

SEQ ID NO: 1307053 - RNA, 15 nt, Human
acuguguauuccaag

SEQ ID NO: 1307054 - RNA, 16 nt, Human
acuguguauuccaaga

SEQ ID NO: 1307055 - RNA, 12 nt, Human
acuguguaacug

SEQ ID NO: 1307056 - RNA, 13 nt, Human
acuguguaacugc

SEQ ID NO: 1307057 - RNA, 14 nt, Human
acuguguaacugcc

SEQ ID NO: 1307058 - RNA, 15 nt, Human
acuguguaacugccc

SEQ ID NO: 1307059 - RNA, 17 nt, Human
acuguguaacugcccaa

SEQ ID NO: 1307060 - RNA, 19 nt, Human
acuguguaagggccagaaa

SEQ ID NO: 1307061 - RNA, 21 nt, Human
acuguguaagggccagaaaua

SEQ ID NO: 1307062 - RNA, 13 nt, Human
acuguguaauuag

SEQ ID NO: 1307063 - RNA, 12 nt, Human
acuguguacaua

SEQ ID NO: 1307064 - RNA, 16 nt, Human
acuguguacauaacug

SEQ ID NO: 1307065 - RNA, 18 nt, Human
acuguguacauaacugaa

SEQ ID NO: 1307066 - RNA, 18 nt, Human
acuguggguagacacaca

SEQ ID NO: 1307067 - RNA, 17 nt, Human
acugggagaaaugaaaa

SEQ ID NO: 1307068 - RNA, 20 nt, Human
acugggaaggcuugggauuu

SEQ ID NO: 1307069 - RNA, 17 nt, Human
acugggaaggcuacuuc

SEQ ID NO: 1307070 - RNA, 15 nt, Human
acugggaccaggcac

SEQ ID NO: 1307071 - RNA, 15 nt, Human
acugucacuguuccu

SEQ ID NO: 1307072 - RNA, 16 nt, Human
acugggagaaaugaaa

SEQ ID NO: 1307073 - RNA, 18 nt, Human
acugggacaggggagaac

SEQ ID NO: 1307074 - RNA, 20 nt, Human
acuggcuuuuauuaaugcac

SEQ ID NO: 1307075 - RNA, 21 nt, Human
acuggcuuuuauuaaugcacu

SEQ ID NO: 1307076 - RNA, 23 nt, Human
acuggcuuuuauuaaugcacuuu

SEQ ID NO: 1307077 - RNA, 16 nt, Human
acugggaaccccuuuc

SEQ ID NO: 1307078 - RNA, 17 nt, Human
acugggaaccccuuucc

SEQ ID NO: 1307079 - RNA, 19 nt, Human
acugggaaccccuuuccca

SEQ ID NO: 1307080 - RNA, 20 nt, Human
acugggaaccccuuucccac

SEQ ID NO: 1307081 - RNA, 11 nt, Human
acugggaaggc

SEQ ID NO: 1307082 - RNA, 12 nt, Human
acugggaaggcu

SEQ ID NO: 1307083 - RNA, 19 nt, Human
acugucagcagggacugua

SEQ ID NO: 1307084 - RNA, 22 nt, Human
acugucagcagggacuguaaac

SEQ ID NO: 1307085 - RNA, 22 nt, Human
acugugcuguuguuaugaugug

SEQ ID NO: 1307086 - RNA, 23 nt, Human
acugugcuguuguuaugaugugc

SEQ ID NO: 1307087 - RNA, 18 nt, Human
acugugcuguuguuauga

SEQ ID NO: 1307088 - RNA, 14 nt, Human
acugugcuguuguu

SEQ ID NO: 1307089 - RNA, 13 nt, Human
acugugcuguugu

SEQ ID NO: 1307090 - RNA, 16 nt, Human
acugucccuugccuca

SEQ ID NO: 1307091 - RNA, 13 nt, Human
ucguaaaauuaag

SEQ ID NO: 1307092 - RNA, 16 nt, Human
ucgguagguucagcca

SEQ ID NO: 1307093 - RNA, 20 nt, Human
ucgguauccccccaucuugc

SEQ ID NO: 1307094 - RNA, 14 nt, Human
ucggucugugcccc

SEQ ID NO: 1307095 - RNA, 12 nt, Human
ucggugaagaaa

SEQ ID NO: 1307096 - RNA, 16 nt, Human
ucguaaaauuaagaaa

SEQ ID NO: 1307097 - RNA, 13 nt, Human
ucgguuucuccaa

SEQ ID NO: 1307098 - RNA, 15 nt, Human
ucguaaagauuuggg

SEQ ID NO: 1307099 - RNA, 22 nt, Human
ucguuuucaaaauuguuacaaa

SEQ ID NO: 1307100 - RNA, 17 nt, Human
ucguuugaaucacagua

SEQ ID NO: 1307101 - RNA, 13 nt, Human
ucguaaagauuug

SEQ ID NO: 1307102 - RNA, 14 nt, Human
ucguuuguguucug

SEQ ID NO: 1307103 - RNA, 15 nt, Human
ucguuuguguucugu

SEQ ID NO: 1307104 - RNA, 13 nt, Human
ucguuuguuuguu

SEQ ID NO: 1307105 - RNA, 20 nt, Human
ucguuuguuuguuuguuuaa

SEQ ID NO: 1307106 - RNA, 13 nt, Human
ucguuuucuuaaa

SEQ ID NO: 1307107 - RNA, 21 nt, Human
ucguuuucuuaaagugccagu

SEQ ID NO: 1307108 - RNA, 14 nt, Human
ucguuuuuuacaaa

SEQ ID NO: 1307109 - RNA, 20 nt, Human
ucguuuuuuuuuuguuuguu

SEQ ID NO: 1307110 - RNA, 17 nt, Human
ucguuuuuuucauucca

SEQ ID NO: 1307111 - RNA, 11 nt, Human
ucuaaaacucc

SEQ ID NO: 1307112 - RNA, 18 nt, Human
ucuaaaagaaaaaggcau

SEQ ID NO: 1307113 - RNA, 15 nt, Human
ucuaaaaucuuauag

SEQ ID NO: 1307114 - RNA, 18 nt, Human
ucuaaaaucuuauaguuc

SEQ ID NO: 1307115 - RNA, 19 nt, Human
ucuaaaaucuuauaguucu

SEQ ID NO: 1307116 - RNA, 22 nt, Human
ucuaaaaucuuauaguucuagg

SEQ ID NO: 1307117 - RNA, 23 nt, Human
ucuaaaaucuuauaguucuaggc

SEQ ID NO: 1307118 - RNA, 19 nt, Human
ucuaaagauggaguuucua

SEQ ID NO: 1307119 - RNA, 20 nt, Human
ucuaaagauggaguuucuaa

SEQ ID NO: 1307120 - RNA, 21 nt, Human
ucuaaagauggaguuucuaag

SEQ ID NO: 1307121 - RNA, 22 nt, Human
ucuaaagauggaguuucuaagg

SEQ ID NO: 1307122 - RNA, 23 nt, Human
ucuaaagauggaguuucuaaggu

SEQ ID NO: 1307123 - RNA, 13 nt, Human
ucuaaagauucua

SEQ ID NO: 1307124 - RNA, 15 nt, Human
ucuaaagauucuaua

SEQ ID NO: 1307125 - RNA, 16 nt, Human
ucuaaagauucuauag

SEQ ID NO: 1307126 - RNA, 20 nt, Human
ucuaaagauucuauaguucu

SEQ ID NO: 1307127 - RNA, 22 nt, Human
ucuaaagauucuauaguucuag

SEQ ID NO: 1307128 - RNA, 23 nt, Human
ucuaaagauucuauaguucuaga

SEQ ID NO: 1307129 - RNA, 11 nt, Human
ucuaaagcaaa

SEQ ID NO: 1307130 - RNA, 16 nt, Human
ucggcugaccaugcuc

SEQ ID NO: 1307131 - RNA, 21 nt, Human
ucgggaaaagguagaggaguc

SEQ ID NO: 1307132 - RNA, 18 nt, Human
ucggcucacugcauccuc

SEQ ID NO: 1307133 - RNA, 19 nt, Human
ucggccugcccccacccca

SEQ ID NO: 1307134 - RNA, 19 nt, Human
ucggcuccccauguguccu

SEQ ID NO: 1307135 - RNA, 15 nt, Human
ucggcugaccaugcu

SEQ ID NO: 1307136 - RNA, 21 nt, Human
ucgggcagcacaaguguaaug

SEQ ID NO: 1307137 - RNA, 22 nt, Human
ucgggcagcacaaguguaauga

SEQ ID NO: 1307138 - RNA, 13 nt, Human
ucgggcccuuccc

SEQ ID NO: 1307139 - RNA, 14 nt, Human
ucggggugcacagg

SEQ ID NO: 1307140 - RNA, 15 nt, Human
ucggggugcacagga

SEQ ID NO: 1307141 - RNA, 16 nt, Human
ucggggugcacaggag

SEQ ID NO: 1307142 - RNA, 17 nt, Human
ucggggugcacaggagg

SEQ ID NO: 1307143 - RNA, 19 nt, Human
ucggggugcacaggagggg

SEQ ID NO: 1307144 - RNA, 22 nt, Human
ucggggugcacaggaggggguc

SEQ ID NO: 1307145 - RNA, 19 nt, Human
uccuaaauauauuuuaaga

SEQ ID NO: 1307146 - RNA, 14 nt, Human
uccuaaauauuaug

SEQ ID NO: 1307147 - RNA, 21 nt, Human
uccuaaauauuaugagaugcu

SEQ ID NO: 1307148 - RNA, 18 nt, Human
uccuaaauuuuccugucc

SEQ ID NO: 1307149 - RNA, 19 nt, Human
uccuaaauuuuccuguccu

SEQ ID NO: 1307150 - RNA, 14 nt, Human
uccuacuuccccuu

SEQ ID NO: 1307151 - RNA, 20 nt, Human
uccuaaauuuuccuguccuc

SEQ ID NO: 1307152 - RNA, 16 nt, Human
uccuaagagugcuggg

SEQ ID NO: 1307153 - RNA, 14 nt, Human
ucccuuuuccauga

SEQ ID NO: 1307154 - RNA, 13 nt, Human
ucccuuuucuguu

SEQ ID NO: 1307155 - RNA, 14 nt, Human
ucccuuuucuguuc

SEQ ID NO: 1307156 - RNA, 16 nt, Human
ucccuuuucuguucua

SEQ ID NO: 1307157 - RNA, 20 nt, Human
ucccuuuucuguucuaguuu

SEQ ID NO: 1307158 - RNA, 21 nt, Human
uccgggaccuggugcugccuc

SEQ ID NO: 1307159 - RNA, 20 nt, Human
ucccuggguagcgggggagg

SEQ ID NO: 1307160 - RNA, 12 nt, Human
ucccuggucccu

SEQ ID NO: 1307161 - RNA, 11 nt, Human
ucccuggugcu

SEQ ID NO: 1307162 - RNA, 15 nt, Human
ucccuggugcuuaug

SEQ ID NO: 1307163 - RNA, 14 nt, Human
ucccugugccccca

SEQ ID NO: 1307164 - RNA, 14 nt, Human
ucccugugccuccu

SEQ ID NO: 1307165 - RNA, 21 nt, Human
ucccuuaauauccuaaacauc

SEQ ID NO: 1307166 - RNA, 17 nt, Human
ucccuuaauauccuaaa

SEQ ID NO: 1307167 - RNA, 19 nt, Human
ucccugugccuccucccuc

SEQ ID NO: 1307168 - RNA, 16 nt, Human
ucccugugccuccucc

SEQ ID NO: 1307169 - RNA, 19 nt, Human
ucccuguuuuccccccaag

SEQ ID NO: 1307170 - RNA, 19 nt, Human
ucccuguuuucccacgagg

SEQ ID NO: 1307171 - RNA, 15 nt, Human
ucccuuaaacaaaaa

SEQ ID NO: 1307172 - RNA, 22 nt, Human
ucccuuaaacaaaaauuaaaau

SEQ ID NO: 1307173 - RNA, 16 nt, Human
ucccuuaacaguugua

SEQ ID NO: 1307174 - RNA, 17 nt, Human
ucccuuaacaguuguau

SEQ ID NO: 1307175 - RNA, 20 nt, Human
ucccuuaacaguuguauuua

SEQ ID NO: 1307176 - RNA, 22 nt, Human
ucccuuaacaguuguauuuaac

SEQ ID NO: 1307177 - RNA, 14 nt, Human
ucccuuaauauccu

SEQ ID NO: 1307178 - RNA, 14 nt, Human
acuccugaaaaaaa

SEQ ID NO: 1307179 - RNA, 16 nt, Human
acuccugaaaaaaaac

SEQ ID NO: 1307180 - RNA, 19 nt, Human
acuccugaaaaaaaaccug

SEQ ID NO: 1307181 - RNA, 15 nt, Human
acuccugaccucaag

SEQ ID NO: 1307182 - RNA, 13 nt, Human
acuccucugucca

SEQ ID NO: 1307183 - RNA, 13 nt, Human
acuccucugcuga

SEQ ID NO: 1307184 - RNA, 16 nt, Human
acuccucugcugaccu

SEQ ID NO: 1307185 - RNA, 14 nt, Human
acuccucuguccag

SEQ ID NO: 1307186 - RNA, 21 nt, Human
acuccucugcugaccugcuga

SEQ ID NO: 1307187 - RNA, 13 nt, Human
acuccugaaaaaa

SEQ ID NO: 1307188 - RNA, 16 nt, Human
acuccuccuuuuucca

SEQ ID NO: 1307189 - RNA, 14 nt, Human
acuccucugacuca

SEQ ID NO: 1307190 - RNA, 20 nt, Human
acuccucugacucagggcuc

SEQ ID NO: 1307191 - RNA, 13 nt, Human
acuccagaccccu

SEQ ID NO: 1307192 - RNA, 13 nt, Human
acucauuagacug

SEQ ID NO: 1307193 - RNA, 14 nt, Human
acucauuagacugg

SEQ ID NO: 1307194 - RNA, 15 nt, Human
acucauuagacugga

SEQ ID NO: 1307195 - RNA, 21 nt, Human
acucauuagacuggaacuuga

SEQ ID NO: 1307196 - RNA, 13 nt, Human
acucauucauuag

SEQ ID NO: 1307197 - RNA, 16 nt, Human
acucauucauuaguca

SEQ ID NO: 1307198 - RNA, 15 nt, Human
acucauucugaagga

SEQ ID NO: 1307199 - RNA, 19 nt, Human
acucauucugaaggagccc

SEQ ID NO: 1307200 - RNA, 18 nt, Human
acucaugugacucuuucc

SEQ ID NO: 1307201 - RNA, 19 nt, Human
acucaugugacucuuucca

SEQ ID NO: 1307202 - RNA, 15 nt, Human
acucacuuucuagau

SEQ ID NO: 1307203 - RNA, 14 nt, Human
acucacuuuuccca

SEQ ID NO: 1307204 - RNA, 15 nt, Human
acucacuuuucccac

SEQ ID NO: 1307205 - RNA, 16 nt, Human
acucacuuuucccacu

SEQ ID NO: 1307206 - RNA, 18 nt, Human
acucacuuuucccacucc

SEQ ID NO: 1307207 - RNA, 17 nt, Human
acucacuuuucccacuc

SEQ ID NO: 1307208 - RNA, 13 nt, Human
acucagaaauuca

SEQ ID NO: 1307209 - RNA, 21 nt, Human
acuacuagggaaaugccuuug

SEQ ID NO: 1307210 - RNA, 22 nt, Human
acuaccuguaaugacaggccug

SEQ ID NO: 1307211 - RNA, 13 nt, Human
acuacucagcaug

SEQ ID NO: 1307212 - RNA, 12 nt, Human
acuacucagcau

SEQ ID NO: 1307213 - RNA, 17 nt, Human
acuacucagcauggaaa

SEQ ID NO: 1307214 - RNA, 13 nt, Human
acucaccacugcc

SEQ ID NO: 1307215 - RNA, 20 nt, Human
uccccuaagcagaccacuga

SEQ ID NO: 1307216 - RNA, 16 nt, Human
uccccuagagucccag

SEQ ID NO: 1307217 - RNA, 15 nt, Human
uccccuagaguccca

SEQ ID NO: 1307218 - RNA, 23 nt, Human
uccccuauguggaaguggggcgg

SEQ ID NO: 1307219 - RNA, 14 nt, Human
uccccuccaucccu

SEQ ID NO: 1307220 - RNA, 15 nt, Human
uccccuccaucccug

SEQ ID NO: 1307221 - RNA, 16 nt, Human
uccccuccaucccugg

SEQ ID NO: 1307222 - RNA, 20 nt, Human
uccccuccaucccuggcccc

SEQ ID NO: 1307223 - RNA, 18 nt, Human
uccccuccaucccuggcc

SEQ ID NO: 1307224 - RNA, 14 nt, Human
uccccuccccaacu

SEQ ID NO: 1307225 - RNA, 20 nt, Human
ucccgaguagcugagauuau

SEQ ID NO: 1307226 - RNA, 24 nt, Human
uccccuuugcuucauucaagucag

SEQ ID NO: 1307227 - RNA, 22 nt, Human
ucccgagcaccuccacauccuc

SEQ ID NO: 1307228 - RNA, 15 nt, Human
ucccgagcuccucuu

SEQ ID NO: 1307229 - RNA, 15 nt, Human
uccccucuccuuccu

SEQ ID NO: 1307230 - RNA, 16 nt, Human
uccccucuccuuccug

SEQ ID NO: 1307231 - RNA, 12 nt, Human
uccccuugccug

SEQ ID NO: 1307232 - RNA, 16 nt, Human
uccccuugccugugcc

SEQ ID NO: 1307233 - RNA, 23 nt, Human
uccccuugccugugccaggugag

SEQ ID NO: 1307234 - RNA, 16 nt, Human
uccccuugggcccaca

SEQ ID NO: 1307235 - RNA, 18 nt, Human
uccccuugggcccacacc

SEQ ID NO: 1307236 - RNA, 19 nt, Human
uccccuugggcccacaccu

SEQ ID NO: 1307237 - RNA, 22 nt, Human
uccccuugggcccacaccuccu

SEQ ID NO: 1307238 - RNA, 14 nt, Human
ucccugacugggag

SEQ ID NO: 1307239 - RNA, 23 nt, Human
ucccugagaugggcuucccaagg

SEQ ID NO: 1307240 - RNA, 20 nt, Human
ucccugaggacugauuucag

SEQ ID NO: 1307241 - RNA, 21 nt, Human
ucccugaggacugauuucaga

SEQ ID NO: 1307242 - RNA, 15 nt, Human
ucccugacugggagu

SEQ ID NO: 1307243 - RNA, 13 nt, Human
ucccugagauggg

SEQ ID NO: 1307244 - RNA, 23 nt, Human
ucccugagcuagaacccucuguu

SEQ ID NO: 1307245 - RNA, 15 nt, Human
ucccugaggacugau

SEQ ID NO: 1307246 - RNA, 18 nt, Human
acucacuaauucauuaau

SEQ ID NO: 1307247 - RNA, 20 nt, Human
acucacuaauucauuaaucu

SEQ ID NO: 1307248 - RNA, 14 nt, Human
acucacuaggcccc

SEQ ID NO: 1307249 - RNA, 15 nt, Human
acucacuaggccccc

SEQ ID NO: 1307250 - RNA, 17 nt, Human
acucacuaggcccccac

SEQ ID NO: 1307251 - RNA, 21 nt, Human
acucacuaggcccccacuugc

SEQ ID NO: 1307252 - RNA, 22 nt, Human
acucacuaggcccccacuugcc

SEQ ID NO: 1307253 - RNA, 16 nt, Human
acucacuccuuuuaaa

SEQ ID NO: 1307254 - RNA, 18 nt, Human
acucacuccuuuuaaaga

SEQ ID NO: 1307255 - RNA, 19 nt, Human
acucacuccuuuuaaagaa

SEQ ID NO: 1307256 - RNA, 15 nt, Human
ucccuccccuugccu

SEQ ID NO: 1307257 - RNA, 21 nt, Human
ucccgggacaccuaggcuagg

SEQ ID NO: 1307258 - RNA, 22 nt, Human
ucccggcugcccuuucugggca

SEQ ID NO: 1307259 - RNA, 13 nt, Human
ucccggcugcccu

SEQ ID NO: 1307260 - RNA, 14 nt, Human
ucccggcugcccuu

SEQ ID NO: 1307261 - RNA, 15 nt, Human
ucccggcugcccuuu

SEQ ID NO: 1307262 - RNA, 18 nt, Human
ucccggcugcccuuucug

SEQ ID NO: 1307263 - RNA, 23 nt, Human
ucccucccagagcaccugcuguc

SEQ ID NO: 1307264 - RNA, 22 nt, Human
ucccucccagaggagccaccag

SEQ ID NO: 1307265 - RNA, 14 nt, Human
ucccuccccuucuc

SEQ ID NO: 1307266 - RNA, 15 nt, Human
ucccuccccuucucu

SEQ ID NO: 1307267 - RNA, 13 nt, Human
ucccuccccuugc

SEQ ID NO: 1307268 - RNA, 14 nt, Human
ucccuccccuugcc

SEQ ID NO: 1307269 - RNA, 17 nt, Human
acgugggcauucaaaug

SEQ ID NO: 1307270 - RNA, 20 nt, Human
acgugggcauucaaauguau

SEQ ID NO: 1307271 - RNA, 22 nt, Human
acguauaaaagccuguuuaaga

SEQ ID NO: 1307272 - RNA, 20 nt, Human
acguacugcagccuccagag

SEQ ID NO: 1307273 - RNA, 14 nt, Human
acguacucugguua

SEQ ID NO: 1307274 - RNA, 18 nt, Human
acguaugucugguucuca

SEQ ID NO: 1307275 - RNA, 17 nt, Human
acguaugucugguucuc

SEQ ID NO: 1307276 - RNA, 13 nt, Human
acguauuuaauag

SEQ ID NO: 1307277 - RNA, 16 nt, Human
acguauuuaauagcaa

SEQ ID NO: 1307278 - RNA, 15 nt, Human
acguauuuaauagca

SEQ ID NO: 1307279 - RNA, 15 nt, Human
acggggacucagccc

SEQ ID NO: 1307280 - RNA, 17 nt, Human
acgggccuguccacagg

SEQ ID NO: 1307281 - RNA, 21 nt, Human
acgguggggguagggggcugg

SEQ ID NO: 1307282 - RNA, 18 nt, Human
acgggacugcggaggaag

SEQ ID NO: 1307283 - RNA, 22 nt, Human
acgggaugguucuggcuguuug

SEQ ID NO: 1307284 - RNA, 18 nt, Human
ucccacccccacccccag

SEQ ID NO: 1307285 - RNA, 20 nt, Human
ucccacccccacccccagcu

SEQ ID NO: 1307286 - RNA, 16 nt, Human
ucccacagccacgugu

SEQ ID NO: 1307287 - RNA, 17 nt, Human
ucccacaggacauuucu

SEQ ID NO: 1307288 - RNA, 14 nt, Human
ucccacaagccucu

SEQ ID NO: 1307289 - RNA, 14 nt, Human
ucccacaagccuga

SEQ ID NO: 1307290 - RNA, 15 nt, Human
ucccacaagccugag

SEQ ID NO: 1307291 - RNA, 16 nt, Human
ucccacaagccugagg

SEQ ID NO: 1307292 - RNA, 21 nt, Human
ucccaagugagucucucuggg

SEQ ID NO: 1307293 - RNA, 17 nt, Human
ucccaagugagucucuc

SEQ ID NO: 1307294 - RNA, 15 nt, Human
ucccaaguguacuau

SEQ ID NO: 1307295 - RNA, 16 nt, Human
ucccaaguugugcuug

SEQ ID NO: 1307296 - RNA, 21 nt, Human
ucccacaagccugagggaaag

SEQ ID NO: 1307297 - RNA, 20 nt, Human
ucccaaguagcugagacuac

SEQ ID NO: 1307298 - RNA, 20 nt, Human
ucccaaguagcugggauuac

SEQ ID NO: 1307299 - RNA, 21 nt, Human
ucccaaguagcugggauuaca

SEQ ID NO: 1307300 - RNA, 23 nt, Human
ucccaaguagcugggauuacagg

SEQ ID NO: 1307301 - RNA, 18 nt, Human
ucccaaagugcugagauu

SEQ ID NO: 1307302 - RNA, 19 nt, Human
ucccaaagugcugagauua

SEQ ID NO: 1307303 - RNA, 20 nt, Human
ucccaaagugcugagauuac

SEQ ID NO: 1307304 - RNA, 23 nt, Human
ucccaaagugcugagauuacagg

SEQ ID NO: 1307305 - RNA, 17 nt, Human
ucccaaguagaaucuca

SEQ ID NO: 1307306 - RNA, 19 nt, Human
ucccaaguagaaucucagu

SEQ ID NO: 1307307 - RNA, 13 nt, Human
ucccaaagugcug

SEQ ID NO: 1307308 - RNA, 21 nt, Human
ucccaaaguccugggauuaca

SEQ ID NO: 1307309 - RNA, 14 nt, Human
ucccaaagcaagca

SEQ ID NO: 1307310 - RNA, 20 nt, Human
ucccaaagcaagcaagaggc

SEQ ID NO: 1307311 - RNA, 20 nt, Human
ucccaaaagcccauucauuc

SEQ ID NO: 1307312 - RNA, 14 nt, Human
ucccaaaaaacuac

SEQ ID NO: 1307313 - RNA, 12 nt, Human
uccauuugcaag

SEQ ID NO: 1307314 - RNA, 14 nt, Human
uccauuucuaauua

SEQ ID NO: 1307315 - RNA, 13 nt, Human
uccauuucuaauu

SEQ ID NO: 1307316 - RNA, 18 nt, Human
uccauuuccccuccuucc

SEQ ID NO: 1307317 - RNA, 12 nt, Human
uccauuucuaau

SEQ ID NO: 1307318 - RNA, 21 nt, Human
ucccaaagaaguucugguaug

SEQ ID NO: 1307319 - RNA, 24 nt, Human
ucccaaacgcccuuuccuccucag

SEQ ID NO: 1307320 - RNA, 20 nt, Human
ucccaaaauguugaaauaug

SEQ ID NO: 1307321 - RNA, 20 nt, Human
ucccaaaccacgccucuuga

SEQ ID NO: 1307322 - RNA, 22 nt, Human
ucccaaacgcccuuuccuccuc

SEQ ID NO: 1307323 - RNA, 23 nt, Human
uccauuuaauggggugcaccugu

SEQ ID NO: 1307324 - RNA, 14 nt, Human
uccauucuggaagu

SEQ ID NO: 1307325 - RNA, 13 nt, Human
uccauucuggaag

SEQ ID NO: 1307326 - RNA, 20 nt, Human
uccauucugcuccuucccca

SEQ ID NO: 1307327 - RNA, 12 nt, Human
uccauucuggaa

SEQ ID NO: 1307328 - RNA, 14 nt, Human
uccauucuccugag

SEQ ID NO: 1307329 - RNA, 18 nt, Human
uccauucucacagguccc

SEQ ID NO: 1307330 - RNA, 20 nt, Human
uccaucucuuguuuaaauuc

SEQ ID NO: 1307331 - RNA, 13 nt, Human
uccaugaagaugu

SEQ ID NO: 1307332 - RNA, 22 nt, Human
uccaugaagauguagaggagaa

SEQ ID NO: 1307333 - RNA, 17 nt, Human
uccaugaaagaacuuaa

SEQ ID NO: 1307334 - RNA, 21 nt, Human
uccaugaagauguagaggaga

SEQ ID NO: 1307335 - RNA, 20 nt, Human
uccauccuugagucaaaaaa

SEQ ID NO: 1307336 - RNA, 16 nt, Human
uccaucuaaacugccc

SEQ ID NO: 1307337 - RNA, 18 nt, Human
uccaucuaaacugccccc

SEQ ID NO: 1307338 - RNA, 21 nt, Human
uccauccugaggcuccacuug

SEQ ID NO: 1307339 - RNA, 20 nt, Human
uccauccugaggcuccacuu

SEQ ID NO: 1307340 - RNA, 15 nt, Human
acuacaguuagggcu

SEQ ID NO: 1307341 - RNA, 17 nt, Human
acuacagcuucagugau

SEQ ID NO: 1307342 - RNA, 16 nt, Human
acuacagucuaaagcu

SEQ ID NO: 1307343 - RNA, 17 nt, Human
acuacagucuaaagcug

SEQ ID NO: 1307344 - RNA, 20 nt, Human
ucccagcaugcugagauuac

SEQ ID NO: 1307345 - RNA, 20 nt, Human
acuacaggcacacaccacca

SEQ ID NO: 1307346 - RNA, 17 nt, Human
acuacaggcgugagcca

SEQ ID NO: 1307347 - RNA, 22 nt, Human
acuacacacuguguacugcagu

SEQ ID NO: 1307348 - RNA, 17 nt, Human
acuacagcuggggugca

SEQ ID NO: 1307349 - RNA, 18 nt, Human
acuacagcuggggugcag

SEQ ID NO: 1307350 - RNA, 19 nt, Human
acuacagcuggggugcagg

SEQ ID NO: 1307351 - RNA, 21 nt, Human
acuacagcuggggugcaggga

SEQ ID NO: 1307352 - RNA, 23 nt, Human
acuacagcuggggugcagggaug

SEQ ID NO: 1307353 - RNA, 16 nt, Human
acuacaaccaauggaa

SEQ ID NO: 1307354 - RNA, 13 nt, Human
acuacacacagua

SEQ ID NO: 1307355 - RNA, 15 nt, Human
acuaaccaagcugag

SEQ ID NO: 1307356 - RNA, 18 nt, Human
acuaaccaagcugaguuu

SEQ ID NO: 1307357 - RNA, 21 nt, Human
acuaaccaagcugaguuuccu

SEQ ID NO: 1307358 - RNA, 22 nt, Human
acuaaccaagcugaguuuccua

SEQ ID NO: 1307359 - RNA, 17 nt, Human
acuacaaagguuuaaau

SEQ ID NO: 1307360 - RNA, 18 nt, Human
acuacaaagguuuaaaug

SEQ ID NO: 1307361 - RNA, 19 nt, Human
acuacaaagguuuaaauga

SEQ ID NO: 1307362 - RNA, 20 nt, Human
acuacaaagguuuaaaugaa

SEQ ID NO: 1307363 - RNA, 21 nt, Human
acuacaaagguuuaaaugaac

SEQ ID NO: 1307364 - RNA, 22 nt, Human
acuacaaagguuuaaaugaaca

SEQ ID NO: 1307365 - RNA, 23 nt, Human
acuacaaagguuuaaaugaacaa

SEQ ID NO: 1307366 - RNA, 11 nt, Human
acuacaaauca

SEQ ID NO: 1307367 - RNA, 13 nt, Human
acuacaaaucaag

SEQ ID NO: 1307368 - RNA, 19 nt, Human
acuacaaaucaaguauuug

SEQ ID NO: 1307369 - RNA, 16 nt, Human
acguugagccccugga

SEQ ID NO: 1307370 - RNA, 18 nt, Human
acguuggagaagcccgug

SEQ ID NO: 1307371 - RNA, 18 nt, Human
acuaacaggccaaagagu

SEQ ID NO: 1307372 - RNA, 15 nt, Human
acuaacauauaaugu

SEQ ID NO: 1307373 - RNA, 17 nt, Human
acuaacauauaauguug

SEQ ID NO: 1307374 - RNA, 17 nt, Human
acuaacauguccugccu

SEQ ID NO: 1307375 - RNA, 14 nt, Human
ucccaucccugcgu

SEQ ID NO: 1307376 - RNA, 12 nt, Human
ucccaucccugc

SEQ ID NO: 1307377 - RNA, 14 nt, Human
ucccauccugugug

SEQ ID NO: 1307378 - RNA, 15 nt, Human
ucccauccugugugu

SEQ ID NO: 1307379 - RNA, 16 nt, Human
ucccauccuguguguu

SEQ ID NO: 1307380 - RNA, 15 nt, Human
uccccaccagaugcu

SEQ ID NO: 1307381 - RNA, 16 nt, Human
uccccaccagaugcug

SEQ ID NO: 1307382 - RNA, 20 nt, Human
uccccaccagaugcugaaaa

SEQ ID NO: 1307383 - RNA, 17 nt, Human
uccccaccagaugcuga

SEQ ID NO: 1307384 - RNA, 13 nt, Human
uccccacccacca

SEQ ID NO: 1307385 - RNA, 21 nt, Human
uccccacccaccaacccucag

SEQ ID NO: 1307386 - RNA, 22 nt, Human
uccccacccaccaacccucagg

SEQ ID NO: 1307387 - RNA, 23 nt, Human
uccccacccaccaacccucaggg

SEQ ID NO: 1307388 - RNA, 13 nt, Human
ucccauccagggc

SEQ ID NO: 1307389 - RNA, 14 nt, Human
ucccauccagggcc

SEQ ID NO: 1307390 - RNA, 14 nt, Human
ucccauccccagcg

SEQ ID NO: 1307391 - RNA, 15 nt, Human
ucccauccccagcga

SEQ ID NO: 1307392 - RNA, 12 nt, Human
ucccagcugccu

SEQ ID NO: 1307393 - RNA, 14 nt, Human
ucccagcugccuag

SEQ ID NO: 1307394 - RNA, 17 nt, Human
ucccagguuggcucugc

SEQ ID NO: 1307395 - RNA, 19 nt, Human
ucccagguuggcucugcca

SEQ ID NO: 1307396 - RNA, 20 nt, Human
ucccagguuggcucugccag

SEQ ID NO: 1307397 - RNA, 21 nt, Human
ucccagguuggcucugccagu

SEQ ID NO: 1307398 - RNA, 23 nt, Human
ucccagguuggcucugccagucc

SEQ ID NO: 1307399 - RNA, 23 nt, Human
ucccaguccaccugaggaacugu

SEQ ID NO: 1307400 - RNA, 19 nt, Human
uccccaucuucuaaaccca

SEQ ID NO: 1307401 - RNA, 17 nt, Human
uccccaugucucgacuc

SEQ ID NO: 1307402 - RNA, 17 nt, Human
uccccauggcccugagc

SEQ ID NO: 1307403 - RNA, 14 nt, Human
uccccauucuuccu

SEQ ID NO: 1307404 - RNA, 17 nt, Human
uccccauucuuccuagu

SEQ ID NO: 1307405 - RNA, 22 nt, Human
uccccauucuuccuaguuuucu

SEQ ID NO: 1307406 - RNA, 19 nt, Human
uccccauuuagguuucuga

SEQ ID NO: 1307407 - RNA, 22 nt, Human
acuacccagguuaagaaaauaa

SEQ ID NO: 1307408 - RNA, 19 nt, Human
acuacccagguuaagaaaa

SEQ ID NO: 1307409 - RNA, 16 nt, Human
acuaccgaaugugucu

SEQ ID NO: 1307410 - RNA, 17 nt, Human
acuaccgaaugugucuu

SEQ ID NO: 1307411 - RNA, 18 nt, Human
acuaccgaaugugucuuu

SEQ ID NO: 1307412 - RNA, 23 nt, Human
acuaccgaaugugucuuuagaua

SEQ ID NO: 1307413 - RNA, 19 nt, Human
acuaccgaaugugucuuua

SEQ ID NO: 1307414 - RNA, 20 nt, Human
accuuuuggucuggagggaa

SEQ ID NO: 1307415 - RNA, 16 nt, Human
uccaccuucccaugcc

SEQ ID NO: 1307416 - RNA, 18 nt, Human
uccaccuucccaugcccu

SEQ ID NO: 1307417 - RNA, 19 nt, Human
uccaccuucccaugcccug

SEQ ID NO: 1307418 - RNA, 14 nt, Human
uccaccuuucccaa

SEQ ID NO: 1307419 - RNA, 14 nt, Human
uccacgacugucuc

SEQ ID NO: 1307420 - RNA, 15 nt, Human
uccacgacugucucc

SEQ ID NO: 1307421 - RNA, 16 nt, Human
uccacgacugucucca

SEQ ID NO: 1307422 - RNA, 14 nt, Human
uccacucaugugac

SEQ ID NO: 1307423 - RNA, 21 nt, Human
uccacucaugugacucuuucc

SEQ ID NO: 1307424 - RNA, 17 nt, Human
uccacgacugucuccau

SEQ ID NO: 1307425 - RNA, 18 nt, Human
uccacgacugucuccaug

SEQ ID NO: 1307426 - RNA, 20 nt, Human
uccacucaggccuccaucuu

SEQ ID NO: 1307427 - RNA, 19 nt, Human
uccacgacugucuccaugg

SEQ ID NO: 1307428 - RNA, 18 nt, Human
accuuagaccaccaagcc

SEQ ID NO: 1307429 - RNA, 19 nt, Human
accuuagaccaccaagccu

SEQ ID NO: 1307430 - RNA, 20 nt, Human
accuuagaccaccaagccuu

SEQ ID NO: 1307431 - RNA, 21 nt, Human
accuuagaccaccaagccuug

SEQ ID NO: 1307432 - RNA, 22 nt, Human
accuuagauguucuaagucuuu

SEQ ID NO: 1307433 - RNA, 22 nt, Human
accuuagaccaccaagccuuga

SEQ ID NO: 1307434 - RNA, 19 nt, Human
accuucaaacuagggccaa

SEQ ID NO: 1307435 - RNA, 11 nt, Human
uccagaccuga

SEQ ID NO: 1307436 - RNA, 15 nt, Human
uccagaccugaagaa

SEQ ID NO: 1307437 - RNA, 16 nt, Human
uccagaccugaagaau

SEQ ID NO: 1307438 - RNA, 13 nt, Human
uccagaccugauc

SEQ ID NO: 1307439 - RNA, 18 nt, Human
uccagaccugauccugga

SEQ ID NO: 1307440 - RNA, 19 nt, Human
uccagaccugauccuggag

SEQ ID NO: 1307441 - RNA, 22 nt, Human
uccagaccugauccuggaggcc

SEQ ID NO: 1307442 - RNA, 15 nt, Human
uccagaccugaggcg

SEQ ID NO: 1307443 - RNA, 22 nt, Human
uccagacugcuuccaauuuucu

SEQ ID NO: 1307444 - RNA, 23 nt, Human
uccagacugcuuccaauuuucug

SEQ ID NO: 1307445 - RNA, 14 nt, Human
uccagagacaacag

SEQ ID NO: 1307446 - RNA, 15 nt, Human
uccagagacaacagg

SEQ ID NO: 1307447 - RNA, 13 nt, Human
uccacugccuucg

SEQ ID NO: 1307448 - RNA, 15 nt, Human
uccacugccuucgau

SEQ ID NO: 1307449 - RNA, 22 nt, Human
uccacugccuucgauacaccgg

SEQ ID NO: 1307450 - RNA, 14 nt, Human
acgagaaaacaaua

SEQ ID NO: 1307451 - RNA, 15 nt, Human
uccaggcuguguuug

SEQ ID NO: 1307452 - RNA, 23 nt, Human
uccaggcuucugcuggggccugg

SEQ ID NO: 1307453 - RNA, 17 nt, Human
uccaggcuucugcuggg

SEQ ID NO: 1307454 - RNA, 19 nt, Human
acgagcuguuuacuaggga

SEQ ID NO: 1307455 - RNA, 20 nt, Human
acgaggaaucugugggucug

SEQ ID NO: 1307456 - RNA, 22 nt, Human
acgaggaaucugugggucuggg

SEQ ID NO: 1307457 - RNA, 21 nt, Human
acgagaaccugaaggggaagg

SEQ ID NO: 1307458 - RNA, 16 nt, Human
acgagacguuuccuac

SEQ ID NO: 1307459 - RNA, 14 nt, Human
acgagacuuuccau

SEQ ID NO: 1307460 - RNA, 17 nt, Human
acgagagcagaggucuc

SEQ ID NO: 1307461 - RNA, 15 nt, Human
uccagccccucuggu

SEQ ID NO: 1307462 - RNA, 16 nt, Human
uccagccccucugguc

SEQ ID NO: 1307463 - RNA, 15 nt, Human
uccagagaguggcuc

SEQ ID NO: 1307464 - RNA, 16 nt, Human
uccagagacaacaggu

SEQ ID NO: 1307465 - RNA, 16 nt, Human
uccagagaguggcucc

SEQ ID NO: 1307466 - RNA, 17 nt, Human
uccagagaguggcuccu

SEQ ID NO: 1307467 - RNA, 18 nt, Human
uccagccccucuggucgc

SEQ ID NO: 1307468 - RNA, 23 nt, Human
uccagccccucuggucgcuccug

SEQ ID NO: 1307469 - RNA, 18 nt, Human
uccagccccucuuggaga

SEQ ID NO: 1307470 - RNA, 20 nt, Human
uccagccccucuuggagaag

SEQ ID NO: 1307471 - RNA, 21 nt, Human
uccagccccucuuggagaagu

SEQ ID NO: 1307472 - RNA, 13 nt, Human
uccaggcaccagg

SEQ ID NO: 1307473 - RNA, 21 nt, Human
uccaggcaccaggacuagggc

SEQ ID NO: 1307474 - RNA, 14 nt, Human
uccaggcacugaga

SEQ ID NO: 1307475 - RNA, 16 nt, Human
uccaggcacugagaua

SEQ ID NO: 1307476 - RNA, 13 nt, Human
uccaggcagaucc

SEQ ID NO: 1307477 - RNA, 11 nt, Human
uccaggcccaa

SEQ ID NO: 1307478 - RNA, 15 nt, Human
uccaggcccaaggcu

SEQ ID NO: 1307479 - RNA, 17 nt, Human
uccaggcccaaggcucc

SEQ ID NO: 1307480 - RNA, 18 nt, Human
uccaggcccaaggcuccc

SEQ ID NO: 1307481 - RNA, 19 nt, Human
uccaggcccaaggcucccg

SEQ ID NO: 1307482 - RNA, 20 nt, Human
uccaggcccaaggcucccgg

SEQ ID NO: 1307483 - RNA, 21 nt, Human
uccaggcaggucugaagcuca

SEQ ID NO: 1307484 - RNA, 14 nt, Human
uccaggcagaucca

SEQ ID NO: 1307485 - RNA, 15 nt, Human
uccaggcagauccag

SEQ ID NO: 1307486 - RNA, 16 nt, Human
uccaggcagauccagg

SEQ ID NO: 1307487 - RNA, 17 nt, Human
uccaggcagauccagga

SEQ ID NO: 1307488 - RNA, 18 nt, Human
uccaggcagauccaggac

SEQ ID NO: 1307489 - RNA, 19 nt, Human
uccaggcagauccaggacu

SEQ ID NO: 1307490 - RNA, 20 nt, Human
uccaggcagauccaggacua

SEQ ID NO: 1307491 - RNA, 21 nt, Human
uccaggcagauccaggacuau

SEQ ID NO: 1307492 - RNA, 15 nt, Human
uccaacccuagcaaa

SEQ ID NO: 1307493 - RNA, 21 nt, Human
uccaaccggcuuuguggcacu

SEQ ID NO: 1307494 - RNA, 14 nt, Human
uccaacccuagcaa

SEQ ID NO: 1307495 - RNA, 13 nt, Human
uccaacccuagca

SEQ ID NO: 1307496 - RNA, 22 nt, Human
uccaacccgucuggcccaccag

SEQ ID NO: 1307497 - RNA, 23 nt, Human
uccaacccgucuggcccaccagg

SEQ ID NO: 1307498 - RNA, 15 nt, Human
uccaacuuggcugca

SEQ ID NO: 1307499 - RNA, 16 nt, Human
uccaagguggggugga

SEQ ID NO: 1307500 - RNA, 13 nt, Human
uccaagguuuaaa

SEQ ID NO: 1307501 - RNA, 14 nt, Human
uccaagguuuaaag

SEQ ID NO: 1307502 - RNA, 15 nt, Human
uccaagguuuaaaga

SEQ ID NO: 1307503 - RNA, 16 nt, Human
uccaagguuuaaagag

SEQ ID NO: 1307504 - RNA, 19 nt, Human
uccaagguuuaaagagucu

SEQ ID NO: 1307505 - RNA, 20 nt, Human
uccaagguuuaaagagucua

SEQ ID NO: 1307506 - RNA, 18 nt, Human
uccaaucccaccaacccu

SEQ ID NO: 1307507 - RNA, 22 nt, Human
uccaagguuuaaagagucuaga

SEQ ID NO: 1307508 - RNA, 14 nt, Human
uccaagucuccacc

SEQ ID NO: 1307509 - RNA, 16 nt, Human
uccaauccuauguuuu

SEQ ID NO: 1307510 - RNA, 23 nt, Human
uccaacuggcccuauuuagauga

SEQ ID NO: 1307511 - RNA, 23 nt, Human
uccaacuuggcugcaggaaucuu

SEQ ID NO: 1307512 - RNA, 21 nt, Human
uccaaccugcaaagaucuguc

SEQ ID NO: 1307513 - RNA, 18 nt, Human
uccaacucgaaucugugu

SEQ ID NO: 1307514 - RNA, 19 nt, Human
uccaacucgaaucugugug

SEQ ID NO: 1307515 - RNA, 24 nt, Human
uccaacucuucccccucucccagu

SEQ ID NO: 1307516 - RNA, 21 nt, Human
accuggucacaggacucugcc

SEQ ID NO: 1307517 - RNA, 11 nt, Human
accuggccuuc

SEQ ID NO: 1307518 - RNA, 15 nt, Human
accuggcucucaccu

SEQ ID NO: 1307519 - RNA, 16 nt, Human
accuggcucucaccuc

SEQ ID NO: 1307520 - RNA, 20 nt, Human
accuggcucucaccucuagg

SEQ ID NO: 1307521 - RNA, 17 nt, Human
accuggcucucaccucu

SEQ ID NO: 1307522 - RNA, 16 nt, Human
accuggguugcagaca

SEQ ID NO: 1307523 - RNA, 18 nt, Human
accuggguugcagacagg

SEQ ID NO: 1307524 - RNA, 20 nt, Human
accuggguugcagacaggaa

SEQ ID NO: 1307525 - RNA, 16 nt, Human
accugguacccuccug

SEQ ID NO: 1307526 - RNA, 18 nt, Human
accugguacccuccuggc

SEQ ID NO: 1307527 - RNA, 19 nt, Human
accugguacccuccuggcu

SEQ ID NO: 1307528 - RNA, 17 nt, Human
accugguacucccucuc

SEQ ID NO: 1307529 - RNA, 21 nt, Human
accugguacucccucucagga

SEQ ID NO: 1307530 - RNA, 12 nt, Human
uccaaugagcuu

SEQ ID NO: 1307531 - RNA, 13 nt, Human
uccaaugagcuuu

SEQ ID NO: 1307532 - RNA, 14 nt, Human
uccaaugagcuuuc

SEQ ID NO: 1307533 - RNA, 20 nt, Human
uccaaugagcuuucugaaca

SEQ ID NO: 1307534 - RNA, 15 nt, Human
uccaaugagcuuucu

SEQ ID NO: 1307535 - RNA, 16 nt, Human
uccaaugagcuuucug

SEQ ID NO: 1307536 - RNA, 17 nt, Human
uccaaugagcuuucuga

SEQ ID NO: 1307537 - RNA, 18 nt, Human
uccaaugagcuuucugaa

SEQ ID NO: 1307538 - RNA, 19 nt, Human
uccaaugagcuuucugaac

SEQ ID NO: 1307539 - RNA, 14 nt, Human
accuggauggggca

SEQ ID NO: 1307540 - RNA, 19 nt, Human
accuggauggggcaggcca

SEQ ID NO: 1307541 - RNA, 14 nt, Human
accuggcagcucug

SEQ ID NO: 1307542 - RNA, 17 nt, Human
accuggcagcucuggac

SEQ ID NO: 1307543 - RNA, 21 nt, Human
accuggcaucgcaccauucug

SEQ ID NO: 1307544 - RNA, 21 nt, Human
accuagggugauauuaaccag

SEQ ID NO: 1307545 - RNA, 16 nt, Human
accuaccaccacgccc

SEQ ID NO: 1307546 - RNA, 20 nt, Human
accuaccaccacgcccggcu

SEQ ID NO: 1307547 - RNA, 14 nt, Human
accuaguuuuccau

SEQ ID NO: 1307548 - RNA, 15 nt, Human
accucaaaauuuaac

SEQ ID NO: 1307549 - RNA, 22 nt, Human
accuaauccaggcagauccagg

SEQ ID NO: 1307550 - RNA, 17 nt, Human
accuaaucucuguaaag

SEQ ID NO: 1307551 - RNA, 21 nt, Human
accuaaucucuguaaagcuaa

SEQ ID NO: 1307552 - RNA, 20 nt, Human
accuacagagaugcuaagag

SEQ ID NO: 1307553 - RNA, 17 nt, Human
accuacagggggucugg

SEQ ID NO: 1307554 - RNA, 19 nt, Human
accuacagggggucuggcu

SEQ ID NO: 1307555 - RNA, 21 nt, Human
accuacagggggucuggcugg

SEQ ID NO: 1307556 - RNA, 23 nt, Human
accuacagggggucuggcuggug

SEQ ID NO: 1307557 - RNA, 22 nt, Human
accuacagggggucuggcuggu

SEQ ID NO: 1307558 - RNA, 11 nt, Human
accuacaguuu

SEQ ID NO: 1307559 - RNA, 16 nt, Human
accuacaguuuuaacu

SEQ ID NO: 1307560 - RNA, 17 nt, Human
accuacaguuuuaacug

SEQ ID NO: 1307561 - RNA, 19 nt, Human
accuacaguuuuaacugug

SEQ ID NO: 1307562 - RNA, 18 nt, Human
accuacaguuuuaacugu

SEQ ID NO: 1307563 - RNA, 17 nt, Human
ucaggaaccgaggcagg

SEQ ID NO: 1307564 - RNA, 22 nt, Human
ucaggaaaggaaucauuucuau

SEQ ID NO: 1307565 - RNA, 17 nt, Human
accgcgucuacccuggg

SEQ ID NO: 1307566 - RNA, 18 nt, Human
accgcgucuacccuggga

SEQ ID NO: 1307567 - RNA, 19 nt, Human
accgcgucuacccugggau

SEQ ID NO: 1307568 - RNA, 20 nt, Human
accgcgacuaauuucaaaau

SEQ ID NO: 1307569 - RNA, 16 nt, Human
accgcgacuaauuuca

SEQ ID NO: 1307570 - RNA, 17 nt, Human
accgcgacuaauuucaa

SEQ ID NO: 1307571 - RNA, 13 nt, Human
accgcuaaaagaa

SEQ ID NO: 1307572 - RNA, 15 nt, Human
accgcuaaaagaaac

SEQ ID NO: 1307573 - RNA, 16 nt, Human
accgcuaaaagaaacu

SEQ ID NO: 1307574 - RNA, 14 nt, Human
accgcuacaccacu

SEQ ID NO: 1307575 - RNA, 17 nt, Human
accgcuacaccacucug

SEQ ID NO: 1307576 - RNA, 19 nt, Human
accgcuacaccacucuggc

SEQ ID NO: 1307577 - RNA, 21 nt, Human
accgcuacaccacucuggcag

SEQ ID NO: 1307578 - RNA, 20 nt, Human
accgcuacaccacucuggca

SEQ ID NO: 1307579 - RNA, 13 nt, Human
accuaaaacuuaa

SEQ ID NO: 1307580 - RNA, 23 nt, Human
accuaaacauagaaauugccuga

SEQ ID NO: 1307581 - RNA, 12 nt, Human
accuaaagaaaa

SEQ ID NO: 1307582 - RNA, 13 nt, Human
accuaaagaaaaa

SEQ ID NO: 1307583 - RNA, 17 nt, Human
accuaaagaaaaacaaa

SEQ ID NO: 1307584 - RNA, 15 nt, Human
accuaaauggccuca

SEQ ID NO: 1307585 - RNA, 20 nt, Human
accuaacaacauuguagccu

SEQ ID NO: 1307586 - RNA, 18 nt, Human
ucaucucagcucacugca

SEQ ID NO: 1307587 - RNA, 13 nt, Human
ucaucucagcuca

SEQ ID NO: 1307588 - RNA, 16 nt, Human
ucaugaauuaguuuua

SEQ ID NO: 1307589 - RNA, 12 nt, Human
ucaugaauguaa

SEQ ID NO: 1307590 - RNA, 18 nt, Human
ucaucuagguaaauuaca

SEQ ID NO: 1307591 - RNA, 13 nt, Human
ucauccuugucuu

SEQ ID NO: 1307592 - RNA, 14 nt, Human
ucauccuugucuua

SEQ ID NO: 1307593 - RNA, 22 nt, Human
ucauccucuccacagcugccuc

SEQ ID NO: 1307594 - RNA, 12 nt, Human
ucauccucuggc

SEQ ID NO: 1307595 - RNA, 11 nt, Human
ucauccucugg

SEQ ID NO: 1307596 - RNA, 23 nt, Human
ucauccucaaagaaaguguauug

SEQ ID NO: 1307597 - RNA, 23 nt, Human
ucauccucacagugaacacucag

SEQ ID NO: 1307598 - RNA, 12 nt, Human
ucauccugcagg

SEQ ID NO: 1307599 - RNA, 13 nt, Human
ucauccugcaggc

SEQ ID NO: 1307600 - RNA, 17 nt, Human
ucauccucaaagaaagu

SEQ ID NO: 1307601 - RNA, 18 nt, Human
ucauccucaaagaaagug

SEQ ID NO: 1307602 - RNA, 21 nt, Human
ucauccucaaagaaaguguau

SEQ ID NO: 1307603 - RNA, 22 nt, Human
ucauccucaaagaaaguguauu

SEQ ID NO: 1307604 - RNA, 19 nt, Human
accucccucaaccucaucc

SEQ ID NO: 1307605 - RNA, 16 nt, Human
accucaacugccuacu

SEQ ID NO: 1307606 - RNA, 22 nt, Human
accucaacugccuacuccaaaa

SEQ ID NO: 1307607 - RNA, 14 nt, Human
accucaagcugcau

SEQ ID NO: 1307608 - RNA, 17 nt, Human
ucauccuaaagaacaaa

SEQ ID NO: 1307609 - RNA, 14 nt, Human
ucauccucaaagaa

SEQ ID NO: 1307610 - RNA, 21 nt, Human
ucaucccgagcaccuccacau

SEQ ID NO: 1307611 - RNA, 23 nt, Human
ucaucccgagcaccuccacaucc

SEQ ID NO: 1307612 - RNA, 22 nt, Human
accucuccagccucagcucuca

SEQ ID NO: 1307613 - RNA, 20 nt, Human
accucuccagccucagcucu

SEQ ID NO: 1307614 - RNA, 18 nt, Human
accucuccagccucagcu

SEQ ID NO: 1307615 - RNA, 16 nt, Human
accucuccagccucag

SEQ ID NO: 1307616 - RNA, 23 nt, Human
accucucaauauucaauaaagcu

SEQ ID NO: 1307617 - RNA, 21 nt, Human
accucucaauauucaauaaag

SEQ ID NO: 1307618 - RNA, 20 nt, Human
accucucaauauucaauaaa

SEQ ID NO: 1307619 - RNA, 19 nt, Human
accucucaauauucaauaa

SEQ ID NO: 1307620 - RNA, 14 nt, Human
accucuaaauucuu

SEQ ID NO: 1307621 - RNA, 17 nt, Human
accucuccccuggaacu

SEQ ID NO: 1307622 - RNA, 11 nt, Human
accugaaaaca

SEQ ID NO: 1307623 - RNA, 18 nt, Human
accugaaaacacugugca

SEQ ID NO: 1307624 - RNA, 19 nt, Human
accugaaaacacugugcac

SEQ ID NO: 1307625 - RNA, 20 nt, Human
accugaaaacacugugcaca

SEQ ID NO: 1307626 - RNA, 17 nt, Human
accugaggaacugucuc

SEQ ID NO: 1307627 - RNA, 15 nt, Human
accugagaccugaag

SEQ ID NO: 1307628 - RNA, 15 nt, Human
accugagauuuauua

SEQ ID NO: 1307629 - RNA, 17 nt, Human
accugagauuuauuaaa

SEQ ID NO: 1307630 - RNA, 18 nt, Human
accugagauuuauuaaag

SEQ ID NO: 1307631 - RNA, 19 nt, Human
accugagauuuauuaaaga

SEQ ID NO: 1307632 - RNA, 20 nt, Human
accugagauuuauuaaagaa

SEQ ID NO: 1307633 - RNA, 17 nt, Human
accugagccugccgagc

SEQ ID NO: 1307634 - RNA, 21 nt, Human
accugagccugccgagcaacc

SEQ ID NO: 1307635 - RNA, 12 nt, Human
accugagcuaaa

SEQ ID NO: 1307636 - RNA, 22 nt, Human
accugagcuaaauaaagauauu

SEQ ID NO: 1307637 - RNA, 21 nt, Human
accugaaaacacugugcacau

SEQ ID NO: 1307638 - RNA, 14 nt, Human
accugaaauuccaa

SEQ ID NO: 1307639 - RNA, 15 nt, Human
accugaaauuccaaa

SEQ ID NO: 1307640 - RNA, 16 nt, Human
accugaaauuccaaag

SEQ ID NO: 1307641 - RNA, 16 nt, Human
accugaccccugcuca

SEQ ID NO: 1307642 - RNA, 17 nt, Human
accugaccccugcucag

SEQ ID NO: 1307643 - RNA, 23 nt, Human
accugaccccugcucaguaaagc

SEQ ID NO: 1307644 - RNA, 14 nt, Human
accugagggucugu

SEQ ID NO: 1307645 - RNA, 15 nt, Human
accugagggucugua

SEQ ID NO: 1307646 - RNA, 17 nt, Human
accugagggucuguagg

SEQ ID NO: 1307647 - RNA, 18 nt, Human
accugagggucuguaggu

SEQ ID NO: 1307648 - RNA, 19 nt, Human
accugagggucuguagguu

SEQ ID NO: 1307649 - RNA, 22 nt, Human
accugagucacccuaccugugc

SEQ ID NO: 1307650 - RNA, 23 nt, Human
accugagucacccuaccugugcc

SEQ ID NO: 1307651 - RNA, 21 nt, Human
accugagucguacagaaagcu

SEQ ID NO: 1307652 - RNA, 11 nt, Human
accugauuuuu

SEQ ID NO: 1307653 - RNA, 17 nt, Human
accugcacuaacagagu

SEQ ID NO: 1307654 - RNA, 18 nt, Human
accugcacuaacagagug

SEQ ID NO: 1307655 - RNA, 23 nt, Human
accugcacuggggagcccgucuc

SEQ ID NO: 1307656 - RNA, 17 nt, Human
accucgugauccacccg

SEQ ID NO: 1307657 - RNA, 19 nt, Human
accuccuucccucucugga

SEQ ID NO: 1307658 - RNA, 21 nt, Human
accuccuucccucucuggaga

SEQ ID NO: 1307659 - RNA, 22 nt, Human
accuccuucccucucuggagaa

SEQ ID NO: 1307660 - RNA, 13 nt, Human
accuccuucccuc

SEQ ID NO: 1307661 - RNA, 14 nt, Human
accuccuucccucu

SEQ ID NO: 1307662 - RNA, 15 nt, Human
accuccuucccucuc

SEQ ID NO: 1307663 - RNA, 16 nt, Human
accuccuucccucucu

SEQ ID NO: 1307664 - RNA, 17 nt, Human
accuccuucccucucug

SEQ ID NO: 1307665 - RNA, 18 nt, Human
accuccuucccucucugg

SEQ ID NO: 1307666 - RNA, 21 nt, Human
ucaugaauuaguuuuauaugc

SEQ ID NO: 1307667 - RNA, 13 nt, Human
ucaugaauguaaa

SEQ ID NO: 1307668 - RNA, 14 nt, Human
ucaugaauguaaau

SEQ ID NO: 1307669 - RNA, 19 nt, Human
ucaugaauguaaauuugua

SEQ ID NO: 1307670 - RNA, 20 nt, Human
ucaugaauguaaauuuguac

SEQ ID NO: 1307671 - RNA, 21 nt, Human
ucaugaauguaaauuuguacu

SEQ ID NO: 1307672 - RNA, 16 nt, Human
ucaugauccaacuaau

SEQ ID NO: 1307673 - RNA, 23 nt, Human
ucaugauuagaaauuaccugugg

SEQ ID NO: 1307674 - RNA, 18 nt, Human
ucauuaaucugccucccu

SEQ ID NO: 1307675 - RNA, 17 nt, Human
ucauuaaucugccuccc

SEQ ID NO: 1307676 - RNA, 13 nt, Human
ucauuaauucuau

SEQ ID NO: 1307677 - RNA, 14 nt, Human
ucauuaauucuaua

SEQ ID NO: 1307678 - RNA, 12 nt, Human
ucauuacuauaa

SEQ ID NO: 1307679 - RNA, 14 nt, Human
ucauucucugucuc

SEQ ID NO: 1307680 - RNA, 15 nt, Human
ucauucucugucuca

SEQ ID NO: 1307681 - RNA, 16 nt, Human
ucauucucugucucau

SEQ ID NO: 1307682 - RNA, 18 nt, Human
ucauucucugucucaucc

SEQ ID NO: 1307683 - RNA, 19 nt, Human
ucauucucugucucaucca

SEQ ID NO: 1307684 - RNA, 18 nt, Human
ucauucugaaggagcccc

SEQ ID NO: 1307685 - RNA, 16 nt, Human
ucauucugcaaguaua

SEQ ID NO: 1307686 - RNA, 14 nt, Human
ucauucuuauuuca

SEQ ID NO: 1307687 - RNA, 18 nt, Human
ucauucuuauuucaugaa

SEQ ID NO: 1307688 - RNA, 21 nt, Human
uauuuuuaucaguuacacaug

SEQ ID NO: 1307689 - RNA, 12 nt, Human
uauuuuuaucuu

SEQ ID NO: 1307690 - RNA, 16 nt, Human
uauuuuucuaacuaca

SEQ ID NO: 1307691 - RNA, 12 nt, Human
uauuuuucuuga

SEQ ID NO: 1307692 - RNA, 18 nt, Human
ucaaaagaaagaaaauca

SEQ ID NO: 1307693 - RNA, 16 nt, Human
uauuuguaaaaugaca

SEQ ID NO: 1307694 - RNA, 13 nt, Human
uauuuguaaaucu

SEQ ID NO: 1307695 - RNA, 17 nt, Human
uauuuguaaaucugcca

SEQ ID NO: 1307696 - RNA, 21 nt, Human
uauuuuuaauuaauugggcca

SEQ ID NO: 1307697 - RNA, 18 nt, Human
uauuuuuacauucugaau

SEQ ID NO: 1307698 - RNA, 14 nt, Human
uauuuuuaauuaau

SEQ ID NO: 1307699 - RNA, 19 nt, Human
ucaaaauuguuacaaauug

SEQ ID NO: 1307700 - RNA, 16 nt, Human
ucaaaauuguuacaaa

SEQ ID NO: 1307701 - RNA, 21 nt, Human
ucaaaaugcucuuauuucauc

SEQ ID NO: 1307702 - RNA, 20 nt, Human
ucaaaauguuaucuucucaa

SEQ ID NO: 1307703 - RNA, 21 nt, Human
ucaaaauguuaucuucucaag

SEQ ID NO: 1307704 - RNA, 12 nt, Human
ucaaaaugcuuu

SEQ ID NO: 1307705 - RNA, 17 nt, Human
ucaaaaugcuuuuuauu

SEQ ID NO: 1307706 - RNA, 19 nt, Human
ucaaaaugcuuuuuauuuc

SEQ ID NO: 1307707 - RNA, 22 nt, Human
ucaaaaugcucuuauuucauca

SEQ ID NO: 1307708 - RNA, 20 nt, Human
ucaaaaugcucuuauuucau

SEQ ID NO: 1307709 - RNA, 19 nt, Human
ucaaaaugcucuuauuuca

SEQ ID NO: 1307710 - RNA, 16 nt, Human
ucaaaaugcucuuauu

SEQ ID NO: 1307711 - RNA, 14 nt, Human
ucaaaaugcucuua

SEQ ID NO: 1307712 - RNA, 21 nt, Human
ucaaaaugauuuccucuguaa

SEQ ID NO: 1307713 - RNA, 22 nt, Human
ucaaaaugauuuccucuguaau

SEQ ID NO: 1307714 - RNA, 14 nt, Human
ucaaaaucucucca

SEQ ID NO: 1307715 - RNA, 16 nt, Human
ucaaaaucucuccacu

SEQ ID NO: 1307716 - RNA, 21 nt, Human
ucaaaaucucuccacuuucag

SEQ ID NO: 1307717 - RNA, 22 nt, Human
ucaaaaucucuccacuuucagc

SEQ ID NO: 1307718 - RNA, 23 nt, Human
ucaaaaucucuccacuuucagcu

SEQ ID NO: 1307719 - RNA, 16 nt, Human
ucaaaauauuuguaca

SEQ ID NO: 1307720 - RNA, 17 nt, Human
ucaaaauauuuguacau

SEQ ID NO: 1307721 - RNA, 19 nt, Human
ucaaaauauuuguacauag

SEQ ID NO: 1307722 - RNA, 18 nt, Human
ucaaaauauuuguacaua

SEQ ID NO: 1307723 - RNA, 21 nt, Human
ucaaaauaugccccauucaac

SEQ ID NO: 1307724 - RNA, 22 nt, Human
ucaaaauagggacuaucuaucu

SEQ ID NO: 1307725 - RNA, 17 nt, Human
ucaaaauagugccacua

SEQ ID NO: 1307726 - RNA, 22 nt, Human
ucaaaagcuauuuaaagcaucu

SEQ ID NO: 1307727 - RNA, 13 nt, Human
ucaaaaguuuguu

SEQ ID NO: 1307728 - RNA, 14 nt, Human
ucaaaaguuuguuu

SEQ ID NO: 1307729 - RNA, 17 nt, Human
ucaaaagcuauuuaaag

SEQ ID NO: 1307730 - RNA, 14 nt, Human
ucaaaguuuaauaa

SEQ ID NO: 1307731 - RNA, 13 nt, Human
ucaaaguuuaaua

SEQ ID NO: 1307732 - RNA, 12 nt, Human
ucaaagccagcg

SEQ ID NO: 1307733 - RNA, 22 nt, Human
ucaaagccagcguccuccucug

SEQ ID NO: 1307734 - RNA, 23 nt, Human
ucaaagccagcguccuccucugu

SEQ ID NO: 1307735 - RNA, 21 nt, Human
ucaaagcaugggauuauuaga

SEQ ID NO: 1307736 - RNA, 11 nt, Human
ucaaagcugcc

SEQ ID NO: 1307737 - RNA, 18 nt, Human
ucaaagcugccugucccu

SEQ ID NO: 1307738 - RNA, 19 nt, Human
ucaaagcuguguguuugga

SEQ ID NO: 1307739 - RNA, 15 nt, Human
ucaaagcuuuuucca

SEQ ID NO: 1307740 - RNA, 16 nt, Human
ucaaagcuuuuuccag

SEQ ID NO: 1307741 - RNA, 20 nt, Human
ucaaaggagcgagcaugucg

SEQ ID NO: 1307742 - RNA, 14 nt, Human
ucaaagcugaaaug

SEQ ID NO: 1307743 - RNA, 19 nt, Human
ucaaagcaucuugcauuau

SEQ ID NO: 1307744 - RNA, 20 nt, Human
ucaaagcaugggauuauuag

SEQ ID NO: 1307745 - RNA, 22 nt, Human
ucaaaauguuaucuucucaagu

SEQ ID NO: 1307746 - RNA, 24 nt, Human
ucaaaauuagugcuuuuuguguca

SEQ ID NO: 1307747 - RNA, 21 nt, Human
ucaaaauuuaacaguuaccug

SEQ ID NO: 1307748 - RNA, 14 nt, Human
ucaaacaaugacaa

SEQ ID NO: 1307749 - RNA, 19 nt, Human
ucaaacaaugacaaagcag

SEQ ID NO: 1307750 - RNA, 21 nt, Human
ucaaacaaugacaaagcagau

SEQ ID NO: 1307751 - RNA, 20 nt, Human
ucaaacaaugacaaagcaga

SEQ ID NO: 1307752 - RNA, 21 nt, Human
ucaaacaccaacauaaaaaug

SEQ ID NO: 1307753 - RNA, 16 nt, Human
acaugaaguccaagca

SEQ ID NO: 1307754 - RNA, 21 nt, Human
acaugaagguaaauaaaaaga

SEQ ID NO: 1307755 - RNA, 22 nt, Human
acaugaagguaaauaaaaagaa

SEQ ID NO: 1307756 - RNA, 23 nt, Human
acaugaagguaaauaaaaagaaa

SEQ ID NO: 1307757 - RNA, 12 nt, Human
acaugaaguauu

SEQ ID NO: 1307758 - RNA, 22 nt, Human
acaugaagauucuuucccaauu

SEQ ID NO: 1307759 - RNA, 19 nt, Human
acaugaagcuguuguguga

SEQ ID NO: 1307760 - RNA, 13 nt, Human
acaugaagcuguu

SEQ ID NO: 1307761 - RNA, 13 nt, Human
acaugaagguaaa

SEQ ID NO: 1307762 - RNA, 15 nt, Human
acaugaagguaaaua

SEQ ID NO: 1307763 - RNA, 16 nt, Human
acaugaagguaaauaa

SEQ ID NO: 1307764 - RNA, 20 nt, Human
ucaaauacgugggcauucaa

SEQ ID NO: 1307765 - RNA, 14 nt, Human
acaugaagaccuuu

SEQ ID NO: 1307766 - RNA, 13 nt, Human
acaugaagaccuu

SEQ ID NO: 1307767 - RNA, 16 nt, Human
acaugaagaagcuaaa

SEQ ID NO: 1307768 - RNA, 21 nt, Human
acaugaagaccuuuuucugca

SEQ ID NO: 1307769 - RNA, 20 nt, Human
acaugaagaccuuuuucugc

SEQ ID NO: 1307770 - RNA, 15 nt, Human
acaugaagauucuuu

SEQ ID NO: 1307771 - RNA, 17 nt, Human
acaugaagauucuuucc

SEQ ID NO: 1307772 - RNA, 18 nt, Human
acaugaagauucuuuccc

SEQ ID NO: 1307773 - RNA, 21 nt, Human
ucaaauacauuuaaaacauua

SEQ ID NO: 1307774 - RNA, 22 nt, Human
ucaaauacauuuaaaacauuaa

SEQ ID NO: 1307775 - RNA, 19 nt, Human
acaugauccugcaauucca

SEQ ID NO: 1307776 - RNA, 13 nt, Human
acaugaaguauuu

SEQ ID NO: 1307777 - RNA, 14 nt, Human
acaugaaguauuuu

SEQ ID NO: 1307778 - RNA, 22 nt, Human
ucaagaacacagcccugcuucu

SEQ ID NO: 1307779 - RNA, 22 nt, Human
ucaagaagugaagaaugcacaa

SEQ ID NO: 1307780 - RNA, 22 nt, Human
ucaagaaaacaggcacugcccu

SEQ ID NO: 1307781 - RNA, 21 nt, Human
ucaagaaagcuucaaacugca

SEQ ID NO: 1307782 - RNA, 20 nt, Human
ucaagaaauaaaaggaagcc

SEQ ID NO: 1307783 - RNA, 21 nt, Human
ucaagaaauaaaaggaagcca

SEQ ID NO: 1307784 - RNA, 22 nt, Human
ucaagaaauaaaaggaagccaa

SEQ ID NO: 1307785 - RNA, 17 nt, Human
ucaagaaauaaguuuuu

SEQ ID NO: 1307786 - RNA, 14 nt, Human
ucaagaaauaaguu

SEQ ID NO: 1307787 - RNA, 21 nt, Human
ucaagaauaaucacgcuuucc

SEQ ID NO: 1307788 - RNA, 19 nt, Human
ucaagaauagcauuguaaa

SEQ ID NO: 1307789 - RNA, 22 nt, Human
ucaagacccuuuuggguuucug

SEQ ID NO: 1307790 - RNA, 15 nt, Human
ucaagagacugaguc

SEQ ID NO: 1307791 - RNA, 22 nt, Human
ucaagagcccugucaguagagu

SEQ ID NO: 1307792 - RNA, 22 nt, Human
ucaacaggccucagggcuccuu

SEQ ID NO: 1307793 - RNA, 13 nt, Human
ucaacaguaaacc

SEQ ID NO: 1307794 - RNA, 14 nt, Human
ucaacaguaaacca

SEQ ID NO: 1307795 - RNA, 18 nt, Human
ucaacaguaaaccacuga

SEQ ID NO: 1307796 - RNA, 20 nt, Human
ucaacaguaaaccacugaaa

SEQ ID NO: 1307797 - RNA, 22 nt, Human
ucaacaguaaaccacugaaaaa

SEQ ID NO: 1307798 - RNA, 15 nt, Human
ucaacagugaagaca

SEQ ID NO: 1307799 - RNA, 17 nt, Human
ucaacagugaagacaga

SEQ ID NO: 1307800 - RNA, 22 nt, Human
ucaacagugaagacagaaguuu

SEQ ID NO: 1307801 - RNA, 18 nt, Human
ucaacagugaagacagaa

SEQ ID NO: 1307802 - RNA, 14 nt, Human
ucaacaguuuuccu

SEQ ID NO: 1307803 - RNA, 15 nt, Human
ucaacaguuuuccua

SEQ ID NO: 1307804 - RNA, 17 nt, Human
ucaacaguuuuccuaug

SEQ ID NO: 1307805 - RNA, 20 nt, Human
ucaacaguuuuccuaugcuu

SEQ ID NO: 1307806 - RNA, 22 nt, Human
ucaacaguuuuccuaugcuuug

SEQ ID NO: 1307807 - RNA, 23 nt, Human
ucaacaguuuuccuaugcuuuga

SEQ ID NO: 1307808 - RNA, 23 nt, Human
ucaagaaaacaggcacugcccug

SEQ ID NO: 1307809 - RNA, 15 nt, Human
ucaagaaaacaggca

SEQ ID NO: 1307810 - RNA, 19 nt, Human
ucaagaaaacaggcacugc

SEQ ID NO: 1307811 - RNA, 12 nt, Human
ucaagaaacuga

SEQ ID NO: 1307812 - RNA, 13 nt, Human
ucaagaaacugag

SEQ ID NO: 1307813 - RNA, 17 nt, Human
ucaagaaacugaggaau

SEQ ID NO: 1307814 - RNA, 18 nt, Human
ucaagaaacugaggaauu

SEQ ID NO: 1307815 - RNA, 20 nt, Human
ucaagaaacugaggaauuuu

SEQ ID NO: 1307816 - RNA, 22 nt, Human
ucaagaaacugaggaauuuucu

SEQ ID NO: 1307817 - RNA, 23 nt, Human
ucaagaaacugaggaauuuucuu

SEQ ID NO: 1307818 - RNA, 16 nt, Human
ucaagggucaggccuu

SEQ ID NO: 1307819 - RNA, 15 nt, Human
ucaaggucguuuuuu

SEQ ID NO: 1307820 - RNA, 12 nt, Human
ucaaguauuugg

SEQ ID NO: 1307821 - RNA, 23 nt, Human
ucaagggcagcuuugcucauauu

SEQ ID NO: 1307822 - RNA, 21 nt, Human
ucaagggcagcuuugcucaua

SEQ ID NO: 1307823 - RNA, 20 nt, Human
ucaagggcagcuuugcucau

SEQ ID NO: 1307824 - RNA, 19 nt, Human
ucaagggcagcuuugcuca

SEQ ID NO: 1307825 - RNA, 13 nt, Human
ucaagggucaggc

SEQ ID NO: 1307826 - RNA, 15 nt, Human
ucaagggucaggccu

SEQ ID NO: 1307827 - RNA, 15 nt, Human
ucaagauucagcuag

SEQ ID NO: 1307828 - RNA, 14 nt, Human
ucaagauucagcua

SEQ ID NO: 1307829 - RNA, 13 nt, Human
ucaagauucagcu

SEQ ID NO: 1307830 - RNA, 13 nt, Human
acauuccauccuu

SEQ ID NO: 1307831 - RNA, 16 nt, Human
acauuccaagacucua

SEQ ID NO: 1307832 - RNA, 19 nt, Human
acauucaggaauucuugga

SEQ ID NO: 1307833 - RNA, 17 nt, Human
acauuccaaagaacagc

SEQ ID NO: 1307834 - RNA, 15 nt, Human
acauuccaacucgua

SEQ ID NO: 1307835 - RNA, 22 nt, Human
acauuccaacucguauagcaug

SEQ ID NO: 1307836 - RNA, 23 nt, Human
ucaaauuuguaggguuucuaggu

SEQ ID NO: 1307837 - RNA, 20 nt, Human
ucaaauuuguaggguuucua

SEQ ID NO: 1307838 - RNA, 14 nt, Human
ucaacaauucuaaa

SEQ ID NO: 1307839 - RNA, 15 nt, Human
ucaacaauucuaaaa

SEQ ID NO: 1307840 - RNA, 17 nt, Human
ucaacaauucuaaaaug

SEQ ID NO: 1307841 - RNA, 14 nt, Human
ucaacaccaugauu

SEQ ID NO: 1307842 - RNA, 22 nt, Human
ucaacaccaugauuccuuuaac

SEQ ID NO: 1307843 - RNA, 16 nt, Human
ucaacaggccucaggg

SEQ ID NO: 1307844 - RNA, 17 nt, Human
ucaacaggccucagggc

SEQ ID NO: 1307845 - RNA, 21 nt, Human
ucaacaggccucagggcuccu

SEQ ID NO: 1307846 - RNA, 23 nt, Human
ucaacaggccucagggcuccuug

SEQ ID NO: 1307847 - RNA, 14 nt, Human
ucaacacccaguuu

SEQ ID NO: 1307848 - RNA, 22 nt, Human
ucaacacccaguuuccuuggga

SEQ ID NO: 1307849 - RNA, 16 nt, Human
ucaacagagacugaau

SEQ ID NO: 1307850 - RNA, 19 nt, Human
ucaacagcagggugggcuu

SEQ ID NO: 1307851 - RNA, 22 nt, Human
ucaacagcguuccuagagaaga

SEQ ID NO: 1307852 - RNA, 22 nt, Human
acauuaaauuuuuuuuacauuu

SEQ ID NO: 1307853 - RNA, 18 nt, Human
acaugucuguucuacaua

SEQ ID NO: 1307854 - RNA, 21 nt, Human
acauguccagugggaggugag

SEQ ID NO: 1307855 - RNA, 23 nt, Human
acauguccugccuauuaucuguc

SEQ ID NO: 1307856 - RNA, 19 nt, Human
acauguccuucugagcccg

SEQ ID NO: 1307857 - RNA, 17 nt, Human
acaugucuguucuacau

SEQ ID NO: 1307858 - RNA, 16 nt, Human
acaugcuccagauuag

SEQ ID NO: 1307859 - RNA, 18 nt, Human
acauuagcaguuugcuuu

SEQ ID NO: 1307860 - RNA, 22 nt, Human
acauuagcaguuugcuuuguau

SEQ ID NO: 1307861 - RNA, 19 nt, Human
acauuaggaaaaguugcua

SEQ ID NO: 1307862 - RNA, 13 nt, Human
acauuaacucauu

SEQ ID NO: 1307863 - RNA, 14 nt, Human
acauuaacucauua

SEQ ID NO: 1307864 - RNA, 15 nt, Human
acauuaacucauuag

SEQ ID NO: 1307865 - RNA, 22 nt, Human
acauuaacucauuagacuggaa

SEQ ID NO: 1307866 - RNA, 14 nt, Human
acauuagucucagu

SEQ ID NO: 1307867 - RNA, 13 nt, Human
acauucaccugcc

SEQ ID NO: 1307868 - RNA, 14 nt, Human
acauucaccugccc

SEQ ID NO: 1307869 - RNA, 20 nt, Human
acauucaccugccccaacuc

SEQ ID NO: 1307870 - RNA, 22 nt, Human
acauucauagucuuuggagaaa

SEQ ID NO: 1307871 - RNA, 22 nt, Human
uaugaacuugaggacacauguc

SEQ ID NO: 1307872 - RNA, 23 nt, Human
uaugaacuugaggacacaugucc

SEQ ID NO: 1307873 - RNA, 14 nt, Human
uaugaagaacugag

SEQ ID NO: 1307874 - RNA, 21 nt, Human
uaugaacuugaggacacaugu

SEQ ID NO: 1307875 - RNA, 20 nt, Human
uaugaacuugaggacacaug

SEQ ID NO: 1307876 - RNA, 21 nt, Human
uaugaaauauuauguuaaaac

SEQ ID NO: 1307877 - RNA, 13 nt, Human
uauuuccacuucu

SEQ ID NO: 1307878 - RNA, 18 nt, Human
uauuuccauucaacaaga

SEQ ID NO: 1307879 - RNA, 14 nt, Human
uaugaagacauaaa

SEQ ID NO: 1307880 - RNA, 16 nt, Human
uaugaagaacugagga

SEQ ID NO: 1307881 - RNA, 17 nt, Human
uaugaagaacugaggag

SEQ ID NO: 1307882 - RNA, 20 nt, Human
uaugaaauauguauaacuuu

SEQ ID NO: 1307883 - RNA, 21 nt, Human
uaugaagaaggugaauagcca

SEQ ID NO: 1307884 - RNA, 16 nt, Human
uauuuccuaugaugua

SEQ ID NO: 1307885 - RNA, 15 nt, Human
uauuuccuaugaugu

SEQ ID NO: 1307886 - RNA, 17 nt, Human
uauuuccuaugauguau

SEQ ID NO: 1307887 - RNA, 13 nt, Human
uauuuccucccuc

SEQ ID NO: 1307888 - RNA, 22 nt, Human
uauuucccuacauuaaacauga

SEQ ID NO: 1307889 - RNA, 17 nt, Human
uauuucccuacauuaaa

SEQ ID NO: 1307890 - RNA, 16 nt, Human
uauuucccuacauuaa

SEQ ID NO: 1307891 - RNA, 15 nt, Human
uauuucccuacauua

SEQ ID NO: 1307892 - RNA, 21 nt, Human
uauuucccaugauuucaugua

SEQ ID NO: 1307893 - RNA, 21 nt, Human
uauuuccccaacauguaauaa

SEQ ID NO: 1307894 - RNA, 18 nt, Human
uauuucccaugauuucau

SEQ ID NO: 1307895 - RNA, 16 nt, Human
uauuucccaugauuuc

SEQ ID NO: 1307896 - RNA, 15 nt, Human
uauuucccaugauuu

SEQ ID NO: 1307897 - RNA, 21 nt, Human
acaguucuuugggccagacau

SEQ ID NO: 1307898 - RNA, 19 nt, Human
acaguugcacagcaucuca

SEQ ID NO: 1307899 - RNA, 15 nt, Human
acaguugcacagcau

SEQ ID NO: 1307900 - RNA, 14 nt, Human
acaguugcacagca

SEQ ID NO: 1307901 - RNA, 13 nt, Human
acaguugcacagc

SEQ ID NO: 1307902 - RNA, 22 nt, Human
acaguucuuugggccagacaug

SEQ ID NO: 1307903 - RNA, 22 nt, Human
acaguugaagggaggggcugug

SEQ ID NO: 1307904 - RNA, 20 nt, Human
acaguugcacagcaucucag

SEQ ID NO: 1307905 - RNA, 13 nt, Human
acaguugcaugua

SEQ ID NO: 1307906 - RNA, 23 nt, Human
acaguugcacagcaucucagcuc

SEQ ID NO: 1307907 - RNA, 23 nt, Human
acaguugcauguaguaacacuaa

SEQ ID NO: 1307908 - RNA, 14 nt, Human
acaguugguaacuu

SEQ ID NO: 1307909 - RNA, 15 nt, Human
acaguugguaacuuu

SEQ ID NO: 1307910 - RNA, 16 nt, Human
acaguugguaacuuuu

SEQ ID NO: 1307911 - RNA, 24 nt, Human
acaguugguaacuuuugugaauua

SEQ ID NO: 1307912 - RNA, 12 nt, Human
acaguuguauuu

SEQ ID NO: 1307913 - RNA, 13 nt, Human
acaguuguauuua

SEQ ID NO: 1307914 - RNA, 18 nt, Human
acaguuguauuuaacaga

SEQ ID NO: 1307915 - RNA, 22 nt, Human
acaguuguauuuaacagaaauu

SEQ ID NO: 1307916 - RNA, 20 nt, Human
acaguuuaauaccacagcuu

SEQ ID NO: 1307917 - RNA, 19 nt, Human
acaguuuaaugaagaucua

SEQ ID NO: 1307918 - RNA, 22 nt, Human
acaguuuaccaguugccuuuua

SEQ ID NO: 1307919 - RNA, 15 nt, Human
acaguuuauuuguug

SEQ ID NO: 1307920 - RNA, 19 nt, Human
acaguuuaccaguugccuu

SEQ ID NO: 1307921 - RNA, 13 nt, Human
acaguuugaaaua

SEQ ID NO: 1307922 - RNA, 14 nt, Human
acaguuugaaauaa

SEQ ID NO: 1307923 - RNA, 15 nt, Human
acaguuugaaauaag

SEQ ID NO: 1307924 - RNA, 18 nt, Human
acaguuugaaauaagcua

SEQ ID NO: 1307925 - RNA, 20 nt, Human
acaguuugaaauaagcuauu

SEQ ID NO: 1307926 - RNA, 22 nt, Human
acaguuugaaauaagcuauuug

SEQ ID NO: 1307927 - RNA, 14 nt, Human
acauaaaaaggaca

SEQ ID NO: 1307928 - RNA, 14 nt, Human
acauacauuuugua

SEQ ID NO: 1307929 - RNA, 14 nt, Human
acauacccccuccc

SEQ ID NO: 1307930 - RNA, 18 nt, Human
acauaccccuuacaaaug

SEQ ID NO: 1307931 - RNA, 20 nt, Human
acauacccccucccccaccg

SEQ ID NO: 1307932 - RNA, 16 nt, Human
acauacccugaccugg

SEQ ID NO: 1307933 - RNA, 22 nt, Human
acauacccugaccuggcccccu

SEQ ID NO: 1307934 - RNA, 20 nt, Human
acauacccuggccgcccccu

SEQ ID NO: 1307935 - RNA, 14 nt, Human
acauaccuaagaag

SEQ ID NO: 1307936 - RNA, 21 nt, Human
acauacccuggccgcccccug

SEQ ID NO: 1307937 - RNA, 14 nt, Human
acauacuaugaaau

SEQ ID NO: 1307938 - RNA, 12 nt, Human
acauacucauuu

SEQ ID NO: 1307939 - RNA, 13 nt, Human
acauacucauuuu

SEQ ID NO: 1307940 - RNA, 14 nt, Human
acauacucauuuuu

SEQ ID NO: 1307941 - RNA, 16 nt, Human
acauacucauuuuuca

SEQ ID NO: 1307942 - RNA, 17 nt, Human
acauacucauuuuucau

SEQ ID NO: 1307943 - RNA, 18 nt, Human
acauacuggccuggacug

SEQ ID NO: 1307944 - RNA, 19 nt, Human
acauacuggccuggacugu

SEQ ID NO: 1307945 - RNA, 15 nt, Human
acauacuugaagggc

SEQ ID NO: 1307946 - RNA, 16 nt, Human
acauacuugaagggcc

SEQ ID NO: 1307947 - RNA, 17 nt, Human
acauacuugaagggcca

SEQ ID NO: 1307948 - RNA, 18 nt, Human
acauacuugaagggccag

SEQ ID NO: 1307949 - RNA, 19 nt, Human
acauacuugaagggccaga

SEQ ID NO: 1307950 - RNA, 20 nt, Human
acauacuugaagggccagag

SEQ ID NO: 1307951 - RNA, 21 nt, Human
acauacuugaagggccagagc

SEQ ID NO: 1307952 - RNA, 22 nt, Human
acauacuugaagggccagagcc

SEQ ID NO: 1307953 - RNA, 23 nt, Human
acauacuugaagggccagagcca

SEQ ID NO: 1307954 - RNA, 16 nt, Human
acauagaaauugccug

SEQ ID NO: 1307955 - RNA, 21 nt, Human
acauagaaauugccugacgaa

SEQ ID NO: 1307956 - RNA, 13 nt, Human
acaguuuuaacug

SEQ ID NO: 1307957 - RNA, 21 nt, Human
acaguuuuaacuguggauauu

SEQ ID NO: 1307958 - RNA, 17 nt, Human
acaguuuuaacugugga

SEQ ID NO: 1307959 - RNA, 19 nt, Human
acaguuuuaacuguggaua

SEQ ID NO: 1307960 - RNA, 20 nt, Human
acaguuuuccuaugcuuuga

SEQ ID NO: 1307961 - RNA, 12 nt, Human
acaucagcaaac

SEQ ID NO: 1307962 - RNA, 16 nt, Human
acaucuacaaaacauu

SEQ ID NO: 1307963 - RNA, 17 nt, Human
acaucuacaaaacauua

SEQ ID NO: 1307964 - RNA, 22 nt, Human
acaucagagugacauccaggag

SEQ ID NO: 1307965 - RNA, 18 nt, Human
acaucuauuuuggauugu

SEQ ID NO: 1307966 - RNA, 19 nt, Human
acaucuauuuuggauugua

SEQ ID NO: 1307967 - RNA, 23 nt, Human
acaucuauuuuggauuguauauu

SEQ ID NO: 1307968 - RNA, 17 nt, Human
acaucucaacaggccuc

SEQ ID NO: 1307969 - RNA, 20 nt, Human
acaucucaacaggccucagg

SEQ ID NO: 1307970 - RNA, 21 nt, Human
acaucucaacaggccucaggg

SEQ ID NO: 1307971 - RNA, 22 nt, Human
acaucucaacaggccucagggc

SEQ ID NO: 1307972 - RNA, 12 nt, Human
acaucucauuuu

SEQ ID NO: 1307973 - RNA, 23 nt, Human
acaucucccuuuuccaugacugu

SEQ ID NO: 1307974 - RNA, 13 nt, Human
acaucacagauga

SEQ ID NO: 1307975 - RNA, 16 nt, Human
acaucacagcccagcc

SEQ ID NO: 1307976 - RNA, 16 nt, Human
acaucaccacaguuua

SEQ ID NO: 1307977 - RNA, 14 nt, Human
acaucacagcccag

SEQ ID NO: 1307978 - RNA, 15 nt, Human
acaucacuuguacaa

SEQ ID NO: 1307979 - RNA, 16 nt, Human
acaucacuuguacaaa

SEQ ID NO: 1307980 - RNA, 19 nt, Human
acaucacuuguacaaaaua

SEQ ID NO: 1307981 - RNA, 18 nt, Human
acaucaacccgagucauu

SEQ ID NO: 1307982 - RNA, 14 nt, Human
acaucaaucuuuaa

SEQ ID NO: 1307983 - RNA, 14 nt, Human
acaucacaagacua

SEQ ID NO: 1307984 - RNA, 13 nt, Human
acaucaacagaua

SEQ ID NO: 1307985 - RNA, 12 nt, Human
acaucaaagagg

SEQ ID NO: 1307986 - RNA, 14 nt, Human
acauauuuuaaaau

SEQ ID NO: 1307987 - RNA, 21 nt, Human
acaucugagguuuuauuucau

SEQ ID NO: 1307988 - RNA, 23 nt, Human
acaucugagguuuuauuucauuu

SEQ ID NO: 1307989 - RNA, 19 nt, Human
acaucuguaaaucuacaca

SEQ ID NO: 1307990 - RNA, 15 nt, Human
acaucugugucuugu

SEQ ID NO: 1307991 - RNA, 16 nt, Human
acaucugugucuuguu

SEQ ID NO: 1307992 - RNA, 22 nt, Human
uauuuggugauuacauuuuaaa

SEQ ID NO: 1307993 - RNA, 17 nt, Human
uauuuggugauuacauu

SEQ ID NO: 1307994 - RNA, 14 nt, Human
uauuuguaaaauga

SEQ ID NO: 1307995 - RNA, 15 nt, Human
uauuuguaaaaugac

SEQ ID NO: 1307996 - RNA, 23 nt, Human
uauuuguaaaaugacaaucaugu

SEQ ID NO: 1307997 - RNA, 19 nt, Human
acauaguauucaugacuau

SEQ ID NO: 1307998 - RNA, 14 nt, Human
acauaguauucaug

SEQ ID NO: 1307999 - RNA, 16 nt, Human
acauagugaugguucc

SEQ ID NO: 1308000 - RNA, 21 nt, Human
acauagugaugguuccccugu

SEQ ID NO: 1308001 - RNA, 20 nt, Human
acauagugggacccugucuc

SEQ ID NO: 1308002 - RNA, 20 nt, Human
acauagugcuaacaugaaga

SEQ ID NO: 1308003 - RNA, 15 nt, Human
acauaguuauuuauu

SEQ ID NO: 1308004 - RNA, 19 nt, Human
acauauauaacaaugcugu

SEQ ID NO: 1308005 - RNA, 23 nt, Human
acauauaauguuguuauuuaaag

SEQ ID NO: 1308006 - RNA, 18 nt, Human
acauagaauuaacacaug

SEQ ID NO: 1308007 - RNA, 14 nt, Human
acauagaauuaaca

SEQ ID NO: 1308008 - RNA, 16 nt, Human
acauagacagaagaaa

SEQ ID NO: 1308009 - RNA, 18 nt, Human
acauagacagaagaaaca

SEQ ID NO: 1308010 - RNA, 17 nt, Human
acauagacagaagaaac

SEQ ID NO: 1308011 - RNA, 19 nt, Human
acauagagccggguguccc

SEQ ID NO: 1308012 - RNA, 22 nt, Human
acauagagccggguguccccaa

SEQ ID NO: 1308013 - RNA, 16 nt, Human
acauagauaaaacauc

SEQ ID NO: 1308014 - RNA, 21 nt, Human
acauagagccgggugucccca

SEQ ID NO: 1308015 - RNA, 16 nt, Human
acauagcccacuuaca

SEQ ID NO: 1308016 - RNA, 19 nt, Human
acauagcccacuuacauuu

SEQ ID NO: 1308017 - RNA, 21 nt, Human
acauagcccacuuacauuuac

SEQ ID NO: 1308018 - RNA, 20 nt, Human
acauauggaauuuugcaaag

SEQ ID NO: 1308019 - RNA, 21 nt, Human
acauaugugcuggaauucuaa

SEQ ID NO: 1308020 - RNA, 15 nt, Human
acauaucuuagaugg

SEQ ID NO: 1308021 - RNA, 16 nt, Human
acauaugaucugucug

SEQ ID NO: 1308022 - RNA, 17 nt, Human
acauaugaucugucugu

SEQ ID NO: 1308023 - RNA, 18 nt, Human
acauaugaucugucugug

SEQ ID NO: 1308024 - RNA, 19 nt, Human
acauaugaucugucugugg

SEQ ID NO: 1308025 - RNA, 13 nt, Human
acauauggaauuu

SEQ ID NO: 1308026 - RNA, 17 nt, Human
acauauggaauuuugca

SEQ ID NO: 1308027 - RNA, 20 nt, Human
accacuuuuugcagcuuucu

SEQ ID NO: 1308028 - RNA, 18 nt, Human
accacuuuuugcagcuuu

SEQ ID NO: 1308029 - RNA, 17 nt, Human
accagaaaagcccaagu

SEQ ID NO: 1308030 - RNA, 24 nt, Human
accagaaagcaguugagacaagaa

SEQ ID NO: 1308031 - RNA, 17 nt, Human
accacuuuuugcagcuu

SEQ ID NO: 1308032 - RNA, 16 nt, Human
accacuuuuugcagcu

SEQ ID NO: 1308033 - RNA, 15 nt, Human
accacuuuuugcagc

SEQ ID NO: 1308034 - RNA, 14 nt, Human
accacuuuuugcag

SEQ ID NO: 1308035 - RNA, 13 nt, Human
accacuuuuugca

SEQ ID NO: 1308036 - RNA, 12 nt, Human
accacuuuuuag

SEQ ID NO: 1308037 - RNA, 23 nt, Human
accagaaagcaguugagacaaga

SEQ ID NO: 1308038 - RNA, 21 nt, Human
accagaaccaauuauuuucau

SEQ ID NO: 1308039 - RNA, 19 nt, Human
accagaaccaauuauuuuc

SEQ ID NO: 1308040 - RNA, 17 nt, Human
accagaagcucccccag

SEQ ID NO: 1308041 - RNA, 19 nt, Human
accagaagcucccccagca

SEQ ID NO: 1308042 - RNA, 20 nt, Human
accagaagcucccccagcaa

SEQ ID NO: 1308043 - RNA, 14 nt, Human
accagacacccagg

SEQ ID NO: 1308044 - RNA, 15 nt, Human
accagacacccagga

SEQ ID NO: 1308045 - RNA, 16 nt, Human
accagacacccaggac

SEQ ID NO: 1308046 - RNA, 17 nt, Human
accagacacccaggacu

SEQ ID NO: 1308047 - RNA, 21 nt, Human
accagacuacuugggagcacc

SEQ ID NO: 1308048 - RNA, 23 nt, Human
accagacuacuugggagcaccgc

SEQ ID NO: 1308049 - RNA, 22 nt, Human
accagacuagauggaccugccu

SEQ ID NO: 1308050 - RNA, 16 nt, Human
accagacucuugccug

SEQ ID NO: 1308051 - RNA, 18 nt, Human
accacuuguguuuugcaa

SEQ ID NO: 1308052 - RNA, 16 nt, Human
accacuggucuguagg

SEQ ID NO: 1308053 - RNA, 15 nt, Human
accacuucagggcuu

SEQ ID NO: 1308054 - RNA, 13 nt, Human
accacugcagaag

SEQ ID NO: 1308055 - RNA, 15 nt, Human
accacugcucugaug

SEQ ID NO: 1308056 - RNA, 17 nt, Human
accacugcucugaugaa

SEQ ID NO: 1308057 - RNA, 23 nt, Human
accacugcucugaugaagaggag

SEQ ID NO: 1308058 - RNA, 21 nt, Human
accacugcugauauuuucucu

SEQ ID NO: 1308059 - RNA, 15 nt, Human
accagacucuugccu

SEQ ID NO: 1308060 - RNA, 14 nt, Human
accagccgugagca

SEQ ID NO: 1308061 - RNA, 19 nt, Human
accagccgugagcauguuu

SEQ ID NO: 1308062 - RNA, 14 nt, Human
accagccuccaugc

SEQ ID NO: 1308063 - RNA, 19 nt, Human
accagccuccaugcugccu

SEQ ID NO: 1308064 - RNA, 20 nt, Human
accagccuccaugcugccuc

SEQ ID NO: 1308065 - RNA, 21 nt, Human
accagccuccaugcugccucc

SEQ ID NO: 1308066 - RNA, 14 nt, Human
accagggacugagg

SEQ ID NO: 1308067 - RNA, 18 nt, Human
accaggcuugccugcagg

SEQ ID NO: 1308068 - RNA, 22 nt, Human
accagccgugagcauguuugga

SEQ ID NO: 1308069 - RNA, 17 nt, Human
accaggcugccucccuu

SEQ ID NO: 1308070 - RNA, 19 nt, Human
accaggcuugccugcaggc

SEQ ID NO: 1308071 - RNA, 22 nt, Human
ucaccucuagguccccauacuc

SEQ ID NO: 1308072 - RNA, 23 nt, Human
ucaccucuagguccccauacucc

SEQ ID NO: 1308073 - RNA, 19 nt, Human
ucaccugagucacccuacc

SEQ ID NO: 1308074 - RNA, 16 nt, Human
ucaccugccccaacuc

SEQ ID NO: 1308075 - RNA, 13 nt, Human
ucaccugcacuaa

SEQ ID NO: 1308076 - RNA, 22 nt, Human
ucacuaggcccccacuugccuc

SEQ ID NO: 1308077 - RNA, 20 nt, Human
ucacuccccaacccccaacu

SEQ ID NO: 1308078 - RNA, 14 nt, Human
ucacuacucagcau

SEQ ID NO: 1308079 - RNA, 15 nt, Human
ucacuacucagcaug

SEQ ID NO: 1308080 - RNA, 18 nt, Human
ucacuagcccuccuuuuu

SEQ ID NO: 1308081 - RNA, 21 nt, Human
ucacuagcccuccuuuuucca

SEQ ID NO: 1308082 - RNA, 19 nt, Human
ucacuaggcccccacuugc

SEQ ID NO: 1308083 - RNA, 21 nt, Human
ucacuaggcccccacuugccu

SEQ ID NO: 1308084 - RNA, 20 nt, Human
ucaccugugcuucgggcccu

SEQ ID NO: 1308085 - RNA, 21 nt, Human
ucaccugugcuucgggcccuu

SEQ ID NO: 1308086 - RNA, 16 nt, Human
ucaccuuagaccacca

SEQ ID NO: 1308087 - RNA, 19 nt, Human
ucaccuuagaccaccaagc

SEQ ID NO: 1308088 - RNA, 20 nt, Human
ucaccuuagaccaccaagcc

SEQ ID NO: 1308089 - RNA, 21 nt, Human
ucaccuuagaccaccaagccu

SEQ ID NO: 1308090 - RNA, 22 nt, Human
ucaccuuagaccaccaagccuu

SEQ ID NO: 1308091 - RNA, 18 nt, Human
ucaccuucaccuucaucc

SEQ ID NO: 1308092 - RNA, 23 nt, Human
ucaauucuucccuaucuuugcca

SEQ ID NO: 1308093 - RNA, 16 nt, Human
ucaauuuuaucccuca

SEQ ID NO: 1308094 - RNA, 21 nt, Human
ucaauuuuaucccucaccugu

SEQ ID NO: 1308095 - RNA, 22 nt, Human
ucaauuuuaucccucaccugua

SEQ ID NO: 1308096 - RNA, 19 nt, Human
ucaauucuucccuaucuuu

SEQ ID NO: 1308097 - RNA, 17 nt, Human
ucaauucuucccuaucu

SEQ ID NO: 1308098 - RNA, 15 nt, Human
ucaauucuugccaaa

SEQ ID NO: 1308099 - RNA, 16 nt, Human
ucaauuuucacugugu

SEQ ID NO: 1308100 - RNA, 15 nt, Human
ucaauuuucacugug

SEQ ID NO: 1308101 - RNA, 17 nt, Human
ucacaaaguggaacgaa

SEQ ID NO: 1308102 - RNA, 14 nt, Human
accacacuccagcu

SEQ ID NO: 1308103 - RNA, 18 nt, Human
accacacccggcuaauuu

SEQ ID NO: 1308104 - RNA, 13 nt, Human
accacacccugua

SEQ ID NO: 1308105 - RNA, 17 nt, Human
accacacccuguacugu

SEQ ID NO: 1308106 - RNA, 23 nt, Human
accaauuauaagggcaaauugga

SEQ ID NO: 1308107 - RNA, 14 nt, Human
accaauuauuuuca

SEQ ID NO: 1308108 - RNA, 13 nt, Human
accaaucauuuua

SEQ ID NO: 1308109 - RNA, 20 nt, Human
accaaucauuuuaauuauua

SEQ ID NO: 1308110 - RNA, 16 nt, Human
accaauuauuuucauc

SEQ ID NO: 1308111 - RNA, 22 nt, Human
accaauugcugcuacuuauaua

SEQ ID NO: 1308112 - RNA, 14 nt, Human
accacaaacuguaa

SEQ ID NO: 1308113 - RNA, 18 nt, Human
accacaaacuguaauaca

SEQ ID NO: 1308114 - RNA, 13 nt, Human
accaaucaugaau

SEQ ID NO: 1308115 - RNA, 15 nt, Human
accaaucaugaauua

SEQ ID NO: 1308116 - RNA, 20 nt, Human
ucaagugaucugcccaccuc

SEQ ID NO: 1308117 - RNA, 17 nt, Human
ucaagugauucucaugc

SEQ ID NO: 1308118 - RNA, 14 nt, Human
ucaagucagcucuu

SEQ ID NO: 1308119 - RNA, 20 nt, Human
ucaagugauucucaugccuc

SEQ ID NO: 1308120 - RNA, 19 nt, Human
ucacccagguuggagugca

SEQ ID NO: 1308121 - RNA, 19 nt, Human
ucacccaggcuggacugca

SEQ ID NO: 1308122 - RNA, 19 nt, Human
ucacccaggcuggagugca

SEQ ID NO: 1308123 - RNA, 18 nt, Human
ucaccaguguguggcuuu

SEQ ID NO: 1308124 - RNA, 23 nt, Human
ucaccaguguguggcuuucagag

SEQ ID NO: 1308125 - RNA, 15 nt, Human
ucacaugaauuauua

SEQ ID NO: 1308126 - RNA, 16 nt, Human
ucacaugaauuauuac

SEQ ID NO: 1308127 - RNA, 17 nt, Human
ucacaugaauuauuaca

SEQ ID NO: 1308128 - RNA, 18 nt, Human
ucacaugaauuauuacag

SEQ ID NO: 1308129 - RNA, 22 nt, Human
ucacaugaauuauuacaguguu

SEQ ID NO: 1308130 - RNA, 21 nt, Human
ucacaugaauuauuacagugu

SEQ ID NO: 1308131 - RNA, 17 nt, Human
ucaccaggcagccucug

SEQ ID NO: 1308132 - RNA, 19 nt, Human
ucaccaggcagccucuggg

SEQ ID NO: 1308133 - RNA, 22 nt, Human
ucaccaggcagccucugggggg

SEQ ID NO: 1308134 - RNA, 20 nt, Human
ucaccaggcagccucugggg

SEQ ID NO: 1308135 - RNA, 16 nt, Human
ucacaacaaccugguc

SEQ ID NO: 1308136 - RNA, 22 nt, Human
ucacacgucuggcuucacagau

SEQ ID NO: 1308137 - RNA, 21 nt, Human
ucacacucaguugugacuaac

SEQ ID NO: 1308138 - RNA, 12 nt, Human
ucacacucgaca

SEQ ID NO: 1308139 - RNA, 16 nt, Human
ucacacucgacaugaa

SEQ ID NO: 1308140 - RNA, 17 nt, Human
accaugguuaagagucc

SEQ ID NO: 1308141 - RNA, 19 nt, Human
accaugguuaagaguccaa

SEQ ID NO: 1308142 - RNA, 21 nt, Human
accauguaaagaacauaaaua

SEQ ID NO: 1308143 - RNA, 21 nt, Human
accaugguuaagaguccaaga

SEQ ID NO: 1308144 - RNA, 12 nt, Human
accauguaaugg

SEQ ID NO: 1308145 - RNA, 11 nt, Human
accauguacau

SEQ ID NO: 1308146 - RNA, 17 nt, Human
accauguacaugaagaa

SEQ ID NO: 1308147 - RNA, 17 nt, Human
accauguagaaaauuug

SEQ ID NO: 1308148 - RNA, 15 nt, Human
ucacuccuaccuggu

SEQ ID NO: 1308149 - RNA, 12 nt, Human
accauuccccau

SEQ ID NO: 1308150 - RNA, 21 nt, Human
accauuccaagucuccacccc

SEQ ID NO: 1308151 - RNA, 13 nt, Human
accauugaaggcu

SEQ ID NO: 1308152 - RNA, 16 nt, Human
accauugaaggcuuaa

SEQ ID NO: 1308153 - RNA, 18 nt, Human
accauugaauucuugguu

SEQ ID NO: 1308154 - RNA, 18 nt, Human
accauugauuuaauguaa

SEQ ID NO: 1308155 - RNA, 13 nt, Human
accauuaaaccau

SEQ ID NO: 1308156 - RNA, 19 nt, Human
accauuaaaccaucucccu

SEQ ID NO: 1308157 - RNA, 13 nt, Human
accauuaaccaga

SEQ ID NO: 1308158 - RNA, 14 nt, Human
accauuaaaccauc

SEQ ID NO: 1308159 - RNA, 19 nt, Human
accauuauaaccuuaauuu

SEQ ID NO: 1308160 - RNA, 17 nt, Human
accauuauaaugaauuu

SEQ ID NO: 1308161 - RNA, 21 nt, Human
accauuauaaccuuaauuuau

SEQ ID NO: 1308162 - RNA, 16 nt, Human
accauuauaaugaauu

SEQ ID NO: 1308163 - RNA, 21 nt, Human
acccagauaaagguucaugca

SEQ ID NO: 1308164 - RNA, 15 nt, Human
acccagacucagaca

SEQ ID NO: 1308165 - RNA, 18 nt, Human
acccagacauaaaggaaa

SEQ ID NO: 1308166 - RNA, 20 nt, Human
acccagacauaaaggaaaag

SEQ ID NO: 1308167 - RNA, 19 nt, Human
acccagacauaaaggaaaa

SEQ ID NO: 1308168 - RNA, 22 nt, Human
acccagaccuguuagcagacag

SEQ ID NO: 1308169 - RNA, 23 nt, Human
accauuucuugagguaaaagcau

SEQ ID NO: 1308170 - RNA, 14 nt, Human
accauugucucaga

SEQ ID NO: 1308171 - RNA, 15 nt, Human
accauugucucagag

SEQ ID NO: 1308172 - RNA, 18 nt, Human
accauugucucagagcag

SEQ ID NO: 1308173 - RNA, 19 nt, Human
accauugucucagagcagg

SEQ ID NO: 1308174 - RNA, 23 nt, Human
accauuuggauccuguguggaga

SEQ ID NO: 1308175 - RNA, 22 nt, Human
accauuuggcaucccugggccu

SEQ ID NO: 1308176 - RNA, 19 nt, Human
accauuuggcaucccuggg

SEQ ID NO: 1308177 - RNA, 20 nt, Human
accauuuggcaucccugggc

SEQ ID NO: 1308178 - RNA, 15 nt, Human
accauuuuaaaguua

SEQ ID NO: 1308179 - RNA, 13 nt, Human
accauuuucuggu

SEQ ID NO: 1308180 - RNA, 19 nt, Human
ucagaaguuucucagcucc

SEQ ID NO: 1308181 - RNA, 17 nt, Human
ucagaaguuaguuugua

SEQ ID NO: 1308182 - RNA, 18 nt, Human
ucagaagucaucuugcua

SEQ ID NO: 1308183 - RNA, 22 nt, Human
ucagaagucaucuugcuaccag

SEQ ID NO: 1308184 - RNA, 15 nt, Human
ucagaagucuuucag

SEQ ID NO: 1308185 - RNA, 18 nt, Human
ucagaagucuuucagcaa

SEQ ID NO: 1308186 - RNA, 23 nt, Human
ucagaagccugggggccuggcug

SEQ ID NO: 1308187 - RNA, 22 nt, Human
ucagaagccugggggccuggcu

SEQ ID NO: 1308188 - RNA, 15 nt, Human
ucagaagucaucuug

SEQ ID NO: 1308189 - RNA, 22 nt, Human
acccagaggaaggggccagagg

SEQ ID NO: 1308190 - RNA, 17 nt, Human
acccagccccagccagg

SEQ ID NO: 1308191 - RNA, 15 nt, Human
acccagcccucaucc

SEQ ID NO: 1308192 - RNA, 16 nt, Human
acccagcccucauccc

SEQ ID NO: 1308193 - RNA, 12 nt, Human
ucagaagccugg

SEQ ID NO: 1308194 - RNA, 13 nt, Human
ucagaagccuggg

SEQ ID NO: 1308195 - RNA, 14 nt, Human
ucagaagccugggg

SEQ ID NO: 1308196 - RNA, 15 nt, Human
ucagaagccuggggg

SEQ ID NO: 1308197 - RNA, 16 nt, Human
ucagaagccugggggc

SEQ ID NO: 1308198 - RNA, 19 nt, Human
ucagaagccugggggccug

SEQ ID NO: 1308199 - RNA, 20 nt, Human
ucagaagccugggggccugg

SEQ ID NO: 1308200 - RNA, 21 nt, Human
ucagaagccugggggccuggc

SEQ ID NO: 1308201 - RNA, 14 nt, Human
ucagaaugucauuu

SEQ ID NO: 1308202 - RNA, 16 nt, Human
ucagaauuaaacuuuu

SEQ ID NO: 1308203 - RNA, 18 nt, Human
ucagaauuaaacuuuuaa

SEQ ID NO: 1308204 - RNA, 20 nt, Human
ucagaauuaaacuuuuaauu

SEQ ID NO: 1308205 - RNA, 23 nt, Human
ucagaauuaaacuuuuaauucau

SEQ ID NO: 1308206 - RNA, 23 nt, Human
accccagcuggggccaggcuggg

SEQ ID NO: 1308207 - RNA, 12 nt, Human
accccacuccca

SEQ ID NO: 1308208 - RNA, 13 nt, Human
accccacucccac

SEQ ID NO: 1308209 - RNA, 14 nt, Human
accccacucccaca

SEQ ID NO: 1308210 - RNA, 14 nt, Human
accccagacacugg

SEQ ID NO: 1308211 - RNA, 18 nt, Human
accccagggcacaggagc

SEQ ID NO: 1308212 - RNA, 20 nt, Human
accccaggcugaagcagguu

SEQ ID NO: 1308213 - RNA, 10 nt, Human
accccagggc

SEQ ID NO: 1308214 - RNA, 11 nt, Human
accccagggca

SEQ ID NO: 1308215 - RNA, 12 nt, Human
accccagggcac

SEQ ID NO: 1308216 - RNA, 15 nt, Human
accccagggcacagg

SEQ ID NO: 1308217 - RNA, 16 nt, Human
accccagggcacagga

SEQ ID NO: 1308218 - RNA, 15 nt, Human
acccagcggacacac

SEQ ID NO: 1308219 - RNA, 14 nt, Human
acccaggaucccca

SEQ ID NO: 1308220 - RNA, 19 nt, Human
acccaggccaggcaugugg

SEQ ID NO: 1308221 - RNA, 18 nt, Human
acccaggcuggagugcag

SEQ ID NO: 1308222 - RNA, 19 nt, Human
acccaggcuggagugcagu

SEQ ID NO: 1308223 - RNA, 20 nt, Human
acccaggcuggagugcagug

SEQ ID NO: 1308224 - RNA, 21 nt, Human
accccaccuuuauuccuucau

SEQ ID NO: 1308225 - RNA, 16 nt, Human
accccacgccuuaucc

SEQ ID NO: 1308226 - RNA, 22 nt, Human
ucagccaagguuuuauaaggcu

SEQ ID NO: 1308227 - RNA, 23 nt, Human
ucagccaagguuuuauaaggcug

SEQ ID NO: 1308228 - RNA, 20 nt, Human
ucagccagugaccaaccuuu

SEQ ID NO: 1308229 - RNA, 14 nt, Human
ucagccauguauuu

SEQ ID NO: 1308230 - RNA, 21 nt, Human
ucagagaggccuuuuggaaug

SEQ ID NO: 1308231 - RNA, 22 nt, Human
ucagagaggccuuuuggaaugu

SEQ ID NO: 1308232 - RNA, 21 nt, Human
ucagagccuccuuucuggcuu

SEQ ID NO: 1308233 - RNA, 16 nt, Human
ucagagcgcacaggga

SEQ ID NO: 1308234 - RNA, 14 nt, Human
ucagagcgcacagg

SEQ ID NO: 1308235 - RNA, 11 nt, Human
ucagcauuuga

SEQ ID NO: 1308236 - RNA, 12 nt, Human
ucagcauuugac

SEQ ID NO: 1308237 - RNA, 19 nt, Human
ucagccuacaggccucaca

SEQ ID NO: 1308238 - RNA, 13 nt, Human
ucaggaaagagaa

SEQ ID NO: 1308239 - RNA, 14 nt, Human
ucaggaaaaggccu

SEQ ID NO: 1308240 - RNA, 15 nt, Human
ucaggaaaaggccug

SEQ ID NO: 1308241 - RNA, 16 nt, Human
ucaggaaaaggccugg

SEQ ID NO: 1308242 - RNA, 17 nt, Human
ucaggaaaaggccuggg

SEQ ID NO: 1308243 - RNA, 19 nt, Human
ucaggaaaaggccuggggu

SEQ ID NO: 1308244 - RNA, 18 nt, Human
ucaggaaaaggccugggg

SEQ ID NO: 1308245 - RNA, 12 nt, Human
ucaggaaaauug

SEQ ID NO: 1308246 - RNA, 19 nt, Human
ucaggaaagagaacuucca

SEQ ID NO: 1308247 - RNA, 18 nt, Human
ucaggaaaauugaaugca

SEQ ID NO: 1308248 - RNA, 22 nt, Human
ucaggaaacgagacuuuccauu

SEQ ID NO: 1308249 - RNA, 21 nt, Human
ucaggaaacgagacuuuccau

SEQ ID NO: 1308250 - RNA, 15 nt, Human
ucaggaaaggaauca

SEQ ID NO: 1308251 - RNA, 12 nt, Human
ucagcucaugga

SEQ ID NO: 1308252 - RNA, 15 nt, Human
ucagcucauccaugc

SEQ ID NO: 1308253 - RNA, 19 nt, Human
ucagcuucguuuauuuuca

SEQ ID NO: 1308254 - RNA, 21 nt, Human
ucagcuucguuuauuuucaag

SEQ ID NO: 1308255 - RNA, 13 nt, Human
ucagcucacugca

SEQ ID NO: 1308256 - RNA, 16 nt, Human
ucagcucacugcaacc

SEQ ID NO: 1308257 - RNA, 11 nt, Human
accccccucug

SEQ ID NO: 1308258 - RNA, 22 nt, Human
accccccuguacacaacucacu

SEQ ID NO: 1308259 - RNA, 14 nt, Human
accccccuguacac

SEQ ID NO: 1308260 - RNA, 18 nt, Human
accccccuuucacaggca

SEQ ID NO: 1308261 - RNA, 21 nt, Human
accccccuuucacaggcagcc

SEQ ID NO: 1308262 - RNA, 20 nt, Human
accccccuuucacaggcagc

SEQ ID NO: 1308263 - RNA, 15 nt, Human
accccuguaggccuc

SEQ ID NO: 1308264 - RNA, 16 nt, Human
accccuguaggccuca

SEQ ID NO: 1308265 - RNA, 17 nt, Human
accccuguaggccucag

SEQ ID NO: 1308266 - RNA, 14 nt, Human
ucagccuugccaga

SEQ ID NO: 1308267 - RNA, 15 nt, Human
ucagccuugccagag

SEQ ID NO: 1308268 - RNA, 16 nt, Human
ucagccuugccagaga

SEQ ID NO: 1308269 - RNA, 17 nt, Human
ucagccuugccagagau

SEQ ID NO: 1308270 - RNA, 19 nt, Human
ucagcgacuccguuggcca

SEQ ID NO: 1308271 - RNA, 20 nt, Human
ucagcgacuccguuggccac

SEQ ID NO: 1308272 - RNA, 23 nt, Human
ucagcgacuccguuggccacucc

SEQ ID NO: 1308273 - RNA, 20 nt, Human
ucagcgcugucaggauugcg

SEQ ID NO: 1308274 - RNA, 21 nt, Human
ucagcgcugucaggauugcga

SEQ ID NO: 1308275 - RNA, 21 nt, Human
aaugccccugaauuuaaauag

SEQ ID NO: 1308276 - RNA, 21 nt, Human
aauggaaugugauguucaugg

SEQ ID NO: 1308277 - RNA, 12 nt, Human
aaugcuuucgau

SEQ ID NO: 1308278 - RNA, 14 nt, Human
aaugcuuugaaauu

SEQ ID NO: 1308279 - RNA, 22 nt, Human
aaugcuuugaaauugaaccuuu

SEQ ID NO: 1308280 - RNA, 12 nt, Human
aaugcuuugaua

SEQ ID NO: 1308281 - RNA, 18 nt, Human
aaugcuuugauauuucaa

SEQ ID NO: 1308282 - RNA, 19 nt, Human
aaugcuuuuuauuucugca

SEQ ID NO: 1308283 - RNA, 20 nt, Human
aaugcuuuuuauuucugcau

SEQ ID NO: 1308284 - RNA, 15 nt, Human
aaugccaaauuaaaa

SEQ ID NO: 1308285 - RNA, 22 nt, Human
aaugccaaauuaaaaaagauaa

SEQ ID NO: 1308286 - RNA, 16 nt, Human
aaugccaaauuaaaaa

SEQ ID NO: 1308287 - RNA, 17 nt, Human
aaugccaaauuaaaaaa

SEQ ID NO: 1308288 - RNA, 21 nt, Human
aaugccaaauuaaaaaagaua

SEQ ID NO: 1308289 - RNA, 14 nt, Human
aaugccaagcacuu

SEQ ID NO: 1308290 - RNA, 19 nt, Human
aaugccaagcacuucuuuu

SEQ ID NO: 1308291 - RNA, 16 nt, Human
aaugcauaaaauguua

SEQ ID NO: 1308292 - RNA, 16 nt, Human
aaugcaguugucucug

SEQ ID NO: 1308293 - RNA, 19 nt, Human
aaugcaguugucucuguuu

SEQ ID NO: 1308294 - RNA, 14 nt, Human
aaugcauaaaugca

SEQ ID NO: 1308295 - RNA, 14 nt, Human
aaugcauacaaguu

SEQ ID NO: 1308296 - RNA, 23 nt, Human
aaugcauuauaggaucauuuguu

SEQ ID NO: 1308297 - RNA, 19 nt, Human
aaugcauucuucucuguug

SEQ ID NO: 1308298 - RNA, 14 nt, Human
aaugcauucuucuc

SEQ ID NO: 1308299 - RNA, 14 nt, Human
uacaaggacagccc

SEQ ID NO: 1308300 - RNA, 15 nt, Human
uacaaguaacaaaaa

SEQ ID NO: 1308301 - RNA, 19 nt, Human
uacaaguaacaaaaauaaa

SEQ ID NO: 1308302 - RNA, 20 nt, Human
uacaaaauaaacaaauaaca

SEQ ID NO: 1308303 - RNA, 10 nt, Human
uacaaaauca

SEQ ID NO: 1308304 - RNA, 13 nt, Human
aaugcauaaaaug

SEQ ID NO: 1308305 - RNA, 15 nt, Human
aaugcaguugucucu

SEQ ID NO: 1308306 - RNA, 17 nt, Human
uacaaguauuuuuaauu

SEQ ID NO: 1308307 - RNA, 18 nt, Human
uacaaguauuuuuaauua

SEQ ID NO: 1308308 - RNA, 19 nt, Human
uacaaguauuuuuaauuaa

SEQ ID NO: 1308309 - RNA, 14 nt, Human
uacaaaaauauaaa

SEQ ID NO: 1308310 - RNA, 17 nt, Human
uacaaaaauauaaaaua

SEQ ID NO: 1308311 - RNA, 18 nt, Human
uacaaaaauauaaaauau

SEQ ID NO: 1308312 - RNA, 21 nt, Human
uacaaaagaagggcugguauu

SEQ ID NO: 1308313 - RNA, 19 nt, Human
uacaaaauaaacaaauaac

SEQ ID NO: 1308314 - RNA, 20 nt, Human
uacaaaaauauaaaauauga

SEQ ID NO: 1308315 - RNA, 13 nt, Human
uacaaaaauuccu

SEQ ID NO: 1308316 - RNA, 14 nt, Human
uacaaaacaaacuc

SEQ ID NO: 1308317 - RNA, 17 nt, Human
uacaaaacaaacucauu

SEQ ID NO: 1308318 - RNA, 22 nt, Human
uacaaaacaaacucauucauua

SEQ ID NO: 1308319 - RNA, 12 nt, Human
uacaaaacauua

SEQ ID NO: 1308320 - RNA, 14 nt, Human
uacaaaacauuaaa

SEQ ID NO: 1308321 - RNA, 16 nt, Human
uacaaaacauuaaacu

SEQ ID NO: 1308322 - RNA, 14 nt, Human
uaauuuaugcagaa

SEQ ID NO: 1308323 - RNA, 14 nt, Human
uaauuuauuauuaa

SEQ ID NO: 1308324 - RNA, 12 nt, Human
uaauuucaaaau

SEQ ID NO: 1308325 - RNA, 15 nt, Human
uaauuucaaaaugcu

SEQ ID NO: 1308326 - RNA, 16 nt, Human
uaauuucaaaaugcuu

SEQ ID NO: 1308327 - RNA, 20 nt, Human
uaauuucaaaaugcuuuuua

SEQ ID NO: 1308328 - RNA, 21 nt, Human
uaauuucaggaggaauacuga

SEQ ID NO: 1308329 - RNA, 23 nt, Human
uaauuucaggaggaauacugaac

SEQ ID NO: 1308330 - RNA, 22 nt, Human
uaauuucaggaggaauacugaa

SEQ ID NO: 1308331 - RNA, 13 nt, Human
uaauuccacagcu

SEQ ID NO: 1308332 - RNA, 15 nt, Human
uaauuccacaccuuu

SEQ ID NO: 1308333 - RNA, 14 nt, Human
uaauuccacagcug

SEQ ID NO: 1308334 - RNA, 17 nt, Human
uaauuccacagcugcuc

SEQ ID NO: 1308335 - RNA, 17 nt, Human
uaauuccacaccuuuua

SEQ ID NO: 1308336 - RNA, 12 nt, Human
aaugagcuuucu

SEQ ID NO: 1308337 - RNA, 13 nt, Human
aaugagcuuucug

SEQ ID NO: 1308338 - RNA, 14 nt, Human
aaugagcuuucuga

SEQ ID NO: 1308339 - RNA, 15 nt, Human
aaugagcuuucugaa

SEQ ID NO: 1308340 - RNA, 16 nt, Human
aaugagcuuucugaac

SEQ ID NO: 1308341 - RNA, 20 nt, Human
aaugagcuuucugaacagcu

SEQ ID NO: 1308342 - RNA, 21 nt, Human
aaugagcuuucugaacagcug

SEQ ID NO: 1308343 - RNA, 22 nt, Human
aaugagcuuucugaacagcugg

SEQ ID NO: 1308344 - RNA, 23 nt, Human
aaugagcuuucugaacagcuggu

SEQ ID NO: 1308345 - RNA, 14 nt, Human
aaugaggagacaca

SEQ ID NO: 1308346 - RNA, 14 nt, Human
uaauuauuuaugua

SEQ ID NO: 1308347 - RNA, 16 nt, Human
uaauuauuuauguaug

SEQ ID NO: 1308348 - RNA, 18 nt, Human
uaauuauuuauguauggu

SEQ ID NO: 1308349 - RNA, 18 nt, Human
uaauucaaggaauuucuu

SEQ ID NO: 1308350 - RNA, 20 nt, Human
uaauucaaggaauuucuuaa

SEQ ID NO: 1308351 - RNA, 22 nt, Human
uaauucaaggaauuucuuaacu

SEQ ID NO: 1308352 - RNA, 19 nt, Human
uaauucaauucaaagcugu

SEQ ID NO: 1308353 - RNA, 16 nt, Human
uaauucaauucaaagc

SEQ ID NO: 1308354 - RNA, 20 nt, Human
uacaguaggagcccagcucu

SEQ ID NO: 1308355 - RNA, 22 nt, Human
uacaguaggagcccagcucuga

SEQ ID NO: 1308356 - RNA, 17 nt, Human
uacaguagauuuuccaa

SEQ ID NO: 1308357 - RNA, 21 nt, Human
uacaguagauuuuccaaaugu

SEQ ID NO: 1308358 - RNA, 13 nt, Human
uacaguaggagcc

SEQ ID NO: 1308359 - RNA, 14 nt, Human
uacaguaggagccc

SEQ ID NO: 1308360 - RNA, 15 nt, Human
uacaguaggagccca

SEQ ID NO: 1308361 - RNA, 18 nt, Human
uacaguaggagcccagcu

SEQ ID NO: 1308362 - RNA, 22 nt, Human
uacaggcgugagccaccgugcc

SEQ ID NO: 1308363 - RNA, 15 nt, Human
uacaggccucacaca

SEQ ID NO: 1308364 - RNA, 14 nt, Human
uacaggcuccugcc

SEQ ID NO: 1308365 - RNA, 15 nt, Human
uacaggcuccugcca

SEQ ID NO: 1308366 - RNA, 17 nt, Human
uacaggcuccugccacc

SEQ ID NO: 1308367 - RNA, 19 nt, Human
uacacuaagagagaaugag

SEQ ID NO: 1308368 - RNA, 14 nt, Human
uacacuccagugag

SEQ ID NO: 1308369 - RNA, 13 nt, Human
uacacuaucuuaa

SEQ ID NO: 1308370 - RNA, 16 nt, Human
uacagagcuucccuga

SEQ ID NO: 1308371 - RNA, 15 nt, Human
uacagagcuucccug

SEQ ID NO: 1308372 - RNA, 19 nt, Human
aauggacuuuuguacauag

SEQ ID NO: 1308373 - RNA, 21 nt, Human
aauggaccggagagugggggu

SEQ ID NO: 1308374 - RNA, 20 nt, Human
aauggagauucaguuuucau

SEQ ID NO: 1308375 - RNA, 21 nt, Human
aauggaggaacuuuccaaaca

SEQ ID NO: 1308376 - RNA, 12 nt, Human
uacaccacucug

SEQ ID NO: 1308377 - RNA, 14 nt, Human
uacaccacucuggc

SEQ ID NO: 1308378 - RNA, 16 nt, Human
uacaccacucuggcag

SEQ ID NO: 1308379 - RNA, 17 nt, Human
uacaccacucuggcagc

SEQ ID NO: 1308380 - RNA, 19 nt, Human
uacaccacucuggcagcca

SEQ ID NO: 1308381 - RNA, 21 nt, Human
uacaccacucuggcagccaca

SEQ ID NO: 1308382 - RNA, 20 nt, Human
uacaccacucuggcagccac

SEQ ID NO: 1308383 - RNA, 17 nt, Human
uacauagaugcuuaguc

SEQ ID NO: 1308384 - RNA, 16 nt, Human
uacauagugcuaacau

SEQ ID NO: 1308385 - RNA, 21 nt, Human
uacauagggauaugcguauua

SEQ ID NO: 1308386 - RNA, 22 nt, Human
uacauauaagugauugcugguu

SEQ ID NO: 1308387 - RNA, 22 nt, Human
uacauagugcugcugugugcuu

SEQ ID NO: 1308388 - RNA, 21 nt, Human
uacauaugugcuggaauucua

SEQ ID NO: 1308389 - RNA, 19 nt, Human
uacauauaagugauugcug

SEQ ID NO: 1308390 - RNA, 23 nt, Human
uacauagugcuaacaugaagacc

SEQ ID NO: 1308391 - RNA, 17 nt, Human
uacauagugcugcugug

SEQ ID NO: 1308392 - RNA, 22 nt, Human
uacauagugcuaacaugaagac

SEQ ID NO: 1308393 - RNA, 21 nt, Human
uacauagugcuaacaugaaga

SEQ ID NO: 1308394 - RNA, 19 nt, Human
uacauagugcugcugugug

SEQ ID NO: 1308395 - RNA, 21 nt, Human
uacauagugcugcugugugcu

SEQ ID NO: 1308396 - RNA, 15 nt, Human
aauguacuaauauuu

SEQ ID NO: 1308397 - RNA, 13 nt, Human
aauguaugucugg

SEQ ID NO: 1308398 - RNA, 11 nt, Human
aaugugauaug

SEQ ID NO: 1308399 - RNA, 16 nt, Human
aaugugauauuauaca

SEQ ID NO: 1308400 - RNA, 12 nt, Human
aaugugaugaau

SEQ ID NO: 1308401 - RNA, 20 nt, Human
aaugugaugaauacuguauu

SEQ ID NO: 1308402 - RNA, 14 nt, Human
aauguggcuccugg

SEQ ID NO: 1308403 - RNA, 16 nt, Human
aaugugaugaauacug

SEQ ID NO: 1308404 - RNA, 13 nt, Human
aaugugauguucu

SEQ ID NO: 1308405 - RNA, 12 nt, Human
aauguggcuuga

SEQ ID NO: 1308406 - RNA, 16 nt, Human
aauguggcuugagaaa

SEQ ID NO: 1308407 - RNA, 21 nt, Human
aauguggcuugagaaauaugg

SEQ ID NO: 1308408 - RNA, 13 nt, Human
aauguauuuuaug

SEQ ID NO: 1308409 - RNA, 15 nt, Human
aauguauuuuauguu

SEQ ID NO: 1308410 - RNA, 18 nt, Human
aauguauuuuauguuaua

SEQ ID NO: 1308411 - RNA, 20 nt, Human
aauguauuuuauguuauaua

SEQ ID NO: 1308412 - RNA, 19 nt, Human
aauguauuuuauguuauau

SEQ ID NO: 1308413 - RNA, 20 nt, Human
uaauagggcaauuaauuccu

SEQ ID NO: 1308414 - RNA, 19 nt, Human
uaauagguuuggacaaaau

SEQ ID NO: 1308415 - RNA, 14 nt, Human
uaauaguauaaacc

SEQ ID NO: 1308416 - RNA, 14 nt, Human
uaauagguuuggac

SEQ ID NO: 1308417 - RNA, 18 nt, Human
uaauagggaaaauucuaa

SEQ ID NO: 1308418 - RNA, 19 nt, Human
uaauacugcugagauacau

SEQ ID NO: 1308419 - RNA, 11 nt, Human
uaauagcugua

SEQ ID NO: 1308420 - RNA, 18 nt, Human
uaaucaauguuucuucua

SEQ ID NO: 1308421 - RNA, 15 nt, Human
uaaucacgcuuuccu

SEQ ID NO: 1308422 - RNA, 23 nt, Human
aaucuuccaauuuaguuguugua

SEQ ID NO: 1308423 - RNA, 15 nt, Human
aaucuuccaauuuag

SEQ ID NO: 1308424 - RNA, 14 nt, Human
aaucuuccuguuua

SEQ ID NO: 1308425 - RNA, 17 nt, Human
aaucuuauaauuguucu

SEQ ID NO: 1308426 - RNA, 14 nt, Human
uaauacuaccuuga

SEQ ID NO: 1308427 - RNA, 15 nt, Human
uaauacuaccuugaa

SEQ ID NO: 1308428 - RNA, 16 nt, Human
uaauacucaaaugagu

SEQ ID NO: 1308429 - RNA, 18 nt, Human
uaauacucaaaugaguaa

SEQ ID NO: 1308430 - RNA, 20 nt, Human
uaauacucaaaugaguaaca

SEQ ID NO: 1308431 - RNA, 21 nt, Human
uaauacucaaaugaguaacau

SEQ ID NO: 1308432 - RNA, 14 nt, Human
uaauacugcugaga

SEQ ID NO: 1308433 - RNA, 23 nt, Human
uaauacugcugagauacauacag

SEQ ID NO: 1308434 - RNA, 20 nt, Human
uaaugacaucaccacaguuu

SEQ ID NO: 1308435 - RNA, 17 nt, Human
uaaugaaacaaagaguu

SEQ ID NO: 1308436 - RNA, 15 nt, Human
uaaugaauuuaguga

SEQ ID NO: 1308437 - RNA, 15 nt, Human
uaaugacaggccugu

SEQ ID NO: 1308438 - RNA, 20 nt, Human
uaaugacaggccuguccaac

SEQ ID NO: 1308439 - RNA, 23 nt, Human
uaaugaaacaaagaguucaagaa

SEQ ID NO: 1308440 - RNA, 22 nt, Human
uaaucaucaagagaauuugggg

SEQ ID NO: 1308441 - RNA, 18 nt, Human
uaaucaucaaguaauaca

SEQ ID NO: 1308442 - RNA, 21 nt, Human
uaaucauauaaauagaaugua

SEQ ID NO: 1308443 - RNA, 20 nt, Human
uaaucauauaaauagaaugu

SEQ ID NO: 1308444 - RNA, 15 nt, Human
uaaucauauaauaaa

SEQ ID NO: 1308445 - RNA, 20 nt, Human
uaaucauauaauaaauguac

SEQ ID NO: 1308446 - RNA, 22 nt, Human
uaaucauauaauaaauguacau

SEQ ID NO: 1308447 - RNA, 19 nt, Human
uaaucauauaaauagaaug

SEQ ID NO: 1308448 - RNA, 17 nt, Human
uaaucauauaaauagaa

SEQ ID NO: 1308449 - RNA, 13 nt, Human
uaaucauauaaau

SEQ ID NO: 1308450 - RNA, 12 nt, Human
uaaucauauaaa

SEQ ID NO: 1308451 - RNA, 17 nt, Human
uaaucacgcuuuccuga

SEQ ID NO: 1308452 - RNA, 23 nt, Human
uaaucaguucauuagaaauauuu

SEQ ID NO: 1308453 - RNA, 15 nt, Human
aaugaaaaccacauu

SEQ ID NO: 1308454 - RNA, 16 nt, Human
aaugaaaacagaaugu

SEQ ID NO: 1308455 - RNA, 18 nt, Human
aaugaaaacagaaugucu

SEQ ID NO: 1308456 - RNA, 18 nt, Human
aaugaaaacucuuugcug

SEQ ID NO: 1308457 - RNA, 14 nt, Human
aaugaaaauaagaa

SEQ ID NO: 1308458 - RNA, 15 nt, Human
aaugaaaauguccau

SEQ ID NO: 1308459 - RNA, 15 nt, Human
aaugaaaaugucuug

SEQ ID NO: 1308460 - RNA, 14 nt, Human
aaugacacucauau

SEQ ID NO: 1308461 - RNA, 17 nt, Human
aaugacacucauauaau

SEQ ID NO: 1308462 - RNA, 11 nt, Human
aaugacacugu

SEQ ID NO: 1308463 - RNA, 19 nt, Human
aaugacacucauauaauua

SEQ ID NO: 1308464 - RNA, 15 nt, Human
aaugacaggccuguc

SEQ ID NO: 1308465 - RNA, 22 nt, Human
aaugacaguccgucaaaacaga

SEQ ID NO: 1308466 - RNA, 18 nt, Human
aaugacaucaccacaguu

SEQ ID NO: 1308467 - RNA, 13 nt, Human
aaugacaugaauu

SEQ ID NO: 1308468 - RNA, 19 nt, Human
aaugacaugaauuuuagcu

SEQ ID NO: 1308469 - RNA, 18 nt, Human
aaugacauuuauaucaca

SEQ ID NO: 1308470 - RNA, 15 nt, Human
aaugagacauccagc

SEQ ID NO: 1308471 - RNA, 14 nt, Human
aaugagacauccag

SEQ ID NO: 1308472 - RNA, 13 nt, Human
aaugagacaucca

SEQ ID NO: 1308473 - RNA, 21 nt, Human
aaugagagacacacugaagaa

SEQ ID NO: 1308474 - RNA, 13 nt, Human
aaugagaaucuac

SEQ ID NO: 1308475 - RNA, 21 nt, Human
aaucuuuaaaagaugcuuuua

SEQ ID NO: 1308476 - RNA, 17 nt, Human
aaucuuuaaaagaugcu

SEQ ID NO: 1308477 - RNA, 21 nt, Human
aaucuuugaaagguuagagaa

SEQ ID NO: 1308478 - RNA, 12 nt, Human
aaucuuuuacaa

SEQ ID NO: 1308479 - RNA, 21 nt, Human
aaucuuuuacaacugccucga

SEQ ID NO: 1308480 - RNA, 23 nt, Human
aaucuuuuacaacugccucgaaa

SEQ ID NO: 1308481 - RNA, 16 nt, Human
uaaugauaacuggaaa

SEQ ID NO: 1308482 - RNA, 19 nt, Human
uaaugguguagaacacuaa

SEQ ID NO: 1308483 - RNA, 16 nt, Human
uaauggugccuucauu

SEQ ID NO: 1308484 - RNA, 18 nt, Human
uaauggugccuucauuug

SEQ ID NO: 1308485 - RNA, 13 nt, Human
uaaugguguagaa

SEQ ID NO: 1308486 - RNA, 18 nt, Human
aaucuugucauguguaua

SEQ ID NO: 1308487 - RNA, 19 nt, Human
aaucuugucauguguauaa

SEQ ID NO: 1308488 - RNA, 20 nt, Human
aauccucaguuuuugugaaa

SEQ ID NO: 1308489 - RNA, 22 nt, Human
aauccuaugcaugguuucagca

SEQ ID NO: 1308490 - RNA, 21 nt, Human
aauccuaugcaugguuucagc

SEQ ID NO: 1308491 - RNA, 17 nt, Human
aauccuaccucaaaauu

SEQ ID NO: 1308492 - RNA, 15 nt, Human
aauccuaccucaaaa

SEQ ID NO: 1308493 - RNA, 15 nt, Human
aauccuaugcauggu

SEQ ID NO: 1308494 - RNA, 18 nt, Human
aauccuaugcaugguuuc

SEQ ID NO: 1308495 - RNA, 14 nt, Human
aaucauuguaugug

SEQ ID NO: 1308496 - RNA, 12 nt, Human
aaucauuucuau

SEQ ID NO: 1308497 - RNA, 19 nt, Human
aaucauuucuauuucuccu

SEQ ID NO: 1308498 - RNA, 20 nt, Human
aaucauuucuauuucuccuc

SEQ ID NO: 1308499 - RNA, 13 nt, Human
aauccuugaagau

SEQ ID NO: 1308500 - RNA, 19 nt, Human
aauccuuagaucuggcaug

SEQ ID NO: 1308501 - RNA, 20 nt, Human
aauccuuagaucuggcaugu

SEQ ID NO: 1308502 - RNA, 20 nt, Human
aauccuugaagguauaucua

SEQ ID NO: 1308503 - RNA, 13 nt, Human
aauccuugcuuau

SEQ ID NO: 1308504 - RNA, 15 nt, Human
aauccuugaagguau

SEQ ID NO: 1308505 - RNA, 22 nt, Human
aauccuucuauucuagccugca

SEQ ID NO: 1308506 - RNA, 19 nt, Human
aauccuucuauucuagccu

SEQ ID NO: 1308507 - RNA, 17 nt, Human
aauccuugcuuaugaca

SEQ ID NO: 1308508 - RNA, 18 nt, Human
aauccuugcuuaugacau

SEQ ID NO: 1308509 - RNA, 17 nt, Human
aauccuugaugauugac

SEQ ID NO: 1308510 - RNA, 15 nt, Human
aaucuacuaauucca

SEQ ID NO: 1308511 - RNA, 16 nt, Human
aaucuacuaauuccac

SEQ ID NO: 1308512 - RNA, 14 nt, Human
aaucuuauaauugu

SEQ ID NO: 1308513 - RNA, 15 nt, Human
aaucuuauaauuguu

SEQ ID NO: 1308514 - RNA, 16 nt, Human
aaucuuauaauuuaaa

SEQ ID NO: 1308515 - RNA, 14 nt, Human
aaucuuauaauuua

SEQ ID NO: 1308516 - RNA, 22 nt, Human
aaucugucacguagaacuugga

SEQ ID NO: 1308517 - RNA, 17 nt, Human
aaucuacuaauuccaca

SEQ ID NO: 1308518 - RNA, 17 nt, Human
aaucuacucaaagcaug

SEQ ID NO: 1308519 - RNA, 16 nt, Human
aaucuacucaaagcau

SEQ ID NO: 1308520 - RNA, 22 nt, Human
aaucuagauaucgacuuguuuu

SEQ ID NO: 1308521 - RNA, 15 nt, Human
aaucaucaagucuuu

SEQ ID NO: 1308522 - RNA, 15 nt, Human
aaucaucaagagaau

SEQ ID NO: 1308523 - RNA, 21 nt, Human
aaucaucaagagaauuugggg

SEQ ID NO: 1308524 - RNA, 23 nt, Human
aaucaucaagagaauuuggggcu

SEQ ID NO: 1308525 - RNA, 12 nt, Human
aaucaucaagua

SEQ ID NO: 1308526 - RNA, 22 nt, Human
aaucaucagaaaggaaaaacaa

SEQ ID NO: 1308527 - RNA, 20 nt, Human
aaucauccauccuugccaau

SEQ ID NO: 1308528 - RNA, 15 nt, Human
uaauaaaaauaauuu

SEQ ID NO: 1308529 - RNA, 11 nt, Human
uaauaaaagaa

SEQ ID NO: 1308530 - RNA, 12 nt, Human
uaauaaaagaaa

SEQ ID NO: 1308531 - RNA, 14 nt, Human
uaauaaaagaaaau

SEQ ID NO: 1308532 - RNA, 13 nt, Human
uaauaaaagaaaa

SEQ ID NO: 1308533 - RNA, 17 nt, Human
aaucauggugcucagag

SEQ ID NO: 1308534 - RNA, 12 nt, Human
aaucaugugugu

SEQ ID NO: 1308535 - RNA, 13 nt, Human
aaucauguguguu

SEQ ID NO: 1308536 - RNA, 15 nt, Human
aaucauguguguuaa

SEQ ID NO: 1308537 - RNA, 19 nt, Human
aaucaugaauuaguuuuau

SEQ ID NO: 1308538 - RNA, 17 nt, Human
aaucaugaauuaguuuu

SEQ ID NO: 1308539 - RNA, 23 nt, Human
aaucaugaauuaguuuuauaugc

SEQ ID NO: 1308540 - RNA, 17 nt, Human
aaucagacuaugaaguu

SEQ ID NO: 1308541 - RNA, 14 nt, Human
aaucagacuaugaa

SEQ ID NO: 1308542 - RNA, 13 nt, Human
aaucagaauuaga

SEQ ID NO: 1308543 - RNA, 12 nt, Human
aaucagacugac

SEQ ID NO: 1308544 - RNA, 16 nt, Human
aaucagagaaggaaca

SEQ ID NO: 1308545 - RNA, 20 nt, Human
aaucagagaccuuccagaaa

SEQ ID NO: 1308546 - RNA, 14 nt, Human
aaucagauagauau

SEQ ID NO: 1308547 - RNA, 16 nt, Human
aaucagauagauauuc

SEQ ID NO: 1308548 - RNA, 21 nt, Human
aaucagauagauauuccuauu

SEQ ID NO: 1308549 - RNA, 12 nt, Human
aaucagcauucu

SEQ ID NO: 1308550 - RNA, 18 nt, Human
uaaguuuuuuuuuaaaaa

SEQ ID NO: 1308551 - RNA, 14 nt, Human
uaaguuucugggac

SEQ ID NO: 1308552 - RNA, 17 nt, Human
uaaguuucucugcagaa

SEQ ID NO: 1308553 - RNA, 16 nt, Human
uaaguuugauuucauu

SEQ ID NO: 1308554 - RNA, 12 nt, Human
uaaguuauugca

SEQ ID NO: 1308555 - RNA, 14 nt, Human
uaaguuauugcagu

SEQ ID NO: 1308556 - RNA, 15 nt, Human
uaaguuauugcaguu

SEQ ID NO: 1308557 - RNA, 16 nt, Human
uaaguuauugcaguuu

SEQ ID NO: 1308558 - RNA, 20 nt, Human
uaaguuauugcaguuuauca

SEQ ID NO: 1308559 - RNA, 20 nt, Human
uaaguuauuuuuacauucug

SEQ ID NO: 1308560 - RNA, 19 nt, Human
uaaguucaaauucuucuga

SEQ ID NO: 1308561 - RNA, 20 nt, Human
uaaguucaaauucuucugaa

SEQ ID NO: 1308562 - RNA, 18 nt, Human
aauaggcguaacuaauuu

SEQ ID NO: 1308563 - RNA, 16 nt, Human
aauaggaauugguuuc

SEQ ID NO: 1308564 - RNA, 14 nt, Human
aauaggcaggaagc

SEQ ID NO: 1308565 - RNA, 18 nt, Human
aauaggcggggcuugccu

SEQ ID NO: 1308566 - RNA, 19 nt, Human
aauaggcggggcuugccuu

SEQ ID NO: 1308567 - RNA, 18 nt, Human
aauagggacuaucuaucu

SEQ ID NO: 1308568 - RNA, 21 nt, Human
aauagggcugagcucucugug

SEQ ID NO: 1308569 - RNA, 19 nt, Human
aauaggguauauuuuccua

SEQ ID NO: 1308570 - RNA, 20 nt, Human
aauaggguauauuuuccuau

SEQ ID NO: 1308571 - RNA, 24 nt, Human
aauagcuuuuuucucugauacaga

SEQ ID NO: 1308572 - RNA, 22 nt, Human
aauagccauauuuguaaaauga

SEQ ID NO: 1308573 - RNA, 18 nt, Human
aauagcuguaaacuucca

SEQ ID NO: 1308574 - RNA, 16 nt, Human
aauagcuuaugaaaag

SEQ ID NO: 1308575 - RNA, 17 nt, Human
aauagcuuaugaaaaga

SEQ ID NO: 1308576 - RNA, 19 nt, Human
aauagcuuaugaaaagaau

SEQ ID NO: 1308577 - RNA, 18 nt, Human
aauagcuuaugaaaagaa

SEQ ID NO: 1308578 - RNA, 15 nt, Human
aauagcuuuaaugau

SEQ ID NO: 1308579 - RNA, 16 nt, Human
aauagcuuuaaugaua

SEQ ID NO: 1308580 - RNA, 16 nt, Human
uaaauuuuuuguugac

SEQ ID NO: 1308581 - RNA, 18 nt, Human
uaaauuuuuuguugacau

SEQ ID NO: 1308582 - RNA, 20 nt, Human
uaaauuuuuuguugacauua

SEQ ID NO: 1308583 - RNA, 14 nt, Human
uaaauuuuuuuccu

SEQ ID NO: 1308584 - RNA, 22 nt, Human
aauagacacuccccgaagucuu

SEQ ID NO: 1308585 - RNA, 23 nt, Human
aauagacacuccccgaagucuuu

SEQ ID NO: 1308586 - RNA, 16 nt, Human
aauagacagcaugaga

SEQ ID NO: 1308587 - RNA, 18 nt, Human
aauagacccacaagaggc

SEQ ID NO: 1308588 - RNA, 16 nt, Human
uaaauuuuuuuccuua

SEQ ID NO: 1308589 - RNA, 20 nt, Human
aauagauaagaguagaaacu

SEQ ID NO: 1308590 - RNA, 21 nt, Human
aauagauauccacuugagaca

SEQ ID NO: 1308591 - RNA, 18 nt, Human
aauagauaugaaagcuga

SEQ ID NO: 1308592 - RNA, 15 nt, Human
aauagccauauuugu

SEQ ID NO: 1308593 - RNA, 18 nt, Human
aauagccauauuuguaaa

SEQ ID NO: 1308594 - RNA, 21 nt, Human
aauagccauauuuguaaaaug

SEQ ID NO: 1308595 - RNA, 23 nt, Human
aauagccacuaaccuugccuggu

SEQ ID NO: 1308596 - RNA, 20 nt, Human
aauagccacuaaccuugccu

SEQ ID NO: 1308597 - RNA, 21 nt, Human
aauagccacuaaccuugccug

SEQ ID NO: 1308598 - RNA, 16 nt, Human
aauagaugcugacugu

SEQ ID NO: 1308599 - RNA, 11 nt, Human
aauagauguuu

SEQ ID NO: 1308600 - RNA, 22 nt, Human
aauagauguuugauagauuuuc

SEQ ID NO: 1308601 - RNA, 19 nt, Human
aauagauaugaaagcugau

SEQ ID NO: 1308602 - RNA, 19 nt, Human
aauagauguuugauagauu

SEQ ID NO: 1308603 - RNA, 11 nt, Human
aauagauucuc

SEQ ID NO: 1308604 - RNA, 12 nt, Human
aauagauucucu

SEQ ID NO: 1308605 - RNA, 20 nt, Human
aauagcaugucacuaaagca

SEQ ID NO: 1308606 - RNA, 20 nt, Human
aauagccacauuuggaauac

SEQ ID NO: 1308607 - RNA, 22 nt, Human
aauagccacauuuggaauacuu

SEQ ID NO: 1308608 - RNA, 23 nt, Human
aauagccacauuuggaauacuuu

SEQ ID NO: 1308609 - RNA, 12 nt, Human
aauaucacuugu

SEQ ID NO: 1308610 - RNA, 21 nt, Human
aauauauuauuacuuguaaau

SEQ ID NO: 1308611 - RNA, 18 nt, Human
aauaucaccaaaaaccua

SEQ ID NO: 1308612 - RNA, 19 nt, Human
aauaucaccaaaaaccuau

SEQ ID NO: 1308613 - RNA, 20 nt, Human
aauaucaccaaaaaccuauu

SEQ ID NO: 1308614 - RNA, 23 nt, Human
aauaucaccaaaaaccuauucca

SEQ ID NO: 1308615 - RNA, 14 nt, Human
aauauauguauaua

SEQ ID NO: 1308616 - RNA, 13 nt, Human
aauauauuauuac

SEQ ID NO: 1308617 - RNA, 15 nt, Human
aauauauuauuacuu

SEQ ID NO: 1308618 - RNA, 18 nt, Human
aauauauuauuacuugua

SEQ ID NO: 1308619 - RNA, 20 nt, Human
aauauauuauuacuuguaaa

SEQ ID NO: 1308620 - RNA, 16 nt, Human
aauaguauuucccauu

SEQ ID NO: 1308621 - RNA, 15 nt, Human
aauaguauuucccau

SEQ ID NO: 1308622 - RNA, 16 nt, Human
aauauauguauauaca

SEQ ID NO: 1308623 - RNA, 15 nt, Human
aauaucacuugucaa

SEQ ID NO: 1308624 - RNA, 20 nt, Human
aauaucacuugucaauaaaa

SEQ ID NO: 1308625 - RNA, 21 nt, Human
aauaucccagaaaaaguaacu

SEQ ID NO: 1308626 - RNA, 22 nt, Human
aauaucccagaaaaaguaacuc

SEQ ID NO: 1308627 - RNA, 16 nt, Human
aauaucccuacaugua

SEQ ID NO: 1308628 - RNA, 17 nt, Human
aauaucccuacauguau

SEQ ID NO: 1308629 - RNA, 18 nt, Human
aauaucccuacauguauu

SEQ ID NO: 1308630 - RNA, 19 nt, Human
aauaucccuacauguauug

SEQ ID NO: 1308631 - RNA, 23 nt, Human
aauaucccuccuguugggagagg

SEQ ID NO: 1308632 - RNA, 12 nt, Human
aauaucccuccu

SEQ ID NO: 1308633 - RNA, 19 nt, Human
aauaucccuccuguuggga

SEQ ID NO: 1308634 - RNA, 22 nt, Human
aauaucccuccuguugggagag

SEQ ID NO: 1308635 - RNA, 14 nt, Human
aauauccuaaacau

SEQ ID NO: 1308636 - RNA, 18 nt, Human
aauauccuaaacaucauu

SEQ ID NO: 1308637 - RNA, 16 nt, Human
uaaccucuaaauucuu

SEQ ID NO: 1308638 - RNA, 16 nt, Human
uaaccucgggccugcu

SEQ ID NO: 1308639 - RNA, 14 nt, Human
uaaccucugcacua

SEQ ID NO: 1308640 - RNA, 17 nt, Human
uaaccucuucagaggcc

SEQ ID NO: 1308641 - RNA, 18 nt, Human
uaaccugucucaccugga

SEQ ID NO: 1308642 - RNA, 12 nt, Human
uaacuaaaauaa

SEQ ID NO: 1308643 - RNA, 18 nt, Human
uaacuaaaauaauuuugu

SEQ ID NO: 1308644 - RNA, 19 nt, Human
uaacuaaaauaauuuugua

SEQ ID NO: 1308645 - RNA, 15 nt, Human
aauauccuaaacauc

SEQ ID NO: 1308646 - RNA, 16 nt, Human
aauauccuaaacauca

SEQ ID NO: 1308647 - RNA, 17 nt, Human
aauauccuaaacaucau

SEQ ID NO: 1308648 - RNA, 14 nt, Human
uaacaugauuuggg

SEQ ID NO: 1308649 - RNA, 14 nt, Human
uaacauaagcuauu

SEQ ID NO: 1308650 - RNA, 15 nt, Human
uaacauaagcuauuu

SEQ ID NO: 1308651 - RNA, 19 nt, Human
uaacauaagcuauuuuucu

SEQ ID NO: 1308652 - RNA, 22 nt, Human
uaacauaccuaagaaguacauu

SEQ ID NO: 1308653 - RNA, 16 nt, Human
aauaucuccgucaacu

SEQ ID NO: 1308654 - RNA, 21 nt, Human
aauaucuccgucaacucauau

SEQ ID NO: 1308655 - RNA, 13 nt, Human
uaagaccuggcag

SEQ ID NO: 1308656 - RNA, 11 nt, Human
uaagaccuggc

SEQ ID NO: 1308657 - RNA, 13 nt, Human
aauauccugcuug

SEQ ID NO: 1308658 - RNA, 12 nt, Human
aauaucugaagc

SEQ ID NO: 1308659 - RNA, 17 nt, Human
aauaucuguaaugguac

SEQ ID NO: 1308660 - RNA, 17 nt, Human
aauaucuucacuuguca

SEQ ID NO: 1308661 - RNA, 19 nt, Human
aauaucuuuuuuuuaauaa

SEQ ID NO: 1308662 - RNA, 20 nt, Human
uaacuaauacagcugagcua

SEQ ID NO: 1308663 - RNA, 16 nt, Human
uaacuaacuaaaacaa

SEQ ID NO: 1308664 - RNA, 18 nt, Human
uaacuaacugcauacacu

SEQ ID NO: 1308665 - RNA, 21 nt, Human
uaacuacaaagguuuaaauga

SEQ ID NO: 1308666 - RNA, 22 nt, Human
uaacuacaaagguuuaaaugaa

SEQ ID NO: 1308667 - RNA, 23 nt, Human
uaacuacaaagguuuaaaugaac

SEQ ID NO: 1308668 - RNA, 21 nt, Human
uaacuaaaauaauuuuguaau

SEQ ID NO: 1308669 - RNA, 20 nt, Human
uaacuaaaauaauuuuguaa

SEQ ID NO: 1308670 - RNA, 16 nt, Human
uaacuaacauguccug

SEQ ID NO: 1308671 - RNA, 13 nt, Human
uaacuacuuuaua

SEQ ID NO: 1308672 - RNA, 14 nt, Human
uaacuacuuuauaa

SEQ ID NO: 1308673 - RNA, 12 nt, Human
uaacuuuguuuu

SEQ ID NO: 1308674 - RNA, 14 nt, Human
uaacuuuguuuuau

SEQ ID NO: 1308675 - RNA, 18 nt, Human
uaacuuuguuuuauuuuc

SEQ ID NO: 1308676 - RNA, 13 nt, Human
uaagaaugaucug

SEQ ID NO: 1308677 - RNA, 21 nt, Human
uaacuuuguuuuauuuucaaa

SEQ ID NO: 1308678 - RNA, 17 nt, Human
uaagaaucuagcaagaa

SEQ ID NO: 1308679 - RNA, 21 nt, Human
uaagaaucuagcaagaauuga

SEQ ID NO: 1308680 - RNA, 14 nt, Human
uaagaaucuuuaga

SEQ ID NO: 1308681 - RNA, 17 nt, Human
uaagacauuuuuggaag

SEQ ID NO: 1308682 - RNA, 20 nt, Human
uaagacaugauuuccuugaa

SEQ ID NO: 1308683 - RNA, 21 nt, Human
uaagacaugauuuccuugaau

SEQ ID NO: 1308684 - RNA, 22 nt, Human
uaagacccuuauugcuguccug

SEQ ID NO: 1308685 - RNA, 14 nt, Human
uaagaccuacuguu

SEQ ID NO: 1308686 - RNA, 16 nt, Human
uaagaccuacuguucu

SEQ ID NO: 1308687 - RNA, 17 nt, Human
uaagaccuacuguucua

SEQ ID NO: 1308688 - RNA, 18 nt, Human
uaagaccuacuguucuaa

SEQ ID NO: 1308689 - RNA, 19 nt, Human
uaagaccuacuguucuaaa

SEQ ID NO: 1308690 - RNA, 20 nt, Human
uaagaccuacuguucuaaag

SEQ ID NO: 1308691 - RNA, 21 nt, Human
uaagaccuacuguucuaaagc

SEQ ID NO: 1308692 - RNA, 22 nt, Human
uaagaccuacuguucuaaagcu

SEQ ID NO: 1308693 - RNA, 12 nt, Human
aauauuuuccuc

SEQ ID NO: 1308694 - RNA, 19 nt, Human
aaucacuguuuagaacaca

SEQ ID NO: 1308695 - RNA, 21 nt, Human
aaucacuguuuagaacacaca

SEQ ID NO: 1308696 - RNA, 16 nt, Human
aaucacuuaggaaaug

SEQ ID NO: 1308697 - RNA, 11 nt, Human
aaucagaacuc

SEQ ID NO: 1308698 - RNA, 12 nt, Human
aaucagaacuca

SEQ ID NO: 1308699 - RNA, 23 nt, Human
aaucagaacucaaauggggccag

SEQ ID NO: 1308700 - RNA, 20 nt, Human
aaucagaagucaucuugcua

SEQ ID NO: 1308701 - RNA, 24 nt, Human
aaucagaagucaucuugcuaccag

SEQ ID NO: 1308702 - RNA, 17 nt, Human
aauauuguuuuacaaua

SEQ ID NO: 1308703 - RNA, 18 nt, Human
aauauuguuuuacaauag

SEQ ID NO: 1308704 - RNA, 15 nt, Human
aauauuucagauaau

SEQ ID NO: 1308705 - RNA, 12 nt, Human
aauauuucuuca

SEQ ID NO: 1308706 - RNA, 16 nt, Human
aauaugauguuaaaaa

SEQ ID NO: 1308707 - RNA, 22 nt, Human
aauauugcuccaugaugacuua

SEQ ID NO: 1308708 - RNA, 14 nt, Human
aauaauuuuaucuc

SEQ ID NO: 1308709 - RNA, 11 nt, Human
aauaauuuuau

SEQ ID NO: 1308710 - RNA, 16 nt, Human
aauaauuuuaaacaaa

SEQ ID NO: 1308711 - RNA, 16 nt, Human
aauaauuucuaauguu

SEQ ID NO: 1308712 - RNA, 12 nt, Human
aauaauuguugu

SEQ ID NO: 1308713 - RNA, 14 nt, Human
aauaauuguuguuc

SEQ ID NO: 1308714 - RNA, 16 nt, Human
aauaauuguuguucug

SEQ ID NO: 1308715 - RNA, 17 nt, Human
aauaauuguuguucugu

SEQ ID NO: 1308716 - RNA, 22 nt, Human
aauaauuguuguucuguuaacu

SEQ ID NO: 1308717 - RNA, 18 nt, Human
aauaauuguuguucuguu

SEQ ID NO: 1308718 - RNA, 12 nt, Human
aauaauuuagac

SEQ ID NO: 1308719 - RNA, 21 nt, Human
aauaauuuagacuucaagcau

SEQ ID NO: 1308720 - RNA, 13 nt, Human
aauaauuucuaau

SEQ ID NO: 1308721 - RNA, 15 nt, Human
aauaauuucuaaugu

SEQ ID NO: 1308722 - RNA, 16 nt, Human
aauaauuuuuauauuu

SEQ ID NO: 1308723 - RNA, 13 nt, Human
aauaauuuuguaa

SEQ ID NO: 1308724 - RNA, 14 nt, Human
aauaauuuuguaau

SEQ ID NO: 1308725 - RNA, 15 nt, Human
aauaauuuuguaaug

SEQ ID NO: 1308726 - RNA, 17 nt, Human
aauaauuuuuauauuug

SEQ ID NO: 1308727 - RNA, 19 nt, Human
aauaauuuuuauauuugaa

SEQ ID NO: 1308728 - RNA, 20 nt, Human
aauaacuggaaaacagaaca

SEQ ID NO: 1308729 - RNA, 13 nt, Human
aauaagaaacuuu

SEQ ID NO: 1308730 - RNA, 22 nt, Human
aauaagaaacaacucuuugaga

SEQ ID NO: 1308731 - RNA, 13 nt, Human
aauaagaauagaa

SEQ ID NO: 1308732 - RNA, 18 nt, Human
aauaagaauagaaauaaa

SEQ ID NO: 1308733 - RNA, 17 nt, Human
aauaauucugaguuuug

SEQ ID NO: 1308734 - RNA, 19 nt, Human
aauaauucugaguuuugug

SEQ ID NO: 1308735 - RNA, 22 nt, Human
aauaauucugaguuuuguguuu

SEQ ID NO: 1308736 - RNA, 21 nt, Human
aauaauucugaguuuuguguu

SEQ ID NO: 1308737 - RNA, 21 nt, Human
uaaauaaaguuuguugaaaca

SEQ ID NO: 1308738 - RNA, 12 nt, Human
uaaauaaaguuu

SEQ ID NO: 1308739 - RNA, 20 nt, Human
aauaauuuuuauauuugaaa

SEQ ID NO: 1308740 - RNA, 22 nt, Human
aauaauuuuucacuucaaaaca

SEQ ID NO: 1308741 - RNA, 12 nt, Human
aauacaaaugga

SEQ ID NO: 1308742 - RNA, 13 nt, Human
aauacaaauggau

SEQ ID NO: 1308743 - RNA, 18 nt, Human
aauacaaauggauuuugg

SEQ ID NO: 1308744 - RNA, 22 nt, Human
aauacaagacugccauauuaaa

SEQ ID NO: 1308745 - RNA, 17 nt, Human
uaaauaaggaaaagcuu

SEQ ID NO: 1308746 - RNA, 18 nt, Human
uaaauaagauucuaacgg

SEQ ID NO: 1308747 - RNA, 14 nt, Human
uaaauaauacauua

SEQ ID NO: 1308748 - RNA, 13 nt, Human
uaaauaaugcuuu

SEQ ID NO: 1308749 - RNA, 16 nt, Human
uaaauaaugcuuugaa

SEQ ID NO: 1308750 - RNA, 21 nt, Human
uaaauaagaaacaacucuuug

SEQ ID NO: 1308751 - RNA, 22 nt, Human
uaaauaagaaacaacucuuuga

SEQ ID NO: 1308752 - RNA, 11 nt, Human
uaaauaagaaa

SEQ ID NO: 1308753 - RNA, 13 nt, Human
uaaauaagaaacu

SEQ ID NO: 1308754 - RNA, 16 nt, Human
uaaauaagaaacuuuu

SEQ ID NO: 1308755 - RNA, 15 nt, Human
uaaauaagaaacuuu

SEQ ID NO: 1308756 - RNA, 13 nt, Human
uaaauaagauucu

SEQ ID NO: 1308757 - RNA, 14 nt, Human
uaaauaagauucua

SEQ ID NO: 1308758 - RNA, 15 nt, Human
uaaauaagauucuaa

SEQ ID NO: 1308759 - RNA, 13 nt, Human
uaaauacaggaaa

SEQ ID NO: 1308760 - RNA, 14 nt, Human
uaaauacaggaaac

SEQ ID NO: 1308761 - RNA, 15 nt, Human
uaaauacaggaaaca

SEQ ID NO: 1308762 - RNA, 16 nt, Human
uaaauacaggaaacag

SEQ ID NO: 1308763 - RNA, 17 nt, Human
uaaauacaggaaacagu

SEQ ID NO: 1308764 - RNA, 18 nt, Human
uaaauacaggaaacaguu

SEQ ID NO: 1308765 - RNA, 13 nt, Human
uaaauacagucuu

SEQ ID NO: 1308766 - RNA, 17 nt, Human
uaaauacagucuuccau

SEQ ID NO: 1308767 - RNA, 20 nt, Human
uaaauacagucuuccauuug

SEQ ID NO: 1308768 - RNA, 22 nt, Human
uaaauacagucuuccauuugca

SEQ ID NO: 1308769 - RNA, 23 nt, Human
uaaauacagucuuccauuugcaa

SEQ ID NO: 1308770 - RNA, 24 nt, Human
uaaauguuuuuuuuuaaagacuuu

SEQ ID NO: 1308771 - RNA, 13 nt, Human
uaaauguuauuau

SEQ ID NO: 1308772 - RNA, 15 nt, Human
uaaauguugacaugg

SEQ ID NO: 1308773 - RNA, 23 nt, Human
uaaauguuaugacuauguaaacu

SEQ ID NO: 1308774 - RNA, 22 nt, Human
uaaauguuaugacuauguaaac

SEQ ID NO: 1308775 - RNA, 14 nt, Human
uaaaucuuuuacaa

SEQ ID NO: 1308776 - RNA, 13 nt, Human
uaaaucuuuuaua

SEQ ID NO: 1308777 - RNA, 16 nt, Human
uaaaugcauaaaugca

SEQ ID NO: 1308778 - RNA, 14 nt, Human
uaaaugcauuauag

SEQ ID NO: 1308779 - RNA, 12 nt, Human
uaaaucugccac

SEQ ID NO: 1308780 - RNA, 15 nt, Human
uaaaucugacccagu

SEQ ID NO: 1308781 - RNA, 16 nt, Human
uaaaucugacccagug

SEQ ID NO: 1308782 - RNA, 17 nt, Human
uaaaucugacccagugc

SEQ ID NO: 1308783 - RNA, 20 nt, Human
uaaaucugcuggaguuucau

SEQ ID NO: 1308784 - RNA, 14 nt, Human
uaaaucugacccag

SEQ ID NO: 1308785 - RNA, 15 nt, Human
uaaauagacacgcac

SEQ ID NO: 1308786 - RNA, 17 nt, Human
uaaauagaccauuaauc

SEQ ID NO: 1308787 - RNA, 18 nt, Human
uaaauagaauguaaaugu

SEQ ID NO: 1308788 - RNA, 16 nt, Human
uaaauagaauguaaau

SEQ ID NO: 1308789 - RNA, 13 nt, Human
uaaauagaaugua

SEQ ID NO: 1308790 - RNA, 17 nt, Human
uaaauacugcaaaucag

SEQ ID NO: 1308791 - RNA, 20 nt, Human
uaaauacugagaaaaccugu

SEQ ID NO: 1308792 - RNA, 13 nt, Human
uaaauacugcaaa

SEQ ID NO: 1308793 - RNA, 16 nt, Human
uaaauacugcaaauca

SEQ ID NO: 1308794 - RNA, 22 nt, Human
uaaauacugcaaaucaggcuuu

SEQ ID NO: 1308795 - RNA, 20 nt, Human
uaaauagaauguaaaugucu

SEQ ID NO: 1308796 - RNA, 22 nt, Human
uaaaguaaaaacaaagaaauua

SEQ ID NO: 1308797 - RNA, 21 nt, Human
uaaaguaaaaacaaagaaauu

SEQ ID NO: 1308798 - RNA, 19 nt, Human
uaaaguaaaaacaaagaaa

SEQ ID NO: 1308799 - RNA, 22 nt, Human
uaaagguucaugcaaacuuuau

SEQ ID NO: 1308800 - RNA, 15 nt, Human
uaaaguacuuguagu

SEQ ID NO: 1308801 - RNA, 16 nt, Human
uaaaguacuuguaguu

SEQ ID NO: 1308802 - RNA, 17 nt, Human
uaaaguaguccugugaa

SEQ ID NO: 1308803 - RNA, 20 nt, Human
uaaaguaucaggauacuaua

SEQ ID NO: 1308804 - RNA, 17 nt, Human
guuuucuuuugccauga

SEQ ID NO: 1308805 - RNA, 18 nt, Human
guuuugaagcuacugugu

SEQ ID NO: 1308806 - RNA, 19 nt, Human
guuuugaagcuacugugug

SEQ ID NO: 1308807 - RNA, 15 nt, Human
guuuugaaggcaaaa

SEQ ID NO: 1308808 - RNA, 22 nt, Human
uaaaggggagaccucagaagua

SEQ ID NO: 1308809 - RNA, 19 nt, Human
uaaagguccacaggucuag

SEQ ID NO: 1308810 - RNA, 20 nt, Human
uaaagguccacaggucuaga

SEQ ID NO: 1308811 - RNA, 21 nt, Human
uaaagguccacaggucuagac

SEQ ID NO: 1308812 - RNA, 22 nt, Human
uaaagguccacaggucuagacu

SEQ ID NO: 1308813 - RNA, 21 nt, Human
uaaaggugacaucggaaaaau

SEQ ID NO: 1308814 - RNA, 22 nt, Human
uaaaggugacaucggaaaaaua

SEQ ID NO: 1308815 - RNA, 13 nt, Human
uaaagguuaaaaa

SEQ ID NO: 1308816 - RNA, 22 nt, Human
uaaagguuacaagccugcacaa

SEQ ID NO: 1308817 - RNA, 13 nt, Human
uaaagucagaugg

SEQ ID NO: 1308818 - RNA, 19 nt, Human
uaaaguauguauuauuuac

SEQ ID NO: 1308819 - RNA, 21 nt, Human
uaaaguauguauuauuuacau

SEQ ID NO: 1308820 - RNA, 13 nt, Human
uaaaguauucuuc

SEQ ID NO: 1308821 - RNA, 14 nt, Human
uaaaguauucuucu

SEQ ID NO: 1308822 - RNA, 18 nt, Human
uaaaguauucuucucuuc

SEQ ID NO: 1308823 - RNA, 13 nt, Human
aauaaaaccagcu

SEQ ID NO: 1308824 - RNA, 17 nt, Human
aauaaaaagaucacuuu

SEQ ID NO: 1308825 - RNA, 19 nt, Human
aauaaaaagaucacuuucu

SEQ ID NO: 1308826 - RNA, 23 nt, Human
aauaaaaagaucacuuucucagu

SEQ ID NO: 1308827 - RNA, 13 nt, Human
aauaaaaagcuuu

SEQ ID NO: 1308828 - RNA, 18 nt, Human
aauaaaaagcuuuugucu

SEQ ID NO: 1308829 - RNA, 16 nt, Human
aauaaaaagcuuuugu

SEQ ID NO: 1308830 - RNA, 21 nt, Human
aauaacaaugaaaguugauaa

SEQ ID NO: 1308831 - RNA, 18 nt, Human
aauaaauuguacagccgg

SEQ ID NO: 1308832 - RNA, 16 nt, Human
aauaaauugcuccuug

SEQ ID NO: 1308833 - RNA, 20 nt, Human
aauaaauugcuccuugacau

SEQ ID NO: 1308834 - RNA, 12 nt, Human
aauaaaugucuu

SEQ ID NO: 1308835 - RNA, 14 nt, Human
aauaaaugucuugc

SEQ ID NO: 1308836 - RNA, 22 nt, Human
aauaaauugauuuuuauaaaua

SEQ ID NO: 1308837 - RNA, 11 nt, Human
aauaaauguca

SEQ ID NO: 1308838 - RNA, 21 nt, Human
aauaaaugucaccagguacuu

SEQ ID NO: 1308839 - RNA, 13 nt, Human
aauaaaugucacu

SEQ ID NO: 1308840 - RNA, 14 nt, Human
aauaaaugucacuu

SEQ ID NO: 1308841 - RNA, 19 nt, Human
aauaaaugucacuuuuuga

SEQ ID NO: 1308842 - RNA, 15 nt, Human
aauaaaugucacuuu

SEQ ID NO: 1308843 - RNA, 15 nt, Human
aauaacgauaaaaga

SEQ ID NO: 1308844 - RNA, 18 nt, Human
aauaacuggaaaacagaa

SEQ ID NO: 1308845 - RNA, 21 nt, Human
aauaacuggaaaacagaacac

SEQ ID NO: 1308846 - RNA, 20 nt, Human
aauaaauuuauuuucuugga

SEQ ID NO: 1308847 - RNA, 13 nt, Human
aauaaauuugacu

SEQ ID NO: 1308848 - RNA, 20 nt, Human
aauaaauuugacuuuucugu

SEQ ID NO: 1308849 - RNA, 13 nt, Human
aauaacaaugugc

SEQ ID NO: 1308850 - RNA, 19 nt, Human
aauaacaaugugcucucgg

SEQ ID NO: 1308851 - RNA, 21 nt, Human
aauaaauuugacuuuucugua

SEQ ID NO: 1308852 - RNA, 12 nt, Human
aauaaagugacc

SEQ ID NO: 1308853 - RNA, 17 nt, Human
aauaaagucagauggaa

SEQ ID NO: 1308854 - RNA, 12 nt, Human
aauaaaguguau

SEQ ID NO: 1308855 - RNA, 15 nt, Human
aauaaaguguaacaa

SEQ ID NO: 1308856 - RNA, 18 nt, Human
aauaaaguguaacaauug

SEQ ID NO: 1308857 - RNA, 15 nt, Human
aauaaaucugaccca

SEQ ID NO: 1308858 - RNA, 16 nt, Human
aauaaaucugacccag

SEQ ID NO: 1308859 - RNA, 17 nt, Human
aauaaaucugacccagu

SEQ ID NO: 1308860 - RNA, 20 nt, Human
aauaaaucugacccagugcc

SEQ ID NO: 1308861 - RNA, 14 nt, Human
aauaaaucuuccua

SEQ ID NO: 1308862 - RNA, 20 nt, Human
aauaaaacccguugauuacu

SEQ ID NO: 1308863 - RNA, 13 nt, Human
aauaaaagaaaau

SEQ ID NO: 1308864 - RNA, 16 nt, Human
aauaaaagaaaauuac

SEQ ID NO: 1308865 - RNA, 13 nt, Human
acacccagcaaua

SEQ ID NO: 1308866 - RNA, 23 nt, Human
acacccagcaauagagacgggac

SEQ ID NO: 1308867 - RNA, 17 nt, Human
acaccccgacuuuuguu

SEQ ID NO: 1308868 - RNA, 16 nt, Human
acacccauuuuuccuu

SEQ ID NO: 1308869 - RNA, 11 nt, Human
acaccuccuuc

SEQ ID NO: 1308870 - RNA, 18 nt, Human
acaccuccuucccucucu

SEQ ID NO: 1308871 - RNA, 22 nt, Human
acaccuccuucccucucuggag

SEQ ID NO: 1308872 - RNA, 13 nt, Human
acaccucccagga

SEQ ID NO: 1308873 - RNA, 19 nt, Human
acaccucccaggagacagu

SEQ ID NO: 1308874 - RNA, 23 nt, Human
acaccugcccugcccugccaccu

SEQ ID NO: 1308875 - RNA, 22 nt, Human
acaccugcccugcccugccacc

SEQ ID NO: 1308876 - RNA, 20 nt, Human
acaccugcccugcccugcca

SEQ ID NO: 1308877 - RNA, 18 nt, Human
acaccugcccugcccugc

SEQ ID NO: 1308878 - RNA, 17 nt, Human
acaccugcccugcccug

SEQ ID NO: 1308879 - RNA, 15 nt, Human
acaccugcccugccc

SEQ ID NO: 1308880 - RNA, 12 nt, Human
acaccugcccug

SEQ ID NO: 1308881 - RNA, 14 nt, Human
acaccugcccugcc

SEQ ID NO: 1308882 - RNA, 13 nt, Human
acaccugcccugc

SEQ ID NO: 1308883 - RNA, 19 nt, Human
acaccuccuucccucucug

SEQ ID NO: 1308884 - RNA, 18 nt, Human
acacuaagagagaaugag

SEQ ID NO: 1308885 - RNA, 19 nt, Human
acacuaagagagaaugaga

SEQ ID NO: 1308886 - RNA, 15 nt, Human
acacuacacccagca

SEQ ID NO: 1308887 - RNA, 14 nt, Human
acacuacacccagc

SEQ ID NO: 1308888 - RNA, 13 nt, Human
acacuacacccag

SEQ ID NO: 1308889 - RNA, 20 nt, Human
acaccuuggacauccuccuc

SEQ ID NO: 1308890 - RNA, 17 nt, Human
acacuacacacugugua

SEQ ID NO: 1308891 - RNA, 17 nt, Human
acacuaagagagaauga

SEQ ID NO: 1308892 - RNA, 17 nt, Human
acacuacacccagcaau

SEQ ID NO: 1308893 - RNA, 16 nt, Human
acacuaccgaaugugu

SEQ ID NO: 1308894 - RNA, 23 nt, Human
acacuacacccagcaauagagac

SEQ ID NO: 1308895 - RNA, 18 nt, Human
acacuaccgaaugugucu

SEQ ID NO: 1308896 - RNA, 19 nt, Human
acacuaccgaaugugucuu

SEQ ID NO: 1308897 - RNA, 20 nt, Human
acacuaccgaaugugucuuu

SEQ ID NO: 1308898 - RNA, 21 nt, Human
acacuaccgaaugugucuuua

SEQ ID NO: 1308899 - RNA, 16 nt, Human
acacuagacaagccag

SEQ ID NO: 1308900 - RNA, 23 nt, Human
acacuaccgaaugugucuuuaga

SEQ ID NO: 1308901 - RNA, 17 nt, Human
acacuagcccaaugaaa

SEQ ID NO: 1308902 - RNA, 20 nt, Human
acacuagcccaaugaaauga

SEQ ID NO: 1308903 - RNA, 23 nt, Human
acacuagccuuggccucuuuccu

SEQ ID NO: 1308904 - RNA, 19 nt, Human
uauaacuauguugauaaaa

SEQ ID NO: 1308905 - RNA, 14 nt, Human
uauaagcuuuucuu

SEQ ID NO: 1308906 - RNA, 15 nt, Human
uauaaccuuaauuua

SEQ ID NO: 1308907 - RNA, 20 nt, Human
uauaaccuuaauuuauuauu

SEQ ID NO: 1308908 - RNA, 14 nt, Human
uauaacguguucaa

SEQ ID NO: 1308909 - RNA, 19 nt, Human
uauaacguguucaauauuu

SEQ ID NO: 1308910 - RNA, 14 nt, Human
uauaacuaacaugu

SEQ ID NO: 1308911 - RNA, 20 nt, Human
uauaacguguucaauauuuu

SEQ ID NO: 1308912 - RNA, 23 nt, Human
acacaugcuucccuuuccugagu

SEQ ID NO: 1308913 - RNA, 21 nt, Human
acacaugcuucccuuuccuga

SEQ ID NO: 1308914 - RNA, 19 nt, Human
acacaugcuucccuuuccu

SEQ ID NO: 1308915 - RNA, 15 nt, Human
acacauuaagcaaau

SEQ ID NO: 1308916 - RNA, 16 nt, Human
acacauuaggaaaagu

SEQ ID NO: 1308917 - RNA, 15 nt, Human
acacauguauuuggu

SEQ ID NO: 1308918 - RNA, 21 nt, Human
acacauugcugugaacaggaa

SEQ ID NO: 1308919 - RNA, 22 nt, Human
acacauugaguuggaaucacug

SEQ ID NO: 1308920 - RNA, 15 nt, Human
acacauuucaaauga

SEQ ID NO: 1308921 - RNA, 14 nt, Human
acacauuugcuuuu

SEQ ID NO: 1308922 - RNA, 17 nt, Human
acacauuugcuuuuugu

SEQ ID NO: 1308923 - RNA, 15 nt, Human
acacccacacucaga

SEQ ID NO: 1308924 - RNA, 21 nt, Human
uauaaaaauaaaaaacacugg

SEQ ID NO: 1308925 - RNA, 21 nt, Human
uaguuuuuucaucuucaguug

SEQ ID NO: 1308926 - RNA, 13 nt, Human
uaguuuuuucauc

SEQ ID NO: 1308927 - RNA, 14 nt, Human
uaguuuuuucaucu

SEQ ID NO: 1308928 - RNA, 15 nt, Human
uaguuuuuucaucuu

SEQ ID NO: 1308929 - RNA, 17 nt, Human
uaguuuuuucaucuuca

SEQ ID NO: 1308930 - RNA, 22 nt, Human
uauaaaaauaaaaaagauccca

SEQ ID NO: 1308931 - RNA, 19 nt, Human
uauaaaaauaaaaaagauc

SEQ ID NO: 1308932 - RNA, 15 nt, Human
uauaaaacuuuccuc

SEQ ID NO: 1308933 - RNA, 12 nt, Human
uauaaaauacag

SEQ ID NO: 1308934 - RNA, 12 nt, Human
uauaaaauagac

SEQ ID NO: 1308935 - RNA, 19 nt, Human
uauaaaauagacaaauaga

SEQ ID NO: 1308936 - RNA, 21 nt, Human
uauaaaauaugaagacauaaa

SEQ ID NO: 1308937 - RNA, 23 nt, Human
uauaaaauaugaagacauaaacc

SEQ ID NO: 1308938 - RNA, 17 nt, Human
uaguuauucacaaaaau

SEQ ID NO: 1308939 - RNA, 23 nt, Human
uaguuaucauguuaguaauaccu

SEQ ID NO: 1308940 - RNA, 16 nt, Human
uaguuaucauguuagu

SEQ ID NO: 1308941 - RNA, 15 nt, Human
uaguuaucauguuag

SEQ ID NO: 1308942 - RNA, 14 nt, Human
uaguuaucauguua

SEQ ID NO: 1308943 - RNA, 13 nt, Human
uaguuaucauguu

SEQ ID NO: 1308944 - RNA, 12 nt, Human
uaguuaucaugu

SEQ ID NO: 1308945 - RNA, 11 nt, Human
uaguuaucaug

SEQ ID NO: 1308946 - RNA, 17 nt, Human
uagucuuuugcuuuugc

SEQ ID NO: 1308947 - RNA, 18 nt, Human
uaguuuugucacaauuau

SEQ ID NO: 1308948 - RNA, 15 nt, Human
uaguuuuuauauguu

SEQ ID NO: 1308949 - RNA, 14 nt, Human
uaguuuuucauuaa

SEQ ID NO: 1308950 - RNA, 21 nt, Human
uaguuuuucauuaaauaaauu

SEQ ID NO: 1308951 - RNA, 16 nt, Human
uaguucagaauuuagu

SEQ ID NO: 1308952 - RNA, 23 nt, Human
uaguucagaauuuaguguaucca

SEQ ID NO: 1308953 - RNA, 22 nt, Human
uaguuuugauuuaauguuuuca

SEQ ID NO: 1308954 - RNA, 22 nt, Human
uaguucagcauccgcaggugcu

SEQ ID NO: 1308955 - RNA, 22 nt, Human
uagguuuggacaaaauggaaua

SEQ ID NO: 1308956 - RNA, 21 nt, Human
uagguuuaugacaguaauugu

SEQ ID NO: 1308957 - RNA, 11 nt, Human
uagguuucaaa

SEQ ID NO: 1308958 - RNA, 14 nt, Human
uagguuucaaagau

SEQ ID NO: 1308959 - RNA, 15 nt, Human
uaguaauaccucuaa

SEQ ID NO: 1308960 - RNA, 13 nt, Human
uaguaauaccucu

SEQ ID NO: 1308961 - RNA, 12 nt, Human
uaguaauaccuc

SEQ ID NO: 1308962 - RNA, 17 nt, Human
acacagugaccauacua

SEQ ID NO: 1308963 - RNA, 20 nt, Human
uagguuuaugacaguaauug

SEQ ID NO: 1308964 - RNA, 19 nt, Human
uagguuuaugacaguaauu

SEQ ID NO: 1308965 - RNA, 17 nt, Human
uagguuuaugacaguaa

SEQ ID NO: 1308966 - RNA, 14 nt, Human
acacacugaagaag

SEQ ID NO: 1308967 - RNA, 11 nt, Human
acacagcugcc

SEQ ID NO: 1308968 - RNA, 12 nt, Human
acacagcugccg

SEQ ID NO: 1308969 - RNA, 12 nt, Human
acacaguauuuu

SEQ ID NO: 1308970 - RNA, 15 nt, Human
uagucuuuggagaaa

SEQ ID NO: 1308971 - RNA, 12 nt, Human
uagucuuuugcu

SEQ ID NO: 1308972 - RNA, 13 nt, Human
uagucuuuugcuu

SEQ ID NO: 1308973 - RNA, 14 nt, Human
uagucuuuugcuuu

SEQ ID NO: 1308974 - RNA, 19 nt, Human
uagucucacugcuugaacu

SEQ ID NO: 1308975 - RNA, 15 nt, Human
uagucucagugaaga

SEQ ID NO: 1308976 - RNA, 17 nt, Human
uagucucagugaagacu

SEQ ID NO: 1308977 - RNA, 18 nt, Human
uagucucagugaagacua

SEQ ID NO: 1308978 - RNA, 12 nt, Human
uaguguuggaga

SEQ ID NO: 1308979 - RNA, 15 nt, Human
uagucuuuugcuuuu

SEQ ID NO: 1308980 - RNA, 16 nt, Human
uagucuuuugcuuuug

SEQ ID NO: 1308981 - RNA, 21 nt, Human
uagucuuuugcuuuuggcaaa

SEQ ID NO: 1308982 - RNA, 16 nt, Human
uaguguuggagaagaa

SEQ ID NO: 1308983 - RNA, 17 nt, Human
uaguguuggagaagaac

SEQ ID NO: 1308984 - RNA, 14 nt, Human
uaguagagacaggg

SEQ ID NO: 1308985 - RNA, 11 nt, Human
uaguccuguga

SEQ ID NO: 1308986 - RNA, 22 nt, Human
uaguccugugaaugccacugcc

SEQ ID NO: 1308987 - RNA, 12 nt, Human
uaguccugugaa

SEQ ID NO: 1308988 - RNA, 14 nt, Human
uaguaauagccugg

SEQ ID NO: 1308989 - RNA, 13 nt, Human
acacacugaagaa

SEQ ID NO: 1308990 - RNA, 11 nt, Human
acacaccugua

SEQ ID NO: 1308991 - RNA, 20 nt, Human
acacaccuguagcacuuacu

SEQ ID NO: 1308992 - RNA, 23 nt, Human
acacacauugcugugaacaggaa

SEQ ID NO: 1308993 - RNA, 14 nt, Human
acacaccaggcgcu

SEQ ID NO: 1308994 - RNA, 17 nt, Human
acacaccaggcgcuaau

SEQ ID NO: 1308995 - RNA, 12 nt, Human
acacacaguacg

SEQ ID NO: 1308996 - RNA, 17 nt, Human
acacaacuauauuguuu

SEQ ID NO: 1308997 - RNA, 12 nt, Human
acaauguaauua

SEQ ID NO: 1308998 - RNA, 13 nt, Human
acaauguaauuau

SEQ ID NO: 1308999 - RNA, 15 nt, Human
acaauguaauuauuu

SEQ ID NO: 1309000 - RNA, 18 nt, Human
acaauguaauuauuuaug

SEQ ID NO: 1309001 - RNA, 17 nt, Human
acaauguagauaagugu

SEQ ID NO: 1309002 - RNA, 20 nt, Human
acaauguagauaaguguucu

SEQ ID NO: 1309003 - RNA, 21 nt, Human
acaauguagauaaguguucug

SEQ ID NO: 1309004 - RNA, 13 nt, Human
acacaacucacuc

SEQ ID NO: 1309005 - RNA, 22 nt, Human
acacaagaagaagggcacccua

SEQ ID NO: 1309006 - RNA, 16 nt, Human
acacaagauugguguu

SEQ ID NO: 1309007 - RNA, 17 nt, Human
acacaagauugguguuu

SEQ ID NO: 1309008 - RNA, 18 nt, Human
acacaagauugguguuuu

SEQ ID NO: 1309009 - RNA, 19 nt, Human
acacaagauugguguuuuu

SEQ ID NO: 1309010 - RNA, 20 nt, Human
acacaagauugguguuuuuu

SEQ ID NO: 1309011 - RNA, 21 nt, Human
acacaagauugguguuuuuuu

SEQ ID NO: 1309012 - RNA, 14 nt, Human
acaaugcuguauuu

SEQ ID NO: 1309013 - RNA, 17 nt, Human
acaaugcuguauuuuaa

SEQ ID NO: 1309014 - RNA, 18 nt, Human
acaaugcuguauuuuaaa

SEQ ID NO: 1309015 - RNA, 14 nt, Human
uagcuuauguuaac

SEQ ID NO: 1309016 - RNA, 22 nt, Human
uagcuuaucuacuuccaaacua

SEQ ID NO: 1309017 - RNA, 12 nt, Human
uagcuuaugaaa

SEQ ID NO: 1309018 - RNA, 15 nt, Human
uagcuuaucuacuuc

SEQ ID NO: 1309019 - RNA, 19 nt, Human
uagcuuaucuacuuccaaa

SEQ ID NO: 1309020 - RNA, 16 nt, Human
uagcuuaugaaaagaa

SEQ ID NO: 1309021 - RNA, 21 nt, Human
uagcucaaugagcauguuuag

SEQ ID NO: 1309022 - RNA, 12 nt, Human
acacugaagaag

SEQ ID NO: 1309023 - RNA, 14 nt, Human
acacugaagaagca

SEQ ID NO: 1309024 - RNA, 12 nt, Human
acacucugcugu

SEQ ID NO: 1309025 - RNA, 17 nt, Human
acacucugcuguuugac

SEQ ID NO: 1309026 - RNA, 13 nt, Human
acacucuguaauu

SEQ ID NO: 1309027 - RNA, 16 nt, Human
acacucugcuguuuga

SEQ ID NO: 1309028 - RNA, 12 nt, Human
acacucuuugua

SEQ ID NO: 1309029 - RNA, 16 nt, Human
acacucuuuguaagag

SEQ ID NO: 1309030 - RNA, 23 nt, Human
acacugaaaaaucuaagugauau

SEQ ID NO: 1309031 - RNA, 21 nt, Human
acacucuuuugcuuuauucca

SEQ ID NO: 1309032 - RNA, 12 nt, Human
acacuguucuua

SEQ ID NO: 1309033 - RNA, 15 nt, Human
acacuguucuuagcu

SEQ ID NO: 1309034 - RNA, 18 nt, Human
acacuguucuuagcucaa

SEQ ID NO: 1309035 - RNA, 21 nt, Human
acacuguucuuagcucaauga

SEQ ID NO: 1309036 - RNA, 22 nt, Human
acacuguucuuagcucaaugag

SEQ ID NO: 1309037 - RNA, 20 nt, Human
acacucucaaagcaaauaau

SEQ ID NO: 1309038 - RNA, 17 nt, Human
acacucguaugauacuu

SEQ ID NO: 1309039 - RNA, 14 nt, Human
acacuccagugaga

SEQ ID NO: 1309040 - RNA, 22 nt, Human
acacucaguggcccauggcauu

SEQ ID NO: 1309041 - RNA, 22 nt, Human
uauaagggcaaauuggagaaaa

SEQ ID NO: 1309042 - RNA, 16 nt, Human
uauaaggugcucucuu

SEQ ID NO: 1309043 - RNA, 22 nt, Human
uauaaggugcucucuuucuguc

SEQ ID NO: 1309044 - RNA, 21 nt, Human
uauaaggugcucucuuucugu

SEQ ID NO: 1309045 - RNA, 24 nt, Human
uauaagggaaguaguuaucauguu

SEQ ID NO: 1309046 - RNA, 21 nt, Human
uauaagggaaguaguuaucau

SEQ ID NO: 1309047 - RNA, 16 nt, Human
uauaaguagcaggcca

SEQ ID NO: 1309048 - RNA, 13 nt, Human
acacucagaagcc

SEQ ID NO: 1309049 - RNA, 14 nt, Human
acacucagaagccu

SEQ ID NO: 1309050 - RNA, 15 nt, Human
acacucagaagccug

SEQ ID NO: 1309051 - RNA, 16 nt, Human
acacucagaagccugg

SEQ ID NO: 1309052 - RNA, 17 nt, Human
acacucagaagccuggg

SEQ ID NO: 1309053 - RNA, 19 nt, Human
acacucagaagccuggggg

SEQ ID NO: 1309054 - RNA, 14 nt, Human
acacucagaccuga

SEQ ID NO: 1309055 - RNA, 19 nt, Human
acacucagaccugaauucu

SEQ ID NO: 1309056 - RNA, 20 nt, Human
acacucagaagccugggggc

SEQ ID NO: 1309057 - RNA, 19 nt, Human
acacucagauccuccucau

SEQ ID NO: 1309058 - RNA, 13 nt, Human
acacucagcacaa

SEQ ID NO: 1309059 - RNA, 16 nt, Human
acacucagcacaaggc

SEQ ID NO: 1309060 - RNA, 23 nt, Human
acacucaguggcccauggcauuu

SEQ ID NO: 1309061 - RNA, 12 nt, Human
uauauuuacaaa

SEQ ID NO: 1309062 - RNA, 17 nt, Human
uauauuuaaaaauaagu

SEQ ID NO: 1309063 - RNA, 18 nt, Human
uauauuuaaaagugucaa

SEQ ID NO: 1309064 - RNA, 15 nt, Human
uauauuuaaaaauaa

SEQ ID NO: 1309065 - RNA, 15 nt, Human
uauauuuaacaagau

SEQ ID NO: 1309066 - RNA, 19 nt, Human
uauauuuaacucucuuuau

SEQ ID NO: 1309067 - RNA, 13 nt, Human
uauauuaucuuuu

SEQ ID NO: 1309068 - RNA, 12 nt, Human
uauauuauuacu

SEQ ID NO: 1309069 - RNA, 16 nt, Human
uauauuauuacuugua

SEQ ID NO: 1309070 - RNA, 19 nt, Human
uauauuauuacuuguaaau

SEQ ID NO: 1309071 - RNA, 20 nt, Human
uauauuauuacuuguaaaua

SEQ ID NO: 1309072 - RNA, 12 nt, Human
uauauuauuaua

SEQ ID NO: 1309073 - RNA, 22 nt, Human
uauauucaggacuugaaagaaa

SEQ ID NO: 1309074 - RNA, 19 nt, Human
acagaaagcagaacaguga

SEQ ID NO: 1309075 - RNA, 23 nt, Human
acacuguucuuagcucaaugagc

SEQ ID NO: 1309076 - RNA, 15 nt, Human
acacuuaaaaauggu

SEQ ID NO: 1309077 - RNA, 13 nt, Human
acacuuaaaaaug

SEQ ID NO: 1309078 - RNA, 17 nt, Human
acacuuguccacauagg

SEQ ID NO: 1309079 - RNA, 20 nt, Human
acacuuguugauuaauggaa

SEQ ID NO: 1309080 - RNA, 23 nt, Human
acacuuguugauuaauggaaaug

SEQ ID NO: 1309081 - RNA, 22 nt, Human
acacuuuaauuaccaaccuguu

SEQ ID NO: 1309082 - RNA, 17 nt, Human
acacuuugcacugauau

SEQ ID NO: 1309083 - RNA, 19 nt, Human
acacuuugcacugauauau

SEQ ID NO: 1309084 - RNA, 22 nt, Human
acacuuugcacugauauaucau

SEQ ID NO: 1309085 - RNA, 19 nt, Human
acacuuugccauauuuuca

SEQ ID NO: 1309086 - RNA, 16 nt, Human
acacuuugguaccaga

SEQ ID NO: 1309087 - RNA, 12 nt, Human
acagaaacaaaa

SEQ ID NO: 1309088 - RNA, 17 nt, Human
acagaaacaaaaacacu

SEQ ID NO: 1309089 - RNA, 15 nt, Human
acagaaaccuuuuua

SEQ ID NO: 1309090 - RNA, 20 nt, Human
acagaaaccuuuuuaaaaau

SEQ ID NO: 1309091 - RNA, 23 nt, Human
acagaaacuaaacucuuaccaua

SEQ ID NO: 1309092 - RNA, 20 nt, Human
acagcccuucuuuccacaga

SEQ ID NO: 1309093 - RNA, 21 nt, Human
acagcccuucuuuccacagaa

SEQ ID NO: 1309094 - RNA, 14 nt, Human
acagcaaccccagg

SEQ ID NO: 1309095 - RNA, 17 nt, Human
acagcaacaauuuauga

SEQ ID NO: 1309096 - RNA, 20 nt, Human
acagcaacaauuuaugaauu

SEQ ID NO: 1309097 - RNA, 20 nt, Human
uaugaaagauggcugugccu

SEQ ID NO: 1309098 - RNA, 22 nt, Human
uaugaaagauggcugugccucu

SEQ ID NO: 1309099 - RNA, 23 nt, Human
uaugaaagauggcugugccucug

SEQ ID NO: 1309100 - RNA, 24 nt, Human
uaucuuuaaacgaaacaaagacaa

SEQ ID NO: 1309101 - RNA, 15 nt, Human
acagcccuuuugucu

SEQ ID NO: 1309102 - RNA, 16 nt, Human
acagcccuuuugucuc

SEQ ID NO: 1309103 - RNA, 23 nt, Human
uaucuuggugaauuuuuuuuucc

SEQ ID NO: 1309104 - RNA, 22 nt, Human
acagauggcacuuugaaggggc

SEQ ID NO: 1309105 - RNA, 16 nt, Human
acagaugggcaaauua

SEQ ID NO: 1309106 - RNA, 13 nt, Human
acagaugccuccu

SEQ ID NO: 1309107 - RNA, 17 nt, Human
acagaugccuccuuccu

SEQ ID NO: 1309108 - RNA, 18 nt, Human
acagaugccuccuuccuc

SEQ ID NO: 1309109 - RNA, 22 nt, Human
acagaugccuccuuccucuuuu

SEQ ID NO: 1309110 - RNA, 21 nt, Human
acagauguccaucagaugaca

SEQ ID NO: 1309111 - RNA, 22 nt, Human
acagauguccaucagaugacaa

SEQ ID NO: 1309112 - RNA, 16 nt, Human
acagauguccaucaga

SEQ ID NO: 1309113 - RNA, 14 nt, Human
acagauguccauca

SEQ ID NO: 1309114 - RNA, 14 nt, Human
acagauggccagcc

SEQ ID NO: 1309115 - RNA, 22 nt, Human
acagcaaacaggugcuaauuug

SEQ ID NO: 1309116 - RNA, 15 nt, Human
acagcaaacaggugc

SEQ ID NO: 1309117 - RNA, 16 nt, Human
acagcaaaugcaaaaa

SEQ ID NO: 1309118 - RNA, 23 nt, Human
acagagcuggagaugaggccaga

SEQ ID NO: 1309119 - RNA, 20 nt, Human
acagagccaggagaagcuca

SEQ ID NO: 1309120 - RNA, 14 nt, Human
acagagcuucccug

SEQ ID NO: 1309121 - RNA, 15 nt, Human
acagagcuucccuga

SEQ ID NO: 1309122 - RNA, 16 nt, Human
acagagcuucccugac

SEQ ID NO: 1309123 - RNA, 16 nt, Human
acagagauucugaacu

SEQ ID NO: 1309124 - RNA, 16 nt, Human
acagagccaggagaag

SEQ ID NO: 1309125 - RNA, 17 nt, Human
acagagccaggagaagc

SEQ ID NO: 1309126 - RNA, 22 nt, Human
acagagccaggagaagcucagc

SEQ ID NO: 1309127 - RNA, 11 nt, Human
acagagccagg

SEQ ID NO: 1309128 - RNA, 13 nt, Human
acagagccaggag

SEQ ID NO: 1309129 - RNA, 14 nt, Human
acagagccaggaga

SEQ ID NO: 1309130 - RNA, 20 nt, Human
uaucucuacugaaugucauu

SEQ ID NO: 1309131 - RNA, 11 nt, Human
uaucucugugu

SEQ ID NO: 1309132 - RNA, 16 nt, Human
uaucucugugugcaca

SEQ ID NO: 1309133 - RNA, 17 nt, Human
uaucucugugugcacaa

SEQ ID NO: 1309134 - RNA, 18 nt, Human
uaucucugugugcacaaa

SEQ ID NO: 1309135 - RNA, 23 nt, Human
uaucucugugugcacaaauauuu

SEQ ID NO: 1309136 - RNA, 12 nt, Human
uaucucuguguu

SEQ ID NO: 1309137 - RNA, 14 nt, Human
acagagagucugga

SEQ ID NO: 1309138 - RNA, 19 nt, Human
acagagaugcuaagagaaa

SEQ ID NO: 1309139 - RNA, 15 nt, Human
uauauuuauuacugu

SEQ ID NO: 1309140 - RNA, 19 nt, Human
uauauuuauuacuguaaga

SEQ ID NO: 1309141 - RNA, 20 nt, Human
uauauuuauuacuguaagaa

SEQ ID NO: 1309142 - RNA, 16 nt, Human
uaucccggcugcccuu

SEQ ID NO: 1309143 - RNA, 15 nt, Human
uaucccuacauguau

SEQ ID NO: 1309144 - RNA, 15 nt, Human
uaucccucaccugua

SEQ ID NO: 1309145 - RNA, 14 nt, Human
uaucccuccuguug

SEQ ID NO: 1309146 - RNA, 20 nt, Human
uaucccuccuguugggagag

SEQ ID NO: 1309147 - RNA, 19 nt, Human
uaucccuccuguugggaga

SEQ ID NO: 1309148 - RNA, 12 nt, Human
uaucucaaacaa

SEQ ID NO: 1309149 - RNA, 23 nt, Human
uaucucaaacaauugaagucaau

SEQ ID NO: 1309150 - RNA, 12 nt, Human
uaucucacacuc

SEQ ID NO: 1309151 - RNA, 10 nt, Human
uaucucagaa

SEQ ID NO: 1309152 - RNA, 12 nt, Human
uaucucagaaag

SEQ ID NO: 1309153 - RNA, 13 nt, Human
uaucucagaaagu

SEQ ID NO: 1309154 - RNA, 19 nt, Human
uaucucagaaagugccuga

SEQ ID NO: 1309155 - RNA, 20 nt, Human
uaucucagaaagugccugac

SEQ ID NO: 1309156 - RNA, 14 nt, Human
uauccuacuucccc

SEQ ID NO: 1309157 - RNA, 17 nt, Human
uauccuacuuccccuuc

SEQ ID NO: 1309158 - RNA, 16 nt, Human
uauccuaucucuccaa

SEQ ID NO: 1309159 - RNA, 15 nt, Human
uauccuccaccgucu

SEQ ID NO: 1309160 - RNA, 19 nt, Human
uacugaaauaaacgucuua

SEQ ID NO: 1309161 - RNA, 22 nt, Human
uacugaaauaaacgucuuaaau

SEQ ID NO: 1309162 - RNA, 22 nt, Human
uacugacauguggggccagguc

SEQ ID NO: 1309163 - RNA, 17 nt, Human
uacugagagugaacaaa

SEQ ID NO: 1309164 - RNA, 16 nt, Human
uacugacuuugcuugc

SEQ ID NO: 1309165 - RNA, 17 nt, Human
uacugacuuugcuugcu

SEQ ID NO: 1309166 - RNA, 14 nt, Human
uacucuagaugaag

SEQ ID NO: 1309167 - RNA, 20 nt, Human
uacucuauaaccaaaugaaa

SEQ ID NO: 1309168 - RNA, 23 nt, Human
uacucuauaaccaaaugaaauau

SEQ ID NO: 1309169 - RNA, 15 nt, Human
uacucuccccacgag

SEQ ID NO: 1309170 - RNA, 20 nt, Human
uacucuccccacgagggcug

SEQ ID NO: 1309171 - RNA, 22 nt, Human
uacucuccccacgagggcuggc

SEQ ID NO: 1309172 - RNA, 14 nt, Human
uacucuuucuguau

SEQ ID NO: 1309173 - RNA, 15 nt, Human
uacucuuucuguaua

SEQ ID NO: 1309174 - RNA, 16 nt, Human
uacucuuucuguauau

SEQ ID NO: 1309175 - RNA, 14 nt, Human
uacugaaaacuuca

SEQ ID NO: 1309176 - RNA, 19 nt, Human
uacugaaagaguccauugu

SEQ ID NO: 1309177 - RNA, 23 nt, Human
uacugguccaaaagauugcugaa

SEQ ID NO: 1309178 - RNA, 22 nt, Human
uacuggggaaacuggccauggc

SEQ ID NO: 1309179 - RNA, 12 nt, Human
uacuggucucuc

SEQ ID NO: 1309180 - RNA, 13 nt, Human
uacuggucucucu

SEQ ID NO: 1309181 - RNA, 19 nt, Human
uacuggucucucuaugccu

SEQ ID NO: 1309182 - RNA, 18 nt, Human
uacuggucuuguggaauu

SEQ ID NO: 1309183 - RNA, 18 nt, Human
uacugacuuugcuugcuu

SEQ ID NO: 1309184 - RNA, 20 nt, Human
uacugacuuugcuugcuuug

SEQ ID NO: 1309185 - RNA, 17 nt, Human
uacugagaaaaccuguu

SEQ ID NO: 1309186 - RNA, 19 nt, Human
uacugagagugaacaaauu

SEQ ID NO: 1309187 - RNA, 22 nt, Human
uacugacuuugcuugcuuugaa

SEQ ID NO: 1309188 - RNA, 13 nt, Human
uacugggaaggcu

SEQ ID NO: 1309189 - RNA, 17 nt, Human
uacugggaaggcuacuu

SEQ ID NO: 1309190 - RNA, 16 nt, Human
uacuggggaaacuggc

SEQ ID NO: 1309191 - RNA, 19 nt, Human
uacuggggaaacuggccau

SEQ ID NO: 1309192 - RNA, 21 nt, Human
uacuggggaaacuggccaugg

SEQ ID NO: 1309193 - RNA, 24 nt, Human
uacuggggaaacuggccauggccu

SEQ ID NO: 1309194 - RNA, 13 nt, Human
uacugguccaaaa

SEQ ID NO: 1309195 - RNA, 18 nt, Human
uacugguccaaaagauug

SEQ ID NO: 1309196 - RNA, 23 nt, Human
uacuguacagacagaaaaaacug

SEQ ID NO: 1309197 - RNA, 14 nt, Human
uacuguacagcugg

SEQ ID NO: 1309198 - RNA, 19 nt, Human
uacuguacagacagaaaaa

SEQ ID NO: 1309199 - RNA, 13 nt, Human
uacuguaauuccu

SEQ ID NO: 1309200 - RNA, 15 nt, Human
uacuguaauuccuca

SEQ ID NO: 1309201 - RNA, 16 nt, Human
uacuguaauuccucaa

SEQ ID NO: 1309202 - RNA, 18 nt, Human
aauugaggacacugauau

SEQ ID NO: 1309203 - RNA, 15 nt, Human
aauugagaaggaaaa

SEQ ID NO: 1309204 - RNA, 23 nt, Human
aauugagaaaaauauauacuaaa

SEQ ID NO: 1309205 - RNA, 19 nt, Human
aauugagaaaaauauauac

SEQ ID NO: 1309206 - RNA, 19 nt, Human
uacuguacagcuggcucua

SEQ ID NO: 1309207 - RNA, 12 nt, Human
aauugcauuucc

SEQ ID NO: 1309208 - RNA, 20 nt, Human
aauugcauugacuuucccca

SEQ ID NO: 1309209 - RNA, 21 nt, Human
aauugcauugacuuuccccac

SEQ ID NO: 1309210 - RNA, 11 nt, Human
aauugcauuga

SEQ ID NO: 1309211 - RNA, 18 nt, Human
aauugcauugacuuuccc

SEQ ID NO: 1309212 - RNA, 23 nt, Human
aauugauuugcauugaacacaaa

SEQ ID NO: 1309213 - RNA, 13 nt, Human
aauugauuuugaa

SEQ ID NO: 1309214 - RNA, 14 nt, Human
aauugauuuugaac

SEQ ID NO: 1309215 - RNA, 14 nt, Human
aauugcaaaucuug

SEQ ID NO: 1309216 - RNA, 18 nt, Human
aauugcaaaucuugaaau

SEQ ID NO: 1309217 - RNA, 20 nt, Human
aauugauuuuuauaaauacu

SEQ ID NO: 1309218 - RNA, 20 nt, Human
aauugcacaccuuggaauuc

SEQ ID NO: 1309219 - RNA, 22 nt, Human
aauugcacgcggagugaguuuu

SEQ ID NO: 1309220 - RNA, 13 nt, Human
aauugauuugcau

SEQ ID NO: 1309221 - RNA, 14 nt, Human
aauugauuugcauu

SEQ ID NO: 1309222 - RNA, 16 nt, Human
aauugauuugcauuga

SEQ ID NO: 1309223 - RNA, 20 nt, Human
aauugauuugcauugaacac

SEQ ID NO: 1309224 - RNA, 22 nt, Human
aauugauuugcauugaacacaa

SEQ ID NO: 1309225 - RNA, 18 nt, Human
uacuagggaaaugccuuu

SEQ ID NO: 1309226 - RNA, 19 nt, Human
uacuagggagccauuugag

SEQ ID NO: 1309227 - RNA, 20 nt, Human
uacuagggagccauuugaga

SEQ ID NO: 1309228 - RNA, 21 nt, Human
uacuagggaucccucaucugu

SEQ ID NO: 1309229 - RNA, 19 nt, Human
uacuauuuaaagccuccuc

SEQ ID NO: 1309230 - RNA, 21 nt, Human
uacuauuuaaagccuccucau

SEQ ID NO: 1309231 - RNA, 22 nt, Human
uacuauuuaaagccuccucauc

SEQ ID NO: 1309232 - RNA, 12 nt, Human
uacuauuuaacu

SEQ ID NO: 1309233 - RNA, 13 nt, Human
uacuauuuaacug

SEQ ID NO: 1309234 - RNA, 14 nt, Human
uacuauuuaacuga

SEQ ID NO: 1309235 - RNA, 17 nt, Human
uacucaaaugaguaaca

SEQ ID NO: 1309236 - RNA, 19 nt, Human
uacuauuuaacugacuauu

SEQ ID NO: 1309237 - RNA, 16 nt, Human
uacuauuuaacugacu

SEQ ID NO: 1309238 - RNA, 13 nt, Human
uacuauuucacaa

SEQ ID NO: 1309239 - RNA, 12 nt, Human
uacuauuucaca

SEQ ID NO: 1309240 - RNA, 19 nt, Human
uacuagagucugaacagcu

SEQ ID NO: 1309241 - RNA, 18 nt, Human
uacuaaaaauacaaaaaa

SEQ ID NO: 1309242 - RNA, 15 nt, Human
uacggauuuucaguu

SEQ ID NO: 1309243 - RNA, 17 nt, Human
uacggauuuucaguuac

SEQ ID NO: 1309244 - RNA, 14 nt, Human
uacuaaaaauacaa

SEQ ID NO: 1309245 - RNA, 17 nt, Human
uacggacagagaccaag

SEQ ID NO: 1309246 - RNA, 14 nt, Human
uacgcuguccagaa

SEQ ID NO: 1309247 - RNA, 14 nt, Human
uacgcuuugauuca

SEQ ID NO: 1309248 - RNA, 15 nt, Human
uacgcuuugauucau

SEQ ID NO: 1309249 - RNA, 13 nt, Human
aauugacccacaa

SEQ ID NO: 1309250 - RNA, 21 nt, Human
aauugaauacuuugaaugugu

SEQ ID NO: 1309251 - RNA, 14 nt, Human
aauugaauauuauu

SEQ ID NO: 1309252 - RNA, 15 nt, Human
aauugaaucacugcu

SEQ ID NO: 1309253 - RNA, 22 nt, Human
aauugaaucacugcucacacug

SEQ ID NO: 1309254 - RNA, 15 nt, Human
aauugaauauuauuc

SEQ ID NO: 1309255 - RNA, 18 nt, Human
aauugaaugcaaaccaua

SEQ ID NO: 1309256 - RNA, 14 nt, Human
aaugugggauuaug

SEQ ID NO: 1309257 - RNA, 14 nt, Human
aaugugauguucua

SEQ ID NO: 1309258 - RNA, 16 nt, Human
aaugugguagccucac

SEQ ID NO: 1309259 - RNA, 13 nt, Human
aauguguaagaac

SEQ ID NO: 1309260 - RNA, 21 nt, Human
aauguguaagaacaacuaccu

SEQ ID NO: 1309261 - RNA, 16 nt, Human
aauguguaguucaugu

SEQ ID NO: 1309262 - RNA, 21 nt, Human
aauguguaguucauguaaaua

SEQ ID NO: 1309263 - RNA, 22 nt, Human
aauguguaguucauguaaauaa

SEQ ID NO: 1309264 - RNA, 15 nt, Human
aauguguauaaacaa

SEQ ID NO: 1309265 - RNA, 22 nt, Human
aauguguauuacaaauauuuug

SEQ ID NO: 1309266 - RNA, 14 nt, Human
aauguguauaaaca

SEQ ID NO: 1309267 - RNA, 11 nt, Human
aaugugucuuu

SEQ ID NO: 1309268 - RNA, 12 nt, Human
aaugugucuuua

SEQ ID NO: 1309269 - RNA, 13 nt, Human
aaugugucuuuag

SEQ ID NO: 1309270 - RNA, 14 nt, Human
aaugugucuuuaga

SEQ ID NO: 1309271 - RNA, 15 nt, Human
aaugugucuuuagau

SEQ ID NO: 1309272 - RNA, 23 nt, Human
aaugugucuuuagauagcccugu

SEQ ID NO: 1309273 - RNA, 17 nt, Human
aaugugucuuuagauag

SEQ ID NO: 1309274 - RNA, 13 nt, Human
aauguguguauau

SEQ ID NO: 1309275 - RNA, 15 nt, Human
aauguguguauaugg

SEQ ID NO: 1309276 - RNA, 17 nt, Human
aauguguguauauggac

SEQ ID NO: 1309277 - RNA, 16 nt, Human
aauguguguauaugga

SEQ ID NO: 1309278 - RNA, 16 nt, Human
aaugugugucaauuua

SEQ ID NO: 1309279 - RNA, 16 nt, Human
aauugaauacuuugaa

SEQ ID NO: 1309280 - RNA, 18 nt, Human
aauugaauacuuugaaug

SEQ ID NO: 1309281 - RNA, 19 nt, Human
aauugaauacuuugaaugu

SEQ ID NO: 1309282 - RNA, 22 nt, Human
aauuuauaaacuuuuuucuuac

SEQ ID NO: 1309283 - RNA, 23 nt, Human
aauuuauaacguguucaauauuu

SEQ ID NO: 1309284 - RNA, 15 nt, Human
aauuuauaaugauua

SEQ ID NO: 1309285 - RNA, 16 nt, Human
aauuuaguuguuguag

SEQ ID NO: 1309286 - RNA, 12 nt, Human
aauuuaguuuca

SEQ ID NO: 1309287 - RNA, 14 nt, Human
aauuuaguuucaua

SEQ ID NO: 1309288 - RNA, 22 nt, Human
aauuuaguuucauauaaaguau

SEQ ID NO: 1309289 - RNA, 21 nt, Human
aauuuaguuucauauaaagua

SEQ ID NO: 1309290 - RNA, 16 nt, Human
aauuuauaaaaaggug

SEQ ID NO: 1309291 - RNA, 22 nt, Human
aauuuauaaaaagguguuuuga

SEQ ID NO: 1309292 - RNA, 21 nt, Human
aauuuauaccucaauuuucac

SEQ ID NO: 1309293 - RNA, 20 nt, Human
aauuuauaccucaauuuuca

SEQ ID NO: 1309294 - RNA, 18 nt, Human
aauuuauaccucaauuuu

SEQ ID NO: 1309295 - RNA, 16 nt, Human
aauuuauauuguaaau

SEQ ID NO: 1309296 - RNA, 23 nt, Human
aauuucuaggacugaauuaugaa

SEQ ID NO: 1309297 - RNA, 15 nt, Human
aauuucuuaacuucu

SEQ ID NO: 1309298 - RNA, 16 nt, Human
aauuucuuaacuucuu

SEQ ID NO: 1309299 - RNA, 20 nt, Human
aauuucuuaacuucuugcuu

SEQ ID NO: 1309300 - RNA, 18 nt, Human
aauuucuaggacugaauu

SEQ ID NO: 1309301 - RNA, 22 nt, Human
aauuucuaggacugaauuauga

SEQ ID NO: 1309302 - RNA, 17 nt, Human
aauuucuaggacugaau

SEQ ID NO: 1309303 - RNA, 11 nt, Human
aauuuaaaugu

SEQ ID NO: 1309304 - RNA, 13 nt, Human
aauuuaaauguua

SEQ ID NO: 1309305 - RNA, 15 nt, Human
aauuggagcucgugg

SEQ ID NO: 1309306 - RNA, 15 nt, Human
aauuggaaagcaggu

SEQ ID NO: 1309307 - RNA, 20 nt, Human
aauuggaagcugcccugccc

SEQ ID NO: 1309308 - RNA, 23 nt, Human
aauugcauugacuuuccccacca

SEQ ID NO: 1309309 - RNA, 13 nt, Human
aauugcuuauuua

SEQ ID NO: 1309310 - RNA, 22 nt, Human
aauugcuuauuuauuguauucu

SEQ ID NO: 1309311 - RNA, 19 nt, Human
aauugcuuauuuauuguau

SEQ ID NO: 1309312 - RNA, 16 nt, Human
aauugcuuguuugcuu

SEQ ID NO: 1309313 - RNA, 19 nt, Human
aauugcuuguuugcuucaa

SEQ ID NO: 1309314 - RNA, 22 nt, Human
aauugcuuuaccuuuuuucuua

SEQ ID NO: 1309315 - RNA, 13 nt, Human
aauuuaguauuuu

SEQ ID NO: 1309316 - RNA, 17 nt, Human
aauuuaguguauccaua

SEQ ID NO: 1309317 - RNA, 16 nt, Human
aauuuaguguauccau

SEQ ID NO: 1309318 - RNA, 18 nt, Human
aauuuacagagacagaaa

SEQ ID NO: 1309319 - RNA, 17 nt, Human
aauuuacagagacagaa

SEQ ID NO: 1309320 - RNA, 15 nt, Human
uacuugaaaauuaac

SEQ ID NO: 1309321 - RNA, 22 nt, Human
uacuucuuuuuucaaaagaaag

SEQ ID NO: 1309322 - RNA, 20 nt, Human
uacuucuuuuuucaaaagaa

SEQ ID NO: 1309323 - RNA, 19 nt, Human
uacuucuuguguguaugca

SEQ ID NO: 1309324 - RNA, 22 nt, Human
uacuucuguaauuguguggauu

SEQ ID NO: 1309325 - RNA, 15 nt, Human
uacuuucccuacccu

SEQ ID NO: 1309326 - RNA, 18 nt, Human
uacuuucccuacccucua

SEQ ID NO: 1309327 - RNA, 21 nt, Human
uacuuucccuacccucuagag

SEQ ID NO: 1309328 - RNA, 19 nt, Human
uacuuucccuacccucuag

SEQ ID NO: 1309329 - RNA, 23 nt, Human
uacuuugauauuuucaacgcagc

SEQ ID NO: 1309330 - RNA, 20 nt, Human
uacuuugacaguguuuuuag

SEQ ID NO: 1309331 - RNA, 15 nt, Human
uacuuugugcauucu

SEQ ID NO: 1309332 - RNA, 14 nt, Human
uacuuugaagucau

SEQ ID NO: 1309333 - RNA, 18 nt, Human
uacuuugaagucauacca

SEQ ID NO: 1309334 - RNA, 13 nt, Human
uacuuugaaugug

SEQ ID NO: 1309335 - RNA, 14 nt, Human
uacuuugaaugugu

SEQ ID NO: 1309336 - RNA, 18 nt, Human
uacuuugaauguguuuca

SEQ ID NO: 1309337 - RNA, 20 nt, Human
uacuuugaauguguuucaca

SEQ ID NO: 1309338 - RNA, 22 nt, Human
uacuuugaauguguuucacagu

SEQ ID NO: 1309339 - RNA, 15 nt, Human
uacuuugacaguguu

SEQ ID NO: 1309340 - RNA, 14 nt, Human
uacuuugacuuuuu

SEQ ID NO: 1309341 - RNA, 19 nt, Human
uacuucuuaggguuaugau

SEQ ID NO: 1309342 - RNA, 22 nt, Human
uacuucguguccgacucuucug

SEQ ID NO: 1309343 - RNA, 20 nt, Human
uacuucucauuuuuuaaaaa

SEQ ID NO: 1309344 - RNA, 16 nt, Human
uacuucucuaauucuu

SEQ ID NO: 1309345 - RNA, 13 nt, Human
uacuucugaggua

SEQ ID NO: 1309346 - RNA, 16 nt, Human
uacuucuguaauugug

SEQ ID NO: 1309347 - RNA, 17 nt, Human
uacuucuguaauugugu

SEQ ID NO: 1309348 - RNA, 20 nt, Human
uacuucuguaauugugugga

SEQ ID NO: 1309349 - RNA, 14 nt, Human
uacuucuugaaggu

SEQ ID NO: 1309350 - RNA, 15 nt, Human
aauuugaaacacuuu

SEQ ID NO: 1309351 - RNA, 17 nt, Human
aauuugauuauuaacau

SEQ ID NO: 1309352 - RNA, 12 nt, Human
aauuugauugau

SEQ ID NO: 1309353 - RNA, 13 nt, Human
aauuugauugauu

SEQ ID NO: 1309354 - RNA, 14 nt, Human
aauuugauugauuu

SEQ ID NO: 1309355 - RNA, 15 nt, Human
aauuugauugauuug

SEQ ID NO: 1309356 - RNA, 16 nt, Human
aauuugauugauuuga

SEQ ID NO: 1309357 - RNA, 17 nt, Human
uacuuaguauugcaaag

SEQ ID NO: 1309358 - RNA, 17 nt, Human
uacuuauauaauugcca

SEQ ID NO: 1309359 - RNA, 20 nt, Human
uacuuaguauugcaaaguca

SEQ ID NO: 1309360 - RNA, 15 nt, Human
uacuuaguauugcaa

SEQ ID NO: 1309361 - RNA, 16 nt, Human
uacuuauauggaaauu

SEQ ID NO: 1309362 - RNA, 17 nt, Human
aauuugauugauuugaa

SEQ ID NO: 1309363 - RNA, 20 nt, Human
aauuugauugauuugaagaa

SEQ ID NO: 1309364 - RNA, 23 nt, Human
uacuuccugugacuucagcucug

SEQ ID NO: 1309365 - RNA, 14 nt, Human
uacuuccuccuccc

SEQ ID NO: 1309366 - RNA, 16 nt, Human
uacuuccuccucccca

SEQ ID NO: 1309367 - RNA, 20 nt, Human
uacuucggggcugggaaguc

SEQ ID NO: 1309368 - RNA, 18 nt, Human
uacuucgacacuguucuu

SEQ ID NO: 1309369 - RNA, 14 nt, Human
uacuuccccuuccu

SEQ ID NO: 1309370 - RNA, 15 nt, Human
uacuuccccuuccua

SEQ ID NO: 1309371 - RNA, 18 nt, Human
uacuuccccuuccuaauu

SEQ ID NO: 1309372 - RNA, 20 nt, Human
uacuuccccuuccuaauucc

SEQ ID NO: 1309373 - RNA, 18 nt, Human
uacuuauuuguauauggu

SEQ ID NO: 1309374 - RNA, 17 nt, Human
uacuuauuuuugacagu

SEQ ID NO: 1309375 - RNA, 20 nt, Human
uacuuauuuuugacaguguu

SEQ ID NO: 1309376 - RNA, 19 nt, Human
uacuuauuuuugacagugu

SEQ ID NO: 1309377 - RNA, 14 nt, Human
uacuuccaaacuaa

SEQ ID NO: 1309378 - RNA, 17 nt, Human
uacuuccccauggcccu

SEQ ID NO: 1309379 - RNA, 13 nt, Human
uacuuuuuguuau

SEQ ID NO: 1309380 - RNA, 15 nt, Human
aauuugcauuaaauu

SEQ ID NO: 1309381 - RNA, 17 nt, Human
aauuugcauuaaauuac

SEQ ID NO: 1309382 - RNA, 17 nt, Human
aauuugcauuaaauuca

SEQ ID NO: 1309383 - RNA, 18 nt, Human
aauuugcauuaaauucac

SEQ ID NO: 1309384 - RNA, 21 nt, Human
aauuugcauuaaauucacaaa

SEQ ID NO: 1309385 - RNA, 14 nt, Human
uacuuuuaaacugu

SEQ ID NO: 1309386 - RNA, 15 nt, Human
uacuuuuaaacugug

SEQ ID NO: 1309387 - RNA, 21 nt, Human
uacuuuuaaacuguguacaua

SEQ ID NO: 1309388 - RNA, 21 nt, Human
uacuuuuaaacagugagccug

SEQ ID NO: 1309389 - RNA, 13 nt, Human
aauuugguuuuca

SEQ ID NO: 1309390 - RNA, 18 nt, Human
aauuugggggacuuacau

SEQ ID NO: 1309391 - RNA, 21 nt, Human
aauuugggggacuuacaugau

SEQ ID NO: 1309392 - RNA, 23 nt, Human
aauuugcauuaaauucacaaacu

SEQ ID NO: 1309393 - RNA, 20 nt, Human
aauuugcauuaaauuacaga

SEQ ID NO: 1309394 - RNA, 13 nt, Human
aauuugccugcug

SEQ ID NO: 1309395 - RNA, 15 nt, Human
aauuugccugcuggg

SEQ ID NO: 1309396 - RNA, 16 nt, Human
aauuugccuguaacaa

SEQ ID NO: 1309397 - RNA, 22 nt, Human
aauuugccuguaacaagccaga

SEQ ID NO: 1309398 - RNA, 15 nt, Human
aauuugguuuucaca

SEQ ID NO: 1309399 - RNA, 21 nt, Human
aauuugguuuucacauuggaa

SEQ ID NO: 1309400 - RNA, 18 nt, Human
aauuuguuauuuugcaac

SEQ ID NO: 1309401 - RNA, 14 nt, Human
aauuuguucuugua

SEQ ID NO: 1309402 - RNA, 22 nt, Human
aauuuuuaaucuuuaauuuuac

SEQ ID NO: 1309403 - RNA, 13 nt, Human
aauuuuuaaacaa

SEQ ID NO: 1309404 - RNA, 15 nt, Human
aauuuuuaaacaagu

SEQ ID NO: 1309405 - RNA, 19 nt, Human
aauuuuuaaacaaguauuu

SEQ ID NO: 1309406 - RNA, 15 nt, Human
aauuuguucuuguau

SEQ ID NO: 1309407 - RNA, 16 nt, Human
aauuuguucuuguauu

SEQ ID NO: 1309408 - RNA, 21 nt, Human
aauuuguucuuguauuuauug

SEQ ID NO: 1309409 - RNA, 12 nt, Human
aauuuguugcau

SEQ ID NO: 1309410 - RNA, 14 nt, Human
aauuuuuacagaau

SEQ ID NO: 1309411 - RNA, 16 nt, Human
aauuuuuacagaauug

SEQ ID NO: 1309412 - RNA, 13 nt, Human
aauuuuugauacu

SEQ ID NO: 1309413 - RNA, 13 nt, Human
aauuuuucuucuu

SEQ ID NO: 1309414 - RNA, 14 nt, Human
aauuuuucuucuug

SEQ ID NO: 1309415 - RNA, 16 nt, Human
aauuuuucuucuugag

SEQ ID NO: 1309416 - RNA, 13 nt, Human
aauuuuuguagua

SEQ ID NO: 1309417 - RNA, 14 nt, Human
aauuuuuguaauuu

SEQ ID NO: 1309418 - RNA, 22 nt, Human
aauuuuuuguugacauuagucu

SEQ ID NO: 1309419 - RNA, 17 nt, Human
aauuuuuuguugacauu

SEQ ID NO: 1309420 - RNA, 19 nt, Human
aauuuuuuuaauuuacaaa

SEQ ID NO: 1309421 - RNA, 16 nt, Human
aauuuuuuuuacauuu

SEQ ID NO: 1309422 - RNA, 12 nt, Human
aauuuuuuuuac

SEQ ID NO: 1309423 - RNA, 15 nt, Human
aauuuuuuuuaacau

SEQ ID NO: 1309424 - RNA, 17 nt, Human
aauuuuuuuuaacauuc

SEQ ID NO: 1309425 - RNA, 18 nt, Human
aauuuuuuuuaacauucc

SEQ ID NO: 1309426 - RNA, 19 nt, Human
aauuuuuuuuaacauuccu

SEQ ID NO: 1309427 - RNA, 20 nt, Human
aauuuuuuuuauuaguauug

SEQ ID NO: 1309428 - RNA, 22 nt, Human
aauuuuuuuuauuaguauuguu

SEQ ID NO: 1309429 - RNA, 23 nt, Human
aauuuuuuuuauuaguauuguug

SEQ ID NO: 1309430 - RNA, 18 nt, Human
aauuuuuuuguauuuuag

SEQ ID NO: 1309431 - RNA, 14 nt, Human
aauuuuuuuuaaca

SEQ ID NO: 1309432 - RNA, 22 nt, Human
uagauaggucagugcaaauacu

SEQ ID NO: 1309433 - RNA, 17 nt, Human
uagauaguuagaaccug

SEQ ID NO: 1309434 - RNA, 21 nt, Human
acaaauagucggauuagaaau

SEQ ID NO: 1309435 - RNA, 12 nt, Human
acaaauauuuau

SEQ ID NO: 1309436 - RNA, 18 nt, Human
acaaauauuuauuuucuu

SEQ ID NO: 1309437 - RNA, 22 nt, Human
acaaauauuuauuuucuuucug

SEQ ID NO: 1309438 - RNA, 23 nt, Human
acaaauauuuauuuucuuucugu

SEQ ID NO: 1309439 - RNA, 16 nt, Human
uagaucuggcauguua

SEQ ID NO: 1309440 - RNA, 13 nt, Human
uagaucucugaag

SEQ ID NO: 1309441 - RNA, 15 nt, Human
uagaucuggcauguu

SEQ ID NO: 1309442 - RNA, 15 nt, Human
uagaugaacucaacu

SEQ ID NO: 1309443 - RNA, 16 nt, Human
uagaugaaguuuuaca

SEQ ID NO: 1309444 - RNA, 21 nt, Human
uagaugcaguucugaagaaga

SEQ ID NO: 1309445 - RNA, 15 nt, Human
uagaugcauuugggu

SEQ ID NO: 1309446 - RNA, 19 nt, Human
uagaugcauuuggguccag

SEQ ID NO: 1309447 - RNA, 20 nt, Human
uagaugcauuuggguccagg

SEQ ID NO: 1309448 - RNA, 21 nt, Human
uagaugcauuuggguccagga

SEQ ID NO: 1309449 - RNA, 23 nt, Human
uagaugcauuuggguccaggagg

SEQ ID NO: 1309450 - RNA, 22 nt, Human
uagaugcucuaugugcuuguaa

SEQ ID NO: 1309451 - RNA, 22 nt, Human
uagaugcauuuggguccaggag

SEQ ID NO: 1309452 - RNA, 17 nt, Human
uagcaaagauaucucau

SEQ ID NO: 1309453 - RNA, 19 nt, Human
uagcaaagauaucucaucu

SEQ ID NO: 1309454 - RNA, 16 nt, Human
acaaaggagccuguga

SEQ ID NO: 1309455 - RNA, 19 nt, Human
acaaaguuuaccagaaagc

SEQ ID NO: 1309456 - RNA, 19 nt, Human
acaaaguuucaauuuguuu

SEQ ID NO: 1309457 - RNA, 13 nt, Human
acaaaggagccug

SEQ ID NO: 1309458 - RNA, 23 nt, Human
acaaaggagccugugaacccagg

SEQ ID NO: 1309459 - RNA, 14 nt, Human
acaaaggagccugu

SEQ ID NO: 1309460 - RNA, 15 nt, Human
acaaaggagccugug

SEQ ID NO: 1309461 - RNA, 18 nt, Human
acaaagcccuuccauguc

SEQ ID NO: 1309462 - RNA, 15 nt, Human
acaaagcccuuuuau

SEQ ID NO: 1309463 - RNA, 16 nt, Human
acaaagcccuuuuaua

SEQ ID NO: 1309464 - RNA, 18 nt, Human
acaaagccacuuucaauc

SEQ ID NO: 1309465 - RNA, 14 nt, Human
acaaaacugcauuu

SEQ ID NO: 1309466 - RNA, 20 nt, Human
acaaaagaagcccggcuccu

SEQ ID NO: 1309467 - RNA, 23 nt, Human
acaaaagaagcccggcuccuggu

SEQ ID NO: 1309468 - RNA, 16 nt, Human
acaaaacugcauuuca

SEQ ID NO: 1309469 - RNA, 19 nt, Human
aauuuuuuuuuccuagccc

SEQ ID NO: 1309470 - RNA, 17 nt, Human
acaaaacuacaugagaa

SEQ ID NO: 1309471 - RNA, 23 nt, Human
acaaaacuacaugagaacaaaca

SEQ ID NO: 1309472 - RNA, 16 nt, Human
acaaaacuagagacuc

SEQ ID NO: 1309473 - RNA, 16 nt, Human
uagcuacuaauuuuaa

SEQ ID NO: 1309474 - RNA, 16 nt, Human
uagccuucucuguuca

SEQ ID NO: 1309475 - RNA, 20 nt, Human
uagccuucucuguucauuuc

SEQ ID NO: 1309476 - RNA, 22 nt, Human
uagccuucucuguucauuuccu

SEQ ID NO: 1309477 - RNA, 12 nt, Human
uagccuugcuug

SEQ ID NO: 1309478 - RNA, 13 nt, Human
uagccuugcuugu

SEQ ID NO: 1309479 - RNA, 15 nt, Human
uagccuugcuuguua

SEQ ID NO: 1309480 - RNA, 14 nt, Human
uagccuugcuuguu

SEQ ID NO: 1309481 - RNA, 24 nt, Human
acaaugaacaucccuuuuucaaug

SEQ ID NO: 1309482 - RNA, 21 nt, Human
acaaugaaaacucuuugcugc

SEQ ID NO: 1309483 - RNA, 18 nt, Human
acaaugaaaacucuuugc

SEQ ID NO: 1309484 - RNA, 23 nt, Human
acaaugaauaaaaacucaaggag

SEQ ID NO: 1309485 - RNA, 15 nt, Human
acaaugacaaagcag

SEQ ID NO: 1309486 - RNA, 16 nt, Human
acaaugacaaagcaga

SEQ ID NO: 1309487 - RNA, 13 nt, Human
uagccuucucugu

SEQ ID NO: 1309488 - RNA, 14 nt, Human
uagccuucucuguu

SEQ ID NO: 1309489 - RNA, 15 nt, Human
uagccuucucuguuc

SEQ ID NO: 1309490 - RNA, 15 nt, Human
uagccuuuuuguaua

SEQ ID NO: 1309491 - RNA, 17 nt, Human
uagccuuuuuguauaaa

SEQ ID NO: 1309492 - RNA, 22 nt, Human
uagccuuuuuguauaaaauaga

SEQ ID NO: 1309493 - RNA, 19 nt, Human
uagccuuuuuuccccagac

SEQ ID NO: 1309494 - RNA, 20 nt, Human
uagccuuuuuuccccagacu

SEQ ID NO: 1309495 - RNA, 22 nt, Human
uagccuuuuuuccccagacuug

SEQ ID NO: 1309496 - RNA, 23 nt, Human
uagccuuuuuuccccagacuugu

SEQ ID NO: 1309497 - RNA, 12 nt, Human
uagcucaaugag

SEQ ID NO: 1309498 - RNA, 13 nt, Human
uagcucaaugagc

SEQ ID NO: 1309499 - RNA, 15 nt, Human
uagcucaaugagcau

SEQ ID NO: 1309500 - RNA, 16 nt, Human
uagcucaaugagcaug

SEQ ID NO: 1309501 - RNA, 17 nt, Human
uagcucaaugagcaugu

SEQ ID NO: 1309502 - RNA, 18 nt, Human
uagcucaaugagcauguu

SEQ ID NO: 1309503 - RNA, 15 nt, Human
uagcucaauuagugu

SEQ ID NO: 1309504 - RNA, 17 nt, Human
acaagcuccauuuaaac

SEQ ID NO: 1309505 - RNA, 23 nt, Human
acaagccugagggaaaggccagc

SEQ ID NO: 1309506 - RNA, 17 nt, Human
acaaguuauuuaaaucu

SEQ ID NO: 1309507 - RNA, 22 nt, Human
acaaguuauuuaaaucuguuuu

SEQ ID NO: 1309508 - RNA, 18 nt, Human
acaagcuccauuuaaaca

SEQ ID NO: 1309509 - RNA, 16 nt, Human
acaaguuggagucacu

SEQ ID NO: 1309510 - RNA, 17 nt, Human
acaaguuggagucacuc

SEQ ID NO: 1309511 - RNA, 18 nt, Human
acaaguuggagucacucu

SEQ ID NO: 1309512 - RNA, 18 nt, Human
acaaucucggcucacugc

SEQ ID NO: 1309513 - RNA, 20 nt, Human
acaaucucggcucacugcau

SEQ ID NO: 1309514 - RNA, 22 nt, Human
acaauaaaaguguccauugaaa

SEQ ID NO: 1309515 - RNA, 14 nt, Human
acaauaaaaauguu

SEQ ID NO: 1309516 - RNA, 16 nt, Human
acaauaaaaauguuua

SEQ ID NO: 1309517 - RNA, 12 nt, Human
acaauaaaacau

SEQ ID NO: 1309518 - RNA, 16 nt, Human
acaauaaaacauuaau

SEQ ID NO: 1309519 - RNA, 21 nt, Human
acaaauucugucucuggauua

SEQ ID NO: 1309520 - RNA, 18 nt, Human
acaaaugccaaauuaaaa

SEQ ID NO: 1309521 - RNA, 22 nt, Human
acaaaugccaaauuaaaaaaga

SEQ ID NO: 1309522 - RNA, 22 nt, Human
uagcaacuacagucuaaagcug

SEQ ID NO: 1309523 - RNA, 21 nt, Human
uagcaacuacagucuaaagcu

SEQ ID NO: 1309524 - RNA, 14 nt, Human
acaacagcugccug

SEQ ID NO: 1309525 - RNA, 16 nt, Human
acaacagguaaaacag

SEQ ID NO: 1309526 - RNA, 23 nt, Human
acaacaguuacauaauucacucu

SEQ ID NO: 1309527 - RNA, 21 nt, Human
acaacaugaggccacuggaga

SEQ ID NO: 1309528 - RNA, 13 nt, Human
acaagacacagug

SEQ ID NO: 1309529 - RNA, 17 nt, Human
acaaauuuacagagaca

SEQ ID NO: 1309530 - RNA, 14 nt, Human
acaaauggccuuua

SEQ ID NO: 1309531 - RNA, 14 nt, Human
acaagacacaguga

SEQ ID NO: 1309532 - RNA, 18 nt, Human
acaagagcuuaacagugu

SEQ ID NO: 1309533 - RNA, 19 nt, Human
acaagagcuuaacagugug

SEQ ID NO: 1309534 - RNA, 18 nt, Human
acaagauggaauuuauca

SEQ ID NO: 1309535 - RNA, 11 nt, Human
acaagccucug

SEQ ID NO: 1309536 - RNA, 13 nt, Human
acaagccucugcc

SEQ ID NO: 1309537 - RNA, 18 nt, Human
acaagccucugcccaggc

SEQ ID NO: 1309538 - RNA, 20 nt, Human
acaagccucugcccaggcac

SEQ ID NO: 1309539 - RNA, 23 nt, Human
acaagccucugcccaggcacugc

SEQ ID NO: 1309540 - RNA, 12 nt, Human
acaagccugagg

SEQ ID NO: 1309541 - RNA, 22 nt, Human
acaagccugagggaaaggccag

SEQ ID NO: 1309542 - RNA, 18 nt, Human
acaagauuauaauauuuu

SEQ ID NO: 1309543 - RNA, 17 nt, Human
acaagauugguguuuuu

SEQ ID NO: 1309544 - RNA, 18 nt, Human
acaagauugguguuuuuu

SEQ ID NO: 1309545 - RNA, 19 nt, Human
acaagauugguguuuuuuu

SEQ ID NO: 1309546 - RNA, 22 nt, Human
acaagauugguguuuuuuucua

SEQ ID NO: 1309547 - RNA, 24 nt, Human
acaagauugguguuuuuuucuaug

SEQ ID NO: 1309548 - RNA, 23 nt, Human
acaagauugguguuuuuuucuau

SEQ ID NO: 1309549 - RNA, 15 nt, Human
guugcccccauuucu

SEQ ID NO: 1309550 - RNA, 15 nt, Human
aaggaugugauugug

SEQ ID NO: 1309551 - RNA, 17 nt, Human
aaggaugugauugugga

SEQ ID NO: 1309552 - RNA, 22 nt, Human
aaggaugugauuguggaaugga

SEQ ID NO: 1309553 - RNA, 21 nt, Human
aaggccaauuccuauacgcag

SEQ ID NO: 1309554 - RNA, 23 nt, Human
aaggcuacuucggggcugggaag

SEQ ID NO: 1309555 - RNA, 20 nt, Human
aaggcuacuucggggcuggg

SEQ ID NO: 1309556 - RNA, 21 nt, Human
guugaugccugugaacugaac

SEQ ID NO: 1309557 - RNA, 19 nt, Human
aaggaugccccgucccccu

SEQ ID NO: 1309558 - RNA, 19 nt, Human
aaggaugaagggcccgaga

SEQ ID NO: 1309559 - RNA, 16 nt, Human
guugcugcuucaauuu

SEQ ID NO: 1309560 - RNA, 18 nt, Human
guugcugcuucucccagg

SEQ ID NO: 1309561 - RNA, 22 nt, Human
guugcugcuucucccaggcaag

SEQ ID NO: 1309562 - RNA, 23 nt, Human
guugcugcuucucccaggcaagg

SEQ ID NO: 1309563 - RNA, 16 nt, Human
guuggucuguacugau

SEQ ID NO: 1309564 - RNA, 15 nt, Human
guuggucuguacuga

SEQ ID NO: 1309565 - RNA, 12 nt, Human
guuguauucauu

SEQ ID NO: 1309566 - RNA, 16 nt, Human
guuguauuuaacagaa

SEQ ID NO: 1309567 - RNA, 18 nt, Human
guuguaccgcaaugugac

SEQ ID NO: 1309568 - RNA, 13 nt, Human
guugguggugcug

SEQ ID NO: 1309569 - RNA, 17 nt, Human
guuguaauauuucuuca

SEQ ID NO: 1309570 - RNA, 20 nt, Human
guuguagagaaaacaugcag

SEQ ID NO: 1309571 - RNA, 18 nt, Human
guuguacuuuggaauucu

SEQ ID NO: 1309572 - RNA, 17 nt, Human
guuggugcacagcacaa

SEQ ID NO: 1309573 - RNA, 21 nt, Human
guuuauguuccauuaaacgau

SEQ ID NO: 1309574 - RNA, 22 nt, Human
guuuauguuccauuaaacgauu

SEQ ID NO: 1309575 - RNA, 14 nt, Human
guuuauuaaucuua

SEQ ID NO: 1309576 - RNA, 18 nt, Human
guuuauuaaucuuagugu

SEQ ID NO: 1309577 - RNA, 20 nt, Human
guuuauuaaucuuaguguau

SEQ ID NO: 1309578 - RNA, 21 nt, Human
guuuauuaaucuuaguguaug

SEQ ID NO: 1309579 - RNA, 18 nt, Human
guuuauuaagcaucagaa

SEQ ID NO: 1309580 - RNA, 22 nt, Human
guuuauuaaucuuaguguauga

SEQ ID NO: 1309581 - RNA, 13 nt, Human
guuuaauguuuug

SEQ ID NO: 1309582 - RNA, 18 nt, Human
guuuaauuuuuauuucuu

SEQ ID NO: 1309583 - RNA, 20 nt, Human
guuuaauuuuuauuucuucc

SEQ ID NO: 1309584 - RNA, 19 nt, Human
guuuacaaaaucagguaac

SEQ ID NO: 1309585 - RNA, 20 nt, Human
guuuacaaaaauuucuguaa

SEQ ID NO: 1309586 - RNA, 16 nt, Human
guuuacacucuuugua

SEQ ID NO: 1309587 - RNA, 15 nt, Human
guuuauguaauuuca

SEQ ID NO: 1309588 - RNA, 20 nt, Human
guuuaagacauuuuuggaag

SEQ ID NO: 1309589 - RNA, 17 nt, Human
guuuaagccaaaacaau

SEQ ID NO: 1309590 - RNA, 20 nt, Human
guuuaagccaaaacaauguu

SEQ ID NO: 1309591 - RNA, 11 nt, Human
guuuaaaacuu

SEQ ID NO: 1309592 - RNA, 19 nt, Human
guuuaaaagacacacuugu

SEQ ID NO: 1309593 - RNA, 23 nt, Human
guuuaaaagacacacuuguccac

SEQ ID NO: 1309594 - RNA, 13 nt, Human
guuuaaagaaagu

SEQ ID NO: 1309595 - RNA, 20 nt, Human
guuuucuuaaccagaucauu

SEQ ID NO: 1309596 - RNA, 12 nt, Human
guuuuauaagca

SEQ ID NO: 1309597 - RNA, 20 nt, Human
guuuuauaagcaucauuauu

SEQ ID NO: 1309598 - RNA, 22 nt, Human
guuuuauaagcaucauuauuua

SEQ ID NO: 1309599 - RNA, 13 nt, Human
guuuuagguucua

SEQ ID NO: 1309600 - RNA, 15 nt, Human
guuuuagguucuaaa

SEQ ID NO: 1309601 - RNA, 16 nt, Human
guuuuagguucuaaag

SEQ ID NO: 1309602 - RNA, 17 nt, Human
guuuuagguucuaaagu

SEQ ID NO: 1309603 - RNA, 21 nt, Human
guuuuagguucuaaaguucua

SEQ ID NO: 1309604 - RNA, 23 nt, Human
guuuuauaagcaucauuauuuau

SEQ ID NO: 1309605 - RNA, 20 nt, Human
guuuuacaauaguucugugg

SEQ ID NO: 1309606 - RNA, 16 nt, Human
guuuuacaauaguucu

SEQ ID NO: 1309607 - RNA, 13 nt, Human
guuuuacaauagu

SEQ ID NO: 1309608 - RNA, 11 nt, Human
guuuuacaaua

SEQ ID NO: 1309609 - RNA, 23 nt, Human
guuuuacaauaaaaucuugaaaa

SEQ ID NO: 1309610 - RNA, 16 nt, Human
guuuuacaaguuggag

SEQ ID NO: 1309611 - RNA, 20 nt, Human
guuugggccccagaggcugg

SEQ ID NO: 1309612 - RNA, 20 nt, Human
guuuuacaaguuggagucac

SEQ ID NO: 1309613 - RNA, 16 nt, Human
guuuuacagauuuauu

SEQ ID NO: 1309614 - RNA, 22 nt, Human
guuuuacagauuuauuccuuug

SEQ ID NO: 1309615 - RNA, 12 nt, Human
guuuuacauugu

SEQ ID NO: 1309616 - RNA, 21 nt, Human
guuuuacauuguugagcuauu

SEQ ID NO: 1309617 - RNA, 20 nt, Human
guuuuagauuuucugguucu

SEQ ID NO: 1309618 - RNA, 21 nt, Human
guuuuagauuuucugguucua

SEQ ID NO: 1309619 - RNA, 12 nt, Human
guuuuagguucu

SEQ ID NO: 1309620 - RNA, 16 nt, Human
aaguaauacaaacuaa

SEQ ID NO: 1309621 - RNA, 20 nt, Human
aaguaauaaaauucaacaaa

SEQ ID NO: 1309622 - RNA, 14 nt, Human
guuucuaagauucu

SEQ ID NO: 1309623 - RNA, 15 nt, Human
guuucuaagauucua

SEQ ID NO: 1309624 - RNA, 16 nt, Human
guuucuaagauucuaa

SEQ ID NO: 1309625 - RNA, 17 nt, Human
guuucugucguuaaaaa

SEQ ID NO: 1309626 - RNA, 15 nt, Human
guuugauuucauuaa

SEQ ID NO: 1309627 - RNA, 22 nt, Human
guuucugucguuaaaaacagau

SEQ ID NO: 1309628 - RNA, 12 nt, Human
guuucuguucca

SEQ ID NO: 1309629 - RNA, 13 nt, Human
guuucuguuccaa

SEQ ID NO: 1309630 - RNA, 15 nt, Human
guuucuguuccaaau

SEQ ID NO: 1309631 - RNA, 14 nt, Human
guuucuguuccaaa

SEQ ID NO: 1309632 - RNA, 13 nt, Human
guuuggcuuucag

SEQ ID NO: 1309633 - RNA, 18 nt, Human
guuuggcuuucagggagg

SEQ ID NO: 1309634 - RNA, 18 nt, Human
guuugcaaaaaauguuuu

SEQ ID NO: 1309635 - RNA, 17 nt, Human
guuugcaccuuucuagu

SEQ ID NO: 1309636 - RNA, 22 nt, Human
guuugccuccguccccugccca

SEQ ID NO: 1309637 - RNA, 21 nt, Human
guuucaaacauauauaacaau

SEQ ID NO: 1309638 - RNA, 17 nt, Human
aaggcuucucucugugg

SEQ ID NO: 1309639 - RNA, 18 nt, Human
aaggcuucucucuguggg

SEQ ID NO: 1309640 - RNA, 14 nt, Human
aaggcuugggauuu

SEQ ID NO: 1309641 - RNA, 19 nt, Human
aaggcuugggauuugcugu

SEQ ID NO: 1309642 - RNA, 17 nt, Human
aaggcuuguugugcuuu

SEQ ID NO: 1309643 - RNA, 19 nt, Human
aaggcuuguugugcuuuua

SEQ ID NO: 1309644 - RNA, 20 nt, Human
aaggcuuguugugcuuuuag

SEQ ID NO: 1309645 - RNA, 14 nt, Human
aaggcuuucucuac

SEQ ID NO: 1309646 - RNA, 21 nt, Human
aaggcuuugcccugcugcccu

SEQ ID NO: 1309647 - RNA, 22 nt, Human
aaggcuuugcccugcugcccuc

SEQ ID NO: 1309648 - RNA, 17 nt, Human
aaggggaauugaggaca

SEQ ID NO: 1309649 - RNA, 16 nt, Human
aagggguuggauugca

SEQ ID NO: 1309650 - RNA, 18 nt, Human
aagggcuuuguuuugcac

SEQ ID NO: 1309651 - RNA, 20 nt, Human
aaguaaaaacaaagaaauua

SEQ ID NO: 1309652 - RNA, 13 nt, Human
aaguaaaaacaaa

SEQ ID NO: 1309653 - RNA, 22 nt, Human
aaguaaaaacaaagaaauuaug

SEQ ID NO: 1309654 - RNA, 11 nt, Human
aagguuuuuuu

SEQ ID NO: 1309655 - RNA, 17 nt, Human
aagguuuuuuuucaguu

SEQ ID NO: 1309656 - RNA, 14 nt, Human
aaguaauaaaauuc

SEQ ID NO: 1309657 - RNA, 13 nt, Human
aagguacuucaaa

SEQ ID NO: 1309658 - RNA, 18 nt, Human
aagguaaaaugccaugau

SEQ ID NO: 1309659 - RNA, 16 nt, Human
aagguaaauaaaaaga

SEQ ID NO: 1309660 - RNA, 19 nt, Human
aagguaaauaaaaagaaag

SEQ ID NO: 1309661 - RNA, 18 nt, Human
aagguacaagaagcauuu

SEQ ID NO: 1309662 - RNA, 19 nt, Human
aagguacaagaagcauuuu

SEQ ID NO: 1309663 - RNA, 22 nt, Human
aagguacuguaugaucaaaugu

SEQ ID NO: 1309664 - RNA, 21 nt, Human
aagguacuguaugaucaaaug

SEQ ID NO: 1309665 - RNA, 20 nt, Human
aagguacuguaugaucaaau

SEQ ID NO: 1309666 - RNA, 19 nt, Human
aagguacuguaugaucaaa

SEQ ID NO: 1309667 - RNA, 17 nt, Human
aagguacuguaugauca

SEQ ID NO: 1309668 - RNA, 15 nt, Human
aagguacuguaugau

SEQ ID NO: 1309669 - RNA, 14 nt, Human
aagguacuguauga

SEQ ID NO: 1309670 - RNA, 20 nt, Human
aagguuuuccucuucuauuu

SEQ ID NO: 1309671 - RNA, 12 nt, Human
aaggguaaacaa

SEQ ID NO: 1309672 - RNA, 13 nt, Human
aaggguaaacaau

SEQ ID NO: 1309673 - RNA, 16 nt, Human
aaggguaaacaauaua

SEQ ID NO: 1309674 - RNA, 15 nt, Human
aaggguaaacaauau

SEQ ID NO: 1309675 - RNA, 14 nt, Human
aagguaaaaugcca

SEQ ID NO: 1309676 - RNA, 22 nt, Human
aagguaaaaugccaugaugccu

SEQ ID NO: 1309677 - RNA, 19 nt, Human
aagccuccuuagaaaaaaa

SEQ ID NO: 1309678 - RNA, 22 nt, Human
guucauauguaccauguacaug

SEQ ID NO: 1309679 - RNA, 15 nt, Human
aagccucugcccagg

SEQ ID NO: 1309680 - RNA, 13 nt, Human
guucauagcccag

SEQ ID NO: 1309681 - RNA, 14 nt, Human
guucauagcccagu

SEQ ID NO: 1309682 - RNA, 19 nt, Human
guucauauguaccauguac

SEQ ID NO: 1309683 - RNA, 20 nt, Human
aagccugggggccuggcugg

SEQ ID NO: 1309684 - RNA, 21 nt, Human
aagccugggggccuggcuggc

SEQ ID NO: 1309685 - RNA, 23 nt, Human
aagccugggggccuggcuggcug

SEQ ID NO: 1309686 - RNA, 22 nt, Human
aagccuggguuugguguauggu

SEQ ID NO: 1309687 - RNA, 15 nt, Human
aagccugggggccug

SEQ ID NO: 1309688 - RNA, 16 nt, Human
aagccugggggccugg

SEQ ID NO: 1309689 - RNA, 17 nt, Human
aagccugggggccuggc

SEQ ID NO: 1309690 - RNA, 18 nt, Human
aagccugggggccuggcu

SEQ ID NO: 1309691 - RNA, 19 nt, Human
aagccugggggccuggcug

SEQ ID NO: 1309692 - RNA, 21 nt, Human
aagccuggccuacaugguuga

SEQ ID NO: 1309693 - RNA, 16 nt, Human
guuauuuguaauagau

SEQ ID NO: 1309694 - RNA, 21 nt, Human
guuauuucccuacauuaaaca

SEQ ID NO: 1309695 - RNA, 22 nt, Human
guuauuugaaaacauguuuauu

SEQ ID NO: 1309696 - RNA, 17 nt, Human
guuauuuguaauagaug

SEQ ID NO: 1309697 - RNA, 23 nt, Human
guuauuucccuacauuaaacaug

SEQ ID NO: 1309698 - RNA, 11 nt, Human
guuauuuaaau

SEQ ID NO: 1309699 - RNA, 13 nt, Human
guuagauuaagaa

SEQ ID NO: 1309700 - RNA, 16 nt, Human
guuagauuaagaaaua

SEQ ID NO: 1309701 - RNA, 13 nt, Human
guuagcagacagg

SEQ ID NO: 1309702 - RNA, 18 nt, Human
guuagcagacaggccccg

SEQ ID NO: 1309703 - RNA, 17 nt, Human
guuagccaauauuuuuc

SEQ ID NO: 1309704 - RNA, 21 nt, Human
guuagcuaauaaaaagcuuuu

SEQ ID NO: 1309705 - RNA, 18 nt, Human
guuagccuuuuuucccca

SEQ ID NO: 1309706 - RNA, 12 nt, Human
guuagcuccugu

SEQ ID NO: 1309707 - RNA, 14 nt, Human
guuaguaauaccuc

SEQ ID NO: 1309708 - RNA, 14 nt, Human
guuagcuccugugg

SEQ ID NO: 1309709 - RNA, 15 nt, Human
guuagcuccuguggc

SEQ ID NO: 1309710 - RNA, 16 nt, Human
guuagcuccuguggcc

SEQ ID NO: 1309711 - RNA, 23 nt, Human
guuagccuuuuuuccccagacuu

SEQ ID NO: 1309712 - RNA, 14 nt, Human
guuaguaucuuuug

SEQ ID NO: 1309713 - RNA, 17 nt, Human
guuaguaucuuuugaua

SEQ ID NO: 1309714 - RNA, 12 nt, Human
guuagucauuug

SEQ ID NO: 1309715 - RNA, 22 nt, Human
guuagucauuugcugagcaugu

SEQ ID NO: 1309716 - RNA, 18 nt, Human
guuaguaucuuuugauau

SEQ ID NO: 1309717 - RNA, 17 nt, Human
guuaguuaccuuauagu

SEQ ID NO: 1309718 - RNA, 22 nt, Human
guuaguuaccuuauaguuacug

SEQ ID NO: 1309719 - RNA, 23 nt, Human
guuaguuaccuuauaguuacugu

SEQ ID NO: 1309720 - RNA, 18 nt, Human
guguuuuaaaaugagaaa

SEQ ID NO: 1309721 - RNA, 18 nt, Human
guguuuccacagccugca

SEQ ID NO: 1309722 - RNA, 14 nt, Human
guguuuccaucuca

SEQ ID NO: 1309723 - RNA, 14 nt, Human
guguuuggcuuuca

SEQ ID NO: 1309724 - RNA, 12 nt, Human
guuaagccuuug

SEQ ID NO: 1309725 - RNA, 13 nt, Human
guuaagccuuugg

SEQ ID NO: 1309726 - RNA, 16 nt, Human
guuaagccuuuggaaa

SEQ ID NO: 1309727 - RNA, 16 nt, Human
guguuuuaauuguaaa

SEQ ID NO: 1309728 - RNA, 15 nt, Human
guuaagcucugcuau

SEQ ID NO: 1309729 - RNA, 14 nt, Human
guguuuuaauugua

SEQ ID NO: 1309730 - RNA, 13 nt, Human
guguuuuaauuua

SEQ ID NO: 1309731 - RNA, 14 nt, Human
guguuuuaauuuaa

SEQ ID NO: 1309732 - RNA, 16 nt, Human
guuaaucuugcuuucu

SEQ ID NO: 1309733 - RNA, 23 nt, Human
guuaaguugagauaguuuucauc

SEQ ID NO: 1309734 - RNA, 13 nt, Human
guuaaucuugcuu

SEQ ID NO: 1309735 - RNA, 21 nt, Human
guuaaucuugcuuucuuuguu

SEQ ID NO: 1309736 - RNA, 22 nt, Human
guuaaguugauggugaugaaau

SEQ ID NO: 1309737 - RNA, 12 nt, Human
guuaagcucugc

SEQ ID NO: 1309738 - RNA, 14 nt, Human
guugacaugggaca

SEQ ID NO: 1309739 - RNA, 18 nt, Human
guugacaugggacauuug

SEQ ID NO: 1309740 - RNA, 13 nt, Human
guugacauucuga

SEQ ID NO: 1309741 - RNA, 14 nt, Human
guugacauucugaa

SEQ ID NO: 1309742 - RNA, 15 nt, Human
guugacauucugaau

SEQ ID NO: 1309743 - RNA, 17 nt, Human
guugacauucugaaugc

SEQ ID NO: 1309744 - RNA, 18 nt, Human
guugacauucugaaugcu

SEQ ID NO: 1309745 - RNA, 19 nt, Human
guugacauucugaaugcuu

SEQ ID NO: 1309746 - RNA, 14 nt, Human
guugaggccacugu

SEQ ID NO: 1309747 - RNA, 21 nt, Human
guugaggccacuguguuccuu

SEQ ID NO: 1309748 - RNA, 19 nt, Human
guugaggccacuguguucc

SEQ ID NO: 1309749 - RNA, 16 nt, Human
guucuuacugcuuaau

SEQ ID NO: 1309750 - RNA, 14 nt, Human
guucuuacugcuug

SEQ ID NO: 1309751 - RNA, 16 nt, Human
guucuuagcucaauga

SEQ ID NO: 1309752 - RNA, 19 nt, Human
guucuuagcucaaugagca

SEQ ID NO: 1309753 - RNA, 17 nt, Human
guucuuagcucaaugag

SEQ ID NO: 1309754 - RNA, 18 nt, Human
guucuuguaauuuuacac

SEQ ID NO: 1309755 - RNA, 12 nt, Human
guucuuguauuu

SEQ ID NO: 1309756 - RNA, 13 nt, Human
guucuuguaauuu

SEQ ID NO: 1309757 - RNA, 13 nt, Human
guucuuguuggug

SEQ ID NO: 1309758 - RNA, 14 nt, Human
guucuuguuggugc

SEQ ID NO: 1309759 - RNA, 15 nt, Human
guucuuguuggugca

SEQ ID NO: 1309760 - RNA, 23 nt, Human
guucuuuaaaauguaaagccaug

SEQ ID NO: 1309761 - RNA, 23 nt, Human
guucugguaugaacuugaggaca

SEQ ID NO: 1309762 - RNA, 17 nt, Human
guucugguccuuuuugg

SEQ ID NO: 1309763 - RNA, 22 nt, Human
guucuuaccuguaugucuccag

SEQ ID NO: 1309764 - RNA, 17 nt, Human
guucuccugcugcuccc

SEQ ID NO: 1309765 - RNA, 18 nt, Human
guucuccugcugcucccu

SEQ ID NO: 1309766 - RNA, 21 nt, Human
guucuccugcugcucccucag

SEQ ID NO: 1309767 - RNA, 22 nt, Human
guucuccugcugcucccucaga

SEQ ID NO: 1309768 - RNA, 13 nt, Human
guucuccuuuucc

SEQ ID NO: 1309769 - RNA, 18 nt, Human
guucuccuuuuccucucu

SEQ ID NO: 1309770 - RNA, 22 nt, Human
guucuccuuuuccucucucccg

SEQ ID NO: 1309771 - RNA, 20 nt, Human
guucuaccucaggcagcuca

SEQ ID NO: 1309772 - RNA, 21 nt, Human
guucuaccucaggcagcucaa

SEQ ID NO: 1309773 - RNA, 12 nt, Human
guucuagaaaaa

SEQ ID NO: 1309774 - RNA, 13 nt, Human
guucuagaaaaac

SEQ ID NO: 1309775 - RNA, 14 nt, Human
guucuagaaaaaca

SEQ ID NO: 1309776 - RNA, 18 nt, Human
guucuagaaaaacaggca

SEQ ID NO: 1309777 - RNA, 21 nt, Human
guucuagaaaaacaggcacuu

SEQ ID NO: 1309778 - RNA, 20 nt, Human
guucuagacauggagguucu

SEQ ID NO: 1309779 - RNA, 21 nt, Human
guucuagacauggagguucua

SEQ ID NO: 1309780 - RNA, 22 nt, Human
guucuagacauggagguucuaa

SEQ ID NO: 1309781 - RNA, 23 nt, Human
guucuagacauggagguucuaag

SEQ ID NO: 1309782 - RNA, 22 nt, Human
guucuccguuagcuccuguggc

SEQ ID NO: 1309783 - RNA, 23 nt, Human
guucuccguuagcuccuguggcc

SEQ ID NO: 1309784 - RNA, 17 nt, Human
aagcuaucguaaaauua

SEQ ID NO: 1309785 - RNA, 18 nt, Human
aagcuccucuccccagcc

SEQ ID NO: 1309786 - RNA, 22 nt, Human
aagcucgauguggucacagcug

SEQ ID NO: 1309787 - RNA, 23 nt, Human
aagcucgauguggucacagcugu

SEQ ID NO: 1309788 - RNA, 19 nt, Human
aagcuccucuccccagccc

SEQ ID NO: 1309789 - RNA, 20 nt, Human
aagcuccucuccccagccca

SEQ ID NO: 1309790 - RNA, 21 nt, Human
aagcuccucuccccagcccag

SEQ ID NO: 1309791 - RNA, 22 nt, Human
aagcuccucuccccagcccaga

SEQ ID NO: 1309792 - RNA, 23 nt, Human
aagcuccucuccccagcccagag

SEQ ID NO: 1309793 - RNA, 14 nt, Human
aagcugacuuggcu

SEQ ID NO: 1309794 - RNA, 15 nt, Human
aagcugacuuggcug

SEQ ID NO: 1309795 - RNA, 16 nt, Human
aagcugacuuggcugg

SEQ ID NO: 1309796 - RNA, 17 nt, Human
aagcugacuuggcuggu

SEQ ID NO: 1309797 - RNA, 18 nt, Human
aagcugacuuggcuggug

SEQ ID NO: 1309798 - RNA, 20 nt, Human
aagcugacuuggcuggugug

SEQ ID NO: 1309799 - RNA, 19 nt, Human
aagcugacuuggcuggugu

SEQ ID NO: 1309800 - RNA, 13 nt, Human
aagcugaggugcc

SEQ ID NO: 1309801 - RNA, 17 nt, Human
aagcugaggugcccagg

SEQ ID NO: 1309802 - RNA, 18 nt, Human
aagcugaggugcccagga

SEQ ID NO: 1309803 - RNA, 19 nt, Human
aagcugaggugcccaggag

SEQ ID NO: 1309804 - RNA, 13 nt, Human
aagcugaguauua

SEQ ID NO: 1309805 - RNA, 20 nt, Human
aagcugaggugcccaggaga

SEQ ID NO: 1309806 - RNA, 18 nt, Human
aagcuucaaacugcauga

SEQ ID NO: 1309807 - RNA, 19 nt, Human
aagcuucagugcugccgau

SEQ ID NO: 1309808 - RNA, 15 nt, Human
aagcuuccaugauuc

SEQ ID NO: 1309809 - RNA, 20 nt, Human
aagcuuccaugauucuauuu

SEQ ID NO: 1309810 - RNA, 15 nt, Human
guuccccaagacauu

SEQ ID NO: 1309811 - RNA, 15 nt, Human
guuccccuuccacug

SEQ ID NO: 1309812 - RNA, 22 nt, Human
guuccccuuccacugagggcag

SEQ ID NO: 1309813 - RNA, 17 nt, Human
guuccccuuugcuucau

SEQ ID NO: 1309814 - RNA, 16 nt, Human
guucccauuucagcug

SEQ ID NO: 1309815 - RNA, 20 nt, Human
guucccuacuuccugugacu

SEQ ID NO: 1309816 - RNA, 19 nt, Human
guucccguuucuccaccua

SEQ ID NO: 1309817 - RNA, 14 nt, Human
guucccguuucucc

SEQ ID NO: 1309818 - RNA, 16 nt, Human
guucccguuucuccac

SEQ ID NO: 1309819 - RNA, 18 nt, Human
guucccguuucuccaccu

SEQ ID NO: 1309820 - RNA, 13 nt, Human
guucccucccaga

SEQ ID NO: 1309821 - RNA, 17 nt, Human
guuccauuaaacgauuu

SEQ ID NO: 1309822 - RNA, 21 nt, Human
guucccaagagcaucaugccu

SEQ ID NO: 1309823 - RNA, 19 nt, Human
guucccaagcucagaggcg

SEQ ID NO: 1309824 - RNA, 23 nt, Human
guucccaagagcaucaugccucu

SEQ ID NO: 1309825 - RNA, 17 nt, Human
guucccacauuaaagaa

SEQ ID NO: 1309826 - RNA, 21 nt, Human
guucccacauuaaagaagacc

SEQ ID NO: 1309827 - RNA, 18 nt, Human
guucccacauuaaagaag

SEQ ID NO: 1309828 - RNA, 20 nt, Human
guucccaguuggagcuccag

SEQ ID NO: 1309829 - RNA, 16 nt, Human
aagcuuccaugauucu

SEQ ID NO: 1309830 - RNA, 14 nt, Human
aagcuuuaucuauu

SEQ ID NO: 1309831 - RNA, 21 nt, Human
aagcuuucagaauaugucagu

SEQ ID NO: 1309832 - RNA, 22 nt, Human
aagcuuucauguaaacugugca

SEQ ID NO: 1309833 - RNA, 23 nt, Human
aagcuuucauguaaacugugcac

SEQ ID NO: 1309834 - RNA, 12 nt, Human
aagcuuuccugc

SEQ ID NO: 1309835 - RNA, 16 nt, Human
aagcuuucagaauaug

SEQ ID NO: 1309836 - RNA, 16 nt, Human
aagcuuuccugcccca

SEQ ID NO: 1309837 - RNA, 14 nt, Human
guguuggucuguac

SEQ ID NO: 1309838 - RNA, 20 nt, Human
guguuggacaagcuucugag

SEQ ID NO: 1309839 - RNA, 13 nt, Human
guguuucacaguu

SEQ ID NO: 1309840 - RNA, 21 nt, Human
guguuucacaguuugaaauaa

SEQ ID NO: 1309841 - RNA, 12 nt, Human
guguugucucua

SEQ ID NO: 1309842 - RNA, 15 nt, Human
guguugucucuugag

SEQ ID NO: 1309843 - RNA, 18 nt, Human
guguguaugcgugugugu

SEQ ID NO: 1309844 - RNA, 14 nt, Human
guguguauauggac

SEQ ID NO: 1309845 - RNA, 12 nt, Human
gugugaggccag

SEQ ID NO: 1309846 - RNA, 19 nt, Human
guguguccacgacugucuc

SEQ ID NO: 1309847 - RNA, 20 nt, Human
guguguccacgacugucucc

SEQ ID NO: 1309848 - RNA, 16 nt, Human
gugugucccccucugu

SEQ ID NO: 1309849 - RNA, 17 nt, Human
gugugucccccucuguc

SEQ ID NO: 1309850 - RNA, 18 nt, Human
gugugucccccucugucc

SEQ ID NO: 1309851 - RNA, 15 nt, Human
gugugucugcucagu

SEQ ID NO: 1309852 - RNA, 16 nt, Human
gugugucugcucagua

SEQ ID NO: 1309853 - RNA, 15 nt, Human
gugugucuguucacu

SEQ ID NO: 1309854 - RNA, 22 nt, Human
gugugucuguucacuuuuccuc

SEQ ID NO: 1309855 - RNA, 14 nt, Human
gugugucuuaauua

SEQ ID NO: 1309856 - RNA, 21 nt, Human
gugugucuuaauuauuauuug

SEQ ID NO: 1309857 - RNA, 15 nt, Human
guguugauacuguug

SEQ ID NO: 1309858 - RNA, 16 nt, Human
guguugauacuguugc

SEQ ID NO: 1309859 - RNA, 17 nt, Human
guguugauacuguugca

SEQ ID NO: 1309860 - RNA, 18 nt, Human
guguugauacuguugcac

SEQ ID NO: 1309861 - RNA, 20 nt, Human
guguugauacuguugcacgu

SEQ ID NO: 1309862 - RNA, 21 nt, Human
guguugauacuguugcacgug

SEQ ID NO: 1309863 - RNA, 23 nt, Human
guguugauacuguugcacgugug

SEQ ID NO: 1309864 - RNA, 17 nt, Human
guguugccaaauauguc

SEQ ID NO: 1309865 - RNA, 19 nt, Human
guguugccaaauauguccu

SEQ ID NO: 1309866 - RNA, 20 nt, Human
guguugccaaauauguccug

SEQ ID NO: 1309867 - RNA, 14 nt, Human
guguugccaagcuc

SEQ ID NO: 1309868 - RNA, 18 nt, Human
guguugccaagcuccaag

SEQ ID NO: 1309869 - RNA, 17 nt, Human
gugucuuuagauagccc

SEQ ID NO: 1309870 - RNA, 18 nt, Human
gugucuuucacagcuccu

SEQ ID NO: 1309871 - RNA, 19 nt, Human
gugucuuuagauagcccug

SEQ ID NO: 1309872 - RNA, 13 nt, Human
aagcaauaugcau

SEQ ID NO: 1309873 - RNA, 19 nt, Human
aagcaauaugcauuuaaau

SEQ ID NO: 1309874 - RNA, 17 nt, Human
gugugaaaaugugugug

SEQ ID NO: 1309875 - RNA, 16 nt, Human
gugucuuuuuuuguau

SEQ ID NO: 1309876 - RNA, 20 nt, Human
gugugaaacuuucauuccuu

SEQ ID NO: 1309877 - RNA, 21 nt, Human
gugugagaagugaaugcuggg

SEQ ID NO: 1309878 - RNA, 22 nt, Human
gugugagaagugaaugcuggga

SEQ ID NO: 1309879 - RNA, 12 nt, Human
gugugagacugg

SEQ ID NO: 1309880 - RNA, 14 nt, Human
aagagguuuuaaag

SEQ ID NO: 1309881 - RNA, 18 nt, Human
aagagguuuuaaagcuuc

SEQ ID NO: 1309882 - RNA, 13 nt, Human
aagaguagaaacu

SEQ ID NO: 1309883 - RNA, 20 nt, Human
aagaguagaaacugcaggga

SEQ ID NO: 1309884 - RNA, 13 nt, Human
aagaguaaucaau

SEQ ID NO: 1309885 - RNA, 14 nt, Human
gugguuucauguua

SEQ ID NO: 1309886 - RNA, 23 nt, Human
gugguuuuagauuuucugguucu

SEQ ID NO: 1309887 - RNA, 17 nt, Human
aagagguguuuuuucua

SEQ ID NO: 1309888 - RNA, 17 nt, Human
aagagguguuauuugga

SEQ ID NO: 1309889 - RNA, 19 nt, Human
aagaucuguccucagccuu

SEQ ID NO: 1309890 - RNA, 20 nt, Human
aagaucuguccucagccuug

SEQ ID NO: 1309891 - RNA, 19 nt, Human
aagauauuuuaaaaucugu

SEQ ID NO: 1309892 - RNA, 16 nt, Human
aagauaugggacauuu

SEQ ID NO: 1309893 - RNA, 19 nt, Human
aagauaugggacauuuuug

SEQ ID NO: 1309894 - RNA, 23 nt, Human
aagaucuuagauucucugugucu

SEQ ID NO: 1309895 - RNA, 11 nt, Human
aagaucuuuua

SEQ ID NO: 1309896 - RNA, 15 nt, Human
aagaucuuuuauuuu

SEQ ID NO: 1309897 - RNA, 17 nt, Human
aagaucuuuuauuuugc

SEQ ID NO: 1309898 - RNA, 20 nt, Human
aagaucuguuuugaaggcaa

SEQ ID NO: 1309899 - RNA, 21 nt, Human
aagaucuguuuugaaggcaaa

SEQ ID NO: 1309900 - RNA, 22 nt, Human
aagaucuguuuugaaggcaaaa

SEQ ID NO: 1309901 - RNA, 13 nt, Human
aagaucuuagauu

SEQ ID NO: 1309902 - RNA, 14 nt, Human
aagaucuuagauuc

SEQ ID NO: 1309903 - RNA, 15 nt, Human
aagaucuuagauucu

SEQ ID NO: 1309904 - RNA, 16 nt, Human
aagaucuuagauucuc

SEQ ID NO: 1309905 - RNA, 17 nt, Human
aagaucuuagauucucu

SEQ ID NO: 1309906 - RNA, 22 nt, Human
aagcaaagacuuuccucuuagu

SEQ ID NO: 1309907 - RNA, 12 nt, Human
aagcaaagcaca

SEQ ID NO: 1309908 - RNA, 15 nt, Human
aagcaaagcacagag

SEQ ID NO: 1309909 - RNA, 17 nt, Human
aagcaaagcacagagag

SEQ ID NO: 1309910 - RNA, 14 nt, Human
aagaugugauauuc

SEQ ID NO: 1309911 - RNA, 16 nt, Human
aagaugugauauucua

SEQ ID NO: 1309912 - RNA, 17 nt, Human
aagaugugauauucuaa

SEQ ID NO: 1309913 - RNA, 18 nt, Human
aagaugugauauucuaag

SEQ ID NO: 1309914 - RNA, 19 nt, Human
aagaugugauauucuaaga

SEQ ID NO: 1309915 - RNA, 20 nt, Human
aagaugugauauucuaagac

SEQ ID NO: 1309916 - RNA, 18 nt, Human
aagaucuuuuauuuugcc

SEQ ID NO: 1309917 - RNA, 23 nt, Human
aagaugcacuuugcuuuaauaua

SEQ ID NO: 1309918 - RNA, 15 nt, Human
aagaugccacauuca

SEQ ID NO: 1309919 - RNA, 16 nt, Human
aagaugccacauucaa

SEQ ID NO: 1309920 - RNA, 22 nt, Human
aagaugccacauucaaaauagg

SEQ ID NO: 1309921 - RNA, 16 nt, Human
aagcaaagcacagaga

SEQ ID NO: 1309922 - RNA, 18 nt, Human
aagcaaccucaguaauuu

SEQ ID NO: 1309923 - RNA, 19 nt, Human
aagcaaccucaguaauuua

SEQ ID NO: 1309924 - RNA, 20 nt, Human
aagcaaccucaguaauuuag

SEQ ID NO: 1309925 - RNA, 21 nt, Human
aagcaaccucaguaauuuaga

SEQ ID NO: 1309926 - RNA, 22 nt, Human
aagcaaccucaguaauuuagaa

SEQ ID NO: 1309927 - RNA, 19 nt, Human
aagcaacuaggccuucagu

SEQ ID NO: 1309928 - RNA, 23 nt, Human
aagcaagaaucagagaaggaaca

SEQ ID NO: 1309929 - RNA, 17 nt, Human
aagcaagaaucagagaa

SEQ ID NO: 1309930 - RNA, 22 nt, Human
aagcaagaggccguggcugcug

SEQ ID NO: 1309931 - RNA, 19 nt, Human
aagcaaguucgucuguugu

SEQ ID NO: 1309932 - RNA, 17 nt, Human
gugggaggugagaccac

SEQ ID NO: 1309933 - RNA, 15 nt, Human
gugggaggguaccag

SEQ ID NO: 1309934 - RNA, 16 nt, Human
gugggaggguaccagc

SEQ ID NO: 1309935 - RNA, 20 nt, Human
gugggaggguaccagcagaa

SEQ ID NO: 1309936 - RNA, 19 nt, Human
gugggacggugcccaagcc

SEQ ID NO: 1309937 - RNA, 20 nt, Human
gugggacggugcccaagcca

SEQ ID NO: 1309938 - RNA, 21 nt, Human
gugggagaccggccugccagg

SEQ ID NO: 1309939 - RNA, 20 nt, Human
gugggacgggaugguucugg

SEQ ID NO: 1309940 - RNA, 19 nt, Human
guggcgugaucucagcuca

SEQ ID NO: 1309941 - RNA, 22 nt, Human
gugggacagcuuguaggggagg

SEQ ID NO: 1309942 - RNA, 17 nt, Human
gugggaccuagggaggc

SEQ ID NO: 1309943 - RNA, 21 nt, Human
gugggacagucaccucaugga

SEQ ID NO: 1309944 - RNA, 16 nt, Human
guggcguuuguaauga

SEQ ID NO: 1309945 - RNA, 19 nt, Human
guggcgcgaucucagcuca

SEQ ID NO: 1309946 - RNA, 22 nt, Human
guggcgccgucuccaggggcug

SEQ ID NO: 1309947 - RNA, 17 nt, Human
guggcgccgucuccagg

SEQ ID NO: 1309948 - RNA, 21 nt, Human
guggcgccgucuccaggggcu

SEQ ID NO: 1309949 - RNA, 14 nt, Human
guggguagacacac

SEQ ID NO: 1309950 - RNA, 13 nt, Human
gugggucugggag

SEQ ID NO: 1309951 - RNA, 13 nt, Human
gugggugccuagg

SEQ ID NO: 1309952 - RNA, 14 nt, Human
gugguggcucggga

SEQ ID NO: 1309953 - RNA, 15 nt, Human
gugguggucccuggg

SEQ ID NO: 1309954 - RNA, 16 nt, Human
gugguggucccugggu

SEQ ID NO: 1309955 - RNA, 20 nt, Human
guggguacccccaggaccag

SEQ ID NO: 1309956 - RNA, 13 nt, Human
gugggguggcugc

SEQ ID NO: 1309957 - RNA, 15 nt, Human
gugggguggcugcag

SEQ ID NO: 1309958 - RNA, 18 nt, Human
gugggguggcugcagccu

SEQ ID NO: 1309959 - RNA, 19 nt, Human
gugggguggcugcagccuc

SEQ ID NO: 1309960 - RNA, 16 nt, Human
gugggguggugucaga

SEQ ID NO: 1309961 - RNA, 13 nt, Human
guggggugugcug

SEQ ID NO: 1309962 - RNA, 16 nt, Human
guggggugugcuggga

SEQ ID NO: 1309963 - RNA, 19 nt, Human
guggggugugcugggagcu

SEQ ID NO: 1309964 - RNA, 17 nt, Human
gugggagugugugccug

SEQ ID NO: 1309965 - RNA, 14 nt, Human
gugggagugugugc

SEQ ID NO: 1309966 - RNA, 23 nt, Human
guggggggggggcgcggcuggga

SEQ ID NO: 1309967 - RNA, 14 nt, Human
aagaggaagcaaau

SEQ ID NO: 1309968 - RNA, 13 nt, Human
aagaggaagcaaa

SEQ ID NO: 1309969 - RNA, 18 nt, Human
guggcccgacagccuggc

SEQ ID NO: 1309970 - RNA, 19 nt, Human
guggcccgacagccuggca

SEQ ID NO: 1309971 - RNA, 14 nt, Human
guggcccucucccc

SEQ ID NO: 1309972 - RNA, 15 nt, Human
guggcccucuccccu

SEQ ID NO: 1309973 - RNA, 17 nt, Human
guggcccucuccccugc

SEQ ID NO: 1309974 - RNA, 18 nt, Human
guggcccucuccccugcc

SEQ ID NO: 1309975 - RNA, 19 nt, Human
guggcccucuccccugccc

SEQ ID NO: 1309976 - RNA, 16 nt, Human
aagagcuuaacagugu

SEQ ID NO: 1309977 - RNA, 23 nt, Human
aagagcgagagaucaaagaugaa

SEQ ID NO: 1309978 - RNA, 14 nt, Human
aagagcuacauaau

SEQ ID NO: 1309979 - RNA, 14 nt, Human
aagagcuuaagaac

SEQ ID NO: 1309980 - RNA, 16 nt, Human
aagagcuacauaauuu

SEQ ID NO: 1309981 - RNA, 16 nt, Human
aagagccuuccaccca

SEQ ID NO: 1309982 - RNA, 18 nt, Human
aagagccuuccacccagg

SEQ ID NO: 1309983 - RNA, 18 nt, Human
aagagcgagagaucaaag

SEQ ID NO: 1309984 - RNA, 21 nt, Human
aagagcgagagaucaaagaug

SEQ ID NO: 1309985 - RNA, 18 nt, Human
aagagcuacguauuuaau

SEQ ID NO: 1309986 - RNA, 14 nt, Human
aagacuuacucuaa

SEQ ID NO: 1309987 - RNA, 15 nt, Human
aagacuuacucuaag

SEQ ID NO: 1309988 - RNA, 16 nt, Human
aagacuuacucuaaga

SEQ ID NO: 1309989 - RNA, 17 nt, Human
aagacuuacucuaagau

SEQ ID NO: 1309990 - RNA, 20 nt, Human
aagacuuacucuaagaucuu

SEQ ID NO: 1309991 - RNA, 13 nt, Human
aagagauuuuuca

SEQ ID NO: 1309992 - RNA, 14 nt, Human
aagagauuuuucau

SEQ ID NO: 1309993 - RNA, 15 nt, Human
aagagauuuuucaug

SEQ ID NO: 1309994 - RNA, 17 nt, Human
aagagauuuuucaugau

SEQ ID NO: 1309995 - RNA, 15 nt, Human
aagagcaaaagaaug

SEQ ID NO: 1309996 - RNA, 20 nt, Human
aagagcaaaagaauggcaga

SEQ ID NO: 1309997 - RNA, 17 nt, Human
aagagcagcaccuccuc

SEQ ID NO: 1309998 - RNA, 20 nt, Human
aagacccuuuuggguuucug

SEQ ID NO: 1309999 - RNA, 17 nt, Human
aagacccuuuuggguuu

SEQ ID NO: 1310000 - RNA, 17 nt, Human
aagaccuacuguucuaa

SEQ ID NO: 1310001 - RNA, 18 nt, Human
aagaccuacuguucuaaa

SEQ ID NO: 1310002 - RNA, 20 nt, Human
aagaccuacuguucuaaagc

SEQ ID NO: 1310003 - RNA, 22 nt, Human
aagaccuacuguucuaaagcuc

SEQ ID NO: 1310004 - RNA, 15 nt, Human
aagaccugagaaugu

SEQ ID NO: 1310005 - RNA, 21 nt, Human
aagaccuacuguucuaaagcu

SEQ ID NO: 1310006 - RNA, 17 nt, Human
aagaccuggcagcucug

SEQ ID NO: 1310007 - RNA, 22 nt, Human
aagacuaucuuacuauuucaca

SEQ ID NO: 1310008 - RNA, 17 nt, Human
aagacuaugaaaaugcu

SEQ ID NO: 1310009 - RNA, 15 nt, Human
aagacuaugaaaaug

SEQ ID NO: 1310010 - RNA, 12 nt, Human
aagacucuagag

SEQ ID NO: 1310011 - RNA, 13 nt, Human
aagacucuagagu

SEQ ID NO: 1310012 - RNA, 15 nt, Human
aagacucuagagucc

SEQ ID NO: 1310013 - RNA, 19 nt, Human
aagacucuagaguccaagg

SEQ ID NO: 1310014 - RNA, 21 nt, Human
aagacucuagaguccaagguu

SEQ ID NO: 1310015 - RNA, 18 nt, Human
gugcuaguaauuggaaag

SEQ ID NO: 1310016 - RNA, 19 nt, Human
gugcuaggaagaggagugg

SEQ ID NO: 1310017 - RNA, 17 nt, Human
aagaauagcuuuaauga

SEQ ID NO: 1310018 - RNA, 12 nt, Human
aagaauacuucu

SEQ ID NO: 1310019 - RNA, 16 nt, Human
aagaauacuucucauu

SEQ ID NO: 1310020 - RNA, 17 nt, Human
aagaauacuucucauuu

SEQ ID NO: 1310021 - RNA, 22 nt, Human
aagaauacuucucauuuuuuaa

SEQ ID NO: 1310022 - RNA, 11 nt, Human
aagaauagaac

SEQ ID NO: 1310023 - RNA, 17 nt, Human
aagaauagcauuguaaa

SEQ ID NO: 1310024 - RNA, 18 nt, Human
aagaauagcauuguaaaa

SEQ ID NO: 1310025 - RNA, 23 nt, Human
aagaauagcauuguaaaagcauu

SEQ ID NO: 1310026 - RNA, 19 nt, Human
aagaaguggggcagcagca

SEQ ID NO: 1310027 - RNA, 18 nt, Human
aagaaguggggcagcagc

SEQ ID NO: 1310028 - RNA, 16 nt, Human
aagaaggcaaaaaugu

SEQ ID NO: 1310029 - RNA, 22 nt, Human
aagaagugaaaaucuacacucc

SEQ ID NO: 1310030 - RNA, 16 nt, Human
aagaagugaaaaucua

SEQ ID NO: 1310031 - RNA, 14 nt, Human
aagaaggcaaaaau

SEQ ID NO: 1310032 - RNA, 15 nt, Human
aagaaggcaaaaaua

SEQ ID NO: 1310033 - RNA, 19 nt, Human
aagaaggcaaaaauaguuu

SEQ ID NO: 1310034 - RNA, 13 nt, Human
aagaaauauaccu

SEQ ID NO: 1310035 - RNA, 15 nt, Human
aagaaauagaacaag

SEQ ID NO: 1310036 - RNA, 20 nt, Human
aagaaauagaacaaggcuga

SEQ ID NO: 1310037 - RNA, 12 nt, Human
aagaaauagaau

SEQ ID NO: 1310038 - RNA, 16 nt, Human
aagaaagacgcacuuu

SEQ ID NO: 1310039 - RNA, 20 nt, Human
aagaaagacgcacuuuggcu

SEQ ID NO: 1310040 - RNA, 14 nt, Human
aagaaauagaacaa

SEQ ID NO: 1310041 - RNA, 16 nt, Human
aagaaagaacggaaga

SEQ ID NO: 1310042 - RNA, 14 nt, Human
aagaaacuuuuuua

SEQ ID NO: 1310043 - RNA, 13 nt, Human
aagaaagaaaauc

SEQ ID NO: 1310044 - RNA, 23 nt, Human
aagaaacuuucuuucucacuaaa

SEQ ID NO: 1310045 - RNA, 17 nt, Human
aagaaacuuguccuucc

SEQ ID NO: 1310046 - RNA, 11 nt, Human
aagaaacuuuc

SEQ ID NO: 1310047 - RNA, 21 nt, Human
aagaaacuggggcuccuccag

SEQ ID NO: 1310048 - RNA, 21 nt, Human
aagaaacugaggaauuuucuu

SEQ ID NO: 1310049 - RNA, 16 nt, Human
aagaaacugaggaauu

SEQ ID NO: 1310050 - RNA, 19 nt, Human
aagaaacugaggaauuuuc

SEQ ID NO: 1310051 - RNA, 20 nt, Human
aagaaacugaggaauuuucu

SEQ ID NO: 1310052 - RNA, 16 nt, Human
aagaaaccuacugccc

SEQ ID NO: 1310053 - RNA, 21 nt, Human
aagaaaccuacugcccaggca

SEQ ID NO: 1310054 - RNA, 21 nt, Human
aagaaaaaaauugaaauguaa

SEQ ID NO: 1310055 - RNA, 20 nt, Human
aagaaaaaaauugaaaugua

SEQ ID NO: 1310056 - RNA, 15 nt, Human
aagaaaaagaagcaa

SEQ ID NO: 1310057 - RNA, 16 nt, Human
aacuuguauuaugugu

SEQ ID NO: 1310058 - RNA, 23 nt, Human
aacuuggggaguuaagaccuggc

SEQ ID NO: 1310059 - RNA, 19 nt, Human
aacuuguccuagcacagau

SEQ ID NO: 1310060 - RNA, 12 nt, Human
aacuugggaacu

SEQ ID NO: 1310061 - RNA, 11 nt, Human
aacuuggcuca

SEQ ID NO: 1310062 - RNA, 18 nt, Human
aacuuggcugcaggaauc

SEQ ID NO: 1310063 - RNA, 19 nt, Human
aacuuggcugcaggaaucu

SEQ ID NO: 1310064 - RNA, 21 nt, Human
aacuuggggaguuaagaccug

SEQ ID NO: 1310065 - RNA, 22 nt, Human
aacuuggggaguuaagaccugg

SEQ ID NO: 1310066 - RNA, 22 nt, Human
gugccuucaagaaaacaggcac

SEQ ID NO: 1310067 - RNA, 21 nt, Human
aacuuggcucgaaucucugug

SEQ ID NO: 1310068 - RNA, 22 nt, Human
aacuuggcucgaaucucugugc

SEQ ID NO: 1310069 - RNA, 23 nt, Human
aacuuggcucgaaucucugugcc

SEQ ID NO: 1310070 - RNA, 19 nt, Human
aacuuuaauguuuuuugcc

SEQ ID NO: 1310071 - RNA, 19 nt, Human
aacuuuaaagcguuugcac

SEQ ID NO: 1310072 - RNA, 13 nt, Human
aacuuuaacuucu

SEQ ID NO: 1310073 - RNA, 20 nt, Human
aacuuuaacuucuguuuuac

SEQ ID NO: 1310074 - RNA, 14 nt, Human
aacuuuaauguuuu

SEQ ID NO: 1310075 - RNA, 15 nt, Human
aagaaaaaaauguau

SEQ ID NO: 1310076 - RNA, 16 nt, Human
aagaaaaaaauguauu

SEQ ID NO: 1310077 - RNA, 17 nt, Human
aagaaaaaaauguauuu

SEQ ID NO: 1310078 - RNA, 21 nt, Human
aagaaaaaaauguauuuuaug

SEQ ID NO: 1310079 - RNA, 23 nt, Human
aagaaaaaaauguauuuuauguu

SEQ ID NO: 1310080 - RNA, 22 nt, Human
aagaaaaaaauguauuuuaugu

SEQ ID NO: 1310081 - RNA, 17 nt, Human
aagaaaaaaauugaaau

SEQ ID NO: 1310082 - RNA, 18 nt, Human
aagaaaaaaauugaaaug

SEQ ID NO: 1310083 - RNA, 19 nt, Human
aagaaaaaaauugaaaugu

SEQ ID NO: 1310084 - RNA, 13 nt, Human
gugccucugccug

SEQ ID NO: 1310085 - RNA, 13 nt, Human
gugccucagagac

SEQ ID NO: 1310086 - RNA, 15 nt, Human
gugccucagagacca

SEQ ID NO: 1310087 - RNA, 19 nt, Human
gugccucagagaccagggc

SEQ ID NO: 1310088 - RNA, 20 nt, Human
gugccucagagaccagggcu

SEQ ID NO: 1310089 - RNA, 15 nt, Human
gugccucugccuguc

SEQ ID NO: 1310090 - RNA, 20 nt, Human
gugccuaguauugacaaaau

SEQ ID NO: 1310091 - RNA, 18 nt, Human
gugccuaguauugacaaa

SEQ ID NO: 1310092 - RNA, 16 nt, Human
gugccuaguauugaca

SEQ ID NO: 1310093 - RNA, 18 nt, Human
gugccuauugcuagagcu

SEQ ID NO: 1310094 - RNA, 19 nt, Human
gugccuauugcuagagcuc

SEQ ID NO: 1310095 - RNA, 20 nt, Human
gugccuauugcuagagcucc

SEQ ID NO: 1310096 - RNA, 21 nt, Human
gugccuauugcuagagcuccu

SEQ ID NO: 1310097 - RNA, 14 nt, Human
gugccuaguauuga

SEQ ID NO: 1310098 - RNA, 20 nt, Human
gugccuaggccugggcagug

SEQ ID NO: 1310099 - RNA, 15 nt, Human
gugccuaggccuggg

SEQ ID NO: 1310100 - RNA, 18 nt, Human
gugccuaggccugggcag

SEQ ID NO: 1310101 - RNA, 14 nt, Human
gugccuaggccugg

SEQ ID NO: 1310102 - RNA, 16 nt, Human
gugcucaggagcccug

SEQ ID NO: 1310103 - RNA, 15 nt, Human
gugcuggccagcgag

SEQ ID NO: 1310104 - RNA, 18 nt, Human
gugcucagcccugaggac

SEQ ID NO: 1310105 - RNA, 15 nt, Human
gugcucaggagcccu

SEQ ID NO: 1310106 - RNA, 16 nt, Human
gugcuauuugucaucu

SEQ ID NO: 1310107 - RNA, 13 nt, Human
gugcucaaggcca

SEQ ID NO: 1310108 - RNA, 12 nt, Human
gugcucagcccu

SEQ ID NO: 1310109 - RNA, 16 nt, Human
gugcucagcccugagg

SEQ ID NO: 1310110 - RNA, 14 nt, Human
gugcuaggaagagg

SEQ ID NO: 1310111 - RNA, 14 nt, Human
gugcuauggugcuc

SEQ ID NO: 1310112 - RNA, 16 nt, Human
gugcuauggugcucug

SEQ ID NO: 1310113 - RNA, 17 nt, Human
gugcugggagaggcagc

SEQ ID NO: 1310114 - RNA, 18 nt, Human
gugcugggagaggcagcc

SEQ ID NO: 1310115 - RNA, 16 nt, Human
gugcugggagcuccac

SEQ ID NO: 1310116 - RNA, 22 nt, Human
gugcugggagcuccacucugcu

SEQ ID NO: 1310117 - RNA, 23 nt, Human
gugcugggagcuccacucugcuu

SEQ ID NO: 1310118 - RNA, 20 nt, Human
gugcugggauuacaggcgug

SEQ ID NO: 1310119 - RNA, 21 nt, Human
guggauggaaggggcugacag

SEQ ID NO: 1310120 - RNA, 13 nt, Human
guggauggcccca

SEQ ID NO: 1310121 - RNA, 12 nt, Human
guggauguuacu

SEQ ID NO: 1310122 - RNA, 15 nt, Human
guggauggccccagc

SEQ ID NO: 1310123 - RNA, 16 nt, Human
guggauggccccagca

SEQ ID NO: 1310124 - RNA, 19 nt, Human
guggauggccccagcacag

SEQ ID NO: 1310125 - RNA, 22 nt, Human
guggauggccccagcacagcuu

SEQ ID NO: 1310126 - RNA, 16 nt, Human
guggaccauggagugg

SEQ ID NO: 1310127 - RNA, 21 nt, Human
guggaccauggaguggcagcc

SEQ ID NO: 1310128 - RNA, 12 nt, Human
guggacaggacu

SEQ ID NO: 1310129 - RNA, 20 nt, Human
gugcugggauuacaggugua

SEQ ID NO: 1310130 - RNA, 16 nt, Human
aagaaugauuaugaau

SEQ ID NO: 1310131 - RNA, 21 nt, Human
aagaauccacauuucuaaaau

SEQ ID NO: 1310132 - RNA, 12 nt, Human
aagaaucucauc

SEQ ID NO: 1310133 - RNA, 20 nt, Human
aagaaucucaucucagugaa

SEQ ID NO: 1310134 - RNA, 20 nt, Human
aagaaucuugguuugccuuc

SEQ ID NO: 1310135 - RNA, 21 nt, Human
aagaaucuugguuugccuucc

SEQ ID NO: 1310136 - RNA, 15 nt, Human
aagaaucuuuagaga

SEQ ID NO: 1310137 - RNA, 17 nt, Human
aagaauccacauuucua

SEQ ID NO: 1310138 - RNA, 18 nt, Human
aagaauccacauuucuaa

SEQ ID NO: 1310139 - RNA, 19 nt, Human
aagaauccacauuucuaaa

SEQ ID NO: 1310140 - RNA, 13 nt, Human
guggauucuuuaa

SEQ ID NO: 1310141 - RNA, 14 nt, Human
guggcacuggggca

SEQ ID NO: 1310142 - RNA, 15 nt, Human
guggcagcccagcca

SEQ ID NO: 1310143 - RNA, 16 nt, Human
guggcagcccagccag

SEQ ID NO: 1310144 - RNA, 17 nt, Human
guggcagcccagccagc

SEQ ID NO: 1310145 - RNA, 18 nt, Human
guggcagcccagccagcg

SEQ ID NO: 1310146 - RNA, 19 nt, Human
guggauugcacguggccuc

SEQ ID NO: 1310147 - RNA, 22 nt, Human
guggcacucagucucucuucuc

SEQ ID NO: 1310148 - RNA, 20 nt, Human
aagacaaaaagcuacuuauu

SEQ ID NO: 1310149 - RNA, 23 nt, Human
aagacaaaaagcuacuuauugua

SEQ ID NO: 1310150 - RNA, 12 nt, Human
aagaauuguugg

SEQ ID NO: 1310151 - RNA, 21 nt, Human
aagaauuguuggggguuuuuu

SEQ ID NO: 1310152 - RNA, 22 nt, Human
aagaauuguuggggguuuuuuu

SEQ ID NO: 1310153 - RNA, 16 nt, Human
aagaauugaguaaugg

SEQ ID NO: 1310154 - RNA, 20 nt, Human
aagaauugugguuuauauau

SEQ ID NO: 1310155 - RNA, 22 nt, Human
aagaauugugguuuauauauuu

SEQ ID NO: 1310156 - RNA, 23 nt, Human
aagaauugugguuuauauauuua

SEQ ID NO: 1310157 - RNA, 15 nt, Human
aagaauugaguaaug

SEQ ID NO: 1310158 - RNA, 17 nt, Human
aagaauugaguaauggu

SEQ ID NO: 1310159 - RNA, 21 nt, Human
aagacaaaacauacauuuugu

SEQ ID NO: 1310160 - RNA, 15 nt, Human
aagacaaacuuugca

SEQ ID NO: 1310161 - RNA, 18 nt, Human
aagacaaacuuugcaucu

SEQ ID NO: 1310162 - RNA, 17 nt, Human
aagacaaagguuuuccu

SEQ ID NO: 1310163 - RNA, 13 nt, Human
aagacccuccccg

SEQ ID NO: 1310164 - RNA, 18 nt, Human
aagacccuaaacauccau

SEQ ID NO: 1310165 - RNA, 14 nt, Human
aagacccuggcuuu

SEQ ID NO: 1310166 - RNA, 18 nt, Human
aagaaugauuaugaauua

SEQ ID NO: 1310167 - RNA, 19 nt, Human
aagaaugaucugauugacc

SEQ ID NO: 1310168 - RNA, 17 nt, Human
aagaaugcacaagaaug

SEQ ID NO: 1310169 - RNA, 18 nt, Human
aagaaugcacaagaaugg

SEQ ID NO: 1310170 - RNA, 19 nt, Human
aagaaugcacaagaaugga

SEQ ID NO: 1310171 - RNA, 20 nt, Human
aagaaugcacaagaauggau

SEQ ID NO: 1310172 - RNA, 21 nt, Human
aagaaugcacaagaauggauc

SEQ ID NO: 1310173 - RNA, 22 nt, Human
aagaaugcacaagaauggauca

SEQ ID NO: 1310174 - RNA, 13 nt, Human
aagaaugcuuaau

SEQ ID NO: 1310175 - RNA, 17 nt, Human
aagaaugcuuaaucaga

SEQ ID NO: 1310176 - RNA, 20 nt, Human
aagaauggcagaaaaguuua

SEQ ID NO: 1310177 - RNA, 17 nt, Human
aagaauggcagaaaagu

SEQ ID NO: 1310178 - RNA, 13 nt, Human
guaggcuacagag

SEQ ID NO: 1310179 - RNA, 13 nt, Human
guaggcaggauug

SEQ ID NO: 1310180 - RNA, 18 nt, Human
guaggcaggauuggggaa

SEQ ID NO: 1310181 - RNA, 14 nt, Human
guaggcauuuccua

SEQ ID NO: 1310182 - RNA, 12 nt, Human
guaggccaaggu

SEQ ID NO: 1310183 - RNA, 18 nt, Human
guaggccaagguguccua

SEQ ID NO: 1310184 - RNA, 20 nt, Human
guaggccaagguguccuaca

SEQ ID NO: 1310185 - RNA, 23 nt, Human
guaggccaagguguccuacagaa

SEQ ID NO: 1310186 - RNA, 14 nt, Human
guaggauuuuuguu

SEQ ID NO: 1310187 - RNA, 19 nt, Human
guaggagacuguuuggaaa

SEQ ID NO: 1310188 - RNA, 20 nt, Human
guaggagacuguuuggaaau

SEQ ID NO: 1310189 - RNA, 18 nt, Human
guaggagcccagcucuga

SEQ ID NO: 1310190 - RNA, 21 nt, Human
guaggagggacugucgcugcu

SEQ ID NO: 1310191 - RNA, 16 nt, Human
guaggagggugggaag

SEQ ID NO: 1310192 - RNA, 17 nt, Human
guaggagggugggaagg

SEQ ID NO: 1310193 - RNA, 16 nt, Human
guaggaaagaggaagc

SEQ ID NO: 1310194 - RNA, 12 nt, Human
guagcuuugcuc

SEQ ID NO: 1310195 - RNA, 13 nt, Human
guaggaaaugugg

SEQ ID NO: 1310196 - RNA, 22 nt, Human
guaggaagguacuguaugauca

SEQ ID NO: 1310197 - RNA, 15 nt, Human
guaggaaguaggaag

SEQ ID NO: 1310198 - RNA, 19 nt, Human
guaggaagguacuguauga

SEQ ID NO: 1310199 - RNA, 17 nt, Human
guaggaagguacuguau

SEQ ID NO: 1310200 - RNA, 19 nt, Human
guaggaccaagcaucuugg

SEQ ID NO: 1310201 - RNA, 13 nt, Human
aaaggacuguaau

SEQ ID NO: 1310202 - RNA, 21 nt, Human
aaaggacuccugaaaaaaaac

SEQ ID NO: 1310203 - RNA, 15 nt, Human
aaaggagaaugaauc

SEQ ID NO: 1310204 - RNA, 23 nt, Human
aaaggagccugugaacccaggac

SEQ ID NO: 1310205 - RNA, 16 nt, Human
aaaggagucaaaacua

SEQ ID NO: 1310206 - RNA, 11 nt, Human
aaaggaguuua

SEQ ID NO: 1310207 - RNA, 21 nt, Human
aaaggaguuuauguuccauua

SEQ ID NO: 1310208 - RNA, 19 nt, Human
guagcucuuugucagggag

SEQ ID NO: 1310209 - RNA, 20 nt, Human
guagcucuuugucagggagu

SEQ ID NO: 1310210 - RNA, 21 nt, Human
guagcucuuugucagggagug

SEQ ID NO: 1310211 - RNA, 11 nt, Human
guagcugagcu

SEQ ID NO: 1310212 - RNA, 12 nt, Human
guagcugagcuc

SEQ ID NO: 1310213 - RNA, 13 nt, Human
guagcugagcuca

SEQ ID NO: 1310214 - RNA, 21 nt, Human
guagcugagcucacaaggcag

SEQ ID NO: 1310215 - RNA, 22 nt, Human
guagcugagcucacaaggcagc

SEQ ID NO: 1310216 - RNA, 15 nt, Human
aaaggaguuuauguu

SEQ ID NO: 1310217 - RNA, 18 nt, Human
guagcugggauuacaggc

SEQ ID NO: 1310218 - RNA, 12 nt, Human
guagcuggggcu

SEQ ID NO: 1310219 - RNA, 23 nt, Human
guagcuggggcuuugauguuccu

SEQ ID NO: 1310220 - RNA, 13 nt, Human
guagcugugaccu

SEQ ID NO: 1310221 - RNA, 14 nt, Human
guagcugugaccug

SEQ ID NO: 1310222 - RNA, 15 nt, Human
guagcugugaccugc

SEQ ID NO: 1310223 - RNA, 16 nt, Human
guagcugugaccugcu

SEQ ID NO: 1310224 - RNA, 17 nt, Human
guagcugugaccugcug

SEQ ID NO: 1310225 - RNA, 18 nt, Human
guagcugugaccugcuga

SEQ ID NO: 1310226 - RNA, 19 nt, Human
guagcugugaccugcugag

SEQ ID NO: 1310227 - RNA, 20 nt, Human
guagcugugaccugcugagc

SEQ ID NO: 1310228 - RNA, 21 nt, Human
guagcugugaccugcugagcu

SEQ ID NO: 1310229 - RNA, 17 nt, Human
guagcugggacuacagg

SEQ ID NO: 1310230 - RNA, 14 nt, Human
aaauccuugaagau

SEQ ID NO: 1310231 - RNA, 15 nt, Human
aaauccuuugugaaa

SEQ ID NO: 1310232 - RNA, 16 nt, Human
aaauccuuuacuguua

SEQ ID NO: 1310233 - RNA, 19 nt, Human
aaauccuuagaucuggcau

SEQ ID NO: 1310234 - RNA, 13 nt, Human
aaaucgaaugaaa

SEQ ID NO: 1310235 - RNA, 20 nt, Human
aaaucgaaugaaauuaacug

SEQ ID NO: 1310236 - RNA, 22 nt, Human
guaggccaagguguccuacaga

SEQ ID NO: 1310237 - RNA, 21 nt, Human
aaauccuuagaucuggcaugu

SEQ ID NO: 1310238 - RNA, 11 nt, Human
aaaugaaaauu

SEQ ID NO: 1310239 - RNA, 15 nt, Human
aaaugaaaaugucuu

SEQ ID NO: 1310240 - RNA, 16 nt, Human
aaaugaaaaugucuug

SEQ ID NO: 1310241 - RNA, 17 nt, Human
aaaugaaaaugucuugu

SEQ ID NO: 1310242 - RNA, 13 nt, Human
aaaucuaccacug

SEQ ID NO: 1310243 - RNA, 19 nt, Human
aaaucuacacuccagugag

SEQ ID NO: 1310244 - RNA, 17 nt, Human
aaaucuaccacuguaug

SEQ ID NO: 1310245 - RNA, 11 nt, Human
aaaugagaaau

SEQ ID NO: 1310246 - RNA, 20 nt, Human
aaaugacacucauauaauua

SEQ ID NO: 1310247 - RNA, 23 nt, Human
aaaugacacucauauaauuauau

SEQ ID NO: 1310248 - RNA, 23 nt, Human
aaaugaauggaggaacuuuccaa

SEQ ID NO: 1310249 - RNA, 16 nt, Human
aaaugacaaucaugug

SEQ ID NO: 1310250 - RNA, 17 nt, Human
aaaugacaaucaugugu

SEQ ID NO: 1310251 - RNA, 19 nt, Human
aaaugacaaucaugugugu

SEQ ID NO: 1310252 - RNA, 21 nt, Human
aaaugacaaucauguguguua

SEQ ID NO: 1310253 - RNA, 22 nt, Human
aaaugaaagcagggacuugaac

SEQ ID NO: 1310254 - RNA, 21 nt, Human
aaaugaaagcagggacuugaa

SEQ ID NO: 1310255 - RNA, 13 nt, Human
aaaugaaagcuac

SEQ ID NO: 1310256 - RNA, 14 nt, Human
aaaugaaagcuacu

SEQ ID NO: 1310257 - RNA, 21 nt, Human
aaaugaaauauauuuaaaaua

SEQ ID NO: 1310258 - RNA, 21 nt, Human
aaaugaacaagagaagcauuc

SEQ ID NO: 1310259 - RNA, 13 nt, Human
aaaugaacaagag

SEQ ID NO: 1310260 - RNA, 11 nt, Human
aaaugaagaaa

SEQ ID NO: 1310261 - RNA, 16 nt, Human
aaaugagaaaucuaaa

SEQ ID NO: 1310262 - RNA, 14 nt, Human
aaaugagaaaucua

SEQ ID NO: 1310263 - RNA, 13 nt, Human
aaaugagaaaucu

SEQ ID NO: 1310264 - RNA, 13 nt, Human
aaaugagccauga

SEQ ID NO: 1310265 - RNA, 19 nt, Human
aaaugaggccauggacucu

SEQ ID NO: 1310266 - RNA, 20 nt, Human
aaaugaggccauggacucug

SEQ ID NO: 1310267 - RNA, 12 nt, Human
aaaugaguaaca

SEQ ID NO: 1310268 - RNA, 13 nt, Human
aaaugaguaacau

SEQ ID NO: 1310269 - RNA, 14 nt, Human
aaaugaguaacauu

SEQ ID NO: 1310270 - RNA, 18 nt, Human
aaaugaguaacauuugcu

SEQ ID NO: 1310271 - RNA, 15 nt, Human
aaaugaguaacauuu

SEQ ID NO: 1310272 - RNA, 13 nt, Human
aaaugcauguugc

SEQ ID NO: 1310273 - RNA, 20 nt, Human
aaaugcauuauaggaucauu

SEQ ID NO: 1310274 - RNA, 15 nt, Human
aaaugcauaaaugca

SEQ ID NO: 1310275 - RNA, 19 nt, Human
aaaugcaaaaacucuuuga

SEQ ID NO: 1310276 - RNA, 14 nt, Human
aaaugcaaauaaca

SEQ ID NO: 1310277 - RNA, 13 nt, Human
aaaugaucuaaac

SEQ ID NO: 1310278 - RNA, 15 nt, Human
aaaugauucuuagug

SEQ ID NO: 1310279 - RNA, 17 nt, Human
aaaugauuacuaaggaa

SEQ ID NO: 1310280 - RNA, 14 nt, Human
aaaugauuguagua

SEQ ID NO: 1310281 - RNA, 21 nt, Human
aaaugauuuccucuguaaucu

SEQ ID NO: 1310282 - RNA, 19 nt, Human
aaauggcuuccuggcaaua

SEQ ID NO: 1310283 - RNA, 18 nt, Human
aaaugccaaauuaaaaaa

SEQ ID NO: 1310284 - RNA, 22 nt, Human
aaaugccaugaugccucugucu

SEQ ID NO: 1310285 - RNA, 14 nt, Human
aaaugcauuucuaa

SEQ ID NO: 1310286 - RNA, 16 nt, Human
aaaugccaaauuaaaa

SEQ ID NO: 1310287 - RNA, 17 nt, Human
aaaugccaaauuaaaaa

SEQ ID NO: 1310288 - RNA, 22 nt, Human
aaaugccaaauuaaaaaagaua

SEQ ID NO: 1310289 - RNA, 21 nt, Human
guauggguuagggaaaacauu

SEQ ID NO: 1310290 - RNA, 19 nt, Human
guauggguaggguaaauca

SEQ ID NO: 1310291 - RNA, 16 nt, Human
guaugggacuggccuc

SEQ ID NO: 1310292 - RNA, 15 nt, Human
guauggugcaaugug

SEQ ID NO: 1310293 - RNA, 14 nt, Human
guaugucugguucu

SEQ ID NO: 1310294 - RNA, 22 nt, Human
guaugucugguucucaauucca

SEQ ID NO: 1310295 - RNA, 17 nt, Human
guaugucugguucucaa

SEQ ID NO: 1310296 - RNA, 19 nt, Human
guauguguaucucacacuc

SEQ ID NO: 1310297 - RNA, 11 nt, Human
guauucucuga

SEQ ID NO: 1310298 - RNA, 12 nt, Human
guauucucugag

SEQ ID NO: 1310299 - RNA, 13 nt, Human
guauucucugagc

SEQ ID NO: 1310300 - RNA, 19 nt, Human
guauucucugagcugugca

SEQ ID NO: 1310301 - RNA, 18 nt, Human
guauucugggguauggcg

SEQ ID NO: 1310302 - RNA, 20 nt, Human
guauugacaaaauguuauuu

SEQ ID NO: 1310303 - RNA, 22 nt, Human
guauucuucucuuccuuuuauc

SEQ ID NO: 1310304 - RNA, 16 nt, Human
guauucuucucuuccu

SEQ ID NO: 1310305 - RNA, 13 nt, Human
guauugcacauug

SEQ ID NO: 1310306 - RNA, 14 nt, Human
guauugcacauugu

SEQ ID NO: 1310307 - RNA, 16 nt, Human
guauugcacauuguaa

SEQ ID NO: 1310308 - RNA, 18 nt, Human
guauugcacauuguaaaa

SEQ ID NO: 1310309 - RNA, 21 nt, Human
guauugcacauuguaaaaagu

SEQ ID NO: 1310310 - RNA, 14 nt, Human
guaugauucccagc

SEQ ID NO: 1310311 - RNA, 19 nt, Human
guaugaucggcaggacacc

SEQ ID NO: 1310312 - RNA, 21 nt, Human
guaugauuacuggccuuuuuc

SEQ ID NO: 1310313 - RNA, 15 nt, Human
guaugcagggagcug

SEQ ID NO: 1310314 - RNA, 19 nt, Human
guaugcacaugaacuuaga

SEQ ID NO: 1310315 - RNA, 13 nt, Human
guauggaaauaaa

SEQ ID NO: 1310316 - RNA, 20 nt, Human
guauggcguaaguacagaga

SEQ ID NO: 1310317 - RNA, 21 nt, Human
guauggcguaaguacagagaa

SEQ ID NO: 1310318 - RNA, 22 nt, Human
guauggcguaaguacagagaag

SEQ ID NO: 1310319 - RNA, 23 nt, Human
guauggcguaaguacagagaagc

SEQ ID NO: 1310320 - RNA, 24 nt, Human
guauggcguaaguacagagaagcc

SEQ ID NO: 1310321 - RNA, 18 nt, Human
guauggacuaucugucug

SEQ ID NO: 1310322 - RNA, 14 nt, Human
guauggccuguguc

SEQ ID NO: 1310323 - RNA, 15 nt, Human
guauggccuguguca

SEQ ID NO: 1310324 - RNA, 18 nt, Human
guauggcguaaguacaga

SEQ ID NO: 1310325 - RNA, 19 nt, Human
guauggcguaaguacagag

SEQ ID NO: 1310326 - RNA, 17 nt, Human
guauccccccaucuugc

SEQ ID NO: 1310327 - RNA, 18 nt, Human
guauccccccaucuugcu

SEQ ID NO: 1310328 - RNA, 13 nt, Human
guauccccugcag

SEQ ID NO: 1310329 - RNA, 13 nt, Human
guaucaaauguaa

SEQ ID NO: 1310330 - RNA, 14 nt, Human
guaucaggacccag

SEQ ID NO: 1310331 - RNA, 18 nt, Human
guaucaggacccagagga

SEQ ID NO: 1310332 - RNA, 21 nt, Human
guaucaggacccagaggaagg

SEQ ID NO: 1310333 - RNA, 22 nt, Human
guaucaggacccagaggaaggg

SEQ ID NO: 1310334 - RNA, 14 nt, Human
guauccccccaucu

SEQ ID NO: 1310335 - RNA, 22 nt, Human
guauauugauccagaaagaaaa

SEQ ID NO: 1310336 - RNA, 12 nt, Human
guauauucagga

SEQ ID NO: 1310337 - RNA, 23 nt, Human
guauauucaggacuugaaagaaa

SEQ ID NO: 1310338 - RNA, 18 nt, Human
guauauuacaaugaucac

SEQ ID NO: 1310339 - RNA, 17 nt, Human
guauauuacaaugauca

SEQ ID NO: 1310340 - RNA, 14 nt, Human
guauaagauccuag

SEQ ID NO: 1310341 - RNA, 22 nt, Human
guauaagauccuagauccuaag

SEQ ID NO: 1310342 - RNA, 18 nt, Human
guauaagauccuagaucc

SEQ ID NO: 1310343 - RNA, 18 nt, Human
guauaaaugucuuuaaug

SEQ ID NO: 1310344 - RNA, 18 nt, Human
guauaacuuuaacuucug

SEQ ID NO: 1310345 - RNA, 21 nt, Human
guauaacuuuaacuucuguuu

SEQ ID NO: 1310346 - RNA, 23 nt, Human
guauaacuuuaacuucuguuuua

SEQ ID NO: 1310347 - RNA, 18 nt, Human
guauaaaagggacugaga

SEQ ID NO: 1310348 - RNA, 21 nt, Human
guauaaaagccuguuuaagag

SEQ ID NO: 1310349 - RNA, 18 nt, Human
guauaaaagccuguuuaa

SEQ ID NO: 1310350 - RNA, 15 nt, Human
guauaaacaagaaaa

SEQ ID NO: 1310351 - RNA, 16 nt, Human
guauaaacaagaaaaa

SEQ ID NO: 1310352 - RNA, 17 nt, Human
guauaaacaagaaaaau

SEQ ID NO: 1310353 - RNA, 22 nt, Human
guauaaacaagaaaaauaaaga

SEQ ID NO: 1310354 - RNA, 23 nt, Human
guauaaacaagaaaaauaaagaa

SEQ ID NO: 1310355 - RNA, 16 nt, Human
guauaaacugauggau

SEQ ID NO: 1310356 - RNA, 17 nt, Human
guauaaagaauuguggu

SEQ ID NO: 1310357 - RNA, 16 nt, Human
guauaaaugucuuuaa

SEQ ID NO: 1310358 - RNA, 17 nt, Human
guauaaaagccuguuua

SEQ ID NO: 1310359 - RNA, 15 nt, Human
guaguucauguaaau

SEQ ID NO: 1310360 - RNA, 22 nt, Human
guaguuccacuuauagccucug

SEQ ID NO: 1310361 - RNA, 23 nt, Human
guaguuccacuuauagccucugu

SEQ ID NO: 1310362 - RNA, 13 nt, Human
guaguucuaagac

SEQ ID NO: 1310363 - RNA, 14 nt, Human
guaguucucaaagu

SEQ ID NO: 1310364 - RNA, 16 nt, Human
guaguucugcuccaga

SEQ ID NO: 1310365 - RNA, 20 nt, Human
guaguucugcuccagacagg

SEQ ID NO: 1310366 - RNA, 15 nt, Human
guaguuaucauguua

SEQ ID NO: 1310367 - RNA, 16 nt, Human
guaguuaucauguuag

SEQ ID NO: 1310368 - RNA, 14 nt, Human
guaguuaucauguu

SEQ ID NO: 1310369 - RNA, 13 nt, Human
guaguuaucaugu

SEQ ID NO: 1310370 - RNA, 12 nt, Human
guaguuaucaug

SEQ ID NO: 1310371 - RNA, 20 nt, Human
aaauguaggcuuaguuugug

SEQ ID NO: 1310372 - RNA, 19 nt, Human
aaauguagaguuuuuaaac

SEQ ID NO: 1310373 - RNA, 15 nt, Human
aaaugggcacuuaaa

SEQ ID NO: 1310374 - RNA, 20 nt, Human
aaaugggcacuuaaagcuuu

SEQ ID NO: 1310375 - RNA, 13 nt, Human
aaauggggccaga

SEQ ID NO: 1310376 - RNA, 16 nt, Human
aaauggggccagaucc

SEQ ID NO: 1310377 - RNA, 17 nt, Human
aaauggggccagaucca

SEQ ID NO: 1310378 - RNA, 21 nt, Human
aaauggggccagauccagccu

SEQ ID NO: 1310379 - RNA, 22 nt, Human
aaauggggccagauccagccug

SEQ ID NO: 1310380 - RNA, 16 nt, Human
guauuuaauucauguu

SEQ ID NO: 1310381 - RNA, 20 nt, Human
guauuuaauagguuuggaca

SEQ ID NO: 1310382 - RNA, 20 nt, Human
guauugggguuauuuucugg

SEQ ID NO: 1310383 - RNA, 19 nt, Human
guauuuaacagaaauugua

SEQ ID NO: 1310384 - RNA, 21 nt, Human
guauuuaacagaaauuguaua

SEQ ID NO: 1310385 - RNA, 20 nt, Human
guauuuaacagaaauuguau

SEQ ID NO: 1310386 - RNA, 22 nt, Human
aaauguuauuucccuacauuaa

SEQ ID NO: 1310387 - RNA, 15 nt, Human
aaauuaccuguggau

SEQ ID NO: 1310388 - RNA, 18 nt, Human
aaauuaccuguggauauu

SEQ ID NO: 1310389 - RNA, 18 nt, Human
aaauuacuuaguauugca

SEQ ID NO: 1310390 - RNA, 13 nt, Human
aaauuacuguuua

SEQ ID NO: 1310391 - RNA, 23 nt, Human
aaauuacuguuuauuaaaguaca

SEQ ID NO: 1310392 - RNA, 22 nt, Human
aaauguuaugacuauguaaacu

SEQ ID NO: 1310393 - RNA, 18 nt, Human
aaauguuaucuucucaag

SEQ ID NO: 1310394 - RNA, 23 nt, Human
aaauguuaucuucucaaguucua

SEQ ID NO: 1310395 - RNA, 20 nt, Human
aaauguuaaguugaugguga

SEQ ID NO: 1310396 - RNA, 17 nt, Human
aaauguuaucuucucaa

SEQ ID NO: 1310397 - RNA, 14 nt, Human
aaauguuauuuccc

SEQ ID NO: 1310398 - RNA, 16 nt, Human
aaauguuauuaucugg

SEQ ID NO: 1310399 - RNA, 20 nt, Human
aaauguuauuuuuuaauuau

SEQ ID NO: 1310400 - RNA, 19 nt, Human
aaauucccuucaucuggaa

SEQ ID NO: 1310401 - RNA, 16 nt, Human
aaauucccuucaucug

SEQ ID NO: 1310402 - RNA, 17 nt, Human
aaauucccguuuuguca

SEQ ID NO: 1310403 - RNA, 20 nt, Human
aaauucaggcuacugcuuca

SEQ ID NO: 1310404 - RNA, 13 nt, Human
aaauucaguuuca

SEQ ID NO: 1310405 - RNA, 14 nt, Human
aaauucaguuucau

SEQ ID NO: 1310406 - RNA, 13 nt, Human
aaauucauuuuuu

SEQ ID NO: 1310407 - RNA, 19 nt, Human
aaauucauuuuuuaaauuc

SEQ ID NO: 1310408 - RNA, 12 nt, Human
aaauucagcaaa

SEQ ID NO: 1310409 - RNA, 13 nt, Human
aaauucagcauuu

SEQ ID NO: 1310410 - RNA, 15 nt, Human
aaauucagcauuuga

SEQ ID NO: 1310411 - RNA, 22 nt, Human
aaauucacccccuuuccuggac

SEQ ID NO: 1310412 - RNA, 18 nt, Human
aaauuauagcucuaaugu

SEQ ID NO: 1310413 - RNA, 15 nt, Human
aaauuauaucaauuu

SEQ ID NO: 1310414 - RNA, 23 nt, Human
aaauuaucaggcaaauuugcauu

SEQ ID NO: 1310415 - RNA, 22 nt, Human
aaauuaucaggcaaauuugcau

SEQ ID NO: 1310416 - RNA, 21 nt, Human
aaauuauagcucuaauguuug

SEQ ID NO: 1310417 - RNA, 15 nt, Human
aaauuauagcucuaa

SEQ ID NO: 1310418 - RNA, 18 nt, Human
aaauuagccaguaauccu

SEQ ID NO: 1310419 - RNA, 14 nt, Human
aaauuagaugaacu

SEQ ID NO: 1310420 - RNA, 14 nt, Human
aaauuacuuuguga

SEQ ID NO: 1310421 - RNA, 17 nt, Human
aaauuacuuugugaaua

SEQ ID NO: 1310422 - RNA, 20 nt, Human
aaauuagacugugauucaga

SEQ ID NO: 1310423 - RNA, 18 nt, Human
aaauuucagcagcugcag

SEQ ID NO: 1310424 - RNA, 17 nt, Human
aaauuucagcagcugca

SEQ ID NO: 1310425 - RNA, 18 nt, Human
aaauucccuucaucugga

SEQ ID NO: 1310426 - RNA, 20 nt, Human
aaauuuaguauuuuguuuca

SEQ ID NO: 1310427 - RNA, 13 nt, Human
aaauuuagcauug

SEQ ID NO: 1310428 - RNA, 16 nt, Human
aaauuuagcauuguag

SEQ ID NO: 1310429 - RNA, 17 nt, Human
aaauuuacaucauuucu

SEQ ID NO: 1310430 - RNA, 22 nt, Human
aaauuuccugggagcuuuugua

SEQ ID NO: 1310431 - RNA, 21 nt, Human
aaauuuagcauuguagugcuu

SEQ ID NO: 1310432 - RNA, 22 nt, Human
aaauuuagcauuguagugcuuu

SEQ ID NO: 1310433 - RNA, 10 nt, Human
aaauuuauaa

SEQ ID NO: 1310434 - RNA, 16 nt, Human
aaauuuauauuguaaa

SEQ ID NO: 1310435 - RNA, 12 nt, Human
aaauuucagauu

SEQ ID NO: 1310436 - RNA, 16 nt, Human
gucaaauugugugaaa

SEQ ID NO: 1310437 - RNA, 22 nt, Human
gucaaaugcauacaaguuucau

SEQ ID NO: 1310438 - RNA, 22 nt, Human
gucaaaugguaggcauuuccua

SEQ ID NO: 1310439 - RNA, 14 nt, Human
gucaacaguuuucc

SEQ ID NO: 1310440 - RNA, 21 nt, Human
gucaacaguuuuccuaugcuu

SEQ ID NO: 1310441 - RNA, 22 nt, Human
gucaacaguuuuccuaugcuuu

SEQ ID NO: 1310442 - RNA, 14 nt, Human
gucaaccugggcaa

SEQ ID NO: 1310443 - RNA, 19 nt, Human
gucaaccugggcaaagccu

SEQ ID NO: 1310444 - RNA, 21 nt, Human
gucaacgagacguuuccuacc

SEQ ID NO: 1310445 - RNA, 19 nt, Human
gucaacucauauuuucaug

SEQ ID NO: 1310446 - RNA, 17 nt, Human
gucaacucuuuguuauu

SEQ ID NO: 1310447 - RNA, 14 nt, Human
gucacaaccaagaa

SEQ ID NO: 1310448 - RNA, 20 nt, Human
gucacaaugagauugaauuu

SEQ ID NO: 1310449 - RNA, 13 nt, Human
gucacacacugau

SEQ ID NO: 1310450 - RNA, 23 nt, Human
gucaaaaauuaaaccggaccauc

SEQ ID NO: 1310451 - RNA, 13 nt, Human
gucaaaaauuaaa

SEQ ID NO: 1310452 - RNA, 14 nt, Human
gucaaaaagaacca

SEQ ID NO: 1310453 - RNA, 14 nt, Human
gucaaaaauuaaac

SEQ ID NO: 1310454 - RNA, 19 nt, Human
gucaaaaagaaccacuugu

SEQ ID NO: 1310455 - RNA, 20 nt, Human
gucuccuaagcuggagugca

SEQ ID NO: 1310456 - RNA, 16 nt, Human
gucuccuaagcaccug

SEQ ID NO: 1310457 - RNA, 17 nt, Human
gucuccuaagcaccugu

SEQ ID NO: 1310458 - RNA, 12 nt, Human
gucucccuccuc

SEQ ID NO: 1310459 - RNA, 16 nt, Human
gucucccuccucugcc

SEQ ID NO: 1310460 - RNA, 16 nt, Human
gucucccucccuuggg

SEQ ID NO: 1310461 - RNA, 19 nt, Human
aacauuuuugauaaagccu

SEQ ID NO: 1310462 - RNA, 16 nt, Human
gucucagugaagacua

SEQ ID NO: 1310463 - RNA, 15 nt, Human
gucucagugaagacu

SEQ ID NO: 1310464 - RNA, 18 nt, Human
gucucaguuugugugucu

SEQ ID NO: 1310465 - RNA, 19 nt, Human
gucucaguuugugugucuu

SEQ ID NO: 1310466 - RNA, 21 nt, Human
gucucaguuugugugucuuaa

SEQ ID NO: 1310467 - RNA, 14 nt, Human
gucucaguuucuug

SEQ ID NO: 1310468 - RNA, 15 nt, Human
gucucauccaucauc

SEQ ID NO: 1310469 - RNA, 16 nt, Human
gucucauccaucauca

SEQ ID NO: 1310470 - RNA, 13 nt, Human
gucucaucugggg

SEQ ID NO: 1310471 - RNA, 15 nt, Human
gucucaucuggggag

SEQ ID NO: 1310472 - RNA, 22 nt, Human
gucucaucuggggagcaggcag

SEQ ID NO: 1310473 - RNA, 22 nt, Human
gucucaugccaguaacaggcuc

SEQ ID NO: 1310474 - RNA, 23 nt, Human
gucucaugccaguaacaggcuca

SEQ ID NO: 1310475 - RNA, 18 nt, Human
gucucccccaacagcugg

SEQ ID NO: 1310476 - RNA, 23 nt, Human
gucucccccaacagcuggacccu

SEQ ID NO: 1310477 - RNA, 20 nt, Human
gucucccccaacagcuggac

SEQ ID NO: 1310478 - RNA, 10 nt, Human
aaccaaguuc

SEQ ID NO: 1310479 - RNA, 19 nt, Human
aaccaauccuaugcauggu

SEQ ID NO: 1310480 - RNA, 13 nt, Human
aaccaauccugga

SEQ ID NO: 1310481 - RNA, 20 nt, Human
aaccaauccuaugcaugguu

SEQ ID NO: 1310482 - RNA, 16 nt, Human
aaccaaagaagaaagu

SEQ ID NO: 1310483 - RNA, 13 nt, Human
aaccaauuauuuu

SEQ ID NO: 1310484 - RNA, 17 nt, Human
aaccacacccacacuca

SEQ ID NO: 1310485 - RNA, 14 nt, Human
aaccaauuauuuuc

SEQ ID NO: 1310486 - RNA, 20 nt, Human
aaccacauuggagauguuua

SEQ ID NO: 1310487 - RNA, 17 nt, Human
aaccacauggcacagag

SEQ ID NO: 1310488 - RNA, 20 nt, Human
aaccuagggugauauuaacc

SEQ ID NO: 1310489 - RNA, 16 nt, Human
aaccccccagauauca

SEQ ID NO: 1310490 - RNA, 22 nt, Human
aaccuaugauauuuucugugcc

SEQ ID NO: 1310491 - RNA, 14 nt, Human
aaccccccagauau

SEQ ID NO: 1310492 - RNA, 22 nt, Human
aaccuauuucuuaaacacuugc

SEQ ID NO: 1310493 - RNA, 15 nt, Human
aaccccagacacugg

SEQ ID NO: 1310494 - RNA, 16 nt, Human
aaccucaacugccuac

SEQ ID NO: 1310495 - RNA, 17 nt, Human
aaccucaacugccuacu

SEQ ID NO: 1310496 - RNA, 18 nt, Human
aaccucaacugccuacuc

SEQ ID NO: 1310497 - RNA, 20 nt, Human
aaccucaccaacuccuaguu

SEQ ID NO: 1310498 - RNA, 17 nt, Human
aaccucaccaacuccua

SEQ ID NO: 1310499 - RNA, 11 nt, Human
aaccucagccu

SEQ ID NO: 1310500 - RNA, 12 nt, Human
aaccucagccug

SEQ ID NO: 1310501 - RNA, 13 nt, Human
aaccucagccugg

SEQ ID NO: 1310502 - RNA, 14 nt, Human
aaccucagccuggc

SEQ ID NO: 1310503 - RNA, 16 nt, Human
aaccucagccuggcca

SEQ ID NO: 1310504 - RNA, 14 nt, Human
aaccacauggcaca

SEQ ID NO: 1310505 - RNA, 20 nt, Human
aaccauguaaagaacauaaa

SEQ ID NO: 1310506 - RNA, 17 nt, Human
aaccauguagaaaauuu

SEQ ID NO: 1310507 - RNA, 17 nt, Human
aaccaugucauuucaga

SEQ ID NO: 1310508 - RNA, 13 nt, Human
aacccaaauguuc

SEQ ID NO: 1310509 - RNA, 18 nt, Human
aacccaaauguucaucaa

SEQ ID NO: 1310510 - RNA, 23 nt, Human
aacccaaauguucaucaaugaau

SEQ ID NO: 1310511 - RNA, 20 nt, Human
aacccagguuggcgacugca

SEQ ID NO: 1310512 - RNA, 15 nt, Human
aacccaguugccauc

SEQ ID NO: 1310513 - RNA, 20 nt, Human
aacccauauuuguacaccaa

SEQ ID NO: 1310514 - RNA, 17 nt, Human
aacccauauuguaaaac

SEQ ID NO: 1310515 - RNA, 21 nt, Human
aacccauauuguaaaacaggu

SEQ ID NO: 1310516 - RNA, 20 nt, Human
aacccaucaacaaaaauugu

SEQ ID NO: 1310517 - RNA, 19 nt, Human
aaccccaacuacuguguua

SEQ ID NO: 1310518 - RNA, 14 nt, Human
aacuccagaaagug

SEQ ID NO: 1310519 - RNA, 16 nt, Human
aacuagccccuggggu

SEQ ID NO: 1310520 - RNA, 13 nt, Human
aacuagccccugg

SEQ ID NO: 1310521 - RNA, 15 nt, Human
aacuagcauuguaaa

SEQ ID NO: 1310522 - RNA, 21 nt, Human
aacuagccaaaccaggacccu

SEQ ID NO: 1310523 - RNA, 18 nt, Human
aacuagccaaaccaggac

SEQ ID NO: 1310524 - RNA, 21 nt, Human
aacuccagaaagugacaagcu

SEQ ID NO: 1310525 - RNA, 15 nt, Human
aacuaggaaguggcu

SEQ ID NO: 1310526 - RNA, 22 nt, Human
aacuaggagcuuugacucagga

SEQ ID NO: 1310527 - RNA, 23 nt, Human
aacuaggagcuuugacucaggag

SEQ ID NO: 1310528 - RNA, 14 nt, Human
aacuaggaucagaa

SEQ ID NO: 1310529 - RNA, 13 nt, Human
aacucccugcccc

SEQ ID NO: 1310530 - RNA, 19 nt, Human
aacucccugccccccagcc

SEQ ID NO: 1310531 - RNA, 21 nt, Human
aacucccauuaccauguaaug

SEQ ID NO: 1310532 - RNA, 15 nt, Human
aacucccauuaccau

SEQ ID NO: 1310533 - RNA, 18 nt, Human
aacucguuaauuuguagu

SEQ ID NO: 1310534 - RNA, 19 nt, Human
aacucgugucuggcacagc

SEQ ID NO: 1310535 - RNA, 15 nt, Human
aacucguuuuuuaca

SEQ ID NO: 1310536 - RNA, 14 nt, Human
aacucccuuucaac

SEQ ID NO: 1310537 - RNA, 13 nt, Human
aacucccuuucaa

SEQ ID NO: 1310538 - RNA, 22 nt, Human
aacucuauauuguucagcaugc

SEQ ID NO: 1310539 - RNA, 23 nt, Human
aacucuauauuguucagcaugca

SEQ ID NO: 1310540 - RNA, 15 nt, Human
aaccuggagauggug

SEQ ID NO: 1310541 - RNA, 17 nt, Human
aaccuggagauggugga

SEQ ID NO: 1310542 - RNA, 11 nt, Human
aaccugcucuc

SEQ ID NO: 1310543 - RNA, 19 nt, Human
aaccugccugacauuugga

SEQ ID NO: 1310544 - RNA, 15 nt, Human
aaccugcucuccucu

SEQ ID NO: 1310545 - RNA, 13 nt, Human
aaccugcucuccu

SEQ ID NO: 1310546 - RNA, 14 nt, Human
aaccugcucuccuc

SEQ ID NO: 1310547 - RNA, 16 nt, Human
aaccugcucuccucuu

SEQ ID NO: 1310548 - RNA, 17 nt, Human
aaccugcucuccucuuc

SEQ ID NO: 1310549 - RNA, 20 nt, Human
aaccugcucuccucuugcca

SEQ ID NO: 1310550 - RNA, 13 nt, Human
aaccugcuuuuca

SEQ ID NO: 1310551 - RNA, 18 nt, Human
aacuaaacucuuaccaua

SEQ ID NO: 1310552 - RNA, 23 nt, Human
aacuaaacucuuaccauauguuu

SEQ ID NO: 1310553 - RNA, 20 nt, Human
aacuaaagugcugcacucaa

SEQ ID NO: 1310554 - RNA, 21 nt, Human
aacuaaaugugcaauagaagg

SEQ ID NO: 1310555 - RNA, 14 nt, Human
aacuaauaauugca

SEQ ID NO: 1310556 - RNA, 12 nt, Human
aacuaaugccuu

SEQ ID NO: 1310557 - RNA, 15 nt, Human
aacuaaugccuuacu

SEQ ID NO: 1310558 - RNA, 23 nt, Human
aacuaauuuuuauuuuugcugag

SEQ ID NO: 1310559 - RNA, 15 nt, Human
aacuaauuuaguaau

SEQ ID NO: 1310560 - RNA, 16 nt, Human
aacuacaaagguuuaa

SEQ ID NO: 1310561 - RNA, 17 nt, Human
aacuacaaagguuuaaa

SEQ ID NO: 1310562 - RNA, 18 nt, Human
aacuacaaagguuuaaau

SEQ ID NO: 1310563 - RNA, 20 nt, Human
aacuacaaagguuuaaauga

SEQ ID NO: 1310564 - RNA, 21 nt, Human
aacuacaaagguuuaaaugaa

SEQ ID NO: 1310565 - RNA, 13 nt, Human
aacuacaaaucaa

SEQ ID NO: 1310566 - RNA, 20 nt, Human
aacuacaaccaauggaaugu

SEQ ID NO: 1310567 - RNA, 14 nt, Human
aacuacagucuaaa

SEQ ID NO: 1310568 - RNA, 13 nt, Human
aacuacaugagaa

SEQ ID NO: 1310569 - RNA, 22 nt, Human
aacuacaugagaacaaacagau

SEQ ID NO: 1310570 - RNA, 13 nt, Human
aacuacaguggcu

SEQ ID NO: 1310571 - RNA, 12 nt, Human
gucugcucccaa

SEQ ID NO: 1310572 - RNA, 18 nt, Human
aaccucuucagaggcccu

SEQ ID NO: 1310573 - RNA, 19 nt, Human
gucugcucccaaggggccu

SEQ ID NO: 1310574 - RNA, 21 nt, Human
gucugcucccaaggggccuga

SEQ ID NO: 1310575 - RNA, 15 nt, Human
gucugcucuuucucu

SEQ ID NO: 1310576 - RNA, 17 nt, Human
gucugcucuuucucugc

SEQ ID NO: 1310577 - RNA, 19 nt, Human
gucugcucuuucucugcca

SEQ ID NO: 1310578 - RNA, 20 nt, Human
gucugcucuuucucugccag

SEQ ID NO: 1310579 - RNA, 22 nt, Human
gucugcucuuucucugccagug

SEQ ID NO: 1310580 - RNA, 13 nt, Human
gucugcuguagaa

SEQ ID NO: 1310581 - RNA, 16 nt, Human
gucugcuguuccagug

SEQ ID NO: 1310582 - RNA, 14 nt, Human
gucugcuguagaaa

SEQ ID NO: 1310583 - RNA, 13 nt, Human
gucuggcuggugu

SEQ ID NO: 1310584 - RNA, 14 nt, Human
gucuggcugguguu

SEQ ID NO: 1310585 - RNA, 15 nt, Human
gucuggcugguguua

SEQ ID NO: 1310586 - RNA, 16 nt, Human
gucuggcugguguuaa

SEQ ID NO: 1310587 - RNA, 15 nt, Human
gucuggcuucacaga

SEQ ID NO: 1310588 - RNA, 21 nt, Human
gucuggcugguguuaacagaa

SEQ ID NO: 1310589 - RNA, 13 nt, Human
gucuuaauuauua

SEQ ID NO: 1310590 - RNA, 18 nt, Human
gucuuaauuauuauuugu

SEQ ID NO: 1310591 - RNA, 21 nt, Human
gucuuaauuauuauuuguguu

SEQ ID NO: 1310592 - RNA, 14 nt, Human
gucuuccucugucu

SEQ ID NO: 1310593 - RNA, 14 nt, Human
gucuuccugacacu

SEQ ID NO: 1310594 - RNA, 18 nt, Human
gucuuccugacacuuuaa

SEQ ID NO: 1310595 - RNA, 19 nt, Human
gucuuccugacacuuuaau

SEQ ID NO: 1310596 - RNA, 12 nt, Human
gucuuccugagu

SEQ ID NO: 1310597 - RNA, 19 nt, Human
gucuuauauauuguagaua

SEQ ID NO: 1310598 - RNA, 19 nt, Human
gucuuaauuauuauuugug

SEQ ID NO: 1310599 - RNA, 19 nt, Human
gucuuccugaguggugcca

SEQ ID NO: 1310600 - RNA, 16 nt, Human
gucuuuucccauuuau

SEQ ID NO: 1310601 - RNA, 21 nt, Human
guccaagcauuuagauguaua

SEQ ID NO: 1310602 - RNA, 15 nt, Human
guccaagcugggaga

SEQ ID NO: 1310603 - RNA, 20 nt, Human
guccaagguuuaaagagucu

SEQ ID NO: 1310604 - RNA, 21 nt, Human
guccaagguuuaaagagucua

SEQ ID NO: 1310605 - RNA, 12 nt, Human
guccaauccuau

SEQ ID NO: 1310606 - RNA, 17 nt, Human
guccaauccuauguuuu

SEQ ID NO: 1310607 - RNA, 15 nt, Human
guccaaugagcuuuc

SEQ ID NO: 1310608 - RNA, 16 nt, Human
guccaaugagcuuucu

SEQ ID NO: 1310609 - RNA, 17 nt, Human
guccaaugagcuuucug

SEQ ID NO: 1310610 - RNA, 18 nt, Human
guccaaugagcuuucuga

SEQ ID NO: 1310611 - RNA, 19 nt, Human
guccaaugagcuuucugaa

SEQ ID NO: 1310612 - RNA, 21 nt, Human
guccaaugagcuuucugaaca

SEQ ID NO: 1310613 - RNA, 15 nt, Human
guccacaacacacag

SEQ ID NO: 1310614 - RNA, 12 nt, Human
guccaauguggc

SEQ ID NO: 1310615 - RNA, 23 nt, Human
guccaaugagcuuucugaacagc

SEQ ID NO: 1310616 - RNA, 16 nt, Human
guccaauuaguuuccu

SEQ ID NO: 1310617 - RNA, 17 nt, Human
guccaauuaguuuccuu

SEQ ID NO: 1310618 - RNA, 20 nt, Human
guccacaaaauaaccaaucc

SEQ ID NO: 1310619 - RNA, 16 nt, Human
guccauuguccaaucc

SEQ ID NO: 1310620 - RNA, 21 nt, Human
guccauuguccaauccuaugu

SEQ ID NO: 1310621 - RNA, 16 nt, Human
guccauuuacacguau

SEQ ID NO: 1310622 - RNA, 11 nt, Human
aacacuuccau

SEQ ID NO: 1310623 - RNA, 12 nt, Human
aacacuuguaau

SEQ ID NO: 1310624 - RNA, 21 nt, Human
gucauuugcugagcauguacu

SEQ ID NO: 1310625 - RNA, 22 nt, Human
gucauuugcugagcauguacug

SEQ ID NO: 1310626 - RNA, 12 nt, Human
aacacucuuuug

SEQ ID NO: 1310627 - RNA, 22 nt, Human
aacacuguaguaaauaaugcuu

SEQ ID NO: 1310628 - RNA, 20 nt, Human
aacacugugcacaucugugu

SEQ ID NO: 1310629 - RNA, 22 nt, Human
aacacugugcacaucugugucu

SEQ ID NO: 1310630 - RNA, 12 nt, Human
aacacugccagc

SEQ ID NO: 1310631 - RNA, 22 nt, Human
aacacugccagcauuucccuuc

SEQ ID NO: 1310632 - RNA, 16 nt, Human
aacacucuuuugcuuu

SEQ ID NO: 1310633 - RNA, 19 nt, Human
aacacucuuuugcuuuauu

SEQ ID NO: 1310634 - RNA, 19 nt, Human
aacacuguaguaaauaaug

SEQ ID NO: 1310635 - RNA, 14 nt, Human
aacaaugcuguauu

SEQ ID NO: 1310636 - RNA, 17 nt, Human
aacaaucuuccuguuua

SEQ ID NO: 1310637 - RNA, 22 nt, Human
aacaaugaauaaaaacucaagg

SEQ ID NO: 1310638 - RNA, 24 nt, Human
aacaaugaauaaaaacucaaggag

SEQ ID NO: 1310639 - RNA, 17 nt, Human
aacaaugacaaagcaga

SEQ ID NO: 1310640 - RNA, 18 nt, Human
aacaaugacaaagcagau

SEQ ID NO: 1310641 - RNA, 15 nt, Human
aacaaugacauuuau

SEQ ID NO: 1310642 - RNA, 18 nt, Human
aacaaugaaaacucuuug

SEQ ID NO: 1310643 - RNA, 14 nt, Human
aacaaucuuccugu

SEQ ID NO: 1310644 - RNA, 18 nt, Human
aacaauuguguagccuuu

SEQ ID NO: 1310645 - RNA, 20 nt, Human
aacaauuguguagccuuuuu

SEQ ID NO: 1310646 - RNA, 23 nt, Human
aacaauuguguagccuuuuugua

SEQ ID NO: 1310647 - RNA, 13 nt, Human
aacaauuuaugaa

SEQ ID NO: 1310648 - RNA, 16 nt, Human
aacaauuuaugaauug

SEQ ID NO: 1310649 - RNA, 22 nt, Human
aacaauuguguagccuuuuugu

SEQ ID NO: 1310650 - RNA, 14 nt, Human
aacaauuuggcaau

SEQ ID NO: 1310651 - RNA, 18 nt, Human
aacaauuuggcaauuuug

SEQ ID NO: 1310652 - RNA, 19 nt, Human
aacaauuuggcaauuuugu

SEQ ID NO: 1310653 - RNA, 23 nt, Human
aacaauuuuaggaggaccagagc

SEQ ID NO: 1310654 - RNA, 15 nt, Human
aacaagucagucauu

SEQ ID NO: 1310655 - RNA, 12 nt, Human
aacaaguauuug

SEQ ID NO: 1310656 - RNA, 20 nt, Human
aacaaguauuuguuaauuua

SEQ ID NO: 1310657 - RNA, 23 nt, Human
aacaaguauuuguuaauuuagaa

SEQ ID NO: 1310658 - RNA, 18 nt, Human
aacaagucagucauucag

SEQ ID NO: 1310659 - RNA, 20 nt, Human
aacaauaccugaaugcucug

SEQ ID NO: 1310660 - RNA, 21 nt, Human
aacaauaccugaaugcucugu

SEQ ID NO: 1310661 - RNA, 12 nt, Human
aacaauaccuga

SEQ ID NO: 1310662 - RNA, 17 nt, Human
aacaauacaaauggauu

SEQ ID NO: 1310663 - RNA, 13 nt, Human
aacaauacaaaug

SEQ ID NO: 1310664 - RNA, 14 nt, Human
aacaauacaaaugg

SEQ ID NO: 1310665 - RNA, 15 nt, Human
aacaauacaaaugga

SEQ ID NO: 1310666 - RNA, 16 nt, Human
aacaauacaaauggau

SEQ ID NO: 1310667 - RNA, 15 nt, Human
aacaaggaugaauua

SEQ ID NO: 1310668 - RNA, 14 nt, Human
aacaaggaagucaa

SEQ ID NO: 1310669 - RNA, 16 nt, Human
aaauuuuucugcuuua

SEQ ID NO: 1310670 - RNA, 21 nt, Human
aacaagccuccuuuuaaagua

SEQ ID NO: 1310671 - RNA, 17 nt, Human
aaauuuuuguaguagcg

SEQ ID NO: 1310672 - RNA, 23 nt, Human
aaauuuuuaaucuuuaauuuuac

SEQ ID NO: 1310673 - RNA, 17 nt, Human
gucacagggcaguaccu

SEQ ID NO: 1310674 - RNA, 18 nt, Human
aaauuuuuaggaaacuca

SEQ ID NO: 1310675 - RNA, 20 nt, Human
aaauuuuguuuauaagaaau

SEQ ID NO: 1310676 - RNA, 17 nt, Human
aaauuuuucuucuugag

SEQ ID NO: 1310677 - RNA, 11 nt, Human
gucacagggca

SEQ ID NO: 1310678 - RNA, 12 nt, Human
gucacagggcag

SEQ ID NO: 1310679 - RNA, 13 nt, Human
gucacagggcagu

SEQ ID NO: 1310680 - RNA, 19 nt, Human
aacaguuguguuugaagca

SEQ ID NO: 1310681 - RNA, 22 nt, Human
aacaguugguaacuuuugugaa

SEQ ID NO: 1310682 - RNA, 13 nt, Human
aacaguuguauuu

SEQ ID NO: 1310683 - RNA, 13 nt, Human
aacaguguuuaaa

SEQ ID NO: 1310684 - RNA, 21 nt, Human
aacaguugguaacuuuuguga

SEQ ID NO: 1310685 - RNA, 23 nt, Human
aacaguuguauuuaacagaaauu

SEQ ID NO: 1310686 - RNA, 20 nt, Human
aacaguuguauuuaacagaa

SEQ ID NO: 1310687 - RNA, 13 nt, Human
aacaguuuaauga

SEQ ID NO: 1310688 - RNA, 15 nt, Human
aacaguuuaaugaag

SEQ ID NO: 1310689 - RNA, 18 nt, Human
aacaguuuaaugaagauc

SEQ ID NO: 1310690 - RNA, 21 nt, Human
aacaguuuaaugaagaucuaa

SEQ ID NO: 1310691 - RNA, 20 nt, Human
aacaguuuaaugaagaucua

SEQ ID NO: 1310692 - RNA, 18 nt, Human
aacaguaaaccacugaaa

SEQ ID NO: 1310693 - RNA, 19 nt, Human
aacaguaaaccacugaaaa

SEQ ID NO: 1310694 - RNA, 18 nt, Human
aacaguaucucaaacaau

SEQ ID NO: 1310695 - RNA, 14 nt, Human
aacaguggaucaca

SEQ ID NO: 1310696 - RNA, 16 nt, Human
aacagugugcaaggca

SEQ ID NO: 1310697 - RNA, 19 nt, Human
aacagugugcaaggcagcc

SEQ ID NO: 1310698 - RNA, 18 nt, Human
aacagugugcaaggcagc

SEQ ID NO: 1310699 - RNA, 22 nt, Human
aacaguagugauaguuguaccg

SEQ ID NO: 1310700 - RNA, 13 nt, Human
aacaguaaaccac

SEQ ID NO: 1310701 - RNA, 15 nt, Human
aacaguaaaccacug

SEQ ID NO: 1310702 - RNA, 16 nt, Human
aacaguaaaccacuga

SEQ ID NO: 1310703 - RNA, 17 nt, Human
aacaguaaaccacugaa

SEQ ID NO: 1310704 - RNA, 23 nt, Human
aacaguaaaccacugaaaaaaua

SEQ ID NO: 1310705 - RNA, 22 nt, Human
guccgcugggugguacccucug

SEQ ID NO: 1310706 - RNA, 15 nt, Human
guccggcagcuucug

SEQ ID NO: 1310707 - RNA, 18 nt, Human
guccggcagcuucugccc

SEQ ID NO: 1310708 - RNA, 23 nt, Human
aacagaaaaauauguaccaagaa

SEQ ID NO: 1310709 - RNA, 13 nt, Human
aacagaaacaaaa

SEQ ID NO: 1310710 - RNA, 15 nt, Human
gucccaacuuguaaa

SEQ ID NO: 1310711 - RNA, 15 nt, Human
guccgaucuuugacu

SEQ ID NO: 1310712 - RNA, 16 nt, Human
aacagaaacaaaaaca

SEQ ID NO: 1310713 - RNA, 22 nt, Human
aacagaaagccugggugacauu

SEQ ID NO: 1310714 - RNA, 15 nt, Human
aacagaaauuguaua

SEQ ID NO: 1310715 - RNA, 17 nt, Human
aacagaaauuguauauu

SEQ ID NO: 1310716 - RNA, 18 nt, Human
aacagaaauuguauauug

SEQ ID NO: 1310717 - RNA, 19 nt, Human
aacagaaauuguauauugu

SEQ ID NO: 1310718 - RNA, 21 nt, Human
aacagaaauuguauauuguaa

SEQ ID NO: 1310719 - RNA, 12 nt, Human
aacagaacacuu

SEQ ID NO: 1310720 - RNA, 13 nt, Human
aacagaacacuua

SEQ ID NO: 1310721 - RNA, 18 nt, Human
aacagaacauagacagaa

SEQ ID NO: 1310722 - RNA, 22 nt, Human
aacauuuguucuauagcuuuuc

SEQ ID NO: 1310723 - RNA, 14 nt, Human
aacauuugcuguuu

SEQ ID NO: 1310724 - RNA, 15 nt, Human
aacauuugcuguuuu

SEQ ID NO: 1310725 - RNA, 16 nt, Human
aacauuugcuguuuua

SEQ ID NO: 1310726 - RNA, 15 nt, Human
guccucugagacucc

SEQ ID NO: 1310727 - RNA, 19 nt, Human
guccucugagacuccagac

SEQ ID NO: 1310728 - RNA, 18 nt, Human
guccucugucagucacag

SEQ ID NO: 1310729 - RNA, 19 nt, Human
guccucugucagucacagc

SEQ ID NO: 1310730 - RNA, 20 nt, Human
guccucugucagucacagcc

SEQ ID NO: 1310731 - RNA, 23 nt, Human
guccucugucagucacagccacc

SEQ ID NO: 1310732 - RNA, 18 nt, Human
guccucuuccaccacaga

SEQ ID NO: 1310733 - RNA, 18 nt, Human
guccucuucccucucugc

SEQ ID NO: 1310734 - RNA, 19 nt, Human
guccucuucccucucugca

SEQ ID NO: 1310735 - RNA, 20 nt, Human
guccucuucccucucugcag

SEQ ID NO: 1310736 - RNA, 13 nt, Human
guccucuucuggg

SEQ ID NO: 1310737 - RNA, 16 nt, Human
guccugagaaagcuca

SEQ ID NO: 1310738 - RNA, 13 nt, Human
guccugagcacug

SEQ ID NO: 1310739 - RNA, 14 nt, Human
guccugagcacugc

SEQ ID NO: 1310740 - RNA, 16 nt, Human
guccugagcacugcca

SEQ ID NO: 1310741 - RNA, 17 nt, Human
guccugagcacugccag

SEQ ID NO: 1310742 - RNA, 18 nt, Human
guccugagcacugccagg

SEQ ID NO: 1310743 - RNA, 19 nt, Human
guccugagcacugccagga

SEQ ID NO: 1310744 - RNA, 20 nt, Human
guccugagcacugccaggag

SEQ ID NO: 1310745 - RNA, 21 nt, Human
guccugagcacugccaggagg

SEQ ID NO: 1310746 - RNA, 22 nt, Human
guccugagcacugccaggaggg

SEQ ID NO: 1310747 - RNA, 23 nt, Human
guccugagcacugccaggaggga

SEQ ID NO: 1310748 - RNA, 18 nt, Human
guccugagccccagggag

SEQ ID NO: 1310749 - RNA, 13 nt, Human
guccugagcucag

SEQ ID NO: 1310750 - RNA, 14 nt, Human
guccugagcucagc

SEQ ID NO: 1310751 - RNA, 15 nt, Human
guccugagcucagcg

SEQ ID NO: 1310752 - RNA, 16 nt, Human
guccugagcucagcgu

SEQ ID NO: 1310753 - RNA, 19 nt, Human
guccugagcucagcgugga

SEQ ID NO: 1310754 - RNA, 18 nt, Human
guccugagcucagcgugg

SEQ ID NO: 1310755 - RNA, 15 nt, Human
guccugaucagagcc

SEQ ID NO: 1310756 - RNA, 17 nt, Human
guccugccacccagccc

SEQ ID NO: 1310757 - RNA, 20 nt, Human
guccugccacccagccccag

SEQ ID NO: 1310758 - RNA, 11 nt, Human
guccugccugu

SEQ ID NO: 1310759 - RNA, 13 nt, Human
guccugccugugg

SEQ ID NO: 1310760 - RNA, 14 nt, Human
guccugccuguggc

SEQ ID NO: 1310761 - RNA, 15 nt, Human
guccugccuguggcg

SEQ ID NO: 1310762 - RNA, 16 nt, Human
guccuuagccuggacc

SEQ ID NO: 1310763 - RNA, 19 nt, Human
guccuuagccuggaccucu

SEQ ID NO: 1310764 - RNA, 20 nt, Human
guccuuagccuggaccucug

SEQ ID NO: 1310765 - RNA, 23 nt, Human
guccuuagccuggaccucugaca

SEQ ID NO: 1310766 - RNA, 18 nt, Human
guccuuaggccucugaga

SEQ ID NO: 1310767 - RNA, 17 nt, Human
guccuuaggccucugag

SEQ ID NO: 1310768 - RNA, 13 nt, Human
guccuucaaaggc

SEQ ID NO: 1310769 - RNA, 20 nt, Human
aacauuuguucuauagcuuu

SEQ ID NO: 1310770 - RNA, 18 nt, Human
aacauuugguaaggggaa

SEQ ID NO: 1310771 - RNA, 16 nt, Human
aacauuucucaauaau

SEQ ID NO: 1310772 - RNA, 19 nt, Human
aacauuuauuuugacauaa

SEQ ID NO: 1310773 - RNA, 22 nt, Human
aacauuucuauagccaaaaaua

SEQ ID NO: 1310774 - RNA, 16 nt, Human
aacauuguagccucaa

SEQ ID NO: 1310775 - RNA, 13 nt, Human
aacauuguguucc

SEQ ID NO: 1310776 - RNA, 23 nt, Human
aacauuguguucccauuucagcu

SEQ ID NO: 1310777 - RNA, 15 nt, Human
aacauuuauuuugac

SEQ ID NO: 1310778 - RNA, 17 nt, Human
aacauuuauuuugacau

SEQ ID NO: 1310779 - RNA, 19 nt, Human
aacauacauuuuguaccaa

SEQ ID NO: 1310780 - RNA, 16 nt, Human
aacauacauuuuguac

SEQ ID NO: 1310781 - RNA, 12 nt, Human
aacaguuuuccu

SEQ ID NO: 1310782 - RNA, 20 nt, Human
aacauaccccuuacaaauga

SEQ ID NO: 1310783 - RNA, 21 nt, Human
aacauaccccuuacaaaugaa

SEQ ID NO: 1310784 - RNA, 17 nt, Human
aacauaccuaagaagua

SEQ ID NO: 1310785 - RNA, 16 nt, Human
caagaccgaucggcgg

SEQ ID NO: 1310786 - RNA, 15 nt, Human
caagaaaugaaagca

SEQ ID NO: 1310787 - RNA, 21 nt, Human
caagaaauaaaaggaagccaa

SEQ ID NO: 1310788 - RNA, 18 nt, Human
caagaaauaaguuuuugu

SEQ ID NO: 1310789 - RNA, 13 nt, Human
caagaaaugaaag

SEQ ID NO: 1310790 - RNA, 13 nt, Human
caagaaauaaaag

SEQ ID NO: 1310791 - RNA, 19 nt, Human
caagaaauaaaaggaagcc

SEQ ID NO: 1310792 - RNA, 20 nt, Human
caagaaauaaaaggaagcca

SEQ ID NO: 1310793 - RNA, 20 nt, Human
caacuugcaaaaucaguuuu

SEQ ID NO: 1310794 - RNA, 19 nt, Human
caacuugcaaaaucaguuu

SEQ ID NO: 1310795 - RNA, 18 nt, Human
caacuugcaaaaucaguu

SEQ ID NO: 1310796 - RNA, 20 nt, Human
caagaaaggcugcuguacug

SEQ ID NO: 1310797 - RNA, 15 nt, Human
caacuugcaaaauca

SEQ ID NO: 1310798 - RNA, 12 nt, Human
caacuugcaaaa

SEQ ID NO: 1310799 - RNA, 19 nt, Human
caacuugagcauguuacug

SEQ ID NO: 1310800 - RNA, 18 nt, Human
caacuugagcauguuacu

SEQ ID NO: 1310801 - RNA, 20 nt, Human
caacuugagcauguuacuga

SEQ ID NO: 1310802 - RNA, 17 nt, Human
caagaccucagugccuu

SEQ ID NO: 1310803 - RNA, 21 nt, Human
caagacccuuuuggguuucug

SEQ ID NO: 1310804 - RNA, 12 nt, Human
caagacugcugu

SEQ ID NO: 1310805 - RNA, 19 nt, Human
caagacugcuguggccagg

SEQ ID NO: 1310806 - RNA, 20 nt, Human
caagacugcuguggccagga

SEQ ID NO: 1310807 - RNA, 21 nt, Human
caagacugcuguggccaggag

SEQ ID NO: 1310808 - RNA, 22 nt, Human
caagacugcuguggccaggagg

SEQ ID NO: 1310809 - RNA, 21 nt, Human
caagcagccugagcaacucuu

SEQ ID NO: 1310810 - RNA, 22 nt, Human
caagcagcgaccgcccccuccu

SEQ ID NO: 1310811 - RNA, 13 nt, Human
caagcagcuuaga

SEQ ID NO: 1310812 - RNA, 18 nt, Human
caagcagcuuagaguugg

SEQ ID NO: 1310813 - RNA, 20 nt, Human
caagcagcuuagaguuggcc

SEQ ID NO: 1310814 - RNA, 14 nt, Human
caagagaaacuucc

SEQ ID NO: 1310815 - RNA, 16 nt, Human
caagagaaacuuccua

SEQ ID NO: 1310816 - RNA, 23 nt, Human
caagacugcuguggccaggaggu

SEQ ID NO: 1310817 - RNA, 20 nt, Human
caagacuucucuuugccuca

SEQ ID NO: 1310818 - RNA, 21 nt, Human
caagacuucucuuugccucaa

SEQ ID NO: 1310819 - RNA, 13 nt, Human
caagagcccuguc

SEQ ID NO: 1310820 - RNA, 18 nt, Human
caagagggcacugguggc

SEQ ID NO: 1310821 - RNA, 19 nt, Human
caagagggcacugguggcc

SEQ ID NO: 1310822 - RNA, 20 nt, Human
caagagggcacugguggccc

SEQ ID NO: 1310823 - RNA, 16 nt, Human
caagcauuuagaugua

SEQ ID NO: 1310824 - RNA, 19 nt, Human
caagcauuuagauguauag

SEQ ID NO: 1310825 - RNA, 14 nt, Human
caagcauucugucu

SEQ ID NO: 1310826 - RNA, 21 nt, Human
caagccauggguagccugggu

SEQ ID NO: 1310827 - RNA, 20 nt, Human
caagccaucuugagugguca

SEQ ID NO: 1310828 - RNA, 17 nt, Human
caagcccagcacugcuu

SEQ ID NO: 1310829 - RNA, 19 nt, Human
caagcccagcccauggaga

SEQ ID NO: 1310830 - RNA, 17 nt, Human
caagcaggaaaugaaaa

SEQ ID NO: 1310831 - RNA, 23 nt, Human
caagcaggaaaugaaaaugucuu

SEQ ID NO: 1310832 - RNA, 15 nt, Human
caagcagucgugccu

SEQ ID NO: 1310833 - RNA, 16 nt, Human
caagcagucgugccug

SEQ ID NO: 1310834 - RNA, 18 nt, Human
caagcagucgugccugug

SEQ ID NO: 1310835 - RNA, 19 nt, Human
caagcagucgugccugugu

SEQ ID NO: 1310836 - RNA, 20 nt, Human
caagcagucgugccuguguc

SEQ ID NO: 1310837 - RNA, 21 nt, Human
caagcagucgugccugugucc

SEQ ID NO: 1310838 - RNA, 22 nt, Human
caagcaguugggacuacaggcg

SEQ ID NO: 1310839 - RNA, 17 nt, Human
caagcauauaaaauuuu

SEQ ID NO: 1310840 - RNA, 21 nt, Human
caagcaucuuggggggguggc

SEQ ID NO: 1310841 - RNA, 18 nt, Human
caagcauggcuauuuuau

SEQ ID NO: 1310842 - RNA, 21 nt, Human
caagcauggcuauuuuauauu

SEQ ID NO: 1310843 - RNA, 23 nt, Human
caagcauggucccacaucccugg

SEQ ID NO: 1310844 - RNA, 22 nt, Human
caagcauggucccacaucccug

SEQ ID NO: 1310845 - RNA, 16 nt, Human
caagcauucagaagaa

SEQ ID NO: 1310846 - RNA, 22 nt, Human
caagcauucagaagaaaaagaa

SEQ ID NO: 1310847 - RNA, 17 nt, Human
caagcauucagaagaaa

SEQ ID NO: 1310848 - RNA, 20 nt, Human
caaggacuaggguccugggg

SEQ ID NO: 1310849 - RNA, 21 nt, Human
caaggacuaggguccugggga

SEQ ID NO: 1310850 - RNA, 16 nt, Human
caaggacuaggguccu

SEQ ID NO: 1310851 - RNA, 18 nt, Human
caaggacuaggguccugg

SEQ ID NO: 1310852 - RNA, 19 nt, Human
caaggacuaggguccuggg

SEQ ID NO: 1310853 - RNA, 14 nt, Human
caagcuguuuucuu

SEQ ID NO: 1310854 - RNA, 16 nt, Human
caagcuguuuucuucu

SEQ ID NO: 1310855 - RNA, 20 nt, Human
caagcuuaauggcugauaau

SEQ ID NO: 1310856 - RNA, 24 nt, Human
caagcuucugagacgucaugagga

SEQ ID NO: 1310857 - RNA, 15 nt, Human
caagcuucugagacg

SEQ ID NO: 1310858 - RNA, 18 nt, Human
caagggcagcuuugcuca

SEQ ID NO: 1310859 - RNA, 22 nt, Human
caagggcagggggccccuuugc

SEQ ID NO: 1310860 - RNA, 23 nt, Human
caagggcagggggccccuuugcu

SEQ ID NO: 1310861 - RNA, 18 nt, Human
caagggcauaaauuauug

SEQ ID NO: 1310862 - RNA, 14 nt, Human
caagggcagcuuug

SEQ ID NO: 1310863 - RNA, 11 nt, Human
caagggcagcu

SEQ ID NO: 1310864 - RNA, 14 nt, Human
caagggaggcugcu

SEQ ID NO: 1310865 - RNA, 16 nt, Human
caagggaggcugcugc

SEQ ID NO: 1310866 - RNA, 17 nt, Human
caagggaggcugcugcu

SEQ ID NO: 1310867 - RNA, 14 nt, Human
caagggccugaugg

SEQ ID NO: 1310868 - RNA, 18 nt, Human
caaggggaaucagaacuc

SEQ ID NO: 1310869 - RNA, 21 nt, Human
caaggggauuuuuaugucugg

SEQ ID NO: 1310870 - RNA, 15 nt, Human
caagguguccuacag

SEQ ID NO: 1310871 - RNA, 16 nt, Human
caagguguccuacaga

SEQ ID NO: 1310872 - RNA, 17 nt, Human
caagguguccuacagaa

SEQ ID NO: 1310873 - RNA, 18 nt, Human
caagguguccuacagaaa

SEQ ID NO: 1310874 - RNA, 21 nt, Human
caagguguccuacagaaaaac

SEQ ID NO: 1310875 - RNA, 20 nt, Human
caagguuacuuaauucaacu

SEQ ID NO: 1310876 - RNA, 21 nt, Human
caagguuacuuaauucaacuu

SEQ ID NO: 1310877 - RNA, 20 nt, Human
caagguguccuacagaaaaa

SEQ ID NO: 1310878 - RNA, 14 nt, Human
caagguacucuggu

SEQ ID NO: 1310879 - RNA, 16 nt, Human
caagguacucugguga

SEQ ID NO: 1310880 - RNA, 15 nt, Human
caagguaccauccua

SEQ ID NO: 1310881 - RNA, 18 nt, Human
caagguuuaaagagucua

SEQ ID NO: 1310882 - RNA, 20 nt, Human
caagguuuaaagagucuaga

SEQ ID NO: 1310883 - RNA, 22 nt, Human
caagguuuaaagagucuagauu

SEQ ID NO: 1310884 - RNA, 21 nt, Human
caagguuuaaagagucuagau

SEQ ID NO: 1310885 - RNA, 18 nt, Human
caagguucaacuuauuaa

SEQ ID NO: 1310886 - RNA, 13 nt, Human
caagguucuaacc

SEQ ID NO: 1310887 - RNA, 15 nt, Human
caagguucuccaaca

SEQ ID NO: 1310888 - RNA, 17 nt, Human
caagguuuaaagagucu

SEQ ID NO: 1310889 - RNA, 21 nt, Human
caagugaccuauaccuguguu

SEQ ID NO: 1310890 - RNA, 20 nt, Human
caaccuccgcauccgggguu

SEQ ID NO: 1310891 - RNA, 20 nt, Human
caaccuccaccuccuggguu

SEQ ID NO: 1310892 - RNA, 17 nt, Human
caaccugcaaagaucug

SEQ ID NO: 1310893 - RNA, 21 nt, Human
caaccugccugacauuuggag

SEQ ID NO: 1310894 - RNA, 14 nt, Human
caaccuccaccucc

SEQ ID NO: 1310895 - RNA, 15 nt, Human
caaccugcucuccuc

SEQ ID NO: 1310896 - RNA, 12 nt, Human
caacucuugauu

SEQ ID NO: 1310897 - RNA, 16 nt, Human
caacucuugauuaucc

SEQ ID NO: 1310898 - RNA, 18 nt, Human
caacucuugauuauccau

SEQ ID NO: 1310899 - RNA, 16 nt, Human
caaccugcucuccucu

SEQ ID NO: 1310900 - RNA, 13 nt, Human
caacucuuugaga

SEQ ID NO: 1310901 - RNA, 14 nt, Human
caacucuuugagaa

SEQ ID NO: 1310902 - RNA, 15 nt, Human
caacucuuugagaaa

SEQ ID NO: 1310903 - RNA, 16 nt, Human
caacucuuugagaaac

SEQ ID NO: 1310904 - RNA, 13 nt, Human
caacucuuuguua

SEQ ID NO: 1310905 - RNA, 14 nt, Human
caacucuuuguuau

SEQ ID NO: 1310906 - RNA, 18 nt, Human
caacucuuuguuauuuga

SEQ ID NO: 1310907 - RNA, 18 nt, Human
caacugaaugaggucagc

SEQ ID NO: 1310908 - RNA, 12 nt, Human
caacuggcaggc

SEQ ID NO: 1310909 - RNA, 14 nt, Human
caacuggcaggcag

SEQ ID NO: 1310910 - RNA, 18 nt, Human
caacuggcccuauuuaga

SEQ ID NO: 1310911 - RNA, 23 nt, Human
caacuggcccuauuuagaugaua

SEQ ID NO: 1310912 - RNA, 19 nt, Human
caacuggcccuauuuagau

SEQ ID NO: 1310913 - RNA, 21 nt, Human
caacugucucgaugcaaugaa

SEQ ID NO: 1310914 - RNA, 23 nt, Human
caacugucucgaugcaaugaaca

SEQ ID NO: 1310915 - RNA, 21 nt, Human
caacugucuccuaccucugcu

SEQ ID NO: 1310916 - RNA, 15 nt, Human
caaccucauccucuc

SEQ ID NO: 1310917 - RNA, 15 nt, Human
caaccucaguaauuu

SEQ ID NO: 1310918 - RNA, 18 nt, Human
caaccucaguaauuuaga

SEQ ID NO: 1310919 - RNA, 18 nt, Human
caaccucauccuccuucu

SEQ ID NO: 1310920 - RNA, 18 nt, Human
caaccucaacugccuacu

SEQ ID NO: 1310921 - RNA, 15 nt, Human
caaccuaaaacucuu

SEQ ID NO: 1310922 - RNA, 16 nt, Human
caacaguuacauaauu

SEQ ID NO: 1310923 - RNA, 12 nt, Human
caacaguuuaau

SEQ ID NO: 1310924 - RNA, 15 nt, Human
caacaguuuaaugaa

SEQ ID NO: 1310925 - RNA, 20 nt, Human
caacaguuuaaugaagaucu

SEQ ID NO: 1310926 - RNA, 12 nt, Human
caacaguuuucc

SEQ ID NO: 1310927 - RNA, 13 nt, Human
caacaguuuuccu

SEQ ID NO: 1310928 - RNA, 20 nt, Human
caacaguuuuccuaugcuuu

SEQ ID NO: 1310929 - RNA, 22 nt, Human
caacaguuuuccuaugcuuuga

SEQ ID NO: 1310930 - RNA, 22 nt, Human
caacaguuuuuuaugcuaauca

SEQ ID NO: 1310931 - RNA, 23 nt, Human
caaauuuacagagacagaaagca

SEQ ID NO: 1310932 - RNA, 17 nt, Human
caaauuuacagagacag

SEQ ID NO: 1310933 - RNA, 17 nt, Human
caaauuguaagcaugca

SEQ ID NO: 1310934 - RNA, 13 nt, Human
caaauuggagaaa

SEQ ID NO: 1310935 - RNA, 21 nt, Human
caaauuggagcuucauggcag

SEQ ID NO: 1310936 - RNA, 14 nt, Human
caaauucuucugaa

SEQ ID NO: 1310937 - RNA, 15 nt, Human
caaauucuucugaac

SEQ ID NO: 1310938 - RNA, 22 nt, Human
caaauguuuaaucauauaaaua

SEQ ID NO: 1310939 - RNA, 23 nt, Human
caaauguuuauuaagcaucagaa

SEQ ID NO: 1310940 - RNA, 15 nt, Human
caaauuaaaaaagau

SEQ ID NO: 1310941 - RNA, 16 nt, Human
caaauuaaaaaagaua

SEQ ID NO: 1310942 - RNA, 17 nt, Human
caaauuaaaaaagauaa

SEQ ID NO: 1310943 - RNA, 19 nt, Human
caaauuaaaaaagauaaac

SEQ ID NO: 1310944 - RNA, 21 nt, Human
caaauuaaaaaagauaaacac

SEQ ID NO: 1310945 - RNA, 20 nt, Human
caaauuaaaaaagauaaaca

SEQ ID NO: 1310946 - RNA, 21 nt, Human
caaaguucuaauaauuucuaa

SEQ ID NO: 1310947 - RNA, 22 nt, Human
caaaguucuaauaauuucuaau

SEQ ID NO: 1310948 - RNA, 17 nt, Human
caaaguucucuguggca

SEQ ID NO: 1310949 - RNA, 22 nt, Human
caaaguucccuacuuccuguga

SEQ ID NO: 1310950 - RNA, 18 nt, Human
caaaggggaccuggaagg

SEQ ID NO: 1310951 - RNA, 20 nt, Human
caaaguucuaauaauuucua

SEQ ID NO: 1310952 - RNA, 20 nt, Human
caaauguuuaaucauauaaa

SEQ ID NO: 1310953 - RNA, 19 nt, Human
caaauguuuaaucauauaa

SEQ ID NO: 1310954 - RNA, 17 nt, Human
caaauguuuaaucauau

SEQ ID NO: 1310955 - RNA, 16 nt, Human
caaauguuuaaucaua

SEQ ID NO: 1310956 - RNA, 15 nt, Human
caaauauuuauuuuc

SEQ ID NO: 1310957 - RNA, 16 nt, Human
caaauauuuauuuucu

SEQ ID NO: 1310958 - RNA, 22 nt, Human
caaauauuuagauguaauuuug

SEQ ID NO: 1310959 - RNA, 23 nt, Human
caaauauuuagauguaauuuugu

SEQ ID NO: 1310960 - RNA, 12 nt, Human
caaauauuuauu

SEQ ID NO: 1310961 - RNA, 14 nt, Human
caaauauuuauuuu

SEQ ID NO: 1310962 - RNA, 23 nt, Human
caaaguucuaauaauuucuaaug

SEQ ID NO: 1310963 - RNA, 21 nt, Human
caaauauuuagauguaauuuu

SEQ ID NO: 1310964 - RNA, 13 nt, Human
caaaggacgcacu

SEQ ID NO: 1310965 - RNA, 18 nt, Human
caaaggacgcacugagca

SEQ ID NO: 1310966 - RNA, 16 nt, Human
caaaggacgcacugag

SEQ ID NO: 1310967 - RNA, 18 nt, Human
caaagcccuuccaugucg

SEQ ID NO: 1310968 - RNA, 22 nt, Human
caaagcccccagagcccaggcu

SEQ ID NO: 1310969 - RNA, 19 nt, Human
caaagcccccagagcccag

SEQ ID NO: 1310970 - RNA, 14 nt, Human
caaagcccccagag

SEQ ID NO: 1310971 - RNA, 15 nt, Human
caaagcccccagagc

SEQ ID NO: 1310972 - RNA, 16 nt, Human
caaagcccccagagcc

SEQ ID NO: 1310973 - RNA, 17 nt, Human
caaagcccccagagccc

SEQ ID NO: 1310974 - RNA, 18 nt, Human
caaagcccccagagccca

SEQ ID NO: 1310975 - RNA, 11 nt, Human
caaaggagccu

SEQ ID NO: 1310976 - RNA, 12 nt, Human
caaaggagccug

SEQ ID NO: 1310977 - RNA, 13 nt, Human
caaaggagccugu

SEQ ID NO: 1310978 - RNA, 14 nt, Human
caaaggagccugug

SEQ ID NO: 1310979 - RNA, 15 nt, Human
caaaggagccuguga

SEQ ID NO: 1310980 - RNA, 16 nt, Human
caaaggagccugugaa

SEQ ID NO: 1310981 - RNA, 23 nt, Human
caaaggagccugugaacccagga

SEQ ID NO: 1310982 - RNA, 18 nt, Human
caaaggagcgagcauguc

SEQ ID NO: 1310983 - RNA, 15 nt, Human
caaaggcuuugcccu

SEQ ID NO: 1310984 - RNA, 23 nt, Human
caaaggcuuugcccugcugcccu

SEQ ID NO: 1310985 - RNA, 21 nt, Human
caaaggcuuugcccugcugcc

SEQ ID NO: 1310986 - RNA, 17 nt, Human
caaagggagucugccag

SEQ ID NO: 1310987 - RNA, 18 nt, Human
caaagggagucugccagg

SEQ ID NO: 1310988 - RNA, 17 nt, Human
caaaggggaccuggaag

SEQ ID NO: 1310989 - RNA, 22 nt, Human
caaaggggaggcaucagugucc

SEQ ID NO: 1310990 - RNA, 17 nt, Human
auuuguacuauuuaacu

SEQ ID NO: 1310991 - RNA, 18 nt, Human
auuuguacuauuuaacug

SEQ ID NO: 1310992 - RNA, 19 nt, Human
auuuguacuauuuaacuga

SEQ ID NO: 1310993 - RNA, 12 nt, Human
auuuuaaaguua

SEQ ID NO: 1310994 - RNA, 13 nt, Human
auuuuaaaguuag

SEQ ID NO: 1310995 - RNA, 14 nt, Human
auuuuaaaguuagu

SEQ ID NO: 1310996 - RNA, 21 nt, Human
auuuuaaaguuaguaucuuuu

SEQ ID NO: 1310997 - RNA, 18 nt, Human
auuuuaaaguuaguaucu

SEQ ID NO: 1310998 - RNA, 18 nt, Human
auuuuaauaauguuucaa

SEQ ID NO: 1310999 - RNA, 19 nt, Human
auuuuaauaauguuucaaa

SEQ ID NO: 1311000 - RNA, 14 nt, Human
auuuuaaucaaauu

SEQ ID NO: 1311001 - RNA, 23 nt, Human
auuuuaaugaagaaaguggaaaa

SEQ ID NO: 1311002 - RNA, 22 nt, Human
caaacugaggaauuucaccugu

SEQ ID NO: 1311003 - RNA, 13 nt, Human
caaacugcaugcc

SEQ ID NO: 1311004 - RNA, 14 nt, Human
caaacugcaugccc

SEQ ID NO: 1311005 - RNA, 16 nt, Human
caaacugcaugcccag

SEQ ID NO: 1311006 - RNA, 18 nt, Human
caaacugcaugcccagag

SEQ ID NO: 1311007 - RNA, 19 nt, Human
caaacugcaugcccagaga

SEQ ID NO: 1311008 - RNA, 20 nt, Human
caaacugcaugcccagagac

SEQ ID NO: 1311009 - RNA, 15 nt, Human
caaagaaauuaugug

SEQ ID NO: 1311010 - RNA, 16 nt, Human
caaagaaaguguauug

SEQ ID NO: 1311011 - RNA, 13 nt, Human
caaagaaauuaug

SEQ ID NO: 1311012 - RNA, 12 nt, Human
caaagaaauuau

SEQ ID NO: 1311013 - RNA, 14 nt, Human
caaacugccuucuu

SEQ ID NO: 1311014 - RNA, 16 nt, Human
caaacugggaaccccu

SEQ ID NO: 1311015 - RNA, 20 nt, Human
caaacugggaaccccuuucc

SEQ ID NO: 1311016 - RNA, 22 nt, Human
caaacugggaaccccuuuccca

SEQ ID NO: 1311017 - RNA, 23 nt, Human
caaacugggaaccccuuucccac

SEQ ID NO: 1311018 - RNA, 14 nt, Human
caaagacccuggcu

SEQ ID NO: 1311019 - RNA, 16 nt, Human
caaagacccuggcuuu

SEQ ID NO: 1311020 - RNA, 18 nt, Human
caaagacccuggcuuuca

SEQ ID NO: 1311021 - RNA, 17 nt, Human
caaagacccuggcuuuc

SEQ ID NO: 1311022 - RNA, 22 nt, Human
caaagacuuaagcccagugcac

SEQ ID NO: 1311023 - RNA, 13 nt, Human
caaagcccagcuu

SEQ ID NO: 1311024 - RNA, 15 nt, Human
caaagaguucaagaa

SEQ ID NO: 1311025 - RNA, 16 nt, Human
caaagaguucaagaaa

SEQ ID NO: 1311026 - RNA, 14 nt, Human
caaagaguagaauu

SEQ ID NO: 1311027 - RNA, 17 nt, Human
caaagaguucaagaaau

SEQ ID NO: 1311028 - RNA, 22 nt, Human
cacaccuacuagucaccagaga

SEQ ID NO: 1311029 - RNA, 10 nt, Human
cacaccuccu

SEQ ID NO: 1311030 - RNA, 22 nt, Human
cacacagauuugagcucagccc

SEQ ID NO: 1311031 - RNA, 14 nt, Human
cacaccaggauaga

SEQ ID NO: 1311032 - RNA, 18 nt, Human
cacaccaggcgcuaauuc

SEQ ID NO: 1311033 - RNA, 19 nt, Human
cacacacaaaagggaaccc

SEQ ID NO: 1311034 - RNA, 20 nt, Human
cacaaucucggcucacugca

SEQ ID NO: 1311035 - RNA, 22 nt, Human
cacaaucucggcucacugcauc

SEQ ID NO: 1311036 - RNA, 23 nt, Human
cacaaucucggcucacugcaucc

SEQ ID NO: 1311037 - RNA, 24 nt, Human
cacaaucucggcucacugcauccu

SEQ ID NO: 1311038 - RNA, 16 nt, Human
cacacaagaagaaggg

SEQ ID NO: 1311039 - RNA, 19 nt, Human
cacacaaggauagaugcug

SEQ ID NO: 1311040 - RNA, 18 nt, Human
cacacaagaagaagggca

SEQ ID NO: 1311041 - RNA, 18 nt, Human
cacacaaugugucugaga

SEQ ID NO: 1311042 - RNA, 11 nt, Human
cacacaccugu

SEQ ID NO: 1311043 - RNA, 14 nt, Human
cacacacugaugcu

SEQ ID NO: 1311044 - RNA, 18 nt, Human
cacacagauuugagcuca

SEQ ID NO: 1311045 - RNA, 20 nt, Human
cacacagauuugagcucagc

SEQ ID NO: 1311046 - RNA, 12 nt, Human
caauuuuguaac

SEQ ID NO: 1311047 - RNA, 11 nt, Human
caauuuuguaa

SEQ ID NO: 1311048 - RNA, 12 nt, Human
caauucaaaaca

SEQ ID NO: 1311049 - RNA, 13 nt, Human
caauucaaaaguu

SEQ ID NO: 1311050 - RNA, 15 nt, Human
caauucaaaaguucc

SEQ ID NO: 1311051 - RNA, 12 nt, Human
cacaaacuguaa

SEQ ID NO: 1311052 - RNA, 13 nt, Human
caauuuuuauauu

SEQ ID NO: 1311053 - RNA, 15 nt, Human
cacaaaccaugcaaa

SEQ ID NO: 1311054 - RNA, 17 nt, Human
caaugcaccuaaagaaa

SEQ ID NO: 1311055 - RNA, 18 nt, Human
caaugcaccuaaagaaaa

SEQ ID NO: 1311056 - RNA, 23 nt, Human
caaugcaccuaaagaaaaacaaa

SEQ ID NO: 1311057 - RNA, 14 nt, Human
caauguaaauauuu

SEQ ID NO: 1311058 - RNA, 16 nt, Human
caauuagggccuagcc

SEQ ID NO: 1311059 - RNA, 17 nt, Human
caauguaaauauuuuaa

SEQ ID NO: 1311060 - RNA, 13 nt, Human
caauuaguuuccu

SEQ ID NO: 1311061 - RNA, 14 nt, Human
caauuaguuuccuu

SEQ ID NO: 1311062 - RNA, 17 nt, Human
caauuaguuuccuuuuu

SEQ ID NO: 1311063 - RNA, 18 nt, Human
caauuaguuuccuuuuua

SEQ ID NO: 1311064 - RNA, 21 nt, Human
caauuaguuuccuuuuuaaua

SEQ ID NO: 1311065 - RNA, 21 nt, Human
caauuauaagaggauaugaac

SEQ ID NO: 1311066 - RNA, 14 nt, Human
caauuauaguuucu

SEQ ID NO: 1311067 - RNA, 15 nt, Human
caauuauaguuucug

SEQ ID NO: 1311068 - RNA, 18 nt, Human
caauuauaguuucugagg

SEQ ID NO: 1311069 - RNA, 22 nt, Human
caauuauaguuucugaggcuuu

SEQ ID NO: 1311070 - RNA, 16 nt, Human
caauuaugaagauuua

SEQ ID NO: 1311071 - RNA, 16 nt, Human
caauuauggaaaaaaa

SEQ ID NO: 1311072 - RNA, 18 nt, Human
caauuauggaaaaaaaau

SEQ ID NO: 1311073 - RNA, 18 nt, Human
cacaagaaaugaaagcag

SEQ ID NO: 1311074 - RNA, 12 nt, Human
cacaacuuguuu

SEQ ID NO: 1311075 - RNA, 20 nt, Human
cacaacuuguuuuugguuuu

SEQ ID NO: 1311076 - RNA, 15 nt, Human
cacaagaaaugaaag

SEQ ID NO: 1311077 - RNA, 13 nt, Human
cacaagaaaugaa

SEQ ID NO: 1311078 - RNA, 16 nt, Human
cacaaauuaguuauau

SEQ ID NO: 1311079 - RNA, 13 nt, Human
cacaaauuaguua

SEQ ID NO: 1311080 - RNA, 14 nt, Human
cacaaauuaguuau

SEQ ID NO: 1311081 - RNA, 14 nt, Human
cacaaacuguaaau

SEQ ID NO: 1311082 - RNA, 13 nt, Human
cacaaacuguaaa

SEQ ID NO: 1311083 - RNA, 13 nt, Human
cacaaauaacaag

SEQ ID NO: 1311084 - RNA, 13 nt, Human
cacaaauauuuau

SEQ ID NO: 1311085 - RNA, 21 nt, Human
cacaaauauuuauuuucuuuc

SEQ ID NO: 1311086 - RNA, 23 nt, Human
cacaaauauuuauuuucuuucug

SEQ ID NO: 1311087 - RNA, 23 nt, Human
cacaagacccaaaaggcagaagc

SEQ ID NO: 1311088 - RNA, 23 nt, Human
cacaagaaaugaaagcagggacu

SEQ ID NO: 1311089 - RNA, 13 nt, Human
cacaagaauggau

SEQ ID NO: 1311090 - RNA, 14 nt, Human
cacaagaauggauc

SEQ ID NO: 1311091 - RNA, 23 nt, Human
cacaagaauggaucacaagaugg

SEQ ID NO: 1311092 - RNA, 19 nt, Human
cacaaucucggcucacugc

SEQ ID NO: 1311093 - RNA, 21 nt, Human
cacaagugcccuccaggcuuu

SEQ ID NO: 1311094 - RNA, 18 nt, Human
cacaaguggguaccccca

SEQ ID NO: 1311095 - RNA, 19 nt, Human
cacaaguggguacccccag

SEQ ID NO: 1311096 - RNA, 21 nt, Human
cacaaguggguacccccagga

SEQ ID NO: 1311097 - RNA, 22 nt, Human
cacaaguggguacccccaggac

SEQ ID NO: 1311098 - RNA, 17 nt, Human
caauauucaauaaagcu

SEQ ID NO: 1311099 - RNA, 16 nt, Human
caauauucaauaaagc

SEQ ID NO: 1311100 - RNA, 15 nt, Human
caauauucaauaaag

SEQ ID NO: 1311101 - RNA, 14 nt, Human
caauauucaauaaa

SEQ ID NO: 1311102 - RNA, 18 nt, Human
caaucucggcucacugca

SEQ ID NO: 1311103 - RNA, 18 nt, Human
caaucuucaauccuugaa

SEQ ID NO: 1311104 - RNA, 21 nt, Human
caaucuuccuguuuaaaaaac

SEQ ID NO: 1311105 - RNA, 15 nt, Human
caaucuucaauccuu

SEQ ID NO: 1311106 - RNA, 14 nt, Human
caaucuucaauccu

SEQ ID NO: 1311107 - RNA, 17 nt, Human
caaucuacucaaagcau

SEQ ID NO: 1311108 - RNA, 16 nt, Human
caaucuacucaaagca

SEQ ID NO: 1311109 - RNA, 14 nt, Human
caagugcugaacag

SEQ ID NO: 1311110 - RNA, 16 nt, Human
caagugcugaacagug

SEQ ID NO: 1311111 - RNA, 17 nt, Human
caagugcugaacagugg

SEQ ID NO: 1311112 - RNA, 20 nt, Human
caagugcugaacaguggagg

SEQ ID NO: 1311113 - RNA, 18 nt, Human
caagugcugaacagugga

SEQ ID NO: 1311114 - RNA, 14 nt, Human
caauauuaaaucug

SEQ ID NO: 1311115 - RNA, 15 nt, Human
caauauuaaaucugc

SEQ ID NO: 1311116 - RNA, 11 nt, Human
caaugaaauga

SEQ ID NO: 1311117 - RNA, 19 nt, Human
caaugaaaugaauuaaagu

SEQ ID NO: 1311118 - RNA, 13 nt, Human
caaucuugcaugu

SEQ ID NO: 1311119 - RNA, 17 nt, Human
caaucuugcauguaacg

SEQ ID NO: 1311120 - RNA, 18 nt, Human
caaucuugcauguaacgc

SEQ ID NO: 1311121 - RNA, 15 nt, Human
caaucuuuaaaccaa

SEQ ID NO: 1311122 - RNA, 22 nt, Human
caaucuuuaaaccaauugcugc

SEQ ID NO: 1311123 - RNA, 15 nt, Human
caaugaaaaaaugua

SEQ ID NO: 1311124 - RNA, 16 nt, Human
caaugaaaacucuuug

SEQ ID NO: 1311125 - RNA, 19 nt, Human
caaugaaaacucuuugcug

SEQ ID NO: 1311126 - RNA, 20 nt, Human
caaugaaaacucuuugcugc

SEQ ID NO: 1311127 - RNA, 13 nt, Human
caaugaaaugaau

SEQ ID NO: 1311128 - RNA, 24 nt, Human
caaugauggcaauuuuguaacgaa

SEQ ID NO: 1311129 - RNA, 14 nt, Human
caagugcugugcaa

SEQ ID NO: 1311130 - RNA, 19 nt, Human
caauguaaauauuuuaaag

SEQ ID NO: 1311131 - RNA, 19 nt, Human
cacacuaaccaagcugagu

SEQ ID NO: 1311132 - RNA, 17 nt, Human
cacaugaaguccaagca

SEQ ID NO: 1311133 - RNA, 20 nt, Human
cacaugaaguccaagcauuu

SEQ ID NO: 1311134 - RNA, 16 nt, Human
cacagugacuucugag

SEQ ID NO: 1311135 - RNA, 15 nt, Human
cacagugacuucuga

SEQ ID NO: 1311136 - RNA, 17 nt, Human
cacagugacuucugaga

SEQ ID NO: 1311137 - RNA, 22 nt, Human
cacaugaauuauuacaguguuu

SEQ ID NO: 1311138 - RNA, 20 nt, Human
cacaugacucgggggugggg

SEQ ID NO: 1311139 - RNA, 18 nt, Human
cacaugaaucugcacauc

SEQ ID NO: 1311140 - RNA, 20 nt, Human
cacaugaaucugcacaucug

SEQ ID NO: 1311141 - RNA, 20 nt, Human
cacaugcuucccuuuccuga

SEQ ID NO: 1311142 - RNA, 21 nt, Human
cacaugucagcaaguccuaag

SEQ ID NO: 1311143 - RNA, 20 nt, Human
cacaugucaguaccuucaaa

SEQ ID NO: 1311144 - RNA, 14 nt, Human
cacaugccccaucc

SEQ ID NO: 1311145 - RNA, 21 nt, Human
cacaugccccaucccaugcug

SEQ ID NO: 1311146 - RNA, 18 nt, Human
cacaugaauuauuacagu

SEQ ID NO: 1311147 - RNA, 16 nt, Human
cacaugauuccagcca

SEQ ID NO: 1311148 - RNA, 14 nt, Human
cacagcccagcccg

SEQ ID NO: 1311149 - RNA, 20 nt, Human
cacaggacaugcgguagcca

SEQ ID NO: 1311150 - RNA, 22 nt, Human
cacaggacaugcgguagccagc

SEQ ID NO: 1311151 - RNA, 23 nt, Human
cacaggacaugcgguagccagca

SEQ ID NO: 1311152 - RNA, 15 nt, Human
cacaggacucugccu

SEQ ID NO: 1311153 - RNA, 16 nt, Human
cacaggacucugccuc

SEQ ID NO: 1311154 - RNA, 15 nt, Human
cacaggacauuucuc

SEQ ID NO: 1311155 - RNA, 17 nt, Human
cacaggacauuucucua

SEQ ID NO: 1311156 - RNA, 12 nt, Human
cacaggcccccu

SEQ ID NO: 1311157 - RNA, 13 nt, Human
cacaggcccccuu

SEQ ID NO: 1311158 - RNA, 21 nt, Human
cacaggcccccuugagugggg

SEQ ID NO: 1311159 - RNA, 22 nt, Human
cacaggcccccuugaguggggu

SEQ ID NO: 1311160 - RNA, 16 nt, Human
cacaggcaaaauccuu

SEQ ID NO: 1311161 - RNA, 20 nt, Human
cacaggcaaaauccuugcuu

SEQ ID NO: 1311162 - RNA, 15 nt, Human
cacaggcauuuccug

SEQ ID NO: 1311163 - RNA, 16 nt, Human
cacaggcauuuccugg

SEQ ID NO: 1311164 - RNA, 17 nt, Human
cacaggcauuuccuggg

SEQ ID NO: 1311165 - RNA, 18 nt, Human
cacaggcauuuccugggu

SEQ ID NO: 1311166 - RNA, 19 nt, Human
cacaggcauuuccugggug

SEQ ID NO: 1311167 - RNA, 20 nt, Human
cacaggcauuuccugggugg

SEQ ID NO: 1311168 - RNA, 23 nt, Human
cacaggcauuuccuggguggcua

SEQ ID NO: 1311169 - RNA, 14 nt, Human
cacagcaaccccag

SEQ ID NO: 1311170 - RNA, 17 nt, Human
cacagcaaccccaggcu

SEQ ID NO: 1311171 - RNA, 18 nt, Human
cacagcaaccccaggcug

SEQ ID NO: 1311172 - RNA, 16 nt, Human
cacagcaauuccucag

SEQ ID NO: 1311173 - RNA, 18 nt, Human
cacagcaauuccucaggc

SEQ ID NO: 1311174 - RNA, 14 nt, Human
cacagcacaaauua

SEQ ID NO: 1311175 - RNA, 16 nt, Human
cacagcacaaauuagu

SEQ ID NO: 1311176 - RNA, 18 nt, Human
cacagcacaaauuaguua

SEQ ID NO: 1311177 - RNA, 23 nt, Human
cacagcacaaauuaguuauauau

SEQ ID NO: 1311178 - RNA, 12 nt, Human
cacagcacagcc

SEQ ID NO: 1311179 - RNA, 15 nt, Human
cacagcacagccaac

SEQ ID NO: 1311180 - RNA, 15 nt, Human
cacagccagcaccug

SEQ ID NO: 1311181 - RNA, 16 nt, Human
cacagccagcaccugg

SEQ ID NO: 1311182 - RNA, 17 nt, Human
cacagccagcaccuggc

SEQ ID NO: 1311183 - RNA, 20 nt, Human
cacagccagcaccuggcauc

SEQ ID NO: 1311184 - RNA, 18 nt, Human
cacagccaggggagcaga

SEQ ID NO: 1311185 - RNA, 19 nt, Human
cacagccaggggagcagag

SEQ ID NO: 1311186 - RNA, 21 nt, Human
caccauauuggccagucuggu

SEQ ID NO: 1311187 - RNA, 18 nt, Human
caccauaggucaccuuua

SEQ ID NO: 1311188 - RNA, 17 nt, Human
caccauagguagaaugu

SEQ ID NO: 1311189 - RNA, 15 nt, Human
caccaguugcugcuu

SEQ ID NO: 1311190 - RNA, 11 nt, Human
caccaguucuc

SEQ ID NO: 1311191 - RNA, 20 nt, Human
caccaguucucauggguggc

SEQ ID NO: 1311192 - RNA, 21 nt, Human
caccaguguguggcuuucaga

SEQ ID NO: 1311193 - RNA, 23 nt, Human
caccaguguguggcuuucagagc

SEQ ID NO: 1311194 - RNA, 23 nt, Human
caccagaugcugaaaauguccuu

SEQ ID NO: 1311195 - RNA, 14 nt, Human
caccagggccagcc

SEQ ID NO: 1311196 - RNA, 13 nt, Human
caccagaucugau

SEQ ID NO: 1311197 - RNA, 13 nt, Human
caccagaugcuga

SEQ ID NO: 1311198 - RNA, 17 nt, Human
caccagggccagccucu

SEQ ID NO: 1311199 - RNA, 16 nt, Human
caccagggccagccuc

SEQ ID NO: 1311200 - RNA, 15 nt, Human
caccagggguuucuc

SEQ ID NO: 1311201 - RNA, 22 nt, Human
caccaggguccuuuugacacug

SEQ ID NO: 1311202 - RNA, 19 nt, Human
caccaggguugaccccaga

SEQ ID NO: 1311203 - RNA, 22 nt, Human
caccaggguugaccccagagga

SEQ ID NO: 1311204 - RNA, 23 nt, Human
caccaggguugaccccagaggau

SEQ ID NO: 1311205 - RNA, 19 nt, Human
caccauguuggccaggcug

SEQ ID NO: 1311206 - RNA, 20 nt, Human
caccauguuggccaggcugc

SEQ ID NO: 1311207 - RNA, 20 nt, Human
caccauguuggccaggcugg

SEQ ID NO: 1311208 - RNA, 20 nt, Human
caccauguugcccaggcugg

SEQ ID NO: 1311209 - RNA, 15 nt, Human
caccaugauuccuuu

SEQ ID NO: 1311210 - RNA, 17 nt, Human
caccaugauuccuuuaa

SEQ ID NO: 1311211 - RNA, 19 nt, Human
caccaugauuccuuuaaca

SEQ ID NO: 1311212 - RNA, 17 nt, Human
caccaugcugcugggga

SEQ ID NO: 1311213 - RNA, 19 nt, Human
caccaugcugcuggggaag

SEQ ID NO: 1311214 - RNA, 22 nt, Human
caccaugcugcuggggaagaca

SEQ ID NO: 1311215 - RNA, 18 nt, Human
caccaacuacuaccugua

SEQ ID NO: 1311216 - RNA, 22 nt, Human
caccaacuccuaguucuagaaa

SEQ ID NO: 1311217 - RNA, 19 nt, Human
caccaacuccuaguucuag

SEQ ID NO: 1311218 - RNA, 13 nt, Human
caccaagcacagc

SEQ ID NO: 1311219 - RNA, 14 nt, Human
caccaagcacagca

SEQ ID NO: 1311220 - RNA, 15 nt, Human
caccaagcacagcag

SEQ ID NO: 1311221 - RNA, 16 nt, Human
caccaagcacagcagc

SEQ ID NO: 1311222 - RNA, 17 nt, Human
caccaagcacagcagcc

SEQ ID NO: 1311223 - RNA, 18 nt, Human
caccaagcacagcagccu

SEQ ID NO: 1311224 - RNA, 19 nt, Human
caccaagcacagcagccug

SEQ ID NO: 1311225 - RNA, 21 nt, Human
caccaagcaggaaaugaaaau

SEQ ID NO: 1311226 - RNA, 13 nt, Human
caccaagccaagg

SEQ ID NO: 1311227 - RNA, 14 nt, Human
caccaagccaaggg

SEQ ID NO: 1311228 - RNA, 16 nt, Human
caccaagugcgggucc

SEQ ID NO: 1311229 - RNA, 21 nt, Human
caccaagugcggguccggcag

SEQ ID NO: 1311230 - RNA, 22 nt, Human
caccaaguuggaacauccuugg

SEQ ID NO: 1311231 - RNA, 23 nt, Human
caccaaguuggaacauccuugga

SEQ ID NO: 1311232 - RNA, 22 nt, Human
caccaagugcggguccggcagc

SEQ ID NO: 1311233 - RNA, 17 nt, Human
caccaauguacccaccg

SEQ ID NO: 1311234 - RNA, 22 nt, Human
caccaauguacccaccgggcca

SEQ ID NO: 1311235 - RNA, 23 nt, Human
caccaauguacccaccgggccac

SEQ ID NO: 1311236 - RNA, 23 nt, Human
caccaauguuucaagaggagccc

SEQ ID NO: 1311237 - RNA, 19 nt, Human
caccagacacccaggacuu

SEQ ID NO: 1311238 - RNA, 20 nt, Human
caccagacacccaggacuua

SEQ ID NO: 1311239 - RNA, 14 nt, Human
caccacgcccggcu

SEQ ID NO: 1311240 - RNA, 15 nt, Human
caccacgcccggcua

SEQ ID NO: 1311241 - RNA, 22 nt, Human
caccacggaccaaagggagucu

SEQ ID NO: 1311242 - RNA, 15 nt, Human
caccagacacccagg

SEQ ID NO: 1311243 - RNA, 16 nt, Human
caccagacacccagga

SEQ ID NO: 1311244 - RNA, 17 nt, Human
caccagacacccaggac

SEQ ID NO: 1311245 - RNA, 18 nt, Human
caccagacacccaggacu

SEQ ID NO: 1311246 - RNA, 20 nt, Human
caccauguuggccaggcuug

SEQ ID NO: 1311247 - RNA, 14 nt, Human
caccauuauaauga

SEQ ID NO: 1311248 - RNA, 16 nt, Human
caccauuauaaugaau

SEQ ID NO: 1311249 - RNA, 17 nt, Human
caccauuauaaugaauu

SEQ ID NO: 1311250 - RNA, 22 nt, Human
caccauuauaaugaauuuagug

SEQ ID NO: 1311251 - RNA, 20 nt, Human
caccauuccaagucuccacc

SEQ ID NO: 1311252 - RNA, 18 nt, Human
caccauuauaaugaauuu

SEQ ID NO: 1311253 - RNA, 13 nt, Human
caccauucugacu

SEQ ID NO: 1311254 - RNA, 14 nt, Human
caccauucugacuc

SEQ ID NO: 1311255 - RNA, 13 nt, Human
caccauugaaggc

SEQ ID NO: 1311256 - RNA, 14 nt, Human
caccauugaaggcu

SEQ ID NO: 1311257 - RNA, 15 nt, Human
caccauugaaggcuu

SEQ ID NO: 1311258 - RNA, 16 nt, Human
caccauugaaggcuua

SEQ ID NO: 1311259 - RNA, 17 nt, Human
caccauuuggauccugu

SEQ ID NO: 1311260 - RNA, 17 nt, Human
caccauuuggcaaugcc

SEQ ID NO: 1311261 - RNA, 18 nt, Human
caccauuuggcaucccug

SEQ ID NO: 1311262 - RNA, 19 nt, Human
caccauuuggcaucccugg

SEQ ID NO: 1311263 - RNA, 20 nt, Human
caccauuuggcaucccuggg

SEQ ID NO: 1311264 - RNA, 21 nt, Human
caccauuuggcaucccugggc

SEQ ID NO: 1311265 - RNA, 22 nt, Human
caccauuuggcaucccugggcc

SEQ ID NO: 1311266 - RNA, 23 nt, Human
caccauuuggcaucccugggccu

SEQ ID NO: 1311267 - RNA, 24 nt, Human
caccauuuggcaucccugggccuu

SEQ ID NO: 1311268 - RNA, 22 nt, Human
cacccaaagagguauuuaucuu

SEQ ID NO: 1311269 - RNA, 14 nt, Human
cacccaacgcucca

SEQ ID NO: 1311270 - RNA, 13 nt, Human
uuuuuucuuacug

SEQ ID NO: 1311271 - RNA, 20 nt, Human
uuuugaaaagcagacauuuu

SEQ ID NO: 1311272 - RNA, 21 nt, Human
uuuugaaaccaugaagagauu

SEQ ID NO: 1311273 - RNA, 17 nt, Human
uuuugaaagucuguccu

SEQ ID NO: 1311274 - RNA, 12 nt, Human
uuuugaaagaau

SEQ ID NO: 1311275 - RNA, 18 nt, Human
uuuuucugcacuauaugc

SEQ ID NO: 1311276 - RNA, 22 nt, Human
uuuuucugcacuauaugcaaac

SEQ ID NO: 1311277 - RNA, 13 nt, Human
uuuuucugcacua

SEQ ID NO: 1311278 - RNA, 14 nt, Human
uuuuucuguaccag

SEQ ID NO: 1311279 - RNA, 16 nt, Human
uuuuucuguaccaguu

SEQ ID NO: 1311280 - RNA, 13 nt, Human
uuuuucuguauaa

SEQ ID NO: 1311281 - RNA, 20 nt, Human
uuuuuuauacaggaugauga

SEQ ID NO: 1311282 - RNA, 16 nt, Human
uuuuucuucacugcaa

SEQ ID NO: 1311283 - RNA, 14 nt, Human
uuuuuuacuuuugu

SEQ ID NO: 1311284 - RNA, 12 nt, Human
uuuuuuaggaaa

SEQ ID NO: 1311285 - RNA, 12 nt, Human
uuuuuucugaaa

SEQ ID NO: 1311286 - RNA, 16 nt, Human
uuuuuuaugcuaauca

SEQ ID NO: 1311287 - RNA, 13 nt, Human
uuuuuucguuugu

SEQ ID NO: 1311288 - RNA, 13 nt, Human
uuuuuuaguugaa

SEQ ID NO: 1311289 - RNA, 15 nt, Human
uuuuuuauauaugug

SEQ ID NO: 1311290 - RNA, 13 nt, Human
uuuuuuaugcuaa

SEQ ID NO: 1311291 - RNA, 17 nt, Human
uuuagaauaugccuugu

SEQ ID NO: 1311292 - RNA, 14 nt, Human
uuuagaagccugca

SEQ ID NO: 1311293 - RNA, 14 nt, Human
uuuagaaucccagc

SEQ ID NO: 1311294 - RNA, 19 nt, Human
uuuagaaucccagcccccu

SEQ ID NO: 1311295 - RNA, 15 nt, Human
uuuagacuucaagca

SEQ ID NO: 1311296 - RNA, 14 nt, Human
uuuagaagccaacu

SEQ ID NO: 1311297 - RNA, 22 nt, Human
uuuagaagccaacuaugauuau

SEQ ID NO: 1311298 - RNA, 21 nt, Human
uuuagacuuggauucuuucca

SEQ ID NO: 1311299 - RNA, 22 nt, Human
uuuagacuuggauucuuuccau

SEQ ID NO: 1311300 - RNA, 15 nt, Human
uuuagacuuuaacau

SEQ ID NO: 1311301 - RNA, 22 nt, Human
uuuagagauaagaguuggcugg

SEQ ID NO: 1311302 - RNA, 20 nt, Human
uuuagaaacacaacuauauu

SEQ ID NO: 1311303 - RNA, 12 nt, Human
uuuagaaaacuu

SEQ ID NO: 1311304 - RNA, 13 nt, Human
uuuagaaaacuuu

SEQ ID NO: 1311305 - RNA, 14 nt, Human
uuuagaaaacuuua

SEQ ID NO: 1311306 - RNA, 15 nt, Human
uuuagaaaacuuuaa

SEQ ID NO: 1311307 - RNA, 16 nt, Human
uuuagaaaacuuuaaa

SEQ ID NO: 1311308 - RNA, 22 nt, Human
uuuagaaacagugcaacacugg

SEQ ID NO: 1311309 - RNA, 12 nt, Human
uuuagaaacaca

SEQ ID NO: 1311310 - RNA, 14 nt, Human
uuuacuuuucuucu

SEQ ID NO: 1311311 - RNA, 15 nt, Human
uuuacuuuuaaacag

SEQ ID NO: 1311312 - RNA, 18 nt, Human
uuuacuuuuaaacaguga

SEQ ID NO: 1311313 - RNA, 15 nt, Human
uuuacuuuuaaacug

SEQ ID NO: 1311314 - RNA, 16 nt, Human
uuuacuuuuaaacugu

SEQ ID NO: 1311315 - RNA, 13 nt, Human
uuuacuuuuguuu

SEQ ID NO: 1311316 - RNA, 22 nt, Human
uuuacauggcuggagcuagaau

SEQ ID NO: 1311317 - RNA, 12 nt, Human
uuuacauguuuu

SEQ ID NO: 1311318 - RNA, 18 nt, Human
uuuacuuuagaagccugc

SEQ ID NO: 1311319 - RNA, 17 nt, Human
uuuacaauaguucugug

SEQ ID NO: 1311320 - RNA, 15 nt, Human
uuuacaauguaauua

SEQ ID NO: 1311321 - RNA, 16 nt, Human
uuuacaauguaauuau

SEQ ID NO: 1311322 - RNA, 17 nt, Human
uuuacaauguaauuauu

SEQ ID NO: 1311323 - RNA, 16 nt, Human
uuuacaaguaacaaaa

SEQ ID NO: 1311324 - RNA, 17 nt, Human
uuuacauggcuggagcu

SEQ ID NO: 1311325 - RNA, 19 nt, Human
uuuacaauuuuuuaucaug

SEQ ID NO: 1311326 - RNA, 18 nt, Human
uuuacacaauagaauuau

SEQ ID NO: 1311327 - RNA, 19 nt, Human
uuuacaauguaauuauuua

SEQ ID NO: 1311328 - RNA, 22 nt, Human
uuuaaucauauaaauagaaugu

SEQ ID NO: 1311329 - RNA, 19 nt, Human
uuguauuguauauuacaau

SEQ ID NO: 1311330 - RNA, 18 nt, Human
uuguauuguauauuacaa

SEQ ID NO: 1311331 - RNA, 13 nt, Human
uuguauuguugaa

SEQ ID NO: 1311332 - RNA, 15 nt, Human
uuguauuguuucaau

SEQ ID NO: 1311333 - RNA, 14 nt, Human
uuguauucucugag

SEQ ID NO: 1311334 - RNA, 15 nt, Human
uuguauucucugagc

SEQ ID NO: 1311335 - RNA, 16 nt, Human
uuguauucucugagcu

SEQ ID NO: 1311336 - RNA, 20 nt, Human
uuguauucucugagcugugc

SEQ ID NO: 1311337 - RNA, 22 nt, Human
uuguauucucugagcugugcag

SEQ ID NO: 1311338 - RNA, 23 nt, Human
uuuaaucauauaaauagaaugua

SEQ ID NO: 1311339 - RNA, 18 nt, Human
uuuaaucauauaaauaga

SEQ ID NO: 1311340 - RNA, 14 nt, Human
uuuaaucauauaaa

SEQ ID NO: 1311341 - RNA, 15 nt, Human
uuguauuuauuuagu

SEQ ID NO: 1311342 - RNA, 16 nt, Human
uuguauuguuucaauu

SEQ ID NO: 1311343 - RNA, 18 nt, Human
uuguauuguugaaaaagu

SEQ ID NO: 1311344 - RNA, 13 nt, Human
uuguauuuaacag

SEQ ID NO: 1311345 - RNA, 17 nt, Human
uuguauuuaacagaaau

SEQ ID NO: 1311346 - RNA, 18 nt, Human
uuguauuuaacagaaauu

SEQ ID NO: 1311347 - RNA, 22 nt, Human
uuguauuuaacagaaauuguau

SEQ ID NO: 1311348 - RNA, 16 nt, Human
uuuaucuuuuuaccuu

SEQ ID NO: 1311349 - RNA, 14 nt, Human
uuuaugaaaguauu

SEQ ID NO: 1311350 - RNA, 14 nt, Human
uuuaucuauaauuu

SEQ ID NO: 1311351 - RNA, 19 nt, Human
uuuaucuauaauuuaccua

SEQ ID NO: 1311352 - RNA, 20 nt, Human
uuuaucuauaauuuaccuaa

SEQ ID NO: 1311353 - RNA, 18 nt, Human
uuuaucuuuauaugaaga

SEQ ID NO: 1311354 - RNA, 12 nt, Human
uuuaucuuuuua

SEQ ID NO: 1311355 - RNA, 19 nt, Human
uuuaugaaaaagaagaauc

SEQ ID NO: 1311356 - RNA, 22 nt, Human
uuuauaaaaguguucauuguuu

SEQ ID NO: 1311357 - RNA, 21 nt, Human
uuuagagauaagaguuggcug

SEQ ID NO: 1311358 - RNA, 14 nt, Human
uuuaugcauauuau

SEQ ID NO: 1311359 - RNA, 16 nt, Human
uuuauucauaugcaua

SEQ ID NO: 1311360 - RNA, 15 nt, Human
uuuauucauaugcau

SEQ ID NO: 1311361 - RNA, 14 nt, Human
uuuauucauaugca

SEQ ID NO: 1311362 - RNA, 18 nt, Human
uuuauuccagaaugcugu

SEQ ID NO: 1311363 - RNA, 19 nt, Human
uuuauuccagaaugcugua

SEQ ID NO: 1311364 - RNA, 22 nt, Human
uuuauuccagaaugcuguacau

SEQ ID NO: 1311365 - RNA, 23 nt, Human
uuuauuccagaaugcuguacauc

SEQ ID NO: 1311366 - RNA, 16 nt, Human
uuuauuggcugagaua

SEQ ID NO: 1311367 - RNA, 15 nt, Human
uuuauugguuuugca

SEQ ID NO: 1311368 - RNA, 17 nt, Human
uuuauugguuuugcaga

SEQ ID NO: 1311369 - RNA, 23 nt, Human
uuuauugguuuugcagaagaagg

SEQ ID NO: 1311370 - RNA, 13 nt, Human
uuuauuguauucu

SEQ ID NO: 1311371 - RNA, 14 nt, Human
uuuauuguauucug

SEQ ID NO: 1311372 - RNA, 18 nt, Human
uuuauuguauucuggggu

SEQ ID NO: 1311373 - RNA, 22 nt, Human
uuucucccuggauuuuuaccag

SEQ ID NO: 1311374 - RNA, 18 nt, Human
uuucuccuuuaauuguaa

SEQ ID NO: 1311375 - RNA, 19 nt, Human
uuucuccuuuaauuguaaa

SEQ ID NO: 1311376 - RNA, 22 nt, Human
uuucuccuuuaauuguaaagua

SEQ ID NO: 1311377 - RNA, 17 nt, Human
uuucucuuuccaugaca

SEQ ID NO: 1311378 - RNA, 20 nt, Human
uuucucuuucccuggucccu

SEQ ID NO: 1311379 - RNA, 16 nt, Human
uuucuaggacugaauu

SEQ ID NO: 1311380 - RNA, 12 nt, Human
uuucucccugga

SEQ ID NO: 1311381 - RNA, 14 nt, Human
uuucucccuggauu

SEQ ID NO: 1311382 - RNA, 20 nt, Human
uuucucccuggauuuuuacc

SEQ ID NO: 1311383 - RNA, 21 nt, Human
uuucucccuggauuuuuacca

SEQ ID NO: 1311384 - RNA, 23 nt, Human
uuucucccuggauuuuuaccagu

SEQ ID NO: 1311385 - RNA, 14 nt, Human
uuucuccuccaugg

SEQ ID NO: 1311386 - RNA, 15 nt, Human
uuucuccucccagga

SEQ ID NO: 1311387 - RNA, 15 nt, Human
uuucuaaugugugaa

SEQ ID NO: 1311388 - RNA, 20 nt, Human
uuucuaagcauaaaagauga

SEQ ID NO: 1311389 - RNA, 14 nt, Human
uuucuaaugagaua

SEQ ID NO: 1311390 - RNA, 16 nt, Human
uuucuagauuaagaua

SEQ ID NO: 1311391 - RNA, 23 nt, Human
uuuccugacagaaggacucaggu

SEQ ID NO: 1311392 - RNA, 21 nt, Human
uuuccugaaacaacuuggaaa

SEQ ID NO: 1311393 - RNA, 22 nt, Human
uuuccucaaaacuucagacaua

SEQ ID NO: 1311394 - RNA, 15 nt, Human
uuuccuaugggaaca

SEQ ID NO: 1311395 - RNA, 17 nt, Human
uuuccuaugggaacaau

SEQ ID NO: 1311396 - RNA, 21 nt, Human
uuuccucuucuauuuuguaaa

SEQ ID NO: 1311397 - RNA, 22 nt, Human
uuuccucuucuauuuuguaaac

SEQ ID NO: 1311398 - RNA, 14 nt, Human
uuuccuaugaugua

SEQ ID NO: 1311399 - RNA, 15 nt, Human
uuuccuaugcuuuga

SEQ ID NO: 1311400 - RNA, 18 nt, Human
uuuccuaugauguauacu

SEQ ID NO: 1311401 - RNA, 17 nt, Human
uuuccuagcccucucac

SEQ ID NO: 1311402 - RNA, 23 nt, Human
uuuccuagcccucucacauuuau

SEQ ID NO: 1311403 - RNA, 20 nt, Human
uuuccaggacuguuucaaac

SEQ ID NO: 1311404 - RNA, 22 nt, Human
uuuccaggacuguuucaaacau

SEQ ID NO: 1311405 - RNA, 16 nt, Human
uuuccaggcuucugcu

SEQ ID NO: 1311406 - RNA, 18 nt, Human
uuuccaggcuucugcugg

SEQ ID NO: 1311407 - RNA, 19 nt, Human
uuuccaggcuucugcuggg

SEQ ID NO: 1311408 - RNA, 23 nt, Human
uuuccaggcuucugcuggggccu

SEQ ID NO: 1311409 - RNA, 14 nt, Human
uuucuaaaggaguu

SEQ ID NO: 1311410 - RNA, 16 nt, Human
uuucuaaaggaguuua

SEQ ID NO: 1311411 - RNA, 21 nt, Human
uuucuaaaggaguuuauguuc

SEQ ID NO: 1311412 - RNA, 18 nt, Human
uuucuaacuacaaagguu

SEQ ID NO: 1311413 - RNA, 20 nt, Human
uuucuaacuacaaagguuua

SEQ ID NO: 1311414 - RNA, 22 nt, Human
uuucuaacuacaaagguuuaaa

SEQ ID NO: 1311415 - RNA, 17 nt, Human
uuucuaagaaacauuua

SEQ ID NO: 1311416 - RNA, 14 nt, Human
uuucuaagaaacau

SEQ ID NO: 1311417 - RNA, 13 nt, Human
uuucuaagauucu

SEQ ID NO: 1311418 - RNA, 14 nt, Human
uuucuaagauucua

SEQ ID NO: 1311419 - RNA, 15 nt, Human
uuucuaagauucuaa

SEQ ID NO: 1311420 - RNA, 17 nt, Human
uuucuaagauucuaaag

SEQ ID NO: 1311421 - RNA, 18 nt, Human
uuucuaagauucuaaagg

SEQ ID NO: 1311422 - RNA, 19 nt, Human
uuucuaagcauaaaagaug

SEQ ID NO: 1311423 - RNA, 15 nt, Human
uuucagauaaucaca

SEQ ID NO: 1311424 - RNA, 13 nt, Human
uuucagagccucc

SEQ ID NO: 1311425 - RNA, 22 nt, Human
uuucagagugacuacacacagu

SEQ ID NO: 1311426 - RNA, 15 nt, Human
uuucaaucuucaauc

SEQ ID NO: 1311427 - RNA, 13 nt, Human
uuucaaucuucaa

SEQ ID NO: 1311428 - RNA, 13 nt, Human
uuuauuuguugag

SEQ ID NO: 1311429 - RNA, 14 nt, Human
uuuauuuguugaga

SEQ ID NO: 1311430 - RNA, 15 nt, Human
uuucagcagcugcag

SEQ ID NO: 1311431 - RNA, 21 nt, Human
uuucagauaaucacaauacau

SEQ ID NO: 1311432 - RNA, 23 nt, Human
uuucagaguucuuuuugaaguau

SEQ ID NO: 1311433 - RNA, 18 nt, Human
uuucagaguucuuuuuga

SEQ ID NO: 1311434 - RNA, 22 nt, Human
uuucagaguucuuuuugaagua

SEQ ID NO: 1311435 - RNA, 12 nt, Human
uuuauuuguuga

SEQ ID NO: 1311436 - RNA, 18 nt, Human
uuuauuuguugagagugu

SEQ ID NO: 1311437 - RNA, 13 nt, Human
uuuauuuccagug

SEQ ID NO: 1311438 - RNA, 17 nt, Human
uuuauuuccuaugaugu

SEQ ID NO: 1311439 - RNA, 20 nt, Human
uuuauuucauuuuucaauag

SEQ ID NO: 1311440 - RNA, 13 nt, Human
uuuauuuccuccc

SEQ ID NO: 1311441 - RNA, 16 nt, Human
uuuauuucugcauaug

SEQ ID NO: 1311442 - RNA, 22 nt, Human
uuucaggagagaguugaaccua

SEQ ID NO: 1311443 - RNA, 12 nt, Human
uuucaggaggaa

SEQ ID NO: 1311444 - RNA, 18 nt, Human
uuucaggaggaauacuga

SEQ ID NO: 1311445 - RNA, 19 nt, Human
uuucaggaggaauacugaa

SEQ ID NO: 1311446 - RNA, 21 nt, Human
uuucaggaggaauacugaaca

SEQ ID NO: 1311447 - RNA, 22 nt, Human
uuucaggaggaauacugaacau

SEQ ID NO: 1311448 - RNA, 13 nt, Human
uuucauuccuuca

SEQ ID NO: 1311449 - RNA, 21 nt, Human
uuucauuccuucagauuuggc

SEQ ID NO: 1311450 - RNA, 13 nt, Human
uuucaggaucuau

SEQ ID NO: 1311451 - RNA, 14 nt, Human
uuucaggaucuauu

SEQ ID NO: 1311452 - RNA, 16 nt, Human
uuucaggaucuauuuu

SEQ ID NO: 1311453 - RNA, 19 nt, Human
uuucaggcauuggauauuu

SEQ ID NO: 1311454 - RNA, 19 nt, Human
uuuccagaggcuauuauuu

SEQ ID NO: 1311455 - RNA, 17 nt, Human
uuuccagcauucccagg

SEQ ID NO: 1311456 - RNA, 18 nt, Human
uuuccagcauucccaggu

SEQ ID NO: 1311457 - RNA, 20 nt, Human
uuuccagcauucccagguag

SEQ ID NO: 1311458 - RNA, 19 nt, Human
uuuccaaaaucucccauuu

SEQ ID NO: 1311459 - RNA, 22 nt, Human
uuucuuacugucuuuuuucuaa

SEQ ID NO: 1311460 - RNA, 20 nt, Human
uuucuuacugauuuuuaagu

SEQ ID NO: 1311461 - RNA, 17 nt, Human
uuucugaggcuuuauga

SEQ ID NO: 1311462 - RNA, 21 nt, Human
uuucugaggugcacugggagg

SEQ ID NO: 1311463 - RNA, 16 nt, Human
uuucugaguuccugca

SEQ ID NO: 1311464 - RNA, 15 nt, Human
uuucugaguuuuacc

SEQ ID NO: 1311465 - RNA, 16 nt, Human
uuucugaguuuuacca

SEQ ID NO: 1311466 - RNA, 17 nt, Human
uuucuuaacuucuugcu

SEQ ID NO: 1311467 - RNA, 18 nt, Human
uuucuuaacuucuugcuu

SEQ ID NO: 1311468 - RNA, 21 nt, Human
uuucuuaacuucuugcuucuu

SEQ ID NO: 1311469 - RNA, 14 nt, Human
uuugagcucagccc

SEQ ID NO: 1311470 - RNA, 15 nt, Human
uuugagcuuaaucuu

SEQ ID NO: 1311471 - RNA, 14 nt, Human
uuugauacauuuuu

SEQ ID NO: 1311472 - RNA, 16 nt, Human
uuugauacuaagcauu

SEQ ID NO: 1311473 - RNA, 17 nt, Human
uuugauacuaagcauug

SEQ ID NO: 1311474 - RNA, 18 nt, Human
uuugauacuaagcauuga

SEQ ID NO: 1311475 - RNA, 23 nt, Human
uuugcauaacguauaaaagccug

SEQ ID NO: 1311476 - RNA, 19 nt, Human
uuugcauaacguauaaaag

SEQ ID NO: 1311477 - RNA, 11 nt, Human
uuugcagcuuu

SEQ ID NO: 1311478 - RNA, 21 nt, Human
uuugcagcugagagaaaauaa

SEQ ID NO: 1311479 - RNA, 16 nt, Human
uuugcagcgacuggca

SEQ ID NO: 1311480 - RNA, 21 nt, Human
uuugauacuaagcauugaaug

SEQ ID NO: 1311481 - RNA, 23 nt, Human
uuugauauagaaguauaaagaau

SEQ ID NO: 1311482 - RNA, 21 nt, Human
uuugauagauuuucugcuacu

SEQ ID NO: 1311483 - RNA, 18 nt, Human
uuuggaacccuaaauaau

SEQ ID NO: 1311484 - RNA, 14 nt, Human
uuuggaaccuuguu

SEQ ID NO: 1311485 - RNA, 12 nt, Human
uuuggaagaagg

SEQ ID NO: 1311486 - RNA, 13 nt, Human
uuuggaaccuugu

SEQ ID NO: 1311487 - RNA, 21 nt, Human
uuuggaaccagacucuugccu

SEQ ID NO: 1311488 - RNA, 15 nt, Human
uuugccagugggaac

SEQ ID NO: 1311489 - RNA, 16 nt, Human
uuugccagugggaacu

SEQ ID NO: 1311490 - RNA, 17 nt, Human
uuugcauacauucuuca

SEQ ID NO: 1311491 - RNA, 22 nt, Human
uuugccaugacaacuucuaauu

SEQ ID NO: 1311492 - RNA, 18 nt, Human
uuugcauacauucuucaa

SEQ ID NO: 1311493 - RNA, 23 nt, Human
uuugcauaguaccaaucauuuua

SEQ ID NO: 1311494 - RNA, 14 nt, Human
uuugucacuuuuuc

SEQ ID NO: 1311495 - RNA, 15 nt, Human
uuugucacuuuuucu

SEQ ID NO: 1311496 - RNA, 20 nt, Human
uuugucagaacuagaauuug

SEQ ID NO: 1311497 - RNA, 22 nt, Human
uuugucagaacuagaauuugau

SEQ ID NO: 1311498 - RNA, 21 nt, Human
uuugucagggaguguucccua

SEQ ID NO: 1311499 - RNA, 21 nt, Human
uuuguauaaaauaauuuuuau

SEQ ID NO: 1311500 - RNA, 13 nt, Human
uuuguauaauugg

SEQ ID NO: 1311501 - RNA, 21 nt, Human
uuuguauaauuggauuuccua

SEQ ID NO: 1311502 - RNA, 20 nt, Human
uuugguuaugaauacuuugc

SEQ ID NO: 1311503 - RNA, 19 nt, Human
uuuggaaguuuagcucuga

SEQ ID NO: 1311504 - RNA, 11 nt, Human
uuuggaaggag

SEQ ID NO: 1311505 - RNA, 13 nt, Human
uuuggaauacuuu

SEQ ID NO: 1311506 - RNA, 15 nt, Human
uuuggaauacuuuuu

SEQ ID NO: 1311507 - RNA, 17 nt, Human
uuuggaauacuuuuugu

SEQ ID NO: 1311508 - RNA, 12 nt, Human
uuugguguaugg

SEQ ID NO: 1311509 - RNA, 13 nt, Human
uuugguguauggu

SEQ ID NO: 1311510 - RNA, 17 nt, Human
uuuguuccccacuggag

SEQ ID NO: 1311511 - RNA, 19 nt, Human
uuuguuccccacuggagca

SEQ ID NO: 1311512 - RNA, 15 nt, Human
uuuguucauauuaag

SEQ ID NO: 1311513 - RNA, 15 nt, Human
uuuguucccaagagc

SEQ ID NO: 1311514 - RNA, 14 nt, Human
uuuguucauauuaa

SEQ ID NO: 1311515 - RNA, 12 nt, Human
uuuguuaauuua

SEQ ID NO: 1311516 - RNA, 21 nt, Human
uuuguuaauuuagaaaacuuu

SEQ ID NO: 1311517 - RNA, 16 nt, Human
uuuguuauuuugcaac

SEQ ID NO: 1311518 - RNA, 12 nt, Human
uuugucccaggu

SEQ ID NO: 1311519 - RNA, 13 nt, Human
uuuguguucuguu

SEQ ID NO: 1311520 - RNA, 17 nt, Human
uuuguguucuguuuugu

SEQ ID NO: 1311521 - RNA, 22 nt, Human
uuuguguuucagccauguauuu

SEQ ID NO: 1311522 - RNA, 22 nt, Human
uuugucaugcugggauuuccaa

SEQ ID NO: 1311523 - RNA, 22 nt, Human
uuuuaaaaugagaaaucuaaaa

SEQ ID NO: 1311524 - RNA, 14 nt, Human
uuuuaaaauguaca

SEQ ID NO: 1311525 - RNA, 13 nt, Human
uuuuaaaauguac

SEQ ID NO: 1311526 - RNA, 11 nt, Human
uuuuaaaauuu

SEQ ID NO: 1311527 - RNA, 15 nt, Human
uuuuaaaauuuguuc

SEQ ID NO: 1311528 - RNA, 20 nt, Human
uuuuaaaauuuguucuugua

SEQ ID NO: 1311529 - RNA, 15 nt, Human
uuuuaaaaugagaaa

SEQ ID NO: 1311530 - RNA, 15 nt, Human
uuuguuuauguaauu

SEQ ID NO: 1311531 - RNA, 21 nt, Human
uuuguuuaugguaaaaaauuu

SEQ ID NO: 1311532 - RNA, 14 nt, Human
uuuguuuaaaaagg

SEQ ID NO: 1311533 - RNA, 20 nt, Human
uuuguuuaaaaaguaauaaa

SEQ ID NO: 1311534 - RNA, 14 nt, Human
uuuguuuaaaaagu

SEQ ID NO: 1311535 - RNA, 21 nt, Human
uuuguuuaauuuuuauuucuu

SEQ ID NO: 1311536 - RNA, 22 nt, Human
uuuguuuaauuuuuauuucuuc

SEQ ID NO: 1311537 - RNA, 13 nt, Human
uuuuacauuaaau

SEQ ID NO: 1311538 - RNA, 15 nt, Human
uuuuacaugaaguau

SEQ ID NO: 1311539 - RNA, 18 nt, Human
uuuuacaugaaguauuuu

SEQ ID NO: 1311540 - RNA, 15 nt, Human
uuuuacauucugaau

SEQ ID NO: 1311541 - RNA, 15 nt, Human
uuuuacaucuaaacu

SEQ ID NO: 1311542 - RNA, 16 nt, Human
uuuuacaucuaaacua

SEQ ID NO: 1311543 - RNA, 11 nt, Human
uuuuacaugaa

SEQ ID NO: 1311544 - RNA, 12 nt, Human
uuuuacaugaag

SEQ ID NO: 1311545 - RNA, 14 nt, Human
uuuuacaugaagua

SEQ ID NO: 1311546 - RNA, 20 nt, Human
uuuuacccauuuguucauau

SEQ ID NO: 1311547 - RNA, 13 nt, Human
uuuuaccaaguuu

SEQ ID NO: 1311548 - RNA, 17 nt, Human
uuuuacuauuguuacau

SEQ ID NO: 1311549 - RNA, 12 nt, Human
uuuuacucugcc

SEQ ID NO: 1311550 - RNA, 22 nt, Human
uuuuacauaaauuuaguauuuu

SEQ ID NO: 1311551 - RNA, 16 nt, Human
uuuuacagcugccugc

SEQ ID NO: 1311552 - RNA, 17 nt, Human
uuuuaauuugguuuuca

SEQ ID NO: 1311553 - RNA, 21 nt, Human
uuuuaauuugguuuucacauu

SEQ ID NO: 1311554 - RNA, 14 nt, Human
uuuuacuguacaga

SEQ ID NO: 1311555 - RNA, 11 nt, Human
uuuuauauaua

SEQ ID NO: 1311556 - RNA, 13 nt, Human
uuuuacucugccu

SEQ ID NO: 1311557 - RNA, 14 nt, Human
uuuuacucugccua

SEQ ID NO: 1311558 - RNA, 22 nt, Human
uuuuacucugccuacagaacuu

SEQ ID NO: 1311559 - RNA, 16 nt, Human
uuuuacucugccuaca

SEQ ID NO: 1311560 - RNA, 16 nt, Human
uuuuacugcucugaga

SEQ ID NO: 1311561 - RNA, 15 nt, Human
uuuuauaugcuucug

SEQ ID NO: 1311562 - RNA, 20 nt, Human
uuuuauaugcuucuguuuua

SEQ ID NO: 1311563 - RNA, 20 nt, Human
uuuuauaucaauuuaaaaaa

SEQ ID NO: 1311564 - RNA, 13 nt, Human
uuuuauaucccau

SEQ ID NO: 1311565 - RNA, 12 nt, Human
uuuuauauauua

SEQ ID NO: 1311566 - RNA, 15 nt, Human
uuuuauauauuauau

SEQ ID NO: 1311567 - RNA, 10 nt, Human
uuuuauauuu

SEQ ID NO: 1311568 - RNA, 20 nt, Human
uuuuauauuaaccagauaua

SEQ ID NO: 1311569 - RNA, 21 nt, Human
uuuuauauuaaccagauauau

SEQ ID NO: 1311570 - RNA, 12 nt, Human
uuuuaucaguag

SEQ ID NO: 1311571 - RNA, 16 nt, Human
uuuuaucaugcauguc

SEQ ID NO: 1311572 - RNA, 20 nt, Human
uuuuaugauacuugaaaauu

SEQ ID NO: 1311573 - RNA, 16 nt, Human
uuuuaugauacuugaa

SEQ ID NO: 1311574 - RNA, 19 nt, Human
uuuuaucauuuucaaaaug

SEQ ID NO: 1311575 - RNA, 15 nt, Human
uuuuaucccaaaguu

SEQ ID NO: 1311576 - RNA, 13 nt, Human
uuuuccugaaaac

SEQ ID NO: 1311577 - RNA, 16 nt, Human
uuuuccuccugagugc

SEQ ID NO: 1311578 - RNA, 18 nt, Human
uuuucccaaaauguugaa

SEQ ID NO: 1311579 - RNA, 20 nt, Human
uuuucccaaagcaucccucu

SEQ ID NO: 1311580 - RNA, 12 nt, Human
uuuucccacgag

SEQ ID NO: 1311581 - RNA, 17 nt, Human
uuuucccacuccaagcc

SEQ ID NO: 1311582 - RNA, 11 nt, Human
uuuuccuauau

SEQ ID NO: 1311583 - RNA, 13 nt, Human
uuuuccucccuca

SEQ ID NO: 1311584 - RNA, 20 nt, Human
uuuuccaugcguguuucuga

SEQ ID NO: 1311585 - RNA, 22 nt, Human
uuuuccauggcaggaaggcuug

SEQ ID NO: 1311586 - RNA, 21 nt, Human
uuuuccauggcaggaaggcuu

SEQ ID NO: 1311587 - RNA, 19 nt, Human
uuuuccucucaauaaaauu

SEQ ID NO: 1311588 - RNA, 18 nt, Human
uuuuccucuucuauuuug

SEQ ID NO: 1311589 - RNA, 16 nt, Human
uuuuccucuccacaca

SEQ ID NO: 1311590 - RNA, 19 nt, Human
uuuuccuucccuuuucugu

SEQ ID NO: 1311591 - RNA, 21 nt, Human
uuuuccuuccaaugucuggag

SEQ ID NO: 1311592 - RNA, 17 nt, Human
uuuuccuuugaauccuc

SEQ ID NO: 1311593 - RNA, 13 nt, Human
uuuuccuuugugc

SEQ ID NO: 1311594 - RNA, 14 nt, Human
uuuucgaaaaucaa

SEQ ID NO: 1311595 - RNA, 15 nt, Human
uuuucgaaaaucaaa

SEQ ID NO: 1311596 - RNA, 16 nt, Human
uuuucgaaaaucaaau

SEQ ID NO: 1311597 - RNA, 19 nt, Human
uuuucggccccauguaucu

SEQ ID NO: 1311598 - RNA, 17 nt, Human
uuuuaucccucaccugu

SEQ ID NO: 1311599 - RNA, 17 nt, Human
uuuucaacgcagcccug

SEQ ID NO: 1311600 - RNA, 21 nt, Human
uuuucaacgcagcccugcuuu

SEQ ID NO: 1311601 - RNA, 22 nt, Human
uuuucaacgcagcccugcuuug

SEQ ID NO: 1311602 - RNA, 14 nt, Human
uuuucaagaaacug

SEQ ID NO: 1311603 - RNA, 15 nt, Human
uuuucaagaaacuga

SEQ ID NO: 1311604 - RNA, 16 nt, Human
uuuucaagaauaauca

SEQ ID NO: 1311605 - RNA, 14 nt, Human
uuuucaauagccac

SEQ ID NO: 1311606 - RNA, 16 nt, Human
uuuucaauagccacua

SEQ ID NO: 1311607 - RNA, 18 nt, Human
uuuucaaugaauuuuaua

SEQ ID NO: 1311608 - RNA, 19 nt, Human
uuuucacugcuggcugccu

SEQ ID NO: 1311609 - RNA, 20 nt, Human
uuuucacugcuggcugccuu

SEQ ID NO: 1311610 - RNA, 16 nt, Human
uuuucacuguagaaug

SEQ ID NO: 1311611 - RNA, 19 nt, Human
uucaaugccccugaauuua

SEQ ID NO: 1311612 - RNA, 20 nt, Human
uucaaucuucaauccuugaa

SEQ ID NO: 1311613 - RNA, 16 nt, Human
uucaaucuguaaacug

SEQ ID NO: 1311614 - RNA, 17 nt, Human
uucaaucuguaaacugu

SEQ ID NO: 1311615 - RNA, 18 nt, Human
uucaaucuguaaacugug

SEQ ID NO: 1311616 - RNA, 20 nt, Human
uucaaucuguaaacugugua

SEQ ID NO: 1311617 - RNA, 15 nt, Human
uucaauguuagccuc

SEQ ID NO: 1311618 - RNA, 15 nt, Human
uucaauucaaagcug

SEQ ID NO: 1311619 - RNA, 18 nt, Human
uucaacaauucuaaaaug

SEQ ID NO: 1311620 - RNA, 22 nt, Human
uucaacaaagaaacaaagaugu

SEQ ID NO: 1311621 - RNA, 14 nt, Human
uucaacaauucuaa

SEQ ID NO: 1311622 - RNA, 15 nt, Human
uucaacaauucuaaa

SEQ ID NO: 1311623 - RNA, 19 nt, Human
uucaacaauucuaaaauga

SEQ ID NO: 1311624 - RNA, 17 nt, Human
uucaaccauuccccaug

SEQ ID NO: 1311625 - RNA, 20 nt, Human
uucaaccauuccccauggga

SEQ ID NO: 1311626 - RNA, 13 nt, Human
uucaacgcagccc

SEQ ID NO: 1311627 - RNA, 14 nt, Human
uucaacgcagcccu

SEQ ID NO: 1311628 - RNA, 15 nt, Human
uucaacgcagcccug

SEQ ID NO: 1311629 - RNA, 16 nt, Human
uucaaucccaggaugu

SEQ ID NO: 1311630 - RNA, 11 nt, Human
uucaauauuuu

SEQ ID NO: 1311631 - RNA, 22 nt, Human
uucaauccuugaagguauaucu

SEQ ID NO: 1311632 - RNA, 16 nt, Human
uucaauauuuucuuuu

SEQ ID NO: 1311633 - RNA, 18 nt, Human
uucaaucucaauugcuuu

SEQ ID NO: 1311634 - RNA, 14 nt, Human
uucaaucuguaaac

SEQ ID NO: 1311635 - RNA, 15 nt, Human
uucaaucuguaaacu

SEQ ID NO: 1311636 - RNA, 12 nt, Human
uuauuuucacug

SEQ ID NO: 1311637 - RNA, 15 nt, Human
uuacgugcucugugg

SEQ ID NO: 1311638 - RNA, 17 nt, Human
uuacuaaaaaaaagaug

SEQ ID NO: 1311639 - RNA, 18 nt, Human
uuacuaaaaaaaagauga

SEQ ID NO: 1311640 - RNA, 15 nt, Human
uucaaagcaaauguc

SEQ ID NO: 1311641 - RNA, 13 nt, Human
uuauuuugaugua

SEQ ID NO: 1311642 - RNA, 15 nt, Human
uuauuuugacauaaa

SEQ ID NO: 1311643 - RNA, 12 nt, Human
uucaaagaugcu

SEQ ID NO: 1311644 - RNA, 12 nt, Human
uuauuuucuggu

SEQ ID NO: 1311645 - RNA, 17 nt, Human
uuauuuugacauaaagu

SEQ ID NO: 1311646 - RNA, 11 nt, Human
uuauuuugaug

SEQ ID NO: 1311647 - RNA, 16 nt, Human
uuauuuugauguaaag

SEQ ID NO: 1311648 - RNA, 17 nt, Human
uucaaauuuuaucugcc

SEQ ID NO: 1311649 - RNA, 12 nt, Human
uucaacaaacau

SEQ ID NO: 1311650 - RNA, 20 nt, Human
uucaacaaacauuugcugaa

SEQ ID NO: 1311651 - RNA, 21 nt, Human
uucaacaaagaaacaaagaug

SEQ ID NO: 1311652 - RNA, 13 nt, Human
uucaaagaugcug

SEQ ID NO: 1311653 - RNA, 18 nt, Human
uucaaagaugcugugagu

SEQ ID NO: 1311654 - RNA, 16 nt, Human
uucaaagcaugaaaug

SEQ ID NO: 1311655 - RNA, 13 nt, Human
uucaaagccagcg

SEQ ID NO: 1311656 - RNA, 21 nt, Human
uucaaagccagcguccuccuc

SEQ ID NO: 1311657 - RNA, 20 nt, Human
uucagacucccauuccugaa

SEQ ID NO: 1311658 - RNA, 21 nt, Human
uucagacucccauuccugaag

SEQ ID NO: 1311659 - RNA, 22 nt, Human
uucagaggcccucgcugccagc

SEQ ID NO: 1311660 - RNA, 23 nt, Human
uucagaggcccucgcugccagcu

SEQ ID NO: 1311661 - RNA, 12 nt, Human
uucagaggcuca

SEQ ID NO: 1311662 - RNA, 13 nt, Human
uucagaggcucag

SEQ ID NO: 1311663 - RNA, 22 nt, Human
uucagaggcucagauuguaaua

SEQ ID NO: 1311664 - RNA, 21 nt, Human
uucagaguucuuuuugaagua

SEQ ID NO: 1311665 - RNA, 16 nt, Human
uucacccccuuuccug

SEQ ID NO: 1311666 - RNA, 20 nt, Human
uucacucuucaaaugccuga

SEQ ID NO: 1311667 - RNA, 19 nt, Human
uucacccccuuuccuggac

SEQ ID NO: 1311668 - RNA, 13 nt, Human
uucagcugccagu

SEQ ID NO: 1311669 - RNA, 15 nt, Human
uucaggcucuucucc

SEQ ID NO: 1311670 - RNA, 23 nt, Human
uucaggaucuauuuuuggagguu

SEQ ID NO: 1311671 - RNA, 12 nt, Human
uucaggaucuau

SEQ ID NO: 1311672 - RNA, 14 nt, Human
uucaggaucuauuu

SEQ ID NO: 1311673 - RNA, 22 nt, Human
uucaggaucuauuuuuggaggu

SEQ ID NO: 1311674 - RNA, 18 nt, Human
uucaggacacucacuaca

SEQ ID NO: 1311675 - RNA, 20 nt, Human
uucaggagagaguugaaccu

SEQ ID NO: 1311676 - RNA, 21 nt, Human
uucaggagagaguugaaccua

SEQ ID NO: 1311677 - RNA, 15 nt, Human
uucaggaggaauacu

SEQ ID NO: 1311678 - RNA, 18 nt, Human
uucaggaggaauacugaa

SEQ ID NO: 1311679 - RNA, 20 nt, Human
uucaggaggaauacugaaca

SEQ ID NO: 1311680 - RNA, 10 nt, Human
uucagcuccu

SEQ ID NO: 1311681 - RNA, 12 nt, Human
uucagcuccuga

SEQ ID NO: 1311682 - RNA, 14 nt, Human
uucagcuccugacc

SEQ ID NO: 1311683 - RNA, 13 nt, Human
uucagcuccugac

SEQ ID NO: 1311684 - RNA, 15 nt, Human
uucagcucugaaaga

SEQ ID NO: 1311685 - RNA, 23 nt, Human
uucagcugagguuugcacuuccu

SEQ ID NO: 1311686 - RNA, 23 nt, Human
uucagcugccaguguccugagcc

SEQ ID NO: 1311687 - RNA, 21 nt, Human
uucccaaaagcccauucauuc

SEQ ID NO: 1311688 - RNA, 11 nt, Human
uucccaaaagc

SEQ ID NO: 1311689 - RNA, 22 nt, Human
uucccaaaauguugaaauauga

SEQ ID NO: 1311690 - RNA, 17 nt, Human
uuccauuugcauuuguu

SEQ ID NO: 1311691 - RNA, 19 nt, Human
uucccaaaauguugaaaua

SEQ ID NO: 1311692 - RNA, 14 nt, Human
uuccccaagacauu

SEQ ID NO: 1311693 - RNA, 15 nt, Human
uuccccaccagaugc

SEQ ID NO: 1311694 - RNA, 20 nt, Human
uuccaugucgccucugcauu

SEQ ID NO: 1311695 - RNA, 21 nt, Human
uuccaugucgccucugcauuc

SEQ ID NO: 1311696 - RNA, 20 nt, Human
uuccauugguccaagauucc

SEQ ID NO: 1311697 - RNA, 13 nt, Human
uuccauuugcaag

SEQ ID NO: 1311698 - RNA, 17 nt, Human
uuccauuugcaagggaa

SEQ ID NO: 1311699 - RNA, 15 nt, Human
uuccauuugcauuug

SEQ ID NO: 1311700 - RNA, 18 nt, Human
uuccauuugcauuuguuu

SEQ ID NO: 1311701 - RNA, 19 nt, Human
uuccaugacugcuugcccu

SEQ ID NO: 1311702 - RNA, 17 nt, Human
uuccaugauucuauuua

SEQ ID NO: 1311703 - RNA, 18 nt, Human
uuccaugauucuauuuau

SEQ ID NO: 1311704 - RNA, 17 nt, Human
uuccaugucgccucugc

SEQ ID NO: 1311705 - RNA, 18 nt, Human
uuccaugucgccucugca

SEQ ID NO: 1311706 - RNA, 19 nt, Human
uuccaugucgccucugcau

SEQ ID NO: 1311707 - RNA, 12 nt, Human
uuccaucugauu

SEQ ID NO: 1311708 - RNA, 13 nt, Human
uuccaucuuuaca

SEQ ID NO: 1311709 - RNA, 18 nt, Human
uuccaucuuuacaaaacu

SEQ ID NO: 1311710 - RNA, 16 nt, Human
uuccaugacaucaaga

SEQ ID NO: 1311711 - RNA, 21 nt, Human
uuccaugacugcuugcccuaa

SEQ ID NO: 1311712 - RNA, 16 nt, Human
uuccagccccucuggu

SEQ ID NO: 1311713 - RNA, 17 nt, Human
uuccagccccucugguc

SEQ ID NO: 1311714 - RNA, 20 nt, Human
uuccagccccucuggucgcu

SEQ ID NO: 1311715 - RNA, 12 nt, Human
uuccagccauca

SEQ ID NO: 1311716 - RNA, 15 nt, Human
uuccagcauucccag

SEQ ID NO: 1311717 - RNA, 20 nt, Human
uuccagcauucccagguagg

SEQ ID NO: 1311718 - RNA, 17 nt, Human
uuccagcauucccaggu

SEQ ID NO: 1311719 - RNA, 14 nt, Human
uuccagccccucug

SEQ ID NO: 1311720 - RNA, 19 nt, Human
uuccacuuauaggaauuga

SEQ ID NO: 1311721 - RNA, 18 nt, Human
uuccacuuauagccucug

SEQ ID NO: 1311722 - RNA, 20 nt, Human
uuccacuuauagccucuguc

SEQ ID NO: 1311723 - RNA, 21 nt, Human
uuccacuuagaaauugcauuu

SEQ ID NO: 1311724 - RNA, 22 nt, Human
uuccacugugcagguucccacu

SEQ ID NO: 1311725 - RNA, 17 nt, Human
uuccacuuauagccucu

SEQ ID NO: 1311726 - RNA, 16 nt, Human
uuccacugagggcagu

SEQ ID NO: 1311727 - RNA, 13 nt, Human
uucauuuucucua

SEQ ID NO: 1311728 - RNA, 15 nt, Human
uuccacugagggcag

SEQ ID NO: 1311729 - RNA, 16 nt, Human
uucaugaccaguaaag

SEQ ID NO: 1311730 - RNA, 16 nt, Human
uucaugacagccucca

SEQ ID NO: 1311731 - RNA, 12 nt, Human
uucaugauaaug

SEQ ID NO: 1311732 - RNA, 15 nt, Human
uucaugauaaugaac

SEQ ID NO: 1311733 - RNA, 18 nt, Human
uucaugauaaugaacaga

SEQ ID NO: 1311734 - RNA, 15 nt, Human
uucaugauuagaaau

SEQ ID NO: 1311735 - RNA, 23 nt, Human
uucaugauuagaaauuaccugug

SEQ ID NO: 1311736 - RNA, 17 nt, Human
uucaugauuucauuuca

SEQ ID NO: 1311737 - RNA, 23 nt, Human
uucaugauuucauuucaacuguu

SEQ ID NO: 1311738 - RNA, 19 nt, Human
uucauuuagucaugugacc

SEQ ID NO: 1311739 - RNA, 17 nt, Human
uucauuuaucuauaauu

SEQ ID NO: 1311740 - RNA, 18 nt, Human
uucauuuaucuauaauuu

SEQ ID NO: 1311741 - RNA, 15 nt, Human
uucauuucaacuguu

SEQ ID NO: 1311742 - RNA, 12 nt, Human
uucauuucacug

SEQ ID NO: 1311743 - RNA, 13 nt, Human
uucauuucaucua

SEQ ID NO: 1311744 - RNA, 13 nt, Human
uucauuuccucaa

SEQ ID NO: 1311745 - RNA, 16 nt, Human
uucauuuccucaaaaa

SEQ ID NO: 1311746 - RNA, 22 nt, Human
uucauuugguucauuaauucua

SEQ ID NO: 1311747 - RNA, 16 nt, Human
uucauuuccuccguca

SEQ ID NO: 1311748 - RNA, 18 nt, Human
uucauuuuaacaucugag

SEQ ID NO: 1311749 - RNA, 21 nt, Human
uucauuuuaacaucugagaaa

SEQ ID NO: 1311750 - RNA, 22 nt, Human
uucaucucccaccuagcagcac

SEQ ID NO: 1311751 - RNA, 19 nt, Human
uucaucuucaguugucucu

SEQ ID NO: 1311752 - RNA, 15 nt, Human
uucaugacagccucc

SEQ ID NO: 1311753 - RNA, 22 nt, Human
uucaguuuauuugaaccaauaa

SEQ ID NO: 1311754 - RNA, 16 nt, Human
uucaguuucauaaaag

SEQ ID NO: 1311755 - RNA, 13 nt, Human
uucaguuucauaa

SEQ ID NO: 1311756 - RNA, 21 nt, Human
uucaguuuucauuugguucau

SEQ ID NO: 1311757 - RNA, 16 nt, Human
uucaguuuugauauuu

SEQ ID NO: 1311758 - RNA, 12 nt, Human
uucauaaguauu

SEQ ID NO: 1311759 - RNA, 19 nt, Human
uucauaaguauuaugucuc

SEQ ID NO: 1311760 - RNA, 20 nt, Human
uucauaaguauuaugucucu

SEQ ID NO: 1311761 - RNA, 17 nt, Human
uucauaaguauuucaaa

SEQ ID NO: 1311762 - RNA, 15 nt, Human
uucauaaucacucua

SEQ ID NO: 1311763 - RNA, 15 nt, Human
uucaucuaggauuuu

SEQ ID NO: 1311764 - RNA, 20 nt, Human
uucaucuaccauuuucuggu

SEQ ID NO: 1311765 - RNA, 23 nt, Human
uucaucuauuuuuggcagucuga

SEQ ID NO: 1311766 - RNA, 16 nt, Human
uucaggcucuucuccu

SEQ ID NO: 1311767 - RNA, 20 nt, Human
uucagggaaggaggagccug

SEQ ID NO: 1311768 - RNA, 21 nt, Human
uucagggaaggaggagccugu

SEQ ID NO: 1311769 - RNA, 22 nt, Human
uucagggaaggaggagccuguc

SEQ ID NO: 1311770 - RNA, 23 nt, Human
uucagggaaggaggagccugucc

SEQ ID NO: 1311771 - RNA, 16 nt, Human
uucaguugcacuucua

SEQ ID NO: 1311772 - RNA, 15 nt, Human
uucaguugucucuga

SEQ ID NO: 1311773 - RNA, 17 nt, Human
uucaguuguucuuuuua

SEQ ID NO: 1311774 - RNA, 16 nt, Human
uucccuucaucuggaa

SEQ ID NO: 1311775 - RNA, 15 nt, Human
uucccuucaucugga

SEQ ID NO: 1311776 - RNA, 14 nt, Human
uucccuucaucugg

SEQ ID NO: 1311777 - RNA, 15 nt, Human
uucccugugccuccu

SEQ ID NO: 1311778 - RNA, 16 nt, Human
uucccuuguagcuccu

SEQ ID NO: 1311779 - RNA, 20 nt, Human
uucccuuguagcuccucccc

SEQ ID NO: 1311780 - RNA, 13 nt, Human
uucccuuuccuga

SEQ ID NO: 1311781 - RNA, 19 nt, Human
uuccuagagaagacaggcu

SEQ ID NO: 1311782 - RNA, 13 nt, Human
uuccccacuggag

SEQ ID NO: 1311783 - RNA, 14 nt, Human
uuccccacuggagc

SEQ ID NO: 1311784 - RNA, 18 nt, Human
uuccccagacgccuggcu

SEQ ID NO: 1311785 - RNA, 15 nt, Human
uuccccagacuuguu

SEQ ID NO: 1311786 - RNA, 11 nt, Human
uuccccagaga

SEQ ID NO: 1311787 - RNA, 12 nt, Human
uuccccagagaa

SEQ ID NO: 1311788 - RNA, 20 nt, Human
uuccccaccagaugcugaaa

SEQ ID NO: 1311789 - RNA, 23 nt, Human
uuccccacccaccaacccucagg

SEQ ID NO: 1311790 - RNA, 19 nt, Human
uuccccacccaccaacccu

SEQ ID NO: 1311791 - RNA, 23 nt, Human
uucccuggucccuuguauccccu

SEQ ID NO: 1311792 - RNA, 18 nt, Human
uucccugugccuccuccc

SEQ ID NO: 1311793 - RNA, 18 nt, Human
uucccuguuuucccccca

SEQ ID NO: 1311794 - RNA, 19 nt, Human
uucccuucaguacccucuc

SEQ ID NO: 1311795 - RNA, 22 nt, Human
uucccuucaguacccucucagc

SEQ ID NO: 1311796 - RNA, 23 nt, Human
uucccuucaguacccucucagcu

SEQ ID NO: 1311797 - RNA, 20 nt, Human
uuccuagguauaauucacau

SEQ ID NO: 1311798 - RNA, 14 nt, Human
uuccuagcccucuc

SEQ ID NO: 1311799 - RNA, 18 nt, Human
uuccuagcccucucacau

SEQ ID NO: 1311800 - RNA, 18 nt, Human
uuccuagcugugugaaua

SEQ ID NO: 1311801 - RNA, 19 nt, Human
uuccucagccagccucgcc

SEQ ID NO: 1311802 - RNA, 16 nt, Human
uuccucagccagccuc

SEQ ID NO: 1311803 - RNA, 23 nt, Human
uuccucaguucauccauucuauu

SEQ ID NO: 1311804 - RNA, 15 nt, Human
uuccuaguuuucucc

SEQ ID NO: 1311805 - RNA, 18 nt, Human
uuccuaguuuucuccucc

SEQ ID NO: 1311806 - RNA, 15 nt, Human
uuccucagccagccu

SEQ ID NO: 1311807 - RNA, 19 nt, Human
uuccucauccaccccaucc

SEQ ID NO: 1311808 - RNA, 18 nt, Human
uuccucauccaccccauc

SEQ ID NO: 1311809 - RNA, 14 nt, Human
uuccucaugaaugu

SEQ ID NO: 1311810 - RNA, 15 nt, Human
uuccucaugaaugua

SEQ ID NO: 1311811 - RNA, 16 nt, Human
uuccucaugaauguaa

SEQ ID NO: 1311812 - RNA, 17 nt, Human
uuccucaugaauguaaa

SEQ ID NO: 1311813 - RNA, 18 nt, Human
uuccucaugaauguaaau

SEQ ID NO: 1311814 - RNA, 21 nt, Human
uuccucaugaauguaaauuug

SEQ ID NO: 1311815 - RNA, 22 nt, Human
uuccucaugaauguaaauuugu

SEQ ID NO: 1311816 - RNA, 20 nt, Human
uuccuccucaggcacacagc

SEQ ID NO: 1311817 - RNA, 14 nt, Human
uuccuccuccccac

SEQ ID NO: 1311818 - RNA, 16 nt, Human
uuccuccuccccacuu

SEQ ID NO: 1311819 - RNA, 13 nt, Human
uuccuccucaggc

SEQ ID NO: 1311820 - RNA, 21 nt, Human
uuccuucccugcugugaaaga

SEQ ID NO: 1311821 - RNA, 19 nt, Human
uuccuucccugcugugaaa

SEQ ID NO: 1311822 - RNA, 15 nt, Human
uuccuucccugcugu

SEQ ID NO: 1311823 - RNA, 14 nt, Human
uuccuucccaugga

SEQ ID NO: 1311824 - RNA, 16 nt, Human
uuccuucccugugccu

SEQ ID NO: 1311825 - RNA, 19 nt, Human
uuccuucccuuuucuguuc

SEQ ID NO: 1311826 - RNA, 18 nt, Human
uuccugccgcaacaguuu

SEQ ID NO: 1311827 - RNA, 17 nt, Human
uuccuucauuuccuccg

SEQ ID NO: 1311828 - RNA, 21 nt, Human
uuccuuccaaugucuggagac

SEQ ID NO: 1311829 - RNA, 13 nt, Human
uuccuuccucuga

SEQ ID NO: 1311830 - RNA, 17 nt, Human
uuccuuccucugagccu

SEQ ID NO: 1311831 - RNA, 12 nt, Human
uuccuuccgcuu

SEQ ID NO: 1311832 - RNA, 11 nt, Human
uuccugcccug

SEQ ID NO: 1311833 - RNA, 18 nt, Human
uuccugccccaggccuga

SEQ ID NO: 1311834 - RNA, 13 nt, Human
uuccuccugcuca

SEQ ID NO: 1311835 - RNA, 15 nt, Human
uuccuccugcucaua

SEQ ID NO: 1311836 - RNA, 11 nt, Human
uuccuccugga

SEQ ID NO: 1311837 - RNA, 13 nt, Human
uuccuccuggaaa

SEQ ID NO: 1311838 - RNA, 13 nt, Human
uuccugcccuggg

SEQ ID NO: 1311839 - RNA, 16 nt, Human
uuccugcccugggagg

SEQ ID NO: 1311840 - RNA, 22 nt, Human
uuccugcccugggaggcaguga

SEQ ID NO: 1311841 - RNA, 14 nt, Human
uuccuccuggaaau

SEQ ID NO: 1311842 - RNA, 18 nt, Human
uucuaaacuggagacugu

SEQ ID NO: 1311843 - RNA, 16 nt, Human
uucuaaaggaguuuau

SEQ ID NO: 1311844 - RNA, 15 nt, Human
uucuaaaaugugaug

SEQ ID NO: 1311845 - RNA, 19 nt, Human
uucuaaaaugugauguucu

SEQ ID NO: 1311846 - RNA, 20 nt, Human
uucuaaaaugugauguucua

SEQ ID NO: 1311847 - RNA, 23 nt, Human
uucuaaaaugugauguucuaagg

SEQ ID NO: 1311848 - RNA, 18 nt, Human
uucuaaacccaauccaaa

SEQ ID NO: 1311849 - RNA, 19 nt, Human
uucuaaacccaauccaaau

SEQ ID NO: 1311850 - RNA, 23 nt, Human
uucuaaacccaauccaaauggcg

SEQ ID NO: 1311851 - RNA, 15 nt, Human
uucuaaacuggagac

SEQ ID NO: 1311852 - RNA, 23 nt, Human
uucuaaaggaguuuauguuccau

SEQ ID NO: 1311853 - RNA, 19 nt, Human
uucuaaaggaguuuauguu

SEQ ID NO: 1311854 - RNA, 21 nt, Human
uucuaaguuucuaagauucua

SEQ ID NO: 1311855 - RNA, 15 nt, Human
uucuaauaauuucua

SEQ ID NO: 1311856 - RNA, 16 nt, Human
uucuaauaauuucuaa

SEQ ID NO: 1311857 - RNA, 18 nt, Human
uucuaauaauuucuaaug

SEQ ID NO: 1311858 - RNA, 22 nt, Human
uucggccuccauccugaggcuc

SEQ ID NO: 1311859 - RNA, 15 nt, Human
uucuaaaagguguga

SEQ ID NO: 1311860 - RNA, 17 nt, Human
uuccuuucuuuuccccc

SEQ ID NO: 1311861 - RNA, 20 nt, Human
uucuaaaaucuuauaguucu

SEQ ID NO: 1311862 - RNA, 21 nt, Human
uucuaaaaucuuauaguucua

SEQ ID NO: 1311863 - RNA, 22 nt, Human
uucuaaaaucuuauaguucuag

SEQ ID NO: 1311864 - RNA, 15 nt, Human
uucuaaaaugauugu

SEQ ID NO: 1311865 - RNA, 14 nt, Human
uucuaaaaugccuu

SEQ ID NO: 1311866 - RNA, 19 nt, Human
uucggccuccauccugagg

SEQ ID NO: 1311867 - RNA, 18 nt, Human
uucggccuccauccugag

SEQ ID NO: 1311868 - RNA, 18 nt, Human
uuccuuucuuuucccccu

SEQ ID NO: 1311869 - RNA, 22 nt, Human
uuccuuugaauccucucucugu

SEQ ID NO: 1311870 - RNA, 14 nt, Human
uucucugauacaga

SEQ ID NO: 1311871 - RNA, 17 nt, Human
uucucugacuucugccu

SEQ ID NO: 1311872 - RNA, 15 nt, Human
uucucugauacagaa

SEQ ID NO: 1311873 - RNA, 16 nt, Human
uucucugauacagaaa

SEQ ID NO: 1311874 - RNA, 17 nt, Human
uucucucuuuauacagc

SEQ ID NO: 1311875 - RNA, 18 nt, Human
uucucucuuuauacagcu

SEQ ID NO: 1311876 - RNA, 20 nt, Human
uucucucuuuauacagcugu

SEQ ID NO: 1311877 - RNA, 21 nt, Human
uucucucuuuauacagcugua

SEQ ID NO: 1311878 - RNA, 11 nt, Human
uucucugacuu

SEQ ID NO: 1311879 - RNA, 12 nt, Human
uucucugacuuc

SEQ ID NO: 1311880 - RNA, 16 nt, Human
uucucugacuucugcc

SEQ ID NO: 1311881 - RNA, 17 nt, Human
uucucugauacagaaaa

SEQ ID NO: 1311882 - RNA, 10 nt, Human
uucucugcca

SEQ ID NO: 1311883 - RNA, 12 nt, Human
uucucugccagu

SEQ ID NO: 1311884 - RNA, 13 nt, Human
uucucugccagug

SEQ ID NO: 1311885 - RNA, 20 nt, Human
uucucuggcuguaaggcucu

SEQ ID NO: 1311886 - RNA, 19 nt, Human
uucucugguaauauugacu

SEQ ID NO: 1311887 - RNA, 13 nt, Human
uucucugucucau

SEQ ID NO: 1311888 - RNA, 12 nt, Human
uucucugucuca

SEQ ID NO: 1311889 - RNA, 18 nt, Human
uucugacucgguuucucc

SEQ ID NO: 1311890 - RNA, 19 nt, Human
uucugacucgguuucucca

SEQ ID NO: 1311891 - RNA, 15 nt, Human
uucugacucugagcu

SEQ ID NO: 1311892 - RNA, 16 nt, Human
uucugacucugagcua

SEQ ID NO: 1311893 - RNA, 23 nt, Human
uucucuccucuccccaugauguu

SEQ ID NO: 1311894 - RNA, 19 nt, Human
uucucuccagcugacuaaa

SEQ ID NO: 1311895 - RNA, 17 nt, Human
uucucucggcuccccau

SEQ ID NO: 1311896 - RNA, 16 nt, Human
uucuccccugcacugu

SEQ ID NO: 1311897 - RNA, 15 nt, Human
uucuccccugcacug

SEQ ID NO: 1311898 - RNA, 12 nt, Human
uucucuccagcu

SEQ ID NO: 1311899 - RNA, 12 nt, Human
uucuccccagcu

SEQ ID NO: 1311900 - RNA, 15 nt, Human
uucuccccagcuccc

SEQ ID NO: 1311901 - RNA, 18 nt, Human
uucuccccagcucccagg

SEQ ID NO: 1311902 - RNA, 21 nt, Human
uucucccccauguucuguccc

SEQ ID NO: 1311903 - RNA, 18 nt, Human
uucuccauggcccugcca

SEQ ID NO: 1311904 - RNA, 23 nt, Human
uucucccaauucauccucacuca

SEQ ID NO: 1311905 - RNA, 11 nt, Human
uucucccacuc

SEQ ID NO: 1311906 - RNA, 12 nt, Human
uucucccacucu

SEQ ID NO: 1311907 - RNA, 16 nt, Human
uucucccacucuccua

SEQ ID NO: 1311908 - RNA, 18 nt, Human
uucucccacucuccuagg

SEQ ID NO: 1311909 - RNA, 19 nt, Human
uucucccaggcaaggcugu

SEQ ID NO: 1311910 - RNA, 20 nt, Human
uucuccauccacaugggagc

SEQ ID NO: 1311911 - RNA, 15 nt, Human
uucuccauccuacca

SEQ ID NO: 1311912 - RNA, 22 nt, Human
uucuccacagcaaccccaggcu

SEQ ID NO: 1311913 - RNA, 15 nt, Human
uucuccacagcaacc

SEQ ID NO: 1311914 - RNA, 15 nt, Human
uucuauggguguuau

SEQ ID NO: 1311915 - RNA, 18 nt, Human
uucuauggguguuaucac

SEQ ID NO: 1311916 - RNA, 13 nt, Human
uucuauuaaaaga

SEQ ID NO: 1311917 - RNA, 14 nt, Human
uucuauuaaaagac

SEQ ID NO: 1311918 - RNA, 15 nt, Human
uucuauuaaaagacu

SEQ ID NO: 1311919 - RNA, 16 nt, Human
uucuauuaaaagacuc

SEQ ID NO: 1311920 - RNA, 17 nt, Human
uucuauuaaaagacuca

SEQ ID NO: 1311921 - RNA, 18 nt, Human
uucuauuaaaagacucau

SEQ ID NO: 1311922 - RNA, 19 nt, Human
uucuauuaaaagacucauc

SEQ ID NO: 1311923 - RNA, 21 nt, Human
uucuauuaaaagacucauccg

SEQ ID NO: 1311924 - RNA, 22 nt, Human
uucuauuaaaagacucauccgu

SEQ ID NO: 1311925 - RNA, 14 nt, Human
uucuauuaaaagug

SEQ ID NO: 1311926 - RNA, 18 nt, Human
uucuauuaaaagugggaa

SEQ ID NO: 1311927 - RNA, 23 nt, Human
uucuauuaaaagugggaauuagg

SEQ ID NO: 1311928 - RNA, 12 nt, Human
uucuauuaaagu

SEQ ID NO: 1311929 - RNA, 21 nt, Human
uucuauuaaagugcuaagguu

SEQ ID NO: 1311930 - RNA, 15 nt, Human
uucuauuaaagugcu

SEQ ID NO: 1311931 - RNA, 20 nt, Human
uucuauuacauuuucaguga

SEQ ID NO: 1311932 - RNA, 13 nt, Human
uucuauugccucu

SEQ ID NO: 1311933 - RNA, 14 nt, Human
uucuauugccucug

SEQ ID NO: 1311934 - RNA, 15 nt, Human
uucuauugccucuga

SEQ ID NO: 1311935 - RNA, 17 nt, Human
uucuauugccucugaga

SEQ ID NO: 1311936 - RNA, 13 nt, Human
uucuaaugaugau

SEQ ID NO: 1311937 - RNA, 14 nt, Human
uucuaauaguuuua

SEQ ID NO: 1311938 - RNA, 19 nt, Human
uucuaauaauuucuaaugu

SEQ ID NO: 1311939 - RNA, 15 nt, Human
uucuauuguuguaca

SEQ ID NO: 1311940 - RNA, 18 nt, Human
uucuauuuauauguacau

SEQ ID NO: 1311941 - RNA, 19 nt, Human
uucuauuuauauguacaug

SEQ ID NO: 1311942 - RNA, 17 nt, Human
uucuauuucacuggagc

SEQ ID NO: 1311943 - RNA, 17 nt, Human
uucuauuucuccuccau

SEQ ID NO: 1311944 - RNA, 19 nt, Human
uucuauuucuccuccaugg

SEQ ID NO: 1311945 - RNA, 15 nt, Human
uucuauuucacugga

SEQ ID NO: 1311946 - RNA, 14 nt, Human
uucuauuuggggcu

SEQ ID NO: 1311947 - RNA, 16 nt, Human
uucuauuuggggcuug

SEQ ID NO: 1311948 - RNA, 18 nt, Human
uucuauuuggggcuugau

SEQ ID NO: 1311949 - RNA, 15 nt, Human
uucuauuuuauuaug

SEQ ID NO: 1311950 - RNA, 18 nt, Human
uucuauuuuauuaugaag

SEQ ID NO: 1311951 - RNA, 20 nt, Human
uucuauuuuauuaugaagaa

SEQ ID NO: 1311952 - RNA, 19 nt, Human
uucuauuuuauuaugaaga

SEQ ID NO: 1311953 - RNA, 13 nt, Human
uucuauuuuguaa

SEQ ID NO: 1311954 - RNA, 16 nt, Human
uucuauuuuguaaacu

SEQ ID NO: 1311955 - RNA, 23 nt, Human
uucuauuuuuuguuuuguuuccu

SEQ ID NO: 1311956 - RNA, 16 nt, Human
uucuauuuuuaucuga

SEQ ID NO: 1311957 - RNA, 15 nt, Human
uucuauuuuuuguuu

SEQ ID NO: 1311958 - RNA, 11 nt, Human
uucucaugccu

SEQ ID NO: 1311959 - RNA, 12 nt, Human
uucucaugccuc

SEQ ID NO: 1311960 - RNA, 14 nt, Human
uucucaugauccaa

SEQ ID NO: 1311961 - RNA, 14 nt, Human
uucucaugccucag

SEQ ID NO: 1311962 - RNA, 21 nt, Human
uucucaugccucagccuccug

SEQ ID NO: 1311963 - RNA, 20 nt, Human
uucuccaaacugaagcagcc

SEQ ID NO: 1311964 - RNA, 22 nt, Human
uucuccaacaucacagcccagc

SEQ ID NO: 1311965 - RNA, 16 nt, Human
uucuccaagagcuaca

SEQ ID NO: 1311966 - RNA, 18 nt, Human
uucucaaaggagcgagca

SEQ ID NO: 1311967 - RNA, 14 nt, Human
uucuuuauaagaaa

SEQ ID NO: 1311968 - RNA, 22 nt, Human
uucuuuauaagaaagccugagu

SEQ ID NO: 1311969 - RNA, 13 nt, Human
uucuuguaauuuu

SEQ ID NO: 1311970 - RNA, 18 nt, Human
uucuuucaauacagauau

SEQ ID NO: 1311971 - RNA, 15 nt, Human
uucuuucaauacaga

SEQ ID NO: 1311972 - RNA, 23 nt, Human
uugaagaauguuaagacuugaca

SEQ ID NO: 1311973 - RNA, 21 nt, Human
uugaagaauguuaagacuuga

SEQ ID NO: 1311974 - RNA, 16 nt, Human
uugaagaacugcaggc

SEQ ID NO: 1311975 - RNA, 20 nt, Human
uugaagaacugcaggcccug

SEQ ID NO: 1311976 - RNA, 19 nt, Human
uugaagaacugcaggcccu

SEQ ID NO: 1311977 - RNA, 15 nt, Human
uugaagaauguuaag

SEQ ID NO: 1311978 - RNA, 19 nt, Human
uugaagaauguuaagacuu

SEQ ID NO: 1311979 - RNA, 14 nt, Human
uugaaagaauagaa

SEQ ID NO: 1311980 - RNA, 15 nt, Human
uugaacucugguggc

SEQ ID NO: 1311981 - RNA, 20 nt, Human
uugaacucuucacucuucaa

SEQ ID NO: 1311982 - RNA, 14 nt, Human
uucugagcauuuaa

SEQ ID NO: 1311983 - RNA, 20 nt, Human
uucugagcagcgagccugcu

SEQ ID NO: 1311984 - RNA, 22 nt, Human
uucugagcagcgagccugcuag

SEQ ID NO: 1311985 - RNA, 19 nt, Human
uucugagcccgguaagagc

SEQ ID NO: 1311986 - RNA, 16 nt, Human
uucugagcuauuucau

SEQ ID NO: 1311987 - RNA, 23 nt, Human
uucugagcuauuucaucuauuuu

SEQ ID NO: 1311988 - RNA, 22 nt, Human
uucugagcccgguaagagcaaa

SEQ ID NO: 1311989 - RNA, 13 nt, Human
uucugagcuccug

SEQ ID NO: 1311990 - RNA, 19 nt, Human
uucugagcuccuguccccu

SEQ ID NO: 1311991 - RNA, 12 nt, Human
uucuguggcuca

SEQ ID NO: 1311992 - RNA, 16 nt, Human
uucuguggcucacaga

SEQ ID NO: 1311993 - RNA, 15 nt, Human
uucugagcuccuguc

SEQ ID NO: 1311994 - RNA, 13 nt, Human
uucuguuaacuga

SEQ ID NO: 1311995 - RNA, 14 nt, Human
uucuguuaacugaa

SEQ ID NO: 1311996 - RNA, 15 nt, Human
uucuguuaacugaau

SEQ ID NO: 1311997 - RNA, 16 nt, Human
uucuguuaacugaaua

SEQ ID NO: 1311998 - RNA, 21 nt, Human
uucuguuaacugaauaccacu

SEQ ID NO: 1311999 - RNA, 17 nt, Human
uucuguuaacugaauac

SEQ ID NO: 1312000 - RNA, 13 nt, Human
uucuguuccaaau

SEQ ID NO: 1312001 - RNA, 17 nt, Human
uucuguuccaaauucag

SEQ ID NO: 1312002 - RNA, 19 nt, Human
uucuguuccaaauucaguu

SEQ ID NO: 1312003 - RNA, 13 nt, Human
uucuguucuaguu

SEQ ID NO: 1312004 - RNA, 14 nt, Human
uucuguucuaguuu

SEQ ID NO: 1312005 - RNA, 21 nt, Human
uucuguucuaguuuuuuacuu

SEQ ID NO: 1312006 - RNA, 14 nt, Human
uucuucaacucccu

SEQ ID NO: 1312007 - RNA, 17 nt, Human
uucuucaagaucccauu

SEQ ID NO: 1312008 - RNA, 12 nt, Human
uucuucaagauc

SEQ ID NO: 1312009 - RNA, 14 nt, Human
uucuuauuucauga

SEQ ID NO: 1312010 - RNA, 16 nt, Human
uucuuauuucaugaaa

SEQ ID NO: 1312011 - RNA, 19 nt, Human
uucuuauuuuuuucuauuu

SEQ ID NO: 1312012 - RNA, 18 nt, Human
uucuucaagaucccauuu

SEQ ID NO: 1312013 - RNA, 16 nt, Human
uucuucaccaaaucuu

SEQ ID NO: 1312014 - RNA, 13 nt, Human
uucuucacugcaa

SEQ ID NO: 1312015 - RNA, 14 nt, Human
uucuucacugcaac

SEQ ID NO: 1312016 - RNA, 22 nt, Human
uucuugguugaggaaacaaaca

SEQ ID NO: 1312017 - RNA, 12 nt, Human
uucuuguaauuu

SEQ ID NO: 1312018 - RNA, 22 nt, Human
uugaccugccucccuucaugca

SEQ ID NO: 1312019 - RNA, 22 nt, Human
uugaccuggauggggcaggcca

SEQ ID NO: 1312020 - RNA, 23 nt, Human
uugaccugccucccuucaugcau

SEQ ID NO: 1312021 - RNA, 21 nt, Human
uugaccuuuuauguaguaauu

SEQ ID NO: 1312022 - RNA, 21 nt, Human
uugaccugccucccuucaugc

SEQ ID NO: 1312023 - RNA, 19 nt, Human
uugaccugaggcugugguc

SEQ ID NO: 1312024 - RNA, 22 nt, Human
uugaccguguuggucuguacug

SEQ ID NO: 1312025 - RNA, 13 nt, Human
uugaccugaggcu

SEQ ID NO: 1312026 - RNA, 20 nt, Human
uugaauggcuauguuuuuaa

SEQ ID NO: 1312027 - RNA, 16 nt, Human
uugaauggcuauguuu

SEQ ID NO: 1312028 - RNA, 16 nt, Human
uugaaugcaaaccaua

SEQ ID NO: 1312029 - RNA, 11 nt, Human
uugaggacaca

SEQ ID NO: 1312030 - RNA, 15 nt, Human
uugaggaaagcaaga

SEQ ID NO: 1312031 - RNA, 23 nt, Human
uugaggaaagcaagaaucagaga

SEQ ID NO: 1312032 - RNA, 13 nt, Human
uugaggaaaacaa

SEQ ID NO: 1312033 - RNA, 23 nt, Human
uugaggaaaacaagcauucacaa

SEQ ID NO: 1312034 - RNA, 15 nt, Human
uugagcuuaaucuuu

SEQ ID NO: 1312035 - RNA, 16 nt, Human
uugagcuuaaucuuug

SEQ ID NO: 1312036 - RNA, 22 nt, Human
uugacuagaaaauuuaaaacau

SEQ ID NO: 1312037 - RNA, 23 nt, Human
uugacuagaugauggaugccaau

SEQ ID NO: 1312038 - RNA, 16 nt, Human
uugaggacacaugucc

SEQ ID NO: 1312039 - RNA, 15 nt, Human
uugaggacacauguc

SEQ ID NO: 1312040 - RNA, 14 nt, Human
uugaggacacaugu

SEQ ID NO: 1312041 - RNA, 13 nt, Human
uugaggacacaug

SEQ ID NO: 1312042 - RNA, 14 nt, Human
uugaggacacugau

SEQ ID NO: 1312043 - RNA, 15 nt, Human
uugaggacacugaua

SEQ ID NO: 1312044 - RNA, 14 nt, Human
uugaggggaccagg

SEQ ID NO: 1312045 - RNA, 17 nt, Human
uugaggggaccaggagu

SEQ ID NO: 1312046 - RNA, 15 nt, Human
uugaggggaccagga

SEQ ID NO: 1312047 - RNA, 21 nt, Human
uugauuggugauuagguggug

SEQ ID NO: 1312048 - RNA, 12 nt, Human
uugaugaagaag

SEQ ID NO: 1312049 - RNA, 13 nt, Human
uugaugaagaagu

SEQ ID NO: 1312050 - RNA, 15 nt, Human
uugaucuggaaccca

SEQ ID NO: 1312051 - RNA, 16 nt, Human
uugaucuggaacccag

SEQ ID NO: 1312052 - RNA, 17 nt, Human
uugaucuggaacccaga

SEQ ID NO: 1312053 - RNA, 19 nt, Human
uugaucuggaacccagacu

SEQ ID NO: 1312054 - RNA, 16 nt, Human
uugcaaaaucaguuuu

SEQ ID NO: 1312055 - RNA, 21 nt, Human
uugcaaaaucaguuuuccucu

SEQ ID NO: 1312056 - RNA, 15 nt, Human
uugcaaaaucaguuu

SEQ ID NO: 1312057 - RNA, 22 nt, Human
uugcaaauguaguauggccugu

SEQ ID NO: 1312058 - RNA, 14 nt, Human
uugauuuucuggau

SEQ ID NO: 1312059 - RNA, 20 nt, Human
uugauuuuugccucuuccag

SEQ ID NO: 1312060 - RNA, 19 nt, Human
uugcaaaaaauguuuuugg

SEQ ID NO: 1312061 - RNA, 15 nt, Human
uugcaaaaacuacaa

SEQ ID NO: 1312062 - RNA, 20 nt, Human
uugcaaaaacuacaaccaau

SEQ ID NO: 1312063 - RNA, 19 nt, Human
uugcaaaaacuacaaccaa

SEQ ID NO: 1312064 - RNA, 14 nt, Human
uugcauagaauaaa

SEQ ID NO: 1312065 - RNA, 22 nt, Human
uugcauacauucuucaagaucc

SEQ ID NO: 1312066 - RNA, 23 nt, Human
uugcagucccaagcggugucucu

SEQ ID NO: 1312067 - RNA, 14 nt, Human
uugcagucacucua

SEQ ID NO: 1312068 - RNA, 16 nt, Human
uugcagucacucuagu

SEQ ID NO: 1312069 - RNA, 22 nt, Human
uugcagucacucuagucaauga

SEQ ID NO: 1312070 - RNA, 13 nt, Human
uugcagucccaag

SEQ ID NO: 1312071 - RNA, 21 nt, Human
uugcagucccaagcggugucu

SEQ ID NO: 1312072 - RNA, 13 nt, Human
uugccacccucau

SEQ ID NO: 1312073 - RNA, 22 nt, Human
uugcauaguaccaaucauuuua

SEQ ID NO: 1312074 - RNA, 23 nt, Human
uugcauaguaccaaucauuuuaa

SEQ ID NO: 1312075 - RNA, 16 nt, Human
uugccacccucaugcu

SEQ ID NO: 1312076 - RNA, 18 nt, Human
uugccaccucuaacagca

SEQ ID NO: 1312077 - RNA, 20 nt, Human
uugccaccucuaacagcacc

SEQ ID NO: 1312078 - RNA, 14 nt, Human
uugccacugccucu

SEQ ID NO: 1312079 - RNA, 15 nt, Human
uugccacugccucuu

SEQ ID NO: 1312080 - RNA, 18 nt, Human
uugcagacaggaaucuua

SEQ ID NO: 1312081 - RNA, 18 nt, Human
uugcagcuguuuuguuga

SEQ ID NO: 1312082 - RNA, 21 nt, Human
uugcagcuguuuuguugacau

SEQ ID NO: 1312083 - RNA, 20 nt, Human
uugcagcuguuuuguugaca

SEQ ID NO: 1312084 - RNA, 23 nt, Human
uugcaguaucggcacuguacaaa

SEQ ID NO: 1312085 - RNA, 15 nt, Human
uugcaguaacuguuu

SEQ ID NO: 1312086 - RNA, 23 nt, Human
uugcagguggccaaguuccucua

SEQ ID NO: 1312087 - RNA, 13 nt, Human
uugcaguaacugu

SEQ ID NO: 1312088 - RNA, 23 nt, Human
uugcaggguccucuucugggccu

SEQ ID NO: 1312089 - RNA, 17 nt, Human
uugcaggguccucuucu

SEQ ID NO: 1312090 - RNA, 14 nt, Human
uugcagguggccaa

SEQ ID NO: 1312091 - RNA, 20 nt, Human
uugcagaagggggucucuuc

SEQ ID NO: 1312092 - RNA, 11 nt, Human
uugcagacagg

SEQ ID NO: 1312093 - RNA, 15 nt, Human
uugcagacaggaauc

SEQ ID NO: 1312094 - RNA, 16 nt, Human
uugcagacaggaaucu

SEQ ID NO: 1312095 - RNA, 13 nt, Human
uugcaaccaggaa

SEQ ID NO: 1312096 - RNA, 18 nt, Human
uugcaaccaggaacagca

SEQ ID NO: 1312097 - RNA, 14 nt, Human
uugcaaccgucugu

SEQ ID NO: 1312098 - RNA, 14 nt, Human
uugcaaccucgcug

SEQ ID NO: 1312099 - RNA, 20 nt, Human
uuggaaguuuagcucugaga

SEQ ID NO: 1312100 - RNA, 15 nt, Human
uuggaaggagcagaa

SEQ ID NO: 1312101 - RNA, 13 nt, Human
uuggaaggagcag

SEQ ID NO: 1312102 - RNA, 20 nt, Human
uuggaagugaaaacuuugua

SEQ ID NO: 1312103 - RNA, 17 nt, Human
uuggaaguuuagcucug

SEQ ID NO: 1312104 - RNA, 18 nt, Human
uuggaaguuuagcucuga

SEQ ID NO: 1312105 - RNA, 19 nt, Human
uuggaaguuuagcucugag

SEQ ID NO: 1312106 - RNA, 21 nt, Human
uuggaaguuuagcucugagaa

SEQ ID NO: 1312107 - RNA, 15 nt, Human
uuggaaguuuuaauc

SEQ ID NO: 1312108 - RNA, 22 nt, Human
uuggaacuugccugccuuucca

SEQ ID NO: 1312109 - RNA, 14 nt, Human
uuggaacuugccug

SEQ ID NO: 1312110 - RNA, 18 nt, Human
uuggaagaaggggcaggu

SEQ ID NO: 1312111 - RNA, 19 nt, Human
uuggaaccuuguuuuggac

SEQ ID NO: 1312112 - RNA, 16 nt, Human
uuggaacucugcuuga

SEQ ID NO: 1312113 - RNA, 17 nt, Human
uuggaacugaagggggc

SEQ ID NO: 1312114 - RNA, 13 nt, Human
uuggaacuggagg

SEQ ID NO: 1312115 - RNA, 14 nt, Human
uuggaacuggaggc

SEQ ID NO: 1312116 - RNA, 16 nt, Human
uuggaacuggaggcag

SEQ ID NO: 1312117 - RNA, 14 nt, Human
uuggauuguauauu

SEQ ID NO: 1312118 - RNA, 18 nt, Human
uuggauuguauauugugu

SEQ ID NO: 1312119 - RNA, 21 nt, Human
uuggauuggacaaaaugacuu

SEQ ID NO: 1312120 - RNA, 17 nt, Human
uuggauuggacaaaaug

SEQ ID NO: 1312121 - RNA, 20 nt, Human
uuggauucuuuccauuugca

SEQ ID NO: 1312122 - RNA, 15 nt, Human
uuggaaauuuagcau

SEQ ID NO: 1312123 - RNA, 16 nt, Human
uuggaaauuuagcauu

SEQ ID NO: 1312124 - RNA, 17 nt, Human
uuggaaauuuagcauug

SEQ ID NO: 1312125 - RNA, 18 nt, Human
uuggaaauuuagcauugu

SEQ ID NO: 1312126 - RNA, 22 nt, Human
uuggaacauuggaauguucuca

SEQ ID NO: 1312127 - RNA, 13 nt, Human
uuggaaccagacu

SEQ ID NO: 1312128 - RNA, 14 nt, Human
uuggaaccagacuc

SEQ ID NO: 1312129 - RNA, 15 nt, Human
uuggaaccagacucu

SEQ ID NO: 1312130 - RNA, 14 nt, Human
uuggaaccuuguuu

SEQ ID NO: 1312131 - RNA, 14 nt, Human
uugcuuaccucuca

SEQ ID NO: 1312132 - RNA, 13 nt, Human
uuggaaagcaggu

SEQ ID NO: 1312133 - RNA, 17 nt, Human
uuggaaaguacacucug

SEQ ID NO: 1312134 - RNA, 22 nt, Human
uuggaaaguacacucugcuguu

SEQ ID NO: 1312135 - RNA, 13 nt, Human
uuggaaauaaagu

SEQ ID NO: 1312136 - RNA, 21 nt, Human
uuggaaauaaagucagaugga

SEQ ID NO: 1312137 - RNA, 21 nt, Human
uuggaaaguacacucugcugu

SEQ ID NO: 1312138 - RNA, 14 nt, Human
uuggaaauacugua

SEQ ID NO: 1312139 - RNA, 16 nt, Human
uugcuguaauguuaau

SEQ ID NO: 1312140 - RNA, 13 nt, Human
uugcuguuuugau

SEQ ID NO: 1312141 - RNA, 18 nt, Human
uugccacugccucuuccu

SEQ ID NO: 1312142 - RNA, 15 nt, Human
uugccaguuguccuc

SEQ ID NO: 1312143 - RNA, 17 nt, Human
uugccaguuguccuccu

SEQ ID NO: 1312144 - RNA, 19 nt, Human
uugccaguuguccuccuuc

SEQ ID NO: 1312145 - RNA, 20 nt, Human
uugccaguuguccuccuucc

SEQ ID NO: 1312146 - RNA, 18 nt, Human
uugccucugagagcauca

SEQ ID NO: 1312147 - RNA, 12 nt, Human
uugccucugugc

SEQ ID NO: 1312148 - RNA, 13 nt, Human
uugccucugugcu

SEQ ID NO: 1312149 - RNA, 22 nt, Human
uugcuaaaggaaaaaaccaucc

SEQ ID NO: 1312150 - RNA, 11 nt, Human
uugcugccuca

SEQ ID NO: 1312151 - RNA, 19 nt, Human
uugcugccccaucagugcu

SEQ ID NO: 1312152 - RNA, 20 nt, Human
uugcugccccaucagugcuc

SEQ ID NO: 1312153 - RNA, 12 nt, Human
uugcugccucau

SEQ ID NO: 1312154 - RNA, 15 nt, Human
uugcugccucaugcu

SEQ ID NO: 1312155 - RNA, 13 nt, Human
uugcugcaaaccu

SEQ ID NO: 1312156 - RNA, 15 nt, Human
uugcugcaaaccuga

SEQ ID NO: 1312157 - RNA, 20 nt, Human
uugcugcaagcacagcccuu

SEQ ID NO: 1312158 - RNA, 18 nt, Human
uugcugcaguaugaaaau

SEQ ID NO: 1312159 - RNA, 16 nt, Human
uugcugcauggcaggg

SEQ ID NO: 1312160 - RNA, 15 nt, Human
uugcugcauggcagg

SEQ ID NO: 1312161 - RNA, 14 nt, Human
uugccucugugcug

SEQ ID NO: 1312162 - RNA, 19 nt, Human
uugccucugugcugugugu

SEQ ID NO: 1312163 - RNA, 17 nt, Human
uugccucuuccagucuu

SEQ ID NO: 1312164 - RNA, 19 nt, Human
uugccucuuccagucuucc

SEQ ID NO: 1312165 - RNA, 19 nt, Human
uugccucugagagcaucag

SEQ ID NO: 1312166 - RNA, 19 nt, Human
uugccugaacuccugccau

SEQ ID NO: 1312167 - RNA, 12 nt, Human
uugccugcaggc

SEQ ID NO: 1312168 - RNA, 12 nt, Human
uugccugccuuu

SEQ ID NO: 1312169 - RNA, 14 nt, Human
uugccugccuuucc

SEQ ID NO: 1312170 - RNA, 15 nt, Human
uugccugccuuucca

SEQ ID NO: 1312171 - RNA, 23 nt, Human
uugccugccuuuccauccauggc

SEQ ID NO: 1312172 - RNA, 16 nt, Human
uugccugccuuuccau

SEQ ID NO: 1312173 - RNA, 12 nt, Human
uugccugguaca

SEQ ID NO: 1312174 - RNA, 13 nt, Human
uugccugguacag

SEQ ID NO: 1312175 - RNA, 14 nt, Human
uugccugguacagu

SEQ ID NO: 1312176 - RNA, 15 nt, Human
uugccugguacagua

SEQ ID NO: 1312177 - RNA, 14 nt, Human
uugcggcuccucag

SEQ ID NO: 1312178 - RNA, 14 nt, Human
uugcgguucaggaa

SEQ ID NO: 1312179 - RNA, 14 nt, Human
uugguaaaccuuuu

SEQ ID NO: 1312180 - RNA, 16 nt, Human
uugguaaagacuggcu

SEQ ID NO: 1312181 - RNA, 19 nt, Human
uugguaaagacuggcuuuu

SEQ ID NO: 1312182 - RNA, 12 nt, Human
uugguaaaccuu

SEQ ID NO: 1312183 - RNA, 15 nt, Human
uuggguuuuuuuccu

SEQ ID NO: 1312184 - RNA, 16 nt, Human
uugggaaacuuggcuc

SEQ ID NO: 1312185 - RNA, 14 nt, Human
uuggcuuaccuggc

SEQ ID NO: 1312186 - RNA, 18 nt, Human
uugggaacugaacucacu

SEQ ID NO: 1312187 - RNA, 12 nt, Human
uugggaggcuga

SEQ ID NO: 1312188 - RNA, 12 nt, Human
uuggcuggaccc

SEQ ID NO: 1312189 - RNA, 17 nt, Human
uuggcuggacccagcca

SEQ ID NO: 1312190 - RNA, 15 nt, Human
uuggcuggacccagc

SEQ ID NO: 1312191 - RNA, 19 nt, Human
uuggccauauuuaccucag

SEQ ID NO: 1312192 - RNA, 15 nt, Human
uuggccacagccagg

SEQ ID NO: 1312193 - RNA, 18 nt, Human
uuggccauauuuaccuca

SEQ ID NO: 1312194 - RNA, 20 nt, Human
uuggcuggugugguacagag

SEQ ID NO: 1312195 - RNA, 21 nt, Human
uuggcuggugugguacagaga

SEQ ID NO: 1312196 - RNA, 23 nt, Human
uuggcuggugugguacagagaag

SEQ ID NO: 1312197 - RNA, 22 nt, Human
uuggcuggugugguacagagaa

SEQ ID NO: 1312198 - RNA, 14 nt, Human
uuggccaggcuggu

SEQ ID NO: 1312199 - RNA, 22 nt, Human
uuggccaaugcaccuaaagaaa

SEQ ID NO: 1312200 - RNA, 23 nt, Human
uuggccaaugcaccuaaagaaaa

SEQ ID NO: 1312201 - RNA, 14 nt, Human
uuggccacuccgag

SEQ ID NO: 1312202 - RNA, 21 nt, Human
uuggccacuccgagagguggg

SEQ ID NO: 1312203 - RNA, 22 nt, Human
uuggccacuccgagaggugggc

SEQ ID NO: 1312204 - RNA, 17 nt, Human
uuggccaaggaaaggca

SEQ ID NO: 1312205 - RNA, 15 nt, Human
uuggcaucccugggc

SEQ ID NO: 1312206 - RNA, 16 nt, Human
uuggcauggaaauuua

SEQ ID NO: 1312207 - RNA, 20 nt, Human
uuggcauggaaauuuaaagc

SEQ ID NO: 1312208 - RNA, 21 nt, Human
uuggcauggaaauuuaaagca

SEQ ID NO: 1312209 - RNA, 22 nt, Human
uuggcauggaaauuuaaagcag

SEQ ID NO: 1312210 - RNA, 13 nt, Human
uuggcaucccugg

SEQ ID NO: 1312211 - RNA, 17 nt, Human
uuggcaucccugggccu

SEQ ID NO: 1312212 - RNA, 16 nt, Human
uuguaaaggaauuuaa

SEQ ID NO: 1312213 - RNA, 17 nt, Human
uuguaaaguauguauua

SEQ ID NO: 1312214 - RNA, 14 nt, Human
uuguaaauauugug

SEQ ID NO: 1312215 - RNA, 21 nt, Human
uuguauucagaguugaugguu

SEQ ID NO: 1312216 - RNA, 14 nt, Human
uuguauucagaguu

SEQ ID NO: 1312217 - RNA, 22 nt, Human
uuguauucaaaaauuaucuaua

SEQ ID NO: 1312218 - RNA, 15 nt, Human
uuguagauugauugu

SEQ ID NO: 1312219 - RNA, 19 nt, Human
uuguagauugauuguauug

SEQ ID NO: 1312220 - RNA, 15 nt, Human
uuguauccccugcag

SEQ ID NO: 1312221 - RNA, 14 nt, Human
uuguauccccugca

SEQ ID NO: 1312222 - RNA, 21 nt, Human
uuguagagaaaacaugcagaa

SEQ ID NO: 1312223 - RNA, 17 nt, Human
uguagauaauacaguuc

SEQ ID NO: 1312224 - RNA, 13 nt, Human
uguagaguugcug

SEQ ID NO: 1312225 - RNA, 14 nt, Human
uguagaguugcuga

SEQ ID NO: 1312226 - RNA, 15 nt, Human
uguagaguugcugag

SEQ ID NO: 1312227 - RNA, 20 nt, Human
uguagaguugcugagagggc

SEQ ID NO: 1312228 - RNA, 13 nt, Human
uguagauaagugu

SEQ ID NO: 1312229 - RNA, 14 nt, Human
uguagauaaguguu

SEQ ID NO: 1312230 - RNA, 17 nt, Human
uguacugauucaauuug

SEQ ID NO: 1312231 - RNA, 16 nt, Human
uguacugauucaauuu

SEQ ID NO: 1312232 - RNA, 15 nt, Human
uguacugauucaauu

SEQ ID NO: 1312233 - RNA, 22 nt, Human
uguacugagccuuguaauucua

SEQ ID NO: 1312234 - RNA, 19 nt, Human
uguacugagccuuguaauu

SEQ ID NO: 1312235 - RNA, 20 nt, Human
uguacugagccuuguaauuc

SEQ ID NO: 1312236 - RNA, 18 nt, Human
uguacugaaguaaaacaa

SEQ ID NO: 1312237 - RNA, 17 nt, Human
uguacugagccuuguaa

SEQ ID NO: 1312238 - RNA, 14 nt, Human
uguacugaaguaaa

SEQ ID NO: 1312239 - RNA, 20 nt, Human
uguacugaaaaaugguaauu

SEQ ID NO: 1312240 - RNA, 12 nt, Human
uguacugaaaaa

SEQ ID NO: 1312241 - RNA, 15 nt, Human
uguacuauuuaacug

SEQ ID NO: 1312242 - RNA, 18 nt, Human
uguacuauuuaacugacu

SEQ ID NO: 1312243 - RNA, 12 nt, Human
uguacuccuccc

SEQ ID NO: 1312244 - RNA, 13 nt, Human
uguacuccuccca

SEQ ID NO: 1312245 - RNA, 19 nt, Human
uguacuaaccuacagagau

SEQ ID NO: 1312246 - RNA, 16 nt, Human
uguacuaacuagcauu

SEQ ID NO: 1312247 - RNA, 21 nt, Human
uguacuauagcggcauauaga

SEQ ID NO: 1312248 - RNA, 14 nt, Human
uguacuauuuaacu

SEQ ID NO: 1312249 - RNA, 15 nt, Human
uguacuaaagccaaa

SEQ ID NO: 1312250 - RNA, 16 nt, Human
uguacuaaagccaaac

SEQ ID NO: 1312251 - RNA, 18 nt, Human
uguacuaaagccaaacau

SEQ ID NO: 1312252 - RNA, 20 nt, Human
uguacuaaagccaaacauau

SEQ ID NO: 1312253 - RNA, 17 nt, Human
uguacccucugaaauac

SEQ ID NO: 1312254 - RNA, 18 nt, Human
uguaccugcccccaaucc

SEQ ID NO: 1312255 - RNA, 15 nt, Human
uguaccgcaauguga

SEQ ID NO: 1312256 - RNA, 14 nt, Human
uguaccauuugccu

SEQ ID NO: 1312257 - RNA, 18 nt, Human
uguaccauuuuaaaguua

SEQ ID NO: 1312258 - RNA, 12 nt, Human
uguacccaccgg

SEQ ID NO: 1312259 - RNA, 16 nt, Human
uguacccaccgggcca

SEQ ID NO: 1312260 - RNA, 20 nt, Human
uguacccaccgggccacucc

SEQ ID NO: 1312261 - RNA, 21 nt, Human
uguacccaccgggccacuccu

SEQ ID NO: 1312262 - RNA, 14 nt, Human
uguacccaguuucu

SEQ ID NO: 1312263 - RNA, 12 nt, Human
uguacccaguuu

SEQ ID NO: 1312264 - RNA, 15 nt, Human
uguaaugaauaccuu

SEQ ID NO: 1312265 - RNA, 14 nt, Human
uguaaugaauaccu

SEQ ID NO: 1312266 - RNA, 11 nt, Human
uguaaugaaua

SEQ ID NO: 1312267 - RNA, 12 nt, Human
uguaaugacagg

SEQ ID NO: 1312268 - RNA, 17 nt, Human
uguaauggcaguuauau

SEQ ID NO: 1312269 - RNA, 23 nt, Human
uguaauggcaguuauauuuugca

SEQ ID NO: 1312270 - RNA, 21 nt, Human
uguaaugguacugacuuugcu

SEQ ID NO: 1312271 - RNA, 19 nt, Human
uguaaugguacugacuuug

SEQ ID NO: 1312272 - RNA, 23 nt, Human
uguaauguaucaaauacauuuaa

SEQ ID NO: 1312273 - RNA, 14 nt, Human
uguacaguagauuu

SEQ ID NO: 1312274 - RNA, 17 nt, Human
uguacaguagauuuucc

SEQ ID NO: 1312275 - RNA, 18 nt, Human
uguacaguagauuuucca

SEQ ID NO: 1312276 - RNA, 20 nt, Human
uguacaguagauuuuccaaa

SEQ ID NO: 1312277 - RNA, 18 nt, Human
uguacaguauguucaaag

SEQ ID NO: 1312278 - RNA, 22 nt, Human
uguaaaugucucacugagcacu

SEQ ID NO: 1312279 - RNA, 17 nt, Human
uguaaaugucucacuga

SEQ ID NO: 1312280 - RNA, 16 nt, Human
uguaaaugucucacug

SEQ ID NO: 1312281 - RNA, 14 nt, Human
uguaaaucugccac

SEQ ID NO: 1312282 - RNA, 15 nt, Human
uguaaaucugccaca

SEQ ID NO: 1312283 - RNA, 16 nt, Human
uguaaaucugccacaa

SEQ ID NO: 1312284 - RNA, 16 nt, Human
ugguaggcauuuccua

SEQ ID NO: 1312285 - RNA, 13 nt, Human
ugguaggguggga

SEQ ID NO: 1312286 - RNA, 19 nt, Human
ugguagggugggagugguu

SEQ ID NO: 1312287 - RNA, 21 nt, Human
uguaaacaaacuguguaacug

SEQ ID NO: 1312288 - RNA, 11 nt, Human
uguaaacacag

SEQ ID NO: 1312289 - RNA, 13 nt, Human
uguaaaucugcca

SEQ ID NO: 1312290 - RNA, 12 nt, Human
uguaaauuggca

SEQ ID NO: 1312291 - RNA, 19 nt, Human
uguaaccucuucagaggcc

SEQ ID NO: 1312292 - RNA, 11 nt, Human
uguaaauuggc

SEQ ID NO: 1312293 - RNA, 20 nt, Human
uguaaaugucucacugagca

SEQ ID NO: 1312294 - RNA, 14 nt, Human
uguaaauuaucagg

SEQ ID NO: 1312295 - RNA, 12 nt, Human
uguaaauuaugu

SEQ ID NO: 1312296 - RNA, 13 nt, Human
uguaaauuaugua

SEQ ID NO: 1312297 - RNA, 23 nt, Human
uguaacgcaaguucccaguugga

SEQ ID NO: 1312298 - RNA, 19 nt, Human
uguaacgcaaguucccagu

SEQ ID NO: 1312299 - RNA, 14 nt, Human
uguaacuaaaauaa

SEQ ID NO: 1312300 - RNA, 15 nt, Human
uguaacuaaaauaau

SEQ ID NO: 1312301 - RNA, 23 nt, Human
uguaacuaaaauaauuuuguaau

SEQ ID NO: 1312302 - RNA, 16 nt, Human
uguaacuacuuuauaa

SEQ ID NO: 1312303 - RNA, 17 nt, Human
uguaacuacuuuauaac

SEQ ID NO: 1312304 - RNA, 18 nt, Human
uguaacuacuuuauaacu

SEQ ID NO: 1312305 - RNA, 19 nt, Human
uguaacuauaguccagcuu

SEQ ID NO: 1312306 - RNA, 21 nt, Human
uguaacuauaguccagcuuug

SEQ ID NO: 1312307 - RNA, 15 nt, Human
uguaaucacagcuac

SEQ ID NO: 1312308 - RNA, 17 nt, Human
uguaaucauauaauaaa

SEQ ID NO: 1312309 - RNA, 13 nt, Human
uguaacugccagg

SEQ ID NO: 1312310 - RNA, 15 nt, Human
uguaacugccaggcu

SEQ ID NO: 1312311 - RNA, 18 nt, Human
uguaacugccaggcucuc

SEQ ID NO: 1312312 - RNA, 11 nt, Human
uguaacugccc

SEQ ID NO: 1312313 - RNA, 13 nt, Human
uguaacugcccaa

SEQ ID NO: 1312314 - RNA, 16 nt, Human
uguaacugccuagaaa

SEQ ID NO: 1312315 - RNA, 18 nt, Human
uguaacugcccaaagcag

SEQ ID NO: 1312316 - RNA, 18 nt, Human
uguauuguauauuacaau

SEQ ID NO: 1312317 - RNA, 16 nt, Human
uguauuguauauuaca

SEQ ID NO: 1312318 - RNA, 13 nt, Human
uguaugcauguug

SEQ ID NO: 1312319 - RNA, 14 nt, Human
uguauugcacauug

SEQ ID NO: 1312320 - RNA, 15 nt, Human
uguauugcacauugu

SEQ ID NO: 1312321 - RNA, 19 nt, Human
uguauugcacauuguaaaa

SEQ ID NO: 1312322 - RNA, 14 nt, Human
uguauuuaacagaa

SEQ ID NO: 1312323 - RNA, 15 nt, Human
uguauuuaacagaaa

SEQ ID NO: 1312324 - RNA, 16 nt, Human
uguauuuaacagaaau

SEQ ID NO: 1312325 - RNA, 21 nt, Human
uguauuuaacagaaauuguau

SEQ ID NO: 1312326 - RNA, 20 nt, Human
uguauuuacgcuuugauuca

SEQ ID NO: 1312327 - RNA, 21 nt, Human
uguauuuacgcuuugauucau

SEQ ID NO: 1312328 - RNA, 23 nt, Human
uguauuuacgcuuugauucauag

SEQ ID NO: 1312329 - RNA, 14 nt, Human
uguauuuauaaaua

SEQ ID NO: 1312330 - RNA, 21 nt, Human
uguauuuauaaauauauuuaa

SEQ ID NO: 1312331 - RNA, 17 nt, Human
uguauuugaaauaagaa

SEQ ID NO: 1312332 - RNA, 16 nt, Human
uguaugcacaguaaaa

SEQ ID NO: 1312333 - RNA, 17 nt, Human
uguaugcacaugaacuu

SEQ ID NO: 1312334 - RNA, 18 nt, Human
uguaugcacaugaacuua

SEQ ID NO: 1312335 - RNA, 18 nt, Human
uguaucuaugcauuuucu

SEQ ID NO: 1312336 - RNA, 14 nt, Human
uguaugcacuuugu

SEQ ID NO: 1312337 - RNA, 21 nt, Human
uguaugcacaugaacuuagau

SEQ ID NO: 1312338 - RNA, 15 nt, Human
uguaugcauguuguc

SEQ ID NO: 1312339 - RNA, 19 nt, Human
uguaucuaugcauuuucug

SEQ ID NO: 1312340 - RNA, 14 nt, Human
uguauacuauagua

SEQ ID NO: 1312341 - RNA, 17 nt, Human
uguauacuauaguacca

SEQ ID NO: 1312342 - RNA, 15 nt, Human
uguauacuauaguac

SEQ ID NO: 1312343 - RNA, 15 nt, Human
uguauacugccacua

SEQ ID NO: 1312344 - RNA, 19 nt, Human
uguauacuauaguaccagu

SEQ ID NO: 1312345 - RNA, 14 nt, Human
uguauccccugcag

SEQ ID NO: 1312346 - RNA, 16 nt, Human
uguauccccugcaggc

SEQ ID NO: 1312347 - RNA, 20 nt, Human
uguagcaacuacagucuaaa

SEQ ID NO: 1312348 - RNA, 15 nt, Human
uguagcacuuacugg

SEQ ID NO: 1312349 - RNA, 19 nt, Human
uguagcacuuacugguagg

SEQ ID NO: 1312350 - RNA, 14 nt, Human
uguauaauuggauu

SEQ ID NO: 1312351 - RNA, 18 nt, Human
uguauaauuggauuuccu

SEQ ID NO: 1312352 - RNA, 19 nt, Human
uguauaauuggauuuccua

SEQ ID NO: 1312353 - RNA, 21 nt, Human
uguauaauuggauuuccuaau

SEQ ID NO: 1312354 - RNA, 16 nt, Human
ugucagucacagccac

SEQ ID NO: 1312355 - RNA, 17 nt, Human
ugucagucacagccacc

SEQ ID NO: 1312356 - RNA, 18 nt, Human
ugucagucacagccaccc

SEQ ID NO: 1312357 - RNA, 22 nt, Human
ugucagucacagccaccccuga

SEQ ID NO: 1312358 - RNA, 12 nt, Human
ugucauacagag

SEQ ID NO: 1312359 - RNA, 13 nt, Human
ugucauacagaga

SEQ ID NO: 1312360 - RNA, 14 nt, Human
ugucauacagagaa

SEQ ID NO: 1312361 - RNA, 15 nt, Human
ugucauacagagaag

SEQ ID NO: 1312362 - RNA, 18 nt, Human
ugucauacagagaaguca

SEQ ID NO: 1312363 - RNA, 16 nt, Human
ugucauacagagaagu

SEQ ID NO: 1312364 - RNA, 12 nt, Human
uguauuugcuaa

SEQ ID NO: 1312365 - RNA, 13 nt, Human
uguauuugcuaau

SEQ ID NO: 1312366 - RNA, 14 nt, Human
uguauuugcuuuuu

SEQ ID NO: 1312367 - RNA, 12 nt, Human
uguauuuggaaa

SEQ ID NO: 1312368 - RNA, 13 nt, Human
uguauuuggaaau

SEQ ID NO: 1312369 - RNA, 21 nt, Human
uguauuuggaaauaaagucag

SEQ ID NO: 1312370 - RNA, 17 nt, Human
uguauuugcuaauuuuu

SEQ ID NO: 1312371 - RNA, 15 nt, Human
ugucacuaaagcagg

SEQ ID NO: 1312372 - RNA, 14 nt, Human
ugucacuaaagcag

SEQ ID NO: 1312373 - RNA, 14 nt, Human
ugucacucaaggcg

SEQ ID NO: 1312374 - RNA, 17 nt, Human
ugucacucaaggcggug

SEQ ID NO: 1312375 - RNA, 20 nt, Human
ugucacucaaggcggugcuu

SEQ ID NO: 1312376 - RNA, 22 nt, Human
ugucacucaaggcggugcuuga

SEQ ID NO: 1312377 - RNA, 17 nt, Human
ugucacugacacacacg

SEQ ID NO: 1312378 - RNA, 14 nt, Human
ugucagucacagcc

SEQ ID NO: 1312379 - RNA, 15 nt, Human
ugucagucacagcca

SEQ ID NO: 1312380 - RNA, 14 nt, Human
uguccauuguccaa

SEQ ID NO: 1312381 - RNA, 17 nt, Human
uguccauuguccaaucc

SEQ ID NO: 1312382 - RNA, 14 nt, Human
ugucccagaagaug

SEQ ID NO: 1312383 - RNA, 16 nt, Human
ugucccagaagaugac

SEQ ID NO: 1312384 - RNA, 21 nt, Human
ugucccagaagaugacugagg

SEQ ID NO: 1312385 - RNA, 14 nt, Human
ugucccagguccuc

SEQ ID NO: 1312386 - RNA, 16 nt, Human
ugucccagguccucac

SEQ ID NO: 1312387 - RNA, 17 nt, Human
ugucccagguccucacu

SEQ ID NO: 1312388 - RNA, 16 nt, Human
ugucccaggcacugua

SEQ ID NO: 1312389 - RNA, 21 nt, Human
ugucccaucggagugcggacc

SEQ ID NO: 1312390 - RNA, 16 nt, Human
ugucccaugaucccug

SEQ ID NO: 1312391 - RNA, 17 nt, Human
ugucccaugaucccugu

SEQ ID NO: 1312392 - RNA, 18 nt, Human
ugucccaugaucccugug

SEQ ID NO: 1312393 - RNA, 15 nt, Human
ugucauagaaauuac

SEQ ID NO: 1312394 - RNA, 16 nt, Human
ugucauagaaauuaca

SEQ ID NO: 1312395 - RNA, 14 nt, Human
ugucaucaauuaaa

SEQ ID NO: 1312396 - RNA, 15 nt, Human
ugucaucaauuaaag

SEQ ID NO: 1312397 - RNA, 13 nt, Human
ugucaucacucua

SEQ ID NO: 1312398 - RNA, 22 nt, Human
ugucaucacucuagguuuuaca

SEQ ID NO: 1312399 - RNA, 23 nt, Human
ugucauuaaauggggcucacaaa

SEQ ID NO: 1312400 - RNA, 23 nt, Human
ugucauucgcuacuaugauuuaa

SEQ ID NO: 1312401 - RNA, 16 nt, Human
ugucauugaaaaacua

SEQ ID NO: 1312402 - RNA, 12 nt, Human
ugucauuguuau

SEQ ID NO: 1312403 - RNA, 14 nt, Human
ugucauuguuauau

SEQ ID NO: 1312404 - RNA, 20 nt, Human
ugucauuguuauauaaucau

SEQ ID NO: 1312405 - RNA, 22 nt, Human
uguccaugcgcucagggccaug

SEQ ID NO: 1312406 - RNA, 13 nt, Human
ugugauauaagug

SEQ ID NO: 1312407 - RNA, 15 nt, Human
ugugcaaggcagccg

SEQ ID NO: 1312408 - RNA, 17 nt, Human
ugugcaaggcagccgug

SEQ ID NO: 1312409 - RNA, 19 nt, Human
ugugcaaggcagccguggg

SEQ ID NO: 1312410 - RNA, 18 nt, Human
ugugcaagguauuacacu

SEQ ID NO: 1312411 - RNA, 21 nt, Human
ugugcaaggcagccgugggcc

SEQ ID NO: 1312412 - RNA, 13 nt, Human
ugugcaauagaag

SEQ ID NO: 1312413 - RNA, 16 nt, Human
ugugcaauagaaggug

SEQ ID NO: 1312414 - RNA, 17 nt, Human
ugugcaauguaaauauu

SEQ ID NO: 1312415 - RNA, 18 nt, Human
ugugcaauguaaauauuu

SEQ ID NO: 1312416 - RNA, 11 nt, Human
ugugcaaugug

SEQ ID NO: 1312417 - RNA, 14 nt, Human
ugugcaauguguau

SEQ ID NO: 1312418 - RNA, 22 nt, Human
ugugaguuuaccuuguauacug

SEQ ID NO: 1312419 - RNA, 16 nt, Human
ugugagucaauacaua

SEQ ID NO: 1312420 - RNA, 23 nt, Human
ugugaguuuaccuuguauacugu

SEQ ID NO: 1312421 - RNA, 21 nt, Human
ugugagucaauacauagugcu

SEQ ID NO: 1312422 - RNA, 13 nt, Human
ugugauaaggaaa

SEQ ID NO: 1312423 - RNA, 15 nt, Human
ugugagggugcugac

SEQ ID NO: 1312424 - RNA, 15 nt, Human
ugugacccccagcuc

SEQ ID NO: 1312425 - RNA, 16 nt, Human
ugugacccccagcucc

SEQ ID NO: 1312426 - RNA, 20 nt, Human
ugugacccccagcuccggcc

SEQ ID NO: 1312427 - RNA, 17 nt, Human
ugugacccccagcuccg

SEQ ID NO: 1312428 - RNA, 16 nt, Human
ugugaaucauuuuacc

SEQ ID NO: 1312429 - RNA, 16 nt, Human
ugugaaucaaggguca

SEQ ID NO: 1312430 - RNA, 17 nt, Human
ugugaaucaagggucag

SEQ ID NO: 1312431 - RNA, 21 nt, Human
ugugaaucaagggucaggccu

SEQ ID NO: 1312432 - RNA, 22 nt, Human
ugugaaucaagggucaggccuu

SEQ ID NO: 1312433 - RNA, 21 nt, Human
ugugaauaccugcucacguca

SEQ ID NO: 1312434 - RNA, 22 nt, Human
ugugaauagaacucugaaauga

SEQ ID NO: 1312435 - RNA, 14 nt, Human
ugugaaugaacacu

SEQ ID NO: 1312436 - RNA, 23 nt, Human
ugugaaugaacacucuuuugcuu

SEQ ID NO: 1312437 - RNA, 17 nt, Human
ugugaaugaacacucuu

SEQ ID NO: 1312438 - RNA, 17 nt, Human
ugugaaugccacugccu

SEQ ID NO: 1312439 - RNA, 15 nt, Human
ugugaccacaacaug

SEQ ID NO: 1312440 - RNA, 22 nt, Human
ugugaccacugcagaagacagu

SEQ ID NO: 1312441 - RNA, 12 nt, Human
ugugacaaaaaa

SEQ ID NO: 1312442 - RNA, 15 nt, Human
ugugacaaaaaauua

SEQ ID NO: 1312443 - RNA, 16 nt, Human
ugugacaaaaaauuaa

SEQ ID NO: 1312444 - RNA, 21 nt, Human
ugugacaaaaaauuaaagcau

SEQ ID NO: 1312445 - RNA, 12 nt, Human
ugugacagggcg

SEQ ID NO: 1312446 - RNA, 16 nt, Human
ugugacauacccccuc

SEQ ID NO: 1312447 - RNA, 21 nt, Human
ugugacauacccccuccccca

SEQ ID NO: 1312448 - RNA, 13 nt, Human
ugugaaacauguu

SEQ ID NO: 1312449 - RNA, 21 nt, Human
ugucuggugguggcaccaucu

SEQ ID NO: 1312450 - RNA, 20 nt, Human
ugucugggugcuacugggga

SEQ ID NO: 1312451 - RNA, 13 nt, Human
ugucugguucuca

SEQ ID NO: 1312452 - RNA, 14 nt, Human
ugucugguucucaa

SEQ ID NO: 1312453 - RNA, 14 nt, Human
ugucuuuuuuugua

SEQ ID NO: 1312454 - RNA, 16 nt, Human
ugucuuuuuuuguaua

SEQ ID NO: 1312455 - RNA, 23 nt, Human
ugucuuuuuuuguauaguuaaca

SEQ ID NO: 1312456 - RNA, 22 nt, Human
ugucuuuuuuuguauaguuaac

SEQ ID NO: 1312457 - RNA, 14 nt, Human
ugugaaacuuucau

SEQ ID NO: 1312458 - RNA, 15 nt, Human
ugugaaacuuucauu

SEQ ID NO: 1312459 - RNA, 14 nt, Human
ugucuuuuuucuaa

SEQ ID NO: 1312460 - RNA, 22 nt, Human
ugucugguucucaauuccaaca

SEQ ID NO: 1312461 - RNA, 21 nt, Human
ugucuggggagcgggucugcu

SEQ ID NO: 1312462 - RNA, 14 nt, Human
ugucuggggcagaa

SEQ ID NO: 1312463 - RNA, 15 nt, Human
ugucugggugcuacu

SEQ ID NO: 1312464 - RNA, 16 nt, Human
ugucugggugcuacug

SEQ ID NO: 1312465 - RNA, 21 nt, Human
ugucugggugcuacuggggaa

SEQ ID NO: 1312466 - RNA, 13 nt, Human
ugucugguggccc

SEQ ID NO: 1312467 - RNA, 14 nt, Human
ugucugguggcccc

SEQ ID NO: 1312468 - RNA, 16 nt, Human
ugucugguggccccgu

SEQ ID NO: 1312469 - RNA, 13 nt, Human
uguccccaacagc

SEQ ID NO: 1312470 - RNA, 14 nt, Human
uguccccaacagcg

SEQ ID NO: 1312471 - RNA, 20 nt, Human
uguccccaacagcgcccaaa

SEQ ID NO: 1312472 - RNA, 20 nt, Human
ugucucaagagggcacuggu

SEQ ID NO: 1312473 - RNA, 21 nt, Human
ugucucaagagggcacuggug

SEQ ID NO: 1312474 - RNA, 23 nt, Human
ugucucaagagggcacugguggc

SEQ ID NO: 1312475 - RNA, 19 nt, Human
ugucucaagcucuuccuua

SEQ ID NO: 1312476 - RNA, 17 nt, Human
ugucucaggucccugca

SEQ ID NO: 1312477 - RNA, 22 nt, Human
ugucucaguccaugaagaugua

SEQ ID NO: 1312478 - RNA, 21 nt, Human
ugucucaguccaugaagaugu

SEQ ID NO: 1312479 - RNA, 15 nt, Human
ugucugccaaccuaa

SEQ ID NO: 1312480 - RNA, 19 nt, Human
ugucugccaaccuaaaacu

SEQ ID NO: 1312481 - RNA, 15 nt, Human
ugugcggcugugugu

SEQ ID NO: 1312482 - RNA, 17 nt, Human
ugugcggcugugugugc

SEQ ID NO: 1312483 - RNA, 15 nt, Human
ugugccugacccuac

SEQ ID NO: 1312484 - RNA, 15 nt, Human
ugugccucugccugu

SEQ ID NO: 1312485 - RNA, 22 nt, Human
ugugcuuauguaugagguacaa

SEQ ID NO: 1312486 - RNA, 23 nt, Human
ugugcuguuguuaugaugugcuu

SEQ ID NO: 1312487 - RNA, 14 nt, Human
ugugcuguuucaaa

SEQ ID NO: 1312488 - RNA, 15 nt, Human
ugugcuguuucaaag

SEQ ID NO: 1312489 - RNA, 18 nt, Human
ugugcuguuucaaaguuc

SEQ ID NO: 1312490 - RNA, 20 nt, Human
ugugcuguuguuaugaugug

SEQ ID NO: 1312491 - RNA, 19 nt, Human
ugugcuguuguuaugaugu

SEQ ID NO: 1312492 - RNA, 19 nt, Human
ugugcuuaacagggaacgu

SEQ ID NO: 1312493 - RNA, 15 nt, Human
ugugcuuaacaggga

SEQ ID NO: 1312494 - RNA, 19 nt, Human
ugugcuuaugguaccagau

SEQ ID NO: 1312495 - RNA, 19 nt, Human
ugugcuucgggcccuuccc

SEQ ID NO: 1312496 - RNA, 16 nt, Human
ugugcuuuuaaaugca

SEQ ID NO: 1312497 - RNA, 16 nt, Human
ugugcuguuguuauga

SEQ ID NO: 1312498 - RNA, 14 nt, Human
ugugcuguuguuau

SEQ ID NO: 1312499 - RNA, 14 nt, Human
ugugccuucgucuu

SEQ ID NO: 1312500 - RNA, 22 nt, Human
ugugcuacaauucauuguguua

SEQ ID NO: 1312501 - RNA, 16 nt, Human
ugugcguggugguccc

SEQ ID NO: 1312502 - RNA, 19 nt, Human
ugugcgugguggucccugg

SEQ ID NO: 1312503 - RNA, 21 nt, Human
ugugcgugguggucccugggu

SEQ ID NO: 1312504 - RNA, 22 nt, Human
ugugcgugguggucccugggua

SEQ ID NO: 1312505 - RNA, 14 nt, Human
ugugccucugccug

SEQ ID NO: 1312506 - RNA, 12 nt, Human
ugugcaguguug

SEQ ID NO: 1312507 - RNA, 13 nt, Human
ugugcaucaggcu

SEQ ID NO: 1312508 - RNA, 15 nt, Human
ugugcaauguguaua

SEQ ID NO: 1312509 - RNA, 16 nt, Human
ugugcaauguguauaa

SEQ ID NO: 1312510 - RNA, 22 nt, Human
ugugcaauguguauaaacaaga

SEQ ID NO: 1312511 - RNA, 13 nt, Human
ugugcaccagggu

SEQ ID NO: 1312512 - RNA, 14 nt, Human
ugugcaccaggguu

SEQ ID NO: 1312513 - RNA, 20 nt, Human
ugugcaauguguauaaacaa

SEQ ID NO: 1312514 - RNA, 17 nt, Human
ugugcaccuaaaacuua

SEQ ID NO: 1312515 - RNA, 22 nt, Human
ugugcacguaaaguacuuguag

SEQ ID NO: 1312516 - RNA, 20 nt, Human
ugugcacguaaaguacuugu

SEQ ID NO: 1312517 - RNA, 16 nt, Human
ugugcagcauuucacu

SEQ ID NO: 1312518 - RNA, 17 nt, Human
ugugcagcauuucacuu

SEQ ID NO: 1312519 - RNA, 19 nt, Human
ugugcagccgcugagcgag

SEQ ID NO: 1312520 - RNA, 18 nt, Human
ugugcaggagcggcagau

SEQ ID NO: 1312521 - RNA, 16 nt, Human
ugugcagguggggaga

SEQ ID NO: 1312522 - RNA, 23 nt, Human
ugugcagguggggagacugggcu

SEQ ID NO: 1312523 - RNA, 14 nt, Human
ugugcagguuccca

SEQ ID NO: 1312524 - RNA, 17 nt, Human
ugugcaggagcggcaga

SEQ ID NO: 1312525 - RNA, 19 nt, Human
ugugcaguacuuugugcau

SEQ ID NO: 1312526 - RNA, 21 nt, Human
uguggcuccuggggguucuuu

SEQ ID NO: 1312527 - RNA, 12 nt, Human
uguggacucugg

SEQ ID NO: 1312528 - RNA, 22 nt, Human
uguggacucuggugccuccaga

SEQ ID NO: 1312529 - RNA, 23 nt, Human
uguggacucuggugccuccagag

SEQ ID NO: 1312530 - RNA, 17 nt, Human
ugugcuuuuuuugugug

SEQ ID NO: 1312531 - RNA, 16 nt, Human
ugugcuuuuuuugugu

SEQ ID NO: 1312532 - RNA, 17 nt, Human
uguggaaaaugaaaauu

SEQ ID NO: 1312533 - RNA, 16 nt, Human
uguggaaaagauggca

SEQ ID NO: 1312534 - RNA, 17 nt, Human
ugugggacuagccuggc

SEQ ID NO: 1312535 - RNA, 14 nt, Human
uguggcuccuuccc

SEQ ID NO: 1312536 - RNA, 15 nt, Human
uguggcuccuuccca

SEQ ID NO: 1312537 - RNA, 17 nt, Human
uguggcuuucagagccu

SEQ ID NO: 1312538 - RNA, 19 nt, Human
ugugggggguaaucccugc

SEQ ID NO: 1312539 - RNA, 22 nt, Human
ugugggggguaaucccugcuuu

SEQ ID NO: 1312540 - RNA, 19 nt, Human
uguggguaguggggaagag

SEQ ID NO: 1312541 - RNA, 16 nt, Human
uguggggauuuucacu

SEQ ID NO: 1312542 - RNA, 15 nt, Human
uguggggccagguca

SEQ ID NO: 1312543 - RNA, 16 nt, Human
uguggggccugggagg

SEQ ID NO: 1312544 - RNA, 14 nt, Human
uguggggccuggga

SEQ ID NO: 1312545 - RNA, 15 nt, Human
ugugggggacuguaa

SEQ ID NO: 1312546 - RNA, 16 nt, Human
ugugggggacuguaag

SEQ ID NO: 1312547 - RNA, 18 nt, Human
uguuuaaaaaaccacaug

SEQ ID NO: 1312548 - RNA, 12 nt, Human
uguuuaaaacau

SEQ ID NO: 1312549 - RNA, 15 nt, Human
uguuuaaaacaucau

SEQ ID NO: 1312550 - RNA, 16 nt, Human
uguuuaaaacaucauu

SEQ ID NO: 1312551 - RNA, 13 nt, Human
uguuggccaggcu

SEQ ID NO: 1312552 - RNA, 18 nt, Human
uguuggccaggcugcucu

SEQ ID NO: 1312553 - RNA, 16 nt, Human
uguuguucuuacaaac

SEQ ID NO: 1312554 - RNA, 19 nt, Human
uguuguugaaagguuuuuu

SEQ ID NO: 1312555 - RNA, 15 nt, Human
uguuguuucuuaaau

SEQ ID NO: 1312556 - RNA, 16 nt, Human
uguuguuucuuaaaua

SEQ ID NO: 1312557 - RNA, 21 nt, Human
uguuguuucuuaaauaagaaa

SEQ ID NO: 1312558 - RNA, 17 nt, Human
uguuguuucuuaaauaa

SEQ ID NO: 1312559 - RNA, 19 nt, Human
uguuuacacucuuuguaag

SEQ ID NO: 1312560 - RNA, 17 nt, Human
uguuuacagauccccaa

SEQ ID NO: 1312561 - RNA, 24 nt, Human
uguuuaaucauauaaauagaaugu

SEQ ID NO: 1312562 - RNA, 23 nt, Human
uguuuaaucauauaaauagaaug

SEQ ID NO: 1312563 - RNA, 20 nt, Human
uguuuaaucauauaaauaga

SEQ ID NO: 1312564 - RNA, 18 nt, Human
uguuuaauuuuuauuucu

SEQ ID NO: 1312565 - RNA, 19 nt, Human
uguuuaauuuuuauuucuu

SEQ ID NO: 1312566 - RNA, 21 nt, Human
uguuuaauuuuuauuucuucc

SEQ ID NO: 1312567 - RNA, 21 nt, Human
uguuuacaaaaauuucuguaa

SEQ ID NO: 1312568 - RNA, 19 nt, Human
uguuuacaaaaucagguaa

SEQ ID NO: 1312569 - RNA, 16 nt, Human
uguuuacacucuuugu

SEQ ID NO: 1312570 - RNA, 18 nt, Human
uguuuacacucuuuguaa

SEQ ID NO: 1312571 - RNA, 16 nt, Human
uguuuaaucauauaaa

SEQ ID NO: 1312572 - RNA, 15 nt, Human
uguuuaaucauauaa

SEQ ID NO: 1312573 - RNA, 14 nt, Human
uguuuaaucauaua

SEQ ID NO: 1312574 - RNA, 12 nt, Human
uguuuaaaacuu

SEQ ID NO: 1312575 - RNA, 18 nt, Human
uguuuaaaacuucaguuu

SEQ ID NO: 1312576 - RNA, 19 nt, Human
uguugaagagguuuuaaag

SEQ ID NO: 1312577 - RNA, 15 nt, Human
uguugaagccuuugu

SEQ ID NO: 1312578 - RNA, 13 nt, Human
uguugagacagag

SEQ ID NO: 1312579 - RNA, 17 nt, Human
uguugaagccacugccu

SEQ ID NO: 1312580 - RNA, 15 nt, Human
uguugagagugugac

SEQ ID NO: 1312581 - RNA, 16 nt, Human
uguugagcaucacaga

SEQ ID NO: 1312582 - RNA, 17 nt, Human
uguugagcaucacagaa

SEQ ID NO: 1312583 - RNA, 20 nt, Human
uguugagcaucacagaaugu

SEQ ID NO: 1312584 - RNA, 13 nt, Human
uguugcugccuca

SEQ ID NO: 1312585 - RNA, 14 nt, Human
uguugauacuguug

SEQ ID NO: 1312586 - RNA, 15 nt, Human
uguugauacuguugc

SEQ ID NO: 1312587 - RNA, 16 nt, Human
uguugauacuguugca

SEQ ID NO: 1312588 - RNA, 17 nt, Human
uguugauacuguugcac

SEQ ID NO: 1312589 - RNA, 19 nt, Human
uguugauacuguugcacgu

SEQ ID NO: 1312590 - RNA, 16 nt, Human
uguugagccuuuuccc

SEQ ID NO: 1312591 - RNA, 18 nt, Human
uguugagccuuuucccuc

SEQ ID NO: 1312592 - RNA, 21 nt, Human
uguuggagaagaacugaaauc

SEQ ID NO: 1312593 - RNA, 13 nt, Human
uguuggaaaaaau

SEQ ID NO: 1312594 - RNA, 14 nt, Human
uguugcugccucau

SEQ ID NO: 1312595 - RNA, 16 nt, Human
uguucauuccuccagg

SEQ ID NO: 1312596 - RNA, 15 nt, Human
uguucauuccuccag

SEQ ID NO: 1312597 - RNA, 14 nt, Human
uguucauuccucca

SEQ ID NO: 1312598 - RNA, 14 nt, Human
uguucauggcagau

SEQ ID NO: 1312599 - RNA, 13 nt, Human
uguucauggcaga

SEQ ID NO: 1312600 - RNA, 11 nt, Human
uguucauuucc

SEQ ID NO: 1312601 - RNA, 13 nt, Human
uguucauuuccuc

SEQ ID NO: 1312602 - RNA, 14 nt, Human
uguucauuuccuca

SEQ ID NO: 1312603 - RNA, 13 nt, Human
uguucauaaauaa

SEQ ID NO: 1312604 - RNA, 22 nt, Human
uguucaccauuauaaugaauuu

SEQ ID NO: 1312605 - RNA, 15 nt, Human
uguucaccauuauaa

SEQ ID NO: 1312606 - RNA, 12 nt, Human
uguucuauagcu

SEQ ID NO: 1312607 - RNA, 14 nt, Human
uguucuaguuuuuu

SEQ ID NO: 1312608 - RNA, 21 nt, Human
uguucuaguuuuuuacuuuug

SEQ ID NO: 1312609 - RNA, 17 nt, Human
uguucucacacuggucu

SEQ ID NO: 1312610 - RNA, 22 nt, Human
uguucucacacuggucugcugu

SEQ ID NO: 1312611 - RNA, 23 nt, Human
uguucucacacuggucugcuguc

SEQ ID NO: 1312612 - RNA, 12 nt, Human
uguucucagauu

SEQ ID NO: 1312613 - RNA, 22 nt, Human
uguucucagaaucccuuaacag

SEQ ID NO: 1312614 - RNA, 18 nt, Human
uguucaguugcacuucua

SEQ ID NO: 1312615 - RNA, 22 nt, Human
uguucuccugcugcucccucag

SEQ ID NO: 1312616 - RNA, 24 nt, Human
uguugaaagguaauuugagagaaa

SEQ ID NO: 1312617 - RNA, 23 nt, Human
uguugaaagguuuuuuuucaguu

SEQ ID NO: 1312618 - RNA, 14 nt, Human
uguugaaaauguuc

SEQ ID NO: 1312619 - RNA, 17 nt, Human
uguugaaaauguucaga

SEQ ID NO: 1312620 - RNA, 17 nt, Human
uguucugcacacagcac

SEQ ID NO: 1312621 - RNA, 15 nt, Human
uguucugauaaugaa

SEQ ID NO: 1312622 - RNA, 11 nt, Human
uguucuccugc

SEQ ID NO: 1312623 - RNA, 13 nt, Human
uguucuccugcug

SEQ ID NO: 1312624 - RNA, 23 nt, Human
uguucucuugggaacugaacuca

SEQ ID NO: 1312625 - RNA, 21 nt, Human
uguucuccugcugcucccuca

SEQ ID NO: 1312626 - RNA, 22 nt, Human
uguguuuaggaacuacugagga

SEQ ID NO: 1312627 - RNA, 22 nt, Human
uguguguccacgacugucucca

SEQ ID NO: 1312628 - RNA, 21 nt, Human
uguguuuacauuuuauggugc

SEQ ID NO: 1312629 - RNA, 20 nt, Human
uguguuuacuuuauguuacu

SEQ ID NO: 1312630 - RNA, 12 nt, Human
uguguguaugca

SEQ ID NO: 1312631 - RNA, 13 nt, Human
uguguguauuugc

SEQ ID NO: 1312632 - RNA, 14 nt, Human
uguguguauuugcu

SEQ ID NO: 1312633 - RNA, 20 nt, Human
uguguguauuugcuaauuuu

SEQ ID NO: 1312634 - RNA, 16 nt, Human
uguguguccaaaacug

SEQ ID NO: 1312635 - RNA, 19 nt, Human
uguguguccaaaacugccu

SEQ ID NO: 1312636 - RNA, 15 nt, Human
ugugugcaucaggcu

SEQ ID NO: 1312637 - RNA, 22 nt, Human
ugugugcaucaggcuuucuuuu

SEQ ID NO: 1312638 - RNA, 17 nt, Human
ugugugcaucaggcuuu

SEQ ID NO: 1312639 - RNA, 14 nt, Human
ugugugcccucugg

SEQ ID NO: 1312640 - RNA, 20 nt, Human
ugugugcccucugggcucug

SEQ ID NO: 1312641 - RNA, 12 nt, Human
ugugugaaugaa

SEQ ID NO: 1312642 - RNA, 16 nt, Human
ugugugaaugaacacu

SEQ ID NO: 1312643 - RNA, 17 nt, Human
ugugugaaugaacacuc

SEQ ID NO: 1312644 - RNA, 18 nt, Human
ugugugaaugaacacucu

SEQ ID NO: 1312645 - RNA, 22 nt, Human
ugugugaaugaacacucuuuug

SEQ ID NO: 1312646 - RNA, 15 nt, Human
uguguauuuacgcuu

SEQ ID NO: 1312647 - RNA, 11 nt, Human
uguguauuugc

SEQ ID NO: 1312648 - RNA, 13 nt, Human
uguguauuugcua

SEQ ID NO: 1312649 - RNA, 15 nt, Human
uguguauuugcuaau

SEQ ID NO: 1312650 - RNA, 23 nt, Human
ugugucacaaugagauugaauuu

SEQ ID NO: 1312651 - RNA, 16 nt, Human
uguguaugugugugug

SEQ ID NO: 1312652 - RNA, 14 nt, Human
uguguauuccaaga

SEQ ID NO: 1312653 - RNA, 14 nt, Human
uguguauauggaca

SEQ ID NO: 1312654 - RNA, 13 nt, Human
uguguauauggac

SEQ ID NO: 1312655 - RNA, 14 nt, Human
uguguaguucaugu

SEQ ID NO: 1312656 - RNA, 17 nt, Human
uguguaguucauguaaa

SEQ ID NO: 1312657 - RNA, 21 nt, Human
uguguauaaaaauaaaaaaga

SEQ ID NO: 1312658 - RNA, 13 nt, Human
uguguauaaacaa

SEQ ID NO: 1312659 - RNA, 14 nt, Human
uguguauaaacaag

SEQ ID NO: 1312660 - RNA, 21 nt, Human
uguguauaaacaagaaaaaua

SEQ ID NO: 1312661 - RNA, 22 nt, Human
uguguauaaacaagaaaaauaa

SEQ ID NO: 1312662 - RNA, 21 nt, Human
uguguauauauauauauaugu

SEQ ID NO: 1312663 - RNA, 17 nt, Human
uguuagauuaagaaaua

SEQ ID NO: 1312664 - RNA, 20 nt, Human
uguuagauuaagaaauagac

SEQ ID NO: 1312665 - RNA, 12 nt, Human
uguuauaaucuu

SEQ ID NO: 1312666 - RNA, 19 nt, Human
uguucaacuaggaucagaa

SEQ ID NO: 1312667 - RNA, 20 nt, Human
uguuaguuaccuuauaguua

SEQ ID NO: 1312668 - RNA, 23 nt, Human
uguuaguuaccuuauaguuacug

SEQ ID NO: 1312669 - RNA, 23 nt, Human
uguuaguuucugaguuuuaccaa

SEQ ID NO: 1312670 - RNA, 16 nt, Human
uguucacaauauauuu

SEQ ID NO: 1312671 - RNA, 21 nt, Human
uguucaagcgauucuccugcc

SEQ ID NO: 1312672 - RNA, 15 nt, Human
uguucaauauuuucu

SEQ ID NO: 1312673 - RNA, 16 nt, Human
uguucacaccagagaa

SEQ ID NO: 1312674 - RNA, 14 nt, Human
uguguuugcuuucu

SEQ ID NO: 1312675 - RNA, 15 nt, Human
uguguuugcuuucug

SEQ ID NO: 1312676 - RNA, 17 nt, Human
uguguuuggaagacuau

SEQ ID NO: 1312677 - RNA, 15 nt, Human
uguguuuggcuuuca

SEQ ID NO: 1312678 - RNA, 16 nt, Human
uguguuuggcuuucag

SEQ ID NO: 1312679 - RNA, 17 nt, Human
uguguuuggcuuucagg

SEQ ID NO: 1312680 - RNA, 15 nt, Human
uguguuuguguauuu

SEQ ID NO: 1312681 - RNA, 15 nt, Human
uguuacauuauuauc

SEQ ID NO: 1312682 - RNA, 19 nt, Human
uguuaccaaaaauaaauau

SEQ ID NO: 1312683 - RNA, 23 nt, Human
uguuaccaaaaauaaauauaucu

SEQ ID NO: 1312684 - RNA, 14 nt, Human
uguuacuucucuaa

SEQ ID NO: 1312685 - RNA, 15 nt, Human
uguuacuucucuaau

SEQ ID NO: 1312686 - RNA, 14 nt, Human
uuacauuuguauaa

SEQ ID NO: 1312687 - RNA, 15 nt, Human
uuacauuuguauaaa

SEQ ID NO: 1312688 - RNA, 19 nt, Human
uuacauuauuaucaacaau

SEQ ID NO: 1312689 - RNA, 14 nt, Human
uuacauguuugcac

SEQ ID NO: 1312690 - RNA, 22 nt, Human
uuacauggcuggagcuagaauu

SEQ ID NO: 1312691 - RNA, 15 nt, Human
uuacagcaaauccuu

SEQ ID NO: 1312692 - RNA, 18 nt, Human
uuacagauauuugucaug

SEQ ID NO: 1312693 - RNA, 23 nt, Human
uuacauggcuggagcuagaauuu

SEQ ID NO: 1312694 - RNA, 19 nt, Human
uuacagauuuauuccuuug

SEQ ID NO: 1312695 - RNA, 20 nt, Human
uuacagauuuauuccuuugu

SEQ ID NO: 1312696 - RNA, 21 nt, Human
uuacagauuuauuccuuuguu

SEQ ID NO: 1312697 - RNA, 12 nt, Human
uuacauguuugc

SEQ ID NO: 1312698 - RNA, 13 nt, Human
uuacauguuugca

SEQ ID NO: 1312699 - RNA, 16 nt, Human
uuacauguuuuaaaga

SEQ ID NO: 1312700 - RNA, 17 nt, Human
uuacaauaguucugugg

SEQ ID NO: 1312701 - RNA, 15 nt, Human
uuacaauaguucugu

SEQ ID NO: 1312702 - RNA, 23 nt, Human
uuacaauaaaaucuugaaaaugc

SEQ ID NO: 1312703 - RNA, 21 nt, Human
uuaauuauuauuuguguuuua

SEQ ID NO: 1312704 - RNA, 14 nt, Human
uuaauuauuguaca

SEQ ID NO: 1312705 - RNA, 17 nt, Human
uuaauucaacuuaacua

SEQ ID NO: 1312706 - RNA, 21 nt, Human
uuaauucagaaccccaacuac

SEQ ID NO: 1312707 - RNA, 16 nt, Human
uuacaauguaauuauu

SEQ ID NO: 1312708 - RNA, 17 nt, Human
uuacaauguaauuauuu

SEQ ID NO: 1312709 - RNA, 21 nt, Human
uuacaauguaauuauuuaugu

SEQ ID NO: 1312710 - RNA, 19 nt, Human
uuacaauguaauuauuuau

SEQ ID NO: 1312711 - RNA, 13 nt, Human
uuacaauguaauu

SEQ ID NO: 1312712 - RNA, 14 nt, Human
uuacaauguaauua

SEQ ID NO: 1312713 - RNA, 15 nt, Human
uuacaauguaauuau

SEQ ID NO: 1312714 - RNA, 16 nt, Human
uuacggaacucaaaua

SEQ ID NO: 1312715 - RNA, 15 nt, Human
uuacgcuuugauuca

SEQ ID NO: 1312716 - RNA, 16 nt, Human
uuacgcuuugauucau

SEQ ID NO: 1312717 - RNA, 13 nt, Human
uuacgcuuugauu

SEQ ID NO: 1312718 - RNA, 19 nt, Human
uuacguaugucugguucuc

SEQ ID NO: 1312719 - RNA, 22 nt, Human
uuacguaugucugguucucaau

SEQ ID NO: 1312720 - RNA, 20 nt, Human
uuaccuuuuuauuugcaugu

SEQ ID NO: 1312721 - RNA, 21 nt, Human
uuaccacuuguguuuugcaag

SEQ ID NO: 1312722 - RNA, 15 nt, Human
uuaccuuuuuauuug

SEQ ID NO: 1312723 - RNA, 18 nt, Human
uuaccuuuuuauuugcau

SEQ ID NO: 1312724 - RNA, 21 nt, Human
uuaccagauuuuuacacaugu

SEQ ID NO: 1312725 - RNA, 24 nt, Human
uuaccagauuuuuacacauguauc

SEQ ID NO: 1312726 - RNA, 20 nt, Human
uuacauuuguauaaaauaau

SEQ ID NO: 1312727 - RNA, 21 nt, Human
uuaauagguuuggacaaaaug

SEQ ID NO: 1312728 - RNA, 22 nt, Human
uuaauauaaaguaguccuguga

SEQ ID NO: 1312729 - RNA, 23 nt, Human
uuaauauaaaguaguccugugaa

SEQ ID NO: 1312730 - RNA, 19 nt, Human
uuaauaucccuacauguau

SEQ ID NO: 1312731 - RNA, 20 nt, Human
uuaauaucccuacauguauu

SEQ ID NO: 1312732 - RNA, 14 nt, Human
uuaauauccuaaac

SEQ ID NO: 1312733 - RNA, 17 nt, Human
uuaauauccuaaacauc

SEQ ID NO: 1312734 - RNA, 19 nt, Human
uuaauauccuaaacaucau

SEQ ID NO: 1312735 - RNA, 20 nt, Human
uuaauaugcuuaaaauaagc

SEQ ID NO: 1312736 - RNA, 18 nt, Human
uuaauggcugauaauuuu

SEQ ID NO: 1312737 - RNA, 14 nt, Human
uuaauggaaauguu

SEQ ID NO: 1312738 - RNA, 16 nt, Human
uuaauggcugauaauu

SEQ ID NO: 1312739 - RNA, 22 nt, Human
uuaauuaugccuuuuuugauca

SEQ ID NO: 1312740 - RNA, 14 nt, Human
uuaauuauuauucu

SEQ ID NO: 1312741 - RNA, 17 nt, Human
uuaauuauuauucuuca

SEQ ID NO: 1312742 - RNA, 14 nt, Human
uuaauuauuauuua

SEQ ID NO: 1312743 - RNA, 14 nt, Human
uuaauuauuauuug

SEQ ID NO: 1312744 - RNA, 18 nt, Human
uuaagggaagaauuccag

SEQ ID NO: 1312745 - RNA, 18 nt, Human
uuaauaauguuucaaaca

SEQ ID NO: 1312746 - RNA, 16 nt, Human
uuaauagguuuggaca

SEQ ID NO: 1312747 - RNA, 19 nt, Human
uuaauaauuuagacuucaa

SEQ ID NO: 1312748 - RNA, 13 nt, Human
uuaaggcauuugu

SEQ ID NO: 1312749 - RNA, 23 nt, Human
uuaacauuccucaugaauguaaa

SEQ ID NO: 1312750 - RNA, 19 nt, Human
uuaacauuccaagacucua

SEQ ID NO: 1312751 - RNA, 15 nt, Human
uuaaagcuuccauug

SEQ ID NO: 1312752 - RNA, 20 nt, Human
uuaaagcuuccauuguuguc

SEQ ID NO: 1312753 - RNA, 19 nt, Human
uuaaauagcuuuuuucucu

SEQ ID NO: 1312754 - RNA, 14 nt, Human
uuaaagcuguuauu

SEQ ID NO: 1312755 - RNA, 18 nt, Human
uuaaauaguaaaaauaaa

SEQ ID NO: 1312756 - RNA, 13 nt, Human
uuaacauuccaag

SEQ ID NO: 1312757 - RNA, 14 nt, Human
uuaacauuccaaga

SEQ ID NO: 1312758 - RNA, 17 nt, Human
uuaacauuccaagacuc

SEQ ID NO: 1312759 - RNA, 11 nt, Human
uuaacauuccu

SEQ ID NO: 1312760 - RNA, 18 nt, Human
uuaaauguaaagacaaaa

SEQ ID NO: 1312761 - RNA, 13 nt, Human
uuaaauguaaaga

SEQ ID NO: 1312762 - RNA, 17 nt, Human
uuaaauguaaagauauu

SEQ ID NO: 1312763 - RNA, 19 nt, Human
uuaaaagaaugauuaugaa

SEQ ID NO: 1312764 - RNA, 15 nt, Human
uuaaaacauuaaaau

SEQ ID NO: 1312765 - RNA, 21 nt, Human
uuaaaacagacacuggcaugg

SEQ ID NO: 1312766 - RNA, 14 nt, Human
uuaaaacagacacu

SEQ ID NO: 1312767 - RNA, 13 nt, Human
uuaaaagacucau

SEQ ID NO: 1312768 - RNA, 14 nt, Human
uuaaaagacucauc

SEQ ID NO: 1312769 - RNA, 18 nt, Human
uuaaaagacucauccguc

SEQ ID NO: 1312770 - RNA, 12 nt, Human
uuaaaagacuca

SEQ ID NO: 1312771 - RNA, 12 nt, Human
uuaaagagucua

SEQ ID NO: 1312772 - RNA, 14 nt, Human
uuaaagagucuaga

SEQ ID NO: 1312773 - RNA, 15 nt, Human
uuaaagagucuagau

SEQ ID NO: 1312774 - RNA, 16 nt, Human
uuaaagagucuagauu

SEQ ID NO: 1312775 - RNA, 17 nt, Human
uuaaagagucuagauuc

SEQ ID NO: 1312776 - RNA, 18 nt, Human
uuaaagagucuagauuca

SEQ ID NO: 1312777 - RNA, 23 nt, Human
uuaaagagucuagauucaaaggu

SEQ ID NO: 1312778 - RNA, 19 nt, Human
uuaaagagucuagauucaa

SEQ ID NO: 1312779 - RNA, 23 nt, Human
uguuuuaaaaugagaaaucuaaa

SEQ ID NO: 1312780 - RNA, 22 nt, Human
uguuuuaaacauuaauagcagc

SEQ ID NO: 1312781 - RNA, 14 nt, Human
uguuuugcuaaagg

SEQ ID NO: 1312782 - RNA, 19 nt, Human
uguuuuggacaguuuacca

SEQ ID NO: 1312783 - RNA, 18 nt, Human
uguuuuggcugaaauucu

SEQ ID NO: 1312784 - RNA, 23 nt, Human
uguuuuggcugaaauucuccugg

SEQ ID NO: 1312785 - RNA, 16 nt, Human
uguuuuuaucuuuuua

SEQ ID NO: 1312786 - RNA, 13 nt, Human
uguuuuucacauu

SEQ ID NO: 1312787 - RNA, 11 nt, Human
uguuuuucauu

SEQ ID NO: 1312788 - RNA, 16 nt, Human
uguuuuuccuuccaau

SEQ ID NO: 1312789 - RNA, 13 nt, Human
uguuuuucuaaag

SEQ ID NO: 1312790 - RNA, 13 nt, Human
uguuuuucuauua

SEQ ID NO: 1312791 - RNA, 14 nt, Human
uguuuuucuauuaa

SEQ ID NO: 1312792 - RNA, 15 nt, Human
uguuuuucuauuaaa

SEQ ID NO: 1312793 - RNA, 16 nt, Human
uguuuuucuauuaaaa

SEQ ID NO: 1312794 - RNA, 17 nt, Human
uguuuuucuauuaaaag

SEQ ID NO: 1312795 - RNA, 18 nt, Human
uguuuuucuauuaaaaga

SEQ ID NO: 1312796 - RNA, 19 nt, Human
uguuuuucuauuaaaagac

SEQ ID NO: 1312797 - RNA, 20 nt, Human
uguuuuucuauuaaaagacu

SEQ ID NO: 1312798 - RNA, 21 nt, Human
uguuuuucuauuaaaagacuc

SEQ ID NO: 1312799 - RNA, 22 nt, Human
uguuuuucuauuaaaagacuca

SEQ ID NO: 1312800 - RNA, 12 nt, Human
uguuuuuucuaa

SEQ ID NO: 1312801 - RNA, 22 nt, Human
uguuucuauuuuuugaaaagca

SEQ ID NO: 1312802 - RNA, 13 nt, Human
uguuucuccccca

SEQ ID NO: 1312803 - RNA, 21 nt, Human
uguuucucccccauguucugu

SEQ ID NO: 1312804 - RNA, 16 nt, Human
uguuucuauuuuuuga

SEQ ID NO: 1312805 - RNA, 15 nt, Human
uguuuacagauaauu

SEQ ID NO: 1312806 - RNA, 16 nt, Human
uguuuacagauaauua

SEQ ID NO: 1312807 - RNA, 22 nt, Human
uguuuacagauaauuaccuacu

SEQ ID NO: 1312808 - RNA, 13 nt, Human
uguuuguuuaauu

SEQ ID NO: 1312809 - RNA, 14 nt, Human
uguuuguuuaauuu

SEQ ID NO: 1312810 - RNA, 18 nt, Human
uguuuuaaaaugagaaau

SEQ ID NO: 1312811 - RNA, 17 nt, Human
uguuuuaaaaaccuguu

SEQ ID NO: 1312812 - RNA, 17 nt, Human
uguuuguuuccuuuguu

SEQ ID NO: 1312813 - RNA, 23 nt, Human
uggguaggaaagaggaagcaaau

SEQ ID NO: 1312814 - RNA, 16 nt, Human
uggguagccugggugu

SEQ ID NO: 1312815 - RNA, 18 nt, Human
uggguaggguaaaucagu

SEQ ID NO: 1312816 - RNA, 17 nt, Human
uggguaguggggaagag

SEQ ID NO: 1312817 - RNA, 13 nt, Human
ugggucaggcagg

SEQ ID NO: 1312818 - RNA, 12 nt, Human
uggguccaggag

SEQ ID NO: 1312819 - RNA, 14 nt, Human
uggguccaggagga

SEQ ID NO: 1312820 - RNA, 22 nt, Human
ugggguggggggggugcugggc

SEQ ID NO: 1312821 - RNA, 21 nt, Human
ugggguggggggggugcuggg

SEQ ID NO: 1312822 - RNA, 17 nt, Human
uggguagacacacauga

SEQ ID NO: 1312823 - RNA, 16 nt, Human
uggguagacacacaug

SEQ ID NO: 1312824 - RNA, 19 nt, Human
ugggguggggggggugcug

SEQ ID NO: 1312825 - RNA, 16 nt, Human
uggggcaggggccggg

SEQ ID NO: 1312826 - RNA, 20 nt, Human
uggggcaggcugggccaugu

SEQ ID NO: 1312827 - RNA, 18 nt, Human
uggggcaggggccggggg

SEQ ID NO: 1312828 - RNA, 22 nt, Human
uggggcaggaguagcugagcuc

SEQ ID NO: 1312829 - RNA, 21 nt, Human
uggggcaggaguagcugagcu

SEQ ID NO: 1312830 - RNA, 21 nt, Human
uggggcaggccaccuggcucu

SEQ ID NO: 1312831 - RNA, 14 nt, Human
uggggcaggcuggg

SEQ ID NO: 1312832 - RNA, 15 nt, Human
uggggcaggcugggc

SEQ ID NO: 1312833 - RNA, 16 nt, Human
uggggcaggcugggcc

SEQ ID NO: 1312834 - RNA, 17 nt, Human
uggggcaggcugggcca

SEQ ID NO: 1312835 - RNA, 18 nt, Human
uggggcaggcugggccau

SEQ ID NO: 1312836 - RNA, 21 nt, Human
uggguucugccugccagcugc

SEQ ID NO: 1312837 - RNA, 22 nt, Human
uggguucugccugccagcugca

SEQ ID NO: 1312838 - RNA, 17 nt, Human
uggguuggaaaacagua

SEQ ID NO: 1312839 - RNA, 16 nt, Human
uggguugcagacagga

SEQ ID NO: 1312840 - RNA, 21 nt, Human
uggguugcagacaggaaucuu

SEQ ID NO: 1312841 - RNA, 15 nt, Human
uggguugggaucagg

SEQ ID NO: 1312842 - RNA, 15 nt, Human
uggguugucaccaag

SEQ ID NO: 1312843 - RNA, 21 nt, Human
uggguuccagcaauucuccug

SEQ ID NO: 1312844 - RNA, 13 nt, Human
uggguuccacaga

SEQ ID NO: 1312845 - RNA, 14 nt, Human
uggguuccacagac

SEQ ID NO: 1312846 - RNA, 15 nt, Human
uggguuccacagacg

SEQ ID NO: 1312847 - RNA, 21 nt, Human
uggguuccuuccucugagccu

SEQ ID NO: 1312848 - RNA, 22 nt, Human
uggguuccuuccucugagccuu

SEQ ID NO: 1312849 - RNA, 13 nt, Human
uggguccaggagg

SEQ ID NO: 1312850 - RNA, 14 nt, Human
uggguccaugggca

SEQ ID NO: 1312851 - RNA, 17 nt, Human
uggguccaugggcagag

SEQ ID NO: 1312852 - RNA, 13 nt, Human
ugggcauucaaau

SEQ ID NO: 1312853 - RNA, 19 nt, Human
ugggcaugguguucuccug

SEQ ID NO: 1312854 - RNA, 20 nt, Human
ugggcaugguguucuccugc

SEQ ID NO: 1312855 - RNA, 13 nt, Human
ugggcaucuuuug

SEQ ID NO: 1312856 - RNA, 15 nt, Human
ugggcaucuuuugua

SEQ ID NO: 1312857 - RNA, 18 nt, Human
ugggcaucuuuuguauua

SEQ ID NO: 1312858 - RNA, 19 nt, Human
ugggcaucuuuuguauuaa

SEQ ID NO: 1312859 - RNA, 23 nt, Human
ugggcaugagggguuccuccccu

SEQ ID NO: 1312860 - RNA, 22 nt, Human
ugggcaugagggguuccucccc

SEQ ID NO: 1312861 - RNA, 18 nt, Human
ugggccuucagggaguga

SEQ ID NO: 1312862 - RNA, 12 nt, Human
ugggccuuggcc

SEQ ID NO: 1312863 - RNA, 13 nt, Human
ugggccuuggccu

SEQ ID NO: 1312864 - RNA, 15 nt, Human
ugggccuuggccugg

SEQ ID NO: 1312865 - RNA, 16 nt, Human
ugggagcuuuuguaga

SEQ ID NO: 1312866 - RNA, 19 nt, Human
ugggagcugguuagaaaug

SEQ ID NO: 1312867 - RNA, 16 nt, Human
ugggagcuugggaaug

SEQ ID NO: 1312868 - RNA, 18 nt, Human
ugggagcugguuagaaau

SEQ ID NO: 1312869 - RNA, 20 nt, Human
ugggagcugguuagaaaugc

SEQ ID NO: 1312870 - RNA, 13 nt, Human
ugggaggaaggac

SEQ ID NO: 1312871 - RNA, 15 nt, Human
ugggcaguuuuuuga

SEQ ID NO: 1312872 - RNA, 16 nt, Human
ugggcaguuuuuugaa

SEQ ID NO: 1312873 - RNA, 17 nt, Human
ugggcgugagaccugcc

SEQ ID NO: 1312874 - RNA, 18 nt, Human
ugggcgugagaccugccc

SEQ ID NO: 1312875 - RNA, 19 nt, Human
ugggcgugagaccugcccc

SEQ ID NO: 1312876 - RNA, 16 nt, Human
ugggccuuggccugga

SEQ ID NO: 1312877 - RNA, 17 nt, Human
ugggccuuggccuggag

SEQ ID NO: 1312878 - RNA, 18 nt, Human
ugggccuuggccuggagc

SEQ ID NO: 1312879 - RNA, 19 nt, Human
ugggccuuggccuggagca

SEQ ID NO: 1312880 - RNA, 14 nt, Human
ugggccuugggcuc

SEQ ID NO: 1312881 - RNA, 15 nt, Human
ugggccuugggcucc

SEQ ID NO: 1312882 - RNA, 16 nt, Human
ugggccuugggcuccg

SEQ ID NO: 1312883 - RNA, 14 nt, Human
ugggcgcugguccu

SEQ ID NO: 1312884 - RNA, 22 nt, Human
ugggcgcugguccuuucuuccg

SEQ ID NO: 1312885 - RNA, 13 nt, Human
ugggcuugggccu

SEQ ID NO: 1312886 - RNA, 14 nt, Human
ugggcuugggccua

SEQ ID NO: 1312887 - RNA, 15 nt, Human
ugggcuugggccuag

SEQ ID NO: 1312888 - RNA, 18 nt, Human
ugggcuugggccuaggcu

SEQ ID NO: 1312889 - RNA, 19 nt, Human
ugggcuugggccuaggcug

SEQ ID NO: 1312890 - RNA, 22 nt, Human
ugggcuugggccuaggcugcau

SEQ ID NO: 1312891 - RNA, 12 nt, Human
uggggcaggagu

SEQ ID NO: 1312892 - RNA, 13 nt, Human
uggggcaggagua

SEQ ID NO: 1312893 - RNA, 14 nt, Human
uggggcaggaguag

SEQ ID NO: 1312894 - RNA, 15 nt, Human
uggggcaggaguagc

SEQ ID NO: 1312895 - RNA, 18 nt, Human
uggggcaggaguagcuga

SEQ ID NO: 1312896 - RNA, 19 nt, Human
uggggcaggaguagcugag

SEQ ID NO: 1312897 - RNA, 20 nt, Human
uggggcaggaguagcugagc

SEQ ID NO: 1312898 - RNA, 19 nt, Human
ugggacauuugcucaugga

SEQ ID NO: 1312899 - RNA, 20 nt, Human
ugggacauuugcucauggaa

SEQ ID NO: 1312900 - RNA, 16 nt, Human
ugggacagggcauggc

SEQ ID NO: 1312901 - RNA, 17 nt, Human
ugggacauuccaaagaa

SEQ ID NO: 1312902 - RNA, 17 nt, Human
ugggaccacaacuauuu

SEQ ID NO: 1312903 - RNA, 13 nt, Human
ugggaccaggcac

SEQ ID NO: 1312904 - RNA, 14 nt, Human
ugggaccaggcacc

SEQ ID NO: 1312905 - RNA, 20 nt, Human
ugggagcaaacugcaugccc

SEQ ID NO: 1312906 - RNA, 22 nt, Human
ugggagcaaacugcaugcccag

SEQ ID NO: 1312907 - RNA, 15 nt, Human
ugggagcccccagcc

SEQ ID NO: 1312908 - RNA, 16 nt, Human
ugggagcccccagccu

SEQ ID NO: 1312909 - RNA, 17 nt, Human
ugggagcccccagccug

SEQ ID NO: 1312910 - RNA, 18 nt, Human
ugggagcccccagccugu

SEQ ID NO: 1312911 - RNA, 20 nt, Human
ugggagcccccagccuguca

SEQ ID NO: 1312912 - RNA, 19 nt, Human
ugggagcccccagccuguc

SEQ ID NO: 1312913 - RNA, 14 nt, Human
ugggagccgggucu

SEQ ID NO: 1312914 - RNA, 18 nt, Human
ugggagccgggucugccu

SEQ ID NO: 1312915 - RNA, 23 nt, Human
ugggagccgggucugccucuucu

SEQ ID NO: 1312916 - RNA, 16 nt, Human
ugggagcuccacucug

SEQ ID NO: 1312917 - RNA, 19 nt, Human
ugggagcuccacucugcuu

SEQ ID NO: 1312918 - RNA, 22 nt, Human
ugggagcuccacucugcuucuc

SEQ ID NO: 1312919 - RNA, 16 nt, Human
ugggagcugaggccac

SEQ ID NO: 1312920 - RNA, 20 nt, Human
uggcuuugugauucaaucug

SEQ ID NO: 1312921 - RNA, 17 nt, Human
uggcuuuuauuaaugca

SEQ ID NO: 1312922 - RNA, 20 nt, Human
uggcuuuuauuaaugcacuu

SEQ ID NO: 1312923 - RNA, 21 nt, Human
uggcuuuuauuaaugcacuuu

SEQ ID NO: 1312924 - RNA, 19 nt, Human
uggcuguaaggcucuagau

SEQ ID NO: 1312925 - RNA, 20 nt, Human
uggcuguaaggcucuagauc

SEQ ID NO: 1312926 - RNA, 21 nt, Human
uggcuguaaggcucuagauca

SEQ ID NO: 1312927 - RNA, 20 nt, Human
uggcugguguuaacagaagg

SEQ ID NO: 1312928 - RNA, 21 nt, Human
uggcugguguuaacagaaggg

SEQ ID NO: 1312929 - RNA, 15 nt, Human
uggcuguaaggcucu

SEQ ID NO: 1312930 - RNA, 16 nt, Human
uggcuguaaggcucua

SEQ ID NO: 1312931 - RNA, 23 nt, Human
ugggaauggaggggcagagccag

SEQ ID NO: 1312932 - RNA, 18 nt, Human
ugggacagucaccucaug

SEQ ID NO: 1312933 - RNA, 20 nt, Human
ugggacagucaccucaugga

SEQ ID NO: 1312934 - RNA, 21 nt, Human
ugggacagucaccucauggaa

SEQ ID NO: 1312935 - RNA, 19 nt, Human
ugggaauggaggggcagag

SEQ ID NO: 1312936 - RNA, 17 nt, Human
ugggaauggaggggcag

SEQ ID NO: 1312937 - RNA, 14 nt, Human
uggcuuuucacugc

SEQ ID NO: 1312938 - RNA, 22 nt, Human
uggcuuuuauuaaugcacuuuc

SEQ ID NO: 1312939 - RNA, 15 nt, Human
uggcuuuucacugcu

SEQ ID NO: 1312940 - RNA, 18 nt, Human
uggcgcgaucucagcuca

SEQ ID NO: 1312941 - RNA, 18 nt, Human
uggcgccgucuccagggg

SEQ ID NO: 1312942 - RNA, 21 nt, Human
uggcgcgaucucggcucacug

SEQ ID NO: 1312943 - RNA, 15 nt, Human
uggcgccgucuccag

SEQ ID NO: 1312944 - RNA, 17 nt, Human
uggcgccgucuccaggg

SEQ ID NO: 1312945 - RNA, 16 nt, Human
uggccuuuuucauuua

SEQ ID NO: 1312946 - RNA, 19 nt, Human
uggccuuuuucauuuaucu

SEQ ID NO: 1312947 - RNA, 20 nt, Human
uggccuuuuucauuuaucua

SEQ ID NO: 1312948 - RNA, 22 nt, Human
uggccuuuuucauuuaucuaua

SEQ ID NO: 1312949 - RNA, 15 nt, Human
uggcgcaggaacuca

SEQ ID NO: 1312950 - RNA, 19 nt, Human
uggcguaggcuacagagaa

SEQ ID NO: 1312951 - RNA, 20 nt, Human
uggcguaggcuacagagaag

SEQ ID NO: 1312952 - RNA, 21 nt, Human
uggcguaggcuacagagaagc

SEQ ID NO: 1312953 - RNA, 23 nt, Human
uggcguaggcuacagagaagccu

SEQ ID NO: 1312954 - RNA, 22 nt, Human
uggcguaggcuacagagaagcc

SEQ ID NO: 1312955 - RNA, 18 nt, Human
uggccuucggccuccauc

SEQ ID NO: 1312956 - RNA, 17 nt, Human
uggccuucggccuccau

SEQ ID NO: 1312957 - RNA, 20 nt, Human
uggccuucggccuccauccu

SEQ ID NO: 1312958 - RNA, 23 nt, Human
uggccuuguaagacccuuauugc

SEQ ID NO: 1312959 - RNA, 18 nt, Human
uggccuuguaagacccuu

SEQ ID NO: 1312960 - RNA, 14 nt, Human
uggccuuguucugu

SEQ ID NO: 1312961 - RNA, 19 nt, Human
uggccuuguucugucacca

SEQ ID NO: 1312962 - RNA, 22 nt, Human
uggccuuuauuaaaaacugagu

SEQ ID NO: 1312963 - RNA, 12 nt, Human
uggccuuuauua

SEQ ID NO: 1312964 - RNA, 14 nt, Human
uggccuuugcgcuc

SEQ ID NO: 1312965 - RNA, 16 nt, Human
uggccuuugcgcuccu

SEQ ID NO: 1312966 - RNA, 19 nt, Human
uggccuuugcgcuccuggc

SEQ ID NO: 1312967 - RNA, 24 nt, Human
uggccuuugcgcuccuggcccagc

SEQ ID NO: 1312968 - RNA, 14 nt, Human
uggcuaaagcucga

SEQ ID NO: 1312969 - RNA, 17 nt, Human
uggcuccuucccaucgc

SEQ ID NO: 1312970 - RNA, 19 nt, Human
uggcuccuucccaucgcug

SEQ ID NO: 1312971 - RNA, 17 nt, Human
uggcuccuugugccaga

SEQ ID NO: 1312972 - RNA, 20 nt, Human
uggcuccuugugccagagaa

SEQ ID NO: 1312973 - RNA, 18 nt, Human
uggcucgaaucucugugc

SEQ ID NO: 1312974 - RNA, 19 nt, Human
uggcucgaaucucugugcc

SEQ ID NO: 1312975 - RNA, 20 nt, Human
uggcucgaaucucugugccu

SEQ ID NO: 1312976 - RNA, 19 nt, Human
uggcucguuggcuagauua

SEQ ID NO: 1312977 - RNA, 18 nt, Human
uggcuccuugugccagag

SEQ ID NO: 1312978 - RNA, 21 nt, Human
uggcucgaaucucugugccuu

SEQ ID NO: 1312979 - RNA, 19 nt, Human
uggcucuaauucacagugc

SEQ ID NO: 1312980 - RNA, 14 nt, Human
uggcucuacuuccc

SEQ ID NO: 1312981 - RNA, 15 nt, Human
uggcucucaccucua

SEQ ID NO: 1312982 - RNA, 14 nt, Human
uggcuggggcaugg

SEQ ID NO: 1312983 - RNA, 20 nt, Human
uggcuggggcauggaaggca

SEQ ID NO: 1312984 - RNA, 16 nt, Human
uggaauacucuuauau

SEQ ID NO: 1312985 - RNA, 12 nt, Human
uggaauacuuuu

SEQ ID NO: 1312986 - RNA, 13 nt, Human
uggaauacuuuuu

SEQ ID NO: 1312987 - RNA, 18 nt, Human
uggaauacuuuuuguuau

SEQ ID NO: 1312988 - RNA, 20 nt, Human
uggaaguuuagcucugagaa

SEQ ID NO: 1312989 - RNA, 18 nt, Human
uggaaguuuagcucugag

SEQ ID NO: 1312990 - RNA, 19 nt, Human
uggaaguuuagcucugaga

SEQ ID NO: 1312991 - RNA, 14 nt, Human
uggaauacaugaaa

SEQ ID NO: 1312992 - RNA, 15 nt, Human
uggaauacaugaaau

SEQ ID NO: 1312993 - RNA, 21 nt, Human
uggaagugugugaucuguggg

SEQ ID NO: 1312994 - RNA, 18 nt, Human
uggaaguuauuaacuuua

SEQ ID NO: 1312995 - RNA, 23 nt, Human
uggaauguggccccugaacaaga

SEQ ID NO: 1312996 - RNA, 14 nt, Human
uggaauguaaucaa

SEQ ID NO: 1312997 - RNA, 21 nt, Human
uggaauguggccccugaacaa

SEQ ID NO: 1312998 - RNA, 15 nt, Human
uggaauauuguccau

SEQ ID NO: 1312999 - RNA, 20 nt, Human
uggaauauuguccauugucc

SEQ ID NO: 1313000 - RNA, 22 nt, Human
uggaaucacuguuuagaacaca

SEQ ID NO: 1313001 - RNA, 16 nt, Human
uggaaucagcucagga

SEQ ID NO: 1313002 - RNA, 21 nt, Human
uggaaucaggaauauuuucca

SEQ ID NO: 1313003 - RNA, 22 nt, Human
uggaaucaggaauauuuuccaa

SEQ ID NO: 1313004 - RNA, 23 nt, Human
uggaaucaggaauauuuuccaaa

SEQ ID NO: 1313005 - RNA, 13 nt, Human
uggaauccuuuca

SEQ ID NO: 1313006 - RNA, 19 nt, Human
uggaacccuaaauaauaaa

SEQ ID NO: 1313007 - RNA, 22 nt, Human
uggaacccagacucagacauug

SEQ ID NO: 1313008 - RNA, 16 nt, Human
uggaacccagacucag

SEQ ID NO: 1313009 - RNA, 17 nt, Human
uggaacccagacucaga

SEQ ID NO: 1313010 - RNA, 12 nt, Human
uggaacccagac

SEQ ID NO: 1313011 - RNA, 14 nt, Human
uggaacccagacuc

SEQ ID NO: 1313012 - RNA, 15 nt, Human
uggaacccagacuca

SEQ ID NO: 1313013 - RNA, 11 nt, Human
uggaaaauaaa

SEQ ID NO: 1313014 - RNA, 15 nt, Human
uggaaaauaaaucaa

SEQ ID NO: 1313015 - RNA, 17 nt, Human
ugcuuuuuuuuccuucu

SEQ ID NO: 1313016 - RNA, 17 nt, Human
ugcuuuuuuugugugua

SEQ ID NO: 1313017 - RNA, 23 nt, Human
ugcuuuuuuuguguguauuugcu

SEQ ID NO: 1313018 - RNA, 14 nt, Human
ugcuuuuuuuuccu

SEQ ID NO: 1313019 - RNA, 16 nt, Human
uggaaaaacagcaugu

SEQ ID NO: 1313020 - RNA, 13 nt, Human
uggaacugcugcc

SEQ ID NO: 1313021 - RNA, 15 nt, Human
uggaacugcugccac

SEQ ID NO: 1313022 - RNA, 17 nt, Human
uggaacugcugccacug

SEQ ID NO: 1313023 - RNA, 19 nt, Human
uggaacugcugccacugag

SEQ ID NO: 1313024 - RNA, 20 nt, Human
uggaacugcugccacugagg

SEQ ID NO: 1313025 - RNA, 20 nt, Human
uggaacuggaauccuuucag

SEQ ID NO: 1313026 - RNA, 13 nt, Human
uggaacuggaggc

SEQ ID NO: 1313027 - RNA, 16 nt, Human
uggaacuggaggcagg

SEQ ID NO: 1313028 - RNA, 23 nt, Human
uggaacugucucucaugaaccuc

SEQ ID NO: 1313029 - RNA, 17 nt, Human
uggaacuggaggcaggg

SEQ ID NO: 1313030 - RNA, 14 nt, Human
uggaacucucgagc

SEQ ID NO: 1313031 - RNA, 15 nt, Human
uggaaccucagccug

SEQ ID NO: 1313032 - RNA, 16 nt, Human
uggaaccucagccugg

SEQ ID NO: 1313033 - RNA, 17 nt, Human
uggaaccucagccuggc

SEQ ID NO: 1313034 - RNA, 13 nt, Human
uggaacucugcuu

SEQ ID NO: 1313035 - RNA, 13 nt, Human
uggaacugaaggg

SEQ ID NO: 1313036 - RNA, 15 nt, Human
uggaacugaaggggg

SEQ ID NO: 1313037 - RNA, 16 nt, Human
uggaacugaagggggc

SEQ ID NO: 1313038 - RNA, 20 nt, Human
uggaacugaagggggcggcc

SEQ ID NO: 1313039 - RNA, 21 nt, Human
uggaacugaagggggcggccu

SEQ ID NO: 1313040 - RNA, 22 nt, Human
uggaacugaagggggcggccua

SEQ ID NO: 1313041 - RNA, 15 nt, Human
ugcuuuauuccagaa

SEQ ID NO: 1313042 - RNA, 17 nt, Human
ugcuuuauuccagaaug

SEQ ID NO: 1313043 - RNA, 14 nt, Human
ugcuuuauuccaga

SEQ ID NO: 1313044 - RNA, 19 nt, Human
ugcuuuccauucgugaaaa

SEQ ID NO: 1313045 - RNA, 18 nt, Human
ugcuuuccauucgugaaa

SEQ ID NO: 1313046 - RNA, 17 nt, Human
ugcuuuuuuguuuuggc

SEQ ID NO: 1313047 - RNA, 18 nt, Human
ugcuuguuaacugagugc

SEQ ID NO: 1313048 - RNA, 14 nt, Human
ugcuucuuucuaga

SEQ ID NO: 1313049 - RNA, 15 nt, Human
ugcuucuuucuagaa

SEQ ID NO: 1313050 - RNA, 14 nt, Human
ugcuucuguuuuau

SEQ ID NO: 1313051 - RNA, 21 nt, Human
ugcuucucugacuucugccug

SEQ ID NO: 1313052 - RNA, 22 nt, Human
ugcuucucugacuucugccugg

SEQ ID NO: 1313053 - RNA, 23 nt, Human
ugcuucucugacuucugccugga

SEQ ID NO: 1313054 - RNA, 20 nt, Human
ugcuucuaguucugccagga

SEQ ID NO: 1313055 - RNA, 14 nt, Human
ugcuucucugacuu

SEQ ID NO: 1313056 - RNA, 17 nt, Human
ugcuucucugacuucug

SEQ ID NO: 1313057 - RNA, 19 nt, Human
ugcuucucugacuucugcc

SEQ ID NO: 1313058 - RNA, 20 nt, Human
ugcuucucugacuucugccu

SEQ ID NO: 1313059 - RNA, 18 nt, Human
ugcuucuaguucugccag

SEQ ID NO: 1313060 - RNA, 19 nt, Human
ugcuucuaguucugccagg

SEQ ID NO: 1313061 - RNA, 17 nt, Human
ugcuucuaaguaaauac

SEQ ID NO: 1313062 - RNA, 18 nt, Human
ugcuucuaaguaaauaca

SEQ ID NO: 1313063 - RNA, 19 nt, Human
ugcuucuaaguaaauacaa

SEQ ID NO: 1313064 - RNA, 20 nt, Human
ugcuucuaaguaaauacaau

SEQ ID NO: 1313065 - RNA, 22 nt, Human
ugcuucuaaguaaauacaauuu

SEQ ID NO: 1313066 - RNA, 13 nt, Human
ugcugccucaugc

SEQ ID NO: 1313067 - RNA, 14 nt, Human
ugcugccuccagaa

SEQ ID NO: 1313068 - RNA, 18 nt, Human
ugcuucgggcccuuccca

SEQ ID NO: 1313069 - RNA, 16 nt, Human
ugcuucuaaguaaaua

SEQ ID NO: 1313070 - RNA, 13 nt, Human
uggagauguuuag

SEQ ID NO: 1313071 - RNA, 15 nt, Human
uggagauugaccugg

SEQ ID NO: 1313072 - RNA, 16 nt, Human
uggagauugaccugga

SEQ ID NO: 1313073 - RNA, 24 nt, Human
uggagaugaggccagaccauggac

SEQ ID NO: 1313074 - RNA, 14 nt, Human
uggagaugguggau

SEQ ID NO: 1313075 - RNA, 22 nt, Human
uggagaugaggccagaccaugg

SEQ ID NO: 1313076 - RNA, 19 nt, Human
uggagaugaggccagacca

SEQ ID NO: 1313077 - RNA, 20 nt, Human
uggagaggcccggccucuca

SEQ ID NO: 1313078 - RNA, 15 nt, Human
uggagagggaaugug

SEQ ID NO: 1313079 - RNA, 16 nt, Human
uggagagggaauguga

SEQ ID NO: 1313080 - RNA, 17 nt, Human
uggagagggaaugugaa

SEQ ID NO: 1313081 - RNA, 19 nt, Human
uggagagggaaugugaaau

SEQ ID NO: 1313082 - RNA, 18 nt, Human
uggagagggaaugugaaa

SEQ ID NO: 1313083 - RNA, 18 nt, Human
uggacaggauguguuugc

SEQ ID NO: 1313084 - RNA, 20 nt, Human
uggagacugucuggcccccc

SEQ ID NO: 1313085 - RNA, 21 nt, Human
uggagacugucuggccccccu

SEQ ID NO: 1313086 - RNA, 18 nt, Human
uggagacugugugugccc

SEQ ID NO: 1313087 - RNA, 20 nt, Human
uggagacugugugugcccuc

SEQ ID NO: 1313088 - RNA, 21 nt, Human
uggagacugugugugcccucu

SEQ ID NO: 1313089 - RNA, 16 nt, Human
uggagacuuagggcac

SEQ ID NO: 1313090 - RNA, 21 nt, Human
uggagacuuagggcaccaggg

SEQ ID NO: 1313091 - RNA, 23 nt, Human
uggagacugugugugcccucugg

SEQ ID NO: 1313092 - RNA, 19 nt, Human
uggagagagcagacuggcg

SEQ ID NO: 1313093 - RNA, 13 nt, Human
uggacagcugugc

SEQ ID NO: 1313094 - RNA, 14 nt, Human
uggacagcugugcc

SEQ ID NO: 1313095 - RNA, 15 nt, Human
uggacagcugugccu

SEQ ID NO: 1313096 - RNA, 16 nt, Human
uggacagcugugccuc

SEQ ID NO: 1313097 - RNA, 18 nt, Human
uggacagcugugccucgc

SEQ ID NO: 1313098 - RNA, 19 nt, Human
uggacagcugugccucgcu

SEQ ID NO: 1313099 - RNA, 12 nt, Human
uggacagcuugu

SEQ ID NO: 1313100 - RNA, 13 nt, Human
uggacagcuugug

SEQ ID NO: 1313101 - RNA, 23 nt, Human
uggacaggacuaacacucagaag

SEQ ID NO: 1313102 - RNA, 13 nt, Human
uggacaggaugug

SEQ ID NO: 1313103 - RNA, 17 nt, Human
uggaggcaggggcuucc

SEQ ID NO: 1313104 - RNA, 18 nt, Human
uggaggcaggggcuuccu

SEQ ID NO: 1313105 - RNA, 20 nt, Human
uggaggcaggggcuuccugg

SEQ ID NO: 1313106 - RNA, 21 nt, Human
uggaggccacuguuuggaaau

SEQ ID NO: 1313107 - RNA, 19 nt, Human
uggaggcaggggcuuccug

SEQ ID NO: 1313108 - RNA, 14 nt, Human
uggaggcaggggcu

SEQ ID NO: 1313109 - RNA, 22 nt, Human
uggaggccauugugugagccua

SEQ ID NO: 1313110 - RNA, 12 nt, Human
uggaggcccagg

SEQ ID NO: 1313111 - RNA, 14 nt, Human
uggaggcccaggcu

SEQ ID NO: 1313112 - RNA, 18 nt, Human
uggaggcccaggcuggga

SEQ ID NO: 1313113 - RNA, 12 nt, Human
uggaggcccagu

SEQ ID NO: 1313114 - RNA, 18 nt, Human
uggaggccccaacccugu

SEQ ID NO: 1313115 - RNA, 15 nt, Human
uggaggcccaguuca

SEQ ID NO: 1313116 - RNA, 12 nt, Human
uggaggcugcuc

SEQ ID NO: 1313117 - RNA, 13 nt, Human
uggauaccauuau

SEQ ID NO: 1313118 - RNA, 15 nt, Human
uggauaccauuauau

SEQ ID NO: 1313119 - RNA, 22 nt, Human
uggauacuuggauuuaguuuca

SEQ ID NO: 1313120 - RNA, 14 nt, Human
uggauacuuggauu

SEQ ID NO: 1313121 - RNA, 15 nt, Human
uggauacuuggauuu

SEQ ID NO: 1313122 - RNA, 16 nt, Human
uggauauaguuuuacu

SEQ ID NO: 1313123 - RNA, 21 nt, Human
uggaucuugauguaaggaugg

SEQ ID NO: 1313124 - RNA, 14 nt, Human
uggaugacauuaaa

SEQ ID NO: 1313125 - RNA, 13 nt, Human
uggaugagcuccc

SEQ ID NO: 1313126 - RNA, 19 nt, Human
uggaugauauaaugcgggu

SEQ ID NO: 1313127 - RNA, 23 nt, Human
uggaugagcucccacaagccuga

SEQ ID NO: 1313128 - RNA, 16 nt, Human
uggaugauacuaauaa

SEQ ID NO: 1313129 - RNA, 22 nt, Human
uggaugauccccacgccacagc

SEQ ID NO: 1313130 - RNA, 22 nt, Human
uggccacuccagaccccuggcu

SEQ ID NO: 1313131 - RNA, 14 nt, Human
uggccacuccgaga

SEQ ID NO: 1313132 - RNA, 18 nt, Human
uggccacuccgagaggug

SEQ ID NO: 1313133 - RNA, 13 nt, Human
uggcaguuauauu

SEQ ID NO: 1313134 - RNA, 20 nt, Human
uggcaguuuauauuuaacuc

SEQ ID NO: 1313135 - RNA, 20 nt, Human
uggccacuccgagagguggg

SEQ ID NO: 1313136 - RNA, 23 nt, Human
uggccacuccgagaggugggcca

SEQ ID NO: 1313137 - RNA, 16 nt, Human
uggcaguuuauauuua

SEQ ID NO: 1313138 - RNA, 12 nt, Human
uggccagacaca

SEQ ID NO: 1313139 - RNA, 13 nt, Human
uggccagacacag

SEQ ID NO: 1313140 - RNA, 18 nt, Human
uggccagacacaggcccu

SEQ ID NO: 1313141 - RNA, 23 nt, Human
uggcaggcagaggcccaggcugc

SEQ ID NO: 1313142 - RNA, 22 nt, Human
uggcaggcagaggcccaggcug

SEQ ID NO: 1313143 - RNA, 20 nt, Human
uggcaggcaggcucccaggg

SEQ ID NO: 1313144 - RNA, 15 nt, Human
uggcaggccagcugu

SEQ ID NO: 1313145 - RNA, 12 nt, Human
uggcaggcuggc

SEQ ID NO: 1313146 - RNA, 13 nt, Human
uggcaggcuggcc

SEQ ID NO: 1313147 - RNA, 14 nt, Human
uggcaggcuggcca

SEQ ID NO: 1313148 - RNA, 18 nt, Human
uggcaggcuggccagucc

SEQ ID NO: 1313149 - RNA, 15 nt, Human
uggcaggcuggccag

SEQ ID NO: 1313150 - RNA, 20 nt, Human
uggaugauacuaauaaacua

SEQ ID NO: 1313151 - RNA, 20 nt, Human
uggaugccaauauuaaaucu

SEQ ID NO: 1313152 - RNA, 21 nt, Human
uggaugccaauauuaaaucug

SEQ ID NO: 1313153 - RNA, 12 nt, Human
uggcaggcagag

SEQ ID NO: 1313154 - RNA, 17 nt, Human
uggcaggcagaggccca

SEQ ID NO: 1313155 - RNA, 18 nt, Human
uggcaggcagaggcccag

SEQ ID NO: 1313156 - RNA, 21 nt, Human
uggcaggcagaggcccaggcu

SEQ ID NO: 1313157 - RNA, 11 nt, Human
uggcacuuuga

SEQ ID NO: 1313158 - RNA, 16 nt, Human
uggcacuuugaagggg

SEQ ID NO: 1313159 - RNA, 12 nt, Human
uggcagaaaagu

SEQ ID NO: 1313160 - RNA, 16 nt, Human
ugcacguaaaguacuu

SEQ ID NO: 1313161 - RNA, 18 nt, Human
ugcacguaaaguacuugu

SEQ ID NO: 1313162 - RNA, 19 nt, Human
ugcacguaaaguacuugua

SEQ ID NO: 1313163 - RNA, 21 nt, Human
ugcacguaaaguacuuguagu

SEQ ID NO: 1313164 - RNA, 22 nt, Human
ugcacuugcgguuccggcaugg

SEQ ID NO: 1313165 - RNA, 16 nt, Human
ugcacuuggcugcaua

SEQ ID NO: 1313166 - RNA, 17 nt, Human
ugcagauaaacaguagu

SEQ ID NO: 1313167 - RNA, 16 nt, Human
ugcagauaaacaguag

SEQ ID NO: 1313168 - RNA, 13 nt, Human
ugcagcuuuaaaa

SEQ ID NO: 1313169 - RNA, 14 nt, Human
ugcagcauuucacu

SEQ ID NO: 1313170 - RNA, 15 nt, Human
ugcagcauuucacuu

SEQ ID NO: 1313171 - RNA, 23 nt, Human
ugcaggaaggagcugccuggacc

SEQ ID NO: 1313172 - RNA, 15 nt, Human
ugcaggaaggagcug

SEQ ID NO: 1313173 - RNA, 16 nt, Human
ugcaggaaggagcugc

SEQ ID NO: 1313174 - RNA, 17 nt, Human
ugcaggaaggagcugcc

SEQ ID NO: 1313175 - RNA, 18 nt, Human
ugcaggaaggagcugccu

SEQ ID NO: 1313176 - RNA, 19 nt, Human
ugcaggaaggagcugccug

SEQ ID NO: 1313177 - RNA, 20 nt, Human
ugcaggaaggagcugccugg

SEQ ID NO: 1313178 - RNA, 21 nt, Human
ugcaggaaggagcugccugga

SEQ ID NO: 1313179 - RNA, 22 nt, Human
ugcaggaaggagcugccuggac

SEQ ID NO: 1313180 - RNA, 12 nt, Human
ugcaggaaggag

SEQ ID NO: 1313181 - RNA, 14 nt, Human
ugcaggaaggagcu

SEQ ID NO: 1313182 - RNA, 22 nt, Human
ugcagcuuuaaaaaauuaaucu

SEQ ID NO: 1313183 - RNA, 22 nt, Human
ugcagcuuguagccagccgggg

SEQ ID NO: 1313184 - RNA, 15 nt, Human
ugcacaucaaaauau

SEQ ID NO: 1313185 - RNA, 12 nt, Human
ugcacaucccug

SEQ ID NO: 1313186 - RNA, 22 nt, Human
ugcacaucuguaaaucuacaca

SEQ ID NO: 1313187 - RNA, 15 nt, Human
ugcacaucugugucu

SEQ ID NO: 1313188 - RNA, 16 nt, Human
ugcacaucugugucuu

SEQ ID NO: 1313189 - RNA, 18 nt, Human
ugcacaucugugucuugu

SEQ ID NO: 1313190 - RNA, 19 nt, Human
ugcacaucugugucuuguu

SEQ ID NO: 1313191 - RNA, 15 nt, Human
ugcaccuaaaacuua

SEQ ID NO: 1313192 - RNA, 13 nt, Human
ugcaccuaaagaa

SEQ ID NO: 1313193 - RNA, 14 nt, Human
ugcaccuaaagaaa

SEQ ID NO: 1313194 - RNA, 15 nt, Human
ugcaccuaaagaaaa

SEQ ID NO: 1313195 - RNA, 16 nt, Human
ugcaccuaaagaaaaa

SEQ ID NO: 1313196 - RNA, 19 nt, Human
ugcaccuaaagaaaaacaa

SEQ ID NO: 1313197 - RNA, 21 nt, Human
ugcaccuaaagaaaaacaaac

SEQ ID NO: 1313198 - RNA, 14 nt, Human
ugcacagcaucuca

SEQ ID NO: 1313199 - RNA, 12 nt, Human
ugcacaggaggg

SEQ ID NO: 1313200 - RNA, 13 nt, Human
ugcacaggagggg

SEQ ID NO: 1313201 - RNA, 19 nt, Human
ugcacagugcaucucagcc

SEQ ID NO: 1313202 - RNA, 20 nt, Human
ugcacagugcaucucagccc

SEQ ID NO: 1313203 - RNA, 15 nt, Human
ugcacaggagggggu

SEQ ID NO: 1313204 - RNA, 23 nt, Human
ugcacaggagggggucguggaga

SEQ ID NO: 1313205 - RNA, 18 nt, Human
ugcacagugcaucucagc

SEQ ID NO: 1313206 - RNA, 24 nt, Human
ugcacagccccuaagucaacuuag

SEQ ID NO: 1313207 - RNA, 15 nt, Human
ugcacagcaucucag

SEQ ID NO: 1313208 - RNA, 22 nt, Human
ugcacagcacaaauuaguuaua

SEQ ID NO: 1313209 - RNA, 16 nt, Human
ugcacagcacaaauua

SEQ ID NO: 1313210 - RNA, 18 nt, Human
ugcacagcacaaauuagu

SEQ ID NO: 1313211 - RNA, 23 nt, Human
ugcacagcacaaauuaguuauau

SEQ ID NO: 1313212 - RNA, 13 nt, Human
ugcacacuuuggu

SEQ ID NO: 1313213 - RNA, 17 nt, Human
ugcacacuuugguacca

SEQ ID NO: 1313214 - RNA, 22 nt, Human
ugcacacuuugccauauuuuca

SEQ ID NO: 1313215 - RNA, 14 nt, Human
ugcacacuuugcca

SEQ ID NO: 1313216 - RNA, 22 nt, Human
ugcacacuuugguaccagauaa

SEQ ID NO: 1313217 - RNA, 20 nt, Human
ugccaggcuggagugcagug

SEQ ID NO: 1313218 - RNA, 17 nt, Human
ugccagggcaaugauga

SEQ ID NO: 1313219 - RNA, 22 nt, Human
ugccagggcaaugaugaaugag

SEQ ID NO: 1313220 - RNA, 11 nt, Human
ugccagggcag

SEQ ID NO: 1313221 - RNA, 12 nt, Human
ugccagggcagg

SEQ ID NO: 1313222 - RNA, 17 nt, Human
ugccaagagugaaggga

SEQ ID NO: 1313223 - RNA, 17 nt, Human
ugccacccagccccagc

SEQ ID NO: 1313224 - RNA, 20 nt, Human
ugccacccagccccagccag

SEQ ID NO: 1313225 - RNA, 21 nt, Human
ugccacccagccccagccagg

SEQ ID NO: 1313226 - RNA, 22 nt, Human
ugccacccagccccagccaggg

SEQ ID NO: 1313227 - RNA, 13 nt, Human
ugccacccaggau

SEQ ID NO: 1313228 - RNA, 22 nt, Human
ugccaguaacgcgucuuccuga

SEQ ID NO: 1313229 - RNA, 23 nt, Human
ugccaguaacgcgucuuccugag

SEQ ID NO: 1313230 - RNA, 17 nt, Human
ugccaguaacaggcuca

SEQ ID NO: 1313231 - RNA, 18 nt, Human
ugccaguaacgcgucuuc

SEQ ID NO: 1313232 - RNA, 21 nt, Human
ugccaguaacgcgucuuccug

SEQ ID NO: 1313233 - RNA, 21 nt, Human
ugccaguauuuuaaaauagcg

SEQ ID NO: 1313234 - RNA, 17 nt, Human
ugccaguauuuuaaaau

SEQ ID NO: 1313235 - RNA, 22 nt, Human
ugccaucugcgugacaauaaaa

SEQ ID NO: 1313236 - RNA, 21 nt, Human
ugccaugaugccucugucuuc

SEQ ID NO: 1313237 - RNA, 18 nt, Human
ugcccacagugucaggca

SEQ ID NO: 1313238 - RNA, 20 nt, Human
ugcccacagugucaggcacu

SEQ ID NO: 1313239 - RNA, 23 nt, Human
ugcccacagugucaggcacuggg

SEQ ID NO: 1313240 - RNA, 21 nt, Human
ugcccacagugucaggcacug

SEQ ID NO: 1313241 - RNA, 15 nt, Human
ugcauuauauuuauu

SEQ ID NO: 1313242 - RNA, 20 nt, Human
ugcauuaaauucacaaacuu

SEQ ID NO: 1313243 - RNA, 21 nt, Human
ugcauuaaauucacaaacuuu

SEQ ID NO: 1313244 - RNA, 20 nt, Human
ugcauuaaauuacagaaauu

SEQ ID NO: 1313245 - RNA, 20 nt, Human
ugcauuauauuuauuacugu

SEQ ID NO: 1313246 - RNA, 21 nt, Human
ugcauuauauuuauuacugua

SEQ ID NO: 1313247 - RNA, 17 nt, Human
ugcauuaaauuacagaa

SEQ ID NO: 1313248 - RNA, 13 nt, Human
ugcauuaaauuca

SEQ ID NO: 1313249 - RNA, 14 nt, Human
ugcauuaaauucac

SEQ ID NO: 1313250 - RNA, 15 nt, Human
ugcauuaaauucaca

SEQ ID NO: 1313251 - RNA, 16 nt, Human
ugcauuaaauucacaa

SEQ ID NO: 1313252 - RNA, 17 nt, Human
ugcauuaaauucacaaa

SEQ ID NO: 1313253 - RNA, 19 nt, Human
ugcauuaaauucacaaacu

SEQ ID NO: 1313254 - RNA, 16 nt, Human
ugccaaaaaaaaauac

SEQ ID NO: 1313255 - RNA, 16 nt, Human
ugccaaaaagugaaau

SEQ ID NO: 1313256 - RNA, 17 nt, Human
ugccaaaaagugaaaua

SEQ ID NO: 1313257 - RNA, 18 nt, Human
ugccaaaaagugaaauaa

SEQ ID NO: 1313258 - RNA, 19 nt, Human
ugccaaaaagugaaauaau

SEQ ID NO: 1313259 - RNA, 22 nt, Human
ugccaaaaagugaaauaaugug

SEQ ID NO: 1313260 - RNA, 21 nt, Human
ugccaaaaagugaaauaaugu

SEQ ID NO: 1313261 - RNA, 14 nt, Human
ugccaagacugcug

SEQ ID NO: 1313262 - RNA, 17 nt, Human
ugccaagacugcugugg

SEQ ID NO: 1313263 - RNA, 21 nt, Human
ugccaagacugcuguggccag

SEQ ID NO: 1313264 - RNA, 22 nt, Human
ugccaagacugcuguggccagg

SEQ ID NO: 1313265 - RNA, 23 nt, Human
ugccaagacugcuguggccagga

SEQ ID NO: 1313266 - RNA, 21 nt, Human
ugcauccagccuggggcugag

SEQ ID NO: 1313267 - RNA, 18 nt, Human
ugcaggauggugucucuu

SEQ ID NO: 1313268 - RNA, 14 nt, Human
ugcaggaugguguc

SEQ ID NO: 1313269 - RNA, 18 nt, Human
ugcauccuccgccucccg

SEQ ID NO: 1313270 - RNA, 21 nt, Human
ugcauccuccgccucccgggu

SEQ ID NO: 1313271 - RNA, 22 nt, Human
ugcauccucuggagccagccga

SEQ ID NO: 1313272 - RNA, 19 nt, Human
ugcauccucuggagccagc

SEQ ID NO: 1313273 - RNA, 16 nt, Human
ugcauguccuguaaag

SEQ ID NO: 1313274 - RNA, 19 nt, Human
ugcaggaaucuuuaaaaga

SEQ ID NO: 1313275 - RNA, 17 nt, Human
ugcaggaucucaccagg

SEQ ID NO: 1313276 - RNA, 19 nt, Human
ugcaggaucucaccaggca

SEQ ID NO: 1313277 - RNA, 20 nt, Human
ugcaggaucucaccaggcag

SEQ ID NO: 1313278 - RNA, 21 nt, Human
ugcaggaucucaccaggcagc

SEQ ID NO: 1313279 - RNA, 22 nt, Human
ugcaggaucucaccaggcagcc

SEQ ID NO: 1313280 - RNA, 18 nt, Human
ugcugauauuuaaauuca

SEQ ID NO: 1313281 - RNA, 15 nt, Human
ugcugauauuuucuc

SEQ ID NO: 1313282 - RNA, 21 nt, Human
ugcugauauuuucucuaggaa

SEQ ID NO: 1313283 - RNA, 18 nt, Human
ugcugauauuuucucuag

SEQ ID NO: 1313284 - RNA, 16 nt, Human
ugcugaucgccuuccc

SEQ ID NO: 1313285 - RNA, 21 nt, Human
ugcugaugaacucuuaaucaa

SEQ ID NO: 1313286 - RNA, 17 nt, Human
ugcugaucgccuucccc

SEQ ID NO: 1313287 - RNA, 18 nt, Human
ugcugaucgccuucccca

SEQ ID NO: 1313288 - RNA, 18 nt, Human
ugcugaauauacagcagg

SEQ ID NO: 1313289 - RNA, 18 nt, Human
ugcugaauguugggacug

SEQ ID NO: 1313290 - RNA, 20 nt, Human
ugcugaauguugggacugcu

SEQ ID NO: 1313291 - RNA, 16 nt, Human
ugcugauggagccuuc

SEQ ID NO: 1313292 - RNA, 15 nt, Human
ugcugauggagccuu

SEQ ID NO: 1313293 - RNA, 21 nt, Human
ugcuccuguucacaccagaga

SEQ ID NO: 1313294 - RNA, 15 nt, Human
ugcuccuuccccauc

SEQ ID NO: 1313295 - RNA, 12 nt, Human
ugcuccuugggc

SEQ ID NO: 1313296 - RNA, 14 nt, Human
ugcuccuugggccc

SEQ ID NO: 1313297 - RNA, 15 nt, Human
ugcuccuugggcccu

SEQ ID NO: 1313298 - RNA, 16 nt, Human
ugcuccuugggcccuu

SEQ ID NO: 1313299 - RNA, 18 nt, Human
ugcuccuugggcccuuug

SEQ ID NO: 1313300 - RNA, 19 nt, Human
ugcuccuugggcccuuuga

SEQ ID NO: 1313301 - RNA, 21 nt, Human
ugcuccuugggcccuuugagu

SEQ ID NO: 1313302 - RNA, 13 nt, Human
ugcuccuucccca

SEQ ID NO: 1313303 - RNA, 16 nt, Human
ugcucuuucucugcca

SEQ ID NO: 1313304 - RNA, 17 nt, Human
ugcucuuucucugccag

SEQ ID NO: 1313305 - RNA, 18 nt, Human
ugcucuuucucugccagu

SEQ ID NO: 1313306 - RNA, 21 nt, Human
ugcucuuucucugccagugac

SEQ ID NO: 1313307 - RNA, 22 nt, Human
ugcucuuucucugccagugaca

SEQ ID NO: 1313308 - RNA, 14 nt, Human
ugcucuuuguuuug

SEQ ID NO: 1313309 - RNA, 15 nt, Human
ugcucuuuguuuugu

SEQ ID NO: 1313310 - RNA, 18 nt, Human
ugcucuuuguuuuguguc

SEQ ID NO: 1313311 - RNA, 20 nt, Human
ugcucuuuguuuugugucuc

SEQ ID NO: 1313312 - RNA, 13 nt, Human
ugcucuuuucucc

SEQ ID NO: 1313313 - RNA, 15 nt, Human
ugcucuuuucuccuc

SEQ ID NO: 1313314 - RNA, 21 nt, Human
ugcucuuuucuccucacugua

SEQ ID NO: 1313315 - RNA, 23 nt, Human
ugcucuuuucuccucacuguauc

SEQ ID NO: 1313316 - RNA, 16 nt, Human
ugcugaaaaaugggca

SEQ ID NO: 1313317 - RNA, 22 nt, Human
ugcucuuuguuuugugucucuu

SEQ ID NO: 1313318 - RNA, 16 nt, Human
ugcugaaaauguccuu

SEQ ID NO: 1313319 - RNA, 21 nt, Human
ugcugaaaauguccuugugau

SEQ ID NO: 1313320 - RNA, 18 nt, Human
ugcugaaaauguccuugu

SEQ ID NO: 1313321 - RNA, 15 nt, Human
ugcucaggagcccug

SEQ ID NO: 1313322 - RNA, 15 nt, Human
ugcucaucauucucu

SEQ ID NO: 1313323 - RNA, 17 nt, Human
ugcucaucauucucugu

SEQ ID NO: 1313324 - RNA, 19 nt, Human
ugcucaucauucucugucu

SEQ ID NO: 1313325 - RNA, 20 nt, Human
ugcucaucauucucugucuc

SEQ ID NO: 1313326 - RNA, 21 nt, Human
ugcucaucauucucugucuca

SEQ ID NO: 1313327 - RNA, 23 nt, Human
ugcucaucauucucugucucauc

SEQ ID NO: 1313328 - RNA, 11 nt, Human
ugcucauggaa

SEQ ID NO: 1313329 - RNA, 17 nt, Human
ugcucauccacucuacu

SEQ ID NO: 1313330 - RNA, 13 nt, Human
ugcucaucugcug

SEQ ID NO: 1313331 - RNA, 14 nt, Human
ugcucaucugcugg

SEQ ID NO: 1313332 - RNA, 15 nt, Human
ugcucaucugcuggu

SEQ ID NO: 1313333 - RNA, 16 nt, Human
ugcucaucugcugguc

SEQ ID NO: 1313334 - RNA, 18 nt, Human
ugcucaucugcugguccg

SEQ ID NO: 1313335 - RNA, 13 nt, Human
ugcuccucuuccc

SEQ ID NO: 1313336 - RNA, 15 nt, Human
ugcuccucuucccca

SEQ ID NO: 1313337 - RNA, 19 nt, Human
ugcuccucuuccccagacg

SEQ ID NO: 1313338 - RNA, 16 nt, Human
ugcuccucuuccccag

SEQ ID NO: 1313339 - RNA, 18 nt, Human
ugcuccuggaucucccug

SEQ ID NO: 1313340 - RNA, 21 nt, Human
ugcuccuggaucucccugaga

SEQ ID NO: 1313341 - RNA, 14 nt, Human
ugcucaggagcccu

SEQ ID NO: 1313342 - RNA, 17 nt, Human
ugcucagcuucuccaac

SEQ ID NO: 1313343 - RNA, 20 nt, Human
ugcucagcuucuccaacaau

SEQ ID NO: 1313344 - RNA, 18 nt, Human
ugcucagcucugggccau

SEQ ID NO: 1313345 - RNA, 20 nt, Human
ugcucagcucugggccauuc

SEQ ID NO: 1313346 - RNA, 16 nt, Human
ugcucagcugucaagg

SEQ ID NO: 1313347 - RNA, 20 nt, Human
ugcucagcugucaaggcuca

SEQ ID NO: 1313348 - RNA, 20 nt, Human
ugcuaggguuaggagguccu

SEQ ID NO: 1313349 - RNA, 21 nt, Human
ugcuaggguuaggagguccuu

SEQ ID NO: 1313350 - RNA, 12 nt, Human
ugcuagguucua

SEQ ID NO: 1313351 - RNA, 13 nt, Human
ugcuagguucuac

SEQ ID NO: 1313352 - RNA, 21 nt, Human
ugcuagaacucccuuucaaca

SEQ ID NO: 1313353 - RNA, 20 nt, Human
ugcuagaacucccuuucaac

SEQ ID NO: 1313354 - RNA, 13 nt, Human
ugcuagagcuccu

SEQ ID NO: 1313355 - RNA, 14 nt, Human
ugcuagagcuccuc

SEQ ID NO: 1313356 - RNA, 19 nt, Human
ugcuagaacucccuuucaa

SEQ ID NO: 1313357 - RNA, 18 nt, Human
ugcgugggagugugugcc

SEQ ID NO: 1313358 - RNA, 14 nt, Human
ugcgugggugugug

SEQ ID NO: 1313359 - RNA, 23 nt, Human
ugcgugggugugugcguguuugg

SEQ ID NO: 1313360 - RNA, 18 nt, Human
ugcgugguggucccuggg

SEQ ID NO: 1313361 - RNA, 19 nt, Human
ugcgugguggucccugggu

SEQ ID NO: 1313362 - RNA, 21 nt, Human
ugcgugguggucccuggguag

SEQ ID NO: 1313363 - RNA, 20 nt, Human
ugcgguuauaaaaaaugguu

SEQ ID NO: 1313364 - RNA, 22 nt, Human
ugcgguuauaaaaaaugguuca

SEQ ID NO: 1313365 - RNA, 18 nt, Human
ugcgguuccggcauggac

SEQ ID NO: 1313366 - RNA, 23 nt, Human
ugcgguucaggaaaauugaaugc

SEQ ID NO: 1313367 - RNA, 19 nt, Human
ugcguccacgagcuguuua

SEQ ID NO: 1313368 - RNA, 20 nt, Human
ugcguggaaugcccuucacu

SEQ ID NO: 1313369 - RNA, 22 nt, Human
ugccuucucaacuccaaacuga

SEQ ID NO: 1313370 - RNA, 13 nt, Human
ugccuucucucuc

SEQ ID NO: 1313371 - RNA, 17 nt, Human
ugccuuccuccugggcc

SEQ ID NO: 1313372 - RNA, 19 nt, Human
ugccuuccuccugggcccu

SEQ ID NO: 1313373 - RNA, 20 nt, Human
ugccuuccuccugggcccuc

SEQ ID NO: 1313374 - RNA, 15 nt, Human
ugccuuccuguuuuu

SEQ ID NO: 1313375 - RNA, 19 nt, Human
ugccuuccuguuuuucaca

SEQ ID NO: 1313376 - RNA, 13 nt, Human
ugccuucgcuucu

SEQ ID NO: 1313377 - RNA, 14 nt, Human
ugccuucgcuucuu

SEQ ID NO: 1313378 - RNA, 16 nt, Human
ugccuucgcuucuugc

SEQ ID NO: 1313379 - RNA, 17 nt, Human
ugccuucgcuucuugcc

SEQ ID NO: 1313380 - RNA, 20 nt, Human
ugccuucgcuucuugccucu

SEQ ID NO: 1313381 - RNA, 21 nt, Human
ugcgcccuuaacugcauccag

SEQ ID NO: 1313382 - RNA, 23 nt, Human
ugcgcccccuccgcccugccacu

SEQ ID NO: 1313383 - RNA, 16 nt, Human
ugcgguuaauuuugaa

SEQ ID NO: 1313384 - RNA, 21 nt, Human
ugcgguuaauuuugaagugcu

SEQ ID NO: 1313385 - RNA, 19 nt, Human
ugcgguuauaaaaaauggu

SEQ ID NO: 1313386 - RNA, 13 nt, Human
ugcgcaggcuggc

SEQ ID NO: 1313387 - RNA, 16 nt, Human
ugcgcaggcuggcccu

SEQ ID NO: 1313388 - RNA, 17 nt, Human
ugcgcaggcuggcccug

SEQ ID NO: 1313389 - RNA, 19 nt, Human
ugcgcaggcuggcccugcc

SEQ ID NO: 1313390 - RNA, 18 nt, Human
ugcgcccagggcugggag

SEQ ID NO: 1313391 - RNA, 19 nt, Human
ugcgcccagggcugggagg

SEQ ID NO: 1313392 - RNA, 23 nt, Human
ugcgcccagggcugggaggaagg

SEQ ID NO: 1313393 - RNA, 21 nt, Human
ugcgcccccuccgcccugcca

SEQ ID NO: 1313394 - RNA, 15 nt, Human
ugccuggcggggugg

SEQ ID NO: 1313395 - RNA, 13 nt, Human
ugccuucagcucu

SEQ ID NO: 1313396 - RNA, 18 nt, Human
ugccuuauucagggaagg

SEQ ID NO: 1313397 - RNA, 12 nt, Human
ugccuucaagaa

SEQ ID NO: 1313398 - RNA, 21 nt, Human
ugccuuauuagagugucuuuc

SEQ ID NO: 1313399 - RNA, 23 nt, Human
ugccuuauuagagugucuuucca

SEQ ID NO: 1313400 - RNA, 17 nt, Human
ugccuucagcucuacag

SEQ ID NO: 1313401 - RNA, 18 nt, Human
ugccuucagcucuacagc

SEQ ID NO: 1313402 - RNA, 17 nt, Human
ugccuuauucagggaag

SEQ ID NO: 1313403 - RNA, 12 nt, Human
ugccuucauuug

SEQ ID NO: 1313404 - RNA, 15 nt, Human
ugccuuccagaaaac

SEQ ID NO: 1313405 - RNA, 18 nt, Human
ugccuuccagaaaacaaa

SEQ ID NO: 1313406 - RNA, 14 nt, Human
ugccuuccuccugg

SEQ ID NO: 1313407 - RNA, 15 nt, Human
ugccuuccuccuggg

SEQ ID NO: 1313408 - RNA, 16 nt, Human
ugccuuccuccugggc

SEQ ID NO: 1313409 - RNA, 22 nt, Human
ugccuaaguccaguguuucuuu

SEQ ID NO: 1313410 - RNA, 19 nt, Human
ugccuaaggcugaacuugu

SEQ ID NO: 1313411 - RNA, 17 nt, Human
ugccuacagaacuucag

SEQ ID NO: 1313412 - RNA, 22 nt, Human
ugccuacagaacuucagaaaga

SEQ ID NO: 1313413 - RNA, 23 nt, Human
ugccuacagaacuucagaaagac

SEQ ID NO: 1313414 - RNA, 13 nt, Human
ugccuagaaacaa

SEQ ID NO: 1313415 - RNA, 18 nt, Human
ugccuagaaacaacacug

SEQ ID NO: 1313416 - RNA, 19 nt, Human
ugccuagaaacaacacugu

SEQ ID NO: 1313417 - RNA, 23 nt, Human
ugccuagaaacaacacuguagua

SEQ ID NO: 1313418 - RNA, 17 nt, Human
ugccuagauucagggaa

SEQ ID NO: 1313419 - RNA, 22 nt, Human
ugccuagaaacaacacuguagu

SEQ ID NO: 1313420 - RNA, 14 nt, Human
ugccuaggccuggg

SEQ ID NO: 1313421 - RNA, 20 nt, Human
ugccuaggccugggcagugg

SEQ ID NO: 1313422 - RNA, 16 nt, Human
ugccuaggccugggca

SEQ ID NO: 1313423 - RNA, 17 nt, Human
ugccuccccucuccuuc

SEQ ID NO: 1313424 - RNA, 15 nt, Human
ugccuaguauugaca

SEQ ID NO: 1313425 - RNA, 18 nt, Human
ugccuccccucuccuucc

SEQ ID NO: 1313426 - RNA, 13 nt, Human
ugccuccuuccuc

SEQ ID NO: 1313427 - RNA, 16 nt, Human
ugccucugucuucugg

SEQ ID NO: 1313428 - RNA, 11 nt, Human
ugccucugugc

SEQ ID NO: 1313429 - RNA, 12 nt, Human
ugccucugugcu

SEQ ID NO: 1313430 - RNA, 13 nt, Human
ugccucugugcug

SEQ ID NO: 1313431 - RNA, 17 nt, Human
ugccucugugcugugug

SEQ ID NO: 1313432 - RNA, 14 nt, Human
ugccucugugcugu

SEQ ID NO: 1313433 - RNA, 16 nt, Human
ugccucugugcugugu

SEQ ID NO: 1313434 - RNA, 15 nt, Human
ugccugaauauuugu

SEQ ID NO: 1313435 - RNA, 13 nt, Human
ugccugacacacu

SEQ ID NO: 1313436 - RNA, 18 nt, Human
ugccucugucuucuggac

SEQ ID NO: 1313437 - RNA, 19 nt, Human
ugccugagucgugaccugc

SEQ ID NO: 1313438 - RNA, 20 nt, Human
ugccugagucgugaccugcu

SEQ ID NO: 1313439 - RNA, 24 nt, Human
ugccugagucgugaccugcuaggc

SEQ ID NO: 1313440 - RNA, 23 nt, Human
ugccugagucgugaccugcuagg

SEQ ID NO: 1313441 - RNA, 22 nt, Human
ucuguuuuauaauuuugugaag

SEQ ID NO: 1313442 - RNA, 17 nt, Human
ucuguuaugcugugaca

SEQ ID NO: 1313443 - RNA, 19 nt, Human
ucuguucacuuuuccuccc

SEQ ID NO: 1313444 - RNA, 21 nt, Human
ucuguucacuuuuccucccuc

SEQ ID NO: 1313445 - RNA, 22 nt, Human
ucuguucacuuuuccucccuca

SEQ ID NO: 1313446 - RNA, 20 nt, Human
ucuguucaaagcugccuguc

SEQ ID NO: 1313447 - RNA, 14 nt, Human
ucuguguugccaag

SEQ ID NO: 1313448 - RNA, 16 nt, Human
ucuguguugccaagcu

SEQ ID NO: 1313449 - RNA, 11 nt, Human
ucugugucuuu

SEQ ID NO: 1313450 - RNA, 18 nt, Human
ucuguguuuugaaagaau

SEQ ID NO: 1313451 - RNA, 13 nt, Human
ucuguuaacugaa

SEQ ID NO: 1313452 - RNA, 16 nt, Human
ucuguuaacugaauac

SEQ ID NO: 1313453 - RNA, 17 nt, Human
ucuguuaacugaauacc

SEQ ID NO: 1313454 - RNA, 20 nt, Human
ucuguuaacugaauaccacu

SEQ ID NO: 1313455 - RNA, 21 nt, Human
ucuguuaacugaauaccacuc

SEQ ID NO: 1313456 - RNA, 19 nt, Human
ucuguuacacuuuuuggaa

SEQ ID NO: 1313457 - RNA, 20 nt, Human
ucuguccguucacaugugug

SEQ ID NO: 1313458 - RNA, 17 nt, Human
ucuguccgagugugcca

SEQ ID NO: 1313459 - RNA, 15 nt, Human
ucuguccgagugugc

SEQ ID NO: 1313460 - RNA, 19 nt, Human
ucugucccuugccccccug

SEQ ID NO: 1313461 - RNA, 16 nt, Human
ucugucccuugccccc

SEQ ID NO: 1313462 - RNA, 22 nt, Human
ucugucccuugccccccuggcc

SEQ ID NO: 1313463 - RNA, 12 nt, Human
ucuguaccaguu

SEQ ID NO: 1313464 - RNA, 13 nt, Human
ucuguaccaguua

SEQ ID NO: 1313465 - RNA, 22 nt, Human
ucuguaccaguuaauuuuucca

SEQ ID NO: 1313466 - RNA, 23 nt, Human
ucugucccuagguguuuuguuca

SEQ ID NO: 1313467 - RNA, 14 nt, Human
ucugugucuaagau

SEQ ID NO: 1313468 - RNA, 16 nt, Human
ucugugucuaagauuc

SEQ ID NO: 1313469 - RNA, 17 nt, Human
ucugugucuaagauucu

SEQ ID NO: 1313470 - RNA, 18 nt, Human
ucugugucuaagauucua

SEQ ID NO: 1313471 - RNA, 20 nt, Human
ucugugucuaagauucuaga

SEQ ID NO: 1313472 - RNA, 22 nt, Human
ucugugucuaagauucuagauc

SEQ ID NO: 1313473 - RNA, 23 nt, Human
ucugugucuaagauucuagauca

SEQ ID NO: 1313474 - RNA, 12 nt, Human
ucugugucuugu

SEQ ID NO: 1313475 - RNA, 21 nt, Human
ucugugucuuucacagcuccu

SEQ ID NO: 1313476 - RNA, 21 nt, Human
ucuguaaaacuaagaaacuua

SEQ ID NO: 1313477 - RNA, 14 nt, Human
ucuguaaaacuaag

SEQ ID NO: 1313478 - RNA, 18 nt, Human
ucuguaagcauaagcuua

SEQ ID NO: 1313479 - RNA, 15 nt, Human
ucugguugaacucug

SEQ ID NO: 1313480 - RNA, 15 nt, Human
ucugguuguuucugu

SEQ ID NO: 1313481 - RNA, 16 nt, Human
ucugguuguuucuguu

SEQ ID NO: 1313482 - RNA, 17 nt, Human
ucugguuguuucuguuc

SEQ ID NO: 1313483 - RNA, 18 nt, Human
ucugguuguuucuguucc

SEQ ID NO: 1313484 - RNA, 20 nt, Human
ucugguuguuucuguuccaa

SEQ ID NO: 1313485 - RNA, 22 nt, Human
ucugguuguuucuguuccaaau

SEQ ID NO: 1313486 - RNA, 18 nt, Human
ucuguaauuauaucuaaa

SEQ ID NO: 1313487 - RNA, 20 nt, Human
ucuguaauuauaucuaaaau

SEQ ID NO: 1313488 - RNA, 16 nt, Human
ucuguaauucagguuu

SEQ ID NO: 1313489 - RNA, 20 nt, Human
ucuggcuuggccacagccag

SEQ ID NO: 1313490 - RNA, 21 nt, Human
ucuggcuuggccacagccagg

SEQ ID NO: 1313491 - RNA, 14 nt, Human
ucugggaacuuguc

SEQ ID NO: 1313492 - RNA, 17 nt, Human
ucugguucucaauucca

SEQ ID NO: 1313493 - RNA, 18 nt, Human
ucugguucucaauuccaa

SEQ ID NO: 1313494 - RNA, 19 nt, Human
ucugguucucaauuccaac

SEQ ID NO: 1313495 - RNA, 20 nt, Human
ucugguucucaauuccaaca

SEQ ID NO: 1313496 - RNA, 14 nt, Human
ucuggaggggaggg

SEQ ID NO: 1313497 - RNA, 21 nt, Human
ucuggaggggagggggauccg

SEQ ID NO: 1313498 - RNA, 22 nt, Human
ucuggcucuaauucacagugcu

SEQ ID NO: 1313499 - RNA, 13 nt, Human
ucuggcucugucu

SEQ ID NO: 1313500 - RNA, 16 nt, Human
ucuggagaccaccagg

SEQ ID NO: 1313501 - RNA, 19 nt, Human
ucuggagaccaccagggca

SEQ ID NO: 1313502 - RNA, 20 nt, Human
ucuggagaccaccagggcau

SEQ ID NO: 1313503 - RNA, 14 nt, Human
ucuggagagaacag

SEQ ID NO: 1313504 - RNA, 23 nt, Human
ucuggagcccacuguacuugcuc

SEQ ID NO: 1313505 - RNA, 21 nt, Human
ucuuguccccaacaccccaca

SEQ ID NO: 1313506 - RNA, 12 nt, Human
ucuugucuuuau

SEQ ID NO: 1313507 - RNA, 15 nt, Human
ucuugugaaggcagg

SEQ ID NO: 1313508 - RNA, 18 nt, Human
ucuuuaaaaggaaagaaa

SEQ ID NO: 1313509 - RNA, 16 nt, Human
ucuuuaaaaggaaaga

SEQ ID NO: 1313510 - RNA, 21 nt, Human
ucuuguuuuuuuuuuccacuu

SEQ ID NO: 1313511 - RNA, 18 nt, Human
ucuuguuuuuuuuuucca

SEQ ID NO: 1313512 - RNA, 21 nt, Human
ucuugccugaacuccugccau

SEQ ID NO: 1313513 - RNA, 16 nt, Human
ucuugccuguuuccca

SEQ ID NO: 1313514 - RNA, 23 nt, Human
ucuugccuguuucccaggcccac

SEQ ID NO: 1313515 - RNA, 15 nt, Human
ucuuguauuuauugg

SEQ ID NO: 1313516 - RNA, 22 nt, Human
ucuuguauuuauugguuuugca

SEQ ID NO: 1313517 - RNA, 11 nt, Human
ucuugucaugu

SEQ ID NO: 1313518 - RNA, 13 nt, Human
ucuugucaugugu

SEQ ID NO: 1313519 - RNA, 15 nt, Human
ucuugucauguguau

SEQ ID NO: 1313520 - RNA, 17 nt, Human
ucuugucauguguauaa

SEQ ID NO: 1313521 - RNA, 13 nt, Human
ucuugucauuuuu

SEQ ID NO: 1313522 - RNA, 16 nt, Human
ucuucuccacuggaug

SEQ ID NO: 1313523 - RNA, 13 nt, Human
ucuugaauuuaau

SEQ ID NO: 1313524 - RNA, 21 nt, Human
ucuugaauuuaauaaucugua

SEQ ID NO: 1313525 - RNA, 23 nt, Human
ucuugaauuuaauaaucuguagg

SEQ ID NO: 1313526 - RNA, 16 nt, Human
ucuugacuacagucag

SEQ ID NO: 1313527 - RNA, 16 nt, Human
ucuugccucaaccucc

SEQ ID NO: 1313528 - RNA, 12 nt, Human
ucuugccucugu

SEQ ID NO: 1313529 - RNA, 13 nt, Human
ucuugccucugug

SEQ ID NO: 1313530 - RNA, 14 nt, Human
ucuugccucugugc

SEQ ID NO: 1313531 - RNA, 15 nt, Human
ucuugccucugugcu

SEQ ID NO: 1313532 - RNA, 16 nt, Human
ucuugccucugugcug

SEQ ID NO: 1313533 - RNA, 19 nt, Human
ucuugccucugugcugugu

SEQ ID NO: 1313534 - RNA, 13 nt, Human
ucuucuccacugg

SEQ ID NO: 1313535 - RNA, 14 nt, Human
ucuucucaaguucu

SEQ ID NO: 1313536 - RNA, 15 nt, Human
ucuucucaaguucua

SEQ ID NO: 1313537 - RNA, 17 nt, Human
ucuucucaaguucuaag

SEQ ID NO: 1313538 - RNA, 18 nt, Human
ucuucucaaguucuaaga

SEQ ID NO: 1313539 - RNA, 19 nt, Human
ucuucucaaguucuaagau

SEQ ID NO: 1313540 - RNA, 21 nt, Human
ucuucucaaguucuaagauuc

SEQ ID NO: 1313541 - RNA, 23 nt, Human
ucuucucaaguucuaagauucua

SEQ ID NO: 1313542 - RNA, 18 nt, Human
ucuucuacaacucauaca

SEQ ID NO: 1313543 - RNA, 12 nt, Human
ucuucuagaguu

SEQ ID NO: 1313544 - RNA, 17 nt, Human
ucuucuagaguucagag

SEQ ID NO: 1313545 - RNA, 17 nt, Human
ucuucuagguucuaaaa

SEQ ID NO: 1313546 - RNA, 14 nt, Human
ucuucuagaguuca

SEQ ID NO: 1313547 - RNA, 16 nt, Human
ucuucuauugccucug

SEQ ID NO: 1313548 - RNA, 14 nt, Human
ucuucuauugccuc

SEQ ID NO: 1313549 - RNA, 13 nt, Human
ucuucuauuuugu

SEQ ID NO: 1313550 - RNA, 15 nt, Human
ucuucuauugccucu

SEQ ID NO: 1313551 - RNA, 11 nt, Human
ucuucucaagu

SEQ ID NO: 1313552 - RNA, 21 nt, Human
ucuuccaauuuaguuguugua

SEQ ID NO: 1313553 - RNA, 13 nt, Human
ucuucuaaacuuc

SEQ ID NO: 1313554 - RNA, 22 nt, Human
ucuucuaaacuuccccaucuuc

SEQ ID NO: 1313555 - RNA, 12 nt, Human
ucuucuaaaugg

SEQ ID NO: 1313556 - RNA, 14 nt, Human
ucuucuaccaccca

SEQ ID NO: 1313557 - RNA, 22 nt, Human
ucuucuacucacuuuucccacu

SEQ ID NO: 1313558 - RNA, 14 nt, Human
ucuuaguguaugau

SEQ ID NO: 1313559 - RNA, 22 nt, Human
ucuuaaaaaguuauaaccaacu

SEQ ID NO: 1313560 - RNA, 13 nt, Human
ucuuaaaaccugc

SEQ ID NO: 1313561 - RNA, 23 nt, Human
ucuuaaaaccugcuuuucaaugu

SEQ ID NO: 1313562 - RNA, 12 nt, Human
ucuuaaaacucc

SEQ ID NO: 1313563 - RNA, 13 nt, Human
ucuuaaaacuccu

SEQ ID NO: 1313564 - RNA, 18 nt, Human
ucuuauggauguccccag

SEQ ID NO: 1313565 - RNA, 14 nt, Human
ucuuauggaauuga

SEQ ID NO: 1313566 - RNA, 15 nt, Human
ucuuauggaauugau

SEQ ID NO: 1313567 - RNA, 17 nt, Human
ucuuauggaauugauuu

SEQ ID NO: 1313568 - RNA, 18 nt, Human
ucuuauggaauugauuug

SEQ ID NO: 1313569 - RNA, 21 nt, Human
ucuuauggaauugauuugcau

SEQ ID NO: 1313570 - RNA, 22 nt, Human
ucuuauggaauugauuugcauu

SEQ ID NO: 1313571 - RNA, 12 nt, Human
ucuuauggaugu

SEQ ID NO: 1313572 - RNA, 19 nt, Human
ucuuauggauguccccagc

SEQ ID NO: 1313573 - RNA, 21 nt, Human
ucuuauaauuguucucagaau

SEQ ID NO: 1313574 - RNA, 13 nt, Human
ucuuauaguucua

SEQ ID NO: 1313575 - RNA, 17 nt, Human
ucuuauaguucuaggca

SEQ ID NO: 1313576 - RNA, 16 nt, Human
ucuuauaguucuaggc

SEQ ID NO: 1313577 - RNA, 15 nt, Human
ucuuaugcuguaccc

SEQ ID NO: 1313578 - RNA, 18 nt, Human
ucuuaugcuguacccagu

SEQ ID NO: 1313579 - RNA, 23 nt, Human
ucuuaugcuguacccaguuucua

SEQ ID NO: 1313580 - RNA, 17 nt, Human
ucuuucacauuuaaaua

SEQ ID NO: 1313581 - RNA, 18 nt, Human
ucuuucacagcuccuccc

SEQ ID NO: 1313582 - RNA, 19 nt, Human
ucuuucacagcuccuccca

SEQ ID NO: 1313583 - RNA, 20 nt, Human
ucuuucacagcuccucccac

SEQ ID NO: 1313584 - RNA, 19 nt, Human
ucuuuaaaagaugcuuuua

SEQ ID NO: 1313585 - RNA, 16 nt, Human
ucuuucaauacagaua

SEQ ID NO: 1313586 - RNA, 18 nt, Human
ucuuucaauacagauaua

SEQ ID NO: 1313587 - RNA, 19 nt, Human
ucuuucaauacagauauau

SEQ ID NO: 1313588 - RNA, 20 nt, Human
ucuuucaauacagauauauu

SEQ ID NO: 1313589 - RNA, 14 nt, Human
ucuuucacagcucc

SEQ ID NO: 1313590 - RNA, 15 nt, Human
ucuuucacagcuccu

SEQ ID NO: 1313591 - RNA, 19 nt, Human
ucuuuucuggaauguaauc

SEQ ID NO: 1313592 - RNA, 12 nt, Human
ucuuuucuuuac

SEQ ID NO: 1313593 - RNA, 19 nt, Human
ucuuuuguaagguuuuugu

SEQ ID NO: 1313594 - RNA, 22 nt, Human
ucuuuugguaaagacuggcuuu

SEQ ID NO: 1313595 - RNA, 20 nt, Human
ucuuuugguuaugaauacuu

SEQ ID NO: 1313596 - RNA, 13 nt, Human
ucuuuugccauga

SEQ ID NO: 1313597 - RNA, 23 nt, Human
ucuuuugccuuuugcaaccagga

SEQ ID NO: 1313598 - RNA, 13 nt, Human
ucuuuugcuuuug

SEQ ID NO: 1313599 - RNA, 19 nt, Human
ucuuuugcuuuugcccauu

SEQ ID NO: 1313600 - RNA, 18 nt, Human
ucuuuugcuuuuggcaaa

SEQ ID NO: 1313601 - RNA, 21 nt, Human
ucuuuuggaggacguacguaa

SEQ ID NO: 1313602 - RNA, 16 nt, Human
ucuuuuuucaaaagaa

SEQ ID NO: 1313603 - RNA, 13 nt, Human
ugaaaacucuuug

SEQ ID NO: 1313604 - RNA, 17 nt, Human
ugaaaacucuuugcugc

SEQ ID NO: 1313605 - RNA, 18 nt, Human
ugaaaacucuuugcugcu

SEQ ID NO: 1313606 - RNA, 19 nt, Human
ugaaaacuuuaugcuaagu

SEQ ID NO: 1313607 - RNA, 13 nt, Human
ugaaaacuuugua

SEQ ID NO: 1313608 - RNA, 16 nt, Human
ugaaaacuuuguagua

SEQ ID NO: 1313609 - RNA, 13 nt, Human
ugaaaagaauugu

SEQ ID NO: 1313610 - RNA, 14 nt, Human
ucuuuuugaaguau

SEQ ID NO: 1313611 - RNA, 17 nt, Human
ucuuuuugaaguauuua

SEQ ID NO: 1313612 - RNA, 15 nt, Human
ucuuuuugaaguauu

SEQ ID NO: 1313613 - RNA, 19 nt, Human
ucuuuuugggagagacuug

SEQ ID NO: 1313614 - RNA, 20 nt, Human
ucuuuuuguagcuggggcuu

SEQ ID NO: 1313615 - RNA, 19 nt, Human
ucuuuuuuaaaugaagaaa

SEQ ID NO: 1313616 - RNA, 22 nt, Human
ucuuuuugggagagacuuguuu

SEQ ID NO: 1313617 - RNA, 13 nt, Human
ugaaagauucaau

SEQ ID NO: 1313618 - RNA, 19 nt, Human
ugaaaggaagauaaacgug

SEQ ID NO: 1313619 - RNA, 12 nt, Human
ugaaaggaaauu

SEQ ID NO: 1313620 - RNA, 16 nt, Human
ugaaaggaaauuaagg

SEQ ID NO: 1313621 - RNA, 20 nt, Human
ugaaaggaaauuaaggcaac

SEQ ID NO: 1313622 - RNA, 23 nt, Human
ugaaagcagggacuugaacccau

SEQ ID NO: 1313623 - RNA, 19 nt, Human
ugaaagcagggacuugaac

SEQ ID NO: 1313624 - RNA, 18 nt, Human
ugaaagcagggacuugaa

SEQ ID NO: 1313625 - RNA, 21 nt, Human
ugaaagauggcugugccucug

SEQ ID NO: 1313626 - RNA, 22 nt, Human
ugaaagauggcugugccucugc

SEQ ID NO: 1313627 - RNA, 23 nt, Human
ugaaagauggcugugccucugcc

SEQ ID NO: 1313628 - RNA, 16 nt, Human
ugaaaagauaaauuau

SEQ ID NO: 1313629 - RNA, 12 nt, Human
ugaaaagagcug

SEQ ID NO: 1313630 - RNA, 15 nt, Human
ugaaaggacccugug

SEQ ID NO: 1313631 - RNA, 14 nt, Human
ugaaauccugcuuc

SEQ ID NO: 1313632 - RNA, 19 nt, Human
ugaaaugcagagucaauga

SEQ ID NO: 1313633 - RNA, 19 nt, Human
ugaaauggacuuuuguaca

SEQ ID NO: 1313634 - RNA, 19 nt, Human
ugaacacaaacuguaaaua

SEQ ID NO: 1313635 - RNA, 17 nt, Human
ugaacaccauugaaggc

SEQ ID NO: 1313636 - RNA, 20 nt, Human
ugaacaccauugaaggcuua

SEQ ID NO: 1313637 - RNA, 16 nt, Human
ugaacacgaagcuuag

SEQ ID NO: 1313638 - RNA, 13 nt, Human
ugaacagaacaua

SEQ ID NO: 1313639 - RNA, 17 nt, Human
ugaacauauuguugaaa

SEQ ID NO: 1313640 - RNA, 20 nt, Human
ugaacaucccuuuuucaaug

SEQ ID NO: 1313641 - RNA, 20 nt, Human
ugaacaucugaguccuggau

SEQ ID NO: 1313642 - RNA, 17 nt, Human
ugaacaucugaguccug

SEQ ID NO: 1313643 - RNA, 15 nt, Human
ugaacucuucacucu

SEQ ID NO: 1313644 - RNA, 14 nt, Human
ugaacugaacucug

SEQ ID NO: 1313645 - RNA, 13 nt, Human
ugaacugaacacc

SEQ ID NO: 1313646 - RNA, 14 nt, Human
ugaacugaacacca

SEQ ID NO: 1313647 - RNA, 12 nt, Human
ugaacugaacac

SEQ ID NO: 1313648 - RNA, 12 nt, Human
ugaacugauuca

SEQ ID NO: 1313649 - RNA, 17 nt, Human
ugaacugauucacaucu

SEQ ID NO: 1313650 - RNA, 20 nt, Human
ugaacugauucacaucucau

SEQ ID NO: 1313651 - RNA, 21 nt, Human
ugaacugauucacaucucauu

SEQ ID NO: 1313652 - RNA, 17 nt, Human
ugaacugaacucugaca

SEQ ID NO: 1313653 - RNA, 19 nt, Human
ugaacugaacucugacaac

SEQ ID NO: 1313654 - RNA, 22 nt, Human
ugaacugaacaccauugaaggc

SEQ ID NO: 1313655 - RNA, 19 nt, Human
ugaagagguuuuaaagcuu

SEQ ID NO: 1313656 - RNA, 15 nt, Human
ugaagauauuuuucc

SEQ ID NO: 1313657 - RNA, 17 nt, Human
ugaagauguagaggaga

SEQ ID NO: 1313658 - RNA, 22 nt, Human
ugaaggagaggcaacauccaaa

SEQ ID NO: 1313659 - RNA, 11 nt, Human
ugaaggagccc

SEQ ID NO: 1313660 - RNA, 22 nt, Human
ugaaggagccccauuccuggga

SEQ ID NO: 1313661 - RNA, 23 nt, Human
ugaaggagccccauuccugggaa

SEQ ID NO: 1313662 - RNA, 14 nt, Human
ugaagaucuaaaua

SEQ ID NO: 1313663 - RNA, 15 nt, Human
ugaagaucuaaauaa

SEQ ID NO: 1313664 - RNA, 22 nt, Human
ugaagaucuaaauaaaaugcua

SEQ ID NO: 1313665 - RNA, 20 nt, Human
ugaagaucuaaauaaaaugc

SEQ ID NO: 1313666 - RNA, 18 nt, Human
ugaagaugcuuuuugauc

SEQ ID NO: 1313667 - RNA, 21 nt, Human
ugaaguccaagcauuuagaug

SEQ ID NO: 1313668 - RNA, 22 nt, Human
ugaaguccaagcauuuagaugu

SEQ ID NO: 1313669 - RNA, 16 nt, Human
ugaaggcaaaauugca

SEQ ID NO: 1313670 - RNA, 17 nt, Human
ugaaggcaaaauugcaa

SEQ ID NO: 1313671 - RNA, 18 nt, Human
ugaaggcaaaauugcaaa

SEQ ID NO: 1313672 - RNA, 20 nt, Human
ugaaggccuucaacccgaga

SEQ ID NO: 1313673 - RNA, 14 nt, Human
ugaaggcaaaauug

SEQ ID NO: 1313674 - RNA, 22 nt, Human
ugaacuuguaaaggaauuuaaa

SEQ ID NO: 1313675 - RNA, 15 nt, Human
ugaagaccuuuuucu

SEQ ID NO: 1313676 - RNA, 23 nt, Human
ugaagacuuacagcaaauccuuu

SEQ ID NO: 1313677 - RNA, 17 nt, Human
ugaagaggaggggaaga

SEQ ID NO: 1313678 - RNA, 23 nt, Human
ugaagaggaggggaagaggccug

SEQ ID NO: 1313679 - RNA, 18 nt, Human
ugaagaccuuuuucugca

SEQ ID NO: 1313680 - RNA, 18 nt, Human
ugaagacuggaagcuaau

SEQ ID NO: 1313681 - RNA, 17 nt, Human
ugaacuugcauugugau

SEQ ID NO: 1313682 - RNA, 12 nt, Human
ugaagacauaaa

SEQ ID NO: 1313683 - RNA, 10 nt, Human
ucggaccagc

SEQ ID NO: 1313684 - RNA, 19 nt, Human
ucggacaagacccccagca

SEQ ID NO: 1313685 - RNA, 21 nt, Human
ucggacaagacccccagcacu

SEQ ID NO: 1313686 - RNA, 17 nt, Human
ucgcuucuugccucugu

SEQ ID NO: 1313687 - RNA, 15 nt, Human
ucggaaaucuuaaac

SEQ ID NO: 1313688 - RNA, 19 nt, Human
ucgcuucuugccucugugc

SEQ ID NO: 1313689 - RNA, 16 nt, Human
ucgcuucauguaacua

SEQ ID NO: 1313690 - RNA, 14 nt, Human
ucgcuucuugccuc

SEQ ID NO: 1313691 - RNA, 15 nt, Human
ucgcuucuugccucu

SEQ ID NO: 1313692 - RNA, 16 nt, Human
ucgcuucuugccucug

SEQ ID NO: 1313693 - RNA, 17 nt, Human
ucgcaauguaagacucg

SEQ ID NO: 1313694 - RNA, 15 nt, Human
ucgauuucuccagga

SEQ ID NO: 1313695 - RNA, 20 nt, Human
ucgcaacccgugccaagucc

SEQ ID NO: 1313696 - RNA, 16 nt, Human
ucgcaccauucugacu

SEQ ID NO: 1313697 - RNA, 17 nt, Human
ucgcaccauucugacuc

SEQ ID NO: 1313698 - RNA, 10 nt, Human
ucgcagccac

SEQ ID NO: 1313699 - RNA, 12 nt, Human
ucgcagccaccc

SEQ ID NO: 1313700 - RNA, 12 nt, Human
ucgcccaggcug

SEQ ID NO: 1313701 - RNA, 14 nt, Human
ucgcccaggcugga

SEQ ID NO: 1313702 - RNA, 21 nt, Human
ucgcccagcggcaucaggcuu

SEQ ID NO: 1313703 - RNA, 19 nt, Human
ucgcccaggcuggagugca

SEQ ID NO: 1313704 - RNA, 14 nt, Human
ucgagugagacaga

SEQ ID NO: 1313705 - RNA, 23 nt, Human
ucgagugagacagacuagaaguu

SEQ ID NO: 1313706 - RNA, 15 nt, Human
ucgaguucccagggu

SEQ ID NO: 1313707 - RNA, 14 nt, Human
ucgauacugcgacu

SEQ ID NO: 1313708 - RNA, 19 nt, Human
ucgauacugcgacuuucug

SEQ ID NO: 1313709 - RNA, 17 nt, Human
uccuuuuuccaacaaga

SEQ ID NO: 1313710 - RNA, 15 nt, Human
uccuuuuuccaacaa

SEQ ID NO: 1313711 - RNA, 12 nt, Human
uccuuuuuccuc

SEQ ID NO: 1313712 - RNA, 21 nt, Human
uccuuuuuccucuccacacag

SEQ ID NO: 1313713 - RNA, 16 nt, Human
uccuuuuuccucucca

SEQ ID NO: 1313714 - RNA, 23 nt, Human
uccuuuuuggucgaggaguaaca

SEQ ID NO: 1313715 - RNA, 12 nt, Human
uccuuuuuuucc

SEQ ID NO: 1313716 - RNA, 21 nt, Human
uccuuuuuuuccaucuuuaca

SEQ ID NO: 1313717 - RNA, 14 nt, Human
uccuuuuuuuguac

SEQ ID NO: 1313718 - RNA, 14 nt, Human
ucgaaaaucaaaug

SEQ ID NO: 1313719 - RNA, 13 nt, Human
ucgaaacacagaa

SEQ ID NO: 1313720 - RNA, 14 nt, Human
uccuuuuggaguca

SEQ ID NO: 1313721 - RNA, 23 nt, Human
uccuuuuggagucagacagaugu

SEQ ID NO: 1313722 - RNA, 12 nt, Human
uccuuuuuaaua

SEQ ID NO: 1313723 - RNA, 17 nt, Human
uccuuuuuaauaugcuu

SEQ ID NO: 1313724 - RNA, 17 nt, Human
uccuuggccaugcagaa

SEQ ID NO: 1313725 - RNA, 23 nt, Human
uccuuggccugcuaaggucuugg

SEQ ID NO: 1313726 - RNA, 13 nt, Human
uccuugggcccuu

SEQ ID NO: 1313727 - RNA, 14 nt, Human
uccuugggcccuuu

SEQ ID NO: 1313728 - RNA, 16 nt, Human
uccuugggcccuuuga

SEQ ID NO: 1313729 - RNA, 21 nt, Human
uccuggugguauuuucaauag

SEQ ID NO: 1313730 - RNA, 18 nt, Human
uccuggugguauuuucaa

SEQ ID NO: 1313731 - RNA, 19 nt, Human
uccuggugguauuuucaau

SEQ ID NO: 1313732 - RNA, 12 nt, Human
uccuggugcugg

SEQ ID NO: 1313733 - RNA, 14 nt, Human
uccuggugcuggag

SEQ ID NO: 1313734 - RNA, 13 nt, Human
uccugguggggca

SEQ ID NO: 1313735 - RNA, 16 nt, Human
uccugguggggcagcu

SEQ ID NO: 1313736 - RNA, 17 nt, Human
uccugguggggcagcuc

SEQ ID NO: 1313737 - RNA, 19 nt, Human
uccugguggggcagcuccu

SEQ ID NO: 1313738 - RNA, 21 nt, Human
uccugguggggcagcuccucu

SEQ ID NO: 1313739 - RNA, 16 nt, Human
uccuggugguauuuuc

SEQ ID NO: 1313740 - RNA, 21 nt, Human
uccuguaggaagguacuguau

SEQ ID NO: 1313741 - RNA, 19 nt, Human
uccuguauaccuccuccag

SEQ ID NO: 1313742 - RNA, 16 nt, Human
uccuguauucagacag

SEQ ID NO: 1313743 - RNA, 17 nt, Human
uccuguauucagacaga

SEQ ID NO: 1313744 - RNA, 20 nt, Human
uccuguauucagacagauga

SEQ ID NO: 1313745 - RNA, 22 nt, Human
uccuguaggaagguacuguaug

SEQ ID NO: 1313746 - RNA, 20 nt, Human
uccuguaggaagguacugua

SEQ ID NO: 1313747 - RNA, 19 nt, Human
uccuguaaagguuacaagc

SEQ ID NO: 1313748 - RNA, 15 nt, Human
uccugguucccguuu

SEQ ID NO: 1313749 - RNA, 21 nt, Human
uccugguucccguuucuccac

SEQ ID NO: 1313750 - RNA, 23 nt, Human
uccugguucccguuucuccaccu

SEQ ID NO: 1313751 - RNA, 13 nt, Human
uccuggcccagcc

SEQ ID NO: 1313752 - RNA, 14 nt, Human
uccuggcccagccu

SEQ ID NO: 1313753 - RNA, 15 nt, Human
uccuggcccagccuu

SEQ ID NO: 1313754 - RNA, 17 nt, Human
uccuggucaccuaggaa

SEQ ID NO: 1313755 - RNA, 20 nt, Human
uccuggucaccuaggaagcc

SEQ ID NO: 1313756 - RNA, 21 nt, Human
uccuggucaccuaggaagccu

SEQ ID NO: 1313757 - RNA, 20 nt, Human
uccuggugccaauuucaagu

SEQ ID NO: 1313758 - RNA, 21 nt, Human
uccuggugccaauuucaaguu

SEQ ID NO: 1313759 - RNA, 13 nt, Human
uccuggugccacc

SEQ ID NO: 1313760 - RNA, 15 nt, Human
uccuggugccaccuc

SEQ ID NO: 1313761 - RNA, 14 nt, Human
uccuggugccaccu

SEQ ID NO: 1313762 - RNA, 22 nt, Human
uccuugauuuaucacacaaagc

SEQ ID NO: 1313763 - RNA, 22 nt, Human
uccuugauuuuagccuucucug

SEQ ID NO: 1313764 - RNA, 23 nt, Human
uccuugauuuuagccuucucugu

SEQ ID NO: 1313765 - RNA, 21 nt, Human
uccuuacaaguuagaaaacau

SEQ ID NO: 1313766 - RNA, 22 nt, Human
uccuuacaaguuagaaaacaua

SEQ ID NO: 1313767 - RNA, 16 nt, Human
uccuucaaagcaaaug

SEQ ID NO: 1313768 - RNA, 21 nt, Human
uccuucaaaguuuaauaaauu

SEQ ID NO: 1313769 - RNA, 18 nt, Human
uccuucaacaauucuaaa

SEQ ID NO: 1313770 - RNA, 20 nt, Human
uccuucaacaauucuaaaau

SEQ ID NO: 1313771 - RNA, 16 nt, Human
uccuuaaggcucuuuu

SEQ ID NO: 1313772 - RNA, 22 nt, Human
uccugucaucaucauggccagc

SEQ ID NO: 1313773 - RNA, 21 nt, Human
uccuguauucagacagaugag

SEQ ID NO: 1313774 - RNA, 17 nt, Human
uccuguauuuguuccca

SEQ ID NO: 1313775 - RNA, 19 nt, Human
uccuguauuuguucccaag

SEQ ID NO: 1313776 - RNA, 20 nt, Human
uccuguauuuguucccaaga

SEQ ID NO: 1313777 - RNA, 22 nt, Human
uccuguauuuguucccaagagc

SEQ ID NO: 1313778 - RNA, 21 nt, Human
uccuguauuuguucccaagag

SEQ ID NO: 1313779 - RNA, 19 nt, Human
uccuuaaggcucuuuugua

SEQ ID NO: 1313780 - RNA, 17 nt, Human
uccuuaagucagaacag

SEQ ID NO: 1313781 - RNA, 16 nt, Human
ucuaaauucuuucauu

SEQ ID NO: 1313782 - RNA, 18 nt, Human
ucggacuuagcugggaga

SEQ ID NO: 1313783 - RNA, 21 nt, Human
ucuaaauguaguucugcucca

SEQ ID NO: 1313784 - RNA, 12 nt, Human
ucuaacaaguca

SEQ ID NO: 1313785 - RNA, 19 nt, Human
ucuaacccuauacuguagu

SEQ ID NO: 1313786 - RNA, 21 nt, Human
ucuacacuaagagagaaugag

SEQ ID NO: 1313787 - RNA, 13 nt, Human
ucuaaccucaucu

SEQ ID NO: 1313788 - RNA, 18 nt, Human
ucuaaccucaucuucuuc

SEQ ID NO: 1313789 - RNA, 20 nt, Human
ucuaaccucaucuucuucac

SEQ ID NO: 1313790 - RNA, 14 nt, Human
ucuaaccuuuacau

SEQ ID NO: 1313791 - RNA, 16 nt, Human
ucuaaccuuuacauga

SEQ ID NO: 1313792 - RNA, 22 nt, Human
ucuaaccuuuacaugaggacuc

SEQ ID NO: 1313793 - RNA, 13 nt, Human
ucuaacgccugag

SEQ ID NO: 1313794 - RNA, 14 nt, Human
ucuaacgccugagc

SEQ ID NO: 1313795 - RNA, 15 nt, Human
ucuaacgccugagcc

SEQ ID NO: 1313796 - RNA, 16 nt, Human
ucuaacgccugagccc

SEQ ID NO: 1313797 - RNA, 21 nt, Human
ucuaacgccugagcccaggga

SEQ ID NO: 1313798 - RNA, 23 nt, Human
ucuaacgccugagcccagggagg

SEQ ID NO: 1313799 - RNA, 17 nt, Human
ucuaacggucuguucug

SEQ ID NO: 1313800 - RNA, 22 nt, Human
ucuaacggucuguucuguuuca

SEQ ID NO: 1313801 - RNA, 17 nt, Human
ucuaacuacaaagguuu

SEQ ID NO: 1313802 - RNA, 15 nt, Human
ucuaacuacaaaggu

SEQ ID NO: 1313803 - RNA, 13 nt, Human
ucuaacucagcaa

SEQ ID NO: 1313804 - RNA, 17 nt, Human
ucuacacuccagugaga

SEQ ID NO: 1313805 - RNA, 19 nt, Human
ucuacacucuuguaauaaa

SEQ ID NO: 1313806 - RNA, 19 nt, Human
ucuacugggaaggcuacuu

SEQ ID NO: 1313807 - RNA, 22 nt, Human
ucuagaaucugcaauucaaaag

SEQ ID NO: 1313808 - RNA, 23 nt, Human
ucuagaaucugcaauucaaaagu

SEQ ID NO: 1313809 - RNA, 15 nt, Human
ucucaacuccaaacu

SEQ ID NO: 1313810 - RNA, 18 nt, Human
ucucagaaugucauuuug

SEQ ID NO: 1313811 - RNA, 11 nt, Human
ucucagaaagu

SEQ ID NO: 1313812 - RNA, 17 nt, Human
ucucagaaagugccuga

SEQ ID NO: 1313813 - RNA, 19 nt, Human
ucucagaaagugccugaca

SEQ ID NO: 1313814 - RNA, 21 nt, Human
ucucagaaagugccugacaca

SEQ ID NO: 1313815 - RNA, 12 nt, Human
ucucagaauccc

SEQ ID NO: 1313816 - RNA, 21 nt, Human
ucucagaaucccuuaacaguu

SEQ ID NO: 1313817 - RNA, 16 nt, Human
ucucaaacuccugacc

SEQ ID NO: 1313818 - RNA, 21 nt, Human
ucucaaacuccugaccucagg

SEQ ID NO: 1313819 - RNA, 23 nt, Human
ucucaaacuccugaccucaggca

SEQ ID NO: 1313820 - RNA, 21 nt, Human
ucucaacaccaugauuccuuu

SEQ ID NO: 1313821 - RNA, 14 nt, Human
ucucaacacccagu

SEQ ID NO: 1313822 - RNA, 19 nt, Human
ucucaacacccaguuuccu

SEQ ID NO: 1313823 - RNA, 23 nt, Human
ucucaacacccaguuuccuuggg

SEQ ID NO: 1313824 - RNA, 16 nt, Human
ucucaacaggccucag

SEQ ID NO: 1313825 - RNA, 17 nt, Human
ucucaacaggccucagg

SEQ ID NO: 1313826 - RNA, 18 nt, Human
ucucaacaggccucaggg

SEQ ID NO: 1313827 - RNA, 19 nt, Human
ucucaacaggccucagggc

SEQ ID NO: 1313828 - RNA, 23 nt, Human
ucucaacaggccucagggcuccu

SEQ ID NO: 1313829 - RNA, 20 nt, Human
ucucaacaggccucagggcu

SEQ ID NO: 1313830 - RNA, 23 nt, Human
ucuaggguacauggugcugggag

SEQ ID NO: 1313831 - RNA, 20 nt, Human
ucuaggguacauggugcugg

SEQ ID NO: 1313832 - RNA, 15 nt, Human
ucuagguuucaaaga

SEQ ID NO: 1313833 - RNA, 17 nt, Human
ucuagguuucaaagaug

SEQ ID NO: 1313834 - RNA, 19 nt, Human
ucuagguuucaaagaugcu

SEQ ID NO: 1313835 - RNA, 20 nt, Human
ucuagguuucaaagaugcug

SEQ ID NO: 1313836 - RNA, 17 nt, Human
ucuagguuuuacagauu

SEQ ID NO: 1313837 - RNA, 22 nt, Human
ucuaguacuugggagaccugua

SEQ ID NO: 1313838 - RNA, 24 nt, Human
ucuaguauuccagaccugaagaau

SEQ ID NO: 1313839 - RNA, 14 nt, Human
ucuagucaaugaca

SEQ ID NO: 1313840 - RNA, 20 nt, Human
ucuagucaaugacaugaauu

SEQ ID NO: 1313841 - RNA, 22 nt, Human
ucuagucaaugacaugaauuuu

SEQ ID NO: 1313842 - RNA, 14 nt, Human
ucucaguugcagcc

SEQ ID NO: 1313843 - RNA, 15 nt, Human
ucuccccccgccugc

SEQ ID NO: 1313844 - RNA, 18 nt, Human
ucuccccugcccccugca

SEQ ID NO: 1313845 - RNA, 21 nt, Human
ucuccccugcccccugcagga

SEQ ID NO: 1313846 - RNA, 19 nt, Human
ucuccccugcccccugcag

SEQ ID NO: 1313847 - RNA, 20 nt, Human
ucucccggagguuggguggg

SEQ ID NO: 1313848 - RNA, 18 nt, Human
ucucaguguugagccuuu

SEQ ID NO: 1313849 - RNA, 22 nt, Human
ucucaguguugagccuuuuccc

SEQ ID NO: 1313850 - RNA, 20 nt, Human
ucucagugaagacuaugaaa

SEQ ID NO: 1313851 - RNA, 21 nt, Human
ucucagugucaaugcagcccc

SEQ ID NO: 1313852 - RNA, 15 nt, Human
ucucaggucccugca

SEQ ID NO: 1313853 - RNA, 20 nt, Human
ucucaguaccccauggagcu

SEQ ID NO: 1313854 - RNA, 16 nt, Human
ucucagugaagacuau

SEQ ID NO: 1313855 - RNA, 12 nt, Human
ucuccugccuca

SEQ ID NO: 1313856 - RNA, 16 nt, Human
ucuccugccuuccucc

SEQ ID NO: 1313857 - RNA, 17 nt, Human
ucuccugccuuccuccu

SEQ ID NO: 1313858 - RNA, 18 nt, Human
ucuccugccuuccuccug

SEQ ID NO: 1313859 - RNA, 20 nt, Human
ucuccugccuuccuccuggg

SEQ ID NO: 1313860 - RNA, 23 nt, Human
ucuccuggcuucccauccccagc

SEQ ID NO: 1313861 - RNA, 16 nt, Human
ucuccugccuugaaaa

SEQ ID NO: 1313862 - RNA, 22 nt, Human
ucucccugagaugggcuuccca

SEQ ID NO: 1313863 - RNA, 13 nt, Human
ucucccugcaugg

SEQ ID NO: 1313864 - RNA, 14 nt, Human
ucucccugcauggc

SEQ ID NO: 1313865 - RNA, 15 nt, Human
ucucucgugaguaua

SEQ ID NO: 1313866 - RNA, 13 nt, Human
ucucucuaugccu

SEQ ID NO: 1313867 - RNA, 22 nt, Human
ucucucucacucccucccuuuc

SEQ ID NO: 1313868 - RNA, 11 nt, Human
ucucucugugg

SEQ ID NO: 1313869 - RNA, 18 nt, Human
ucucuauccucucuuccu

SEQ ID NO: 1313870 - RNA, 14 nt, Human
ucucuauguaucaa

SEQ ID NO: 1313871 - RNA, 15 nt, Human
ucucuauguaucaaa

SEQ ID NO: 1313872 - RNA, 16 nt, Human
ucucuauguaucaaau

SEQ ID NO: 1313873 - RNA, 13 nt, Human
ucucuaugccucu

SEQ ID NO: 1313874 - RNA, 13 nt, Human
ucucucaacacca

SEQ ID NO: 1313875 - RNA, 19 nt, Human
ucucucaacaccaugauuc

SEQ ID NO: 1313876 - RNA, 22 nt, Human
ucucucaacaccaugauuccuu

SEQ ID NO: 1313877 - RNA, 15 nt, Human
ucucucggcucccca

SEQ ID NO: 1313878 - RNA, 20 nt, Human
ucucucggcuccccaugugu

SEQ ID NO: 1313879 - RNA, 23 nt, Human
ucucucggcuccccauguguccu

SEQ ID NO: 1313880 - RNA, 19 nt, Human
ucucugauuuucaaagcuu

SEQ ID NO: 1313881 - RNA, 20 nt, Human
ucucugauuuucaaagcuuu

SEQ ID NO: 1313882 - RNA, 17 nt, Human
ucucugacuucugccug

SEQ ID NO: 1313883 - RNA, 18 nt, Human
ucucugacuucugccugg

SEQ ID NO: 1313884 - RNA, 19 nt, Human
ucucugacuucugccugga

SEQ ID NO: 1313885 - RNA, 14 nt, Human
ucucugagcaguga

SEQ ID NO: 1313886 - RNA, 15 nt, Human
ucucugagcugugca

SEQ ID NO: 1313887 - RNA, 16 nt, Human
ucucugagcugugcag

SEQ ID NO: 1313888 - RNA, 16 nt, Human
ucucucuuuauacagc

SEQ ID NO: 1313889 - RNA, 12 nt, Human
ucucucuucucu

SEQ ID NO: 1313890 - RNA, 17 nt, Human
ucucucuuuauacagcu

SEQ ID NO: 1313891 - RNA, 12 nt, Human
ucucugaacaca

SEQ ID NO: 1313892 - RNA, 20 nt, Human
ucucucuuugcauggauuuc

SEQ ID NO: 1313893 - RNA, 14 nt, Human
ucucugacuucugc

SEQ ID NO: 1313894 - RNA, 16 nt, Human
ucucugacuucugccu

SEQ ID NO: 1313895 - RNA, 19 nt, Human
ucucuauaccaauaaagug

SEQ ID NO: 1313896 - RNA, 17 nt, Human
ucucuauaccaauaaag

SEQ ID NO: 1313897 - RNA, 16 nt, Human
ucucuauaccaauaaa

SEQ ID NO: 1313898 - RNA, 14 nt, Human
ucucuauaccaaua

SEQ ID NO: 1313899 - RNA, 13 nt, Human
ucucuaggaaaua

SEQ ID NO: 1313900 - RNA, 19 nt, Human
ucucuaggaaauauuuauu

SEQ ID NO: 1313901 - RNA, 15 nt, Human
ucucuaauucuauua

SEQ ID NO: 1313902 - RNA, 13 nt, Human
ucucuacaaaccc

SEQ ID NO: 1313903 - RNA, 18 nt, Human
ucucuaauucuuccuuug

SEQ ID NO: 1313904 - RNA, 18 nt, Human
ucucuacagucucgucuc

SEQ ID NO: 1313905 - RNA, 21 nt, Human
ucucuacagucucgucucuuu

SEQ ID NO: 1313906 - RNA, 22 nt, Human
ucucuacagucucgucucuuuu

SEQ ID NO: 1313907 - RNA, 20 nt, Human
ucucuaccacugcugauauu

SEQ ID NO: 1313908 - RNA, 14 nt, Human
ucucuaccuucucc

SEQ ID NO: 1313909 - RNA, 16 nt, Human
ucucuaccuucucccc

SEQ ID NO: 1313910 - RNA, 18 nt, Human
ucucuaccuucuccccag

SEQ ID NO: 1313911 - RNA, 23 nt, Human
ucucuaccuucuccccagcuccc

SEQ ID NO: 1313912 - RNA, 22 nt, Human
ucucuacugaaugucauugaaa

SEQ ID NO: 1313913 - RNA, 19 nt, Human
ucucuaccuucuccccagc

SEQ ID NO: 1313914 - RNA, 20 nt, Human
ucucuucugaauaaagcaau

SEQ ID NO: 1313915 - RNA, 19 nt, Human
ucucuucugaauaaagcaa

SEQ ID NO: 1313916 - RNA, 23 nt, Human
ucucuucucuccagcugacuaaa

SEQ ID NO: 1313917 - RNA, 13 nt, Human
ucucuuugccuca

SEQ ID NO: 1313918 - RNA, 12 nt, Human
ucucuucucucc

SEQ ID NO: 1313919 - RNA, 14 nt, Human
ucucuucucuccag

SEQ ID NO: 1313920 - RNA, 15 nt, Human
ucucuucucuccagc

SEQ ID NO: 1313921 - RNA, 16 nt, Human
ucucuucucuccagcu

SEQ ID NO: 1313922 - RNA, 11 nt, Human
ucucuucucca

SEQ ID NO: 1313923 - RNA, 20 nt, Human
ucucuuccuuuuaucaguag

SEQ ID NO: 1313924 - RNA, 22 nt, Human
ucucuuccucuucccccaagau

SEQ ID NO: 1313925 - RNA, 13 nt, Human
ucucuucuccacu

SEQ ID NO: 1313926 - RNA, 14 nt, Human
ucucuucuccacug

SEQ ID NO: 1313927 - RNA, 15 nt, Human
ucucuucuccacugg

SEQ ID NO: 1313928 - RNA, 16 nt, Human
ucucuucuccacugga

SEQ ID NO: 1313929 - RNA, 11 nt, Human
ucucugcaggu

SEQ ID NO: 1313930 - RNA, 20 nt, Human
ucucuuauggauguccccag

SEQ ID NO: 1313931 - RNA, 15 nt, Human
ucucuuauugccuca

SEQ ID NO: 1313932 - RNA, 16 nt, Human
ucucuuauugccucac

SEQ ID NO: 1313933 - RNA, 19 nt, Human
ucucugcaaacugccuucu

SEQ ID NO: 1313934 - RNA, 17 nt, Human
ucucugcaaacugccuu

SEQ ID NO: 1313935 - RNA, 20 nt, Human
ucucugcagacuucccagcu

SEQ ID NO: 1313936 - RNA, 15 nt, Human
ucucugcagacuucc

SEQ ID NO: 1313937 - RNA, 17 nt, Human
ucucuucagucucuaua

SEQ ID NO: 1313938 - RNA, 13 nt, Human
ucucuucagucuc

SEQ ID NO: 1313939 - RNA, 22 nt, Human
ucucuuauugccucacuucagg

SEQ ID NO: 1313940 - RNA, 18 nt, Human
ucucuucacagucacauu

SEQ ID NO: 1313941 - RNA, 14 nt, Human
ucugaaauuuccug

SEQ ID NO: 1313942 - RNA, 13 nt, Human
ucugaaaugaaga

SEQ ID NO: 1313943 - RNA, 12 nt, Human
ucugaacucaaa

SEQ ID NO: 1313944 - RNA, 14 nt, Human
ucugaacucaaacu

SEQ ID NO: 1313945 - RNA, 16 nt, Human
ucugaacucaaacuga

SEQ ID NO: 1313946 - RNA, 17 nt, Human
ucugaacucaaacugag

SEQ ID NO: 1313947 - RNA, 21 nt, Human
ucugaacucaaacugaggaau

SEQ ID NO: 1313948 - RNA, 14 nt, Human
ucucuuugccucaa

SEQ ID NO: 1313949 - RNA, 18 nt, Human
ucucuuuuugcuuucgaa

SEQ ID NO: 1313950 - RNA, 14 nt, Human
ucugaggacaagag

SEQ ID NO: 1313951 - RNA, 17 nt, Human
ucugaggacaagagaaa

SEQ ID NO: 1313952 - RNA, 19 nt, Human
ucugagcugucaacgagac

SEQ ID NO: 1313953 - RNA, 10 nt, Human
ucugagcugu

SEQ ID NO: 1313954 - RNA, 22 nt, Human
ucugagcauuagauuucucauu

SEQ ID NO: 1313955 - RNA, 19 nt, Human
ucugagcagugaaugauuc

SEQ ID NO: 1313956 - RNA, 20 nt, Human
ucugagcuccuguccccugc

SEQ ID NO: 1313957 - RNA, 12 nt, Human
ucugagcuccug

SEQ ID NO: 1313958 - RNA, 21 nt, Human
ucugcaauuccccucugcugc

SEQ ID NO: 1313959 - RNA, 22 nt, Human
ucugcaauuccccucugcugcu

SEQ ID NO: 1313960 - RNA, 16 nt, Human
ucugauugugauguga

SEQ ID NO: 1313961 - RNA, 23 nt, Human
ucugcaauucaaaaguuccaaga

SEQ ID NO: 1313962 - RNA, 16 nt, Human
ucugcaauuccccucu

SEQ ID NO: 1313963 - RNA, 18 nt, Human
ucugcaauuccccucugc

SEQ ID NO: 1313964 - RNA, 20 nt, Human
ucugcaauuccccucugcug

SEQ ID NO: 1313965 - RNA, 18 nt, Human
ucugaggacaagagaaaa

SEQ ID NO: 1313966 - RNA, 19 nt, Human
ucugauucgaaugacacug

SEQ ID NO: 1313967 - RNA, 22 nt, Human
ucugauucgaaugacacuguuc

SEQ ID NO: 1313968 - RNA, 20 nt, Human
ucugauucgaaugacacugu

SEQ ID NO: 1313969 - RNA, 19 nt, Human
ucugacccagugcccccac

SEQ ID NO: 1313970 - RNA, 22 nt, Human
ucugacccagugcccccacuga

SEQ ID NO: 1313971 - RNA, 23 nt, Human
ucugacccagugcccccacugac

SEQ ID NO: 1313972 - RNA, 22 nt, Human
ucugagaucuguugauugauga

SEQ ID NO: 1313973 - RNA, 18 nt, Human
ucugagauggcucccagg

SEQ ID NO: 1313974 - RNA, 19 nt, Human
ucugagauggcucccaggg

SEQ ID NO: 1313975 - RNA, 22 nt, Human
ucugagauggcucccaggggcu

SEQ ID NO: 1313976 - RNA, 20 nt, Human
ucugagcauuagauuucuca

SEQ ID NO: 1313977 - RNA, 17 nt, Human
ucugagcagcgagccug

SEQ ID NO: 1313978 - RNA, 18 nt, Human
ucugagcagcgagccugc

SEQ ID NO: 1313979 - RNA, 19 nt, Human
ucugagcagcgagccugcu

SEQ ID NO: 1313980 - RNA, 21 nt, Human
ucugagcagcgagccugcuag

SEQ ID NO: 1313981 - RNA, 22 nt, Human
ucugagcacuguuuauacacug

SEQ ID NO: 1313982 - RNA, 19 nt, Human
ucugaacuugcauugugau

SEQ ID NO: 1313983 - RNA, 18 nt, Human
ucugaacuugcauuguga

SEQ ID NO: 1313984 - RNA, 22 nt, Human
ucugacauuaugugguuuuaga

SEQ ID NO: 1313985 - RNA, 23 nt, Human
ucugacauuaugugguuuuagau

SEQ ID NO: 1313986 - RNA, 13 nt, Human
ucugacccagugc

SEQ ID NO: 1313987 - RNA, 14 nt, Human
ucugacccagugcc

SEQ ID NO: 1313988 - RNA, 15 nt, Human
ucugacccagugccc

SEQ ID NO: 1313989 - RNA, 17 nt, Human
ucugacauucugauucg

SEQ ID NO: 1313990 - RNA, 11 nt, Human
ucugacccagu

SEQ ID NO: 1313991 - RNA, 21 nt, Human
ucagcacuuuagaauaugccu

SEQ ID NO: 1313992 - RNA, 14 nt, Human
ucagcacuuggccc

SEQ ID NO: 1313993 - RNA, 16 nt, Human
ucagcacuuggcccuu

SEQ ID NO: 1313994 - RNA, 17 nt, Human
ucagcagccucccugaa

SEQ ID NO: 1313995 - RNA, 12 nt, Human
ucaguugcagcc

SEQ ID NO: 1313996 - RNA, 17 nt, Human
ucaguugauuuucugga

SEQ ID NO: 1313997 - RNA, 18 nt, Human
ucaguugauuuucuggau

SEQ ID NO: 1313998 - RNA, 15 nt, Human
ucaguugugacuaac

SEQ ID NO: 1313999 - RNA, 15 nt, Human
ucaguuacucuucag

SEQ ID NO: 1314000 - RNA, 15 nt, Human
ucauaauuauuauuu

SEQ ID NO: 1314001 - RNA, 13 nt, Human
ucaguugucucug

SEQ ID NO: 1314002 - RNA, 19 nt, Human
ucauaauggggguaaaguu

SEQ ID NO: 1314003 - RNA, 23 nt, Human
ucauaauugcauugacuuucccc

SEQ ID NO: 1314004 - RNA, 19 nt, Human
ucauaauugcauugacuuu

SEQ ID NO: 1314005 - RNA, 15 nt, Human
ucauacagagaaguc

SEQ ID NO: 1314006 - RNA, 16 nt, Human
ucauacagagaaguca

SEQ ID NO: 1314007 - RNA, 17 nt, Human
ucauacagagaagucac

SEQ ID NO: 1314008 - RNA, 14 nt, Human
ucauacauuuucua

SEQ ID NO: 1314009 - RNA, 13 nt, Human
ucauacacagaaa

SEQ ID NO: 1314010 - RNA, 11 nt, Human
ucauacagaga

SEQ ID NO: 1314011 - RNA, 12 nt, Human
ucauacagagaa

SEQ ID NO: 1314012 - RNA, 13 nt, Human
ucauacagagaag

SEQ ID NO: 1314013 - RNA, 14 nt, Human
ucauacagagaagu

SEQ ID NO: 1314014 - RNA, 23 nt, Human
ucauacagagaagucacagggca

SEQ ID NO: 1314015 - RNA, 15 nt, Human
ucauguaauccucaa

SEQ ID NO: 1314016 - RNA, 18 nt, Human
ucauguaagcugaaaaua

SEQ ID NO: 1314017 - RNA, 19 nt, Human
ucauguaagcugaaaauau

SEQ ID NO: 1314018 - RNA, 22 nt, Human
ucauuauuuauguauugugcaa

SEQ ID NO: 1314019 - RNA, 19 nt, Human
ucauguaaauaauacauua

SEQ ID NO: 1314020 - RNA, 18 nt, Human
ucauguaaauaauacauu

SEQ ID NO: 1314021 - RNA, 20 nt, Human
ucauguaacuucccugaaaa

SEQ ID NO: 1314022 - RNA, 13 nt, Human
ucauguaaacugu

SEQ ID NO: 1314023 - RNA, 14 nt, Human
ucauguaaacugug

SEQ ID NO: 1314024 - RNA, 17 nt, Human
ucauguaaacugugcac

SEQ ID NO: 1314025 - RNA, 16 nt, Human
ucauguaaacugugca

SEQ ID NO: 1314026 - RNA, 13 nt, Human
ucauguaaauaau

SEQ ID NO: 1314027 - RNA, 16 nt, Human
ucaugccccuggcugg

SEQ ID NO: 1314028 - RNA, 15 nt, Human
ucaugcccugugcaa

SEQ ID NO: 1314029 - RNA, 13 nt, Human
ucaugccucugag

SEQ ID NO: 1314030 - RNA, 14 nt, Human
ucaugccucugagg

SEQ ID NO: 1314031 - RNA, 15 nt, Human
ucaugccucugaggc

SEQ ID NO: 1314032 - RNA, 16 nt, Human
ucaugccucugaggcc

SEQ ID NO: 1314033 - RNA, 21 nt, Human
ucaugccucugaggccagccu

SEQ ID NO: 1314034 - RNA, 22 nt, Human
ucaugccucugaggccagccug

SEQ ID NO: 1314035 - RNA, 22 nt, Human
ucaugcuaauuauauaauauuu

SEQ ID NO: 1314036 - RNA, 15 nt, Human
ucaugcuaucucugu

SEQ ID NO: 1314037 - RNA, 21 nt, Human
ucauacauuuucuaagaaaca

SEQ ID NO: 1314038 - RNA, 15 nt, Human
ucauaccaaugaaaa

SEQ ID NO: 1314039 - RNA, 14 nt, Human
ucauaggucugaaa

SEQ ID NO: 1314040 - RNA, 15 nt, Human
ucauaggucugaaau

SEQ ID NO: 1314041 - RNA, 22 nt, Human
ucauaggucugaaauuuuucuu

SEQ ID NO: 1314042 - RNA, 16 nt, Human
ucauaggucugaaauu

SEQ ID NO: 1314043 - RNA, 14 nt, Human
ucauaguaacuucu

SEQ ID NO: 1314044 - RNA, 15 nt, Human
ucauaguaacuucuu

SEQ ID NO: 1314045 - RNA, 16 nt, Human
ucauaguaacuucuua

SEQ ID NO: 1314046 - RNA, 18 nt, Human
ucauaguaacuucuuaug

SEQ ID NO: 1314047 - RNA, 21 nt, Human
ucauaguaacuucuuauggaa

SEQ ID NO: 1314048 - RNA, 21 nt, Human
ucaucuccugccuuccuccug

SEQ ID NO: 1314049 - RNA, 22 nt, Human
ucaucuccugccuuccuccugg

SEQ ID NO: 1314050 - RNA, 23 nt, Human
ucaucuccugccuuccuccuggg

SEQ ID NO: 1314051 - RNA, 14 nt, Human
ucaucucucugccc

SEQ ID NO: 1314052 - RNA, 16 nt, Human
ucaucucucugcccaa

SEQ ID NO: 1314053 - RNA, 14 nt, Human
ucaucucuucuuuu

SEQ ID NO: 1314054 - RNA, 23 nt, Human
ucaucugggaacuugucacagau

SEQ ID NO: 1314055 - RNA, 16 nt, Human
ucaucuggggagcagg

SEQ ID NO: 1314056 - RNA, 20 nt, Human
ucaucuggggagcaggcagc

SEQ ID NO: 1314057 - RNA, 23 nt, Human
ucaucuggggagcaggcagccag

SEQ ID NO: 1314058 - RNA, 21 nt, Human
ucaucuggggagcaggcagcc

SEQ ID NO: 1314059 - RNA, 23 nt, Human
ucaucugguugaacucugguggc

SEQ ID NO: 1314060 - RNA, 20 nt, Human
ucaucugguugaacucuggu

SEQ ID NO: 1314061 - RNA, 12 nt, Human
ucaucugucccu

SEQ ID NO: 1314062 - RNA, 17 nt, Human
ucaucugucccuccggg

SEQ ID NO: 1314063 - RNA, 18 nt, Human
ucaucugucccuccggga

SEQ ID NO: 1314064 - RNA, 12 nt, Human
ucaucugugcac

SEQ ID NO: 1314065 - RNA, 22 nt, Human
ucauucagauaugauucaaaug

SEQ ID NO: 1314066 - RNA, 20 nt, Human
ucauucacuucacugugcug

SEQ ID NO: 1314067 - RNA, 19 nt, Human
ucauucacuucacugugcu

SEQ ID NO: 1314068 - RNA, 17 nt, Human
ucauucacuucacugug

SEQ ID NO: 1314069 - RNA, 16 nt, Human
ucauucacuucacugu

SEQ ID NO: 1314070 - RNA, 16 nt, Human
ucauguacaagaugaa

SEQ ID NO: 1314071 - RNA, 18 nt, Human
ucauucauuagucauguu

SEQ ID NO: 1314072 - RNA, 14 nt, Human
ucauuucucaucca

SEQ ID NO: 1314073 - RNA, 23 nt, Human
ucauuucuuuuugggagagacuu

SEQ ID NO: 1314074 - RNA, 23 nt, Human
uccaaacugacucuuaagaagac

SEQ ID NO: 1314075 - RNA, 19 nt, Human
uccaaacucuucccucucu

SEQ ID NO: 1314076 - RNA, 19 nt, Human
uccaaacugaagcagccuc

SEQ ID NO: 1314077 - RNA, 22 nt, Human
uccaaagaguagaauugcauug

SEQ ID NO: 1314078 - RNA, 23 nt, Human
uccaaagaguagaauugcauuga

SEQ ID NO: 1314079 - RNA, 19 nt, Human
uccaaaagauugcugaaau

SEQ ID NO: 1314080 - RNA, 20 nt, Human
uccaaaagauugcugaaauu

SEQ ID NO: 1314081 - RNA, 22 nt, Human
uccaaaagauugcugaaauuuu

SEQ ID NO: 1314082 - RNA, 13 nt, Human
uccaaaagcuuuu

SEQ ID NO: 1314083 - RNA, 16 nt, Human
uccaaaagcuuuuuau

SEQ ID NO: 1314084 - RNA, 22 nt, Human
ucauuucuuuuugggagagacu

SEQ ID NO: 1314085 - RNA, 14 nt, Human
uccaagaauuucua

SEQ ID NO: 1314086 - RNA, 16 nt, Human
uccaagaauccacauu

SEQ ID NO: 1314087 - RNA, 19 nt, Human
uccaagaauccacauuucu

SEQ ID NO: 1314088 - RNA, 20 nt, Human
uccaagaauccacauuucua

SEQ ID NO: 1314089 - RNA, 21 nt, Human
uccaagaauccacauuucuaa

SEQ ID NO: 1314090 - RNA, 22 nt, Human
uccaagaauccacauuucuaaa

SEQ ID NO: 1314091 - RNA, 23 nt, Human
uccaagaauccacauuucuaaaa

SEQ ID NO: 1314092 - RNA, 14 nt, Human
uccaagaauccaca

SEQ ID NO: 1314093 - RNA, 22 nt, Human
uccaaaggaggauggcauauaa

SEQ ID NO: 1314094 - RNA, 16 nt, Human
uccaaagcuucccacg

SEQ ID NO: 1314095 - RNA, 14 nt, Human
uccaaagcagacag

SEQ ID NO: 1314096 - RNA, 15 nt, Human
uccaaagcagacagc

SEQ ID NO: 1314097 - RNA, 13 nt, Human
uccaagcaaaugu

SEQ ID NO: 1314098 - RNA, 13 nt, Human
uccaagauuccgg

SEQ ID NO: 1314099 - RNA, 15 nt, Human
uccaagauuccggau

SEQ ID NO: 1314100 - RNA, 12 nt, Human
uccaagauucua

SEQ ID NO: 1314101 - RNA, 13 nt, Human
uccaagauucuag

SEQ ID NO: 1314102 - RNA, 14 nt, Human
uccaagauucuaga

SEQ ID NO: 1314103 - RNA, 15 nt, Human
uccaagauucuagau

SEQ ID NO: 1314104 - RNA, 16 nt, Human
uccaagauucuagaug

SEQ ID NO: 1314105 - RNA, 17 nt, Human
uccaagauucuagauga

SEQ ID NO: 1314106 - RNA, 17 nt, Human
uccaagcauuuagaugu

SEQ ID NO: 1314107 - RNA, 17 nt, Human
uccaagagucuaaagau

SEQ ID NO: 1314108 - RNA, 18 nt, Human
uccaagagucuaaagaug

SEQ ID NO: 1314109 - RNA, 18 nt, Human
uccaagauauuuuaaaau

SEQ ID NO: 1314110 - RNA, 22 nt, Human
uccaagauauuuuaaaaucugu

SEQ ID NO: 1314111 - RNA, 17 nt, Human
uccaagacaugucuguu

SEQ ID NO: 1314112 - RNA, 20 nt, Human
uccaagacaugucuguucua

SEQ ID NO: 1314113 - RNA, 22 nt, Human
uccaagacaugucuguucuaca

SEQ ID NO: 1314114 - RNA, 16 nt, Human
uccagauccuggaaau

SEQ ID NO: 1314115 - RNA, 17 nt, Human
uccagauccuggaaauc

SEQ ID NO: 1314116 - RNA, 14 nt, Human
uccagauccuggaa

SEQ ID NO: 1314117 - RNA, 22 nt, Human
uccagcagauuuccagccuucu

SEQ ID NO: 1314118 - RNA, 15 nt, Human
uccagcauucccagg

SEQ ID NO: 1314119 - RNA, 17 nt, Human
uccacuucugacagccu

SEQ ID NO: 1314120 - RNA, 19 nt, Human
uccacuucugacagccuca

SEQ ID NO: 1314121 - RNA, 13 nt, Human
uccacuuggucug

SEQ ID NO: 1314122 - RNA, 12 nt, Human
uccacuuggucu

SEQ ID NO: 1314123 - RNA, 14 nt, Human
uccacuuggucugu

SEQ ID NO: 1314124 - RNA, 19 nt, Human
uccagaaauacaauuuuag

SEQ ID NO: 1314125 - RNA, 18 nt, Human
uccaccgcagaaggaagg

SEQ ID NO: 1314126 - RNA, 17 nt, Human
uccaccgcagaaggaag

SEQ ID NO: 1314127 - RNA, 16 nt, Human
uccaccgcagaaggaa

SEQ ID NO: 1314128 - RNA, 15 nt, Human
uccaccgcagaagga

SEQ ID NO: 1314129 - RNA, 14 nt, Human
uccaccucaacucc

SEQ ID NO: 1314130 - RNA, 23 nt, Human
uccaccgucuuucuuuuauacug

SEQ ID NO: 1314131 - RNA, 14 nt, Human
uccaccuacaugag

SEQ ID NO: 1314132 - RNA, 15 nt, Human
uccaagcaaauguga

SEQ ID NO: 1314133 - RNA, 18 nt, Human
uccaagauucuagaugau

SEQ ID NO: 1314134 - RNA, 20 nt, Human
uccaagauucuagaugauua

SEQ ID NO: 1314135 - RNA, 20 nt, Human
uccaagcauuuagauguaua

SEQ ID NO: 1314136 - RNA, 14 nt, Human
uccacaacacacag

SEQ ID NO: 1314137 - RNA, 14 nt, Human
uccacaaauuauua

SEQ ID NO: 1314138 - RNA, 20 nt, Human
uccacaaauuauuaaugaaa

SEQ ID NO: 1314139 - RNA, 22 nt, Human
uccaauuuucuggaauacauga

SEQ ID NO: 1314140 - RNA, 12 nt, Human
uccacaaaauaa

SEQ ID NO: 1314141 - RNA, 20 nt, Human
uccacaaaauaaccaauccu

SEQ ID NO: 1314142 - RNA, 21 nt, Human
uccacaaauuauuaaugaaaa

SEQ ID NO: 1314143 - RNA, 21 nt, Human
ucccaaguaacugggauuaca

SEQ ID NO: 1314144 - RNA, 20 nt, Human
ucccaaguaacugggauuac

SEQ ID NO: 1314145 - RNA, 22 nt, Human
ucccaaggcucugagcaaaugu

SEQ ID NO: 1314146 - RNA, 15 nt, Human
ucccaagggcugccg

SEQ ID NO: 1314147 - RNA, 16 nt, Human
ucccaaggggccugag

SEQ ID NO: 1314148 - RNA, 17 nt, Human
ucccaaggggccugagc

SEQ ID NO: 1314149 - RNA, 18 nt, Human
ucccaaggggccugagca

SEQ ID NO: 1314150 - RNA, 16 nt, Human
ucccaagguuacuuaa

SEQ ID NO: 1314151 - RNA, 20 nt, Human
ucccaagguuacuuaauuca

SEQ ID NO: 1314152 - RNA, 13 nt, Human
ucccaggacccug

SEQ ID NO: 1314153 - RNA, 19 nt, Human
ucccaaggggccugagcag

SEQ ID NO: 1314154 - RNA, 16 nt, Human
ucccaaguagaaucuc

SEQ ID NO: 1314155 - RNA, 17 nt, Human
ucccaccuagcagcacc

SEQ ID NO: 1314156 - RNA, 14 nt, Human
ucccaggacccuga

SEQ ID NO: 1314157 - RNA, 16 nt, Human
ucccaggacccugaag

SEQ ID NO: 1314158 - RNA, 19 nt, Human
ucccaggacccugaagggg

SEQ ID NO: 1314159 - RNA, 15 nt, Human
ucccaggagacaguu

SEQ ID NO: 1314160 - RNA, 16 nt, Human
ucccaggauguacaag

SEQ ID NO: 1314161 - RNA, 20 nt, Human
ucccaggcgccccuuccccc

SEQ ID NO: 1314162 - RNA, 18 nt, Human
ucccaggcgccccuuccc

SEQ ID NO: 1314163 - RNA, 21 nt, Human
ucccaggcgccccuucccccu

SEQ ID NO: 1314164 - RNA, 15 nt, Human
ucccaggcugagccu

SEQ ID NO: 1314165 - RNA, 16 nt, Human
ucccaggagacaguuc

SEQ ID NO: 1314166 - RNA, 22 nt, Human
ucccaggagacaguucaagaaa

SEQ ID NO: 1314167 - RNA, 19 nt, Human
ucccaggacccuggaccca

SEQ ID NO: 1314168 - RNA, 16 nt, Human
ucccaggcugagccuc

SEQ ID NO: 1314169 - RNA, 18 nt, Human
ucccaggcugagccucag

SEQ ID NO: 1314170 - RNA, 13 nt, Human
ucccaucugcuuc

SEQ ID NO: 1314171 - RNA, 14 nt, Human
ucccauggggaggg

SEQ ID NO: 1314172 - RNA, 23 nt, Human
ucccaugggcagaggaccaggcu

SEQ ID NO: 1314173 - RNA, 18 nt, Human
uccccagacgccuggcug

SEQ ID NO: 1314174 - RNA, 21 nt, Human
uccccagacgccuggcugcug

SEQ ID NO: 1314175 - RNA, 17 nt, Human
uccccagaauggaggca

SEQ ID NO: 1314176 - RNA, 21 nt, Human
uccccacuuguccgcugggug

SEQ ID NO: 1314177 - RNA, 19 nt, Human
uccccacuugcagcccugu

SEQ ID NO: 1314178 - RNA, 19 nt, Human
uccccacuuguccgcuggg

SEQ ID NO: 1314179 - RNA, 16 nt, Human
ucccauucaagauucc

SEQ ID NO: 1314180 - RNA, 14 nt, Human
ucccauucaagauu

SEQ ID NO: 1314181 - RNA, 19 nt, Human
ucccauucccccagugcgg

SEQ ID NO: 1314182 - RNA, 13 nt, Human
ucccauuccugaa

SEQ ID NO: 1314183 - RNA, 14 nt, Human
ucccauuccugaag

SEQ ID NO: 1314184 - RNA, 17 nt, Human
ucccauuccugaagaac

SEQ ID NO: 1314185 - RNA, 15 nt, Human
ucccauuccugaaga

SEQ ID NO: 1314186 - RNA, 13 nt, Human
ucccauuccccca

SEQ ID NO: 1314187 - RNA, 14 nt, Human
uccauggcccugcc

SEQ ID NO: 1314188 - RNA, 15 nt, Human
uccauggccagcagc

SEQ ID NO: 1314189 - RNA, 16 nt, Human
uccauggccagcagca

SEQ ID NO: 1314190 - RNA, 20 nt, Human
uccauggcccugcaaaagga

SEQ ID NO: 1314191 - RNA, 18 nt, Human
uccauggcaggaaggcuu

SEQ ID NO: 1314192 - RNA, 14 nt, Human
uccauggccagcag

SEQ ID NO: 1314193 - RNA, 23 nt, Human
uccaugucaagauucagcuagug

SEQ ID NO: 1314194 - RNA, 22 nt, Human
uccauguaacugccuagaaaca

SEQ ID NO: 1314195 - RNA, 17 nt, Human
uccauggccagcagcac

SEQ ID NO: 1314196 - RNA, 12 nt, Human
uccauguaacug

SEQ ID NO: 1314197 - RNA, 14 nt, Human
uccauguaacugcc

SEQ ID NO: 1314198 - RNA, 15 nt, Human
uccauguaacugccu

SEQ ID NO: 1314199 - RNA, 24 nt, Human
uccauguaacugccuagaaacaac

SEQ ID NO: 1314200 - RNA, 17 nt, Human
uccagcauucccaggua

SEQ ID NO: 1314201 - RNA, 16 nt, Human
uccagcauucccaggu

SEQ ID NO: 1314202 - RNA, 12 nt, Human
uccagcuccaac

SEQ ID NO: 1314203 - RNA, 16 nt, Human
uccagcuccaaccugc

SEQ ID NO: 1314204 - RNA, 18 nt, Human
uccagcuccaaccugcaa

SEQ ID NO: 1314205 - RNA, 19 nt, Human
uccagcuccaaccugcaaa

SEQ ID NO: 1314206 - RNA, 17 nt, Human
uccagcucccugugccc

SEQ ID NO: 1314207 - RNA, 19 nt, Human
uccagcucccugugccccc

SEQ ID NO: 1314208 - RNA, 20 nt, Human
uccagcucccugugccccca

SEQ ID NO: 1314209 - RNA, 23 nt, Human
uccagcucccugugcccccaggg

SEQ ID NO: 1314210 - RNA, 16 nt, Human
uccauccaggccauuc

SEQ ID NO: 1314211 - RNA, 18 nt, Human
uccauccaccuuucccaa

SEQ ID NO: 1314212 - RNA, 15 nt, Human
uccauccauggccag

SEQ ID NO: 1314213 - RNA, 13 nt, Human
uccauccaaggcc

SEQ ID NO: 1314214 - RNA, 21 nt, Human
uccauccaaggccagguucuc

SEQ ID NO: 1314215 - RNA, 15 nt, Human
uccauccacauggga

SEQ ID NO: 1314216 - RNA, 19 nt, Human
uccauccauggccagcagc

SEQ ID NO: 1314217 - RNA, 16 nt, Human
uccauccauggccagc

SEQ ID NO: 1314218 - RNA, 17 nt, Human
uccauccauggccagca

SEQ ID NO: 1314219 - RNA, 18 nt, Human
ucccaaggcucugagcaa

SEQ ID NO: 1314220 - RNA, 20 nt, Human
ucccaaauuugauugauuug

SEQ ID NO: 1314221 - RNA, 22 nt, Human
ucccaaauuugauugauuugaa

SEQ ID NO: 1314222 - RNA, 16 nt, Human
ucccaagcucagaggc

SEQ ID NO: 1314223 - RNA, 20 nt, Human
uccaugucaagauucagcua

SEQ ID NO: 1314224 - RNA, 16 nt, Human
uccaugucaagauuca

SEQ ID NO: 1314225 - RNA, 14 nt, Human
uccaugucaagauu

SEQ ID NO: 1314226 - RNA, 14 nt, Human
ucccaaaugagcca

SEQ ID NO: 1314227 - RNA, 17 nt, Human
ucccaaauuugauugau

SEQ ID NO: 1314228 - RNA, 19 nt, Human
ucccaaauuugauugauuu

SEQ ID NO: 1314229 - RNA, 14 nt, Human
ucccuaauaaagcu

SEQ ID NO: 1314230 - RNA, 13 nt, Human
ucccuaauaaagc

SEQ ID NO: 1314231 - RNA, 19 nt, Human
ucccuaccuugaaagaaga

SEQ ID NO: 1314232 - RNA, 15 nt, Human
ucccuacugaagccc

SEQ ID NO: 1314233 - RNA, 18 nt, Human
ucccuacugaagcccuug

SEQ ID NO: 1314234 - RNA, 21 nt, Human
ucccuacugaagcccuuguga

SEQ ID NO: 1314235 - RNA, 15 nt, Human
ucccuacuuccugug

SEQ ID NO: 1314236 - RNA, 16 nt, Human
ucccuacuuccuguga

SEQ ID NO: 1314237 - RNA, 17 nt, Human
ucccuacuuccugugac

SEQ ID NO: 1314238 - RNA, 14 nt, Human
ucccucccucuccg

SEQ ID NO: 1314239 - RNA, 12 nt, Human
ucccuaauaaag

SEQ ID NO: 1314240 - RNA, 11 nt, Human
ucccuaauaaa

SEQ ID NO: 1314241 - RNA, 14 nt, Human
uccccuucuccccu

SEQ ID NO: 1314242 - RNA, 11 nt, Human
ucccuaagcca

SEQ ID NO: 1314243 - RNA, 13 nt, Human
ucccuaagccagc

SEQ ID NO: 1314244 - RNA, 14 nt, Human
ucccuaagccagcu

SEQ ID NO: 1314245 - RNA, 15 nt, Human
uccccuguuuauuca

SEQ ID NO: 1314246 - RNA, 13 nt, Human
uccccuuccacug

SEQ ID NO: 1314247 - RNA, 17 nt, Human
uccccuuccacugaggg

SEQ ID NO: 1314248 - RNA, 18 nt, Human
uccccuuccacugagggc

SEQ ID NO: 1314249 - RNA, 21 nt, Human
uccccuuccuaauuccacagc

SEQ ID NO: 1314250 - RNA, 22 nt, Human
uccccuuccuaauuccacagcu

SEQ ID NO: 1314251 - RNA, 15 nt, Human
uccccuguucacucu

SEQ ID NO: 1314252 - RNA, 18 nt, Human
uccccuggaacugucucu

SEQ ID NO: 1314253 - RNA, 20 nt, Human
uccccuggaacugucucuca

SEQ ID NO: 1314254 - RNA, 19 nt, Human
uccccuggagggggaaugg

SEQ ID NO: 1314255 - RNA, 21 nt, Human
uccccugcccccugcaggaag

SEQ ID NO: 1314256 - RNA, 23 nt, Human
uccccugcccccugcaggaagga

SEQ ID NO: 1314257 - RNA, 18 nt, Human
uccccugccugcccuggu

SEQ ID NO: 1314258 - RNA, 17 nt, Human
uccccgacuggggcagg

SEQ ID NO: 1314259 - RNA, 14 nt, Human
uccccgcacccccc

SEQ ID NO: 1314260 - RNA, 21 nt, Human
uccccgcaccccccaagcugu

SEQ ID NO: 1314261 - RNA, 23 nt, Human
uccccgauaccaugcuguaagga

SEQ ID NO: 1314262 - RNA, 14 nt, Human
uccccugcacugua

SEQ ID NO: 1314263 - RNA, 15 nt, Human
uccccugcacuguaa

SEQ ID NO: 1314264 - RNA, 16 nt, Human
uccccugcacuguaaa

SEQ ID NO: 1314265 - RNA, 17 nt, Human
uccccugcacuguaaaa

SEQ ID NO: 1314266 - RNA, 18 nt, Human
uccccugcacuguaaaau

SEQ ID NO: 1314267 - RNA, 19 nt, Human
uccccugcacuguaaaaug

SEQ ID NO: 1314268 - RNA, 22 nt, Human
uccccugcacuguaaaaugugg

SEQ ID NO: 1314269 - RNA, 14 nt, Human
uccccugcaggcug

SEQ ID NO: 1314270 - RNA, 18 nt, Human
uccccugcaggcugagug

SEQ ID NO: 1314271 - RNA, 13 nt, Human
uccccugccacca

SEQ ID NO: 1314272 - RNA, 14 nt, Human
uccccugccaccag

SEQ ID NO: 1314273 - RNA, 16 nt, Human
uccccugccaccaggc

SEQ ID NO: 1314274 - RNA, 17 nt, Human
uccccugccaccaggcc

SEQ ID NO: 1314275 - RNA, 19 nt, Human
uccccugccaccaggccac

SEQ ID NO: 1314276 - RNA, 12 nt, Human
uccccugccagg

SEQ ID NO: 1314277 - RNA, 14 nt, Human
uccccugccagggc

SEQ ID NO: 1314278 - RNA, 15 nt, Human
uccccugccagggca

SEQ ID NO: 1314279 - RNA, 20 nt, Human
uccccugccagggcagggcc

SEQ ID NO: 1314280 - RNA, 20 nt, Human
uccccugcaggcugagugca

SEQ ID NO: 1314281 - RNA, 14 nt, Human
uccccugcccaugc

SEQ ID NO: 1314282 - RNA, 15 nt, Human
uccccugcccaugcu

SEQ ID NO: 1314283 - RNA, 21 nt, Human
uccccugcccaugcugggagc

SEQ ID NO: 1314284 - RNA, 12 nt, Human
uccccugccccc

SEQ ID NO: 1314285 - RNA, 16 nt, Human
uccccugcccccugca

SEQ ID NO: 1314286 - RNA, 17 nt, Human
uccccugcccccugcag

SEQ ID NO: 1314287 - RNA, 18 nt, Human
uccccugcccccugcagg

SEQ ID NO: 1314288 - RNA, 19 nt, Human
uccccugcccccugcagga

SEQ ID NO: 1314289 - RNA, 23 nt, Human
ucccccagucauucugggaacau

SEQ ID NO: 1314290 - RNA, 12 nt, Human
ucccccagugcg

SEQ ID NO: 1314291 - RNA, 15 nt, Human
uccccagacuuguug

SEQ ID NO: 1314292 - RNA, 17 nt, Human
uccccagacuuguuggc

SEQ ID NO: 1314293 - RNA, 10 nt, Human
uccccagaga

SEQ ID NO: 1314294 - RNA, 11 nt, Human
uccccagagaa

SEQ ID NO: 1314295 - RNA, 22 nt, Human
uccccagagaaaggggagccca

SEQ ID NO: 1314296 - RNA, 14 nt, Human
uccccagccuggga

SEQ ID NO: 1314297 - RNA, 23 nt, Human
uccccagcgauucccucucccag

SEQ ID NO: 1314298 - RNA, 13 nt, Human
uccccagcuccca

SEQ ID NO: 1314299 - RNA, 15 nt, Human
uccccagcucccagg

SEQ ID NO: 1314300 - RNA, 16 nt, Human
uccccagcucccagga

SEQ ID NO: 1314301 - RNA, 17 nt, Human
uccccagcucccaggac

SEQ ID NO: 1314302 - RNA, 17 nt, Human
ucccccaucucuucugg

SEQ ID NO: 1314303 - RNA, 16 nt, Human
ucccccauguucuguc

SEQ ID NO: 1314304 - RNA, 19 nt, Human
ucccccauguucugucccu

SEQ ID NO: 1314305 - RNA, 13 nt, Human
ucccccucuggcu

SEQ ID NO: 1314306 - RNA, 12 nt, Human
ucccccucuguc

SEQ ID NO: 1314307 - RNA, 18 nt, Human
ucccccuccucuccacca

SEQ ID NO: 1314308 - RNA, 13 nt, Human
ucccccugcccca

SEQ ID NO: 1314309 - RNA, 15 nt, Human
ucccccucuguccag

SEQ ID NO: 1314310 - RNA, 16 nt, Human
ucccccucccuccccu

SEQ ID NO: 1314311 - RNA, 17 nt, Human
ucacucuagguuuuaca

SEQ ID NO: 1314312 - RNA, 18 nt, Human
ucacucuagucaaugaca

SEQ ID NO: 1314313 - RNA, 20 nt, Human
ucacucuagucaaugacaug

SEQ ID NO: 1314314 - RNA, 21 nt, Human
ucacucuagucaaugacauga

SEQ ID NO: 1314315 - RNA, 19 nt, Human
ucacucuacuuagcauguc

SEQ ID NO: 1314316 - RNA, 20 nt, Human
ucacucuacuuagcaugucc

SEQ ID NO: 1314317 - RNA, 15 nt, Human
ucacucugaguguuu

SEQ ID NO: 1314318 - RNA, 20 nt, Human
ucacucugaguguuuuauga

SEQ ID NO: 1314319 - RNA, 13 nt, Human
ucacuccuuuuaa

SEQ ID NO: 1314320 - RNA, 14 nt, Human
ucacuccuuuuaaa

SEQ ID NO: 1314321 - RNA, 15 nt, Human
ucacuccuuuuaaag

SEQ ID NO: 1314322 - RNA, 16 nt, Human
ucacuccuuuuaaaga

SEQ ID NO: 1314323 - RNA, 17 nt, Human
ucacuccuuuuaaagaa

SEQ ID NO: 1314324 - RNA, 18 nt, Human
ucacuccuuuuaaagaaa

SEQ ID NO: 1314325 - RNA, 14 nt, Human
ucacucgauaauaa

SEQ ID NO: 1314326 - RNA, 18 nt, Human
ucacucgauaauaaagua

SEQ ID NO: 1314327 - RNA, 16 nt, Human
ucacucgucuccccca

SEQ ID NO: 1314328 - RNA, 21 nt, Human
ucacucuaauuaauuguaauc

SEQ ID NO: 1314329 - RNA, 18 nt, Human
ucacuccuaccugguaau

SEQ ID NO: 1314330 - RNA, 19 nt, Human
ucacggccacacagcugcc

SEQ ID NO: 1314331 - RNA, 20 nt, Human
ucacggccacacagcugccg

SEQ ID NO: 1314332 - RNA, 14 nt, Human
ucacggcugcgcac

SEQ ID NO: 1314333 - RNA, 18 nt, Human
ucacggcugcgcacugug

SEQ ID NO: 1314334 - RNA, 19 nt, Human
ucacggcugcgcacugugu

SEQ ID NO: 1314335 - RNA, 17 nt, Human
ucacgggacuauuucca

SEQ ID NO: 1314336 - RNA, 14 nt, Human
ucacgcuuuccuga

SEQ ID NO: 1314337 - RNA, 15 nt, Human
ucacgcuuuccugaa

SEQ ID NO: 1314338 - RNA, 16 nt, Human
ucacgcuuuccugaau

SEQ ID NO: 1314339 - RNA, 17 nt, Human
ucacgcuuuccugaauc

SEQ ID NO: 1314340 - RNA, 22 nt, Human
ucacgcuuuccugaauccaaac

SEQ ID NO: 1314341 - RNA, 16 nt, Human
ucacgcuuuuugaaaa

SEQ ID NO: 1314342 - RNA, 16 nt, Human
ucacaggacucugccu

SEQ ID NO: 1314343 - RNA, 14 nt, Human
ucacaggcagccag

SEQ ID NO: 1314344 - RNA, 15 nt, Human
ucacaggcagccagu

SEQ ID NO: 1314345 - RNA, 19 nt, Human
ucacaggccccaggaaagg

SEQ ID NO: 1314346 - RNA, 19 nt, Human
ucacaggcagccagugccc

SEQ ID NO: 1314347 - RNA, 22 nt, Human
ucacaggcagccagugcccuga

SEQ ID NO: 1314348 - RNA, 23 nt, Human
ucacaggcagccagugcccugag

SEQ ID NO: 1314349 - RNA, 12 nt, Human
ucacagggcagu

SEQ ID NO: 1314350 - RNA, 16 nt, Human
ucacagggcaguaccu

SEQ ID NO: 1314351 - RNA, 18 nt, Human
ucacagggcaguaccuga

SEQ ID NO: 1314352 - RNA, 22 nt, Human
ucacagggcaguaccugagggu

SEQ ID NO: 1314353 - RNA, 20 nt, Human
ucacagggcaguaccugagg

SEQ ID NO: 1314354 - RNA, 19 nt, Human
ucaccuacucacacaggca

SEQ ID NO: 1314355 - RNA, 16 nt, Human
ucaccuagcugaaugu

SEQ ID NO: 1314356 - RNA, 20 nt, Human
ucaccuagcugaauguuuuu

SEQ ID NO: 1314357 - RNA, 13 nt, Human
ucaccuuuauucu

SEQ ID NO: 1314358 - RNA, 23 nt, Human
ucaccuuggcaccagacacccag

SEQ ID NO: 1314359 - RNA, 18 nt, Human
ucaccuuggcaccagaca

SEQ ID NO: 1314360 - RNA, 19 nt, Human
ucaccuuggcaccagacac

SEQ ID NO: 1314361 - RNA, 22 nt, Human
ucaccuagcugaauguuuuucu

SEQ ID NO: 1314362 - RNA, 23 nt, Human
ucaccuagcugaauguuuuucua

SEQ ID NO: 1314363 - RNA, 14 nt, Human
ucaccuaggaagcc

SEQ ID NO: 1314364 - RNA, 15 nt, Human
ucaccuaggaagccu

SEQ ID NO: 1314365 - RNA, 17 nt, Human
ucaccuaggaagccuca

SEQ ID NO: 1314366 - RNA, 19 nt, Human
ucaccuaggaagccucaga

SEQ ID NO: 1314367 - RNA, 20 nt, Human
ucaccuaggaagccucagau

SEQ ID NO: 1314368 - RNA, 23 nt, Human
ucaccuaggaagccucagauucc

SEQ ID NO: 1314369 - RNA, 20 nt, Human
ucaccuauuuccauucaaca

SEQ ID NO: 1314370 - RNA, 16 nt, Human
ucaccucagauggcag

SEQ ID NO: 1314371 - RNA, 17 nt, Human
ucaccucagauggcagc

SEQ ID NO: 1314372 - RNA, 18 nt, Human
ucaccucagauggcagcu

SEQ ID NO: 1314373 - RNA, 19 nt, Human
ucaccucagauggcagcuu

SEQ ID NO: 1314374 - RNA, 20 nt, Human
ucaccucagauggcagcuuu

SEQ ID NO: 1314375 - RNA, 21 nt, Human
ucaccucagauggcagcuuuu

SEQ ID NO: 1314376 - RNA, 23 nt, Human
ucaccucagauggcagcuuuuaa

SEQ ID NO: 1314377 - RNA, 22 nt, Human
ucaccucagauggcagcuuuua

SEQ ID NO: 1314378 - RNA, 16 nt, Human
ucacgcaugcaguguu

SEQ ID NO: 1314379 - RNA, 18 nt, Human
ucacgccagacuucccac

SEQ ID NO: 1314380 - RNA, 14 nt, Human
ucacgcaugcagug

SEQ ID NO: 1314381 - RNA, 21 nt, Human
ucagcaaacaggaucaguuaa

SEQ ID NO: 1314382 - RNA, 15 nt, Human
ucagcaaacucuuuu

SEQ ID NO: 1314383 - RNA, 21 nt, Human
ucagaguugcugcaaaccuga

SEQ ID NO: 1314384 - RNA, 15 nt, Human
ucagcaaacaggauc

SEQ ID NO: 1314385 - RNA, 22 nt, Human
ucagaguugaugguuguacaua

SEQ ID NO: 1314386 - RNA, 21 nt, Human
ucagagugacauccaggagga

SEQ ID NO: 1314387 - RNA, 20 nt, Human
ucagagugacuacacacagu

SEQ ID NO: 1314388 - RNA, 16 nt, Human
ucagaguucuuuuuga

SEQ ID NO: 1314389 - RNA, 19 nt, Human
ucagaguucuuuuugaagu

SEQ ID NO: 1314390 - RNA, 21 nt, Human
ucagaggggaauaaacuguug

SEQ ID NO: 1314391 - RNA, 16 nt, Human
ucagaggcgcacugug

SEQ ID NO: 1314392 - RNA, 17 nt, Human
ucagaguccuuaaaaug

SEQ ID NO: 1314393 - RNA, 18 nt, Human
ucagaguccuuaaaaugu

SEQ ID NO: 1314394 - RNA, 19 nt, Human
ucagagugacauccaggag

SEQ ID NO: 1314395 - RNA, 18 nt, Human
ucagaggcccucgcugcc

SEQ ID NO: 1314396 - RNA, 21 nt, Human
ucagaggcccucgcugccagc

SEQ ID NO: 1314397 - RNA, 22 nt, Human
ucagaggcccucgcugccagcu

SEQ ID NO: 1314398 - RNA, 14 nt, Human
ucagcacuagccaa

SEQ ID NO: 1314399 - RNA, 13 nt, Human
ucagcacaaggcc

SEQ ID NO: 1314400 - RNA, 19 nt, Human
ucagcaaguuagaacuagc

SEQ ID NO: 1314401 - RNA, 15 nt, Human
ucagcacugccugcu

SEQ ID NO: 1314402 - RNA, 18 nt, Human
ucagcacugccugcuccc

SEQ ID NO: 1314403 - RNA, 22 nt, Human
ucagcacugccugcucccaucc

SEQ ID NO: 1314404 - RNA, 12 nt, Human
ucagcacugucc

SEQ ID NO: 1314405 - RNA, 13 nt, Human
ucagcacuguccc

SEQ ID NO: 1314406 - RNA, 14 nt, Human
ucagcacugucccu

SEQ ID NO: 1314407 - RNA, 21 nt, Human
ucagcacugucccuugccuca

SEQ ID NO: 1314408 - RNA, 19 nt, Human
ucagcacuuggcccuucua

SEQ ID NO: 1314409 - RNA, 18 nt, Human
ucagcaaagugguucccu

SEQ ID NO: 1314410 - RNA, 20 nt, Human
ucagcaaagugguucccucu

SEQ ID NO: 1314411 - RNA, 16 nt, Human
ucagcaacucgcuuua

SEQ ID NO: 1314412 - RNA, 19 nt, Human
ucagcaagacuucucuuug

SEQ ID NO: 1314413 - RNA, 18 nt, Human
ucagcaagauaaacauua

SEQ ID NO: 1314414 - RNA, 21 nt, Human
ucagcaaguuagaacuagcca

SEQ ID NO: 1314415 - RNA, 19 nt, Human
ucagcacaaggccaucugg

SEQ ID NO: 1314416 - RNA, 19 nt, Human
ucagacauagaauuaacac

SEQ ID NO: 1314417 - RNA, 22 nt, Human
ucagacauagaauuaacacaug

SEQ ID NO: 1314418 - RNA, 19 nt, Human
ucagacaucugagguuuua

SEQ ID NO: 1314419 - RNA, 22 nt, Human
ucagacaucugagguuuuauuu

SEQ ID NO: 1314420 - RNA, 14 nt, Human
ucagaccacaugcc

SEQ ID NO: 1314421 - RNA, 14 nt, Human
ucagaccacggcuc

SEQ ID NO: 1314422 - RNA, 17 nt, Human
ucagacuaagccagcac

SEQ ID NO: 1314423 - RNA, 19 nt, Human
ucagacucccauuccugaa

SEQ ID NO: 1314424 - RNA, 21 nt, Human
ucagacucccauuccugaaga

SEQ ID NO: 1314425 - RNA, 22 nt, Human
ucagacucccauuccugaagaa

SEQ ID NO: 1314426 - RNA, 19 nt, Human
ucagacucuaagaaagaac

SEQ ID NO: 1314427 - RNA, 15 nt, Human
ucagaccauaauguu

SEQ ID NO: 1314428 - RNA, 15 nt, Human
ucagacuaagccagc

SEQ ID NO: 1314429 - RNA, 17 nt, Human
ucagacucuaagaaaga

SEQ ID NO: 1314430 - RNA, 18 nt, Human
ucagacucuaagaaagaa

SEQ ID NO: 1314431 - RNA, 18 nt, Human
ucagacugacaguuuaca

SEQ ID NO: 1314432 - RNA, 17 nt, Human
ucacuugucaauaaaau

SEQ ID NO: 1314433 - RNA, 16 nt, Human
ucacuuguacaaaaua

SEQ ID NO: 1314434 - RNA, 17 nt, Human
ucacuuguacaaaauaa

SEQ ID NO: 1314435 - RNA, 19 nt, Human
ucacuugucaggagugugu

SEQ ID NO: 1314436 - RNA, 21 nt, Human
ucacuugucaggagugugugu

SEQ ID NO: 1314437 - RNA, 22 nt, Human
ucacuugucaggagugugugug

SEQ ID NO: 1314438 - RNA, 18 nt, Human
ucacuggcucuccuggcc

SEQ ID NO: 1314439 - RNA, 13 nt, Human
ucacuuguacaaa

SEQ ID NO: 1314440 - RNA, 14 nt, Human
ucacuuguacaaaa

SEQ ID NO: 1314441 - RNA, 15 nt, Human
ucacuuguacaaaau

SEQ ID NO: 1314442 - RNA, 20 nt, Human
ucacuggcgacacguagcag

SEQ ID NO: 1314443 - RNA, 22 nt, Human
ucacuggcgacacguagcagcu

SEQ ID NO: 1314444 - RNA, 13 nt, Human
ucacuggcucucc

SEQ ID NO: 1314445 - RNA, 12 nt, Human
ucacuggcucuc

SEQ ID NO: 1314446 - RNA, 17 nt, Human
ucacuggcucuccuggc

SEQ ID NO: 1314447 - RNA, 17 nt, Human
ucacucugaguguuuua

SEQ ID NO: 1314448 - RNA, 12 nt, Human
ucacuuuuauuu

SEQ ID NO: 1314449 - RNA, 22 nt, Human
ucacuuuuauuuagcaccaggg

SEQ ID NO: 1314450 - RNA, 13 nt, Human
ucacuuuucccac

SEQ ID NO: 1314451 - RNA, 14 nt, Human
ucacuuuucccacu

SEQ ID NO: 1314452 - RNA, 12 nt, Human
ucacuuuuccuc

SEQ ID NO: 1314453 - RNA, 17 nt, Human
ucacuugugcaguguug

SEQ ID NO: 1314454 - RNA, 14 nt, Human
ucacuuucuagauu

SEQ ID NO: 1314455 - RNA, 14 nt, Human
ucacuuucucaguu

SEQ ID NO: 1314456 - RNA, 19 nt, Human
ucacuuuuaaugaacaaau

SEQ ID NO: 1314457 - RNA, 21 nt, Human
ucacuuuuaaugaacaaaugg

SEQ ID NO: 1314458 - RNA, 13 nt, Human
ucacuuuuccucc

SEQ ID NO: 1314459 - RNA, 18 nt, Human
ucacuuuuccucccucag

SEQ ID NO: 1314460 - RNA, 18 nt, Human
ucacuuuugacaaaggca

SEQ ID NO: 1314461 - RNA, 15 nt, Human
ucacuuuucccacuc

SEQ ID NO: 1314462 - RNA, 13 nt, Human
ucacuuuuucuga

SEQ ID NO: 1314463 - RNA, 14 nt, Human
ucacuuuuucugau

SEQ ID NO: 1314464 - RNA, 16 nt, Human
ucacuuuuucugauaa

SEQ ID NO: 1314465 - RNA, 17 nt, Human
ucacuuuuucugauaaa

SEQ ID NO: 1314466 - RNA, 22 nt, Human
ucacuuuuugaggcaaaagaag

SEQ ID NO: 1314467 - RNA, 16 nt, Human
ucacuuuuugaggcaa

SEQ ID NO: 1314468 - RNA, 20 nt, Human
ucacuuuuugaggcaaaaga

SEQ ID NO: 1314469 - RNA, 20 nt, Human
ucagaaaauaucccuccugu

SEQ ID NO: 1314470 - RNA, 15 nt, Human
ucagaaaauguucug

SEQ ID NO: 1314471 - RNA, 18 nt, Human
ucagaaaauguucuguuu

SEQ ID NO: 1314472 - RNA, 19 nt, Human
ucagaaaauguucuguuug

SEQ ID NO: 1314473 - RNA, 23 nt, Human
ucagaaaauguucuguuugcugu

SEQ ID NO: 1314474 - RNA, 20 nt, Human
ucagaaaggaaaaacaaacu

SEQ ID NO: 1314475 - RNA, 17 nt, Human
ucagaaaggaaaaacaa

SEQ ID NO: 1314476 - RNA, 14 nt, Human
ucagaaagggaggg

SEQ ID NO: 1314477 - RNA, 17 nt, Human
ucagaaagggagggcuc

SEQ ID NO: 1314478 - RNA, 18 nt, Human
ucagaaagggagggcucu

SEQ ID NO: 1314479 - RNA, 19 nt, Human
ucagaaagggagggcucug

SEQ ID NO: 1314480 - RNA, 20 nt, Human
ucagaaagggagggcucuga

SEQ ID NO: 1314481 - RNA, 21 nt, Human
ucagaaagggagggcucugag

SEQ ID NO: 1314482 - RNA, 22 nt, Human
ucagaaagggagggcucugagg

SEQ ID NO: 1314483 - RNA, 23 nt, Human
ucagaaagggagggcucugaggc

SEQ ID NO: 1314484 - RNA, 15 nt, Human
ucagaaagugccuga

SEQ ID NO: 1314485 - RNA, 23 nt, Human
ucagaaagugccugacacacuaa

SEQ ID NO: 1314486 - RNA, 16 nt, Human
uauuuuauguugcaua

SEQ ID NO: 1314487 - RNA, 15 nt, Human
uauuuuauguugcau

SEQ ID NO: 1314488 - RNA, 17 nt, Human
uauuuuauauuguuaua

SEQ ID NO: 1314489 - RNA, 12 nt, Human
uauuuuauguua

SEQ ID NO: 1314490 - RNA, 14 nt, Human
uauuuuauguuaua

SEQ ID NO: 1314491 - RNA, 21 nt, Human
uauuuucaacgcagcccugcu

SEQ ID NO: 1314492 - RNA, 13 nt, Human
uauuuucaagaaa

SEQ ID NO: 1314493 - RNA, 16 nt, Human
uauuuucaagaaacug

SEQ ID NO: 1314494 - RNA, 19 nt, Human
uauuuucaauagccacuaa

SEQ ID NO: 1314495 - RNA, 21 nt, Human
uauuuuauguuauauauaaau

SEQ ID NO: 1314496 - RNA, 13 nt, Human
uauuuucaccauu

SEQ ID NO: 1314497 - RNA, 14 nt, Human
uauuuucaccauuu

SEQ ID NO: 1314498 - RNA, 14 nt, Human
uauuuucagaugug

SEQ ID NO: 1314499 - RNA, 18 nt, Human
uauuuucaauagccacua

SEQ ID NO: 1314500 - RNA, 19 nt, Human
uauuuucauccuugucuua

SEQ ID NO: 1314501 - RNA, 13 nt, Human
uauuuucuuggau

SEQ ID NO: 1314502 - RNA, 12 nt, Human
uauuuucuuucu

SEQ ID NO: 1314503 - RNA, 14 nt, Human
uauuuucauucaaa

SEQ ID NO: 1314504 - RNA, 12 nt, Human
uauuuugaauca

SEQ ID NO: 1314505 - RNA, 13 nt, Human
uauuuugaaucaa

SEQ ID NO: 1314506 - RNA, 15 nt, Human
uauuuugaaucaaua

SEQ ID NO: 1314507 - RNA, 16 nt, Human
uauuuugaaucaauaa

SEQ ID NO: 1314508 - RNA, 22 nt, Human
uauuuugaaucaauaauauauu

SEQ ID NO: 1314509 - RNA, 23 nt, Human
uauuuugaaucaauaauauauuu

SEQ ID NO: 1314510 - RNA, 18 nt, Human
uauuuugacauaaaguug

SEQ ID NO: 1314511 - RNA, 17 nt, Human
uauuuugacauaaaguu

SEQ ID NO: 1314512 - RNA, 12 nt, Human
uauuuuuuaauu

SEQ ID NO: 1314513 - RNA, 15 nt, Human
uauuuuuuaauuauu

SEQ ID NO: 1314514 - RNA, 22 nt, Human
uauuuuuuucugaauuauuuuc

SEQ ID NO: 1314515 - RNA, 17 nt, Human
uauuuuuuucuauuuuu

SEQ ID NO: 1314516 - RNA, 12 nt, Human
ucaaaaaaggca

SEQ ID NO: 1314517 - RNA, 16 nt, Human
uauuuuuuucugaaau

SEQ ID NO: 1314518 - RNA, 17 nt, Human
uauuuuuuucugaaauu

SEQ ID NO: 1314519 - RNA, 13 nt, Human
ucaaaaaauugca

SEQ ID NO: 1314520 - RNA, 13 nt, Human
ucaaaaacuauuu

SEQ ID NO: 1314521 - RNA, 17 nt, Human
ucaaaaacuuuggaguc

SEQ ID NO: 1314522 - RNA, 22 nt, Human
ucaaaaacuuuggaguccccuc

SEQ ID NO: 1314523 - RNA, 12 nt, Human
ucaaaaagaacc

SEQ ID NO: 1314524 - RNA, 12 nt, Human
ucaaaacauugu

SEQ ID NO: 1314525 - RNA, 22 nt, Human
ucaaaacauugugccaugucaa

SEQ ID NO: 1314526 - RNA, 22 nt, Human
ucaaaaccagguccaaugagcu

SEQ ID NO: 1314527 - RNA, 18 nt, Human
ucaaacuacauauuguaa

SEQ ID NO: 1314528 - RNA, 16 nt, Human
ucaaacuacuuugcug

SEQ ID NO: 1314529 - RNA, 21 nt, Human
ucaaacuacuuugcugcuaau

SEQ ID NO: 1314530 - RNA, 15 nt, Human
ucaaacgugaaaaug

SEQ ID NO: 1314531 - RNA, 16 nt, Human
ucaaacgugaaaaugc

SEQ ID NO: 1314532 - RNA, 15 nt, Human
ucaaaaccuuuugaa

SEQ ID NO: 1314533 - RNA, 16 nt, Human
ucaaaacuacaaauca

SEQ ID NO: 1314534 - RNA, 23 nt, Human
ucaaacggccucacuaggcuucu

SEQ ID NO: 1314535 - RNA, 13 nt, Human
uauuuauuacugu

SEQ ID NO: 1314536 - RNA, 22 nt, Human
uauuucuaugaaauauuauguu

SEQ ID NO: 1314537 - RNA, 14 nt, Human
uauuuauugguuuu

SEQ ID NO: 1314538 - RNA, 13 nt, Human
uauuuauuguauu

SEQ ID NO: 1314539 - RNA, 17 nt, Human
uauuuauuguauucugg

SEQ ID NO: 1314540 - RNA, 21 nt, Human
uauuucuaugaaauauuaugu

SEQ ID NO: 1314541 - RNA, 20 nt, Human
uaucugaauuuuuaaacaag

SEQ ID NO: 1314542 - RNA, 19 nt, Human
uaucugaauuuuuaaacaa

SEQ ID NO: 1314543 - RNA, 17 nt, Human
uauuucugcauauguug

SEQ ID NO: 1314544 - RNA, 14 nt, Human
uauuucugccuccc

SEQ ID NO: 1314545 - RNA, 22 nt, Human
uauuucuguaauuauaucuaaa

SEQ ID NO: 1314546 - RNA, 13 nt, Human
uauuucuuaaaca

SEQ ID NO: 1314547 - RNA, 16 nt, Human
uauuucuuaaacacuu

SEQ ID NO: 1314548 - RNA, 19 nt, Human
uauuucuuaaaucuaguaa

SEQ ID NO: 1314549 - RNA, 14 nt, Human
uauuugauguaaua

SEQ ID NO: 1314550 - RNA, 19 nt, Human
uauuugauguaauacuucu

SEQ ID NO: 1314551 - RNA, 14 nt, Human
uauuugcuaauuuu

SEQ ID NO: 1314552 - RNA, 11 nt, Human
uauuugcuuuu

SEQ ID NO: 1314553 - RNA, 16 nt, Human
uauuuggaaauaaagu

SEQ ID NO: 1314554 - RNA, 17 nt, Human
uauuuggaaauaaaguc

SEQ ID NO: 1314555 - RNA, 19 nt, Human
uauuuggaaauaaagucag

SEQ ID NO: 1314556 - RNA, 14 nt, Human
uauuugggaaguga

SEQ ID NO: 1314557 - RNA, 15 nt, Human
uauuugggaagugaa

SEQ ID NO: 1314558 - RNA, 23 nt, Human
uauuugggccugcuccagaccug

SEQ ID NO: 1314559 - RNA, 21 nt, Human
uauuuuagugaacuugaaaua

SEQ ID NO: 1314560 - RNA, 19 nt, Human
ucaacuccaaacugacucu

SEQ ID NO: 1314561 - RNA, 15 nt, Human
ucaacuaggaucaga

SEQ ID NO: 1314562 - RNA, 23 nt, Human
ucaagcagcgaccgcccccuccu

SEQ ID NO: 1314563 - RNA, 16 nt, Human
ucaagcagucgugccu

SEQ ID NO: 1314564 - RNA, 17 nt, Human
ucaagcagucgugccug

SEQ ID NO: 1314565 - RNA, 18 nt, Human
ucaagcagucgugccugu

SEQ ID NO: 1314566 - RNA, 11 nt, Human
ucaaccucauc

SEQ ID NO: 1314567 - RNA, 12 nt, Human
ucaaccucccaa

SEQ ID NO: 1314568 - RNA, 21 nt, Human
ucaacggaaagugcugucuua

SEQ ID NO: 1314569 - RNA, 15 nt, Human
ucaacguauuguuuc

SEQ ID NO: 1314570 - RNA, 20 nt, Human
ucaaacuacuuugcugcuaa

SEQ ID NO: 1314571 - RNA, 18 nt, Human
ucaaacuccugaccucag

SEQ ID NO: 1314572 - RNA, 20 nt, Human
ucaaacuccugaccucaggc

SEQ ID NO: 1314573 - RNA, 21 nt, Human
ucaaacuccugaccucaggca

SEQ ID NO: 1314574 - RNA, 15 nt, Human
ucaaacugaggaauu

SEQ ID NO: 1314575 - RNA, 12 nt, Human
ucaaagaaagug

SEQ ID NO: 1314576 - RNA, 14 nt, Human
ucaaagaaagugua

SEQ ID NO: 1314577 - RNA, 15 nt, Human
ucaaagaaaguguau

SEQ ID NO: 1314578 - RNA, 16 nt, Human
ucaaagaaaguguauu

SEQ ID NO: 1314579 - RNA, 15 nt, Human
ucaagcgauucuccu

SEQ ID NO: 1314580 - RNA, 19 nt, Human
ucaagcagucgugccugug

SEQ ID NO: 1314581 - RNA, 20 nt, Human
ucaagcagucgugccugugu

SEQ ID NO: 1314582 - RNA, 21 nt, Human
ucaagcagucgugccuguguc

SEQ ID NO: 1314583 - RNA, 22 nt, Human
ucaagcagucgugccugugucc

SEQ ID NO: 1314584 - RNA, 23 nt, Human
ucaagcagucgugccugugucca

SEQ ID NO: 1314585 - RNA, 16 nt, Human
ucaagccccggacuca

SEQ ID NO: 1314586 - RNA, 11 nt, Human
ucaagcucuga

SEQ ID NO: 1314587 - RNA, 12 nt, Human
ucaagcucugag

SEQ ID NO: 1314588 - RNA, 13 nt, Human
ucaagcucugagg

SEQ ID NO: 1314589 - RNA, 15 nt, Human
ucaagcucugaggga

SEQ ID NO: 1314590 - RNA, 21 nt, Human
ucaagcucugagggaaagggc

SEQ ID NO: 1314591 - RNA, 18 nt, Human
ucaagcucugagggaaag

SEQ ID NO: 1314592 - RNA, 20 nt, Human
ucaagcugaguauuaaaaug

SEQ ID NO: 1314593 - RNA, 23 nt, Human
ucaagcugaguauuaaaauguau

SEQ ID NO: 1314594 - RNA, 21 nt, Human
ucaagcugaguauuaaaaugu

SEQ ID NO: 1314595 - RNA, 23 nt, Human
ucacaggacagcccuucuuucca

SEQ ID NO: 1314596 - RNA, 19 nt, Human
ucacaggaaguagaggagg

SEQ ID NO: 1314597 - RNA, 14 nt, Human
ucacacaaagcaga

SEQ ID NO: 1314598 - RNA, 20 nt, Human
ucacacaggcauuuccuggg

SEQ ID NO: 1314599 - RNA, 21 nt, Human
ucacacaggcauuuccugggu

SEQ ID NO: 1314600 - RNA, 23 nt, Human
ucacacaggcauuuccugggugg

SEQ ID NO: 1314601 - RNA, 16 nt, Human
ucacaauaauuuucua

SEQ ID NO: 1314602 - RNA, 15 nt, Human
ucacaauaauuuucu

SEQ ID NO: 1314603 - RNA, 15 nt, Human
ucacaaugagauuga

SEQ ID NO: 1314604 - RNA, 13 nt, Human
ucacacaaagcag

SEQ ID NO: 1314605 - RNA, 13 nt, Human
ucaaugcagcccc

SEQ ID NO: 1314606 - RNA, 17 nt, Human
ucaaugcuauaacuaug

SEQ ID NO: 1314607 - RNA, 14 nt, Human
ucaauggggccagu

SEQ ID NO: 1314608 - RNA, 15 nt, Human
ucaauacagauauau

SEQ ID NO: 1314609 - RNA, 16 nt, Human
ucaauacagauauauu

SEQ ID NO: 1314610 - RNA, 19 nt, Human
ucaauacagauauauuuuc

SEQ ID NO: 1314611 - RNA, 14 nt, Human
ucaauacagauaua

SEQ ID NO: 1314612 - RNA, 12 nt, Human
ucaauagccacu

SEQ ID NO: 1314613 - RNA, 13 nt, Human
ucaauagccacua

SEQ ID NO: 1314614 - RNA, 23 nt, Human
ucaauagccacuaaccuugccug

SEQ ID NO: 1314615 - RNA, 22 nt, Human
ucaauagccacuaaccuugccu

SEQ ID NO: 1314616 - RNA, 16 nt, Human
guuuaguaaucauauu

SEQ ID NO: 1314617 - RNA, 20 nt, Human
guuuagcugacaaaauacuu

SEQ ID NO: 1314618 - RNA, 14 nt, Human
guuuaggcuauuug

SEQ ID NO: 1314619 - RNA, 17 nt, Human
guuuagcugacaaaaua

SEQ ID NO: 1314620 - RNA, 15 nt, Human
guuuagcugacaaaa

SEQ ID NO: 1314621 - RNA, 14 nt, Human
guuuagcugacaaa

SEQ ID NO: 1314622 - RNA, 16 nt, Human
guuuagcucugagaac

SEQ ID NO: 1314623 - RNA, 14 nt, Human
guuuagcucugaga

SEQ ID NO: 1314624 - RNA, 15 nt, Human
guuuagcucugagaa

SEQ ID NO: 1314625 - RNA, 15 nt, Human
guuuaggcuauuugu

SEQ ID NO: 1314626 - RNA, 22 nt, Human
guuuaggcuauuuguaaaucug

SEQ ID NO: 1314627 - RNA, 23 nt, Human
guuuaggcuauuuguaaaucugc

SEQ ID NO: 1314628 - RNA, 16 nt, Human
guuuagggaacaauuu

SEQ ID NO: 1314629 - RNA, 17 nt, Human
guuuagggaacaauuug

SEQ ID NO: 1314630 - RNA, 20 nt, Human
guuuagcuggaaaaguaugu

SEQ ID NO: 1314631 - RNA, 12 nt, Human
guuuagcucuga

SEQ ID NO: 1314632 - RNA, 13 nt, Human
guuuagcucugag

SEQ ID NO: 1314633 - RNA, 20 nt, Human
guuuagauuuaugguuguua

SEQ ID NO: 1314634 - RNA, 14 nt, Human
gguugcagacagga

SEQ ID NO: 1314635 - RNA, 16 nt, Human
gguuggcucugccagu

SEQ ID NO: 1314636 - RNA, 20 nt, Human
gguuggcucugccaguccug

SEQ ID NO: 1314637 - RNA, 16 nt, Human
guuuacuuguuucaga

SEQ ID NO: 1314638 - RNA, 17 nt, Human
guuuagaaagcuugccc

SEQ ID NO: 1314639 - RNA, 13 nt, Human
guuuagaaagcuu

SEQ ID NO: 1314640 - RNA, 16 nt, Human
guuuccuuauauuaug

SEQ ID NO: 1314641 - RNA, 22 nt, Human
guuuccugcccugggaggcagu

SEQ ID NO: 1314642 - RNA, 13 nt, Human
guuuccugcccug

SEQ ID NO: 1314643 - RNA, 17 nt, Human
guuuccugcccugggag

SEQ ID NO: 1314644 - RNA, 16 nt, Human
guuucccaagagcuac

SEQ ID NO: 1314645 - RNA, 14 nt, Human
guuucccaggccca

SEQ ID NO: 1314646 - RNA, 22 nt, Human
guuuccugaaacaacuuggaaa

SEQ ID NO: 1314647 - RNA, 18 nt, Human
guuucagcgacuccguug

SEQ ID NO: 1314648 - RNA, 12 nt, Human
guuucagcacua

SEQ ID NO: 1314649 - RNA, 23 nt, Human
guuucagcacuagccaaaccuca

SEQ ID NO: 1314650 - RNA, 22 nt, Human
guuucaggagagaguugaaccu

SEQ ID NO: 1314651 - RNA, 23 nt, Human
guuucaggagagaguugaaccua

SEQ ID NO: 1314652 - RNA, 19 nt, Human
guuucauuuagucauguga

SEQ ID NO: 1314653 - RNA, 20 nt, Human
guuucauuuagucaugugac

SEQ ID NO: 1314654 - RNA, 21 nt, Human
guuucauuuagucaugugacc

SEQ ID NO: 1314655 - RNA, 16 nt, Human
guuuccacagccugca

SEQ ID NO: 1314656 - RNA, 13 nt, Human
guuuccagcauuc

SEQ ID NO: 1314657 - RNA, 16 nt, Human
guuuccagcauuccca

SEQ ID NO: 1314658 - RNA, 19 nt, Human
guuuccagcauucccaggu

SEQ ID NO: 1314659 - RNA, 18 nt, Human
guuucuuuguaaugaaaa

SEQ ID NO: 1314660 - RNA, 17 nt, Human
guuucuuuguaaugaaa

SEQ ID NO: 1314661 - RNA, 14 nt, Human
guuucuuuguaaug

SEQ ID NO: 1314662 - RNA, 19 nt, Human
guuucuuucucugaggaca

SEQ ID NO: 1314663 - RNA, 20 nt, Human
guuucuuucucugaggacaa

SEQ ID NO: 1314664 - RNA, 12 nt, Human
guuucuuucuuu

SEQ ID NO: 1314665 - RNA, 23 nt, Human
guuucuuucuuucuuuauuuuga

SEQ ID NO: 1314666 - RNA, 18 nt, Human
guuucuaaacuggagacu

SEQ ID NO: 1314667 - RNA, 19 nt, Human
guuuccuugggaguuguca

SEQ ID NO: 1314668 - RNA, 15 nt, Human
guuucguggggaggu

SEQ ID NO: 1314669 - RNA, 23 nt, Human
guuucguggggaggucuaaucua

SEQ ID NO: 1314670 - RNA, 15 nt, Human
guuucuaaacuggag

SEQ ID NO: 1314671 - RNA, 17 nt, Human
guuucuaaacuggagac

SEQ ID NO: 1314672 - RNA, 16 nt, Human
guuugugacagggcgg

SEQ ID NO: 1314673 - RNA, 17 nt, Human
guuugugacagggcggg

SEQ ID NO: 1314674 - RNA, 19 nt, Human
guuuguggaaaaugaaaau

SEQ ID NO: 1314675 - RNA, 19 nt, Human
guuugugcuguaaagaguu

SEQ ID NO: 1314676 - RNA, 20 nt, Human
guuugaugaggcccuccaca

SEQ ID NO: 1314677 - RNA, 15 nt, Human
guuugagauucucaa

SEQ ID NO: 1314678 - RNA, 16 nt, Human
guuugauagauuuucu

SEQ ID NO: 1314679 - RNA, 15 nt, Human
guuugaugaggcccu

SEQ ID NO: 1314680 - RNA, 19 nt, Human
guuugaugaggcccuccac

SEQ ID NO: 1314681 - RNA, 11 nt, Human
uaaaaaacacu

SEQ ID NO: 1314682 - RNA, 22 nt, Human
uaaaaaaauaagaagaaugcuu

SEQ ID NO: 1314683 - RNA, 15 nt, Human
uaaaaaaauaagaag

SEQ ID NO: 1314684 - RNA, 20 nt, Human
uaaaaaaauaagaagaaugc

SEQ ID NO: 1314685 - RNA, 15 nt, Human
uaaaaaaaagaugaa

SEQ ID NO: 1314686 - RNA, 23 nt, Human
guuuuucagguauauaccuccau

SEQ ID NO: 1314687 - RNA, 16 nt, Human
guuuuucacauuuucc

SEQ ID NO: 1314688 - RNA, 12 nt, Human
guuuuucacauu

SEQ ID NO: 1314689 - RNA, 14 nt, Human
guuuuucacauuuu

SEQ ID NO: 1314690 - RNA, 19 nt, Human
uaaaaaaaaagaucuguuu

SEQ ID NO: 1314691 - RNA, 21 nt, Human
guuuuuauuuccuaugaugua

SEQ ID NO: 1314692 - RNA, 20 nt, Human
guuuuuauuuccuaugaugu

SEQ ID NO: 1314693 - RNA, 19 nt, Human
guuuuuauuuccuaugaug

SEQ ID NO: 1314694 - RNA, 16 nt, Human
guuuuuauuuccuaug

SEQ ID NO: 1314695 - RNA, 14 nt, Human
guuuuuauuuccua

SEQ ID NO: 1314696 - RNA, 21 nt, Human
guuuuuaucugaaaucaauua

SEQ ID NO: 1314697 - RNA, 17 nt, Human
guuuuuaugagaaacuu

SEQ ID NO: 1314698 - RNA, 15 nt, Human
guuuuuaugagaaac

SEQ ID NO: 1314699 - RNA, 17 nt, Human
uaaaaacaaagaaauua

SEQ ID NO: 1314700 - RNA, 19 nt, Human
uaaaaaaugguucagaauu

SEQ ID NO: 1314701 - RNA, 12 nt, Human
uaaaaaaugguu

SEQ ID NO: 1314702 - RNA, 14 nt, Human
uaaaaaauggucac

SEQ ID NO: 1314703 - RNA, 19 nt, Human
uaaaaaagcuuaaaacuuu

SEQ ID NO: 1314704 - RNA, 17 nt, Human
uaaaaaagaucccaaau

SEQ ID NO: 1314705 - RNA, 17 nt, Human
uaaaaaagcuuaaaacu

SEQ ID NO: 1314706 - RNA, 18 nt, Human
uaaaaaagcuuaaaacuu

SEQ ID NO: 1314707 - RNA, 22 nt, Human
uaaaaaaguuuagaaugugugu

SEQ ID NO: 1314708 - RNA, 15 nt, Human
uaaaaaccuguucaa

SEQ ID NO: 1314709 - RNA, 20 nt, Human
uaaaaacuagaggugagaaa

SEQ ID NO: 1314710 - RNA, 14 nt, Human
uaaaaacucaagga

SEQ ID NO: 1314711 - RNA, 21 nt, Human
uaaaaacugagugacucuaua

SEQ ID NO: 1314712 - RNA, 16 nt, Human
uaaaaacugagugacu

SEQ ID NO: 1314713 - RNA, 18 nt, Human
uaaaaagaaaaaugugua

SEQ ID NO: 1314714 - RNA, 19 nt, Human
uaaaaaugauuucaguagc

SEQ ID NO: 1314715 - RNA, 16 nt, Human
uaaaaaagaaacauuu

SEQ ID NO: 1314716 - RNA, 15 nt, Human
uaaaaaaccacaugg

SEQ ID NO: 1314717 - RNA, 17 nt, Human
uaaaaaacuaaaaacua

SEQ ID NO: 1314718 - RNA, 19 nt, Human
uaaaaaacuaaaaacuaga

SEQ ID NO: 1314719 - RNA, 12 nt, Human
uaaaaaagauaa

SEQ ID NO: 1314720 - RNA, 13 nt, Human
uaaaaaagauaaa

SEQ ID NO: 1314721 - RNA, 16 nt, Human
uaaaaaagauaaacac

SEQ ID NO: 1314722 - RNA, 17 nt, Human
uaaaaaagauaaacaca

SEQ ID NO: 1314723 - RNA, 20 nt, Human
uaaaaaagcuuaaaacuuug

SEQ ID NO: 1314724 - RNA, 12 nt, Human
uaaaaaacacug

SEQ ID NO: 1314725 - RNA, 11 nt, Human
uaaaaaacaac

SEQ ID NO: 1314726 - RNA, 18 nt, Human
guuuucaggcuagaugua

SEQ ID NO: 1314727 - RNA, 18 nt, Human
guuuucauccauaacuga

SEQ ID NO: 1314728 - RNA, 16 nt, Human
guuuguugugaggauu

SEQ ID NO: 1314729 - RNA, 23 nt, Human
guuugugccuuuuuauuuuuguu

SEQ ID NO: 1314730 - RNA, 22 nt, Human
guuuguugguugguuuucuucu

SEQ ID NO: 1314731 - RNA, 18 nt, Human
guuuguuuacaaaaucag

SEQ ID NO: 1314732 - RNA, 17 nt, Human
guuuucauuugguucau

SEQ ID NO: 1314733 - RNA, 16 nt, Human
guuuucauuugguuca

SEQ ID NO: 1314734 - RNA, 19 nt, Human
guuuucauccauaacugaa

SEQ ID NO: 1314735 - RNA, 20 nt, Human
guuuucauccauaacugaac

SEQ ID NO: 1314736 - RNA, 21 nt, Human
guuuucauccauaacugaaca

SEQ ID NO: 1314737 - RNA, 23 nt, Human
guuuucuaguguaucaaaaugcu

SEQ ID NO: 1314738 - RNA, 14 nt, Human
guuuucuaguguau

SEQ ID NO: 1314739 - RNA, 14 nt, Human
guuuucuaauugcu

SEQ ID NO: 1314740 - RNA, 13 nt, Human
guuuucuccuccc

SEQ ID NO: 1314741 - RNA, 16 nt, Human
guuuucuccucccagg

SEQ ID NO: 1314742 - RNA, 18 nt, Human
guuuucuccucccaggaa

SEQ ID NO: 1314743 - RNA, 21 nt, Human
guuuucuccucccaggaacug

SEQ ID NO: 1314744 - RNA, 18 nt, Human
guuuucuccaagagcuac

SEQ ID NO: 1314745 - RNA, 17 nt, Human
guuuucucucggcuccc

SEQ ID NO: 1314746 - RNA, 14 nt, Human
guuuucgaaaauca

SEQ ID NO: 1314747 - RNA, 16 nt, Human
guuuucgaaaaucaaa

SEQ ID NO: 1314748 - RNA, 11 nt, Human
guuuucuaauu

SEQ ID NO: 1314749 - RNA, 12 nt, Human
guuuucuaauug

SEQ ID NO: 1314750 - RNA, 19 nt, Human
guuuucucucggcucccca

SEQ ID NO: 1314751 - RNA, 14 nt, Human
guuuucucugaaca

SEQ ID NO: 1314752 - RNA, 17 nt, Human
guuuucugaaaauauaa

SEQ ID NO: 1314753 - RNA, 12 nt, Human
guuuuguauucu

SEQ ID NO: 1314754 - RNA, 15 nt, Human
guuuuguauucucug

SEQ ID NO: 1314755 - RNA, 14 nt, Human
guuuugugucucuu

SEQ ID NO: 1314756 - RNA, 16 nt, Human
guuuugugucucuuau

SEQ ID NO: 1314757 - RNA, 15 nt, Human
guuuuguuuuuacaa

SEQ ID NO: 1314758 - RNA, 14 nt, Human
guuuuuacugcucu

SEQ ID NO: 1314759 - RNA, 18 nt, Human
guuuuuacugcucugaga

SEQ ID NO: 1314760 - RNA, 16 nt, Human
guuuuuacugcucuga

SEQ ID NO: 1314761 - RNA, 13 nt, Human
guuuuuaaacugu

SEQ ID NO: 1314762 - RNA, 14 nt, Human
guuuuuaaacugua

SEQ ID NO: 1314763 - RNA, 15 nt, Human
guuuuuaaacuguac

SEQ ID NO: 1314764 - RNA, 16 nt, Human
guuuuuaaacuguaca

SEQ ID NO: 1314765 - RNA, 17 nt, Human
guuuuuaaacuguacag

SEQ ID NO: 1314766 - RNA, 18 nt, Human
guuuuuaaacuguacagu

SEQ ID NO: 1314767 - RNA, 20 nt, Human
guuuuuaaacuguacagugu

SEQ ID NO: 1314768 - RNA, 22 nt, Human
guuuuuaaacuguacagugucu

SEQ ID NO: 1314769 - RNA, 16 nt, Human
uaaaaugagaaaucua

SEQ ID NO: 1314770 - RNA, 15 nt, Human
uaaaaugagaaaucu

SEQ ID NO: 1314771 - RNA, 21 nt, Human
uaaaaugacaaucaugugugu

SEQ ID NO: 1314772 - RNA, 17 nt, Human
uaaaaugacaaucaugu

SEQ ID NO: 1314773 - RNA, 18 nt, Human
uaaaaugacaaucaugug

SEQ ID NO: 1314774 - RNA, 19 nt, Human
uaaaaugacaaucaugugu

SEQ ID NO: 1314775 - RNA, 23 nt, Human
uaaaaugauauuguuauauacau

SEQ ID NO: 1314776 - RNA, 13 nt, Human
uaaaaugagaaau

SEQ ID NO: 1314777 - RNA, 23 nt, Human
uaaaaucuugucauguguauaaa

SEQ ID NO: 1314778 - RNA, 14 nt, Human
uaaaaugacaauca

SEQ ID NO: 1314779 - RNA, 21 nt, Human
uaaaaucugcuuguauuccaa

SEQ ID NO: 1314780 - RNA, 13 nt, Human
uaaaaucugucac

SEQ ID NO: 1314781 - RNA, 20 nt, Human
uaaaaucuugucauguguau

SEQ ID NO: 1314782 - RNA, 21 nt, Human
uaaaaucuugucauguguaua

SEQ ID NO: 1314783 - RNA, 22 nt, Human
uaaaaucuugucauguguauaa

SEQ ID NO: 1314784 - RNA, 13 nt, Human
uaaaauauuuauu

SEQ ID NO: 1314785 - RNA, 14 nt, Human
uaaaauauuuugaa

SEQ ID NO: 1314786 - RNA, 16 nt, Human
uaaaauauuuugaauc

SEQ ID NO: 1314787 - RNA, 20 nt, Human
uaaaauauuuugaaucaaua

SEQ ID NO: 1314788 - RNA, 19 nt, Human
uaaaauccauacauuugug

SEQ ID NO: 1314789 - RNA, 15 nt, Human
uaaaauccucaaucc

SEQ ID NO: 1314790 - RNA, 21 nt, Human
uaaaagggacugagaaauuua

SEQ ID NO: 1314791 - RNA, 20 nt, Human
uaaaagggacugagaaauuu

SEQ ID NO: 1314792 - RNA, 19 nt, Human
uaaaagggacugagaaauu

SEQ ID NO: 1314793 - RNA, 17 nt, Human
uaaaagggacugagaaa

SEQ ID NO: 1314794 - RNA, 14 nt, Human
uaaaagcauuuugu

SEQ ID NO: 1314795 - RNA, 15 nt, Human
uaaaagcauuuugua

SEQ ID NO: 1314796 - RNA, 16 nt, Human
uaaaagcauuuuguaa

SEQ ID NO: 1314797 - RNA, 17 nt, Human
uaaaagcauuuuguaau

SEQ ID NO: 1314798 - RNA, 18 nt, Human
uaaaagcauuuuguaaua

SEQ ID NO: 1314799 - RNA, 12 nt, Human
uaaaagccugcu

SEQ ID NO: 1314800 - RNA, 14 nt, Human
uaaaagccugcuca

SEQ ID NO: 1314801 - RNA, 22 nt, Human
uaaaaauggaaacuauauugac

SEQ ID NO: 1314802 - RNA, 15 nt, Human
uaaaaaugaucuaaa

SEQ ID NO: 1314803 - RNA, 16 nt, Human
uaaaaaugauuucagu

SEQ ID NO: 1314804 - RNA, 23 nt, Human
uaaaaauggcaggggguggaauu

SEQ ID NO: 1314805 - RNA, 15 nt, Human
uaaaaaugguuuaaa

SEQ ID NO: 1314806 - RNA, 13 nt, Human
uaaaagaugaaag

SEQ ID NO: 1314807 - RNA, 17 nt, Human
uaaaagaugaaagagca

SEQ ID NO: 1314808 - RNA, 12 nt, Human
uaaaagaugcuu

SEQ ID NO: 1314809 - RNA, 14 nt, Human
uaaaagaugcuuuu

SEQ ID NO: 1314810 - RNA, 15 nt, Human
uaaaagaugcuuuua

SEQ ID NO: 1314811 - RNA, 21 nt, Human
uaaacacucuugaaaaaugca

SEQ ID NO: 1314812 - RNA, 22 nt, Human
uaaacaaguauuuguuaauuua

SEQ ID NO: 1314813 - RNA, 22 nt, Human
uaaacacaagauugguguuuuu

SEQ ID NO: 1314814 - RNA, 22 nt, Human
uaaacagauguccaucagauga

SEQ ID NO: 1314815 - RNA, 21 nt, Human
uaaacagauguccaucagaug

SEQ ID NO: 1314816 - RNA, 16 nt, Human
uaaacagauguccauc

SEQ ID NO: 1314817 - RNA, 14 nt, Human
uaaacacagacagg

SEQ ID NO: 1314818 - RNA, 20 nt, Human
uaaacacaagauugguguuu

SEQ ID NO: 1314819 - RNA, 16 nt, Human
uaaacacuugcaaccu

SEQ ID NO: 1314820 - RNA, 14 nt, Human
uaaacaagaaaaau

SEQ ID NO: 1314821 - RNA, 17 nt, Human
uaaacaagaaaaauaaa

SEQ ID NO: 1314822 - RNA, 18 nt, Human
uaaacaagaaaaauaaag

SEQ ID NO: 1314823 - RNA, 19 nt, Human
uaaacaagaaaaauaaaga

SEQ ID NO: 1314824 - RNA, 21 nt, Human
uaaacaagaaaaauaaagaaa

SEQ ID NO: 1314825 - RNA, 20 nt, Human
uaaacaagaaaaauaaagaa

SEQ ID NO: 1314826 - RNA, 13 nt, Human
uaaacaaguauuu

SEQ ID NO: 1314827 - RNA, 18 nt, Human
uaaacaaguauuuguuaa

SEQ ID NO: 1314828 - RNA, 23 nt, Human
uaaacaaguauuuguuaauuuag

SEQ ID NO: 1314829 - RNA, 13 nt, Human
uaaacaagaaaaa

SEQ ID NO: 1314830 - RNA, 16 nt, Human
uaaaaugauuguagua

SEQ ID NO: 1314831 - RNA, 14 nt, Human
uaaaaugcuagguu

SEQ ID NO: 1314832 - RNA, 16 nt, Human
uaaaaugcuagguucu

SEQ ID NO: 1314833 - RNA, 17 nt, Human
uaaaaugcuagguucua

SEQ ID NO: 1314834 - RNA, 20 nt, Human
uaaaaugcuagguucuaccu

SEQ ID NO: 1314835 - RNA, 23 nt, Human
uaaaaugcuuacauuugaacuug

SEQ ID NO: 1314836 - RNA, 18 nt, Human
uaaacuguacagugucuu

SEQ ID NO: 1314837 - RNA, 16 nt, Human
uaaacuggagacugug

SEQ ID NO: 1314838 - RNA, 12 nt, Human
uaaacuguacag

SEQ ID NO: 1314839 - RNA, 13 nt, Human
uaaacuguacagu

SEQ ID NO: 1314840 - RNA, 14 nt, Human
uaaacuguacagug

SEQ ID NO: 1314841 - RNA, 15 nt, Human
uaaacuguacagugu

SEQ ID NO: 1314842 - RNA, 17 nt, Human
uaaacuguacagugucu

SEQ ID NO: 1314843 - RNA, 16 nt, Human
uaaacuuuaucacuua

SEQ ID NO: 1314844 - RNA, 20 nt, Human
uaaacugcccccucugcccu

SEQ ID NO: 1314845 - RNA, 21 nt, Human
uaaacugcccccucugcccug

SEQ ID NO: 1314846 - RNA, 22 nt, Human
uaaacaguugcacagcaucuca

SEQ ID NO: 1314847 - RNA, 22 nt, Human
uaaacugcccccucugcccugc

SEQ ID NO: 1314848 - RNA, 23 nt, Human
uaaacugcccccucugcccugcg

SEQ ID NO: 1314849 - RNA, 12 nt, Human
uaaacuggagac

SEQ ID NO: 1314850 - RNA, 13 nt, Human
uaaacuggagacu

SEQ ID NO: 1314851 - RNA, 14 nt, Human
uaaacuggagacug

SEQ ID NO: 1314852 - RNA, 23 nt, Human
uaaacuggagacugugugugccc

SEQ ID NO: 1314853 - RNA, 19 nt, Human
uaaacaguugcacagcauc

SEQ ID NO: 1314854 - RNA, 18 nt, Human
uaaacaguugcacagcau

SEQ ID NO: 1314855 - RNA, 17 nt, Human
uaaacaguugcacagca

SEQ ID NO: 1314856 - RNA, 16 nt, Human
uaaacaguugcacagc

SEQ ID NO: 1314857 - RNA, 20 nt, Human
uaaacagugagccugaauuu

SEQ ID NO: 1314858 - RNA, 23 nt, Human
uaaacagugagccugaauuuugu

SEQ ID NO: 1314859 - RNA, 23 nt, Human
uaaacagauguccaucagaugac

SEQ ID NO: 1314860 - RNA, 22 nt, Human
uaaauauauuuuaagacgaaac

SEQ ID NO: 1314861 - RNA, 16 nt, Human
uaaauauauuuuaaga

SEQ ID NO: 1314862 - RNA, 23 nt, Human
uaaauauauuauuacuuguaaau

SEQ ID NO: 1314863 - RNA, 18 nt, Human
uaaauauaugcuaagucu

SEQ ID NO: 1314864 - RNA, 13 nt, Human
uaaauauauuauu

SEQ ID NO: 1314865 - RNA, 14 nt, Human
uaaauauauuauua

SEQ ID NO: 1314866 - RNA, 15 nt, Human
uaaauauauuauuac

SEQ ID NO: 1314867 - RNA, 17 nt, Human
uaaauauauuauuacuu

SEQ ID NO: 1314868 - RNA, 18 nt, Human
uaaauauauuauuacuug

SEQ ID NO: 1314869 - RNA, 20 nt, Human
uaaauauauuauuacuugua

SEQ ID NO: 1314870 - RNA, 21 nt, Human
uaaauauauuauuacuuguaa

SEQ ID NO: 1314871 - RNA, 22 nt, Human
uaaauauauuauuacuuguaaa

SEQ ID NO: 1314872 - RNA, 17 nt, Human
uaaauauauuuaagaua

SEQ ID NO: 1314873 - RNA, 22 nt, Human
uaaauauauuuaagauaauuau

SEQ ID NO: 1314874 - RNA, 17 nt, Human
uaaauaaaaugcuaggu

SEQ ID NO: 1314875 - RNA, 20 nt, Human
uaaauaaaaugcuagguucu

SEQ ID NO: 1314876 - RNA, 21 nt, Human
uaaauaaaaugcuagguucua

SEQ ID NO: 1314877 - RNA, 22 nt, Human
uaaauaaaaugcuagguucuac

SEQ ID NO: 1314878 - RNA, 23 nt, Human
uaaauaaaaugcuagguucuacc

SEQ ID NO: 1314879 - RNA, 13 nt, Human
uaaauaaaauuug

SEQ ID NO: 1314880 - RNA, 14 nt, Human
uaaauaaaauuugu

SEQ ID NO: 1314881 - RNA, 20 nt, Human
uaaauaaaauuuguugcaua

SEQ ID NO: 1314882 - RNA, 13 nt, Human
uaaauaaacccuu

SEQ ID NO: 1314883 - RNA, 14 nt, Human
uaaauauaucuacc

SEQ ID NO: 1314884 - RNA, 18 nt, Human
uaaauauaucuaccccag

SEQ ID NO: 1314885 - RNA, 20 nt, Human
uaaauauaucuaccccagac

SEQ ID NO: 1314886 - RNA, 15 nt, Human
uaaaucauuuuaugu

SEQ ID NO: 1314887 - RNA, 13 nt, Human
uaaaucauuuuau

SEQ ID NO: 1314888 - RNA, 12 nt, Human
uaaaucauuuua

SEQ ID NO: 1314889 - RNA, 17 nt, Human
uaaaucaguaagaggug

SEQ ID NO: 1314890 - RNA, 19 nt, Human
uaaaucacgcuuuuugaaa

SEQ ID NO: 1314891 - RNA, 21 nt, Human
uaaaucacgcuuuuugaaaaa

SEQ ID NO: 1314892 - RNA, 22 nt, Human
uaaaucacgcuuuuugaaaaag

SEQ ID NO: 1314893 - RNA, 18 nt, Human
uaaaucaguaagaggugu

SEQ ID NO: 1314894 - RNA, 20 nt, Human
uaaaucagacuaugaaguuu

SEQ ID NO: 1314895 - RNA, 19 nt, Human
uaaaucaaguuggcuucua

SEQ ID NO: 1314896 - RNA, 22 nt, Human
uaaauauuuuuucuuuucuauu

SEQ ID NO: 1314897 - RNA, 13 nt, Human
uaaaucaauaaag

SEQ ID NO: 1314898 - RNA, 17 nt, Human
uaaauauuuuaaagaau

SEQ ID NO: 1314899 - RNA, 16 nt, Human
uaaaucacgcuuuuug

SEQ ID NO: 1314900 - RNA, 18 nt, Human
uaaaucacgcuuuuugaa

SEQ ID NO: 1314901 - RNA, 17 nt, Human
uaaauauggacugcuca

SEQ ID NO: 1314902 - RNA, 19 nt, Human
uaaauauggacugcucagg

SEQ ID NO: 1314903 - RNA, 21 nt, Human
uaaauauggacugcucaggaa

SEQ ID NO: 1314904 - RNA, 23 nt, Human
uaaauauggacugcucaggaaac

SEQ ID NO: 1314905 - RNA, 18 nt, Human
uaaauauuuuaaagaauu

SEQ ID NO: 1314906 - RNA, 14 nt, Human
uaaauauuuuaaag

SEQ ID NO: 1314907 - RNA, 15 nt, Human
uaaauauuuuaaaga

SEQ ID NO: 1314908 - RNA, 20 nt, Human
uaaacuuuuuucuuacuguc

SEQ ID NO: 1314909 - RNA, 15 nt, Human
uaaacuuuuaauuca

SEQ ID NO: 1314910 - RNA, 17 nt, Human
uaaacuuuuaauucauu

SEQ ID NO: 1314911 - RNA, 15 nt, Human
uaaacuuuaucacuu

SEQ ID NO: 1314912 - RNA, 16 nt, Human
uaaacuuuuaauucau

SEQ ID NO: 1314913 - RNA, 12 nt, Human
uaaacuuuuugu

SEQ ID NO: 1314914 - RNA, 17 nt, Human
uaaacuuuuuguucugg

SEQ ID NO: 1314915 - RNA, 16 nt, Human
uaaacuuuuuuucugu

SEQ ID NO: 1314916 - RNA, 18 nt, Human
uaaacuuuuuuucuguac

SEQ ID NO: 1314917 - RNA, 20 nt, Human
uaaacuuuuuuucuguacca

SEQ ID NO: 1314918 - RNA, 13 nt, Human
uaaagcaguauuu

SEQ ID NO: 1314919 - RNA, 14 nt, Human
uaaagcaguauuuu

SEQ ID NO: 1314920 - RNA, 17 nt, Human
uaaagcaguauuuuucu

SEQ ID NO: 1314921 - RNA, 14 nt, Human
uaaaggacuguaau

SEQ ID NO: 1314922 - RNA, 12 nt, Human
uaaaggacugua

SEQ ID NO: 1314923 - RNA, 14 nt, Human
uaaagcucugacau

SEQ ID NO: 1314924 - RNA, 15 nt, Human
uaaaggaguuuaugu

SEQ ID NO: 1314925 - RNA, 16 nt, Human
uaaaggaguuuauguu

SEQ ID NO: 1314926 - RNA, 17 nt, Human
uaaaggaguuuauguuc

SEQ ID NO: 1314927 - RNA, 14 nt, Human
uaaagcugaaaacu

SEQ ID NO: 1314928 - RNA, 11 nt, Human
uaaagcauuua

SEQ ID NO: 1314929 - RNA, 20 nt, Human
uaaagcauuuaaccccccug

SEQ ID NO: 1314930 - RNA, 19 nt, Human
uaaagcauuuagaaaacuu

SEQ ID NO: 1314931 - RNA, 13 nt, Human
uaaagcauuuaga

SEQ ID NO: 1314932 - RNA, 15 nt, Human
uaaagcguuugcaca

SEQ ID NO: 1314933 - RNA, 21 nt, Human
uaaagcguuugcacagaucaa

SEQ ID NO: 1314934 - RNA, 15 nt, Human
uaaagcuaaaauaaa

SEQ ID NO: 1314935 - RNA, 22 nt, Human
uaaagcuaaaauaaagaaauag

SEQ ID NO: 1314936 - RNA, 23 nt, Human
uaaagcuaaaauaaagaaauaga

SEQ ID NO: 1314937 - RNA, 16 nt, Human
uaaaggaugugauugu

SEQ ID NO: 1314938 - RNA, 22 nt, Human
uaaaggaugugauuguggaaug

SEQ ID NO: 1314939 - RNA, 19 nt, Human
uaaaggaguuuauguucca

SEQ ID NO: 1314940 - RNA, 16 nt, Human
uaaaggcaaaggcaau

SEQ ID NO: 1314941 - RNA, 17 nt, Human
uaaauaaaaauaauccu

SEQ ID NO: 1314942 - RNA, 23 nt, Human
uaaaguuuuauauauuauaugga

SEQ ID NO: 1314943 - RNA, 19 nt, Human
uaaaguuuuauauauuaua

SEQ ID NO: 1314944 - RNA, 16 nt, Human
uaaauaaaaagaaagg

SEQ ID NO: 1314945 - RNA, 17 nt, Human
uaaauaaaaagaaaggc

SEQ ID NO: 1314946 - RNA, 14 nt, Human
uaaaguuuguugaa

SEQ ID NO: 1314947 - RNA, 14 nt, Human
uaaaguuuuauaua

SEQ ID NO: 1314948 - RNA, 17 nt, Human
uaaaguuuuauauauua

SEQ ID NO: 1314949 - RNA, 18 nt, Human
uaaaguuuuauauauuau

SEQ ID NO: 1314950 - RNA, 18 nt, Human
uaauuaaaagcaaaucau

SEQ ID NO: 1314951 - RNA, 19 nt, Human
uaauuaaaagcaaaucauu

SEQ ID NO: 1314952 - RNA, 14 nt, Human
uaauguuucaaaca

SEQ ID NO: 1314953 - RNA, 23 nt, Human
uaaugcgcaggcuggcccugccc

SEQ ID NO: 1314954 - RNA, 15 nt, Human
uaauguuuaaaacau

SEQ ID NO: 1314955 - RNA, 15 nt, Human
uaauguuucaaacau

SEQ ID NO: 1314956 - RNA, 19 nt, Human
uaaugcgcaggcuggcccu

SEQ ID NO: 1314957 - RNA, 22 nt, Human
uaaugcgcaggcuggcccugcc

SEQ ID NO: 1314958 - RNA, 18 nt, Human
uaaugcauucuucucugu

SEQ ID NO: 1314959 - RNA, 19 nt, Human
uaaugcauucuucucuguu

SEQ ID NO: 1314960 - RNA, 12 nt, Human
uaaugcccagac

SEQ ID NO: 1314961 - RNA, 18 nt, Human
uaaugccucuucauucuu

SEQ ID NO: 1314962 - RNA, 15 nt, Human
uaaugccuuacucuu

SEQ ID NO: 1314963 - RNA, 21 nt, Human
uaaugccuuacucuucuugaa

SEQ ID NO: 1314964 - RNA, 14 nt, Human
uaauucucauuaaa

SEQ ID NO: 1314965 - RNA, 17 nt, Human
uaauucugaguuuugug

SEQ ID NO: 1314966 - RNA, 21 nt, Human
uaauuaauugggccagcuuuu

SEQ ID NO: 1314967 - RNA, 14 nt, Human
uaauuaauuguaau

SEQ ID NO: 1314968 - RNA, 16 nt, Human
uaauuaccaaccuguu

SEQ ID NO: 1314969 - RNA, 17 nt, Human
uaauuaccaaccuguua

SEQ ID NO: 1314970 - RNA, 21 nt, Human
uaauuaccaaccuguuaccua

SEQ ID NO: 1314971 - RNA, 16 nt, Human
uaauuaccuacucugg

SEQ ID NO: 1314972 - RNA, 18 nt, Human
uaauucucauuaaaagaa

SEQ ID NO: 1314973 - RNA, 16 nt, Human
uaauugagaagaaaaa

SEQ ID NO: 1314974 - RNA, 20 nt, Human
uaauugagaagaaaaacuca

SEQ ID NO: 1314975 - RNA, 12 nt, Human
uaauucuuucaa

SEQ ID NO: 1314976 - RNA, 18 nt, Human
uaauucuuucaauacaga

SEQ ID NO: 1314977 - RNA, 20 nt, Human
uaauucuuucaauacagaua

SEQ ID NO: 1314978 - RNA, 21 nt, Human
uaauucuuucaauacagauau

SEQ ID NO: 1314979 - RNA, 15 nt, Human
uaauucuuccuuugu

SEQ ID NO: 1314980 - RNA, 22 nt, Human
uaauuggaaaggcagcucuaaa

SEQ ID NO: 1314981 - RNA, 22 nt, Human
uaauugcuuauuuauuguauuc

SEQ ID NO: 1314982 - RNA, 15 nt, Human
uaauuggauuuccua

SEQ ID NO: 1314983 - RNA, 16 nt, Human
uaauuggauuuccuaa

SEQ ID NO: 1314984 - RNA, 17 nt, Human
uaauuggauuuccuaau

SEQ ID NO: 1314985 - RNA, 23 nt, Human
uaauuggauuuccuaauacuguc

SEQ ID NO: 1314986 - RNA, 21 nt, Human
uaauugggccagcuuuucaaa

SEQ ID NO: 1314987 - RNA, 18 nt, Human
uaauugguccgaucuuug

SEQ ID NO: 1314988 - RNA, 18 nt, Human
uaauugggccagcuuuuc

SEQ ID NO: 1314989 - RNA, 17 nt, Human
uaauugcauugacuuuc

SEQ ID NO: 1314990 - RNA, 22 nt, Human
uaauugccaaaaagugaaauaa

SEQ ID NO: 1314991 - RNA, 23 nt, Human
uaauugccaaaaagugaaauaau

SEQ ID NO: 1314992 - RNA, 14 nt, Human
uaauugccaccucu

SEQ ID NO: 1314993 - RNA, 18 nt, Human
uaauugccaccucuaaca

SEQ ID NO: 1314994 - RNA, 23 nt, Human
uaauugccaccucuaacagcacc

SEQ ID NO: 1314995 - RNA, 11 nt, Human
uaauugccaug

SEQ ID NO: 1314996 - RNA, 12 nt, Human
uaauugccaugu

SEQ ID NO: 1314997 - RNA, 13 nt, Human
uaauugcuuauuu

SEQ ID NO: 1314998 - RNA, 20 nt, Human
uaauugcuuauuuauuguau

SEQ ID NO: 1314999 - RNA, 21 nt, Human
uaauugcuuauuuauuguauu

SEQ ID NO: 1315000 - RNA, 21 nt, Human
uaauuguguuuacauuuuaug

SEQ ID NO: 1315001 - RNA, 22 nt, Human
uaauuguguuuacauuuuaugg

SEQ ID NO: 1315002 - RNA, 20 nt, Human
uaauuguguuuacauuuuau

SEQ ID NO: 1315003 - RNA, 19 nt, Human
uaauuguguuuacauuuua

SEQ ID NO: 1315004 - RNA, 18 nt, Human
uaauuguguuuacauuuu

SEQ ID NO: 1315005 - RNA, 17 nt, Human
uaauuguguuuacauuu

SEQ ID NO: 1315006 - RNA, 16 nt, Human
uaauuguguuuacauu

SEQ ID NO: 1315007 - RNA, 14 nt, Human
uaauuguguuuaca

SEQ ID NO: 1315008 - RNA, 13 nt, Human
uaauuguguuuac

SEQ ID NO: 1315009 - RNA, 20 nt, Human
uaauuguguggauucuuuaa

SEQ ID NO: 1315010 - RNA, 14 nt, Human
uaauuguguggauu

SEQ ID NO: 1315011 - RNA, 17 nt, Human
uaauuguucucagaauc

SEQ ID NO: 1315012 - RNA, 16 nt, Human
uaauuguucucagaau

SEQ ID NO: 1315013 - RNA, 16 nt, Human
uaauuguugcuaaucu

SEQ ID NO: 1315014 - RNA, 14 nt, Human
uaauuguuguucug

SEQ ID NO: 1315015 - RNA, 15 nt, Human
uaauuguuguucugu

SEQ ID NO: 1315016 - RNA, 16 nt, Human
uaauuguuguucuguu

SEQ ID NO: 1315017 - RNA, 17 nt, Human
uaauuguuguucuguua

SEQ ID NO: 1315018 - RNA, 18 nt, Human
uaauuguuguucuguuaa

SEQ ID NO: 1315019 - RNA, 19 nt, Human
uaauuguuguucuguuaac

SEQ ID NO: 1315020 - RNA, 20 nt, Human
uaauuguuguucuguuaacu

SEQ ID NO: 1315021 - RNA, 22 nt, Human
uaauuguaaaguaaaagcuaua

SEQ ID NO: 1315022 - RNA, 18 nt, Human
uaauuguacuaaagccaa

SEQ ID NO: 1315023 - RNA, 22 nt, Human
uaauuguacuaaagccaaacau

SEQ ID NO: 1315024 - RNA, 23 nt, Human
uaauuguacuaaagccaaacaua

SEQ ID NO: 1315025 - RNA, 23 nt, Human
uaauugugauuagacagaacacc

SEQ ID NO: 1315026 - RNA, 22 nt, Human
uaauugugauuagacagaacac

SEQ ID NO: 1315027 - RNA, 20 nt, Human
uaauuuguaguguuggagaa

SEQ ID NO: 1315028 - RNA, 18 nt, Human
uaauuugguuuucacauu

SEQ ID NO: 1315029 - RNA, 23 nt, Human
uaauuuggaucucuucuuaaugu

SEQ ID NO: 1315030 - RNA, 15 nt, Human
uaauuugguuuucac

SEQ ID NO: 1315031 - RNA, 17 nt, Human
uaauuugguuuucacau

SEQ ID NO: 1315032 - RNA, 23 nt, Human
uaauuguuguucuguuaacugaa

SEQ ID NO: 1315033 - RNA, 21 nt, Human
uaauuguuguucuguuaacug

SEQ ID NO: 1315034 - RNA, 23 nt, Human
uaauuuguaguguuggagaagaa

SEQ ID NO: 1315035 - RNA, 17 nt, Human
uaauuuguuuuggauau

SEQ ID NO: 1315036 - RNA, 14 nt, Human
uaauuuuaaacaaa

SEQ ID NO: 1315037 - RNA, 13 nt, Human
uaauuuuaaauuc

SEQ ID NO: 1315038 - RNA, 18 nt, Human
uaauuuuacacgcuuuug

SEQ ID NO: 1315039 - RNA, 19 nt, Human
uaauuuuacacgcuuuugu

SEQ ID NO: 1315040 - RNA, 20 nt, Human
uaauuuuacacgcuuuugug

SEQ ID NO: 1315041 - RNA, 21 nt, Human
uaauuuuacacgcuuuuguga

SEQ ID NO: 1315042 - RNA, 14 nt, Human
uaauuuuaguuuuu

SEQ ID NO: 1315043 - RNA, 16 nt, Human
uaauuuuaguuuuuca

SEQ ID NO: 1315044 - RNA, 19 nt, Human
uaauuuuaguuuuucauua

SEQ ID NO: 1315045 - RNA, 21 nt, Human
uaauuuuaguuuuucauuaaa

SEQ ID NO: 1315046 - RNA, 23 nt, Human
uaauuuuaguuuuucauuaaaua

SEQ ID NO: 1315047 - RNA, 17 nt, Human
uaauuuuccuaauaaag

SEQ ID NO: 1315048 - RNA, 22 nt, Human
uaauaauuuagacuucaagcau

SEQ ID NO: 1315049 - RNA, 13 nt, Human
uaauaauuucuaa

SEQ ID NO: 1315050 - RNA, 14 nt, Human
uaauaauuucuaau

SEQ ID NO: 1315051 - RNA, 16 nt, Human
uaauaauuucuaaugu

SEQ ID NO: 1315052 - RNA, 15 nt, Human
uaauaauguuucaaa

SEQ ID NO: 1315053 - RNA, 13 nt, Human
uaauaagguuuua

SEQ ID NO: 1315054 - RNA, 14 nt, Human
uaauaagguuuuaa

SEQ ID NO: 1315055 - RNA, 16 nt, Human
uaauaagguuuuaauu

SEQ ID NO: 1315056 - RNA, 21 nt, Human
uaauaagguuuuaauuuagua

SEQ ID NO: 1315057 - RNA, 16 nt, Human
uaauaauaaagaauag

SEQ ID NO: 1315058 - RNA, 20 nt, Human
uaauaauuuuuaagaaauaa

SEQ ID NO: 1315059 - RNA, 16 nt, Human
uaauaauuuuuuaauu

SEQ ID NO: 1315060 - RNA, 14 nt, Human
uaauacaaacuaau

SEQ ID NO: 1315061 - RNA, 14 nt, Human
uaauacaaaggcuu

SEQ ID NO: 1315062 - RNA, 15 nt, Human
uaauacaaacuauau

SEQ ID NO: 1315063 - RNA, 15 nt, Human
uaauacacacaguua

SEQ ID NO: 1315064 - RNA, 13 nt, Human
uaauaguuccugc

SEQ ID NO: 1315065 - RNA, 21 nt, Human
uaauauaaaaagcuuccauga

SEQ ID NO: 1315066 - RNA, 12 nt, Human
uaauaguuccug

SEQ ID NO: 1315067 - RNA, 21 nt, Human
uaauauaaaguaguccuguga

SEQ ID NO: 1315068 - RNA, 15 nt, Human
uaauauaaaguuuua

SEQ ID NO: 1315069 - RNA, 20 nt, Human
uaauauaaaguuuuauauau

SEQ ID NO: 1315070 - RNA, 22 nt, Human
uaauauaaaguuuuauauauua

SEQ ID NO: 1315071 - RNA, 12 nt, Human
uaauauaaaugc

SEQ ID NO: 1315072 - RNA, 13 nt, Human
uaauauaaaugca

SEQ ID NO: 1315073 - RNA, 14 nt, Human
uaauauaaaugcaa

SEQ ID NO: 1315074 - RNA, 16 nt, Human
uaauauaaaugcaaau

SEQ ID NO: 1315075 - RNA, 22 nt, Human
uaauauaaaugcaaauaacaaa

SEQ ID NO: 1315076 - RNA, 15 nt, Human
uaauaagguugaaca

SEQ ID NO: 1315077 - RNA, 11 nt, Human
uaauaaagcug

SEQ ID NO: 1315078 - RNA, 17 nt, Human
uaauaaauguacauuaa

SEQ ID NO: 1315079 - RNA, 19 nt, Human
uaauaaauguacauuaauu

SEQ ID NO: 1315080 - RNA, 17 nt, Human
uaauaaacuuuaauaua

SEQ ID NO: 1315081 - RNA, 19 nt, Human
uaaggccauuauuguacuu

SEQ ID NO: 1315082 - RNA, 16 nt, Human
uaaggccuaggauucu

SEQ ID NO: 1315083 - RNA, 18 nt, Human
uaaggccuaggauucuaa

SEQ ID NO: 1315084 - RNA, 19 nt, Human
uaaggccuaggauucuaaa

SEQ ID NO: 1315085 - RNA, 20 nt, Human
uaaggccuaggauucuaaaa

SEQ ID NO: 1315086 - RNA, 21 nt, Human
uaaggccuaggauucuaaaau

SEQ ID NO: 1315087 - RNA, 16 nt, Human
uaaggccugugggggg

SEQ ID NO: 1315088 - RNA, 12 nt, Human
uaaggcucuaga

SEQ ID NO: 1315089 - RNA, 14 nt, Human
uaaggcucuagauc

SEQ ID NO: 1315090 - RNA, 20 nt, Human
uaauauguucuuuuaaauga

SEQ ID NO: 1315091 - RNA, 17 nt, Human
uaauauauuuucuguuu

SEQ ID NO: 1315092 - RNA, 21 nt, Human
uaauauauuuucuguuuucuu

SEQ ID NO: 1315093 - RNA, 14 nt, Human
uaauauauuuaaaa

SEQ ID NO: 1315094 - RNA, 17 nt, Human
uaauauauuuaaaaaua

SEQ ID NO: 1315095 - RNA, 13 nt, Human
uaauauauuuucu

SEQ ID NO: 1315096 - RNA, 16 nt, Human
uaauauacuauauuua

SEQ ID NO: 1315097 - RNA, 16 nt, Human
uaauauauauuaucuu

SEQ ID NO: 1315098 - RNA, 18 nt, Human
uaauauauauuaucuuuu

SEQ ID NO: 1315099 - RNA, 19 nt, Human
uaauauauauuaucuuuuc

SEQ ID NO: 1315100 - RNA, 22 nt, Human
uaauccuguaggaagguacugu

SEQ ID NO: 1315101 - RNA, 23 nt, Human
uaauccuguaggaagguacugua

SEQ ID NO: 1315102 - RNA, 18 nt, Human
uaauccuguaggaaggua

SEQ ID NO: 1315103 - RNA, 14 nt, Human
uaauccuguaggaa

SEQ ID NO: 1315104 - RNA, 13 nt, Human
uaaucgaccugcc

SEQ ID NO: 1315105 - RNA, 14 nt, Human
uaaucgaccugccu

SEQ ID NO: 1315106 - RNA, 16 nt, Human
uaaucgaccugccucg

SEQ ID NO: 1315107 - RNA, 16 nt, Human
uaaucguguccccuau

SEQ ID NO: 1315108 - RNA, 15 nt, Human
uaaucuucaauaguu

SEQ ID NO: 1315109 - RNA, 14 nt, Human
uaaucuucugccuu

SEQ ID NO: 1315110 - RNA, 15 nt, Human
uaaucuuauuuagga

SEQ ID NO: 1315111 - RNA, 21 nt, Human
uaaucuuauucauuuucucua

SEQ ID NO: 1315112 - RNA, 22 nt, Human
uaaucuuauucauuuucucuaa

SEQ ID NO: 1315113 - RNA, 22 nt, Human
uaaucuuauaauuguucucaga

SEQ ID NO: 1315114 - RNA, 16 nt, Human
uaaugauaugcuugua

SEQ ID NO: 1315115 - RNA, 15 nt, Human
uaaugauaugcuugu

SEQ ID NO: 1315116 - RNA, 19 nt, Human
uaaugccacuaaauugaca

SEQ ID NO: 1315117 - RNA, 17 nt, Human
uaaugaugucguuugaa

SEQ ID NO: 1315118 - RNA, 23 nt, Human
uaaugaugucguuugaaucacag

SEQ ID NO: 1315119 - RNA, 12 nt, Human
uaaugcacuuuc

SEQ ID NO: 1315120 - RNA, 13 nt, Human
uaaugcacuuucu

SEQ ID NO: 1315121 - RNA, 14 nt, Human
uaaugcacuuucua

SEQ ID NO: 1315122 - RNA, 18 nt, Human
uaaucucuguaaagcuaa

SEQ ID NO: 1315123 - RNA, 17 nt, Human
uaaucucuguaaagcua

SEQ ID NO: 1315124 - RNA, 13 nt, Human
uaaucugaauaaa

SEQ ID NO: 1315125 - RNA, 17 nt, Human
uaaucugaauaaagugu

SEQ ID NO: 1315126 - RNA, 20 nt, Human
uaaucugaauaaaguguaac

SEQ ID NO: 1315127 - RNA, 21 nt, Human
uaaucugaauaaaguguaaca

SEQ ID NO: 1315128 - RNA, 22 nt, Human
uaaucugaauaaaguguaacaa

SEQ ID NO: 1315129 - RNA, 23 nt, Human
uaaucugaauaaaguguaacaau

SEQ ID NO: 1315130 - RNA, 21 nt, Human
uaaucugugcuguuucaaagu

SEQ ID NO: 1315131 - RNA, 22 nt, Human
uaaucugugcuguuucaaaguu

SEQ ID NO: 1315132 - RNA, 23 nt, Human
uaaucugugcuguuucaaaguuc

SEQ ID NO: 1315133 - RNA, 13 nt, Human
uaaucuuagugua

SEQ ID NO: 1315134 - RNA, 15 nt, Human
uaaucuuaguguaug

SEQ ID NO: 1315135 - RNA, 18 nt, Human
uaaucuuaguguaugauu

SEQ ID NO: 1315136 - RNA, 15 nt, Human
uaaucuuauaauugu

SEQ ID NO: 1315137 - RNA, 18 nt, Human
uaaucuuauaauuguucu

SEQ ID NO: 1315138 - RNA, 15 nt, Human
uaaauugcuccuuga

SEQ ID NO: 1315139 - RNA, 13 nt, Human
uaaauuggaaagc

SEQ ID NO: 1315140 - RNA, 17 nt, Human
uaaauuggcauggaaau

SEQ ID NO: 1315141 - RNA, 20 nt, Human
uaaauuggcauggaaauuua

SEQ ID NO: 1315142 - RNA, 19 nt, Human
uaaaucauuuuaugucaag

SEQ ID NO: 1315143 - RNA, 16 nt, Human
uaaauugauguugcug

SEQ ID NO: 1315144 - RNA, 13 nt, Human
uaaauugauuuuu

SEQ ID NO: 1315145 - RNA, 21 nt, Human
uaaauugauuuuuauaaauac

SEQ ID NO: 1315146 - RNA, 22 nt, Human
uaaauugauuuuuauaaauacu

SEQ ID NO: 1315147 - RNA, 14 nt, Human
uaaauuuaguauuu

SEQ ID NO: 1315148 - RNA, 22 nt, Human
uaaauuuaguauuuuguuucag

SEQ ID NO: 1315149 - RNA, 21 nt, Human
uaaauuggcauggaaauuuaa

SEQ ID NO: 1315150 - RNA, 17 nt, Human
uaaauuguacagccggc

SEQ ID NO: 1315151 - RNA, 16 nt, Human
uaacaauuaggcagac

SEQ ID NO: 1315152 - RNA, 20 nt, Human
uaacaauuaggcagacucuu

SEQ ID NO: 1315153 - RNA, 13 nt, Human
uaacaauuccucu

SEQ ID NO: 1315154 - RNA, 14 nt, Human
uaacaauuccucua

SEQ ID NO: 1315155 - RNA, 14 nt, Human
uaacaauuguguag

SEQ ID NO: 1315156 - RNA, 18 nt, Human
uaacaauuguguagccuu

SEQ ID NO: 1315157 - RNA, 19 nt, Human
uaacaauuguguagccuuu

SEQ ID NO: 1315158 - RNA, 23 nt, Human
uaacaauuguguagccuuuuugu

SEQ ID NO: 1315159 - RNA, 20 nt, Human
uaacaauuguguagccuuuu

SEQ ID NO: 1315160 - RNA, 21 nt, Human
uaacacacuaccgaauguguc

SEQ ID NO: 1315161 - RNA, 22 nt, Human
uaacacacuaccgaaugugucu

SEQ ID NO: 1315162 - RNA, 23 nt, Human
uaacacacuaccgaaugugucuu

SEQ ID NO: 1315163 - RNA, 21 nt, Human
uaacacagcauuguauaugug

SEQ ID NO: 1315164 - RNA, 20 nt, Human
uaacacacuaccgaaugugu

SEQ ID NO: 1315165 - RNA, 13 nt, Human
uaacagaaauugu

SEQ ID NO: 1315166 - RNA, 14 nt, Human
uaacagaaauugua

SEQ ID NO: 1315167 - RNA, 15 nt, Human
uaacagaaauuguau

SEQ ID NO: 1315168 - RNA, 17 nt, Human
uaacagaaauuguauau

SEQ ID NO: 1315169 - RNA, 22 nt, Human
uaacagaaauuguauauuguaa

SEQ ID NO: 1315170 - RNA, 19 nt, Human
uaacagaagggagggcaga

SEQ ID NO: 1315171 - RNA, 15 nt, Human
uaacagcaccaaauc

SEQ ID NO: 1315172 - RNA, 11 nt, Human
uaacagcccuc

SEQ ID NO: 1315173 - RNA, 17 nt, Human
uaacagcccuccucugc

SEQ ID NO: 1315174 - RNA, 18 nt, Human
uaacagcccuccucugca

SEQ ID NO: 1315175 - RNA, 20 nt, Human
uaacagcccuccucugcacu

SEQ ID NO: 1315176 - RNA, 17 nt, Human
uaaccaggggccaugaa

SEQ ID NO: 1315177 - RNA, 17 nt, Human
uaacccuuugugugcuc

SEQ ID NO: 1315178 - RNA, 19 nt, Human
uaacccuuugugugcucuc

SEQ ID NO: 1315179 - RNA, 21 nt, Human
uaacccuuugugugcucucca

SEQ ID NO: 1315180 - RNA, 22 nt, Human
uaaccgagaucaguauuuaacu

SEQ ID NO: 1315181 - RNA, 12 nt, Human
uaaccaaguucc

SEQ ID NO: 1315182 - RNA, 11 nt, Human
uaaccaaguuc

SEQ ID NO: 1315183 - RNA, 19 nt, Human
uaaccaagcugaguuuccu

SEQ ID NO: 1315184 - RNA, 22 nt, Human
uaacauuaucuaguucauugaa

SEQ ID NO: 1315185 - RNA, 21 nt, Human
uaacauucaggaauucuugga

SEQ ID NO: 1315186 - RNA, 12 nt, Human
uaacauuccaag

SEQ ID NO: 1315187 - RNA, 13 nt, Human
uaacauuccaaga

SEQ ID NO: 1315188 - RNA, 18 nt, Human
uaacauuccaagacucua

SEQ ID NO: 1315189 - RNA, 10 nt, Human
uaacauuccu

SEQ ID NO: 1315190 - RNA, 22 nt, Human
uaacauuccaagacucuagagu

SEQ ID NO: 1315191 - RNA, 21 nt, Human
uaaccaagagauaacuguaaa

SEQ ID NO: 1315192 - RNA, 16 nt, Human
uaaccaagcugaguuu

SEQ ID NO: 1315193 - RNA, 20 nt, Human
uaaccaagcugaguuuccua

SEQ ID NO: 1315194 - RNA, 16 nt, Human
uaacagggaaggcagg

SEQ ID NO: 1315195 - RNA, 17 nt, Human
uaacagggaaggcaggc

SEQ ID NO: 1315196 - RNA, 19 nt, Human
uaacagggaaggcaggcag

SEQ ID NO: 1315197 - RNA, 23 nt, Human
uaacagggaacgugauuagugaa

SEQ ID NO: 1315198 - RNA, 14 nt, Human
uaacagggaaggca

SEQ ID NO: 1315199 - RNA, 22 nt, Human
uaacagggaacgugauuaguga

SEQ ID NO: 1315200 - RNA, 15 nt, Human
uaacagggaacguga

SEQ ID NO: 1315201 - RNA, 19 nt, Human
uaacaggcucaaacaauga

SEQ ID NO: 1315202 - RNA, 15 nt, Human
uaacaggccaaagag

SEQ ID NO: 1315203 - RNA, 21 nt, Human
uaacaggcucaaacaaugaca

SEQ ID NO: 1315204 - RNA, 12 nt, Human
uaacuguauuug

SEQ ID NO: 1315205 - RNA, 22 nt, Human
uaacuguauuugaaauaagaau

SEQ ID NO: 1315206 - RNA, 14 nt, Human
uaacuguauuugaa

SEQ ID NO: 1315207 - RNA, 17 nt, Human
uaacuggguaaugaaac

SEQ ID NO: 1315208 - RNA, 19 nt, Human
uaacuggguaaugaaacaa

SEQ ID NO: 1315209 - RNA, 20 nt, Human
uaacuggguaaugaaacaaa

SEQ ID NO: 1315210 - RNA, 15 nt, Human
uaacuguaaagaugu

SEQ ID NO: 1315211 - RNA, 23 nt, Human
uaacuguaaagauguuuauuuca

SEQ ID NO: 1315212 - RNA, 18 nt, Human
uaacuguaaaugugacau

SEQ ID NO: 1315213 - RNA, 17 nt, Human
uaacugagugccuuuug

SEQ ID NO: 1315214 - RNA, 14 nt, Human
uaacugcauacacu

SEQ ID NO: 1315215 - RNA, 11 nt, Human
uaacugccagg

SEQ ID NO: 1315216 - RNA, 17 nt, Human
uaacugcccaaagcagc

SEQ ID NO: 1315217 - RNA, 21 nt, Human
uaacugcccaaagcagcacuu

SEQ ID NO: 1315218 - RNA, 17 nt, Human
uaacugccguaauuuaa

SEQ ID NO: 1315219 - RNA, 14 nt, Human
uaacugccuagaaa

SEQ ID NO: 1315220 - RNA, 16 nt, Human
uaacugccuagaaaca

SEQ ID NO: 1315221 - RNA, 15 nt, Human
uaacugccuagaaac

SEQ ID NO: 1315222 - RNA, 17 nt, Human
uaacugggggaaaagau

SEQ ID NO: 1315223 - RNA, 16 nt, Human
uaacugagugccuuuu

SEQ ID NO: 1315224 - RNA, 15 nt, Human
uaacucaucugucac

SEQ ID NO: 1315225 - RNA, 12 nt, Human
uaacucauuaga

SEQ ID NO: 1315226 - RNA, 15 nt, Human
uaacucauugcucug

SEQ ID NO: 1315227 - RNA, 16 nt, Human
uaacucauuagacugg

SEQ ID NO: 1315228 - RNA, 14 nt, Human
uaacucaucuguca

SEQ ID NO: 1315229 - RNA, 23 nt, Human
uaaccgagaucaguauuuaacua

SEQ ID NO: 1315230 - RNA, 20 nt, Human
uaaccuaugauauuuucugu

SEQ ID NO: 1315231 - RNA, 14 nt, Human
uaaccucaucuucu

SEQ ID NO: 1315232 - RNA, 18 nt, Human
uaaccucaucuucuucac

SEQ ID NO: 1315233 - RNA, 16 nt, Human
uaagcauuccaacuau

SEQ ID NO: 1315234 - RNA, 18 nt, Human
uaagcauuccaacuaucu

SEQ ID NO: 1315235 - RNA, 20 nt, Human
uaagcauuccaacuaucuca

SEQ ID NO: 1315236 - RNA, 22 nt, Human
uaagcauugaauggcuauguuu

SEQ ID NO: 1315237 - RNA, 13 nt, Human
uaagccagacauc

SEQ ID NO: 1315238 - RNA, 17 nt, Human
uaagccacuuaaaaugu

SEQ ID NO: 1315239 - RNA, 19 nt, Human
uaagccacuuaaaauguuc

SEQ ID NO: 1315240 - RNA, 16 nt, Human
uaagccaaaacaaugu

SEQ ID NO: 1315241 - RNA, 15 nt, Human
uaagccaauuucaau

SEQ ID NO: 1315242 - RNA, 15 nt, Human
uaagcaugcacaaau

SEQ ID NO: 1315243 - RNA, 18 nt, Human
uaagcaucuggcucuaau

SEQ ID NO: 1315244 - RNA, 14 nt, Human
uaagcaucauuauu

SEQ ID NO: 1315245 - RNA, 19 nt, Human
uaagcaucauuauuuaugu

SEQ ID NO: 1315246 - RNA, 20 nt, Human
uaagcaucauuauuuaugua

SEQ ID NO: 1315247 - RNA, 21 nt, Human
uaagcaucauuauuuauguau

SEQ ID NO: 1315248 - RNA, 23 nt, Human
uaagcaucauuauuuauguauug

SEQ ID NO: 1315249 - RNA, 22 nt, Human
uaagcaucauuauuuauguauu

SEQ ID NO: 1315250 - RNA, 14 nt, Human
uaagcaucuaaguu

SEQ ID NO: 1315251 - RNA, 18 nt, Human
uaagaucuuuuauuuugc

SEQ ID NO: 1315252 - RNA, 14 nt, Human
uaagaucuuagauu

SEQ ID NO: 1315253 - RNA, 16 nt, Human
uaagaucuuagauucu

SEQ ID NO: 1315254 - RNA, 17 nt, Human
uaagaucuuagauucuc

SEQ ID NO: 1315255 - RNA, 20 nt, Human
uaagaucuuagauucucugu

SEQ ID NO: 1315256 - RNA, 17 nt, Human
uaagaucuauagccucu

SEQ ID NO: 1315257 - RNA, 15 nt, Human
uaaggcaaucauggu

SEQ ID NO: 1315258 - RNA, 22 nt, Human
uaagcgcuagaggaagcagcca

SEQ ID NO: 1315259 - RNA, 21 nt, Human
uaagccuuuggaaacagcucg

SEQ ID NO: 1315260 - RNA, 14 nt, Human
uaagccuuuggaaa

SEQ ID NO: 1315261 - RNA, 17 nt, Human
uaagccuuuggaaacag

SEQ ID NO: 1315262 - RNA, 21 nt, Human
uaagccagacaucaacagaua

SEQ ID NO: 1315263 - RNA, 20 nt, Human
uaagccagacaucaacagau

SEQ ID NO: 1315264 - RNA, 20 nt, Human
uaagccacuuaaaauguuca

SEQ ID NO: 1315265 - RNA, 17 nt, Human
uaagccagcaccggacc

SEQ ID NO: 1315266 - RNA, 23 nt, Human
uaagccagcaccggaccagccug

SEQ ID NO: 1315267 - RNA, 22 nt, Human
uaagccagcaccggaccagccu

SEQ ID NO: 1315268 - RNA, 15 nt, Human
uaagccagcugcccc

SEQ ID NO: 1315269 - RNA, 22 nt, Human
uaagccagcugcccccagagcc

SEQ ID NO: 1315270 - RNA, 17 nt, Human
uaagagagucuauuuac

SEQ ID NO: 1315271 - RNA, 21 nt, Human
uaagaagaaugcuuaaucaga

SEQ ID NO: 1315272 - RNA, 23 nt, Human
uaagaagcacgugguaaaacacu

SEQ ID NO: 1315273 - RNA, 22 nt, Human
uaagagcaaaagaauggcagaa

SEQ ID NO: 1315274 - RNA, 20 nt, Human
uaagagcaaaagaauggcag

SEQ ID NO: 1315275 - RNA, 12 nt, Human
uaagagcucagg

SEQ ID NO: 1315276 - RNA, 14 nt, Human
uaagagcucaggau

SEQ ID NO: 1315277 - RNA, 15 nt, Human
uaagagcucaggaug

SEQ ID NO: 1315278 - RNA, 22 nt, Human
uaagagcucaggaugagggaaa

SEQ ID NO: 1315279 - RNA, 16 nt, Human
uaagaggcugcccucc

SEQ ID NO: 1315280 - RNA, 13 nt, Human
uaagaaagccuga

SEQ ID NO: 1315281 - RNA, 14 nt, Human
uaagaaagccugag

SEQ ID NO: 1315282 - RNA, 15 nt, Human
uaagaaagccugagu

SEQ ID NO: 1315283 - RNA, 17 nt, Human
uaagaaagccugaguac

SEQ ID NO: 1315284 - RNA, 15 nt, Human
uaagaaaggaagcau

SEQ ID NO: 1315285 - RNA, 18 nt, Human
uaagaaaggaagcauugu

SEQ ID NO: 1315286 - RNA, 20 nt, Human
uaagaaaggaagcauuguaa

SEQ ID NO: 1315287 - RNA, 21 nt, Human
uaagaaaggaagcauuguaaa

SEQ ID NO: 1315288 - RNA, 23 nt, Human
uaagaaaggaagcauuguaaaau

SEQ ID NO: 1315289 - RNA, 22 nt, Human
uaagaaaggaagcauuguaaaa

SEQ ID NO: 1315290 - RNA, 15 nt, Human
uaagaaauacagacu

SEQ ID NO: 1315291 - RNA, 13 nt, Human
uaagaaauagaau

SEQ ID NO: 1315292 - RNA, 17 nt, Human
uaagaggcugcccuccu

SEQ ID NO: 1315293 - RNA, 20 nt, Human
uaagaggcugcccuccugug

SEQ ID NO: 1315294 - RNA, 18 nt, Human
uaagagguguuauuugga

SEQ ID NO: 1315295 - RNA, 21 nt, Human
uaagaguagaaacugcaggga

SEQ ID NO: 1315296 - RNA, 18 nt, Human
uaagaguccaagaaucca

SEQ ID NO: 1315297 - RNA, 14 nt, Human
uaagagugcugggc

SEQ ID NO: 1315298 - RNA, 12 nt, Human
uaagauaauuau

SEQ ID NO: 1315299 - RNA, 13 nt, Human
uaagauaauuaua

SEQ ID NO: 1315300 - RNA, 19 nt, Human
uaagauaugggacauuuuu

SEQ ID NO: 1315301 - RNA, 21 nt, Human
uaagauaugggacauuuuuga

SEQ ID NO: 1315302 - RNA, 14 nt, Human
uaagauauuuuuca

SEQ ID NO: 1315303 - RNA, 15 nt, Human
uaagauauuuuucau

SEQ ID NO: 1315304 - RNA, 17 nt, Human
uaagauauuuuucauga

SEQ ID NO: 1315305 - RNA, 18 nt, Human
uaagauauuuuucaugau

SEQ ID NO: 1315306 - RNA, 19 nt, Human
uaagauauuuuucaugauu

SEQ ID NO: 1315307 - RNA, 23 nt, Human
uaagauccuagauccuaaggguc

SEQ ID NO: 1315308 - RNA, 16 nt, Human
uagauguauguacuuc

SEQ ID NO: 1315309 - RNA, 15 nt, Human
uagauguaguauuuu

SEQ ID NO: 1315310 - RNA, 17 nt, Human
uagauguaguauuuuuu

SEQ ID NO: 1315311 - RNA, 16 nt, Human
uagauguauaacuagg

SEQ ID NO: 1315312 - RNA, 20 nt, Human
uagauguauguacuucaugc

SEQ ID NO: 1315313 - RNA, 20 nt, Human
uagaugucuuuucccauuua

SEQ ID NO: 1315314 - RNA, 13 nt, Human
uagaugucuuuuc

SEQ ID NO: 1315315 - RNA, 18 nt, Human
uagauguuccaguaaucu

SEQ ID NO: 1315316 - RNA, 21 nt, Human
uagauguucuaagucuuucca

SEQ ID NO: 1315317 - RNA, 23 nt, Human
uagauaacaagaccucagugccu

SEQ ID NO: 1315318 - RNA, 23 nt, Human
uagauaaaacaucuuugaaauua

SEQ ID NO: 1315319 - RNA, 18 nt, Human
uagauacaugcuuuuuaa

SEQ ID NO: 1315320 - RNA, 22 nt, Human
uagauacccuacgcuguccaga

SEQ ID NO: 1315321 - RNA, 16 nt, Human
uagauguaauuuugug

SEQ ID NO: 1315322 - RNA, 21 nt, Human
uagaugggagggaggcucagg

SEQ ID NO: 1315323 - RNA, 22 nt, Human
uagaugggggaaagcaaagcac

SEQ ID NO: 1315324 - RNA, 13 nt, Human
uagcagacaggcc

SEQ ID NO: 1315325 - RNA, 19 nt, Human
uagcagacaggccccguga

SEQ ID NO: 1315326 - RNA, 15 nt, Human
uagcagacaguguuu

SEQ ID NO: 1315327 - RNA, 19 nt, Human
uagcagcaccguucugugc

SEQ ID NO: 1315328 - RNA, 20 nt, Human
uagcagcaccguucugugca

SEQ ID NO: 1315329 - RNA, 16 nt, Human
uagauuuaauauaaag

SEQ ID NO: 1315330 - RNA, 20 nt, Human
uagauguuuauucuucuaga

SEQ ID NO: 1315331 - RNA, 21 nt, Human
uagauguuuauucuucuagag

SEQ ID NO: 1315332 - RNA, 17 nt, Human
uagauucuaaagauucu

SEQ ID NO: 1315333 - RNA, 18 nt, Human
uagauucuaaagauucua

SEQ ID NO: 1315334 - RNA, 22 nt, Human
uagauucucuggcuguaaggcu

SEQ ID NO: 1315335 - RNA, 23 nt, Human
uagauucucuggcuguaaggcuc

SEQ ID NO: 1315336 - RNA, 19 nt, Human
uagauucucugugucuaag

SEQ ID NO: 1315337 - RNA, 20 nt, Human
uagauucucugugucuaaga

SEQ ID NO: 1315338 - RNA, 21 nt, Human
uagauucucugugucuaagau

SEQ ID NO: 1315339 - RNA, 22 nt, Human
uagauucucugugucuaagauu

SEQ ID NO: 1315340 - RNA, 23 nt, Human
uagauucucugugucuaagauuc

SEQ ID NO: 1315341 - RNA, 23 nt, Human
uagauucucuuguauaagauccu

SEQ ID NO: 1315342 - RNA, 14 nt, Human
uagauugauuguau

SEQ ID NO: 1315343 - RNA, 16 nt, Human
uagauugauuguauug

SEQ ID NO: 1315344 - RNA, 23 nt, Human
uagauugauuguauuguugaaaa

SEQ ID NO: 1315345 - RNA, 23 nt, Human
uagauugcagaaaauucugugcc

SEQ ID NO: 1315346 - RNA, 12 nt, Human
uagauugcagaa

SEQ ID NO: 1315347 - RNA, 18 nt, Human
uagauuguccuuuugcaa

SEQ ID NO: 1315348 - RNA, 23 nt, Human
uagauuguccuuuugcaaagaaa

SEQ ID NO: 1315349 - RNA, 23 nt, Human
uagauuuaauauaaaguuuuaua

SEQ ID NO: 1315350 - RNA, 20 nt, Human
uagauuguccuuuugcaaag

SEQ ID NO: 1315351 - RNA, 13 nt, Human
uagauuuaauaua

SEQ ID NO: 1315352 - RNA, 23 nt, Human
uagcagaagguugcaccuccccc

SEQ ID NO: 1315353 - RNA, 11 nt, Human
uagcagacagg

SEQ ID NO: 1315354 - RNA, 19 nt, Human
uagacuggaacuugaacug

SEQ ID NO: 1315355 - RNA, 14 nt, Human
uagacuggacagcu

SEQ ID NO: 1315356 - RNA, 18 nt, Human
uagacuggacagcuugug

SEQ ID NO: 1315357 - RNA, 19 nt, Human
uagagaaaacaugcagaac

SEQ ID NO: 1315358 - RNA, 21 nt, Human
uagagaaaacuaaagaaauuu

SEQ ID NO: 1315359 - RNA, 13 nt, Human
uagagaagacagg

SEQ ID NO: 1315360 - RNA, 16 nt, Human
uagacuggacagcuug

SEQ ID NO: 1315361 - RNA, 20 nt, Human
uagacuuggauucuuuccau

SEQ ID NO: 1315362 - RNA, 16 nt, Human
uagacuuggauucuuu

SEQ ID NO: 1315363 - RNA, 14 nt, Human
uagacuuuaacaua

SEQ ID NO: 1315364 - RNA, 21 nt, Human
uagacuuuaacauaagcuauu

SEQ ID NO: 1315365 - RNA, 12 nt, Human
uagaaccaggca

SEQ ID NO: 1315366 - RNA, 23 nt, Human
uagaaccaggcaacuugggaacu

SEQ ID NO: 1315367 - RNA, 22 nt, Human
uagaacccucuguuccuucccu

SEQ ID NO: 1315368 - RNA, 21 nt, Human
uagaacccucuguuccuuccc

SEQ ID NO: 1315369 - RNA, 15 nt, Human
uagaaccuaauucaa

SEQ ID NO: 1315370 - RNA, 23 nt, Human
uagaaccuaauucaauucaaagc

SEQ ID NO: 1315371 - RNA, 12 nt, Human
uagaccuacagg

SEQ ID NO: 1315372 - RNA, 13 nt, Human
uagaccuacaggg

SEQ ID NO: 1315373 - RNA, 15 nt, Human
uagaccuacaggggg

SEQ ID NO: 1315374 - RNA, 16 nt, Human
uagaccuccagcuguu

SEQ ID NO: 1315375 - RNA, 21 nt, Human
uagacucuuuuccuucccuuu

SEQ ID NO: 1315376 - RNA, 17 nt, Human
uagaguuuagcuggaaa

SEQ ID NO: 1315377 - RNA, 18 nt, Human
uagaguuuagcuggaaaa

SEQ ID NO: 1315378 - RNA, 13 nt, Human
uagaguugcugag

SEQ ID NO: 1315379 - RNA, 14 nt, Human
uagaguugcugaga

SEQ ID NO: 1315380 - RNA, 14 nt, Human
uagaguuggccaua

SEQ ID NO: 1315381 - RNA, 16 nt, Human
uagaguugcugagagg

SEQ ID NO: 1315382 - RNA, 18 nt, Human
uagaguuuuuaaacauca

SEQ ID NO: 1315383 - RNA, 19 nt, Human
uagauaaaacaucuuugaa

SEQ ID NO: 1315384 - RNA, 20 nt, Human
uagauaaaacaucuuugaaa

SEQ ID NO: 1315385 - RNA, 21 nt, Human
uagauaaaacaucuuugaaau

SEQ ID NO: 1315386 - RNA, 17 nt, Human
uagaguagaagucucuu

SEQ ID NO: 1315387 - RNA, 13 nt, Human
uagaguccaaggu

SEQ ID NO: 1315388 - RNA, 16 nt, Human
uagaguccaagguuua

SEQ ID NO: 1315389 - RNA, 20 nt, Human
uagagucccagguuggcucu

SEQ ID NO: 1315390 - RNA, 14 nt, Human
uagagacuggaaca

SEQ ID NO: 1315391 - RNA, 18 nt, Human
uagagacuggaacacuag

SEQ ID NO: 1315392 - RNA, 16 nt, Human
uaggaauuguguuuau

SEQ ID NO: 1315393 - RNA, 22 nt, Human
uaggaaguugacuuauaguaca

SEQ ID NO: 1315394 - RNA, 14 nt, Human
uaggaauuguguuu

SEQ ID NO: 1315395 - RNA, 23 nt, Human
uaggaauugacccacaagaaaug

SEQ ID NO: 1315396 - RNA, 15 nt, Human
uaggaauagcauguc

SEQ ID NO: 1315397 - RNA, 17 nt, Human
uaggaaguugacuuaua

SEQ ID NO: 1315398 - RNA, 16 nt, Human
uaggaaguaaauuaua

SEQ ID NO: 1315399 - RNA, 24 nt, Human
uaggaagguacuguaugaucaaau

SEQ ID NO: 1315400 - RNA, 18 nt, Human
uaggaagguacuguauga

SEQ ID NO: 1315401 - RNA, 16 nt, Human
uaggaagguacuguau

SEQ ID NO: 1315402 - RNA, 15 nt, Human
uaggaagguacugua

SEQ ID NO: 1315403 - RNA, 14 nt, Human
uaggaagguacugu

SEQ ID NO: 1315404 - RNA, 17 nt, Human
uaggccagagcccacuc

SEQ ID NO: 1315405 - RNA, 13 nt, Human
uaggccagcaagc

SEQ ID NO: 1315406 - RNA, 22 nt, Human
uaggccagccgcgcaucagacu

SEQ ID NO: 1315407 - RNA, 23 nt, Human
uaggccagcaagcggggaugucc

SEQ ID NO: 1315408 - RNA, 19 nt, Human
uaggccucaggugaaacuc

SEQ ID NO: 1315409 - RNA, 16 nt, Human
uaggccaugggacagg

SEQ ID NO: 1315410 - RNA, 13 nt, Human
uaggccaugggac

SEQ ID NO: 1315411 - RNA, 18 nt, Human
uaggccaagguguccuac

SEQ ID NO: 1315412 - RNA, 21 nt, Human
uaggccaagguguccuacaga

SEQ ID NO: 1315413 - RNA, 23 nt, Human
uaggccaagguguccuacagaaa

SEQ ID NO: 1315414 - RNA, 22 nt, Human
uaggccaagguguccuacagaa

SEQ ID NO: 1315415 - RNA, 14 nt, Human
uaggccagagccca

SEQ ID NO: 1315416 - RNA, 16 nt, Human
uaggccagagcccacu

SEQ ID NO: 1315417 - RNA, 12 nt, Human
uaggaagaaaga

SEQ ID NO: 1315418 - RNA, 17 nt, Human
uaggaagaaagaagaca

SEQ ID NO: 1315419 - RNA, 19 nt, Human
uaggaagaaagaagacaaa

SEQ ID NO: 1315420 - RNA, 18 nt, Human
uaggaagagcaggacucc

SEQ ID NO: 1315421 - RNA, 21 nt, Human
uaggaagagccuuccacccag

SEQ ID NO: 1315422 - RNA, 14 nt, Human
uaggaagccucaga

SEQ ID NO: 1315423 - RNA, 15 nt, Human
uagcugggauuacag

SEQ ID NO: 1315424 - RNA, 22 nt, Human
uagcuggcucugugagggugcu

SEQ ID NO: 1315425 - RNA, 22 nt, Human
uaggaaauggcuuugugauuca

SEQ ID NO: 1315426 - RNA, 23 nt, Human
uaggaaauggcuuugugauucaa

SEQ ID NO: 1315427 - RNA, 21 nt, Human
uaggaaauguuuuuaauaaaa

SEQ ID NO: 1315428 - RNA, 22 nt, Human
uagcugggagaaagagagagcu

SEQ ID NO: 1315429 - RNA, 11 nt, Human
uagcucugggg

SEQ ID NO: 1315430 - RNA, 22 nt, Human
uagcucuggggugggcaguuuu

SEQ ID NO: 1315431 - RNA, 23 nt, Human
uagcucuggggugggcaguuuuu

SEQ ID NO: 1315432 - RNA, 12 nt, Human
uagcucugagaa

SEQ ID NO: 1315433 - RNA, 23 nt, Human
uagcucuuguugagccgugggca

SEQ ID NO: 1315434 - RNA, 13 nt, Human
uagcucuuuguca

SEQ ID NO: 1315435 - RNA, 18 nt, Human
uagcucuuugucagggag

SEQ ID NO: 1315436 - RNA, 21 nt, Human
uagcucuaauguuugcauaua

SEQ ID NO: 1315437 - RNA, 11 nt, Human
uagcucugaga

SEQ ID NO: 1315438 - RNA, 13 nt, Human
uagcucugagaac

SEQ ID NO: 1315439 - RNA, 20 nt, Human
uagcucuaauguuugcauau

SEQ ID NO: 1315440 - RNA, 19 nt, Human
uagcucuaauguuugcaua

SEQ ID NO: 1315441 - RNA, 18 nt, Human
uagcucuaauguuugcau

SEQ ID NO: 1315442 - RNA, 17 nt, Human
uagcucuaauguuugca

SEQ ID NO: 1315443 - RNA, 12 nt, Human
uagcuccucccc

SEQ ID NO: 1315444 - RNA, 14 nt, Human
uagcucuaaaaucu

SEQ ID NO: 1315445 - RNA, 22 nt, Human
uagcucuaaaaucugcuuguau

SEQ ID NO: 1315446 - RNA, 20 nt, Human
uagcuccuguggccccaccc

SEQ ID NO: 1315447 - RNA, 22 nt, Human
uagcuccuguggccccacccug

SEQ ID NO: 1315448 - RNA, 12 nt, Human
uagcuccugugg

SEQ ID NO: 1315449 - RNA, 13 nt, Human
uagcuccuguggc

SEQ ID NO: 1315450 - RNA, 14 nt, Human
uagcuccuguggcc

SEQ ID NO: 1315451 - RNA, 16 nt, Human
uagcuccuguggcccc

SEQ ID NO: 1315452 - RNA, 11 nt, Human
uagcuccuccc

SEQ ID NO: 1315453 - RNA, 15 nt, Human
uagcuccuccccugg

SEQ ID NO: 1315454 - RNA, 18 nt, Human
uagcauaaacacaucaca

SEQ ID NO: 1315455 - RNA, 23 nt, Human
uagcauaaacacaucacagauga

SEQ ID NO: 1315456 - RNA, 24 nt, Human
uagcaguggcaggcagaggcccag

SEQ ID NO: 1315457 - RNA, 16 nt, Human
uagcaguccccuuccc

SEQ ID NO: 1315458 - RNA, 15 nt, Human
uagcaguggcaggca

SEQ ID NO: 1315459 - RNA, 16 nt, Human
uagcaguggcaggcag

SEQ ID NO: 1315460 - RNA, 18 nt, Human
uagcaguggcaggcagag

SEQ ID NO: 1315461 - RNA, 18 nt, Human
uagcccaaugaaaugaau

SEQ ID NO: 1315462 - RNA, 21 nt, Human
uagcccacuuacauuuacaaa

SEQ ID NO: 1315463 - RNA, 13 nt, Human
uagccccagugac

SEQ ID NO: 1315464 - RNA, 13 nt, Human
uagccccauaauu

SEQ ID NO: 1315465 - RNA, 17 nt, Human
uagccccagugacagcu

SEQ ID NO: 1315466 - RNA, 18 nt, Human
uagcccucacccuggggc

SEQ ID NO: 1315467 - RNA, 18 nt, Human
uagcccuccuuuuuccaa

SEQ ID NO: 1315468 - RNA, 20 nt, Human
uagcccuccuuuuuccaaca

SEQ ID NO: 1315469 - RNA, 13 nt, Human
uagcccuguccug

SEQ ID NO: 1315470 - RNA, 14 nt, Human
uagcccuguccugg

SEQ ID NO: 1315471 - RNA, 15 nt, Human
uagcccuguccuggu

SEQ ID NO: 1315472 - RNA, 22 nt, Human
uagcccuguccuggugguauuu

SEQ ID NO: 1315473 - RNA, 17 nt, Human
uagcccuguccuggugg

SEQ ID NO: 1315474 - RNA, 19 nt, Human
uagccucaauuucugaaca

SEQ ID NO: 1315475 - RNA, 23 nt, Human
uagccucacuuuuaaugaacaaa

SEQ ID NO: 1315476 - RNA, 18 nt, Human
uagccucacuuuuaauga

SEQ ID NO: 1315477 - RNA, 12 nt, Human
uagccucagggg

SEQ ID NO: 1315478 - RNA, 22 nt, Human
uagccucaggggucugagcucc

SEQ ID NO: 1315479 - RNA, 16 nt, Human
uagccucugucuggca

SEQ ID NO: 1315480 - RNA, 18 nt, Human
uagucaaauugugugaaa

SEQ ID NO: 1315481 - RNA, 15 nt, Human
uaggcuagggugggg

SEQ ID NO: 1315482 - RNA, 15 nt, Human
uagucaaucaagucu

SEQ ID NO: 1315483 - RNA, 18 nt, Human
uagucaaucaagucuguu

SEQ ID NO: 1315484 - RNA, 19 nt, Human
uagucaaucaagucuguuu

SEQ ID NO: 1315485 - RNA, 21 nt, Human
uagucaaucaagucuguuuac

SEQ ID NO: 1315486 - RNA, 18 nt, Human
uagucaaugacaugaauu

SEQ ID NO: 1315487 - RNA, 19 nt, Human
uagucaaugacaugaauuu

SEQ ID NO: 1315488 - RNA, 13 nt, Human
uaggcuagggugg

SEQ ID NO: 1315489 - RNA, 18 nt, Human
uaggcuacagagaagccu

SEQ ID NO: 1315490 - RNA, 19 nt, Human
uaggcuacagagaagccuu

SEQ ID NO: 1315491 - RNA, 20 nt, Human
uaggcuacagagaagccuuc

SEQ ID NO: 1315492 - RNA, 21 nt, Human
uaggcuacagagaagccuuca

SEQ ID NO: 1315493 - RNA, 12 nt, Human
uaggcuacagag

SEQ ID NO: 1315494 - RNA, 13 nt, Human
uaggcuacagaga

SEQ ID NO: 1315495 - RNA, 14 nt, Human
uaggcuacagagaa

SEQ ID NO: 1315496 - RNA, 15 nt, Human
uaggcuacagagaag

SEQ ID NO: 1315497 - RNA, 16 nt, Human
uaggcuacagagaagc

SEQ ID NO: 1315498 - RNA, 17 nt, Human
uaggcuacagagaagcc

SEQ ID NO: 1315499 - RNA, 24 nt, Human
uaggccuugcggcuccucagggac

SEQ ID NO: 1315500 - RNA, 23 nt, Human
uaggccuugcggcuccucaggga

SEQ ID NO: 1315501 - RNA, 19 nt, Human
uaggcggggcuugccuucu

SEQ ID NO: 1315502 - RNA, 22 nt, Human
uaggcggggcuugccuucuggu

SEQ ID NO: 1315503 - RNA, 20 nt, Human
uagugauuuuuaugccaccu

SEQ ID NO: 1315504 - RNA, 21 nt, Human
uagugauuuuuaugccaccug

SEQ ID NO: 1315505 - RNA, 14 nt, Human
uagugaugguuccc

SEQ ID NO: 1315506 - RNA, 18 nt, Human
uagugaugguuccccugu

SEQ ID NO: 1315507 - RNA, 22 nt, Human
uagugauuuuuaugccaccuga

SEQ ID NO: 1315508 - RNA, 17 nt, Human
uagugcuacagggucca

SEQ ID NO: 1315509 - RNA, 15 nt, Human
uagugcuacaggguc

SEQ ID NO: 1315510 - RNA, 22 nt, Human
uagugcugcugugugcuuuuuu

SEQ ID NO: 1315511 - RNA, 12 nt, Human
uagugcuuugag

SEQ ID NO: 1315512 - RNA, 15 nt, Human
uagugcuuugagaga

SEQ ID NO: 1315513 - RNA, 15 nt, Human
uaguggaaaaggcac

SEQ ID NO: 1315514 - RNA, 18 nt, Human
uaguuguaaaccaaguga

SEQ ID NO: 1315515 - RNA, 19 nt, Human
uaguguaucaaaaugcucu

SEQ ID NO: 1315516 - RNA, 15 nt, Human
uaguguaugauuacu

SEQ ID NO: 1315517 - RNA, 19 nt, Human
uaguguaugauuacuggcc

SEQ ID NO: 1315518 - RNA, 17 nt, Human
uaguguaucaaaaugcu

SEQ ID NO: 1315519 - RNA, 14 nt, Human
uaguguaucaaaau

SEQ ID NO: 1315520 - RNA, 12 nt, Human
uaguguaucaaa

SEQ ID NO: 1315521 - RNA, 15 nt, Human
uaguggauggaaggg

SEQ ID NO: 1315522 - RNA, 18 nt, Human
uaguggauggaaggggcu

SEQ ID NO: 1315523 - RNA, 17 nt, Human
uaguggauuacugccau

SEQ ID NO: 1315524 - RNA, 23 nt, Human
uaguggauuacugccauucacuu

SEQ ID NO: 1315525 - RNA, 13 nt, Human
uaguuucugaggc

SEQ ID NO: 1315526 - RNA, 12 nt, Human
uaguuucugagu

SEQ ID NO: 1315527 - RNA, 20 nt, Human
uaguuucugaguuuuaccaa

SEQ ID NO: 1315528 - RNA, 21 nt, Human
uaguuguaccgcaaugugacu

SEQ ID NO: 1315529 - RNA, 17 nt, Human
uaguugucuuuccuggc

SEQ ID NO: 1315530 - RNA, 12 nt, Human
uaguugugucug

SEQ ID NO: 1315531 - RNA, 15 nt, Human
uaguuguguuucaac

SEQ ID NO: 1315532 - RNA, 21 nt, Human
uaguuucaguagauugcagaa

SEQ ID NO: 1315533 - RNA, 19 nt, Human
uaguuucauauaaaguauc

SEQ ID NO: 1315534 - RNA, 20 nt, Human
uaguuucauauaaaguauca

SEQ ID NO: 1315535 - RNA, 13 nt, Human
uaguuuccuuuuu

SEQ ID NO: 1315536 - RNA, 15 nt, Human
uaguuuuauaugcuu

SEQ ID NO: 1315537 - RNA, 20 nt, Human
uaguuuuacuuuuaaacugu

SEQ ID NO: 1315538 - RNA, 22 nt, Human
uaguuuuacuuuuaaacugugu

SEQ ID NO: 1315539 - RNA, 19 nt, Human
uauaaauauauauucuauu

SEQ ID NO: 1315540 - RNA, 15 nt, Human
uauaaauauauuauu

SEQ ID NO: 1315541 - RNA, 15 nt, Human
uauaaauauauuuaa

SEQ ID NO: 1315542 - RNA, 19 nt, Human
uauaaauauauuauuacuu

SEQ ID NO: 1315543 - RNA, 21 nt, Human
uaguuugauuauucaguguca

SEQ ID NO: 1315544 - RNA, 11 nt, Human
uaguuuggaua

SEQ ID NO: 1315545 - RNA, 19 nt, Human
uaguuuguguguugucucu

SEQ ID NO: 1315546 - RNA, 14 nt, Human
uaguuuuacuuuua

SEQ ID NO: 1315547 - RNA, 18 nt, Human
uauaacaaugcuguauuu

SEQ ID NO: 1315548 - RNA, 16 nt, Human
uauaaugaauuuagug

SEQ ID NO: 1315549 - RNA, 20 nt, Human
uauacuauaguaccaguagg

SEQ ID NO: 1315550 - RNA, 16 nt, Human
uauacuauauuuaugg

SEQ ID NO: 1315551 - RNA, 19 nt, Human
uauacuauuaaaaagguuu

SEQ ID NO: 1315552 - RNA, 17 nt, Human
uauacucacuuucuaga

SEQ ID NO: 1315553 - RNA, 20 nt, Human
uauaccugauuuuuuuuccu

SEQ ID NO: 1315554 - RNA, 20 nt, Human
uauacucuuauagacaacau

SEQ ID NO: 1315555 - RNA, 21 nt, Human
uauacuauuaaaaagguuuac

SEQ ID NO: 1315556 - RNA, 18 nt, Human
uauacucuagaugaaguu

SEQ ID NO: 1315557 - RNA, 16 nt, Human
uauacucuuucuguau

SEQ ID NO: 1315558 - RNA, 17 nt, Human
uauacucuuucuguaua

SEQ ID NO: 1315559 - RNA, 19 nt, Human
uauacucuuucuguauaua

SEQ ID NO: 1315560 - RNA, 22 nt, Human
uauacucuuucuguauauacuu

SEQ ID NO: 1315561 - RNA, 22 nt, Human
uauacccacccagaaugagaca

SEQ ID NO: 1315562 - RNA, 15 nt, Human
uauaauucucauuaa

SEQ ID NO: 1315563 - RNA, 16 nt, Human
uauaauucucauuaaa

SEQ ID NO: 1315564 - RNA, 15 nt, Human
uauacccacccagaa

SEQ ID NO: 1315565 - RNA, 17 nt, Human
uauacccccugcaaagc

SEQ ID NO: 1315566 - RNA, 22 nt, Human
uauaccucaauuuucacugugu

SEQ ID NO: 1315567 - RNA, 12 nt, Human
uauaccucacuu

SEQ ID NO: 1315568 - RNA, 12 nt, Human
uauaccugauuu

SEQ ID NO: 1315569 - RNA, 21 nt, Human
uauaccucaauuuucacugug

SEQ ID NO: 1315570 - RNA, 15 nt, Human
uauaauucaccuucu

SEQ ID NO: 1315571 - RNA, 13 nt, Human
uauaaugauuauu

SEQ ID NO: 1315572 - RNA, 14 nt, Human
uauauuuuaagacg

SEQ ID NO: 1315573 - RNA, 16 nt, Human
uauauuuuacaauuuu

SEQ ID NO: 1315574 - RNA, 13 nt, Human
uauauuuuaagac

SEQ ID NO: 1315575 - RNA, 23 nt, Human
uauauuucuauuuuauuaugaag

SEQ ID NO: 1315576 - RNA, 13 nt, Human
uauauuuuaagaa

SEQ ID NO: 1315577 - RNA, 13 nt, Human
uauauuugaaaua

SEQ ID NO: 1315578 - RNA, 14 nt, Human
uauauuugaaauau

SEQ ID NO: 1315579 - RNA, 20 nt, Human
uauauuugaaauauugacuu

SEQ ID NO: 1315580 - RNA, 19 nt, Human
uauauguaccguaggcuuu

SEQ ID NO: 1315581 - RNA, 12 nt, Human
uauauguacaug

SEQ ID NO: 1315582 - RNA, 12 nt, Human
uauauguacagu

SEQ ID NO: 1315583 - RNA, 18 nt, Human
uauauguacccucugaaa

SEQ ID NO: 1315584 - RNA, 19 nt, Human
uauauguacccucugaaau

SEQ ID NO: 1315585 - RNA, 22 nt, Human
uauauguacccucugaaauaca

SEQ ID NO: 1315586 - RNA, 20 nt, Human
uauauggggaugguaguuuu

SEQ ID NO: 1315587 - RNA, 21 nt, Human
uauauggggaugguaguuuuu

SEQ ID NO: 1315588 - RNA, 23 nt, Human
uauauuuauuacuguaagaaaau

SEQ ID NO: 1315589 - RNA, 16 nt, Human
uauauuuccacuucuu

SEQ ID NO: 1315590 - RNA, 21 nt, Human
uauaugcacuuauaauuuucc

SEQ ID NO: 1315591 - RNA, 19 nt, Human
uauaugaggacuugugucu

SEQ ID NO: 1315592 - RNA, 13 nt, Human
uauaugauggggg

SEQ ID NO: 1315593 - RNA, 20 nt, Human
uauauacucaagagugguau

SEQ ID NO: 1315594 - RNA, 16 nt, Human
uauauaccaaagcaca

SEQ ID NO: 1315595 - RNA, 21 nt, Human
uauauaccaaagcacauuuua

SEQ ID NO: 1315596 - RNA, 21 nt, Human
uauacucucaccauuuggauc

SEQ ID NO: 1315597 - RNA, 16 nt, Human
uauacuugaaugaaaa

SEQ ID NO: 1315598 - RNA, 14 nt, Human
uauacuugaaugaa

SEQ ID NO: 1315599 - RNA, 13 nt, Human
uauacuuguaauu

SEQ ID NO: 1315600 - RNA, 14 nt, Human
uauacuuguaauua

SEQ ID NO: 1315601 - RNA, 15 nt, Human
uauacuuguaauuau

SEQ ID NO: 1315602 - RNA, 16 nt, Human
uauacuuguaauuaug

SEQ ID NO: 1315603 - RNA, 18 nt, Human
uauacuuguaauuaugga

SEQ ID NO: 1315604 - RNA, 22 nt, Human
uauacuuguaauuauggaguca

SEQ ID NO: 1315605 - RNA, 19 nt, Human
uauauaaguguacauaugu

SEQ ID NO: 1315606 - RNA, 23 nt, Human
uauauaaguguacauaugugcug

SEQ ID NO: 1315607 - RNA, 16 nt, Human
uauauaaucaucaagu

SEQ ID NO: 1315608 - RNA, 14 nt, Human
uauauaauugccaa

SEQ ID NO: 1315609 - RNA, 13 nt, Human
uauauaauugcca

SEQ ID NO: 1315610 - RNA, 22 nt, Human
uaucaugugaaaucauucauuu

SEQ ID NO: 1315611 - RNA, 17 nt, Human
uaucaugugaaaucauu

SEQ ID NO: 1315612 - RNA, 21 nt, Human
uaucaugucaaacgugaaaau

SEQ ID NO: 1315613 - RNA, 14 nt, Human
uauccuucagccug

SEQ ID NO: 1315614 - RNA, 21 nt, Human
uauccuguuugaggaaagcaa

SEQ ID NO: 1315615 - RNA, 22 nt, Human
uauccuguuugaggaaagcaag

SEQ ID NO: 1315616 - RNA, 20 nt, Human
uauccuggagcauuguguau

SEQ ID NO: 1315617 - RNA, 16 nt, Human
uaucucuucagucucu

SEQ ID NO: 1315618 - RNA, 22 nt, Human
uaucuaaauauggacugcucag

SEQ ID NO: 1315619 - RNA, 14 nt, Human
uaucucuucagucu

SEQ ID NO: 1315620 - RNA, 13 nt, Human
uaucucuucaguc

SEQ ID NO: 1315621 - RNA, 12 nt, Human
uaucucuucagu

SEQ ID NO: 1315622 - RNA, 23 nt, Human
uaucuaaacuggauucacagcuc

SEQ ID NO: 1315623 - RNA, 18 nt, Human
uaucguuuucuuaaagug

SEQ ID NO: 1315624 - RNA, 17 nt, Human
uaucggcacuguacaaa

SEQ ID NO: 1315625 - RNA, 13 nt, Human
uaucggcacugua

SEQ ID NO: 1315626 - RNA, 18 nt, Human
uaucgcuucauguaacua

SEQ ID NO: 1315627 - RNA, 23 nt, Human
uaucgacuuguuuuugcacaugu

SEQ ID NO: 1315628 - RNA, 17 nt, Human
uaucgcugggaaaugag

SEQ ID NO: 1315629 - RNA, 19 nt, Human
uauauuuuuuguuaaauga

SEQ ID NO: 1315630 - RNA, 19 nt, Human
uaucaggcaaauuugcauu

SEQ ID NO: 1315631 - RNA, 20 nt, Human
uaucaggacccagaggaagg

SEQ ID NO: 1315632 - RNA, 21 nt, Human
uaucaggacccagaggaaggg

SEQ ID NO: 1315633 - RNA, 16 nt, Human
uaucaugucaaacgug

SEQ ID NO: 1315634 - RNA, 14 nt, Human
uaucauccacacau

SEQ ID NO: 1315635 - RNA, 15 nt, Human
uaucauccacacaug

SEQ ID NO: 1315636 - RNA, 17 nt, Human
uaucauccacacaugaa

SEQ ID NO: 1315637 - RNA, 16 nt, Human
uaucaucuaccuagau

SEQ ID NO: 1315638 - RNA, 17 nt, Human
uaucaucuaccuagauu

SEQ ID NO: 1315639 - RNA, 22 nt, Human
uaucaucuaccuagauuuaaua

SEQ ID NO: 1315640 - RNA, 15 nt, Human
uaucaguuacacaug

SEQ ID NO: 1315641 - RNA, 13 nt, Human
uaucagugcuucc

SEQ ID NO: 1315642 - RNA, 22 nt, Human
uaucagucuuguaccaaggcaa

SEQ ID NO: 1315643 - RNA, 11 nt, Human
uaucagugcuu

SEQ ID NO: 1315644 - RNA, 23 nt, Human
uaucaucaguguagaaccuaauu

SEQ ID NO: 1315645 - RNA, 14 nt, Human
uacagaagaaacug

SEQ ID NO: 1315646 - RNA, 15 nt, Human
uacagaacuucagaa

SEQ ID NO: 1315647 - RNA, 18 nt, Human
uacagaacuucagaaaga

SEQ ID NO: 1315648 - RNA, 19 nt, Human
uacagaacuucagaaagac

SEQ ID NO: 1315649 - RNA, 11 nt, Human
uacagaacuac

SEQ ID NO: 1315650 - RNA, 16 nt, Human
uacagaacucuuucaa

SEQ ID NO: 1315651 - RNA, 17 nt, Human
uacagaacucuuucaaa

SEQ ID NO: 1315652 - RNA, 19 nt, Human
uacagaacucuuucaaaac

SEQ ID NO: 1315653 - RNA, 14 nt, Human
uacagaaagcugcc

SEQ ID NO: 1315654 - RNA, 19 nt, Human
uacagaaauuuaauucaga

SEQ ID NO: 1315655 - RNA, 20 nt, Human
uacagaaauuuaauucagaa

SEQ ID NO: 1315656 - RNA, 13 nt, Human
uacagaauuuuau

SEQ ID NO: 1315657 - RNA, 23 nt, Human
uacagaauuacuguaacugauua

SEQ ID NO: 1315658 - RNA, 15 nt, Human
uacagaauuacugua

SEQ ID NO: 1315659 - RNA, 16 nt, Human
uacagcacccuguggu

SEQ ID NO: 1315660 - RNA, 18 nt, Human
uacagaaaaguugaauuu

SEQ ID NO: 1315661 - RNA, 15 nt, Human
uacagaaaaaccuug

SEQ ID NO: 1315662 - RNA, 20 nt, Human
uacagaaaaaccuuggguua

SEQ ID NO: 1315663 - RNA, 22 nt, Human
uacagaaaaguugaauuuuaca

SEQ ID NO: 1315664 - RNA, 16 nt, Human
uacagaaaaaccuugg

SEQ ID NO: 1315665 - RNA, 13 nt, Human
uacagaaagcugc

SEQ ID NO: 1315666 - RNA, 15 nt, Human
uacaggaaacaguug

SEQ ID NO: 1315667 - RNA, 21 nt, Human
uacaggaaacaguugcaugua

SEQ ID NO: 1315668 - RNA, 13 nt, Human
uacaggaacuuca

SEQ ID NO: 1315669 - RNA, 15 nt, Human
uacaggcauagaguu

SEQ ID NO: 1315670 - RNA, 12 nt, Human
uacagugucuuu

SEQ ID NO: 1315671 - RNA, 13 nt, Human
uacagugucuuuu

SEQ ID NO: 1315672 - RNA, 15 nt, Human
uacagccucagaaac

SEQ ID NO: 1315673 - RNA, 17 nt, Human
uacaauuuuuuaucaug

SEQ ID NO: 1315674 - RNA, 23 nt, Human
uacaauuuuuuaucaugcauguc

SEQ ID NO: 1315675 - RNA, 18 nt, Human
uacaauuuuuuuuauuag

SEQ ID NO: 1315676 - RNA, 19 nt, Human
uacaauuuuuuuuauuagu

SEQ ID NO: 1315677 - RNA, 21 nt, Human
uacaauuuuuuuuauuaguau

SEQ ID NO: 1315678 - RNA, 13 nt, Human
uacacaacucacu

SEQ ID NO: 1315679 - RNA, 14 nt, Human
uacacaacucacuc

SEQ ID NO: 1315680 - RNA, 15 nt, Human
uacacaacucacucc

SEQ ID NO: 1315681 - RNA, 22 nt, Human
uacacaacucacuccuuuuaaa

SEQ ID NO: 1315682 - RNA, 15 nt, Human
uacaagacacaguga

SEQ ID NO: 1315683 - RNA, 21 nt, Human
uacaagaagcauuuuguaagu

SEQ ID NO: 1315684 - RNA, 19 nt, Human
uacaagaagcauuuuguaa

SEQ ID NO: 1315685 - RNA, 16 nt, Human
uacaagacugccauau

SEQ ID NO: 1315686 - RNA, 19 nt, Human
uacaagacugccauauuaa

SEQ ID NO: 1315687 - RNA, 20 nt, Human
uacaagacugccauauuaaa

SEQ ID NO: 1315688 - RNA, 23 nt, Human
uacaagagaaaaagcagaggcca

SEQ ID NO: 1315689 - RNA, 19 nt, Human
uacaagagcuuaacagugu

SEQ ID NO: 1315690 - RNA, 22 nt, Human
uacaagacugccauauuaaauu

SEQ ID NO: 1315691 - RNA, 24 nt, Human
uacaagaugaaggagaggcaacau

SEQ ID NO: 1315692 - RNA, 17 nt, Human
uaauuuugaaaaacugc

SEQ ID NO: 1315693 - RNA, 13 nt, Human
uaauuuugaaaaa

SEQ ID NO: 1315694 - RNA, 12 nt, Human
uaauuuucuacc

SEQ ID NO: 1315695 - RNA, 18 nt, Human
uaauuuugaagugcuguu

SEQ ID NO: 1315696 - RNA, 22 nt, Human
uaauuuugaagugcuguuuauu

SEQ ID NO: 1315697 - RNA, 13 nt, Human
uaauuuuggauuu

SEQ ID NO: 1315698 - RNA, 13 nt, Human
uaauuuugugaag

SEQ ID NO: 1315699 - RNA, 12 nt, Human
uaauuuuguaau

SEQ ID NO: 1315700 - RNA, 19 nt, Human
uaauuuuguaauguaucaa

SEQ ID NO: 1315701 - RNA, 14 nt, Human
uaauuuuguaucuu

SEQ ID NO: 1315702 - RNA, 15 nt, Human
uacacaauaagcaaa

SEQ ID NO: 1315703 - RNA, 16 nt, Human
uacacaauagaauuau

SEQ ID NO: 1315704 - RNA, 18 nt, Human
uacacaauagaauuauaa

SEQ ID NO: 1315705 - RNA, 14 nt, Human
uacacaauaagcaa

SEQ ID NO: 1315706 - RNA, 18 nt, Human
uacacagaaauacaguua

SEQ ID NO: 1315707 - RNA, 17 nt, Human
uacacagcaccagaaug

SEQ ID NO: 1315708 - RNA, 15 nt, Human
uacacagcucuagac

SEQ ID NO: 1315709 - RNA, 20 nt, Human
uacacugucagcagggacug

SEQ ID NO: 1315710 - RNA, 15 nt, Human
uacccaaauuaagag

SEQ ID NO: 1315711 - RNA, 14 nt, Human
uacccaaacugcuu

SEQ ID NO: 1315712 - RNA, 15 nt, Human
uacccaaacugcuuu

SEQ ID NO: 1315713 - RNA, 12 nt, Human
uacccacccaga

SEQ ID NO: 1315714 - RNA, 20 nt, Human
uacccaccgggccacuccuu

SEQ ID NO: 1315715 - RNA, 22 nt, Human
uacccaccgggccacuccuucc

SEQ ID NO: 1315716 - RNA, 14 nt, Human
uaccaauaaaguga

SEQ ID NO: 1315717 - RNA, 17 nt, Human
uaccaauaaagugaccc

SEQ ID NO: 1315718 - RNA, 13 nt, Human
uaccaauaaagug

SEQ ID NO: 1315719 - RNA, 12 nt, Human
uaccaauaaagu

SEQ ID NO: 1315720 - RNA, 18 nt, Human
uaccaaggucuucuuaau

SEQ ID NO: 1315721 - RNA, 14 nt, Human
uaccaagucaaacu

SEQ ID NO: 1315722 - RNA, 16 nt, Human
uaccaaguuucaggua

SEQ ID NO: 1315723 - RNA, 21 nt, Human
uaccaaguuucagguauuaag

SEQ ID NO: 1315724 - RNA, 18 nt, Human
uaccacaaugcagugccu

SEQ ID NO: 1315725 - RNA, 15 nt, Human
uaccaaucauuuuaa

SEQ ID NO: 1315726 - RNA, 19 nt, Human
uaccaaucauuuuaauuau

SEQ ID NO: 1315727 - RNA, 20 nt, Human
uaccaaucauuuuaauuauu

SEQ ID NO: 1315728 - RNA, 22 nt, Human
uaccaaucauuuuaauuauuau

SEQ ID NO: 1315729 - RNA, 13 nt, Human
uaccaaugaaaaa

SEQ ID NO: 1315730 - RNA, 15 nt, Human
uaccaaugaaaaaau

SEQ ID NO: 1315731 - RNA, 17 nt, Human
uaccaaugaaaaaaugu

SEQ ID NO: 1315732 - RNA, 23 nt, Human
uaccacaggaaccacaagacugc

SEQ ID NO: 1315733 - RNA, 15 nt, Human
uaccaccacgcccgg

SEQ ID NO: 1315734 - RNA, 18 nt, Human
uaccaccagucugacugu

SEQ ID NO: 1315735 - RNA, 13 nt, Human
uaccaccagcugu

SEQ ID NO: 1315736 - RNA, 14 nt, Human
uaccaccagcugug

SEQ ID NO: 1315737 - RNA, 18 nt, Human
uaccaccagcugugucca

SEQ ID NO: 1315738 - RNA, 13 nt, Human
uaccauuuacaug

SEQ ID NO: 1315739 - RNA, 17 nt, Human
uaccauuuacauguuuu

SEQ ID NO: 1315740 - RNA, 18 nt, Human
uaccauuuuaaaguuagu

SEQ ID NO: 1315741 - RNA, 15 nt, Human
uaccauuuucugguu

SEQ ID NO: 1315742 - RNA, 16 nt, Human
uaccauuuucugguuc

SEQ ID NO: 1315743 - RNA, 12 nt, Human
uaccauuucaga

SEQ ID NO: 1315744 - RNA, 15 nt, Human
uaccauuucagagag

SEQ ID NO: 1315745 - RNA, 16 nt, Human
uaccauuucagagagg

SEQ ID NO: 1315746 - RNA, 15 nt, Human
uaccauuugccuccc

SEQ ID NO: 1315747 - RNA, 16 nt, Human
uacauuuguauaaaau

SEQ ID NO: 1315748 - RNA, 19 nt, Human
uacauuugggaguuuuuau

SEQ ID NO: 1315749 - RNA, 17 nt, Human
uacauuuguauaaaaua

SEQ ID NO: 1315750 - RNA, 11 nt, Human
uacauuugugu

SEQ ID NO: 1315751 - RNA, 22 nt, Human
uacaugagguacugagagugaa

SEQ ID NO: 1315752 - RNA, 21 nt, Human
uacaugagguacugagaguga

SEQ ID NO: 1315753 - RNA, 13 nt, Human
uacaugaggacuc

SEQ ID NO: 1315754 - RNA, 14 nt, Human
uacaugaggacucu

SEQ ID NO: 1315755 - RNA, 21 nt, Human
uacaugaggacucuauucuuu

SEQ ID NO: 1315756 - RNA, 22 nt, Human
uacaugaggacucuauucuuua

SEQ ID NO: 1315757 - RNA, 23 nt, Human
uacaugaggacucuauucuuuaa

SEQ ID NO: 1315758 - RNA, 15 nt, Human
uacaugauucauuuu

SEQ ID NO: 1315759 - RNA, 14 nt, Human
uacaugauucauuu

SEQ ID NO: 1315760 - RNA, 16 nt, Human
uacauuuuguaccaac

SEQ ID NO: 1315761 - RNA, 14 nt, Human
uacauuuuguacca

SEQ ID NO: 1315762 - RNA, 19 nt, Human
uacauuuucuaagaaacau

SEQ ID NO: 1315763 - RNA, 20 nt, Human
uacauuuucuaagaaacauu

SEQ ID NO: 1315764 - RNA, 17 nt, Human
uacauuuuguaccaacc

SEQ ID NO: 1315765 - RNA, 12 nt, Human
uacauuuuaugg

SEQ ID NO: 1315766 - RNA, 15 nt, Human
uacauuuucuaagaa

SEQ ID NO: 1315767 - RNA, 21 nt, Human
uacauuugggaguuuuuauga

SEQ ID NO: 1315768 - RNA, 12 nt, Human
uaccaaagcaca

SEQ ID NO: 1315769 - RNA, 17 nt, Human
uaccaaagaugaaugaa

SEQ ID NO: 1315770 - RNA, 12 nt, Human
uaccaaccuguu

SEQ ID NO: 1315771 - RNA, 18 nt, Human
uacaguuccuagguauaa

SEQ ID NO: 1315772 - RNA, 21 nt, Human
uacaguuagggcuccuauuca

SEQ ID NO: 1315773 - RNA, 19 nt, Human
uacaguuaucuaaguuaau

SEQ ID NO: 1315774 - RNA, 14 nt, Human
uacagugucuuuuu

SEQ ID NO: 1315775 - RNA, 21 nt, Human
uacagugucuuuuuuuguaua

SEQ ID NO: 1315776 - RNA, 12 nt, Human
uacaguguuacc

SEQ ID NO: 1315777 - RNA, 23 nt, Human
uacagugucuuuuuuuguauagu

SEQ ID NO: 1315778 - RNA, 15 nt, Human
uacaguguuuauccu

SEQ ID NO: 1315779 - RNA, 23 nt, Human
uacaguguuuauccuuucauaua

SEQ ID NO: 1315780 - RNA, 13 nt, Human
uacaguuaaguuu

SEQ ID NO: 1315781 - RNA, 18 nt, Human
uacaucuauuuuggauug

SEQ ID NO: 1315782 - RNA, 19 nt, Human
uacaucuauuuuggauugu

SEQ ID NO: 1315783 - RNA, 20 nt, Human
uacaucuauuuuggauugua

SEQ ID NO: 1315784 - RNA, 22 nt, Human
uacaucuauuuuggauuguaua

SEQ ID NO: 1315785 - RNA, 23 nt, Human
uacaucuauuuuggauuguauau

SEQ ID NO: 1315786 - RNA, 14 nt, Human
uacaucuucugccu

SEQ ID NO: 1315787 - RNA, 17 nt, Human
uacaucuucugccuuag

SEQ ID NO: 1315788 - RNA, 13 nt, Human
uacaugaaguauu

SEQ ID NO: 1315789 - RNA, 15 nt, Human
uacaugaaguauuuu

SEQ ID NO: 1315790 - RNA, 21 nt, Human
uacaugaaguauuuuuucagu

SEQ ID NO: 1315791 - RNA, 22 nt, Human
uacaugaaguauuuuuucagua

SEQ ID NO: 1315792 - RNA, 16 nt, Human
uacaugacauuuauuu

SEQ ID NO: 1315793 - RNA, 21 nt, Human
uacaugacauuuauuuuucau

SEQ ID NO: 1315794 - RNA, 17 nt, Human
uacaugagaacaaacag

SEQ ID NO: 1315795 - RNA, 18 nt, Human
uacaugagaacaaacaga

SEQ ID NO: 1315796 - RNA, 16 nt, Human
uacaugagaaggaacu

SEQ ID NO: 1315797 - RNA, 19 nt, Human
uaccuuugacaaagguaaa

SEQ ID NO: 1315798 - RNA, 13 nt, Human
uaccuugguuccc

SEQ ID NO: 1315799 - RNA, 22 nt, Human
uaccuugguucccccacugauc

SEQ ID NO: 1315800 - RNA, 14 nt, Human
uaccuuguauacug

SEQ ID NO: 1315801 - RNA, 16 nt, Human
uaccuuguauacugua

SEQ ID NO: 1315802 - RNA, 20 nt, Human
uaccuuguauacuguaggca

SEQ ID NO: 1315803 - RNA, 12 nt, Human
uaccuuucauac

SEQ ID NO: 1315804 - RNA, 19 nt, Human
uaccuuucuccuucccaaa

SEQ ID NO: 1315805 - RNA, 19 nt, Human
uacccaguaacucaucugu

SEQ ID NO: 1315806 - RNA, 22 nt, Human
uacccaguaacucaucugucac

SEQ ID NO: 1315807 - RNA, 22 nt, Human
uacccaguuucuaaacuggaga

SEQ ID NO: 1315808 - RNA, 23 nt, Human
uacccaguuucuaaacuggagac

SEQ ID NO: 1315809 - RNA, 24 nt, Human
uacccaguuucuaaacuggagacu

SEQ ID NO: 1315810 - RNA, 22 nt, Human
uacccauuuguucauauuaaga

SEQ ID NO: 1315811 - RNA, 13 nt, Human
uaccuucucccca

SEQ ID NO: 1315812 - RNA, 19 nt, Human
uaccuucuccccagcuccc

SEQ ID NO: 1315813 - RNA, 22 nt, Human
uaccuucuccccagcucccagg

SEQ ID NO: 1315814 - RNA, 15 nt, Human
uacccauuuguucau

SEQ ID NO: 1315815 - RNA, 14 nt, Human
uacccauuuguuca

SEQ ID NO: 1315816 - RNA, 19 nt, Human
uacccaugucuacacagau

SEQ ID NO: 1315817 - RNA, 23 nt, Human
uaccuucuccccagcucccagga

SEQ ID NO: 1315818 - RNA, 22 nt, Human
uaccuugaaaauaagaauagaa

SEQ ID NO: 1315819 - RNA, 17 nt, Human
uaccuugcaucucacag

SEQ ID NO: 1315820 - RNA, 14 nt, Human
uacgaauacuuuug

SEQ ID NO: 1315821 - RNA, 23 nt, Human
uacgacaguacacugucagcagg

SEQ ID NO: 1315822 - RNA, 14 nt, Human
uacuaauaaacuaa

SEQ ID NO: 1315823 - RNA, 16 nt, Human
uacuaauaaacuaaua

SEQ ID NO: 1315824 - RNA, 23 nt, Human
uacuaauagaauaaaggcaguuu

SEQ ID NO: 1315825 - RNA, 20 nt, Human
uacuaauaaacuaauaauug

SEQ ID NO: 1315826 - RNA, 22 nt, Human
uacuaauaaacuaauaauugca

SEQ ID NO: 1315827 - RNA, 20 nt, Human
uacuaauagaauaaaggcag

SEQ ID NO: 1315828 - RNA, 15 nt, Human
uacuccccuccuuga

SEQ ID NO: 1315829 - RNA, 11 nt, Human
uacuccugugg

SEQ ID NO: 1315830 - RNA, 12 nt, Human
uacuccuguggg

SEQ ID NO: 1315831 - RNA, 17 nt, Human
uacuccugugggagccu

SEQ ID NO: 1315832 - RNA, 18 nt, Human
uacuccugugggagccuc

SEQ ID NO: 1315833 - RNA, 20 nt, Human
uacuccugugggagccucgc

SEQ ID NO: 1315834 - RNA, 21 nt, Human
uacuccugugggagccucgca

SEQ ID NO: 1315835 - RNA, 15 nt, Human
uacugagccuuguaa

SEQ ID NO: 1315836 - RNA, 18 nt, Human
uacugagccuuguaauuc

SEQ ID NO: 1315837 - RNA, 19 nt, Human
uacugagccuuguaauucu

SEQ ID NO: 1315838 - RNA, 23 nt, Human
uacugagccuuguaauucuaaau

SEQ ID NO: 1315839 - RNA, 20 nt, Human
uacugauucaauuugaugug

SEQ ID NO: 1315840 - RNA, 17 nt, Human
uacugauucaauuugau

SEQ ID NO: 1315841 - RNA, 14 nt, Human
uacugauucaauuu

SEQ ID NO: 1315842 - RNA, 14 nt, Human
uacugauauauuuu

SEQ ID NO: 1315843 - RNA, 16 nt, Human
uacugauauauuuuac

SEQ ID NO: 1315844 - RNA, 13 nt, Human
uacuacaugcacu

SEQ ID NO: 1315845 - RNA, 14 nt, Human
uacuaccuguaaug

SEQ ID NO: 1315846 - RNA, 13 nt, Human
uacuaccuugaaa

SEQ ID NO: 1315847 - RNA, 14 nt, Human
uacuaccuugaaaa

SEQ ID NO: 1315848 - RNA, 16 nt, Human
uacuaccuugaaaaua

SEQ ID NO: 1315849 - RNA, 20 nt, Human
uacuaccuugaaaauaagaa

SEQ ID NO: 1315850 - RNA, 20 nt, Human
uacucacuuucuagauuaag

SEQ ID NO: 1315851 - RNA, 16 nt, Human
uacucacuuuucccac

SEQ ID NO: 1315852 - RNA, 18 nt, Human
uacucacuuuucccacuc

SEQ ID NO: 1315853 - RNA, 14 nt, Human
uacucagaauuaag

SEQ ID NO: 1315854 - RNA, 17 nt, Human
uacucacuuuucccacu

SEQ ID NO: 1315855 - RNA, 16 nt, Human
uacucagauaagguaa

SEQ ID NO: 1315856 - RNA, 23 nt, Human
uacucagauaagguaaaaugcca

SEQ ID NO: 1315857 - RNA, 15 nt, Human
uacucauaaguaaaa

SEQ ID NO: 1315858 - RNA, 11 nt, Human
uagaaagcuau

SEQ ID NO: 1315859 - RNA, 16 nt, Human
uagaaauaaagcaucu

SEQ ID NO: 1315860 - RNA, 19 nt, Human
uagaaauaaaggaugugau

SEQ ID NO: 1315861 - RNA, 20 nt, Human
uagaaauaaaggaugugauu

SEQ ID NO: 1315862 - RNA, 17 nt, Human
uacuuuagaagccugca

SEQ ID NO: 1315863 - RNA, 21 nt, Human
uacuuuagaagccugcauaau

SEQ ID NO: 1315864 - RNA, 19 nt, Human
uacuuuauaacuaacaugu

SEQ ID NO: 1315865 - RNA, 20 nt, Human
uacuuuauaacuaacauguc

SEQ ID NO: 1315866 - RNA, 23 nt, Human
uacuuuauaacuaacauguccug

SEQ ID NO: 1315867 - RNA, 17 nt, Human
uacuuuauguuacuaca

SEQ ID NO: 1315868 - RNA, 20 nt, Human
uacuuuauguuacuacaugc

SEQ ID NO: 1315869 - RNA, 15 nt, Human
uagaaacuuccaaau

SEQ ID NO: 1315870 - RNA, 15 nt, Human
uagaaagaccaggcc

SEQ ID NO: 1315871 - RNA, 17 nt, Human
uagaaagaccaggccaa

SEQ ID NO: 1315872 - RNA, 16 nt, Human
uagaaagagaaacagu

SEQ ID NO: 1315873 - RNA, 17 nt, Human
uagaaagagauacagag

SEQ ID NO: 1315874 - RNA, 18 nt, Human
uagaaagagauacagagg

SEQ ID NO: 1315875 - RNA, 16 nt, Human
uagaaagcagagauuu

SEQ ID NO: 1315876 - RNA, 17 nt, Human
uagaaagcagagauuuu

SEQ ID NO: 1315877 - RNA, 14 nt, Human
uagaaauauuuuaa

SEQ ID NO: 1315878 - RNA, 15 nt, Human
uagaaauauuuuaaa

SEQ ID NO: 1315879 - RNA, 16 nt, Human
uagaaauauuuuaaaa

SEQ ID NO: 1315880 - RNA, 19 nt, Human
uagaaauauuuuaaaauca

SEQ ID NO: 1315881 - RNA, 11 nt, Human
uagaaaucaua

SEQ ID NO: 1315882 - RNA, 20 nt, Human
uagaaauauuuuaaaaucag

SEQ ID NO: 1315883 - RNA, 13 nt, Human
uagaaaucauuuu

SEQ ID NO: 1315884 - RNA, 17 nt, Human
uagaaaucauuuugcaa

SEQ ID NO: 1315885 - RNA, 19 nt, Human
uagaaauguaacuuuugua

SEQ ID NO: 1315886 - RNA, 16 nt, Human
uagaaaucauuuugca

SEQ ID NO: 1315887 - RNA, 19 nt, Human
uagaaauuacacccaaaga

SEQ ID NO: 1315888 - RNA, 16 nt, Human
uagaaauuaccugugg

SEQ ID NO: 1315889 - RNA, 18 nt, Human
uagaaauuaccuguggau

SEQ ID NO: 1315890 - RNA, 13 nt, Human
uagaacaaggcug

SEQ ID NO: 1315891 - RNA, 12 nt, Human
uagaacacacac

SEQ ID NO: 1315892 - RNA, 17 nt, Human
uagaacacacacacuua

SEQ ID NO: 1315893 - RNA, 15 nt, Human
uagaacacaggcaaa

SEQ ID NO: 1315894 - RNA, 20 nt, Human
uagaacacuaauucauaauc

SEQ ID NO: 1315895 - RNA, 15 nt, Human
uagaacacuaauuca

SEQ ID NO: 1315896 - RNA, 16 nt, Human
uagaacacuaauucau

SEQ ID NO: 1315897 - RNA, 18 nt, Human
uagaacacuaauucauaa

SEQ ID NO: 1315898 - RNA, 19 nt, Human
uagaacacuaauucauaau

SEQ ID NO: 1315899 - RNA, 22 nt, Human
uagaacagggaaaauaggcagg

SEQ ID NO: 1315900 - RNA, 22 nt, Human
uagaacaugguuaccaugucuu

SEQ ID NO: 1315901 - RNA, 21 nt, Human
uacuugcucuugaugccuggc

SEQ ID NO: 1315902 - RNA, 23 nt, Human
uacuugccuuauuagagugucuu

SEQ ID NO: 1315903 - RNA, 16 nt, Human
uacuugcucagguacu

SEQ ID NO: 1315904 - RNA, 17 nt, Human
uacuugcucagguacuu

SEQ ID NO: 1315905 - RNA, 14 nt, Human
uacuugaaugaaaa

SEQ ID NO: 1315906 - RNA, 12 nt, Human
uacuugaaugaa

SEQ ID NO: 1315907 - RNA, 15 nt, Human
uacuuaauccaaugg

SEQ ID NO: 1315908 - RNA, 15 nt, Human
uacuuaauucaacuu

SEQ ID NO: 1315909 - RNA, 23 nt, Human
uacuuacaugcauuacugcaugc

SEQ ID NO: 1315910 - RNA, 19 nt, Human
uacuuacaugcauuacugc

SEQ ID NO: 1315911 - RNA, 21 nt, Human
uacuugaagggccagagccag

SEQ ID NO: 1315912 - RNA, 22 nt, Human
uacuugaagggccagagccagg

SEQ ID NO: 1315913 - RNA, 14 nt, Human
uacuuggauuuagu

SEQ ID NO: 1315914 - RNA, 21 nt, Human
uacuugggagaccuguaauca

SEQ ID NO: 1315915 - RNA, 23 nt, Human
uacuugggagaccuguaaucaua

SEQ ID NO: 1315916 - RNA, 13 nt, Human
uacuuguaaauau

SEQ ID NO: 1315917 - RNA, 16 nt, Human
uacuuguaaauauaaa

SEQ ID NO: 1315918 - RNA, 14 nt, Human
uacuuguaaauaua

SEQ ID NO: 1315919 - RNA, 15 nt, Human
uacuuguaaauauaa

SEQ ID NO: 1315920 - RNA, 19 nt, Human
uacuguaugaucaaauguu

SEQ ID NO: 1315921 - RNA, 18 nt, Human
uacuguaugaucaaaugu

SEQ ID NO: 1315922 - RNA, 17 nt, Human
uacuguaugaucaaaug

SEQ ID NO: 1315923 - RNA, 16 nt, Human
uacuguaugaucaaau

SEQ ID NO: 1315924 - RNA, 15 nt, Human
uacuguaugaucaaa

SEQ ID NO: 1315925 - RNA, 14 nt, Human
uacuguaugaucaa

SEQ ID NO: 1315926 - RNA, 13 nt, Human
uacuguaugauca

SEQ ID NO: 1315927 - RNA, 11 nt, Human
uacuguaugau

SEQ ID NO: 1315928 - RNA, 22 nt, Human
uacuguaugaucaaauguuuaa

SEQ ID NO: 1315929 - RNA, 21 nt, Human
uacuguaugaucaaauguuua

SEQ ID NO: 1315930 - RNA, 17 nt, Human
uacuguauuuuguauug

SEQ ID NO: 1315931 - RNA, 23 nt, Human
uacuguauuuuguauuguuucaa

SEQ ID NO: 1315932 - RNA, 18 nt, Human
uacuguaugguuuuguuu

SEQ ID NO: 1315933 - RNA, 17 nt, Human
uacugcauacuuuuuaa

SEQ ID NO: 1315934 - RNA, 18 nt, Human
uacugcauacuuuuuaaa

SEQ ID NO: 1315935 - RNA, 21 nt, Human
uacugcauacuuuuuaaaugu

SEQ ID NO: 1315936 - RNA, 22 nt, Human
uacugcauacuuuuuaaaugua

SEQ ID NO: 1315937 - RNA, 13 nt, Human
uacugcauacuuu

SEQ ID NO: 1315938 - RNA, 15 nt, Human
uacugcauacuuuuu

SEQ ID NO: 1315939 - RNA, 13 nt, Human
uacuguguaauua

SEQ ID NO: 1315940 - RNA, 14 nt, Human
uacuguguaauuag

SEQ ID NO: 1315941 - RNA, 14 nt, Human
uacuguguguguga

SEQ ID NO: 1315942 - RNA, 17 nt, Human
uacugugugugugaaug

SEQ ID NO: 1315943 - RNA, 18 nt, Human
uacugugugugugaauga

SEQ ID NO: 1315944 - RNA, 19 nt, Human
uacugugugugugaaugaa

SEQ ID NO: 1315945 - RNA, 21 nt, Human
uacugugugugugaaugaaca

SEQ ID NO: 1315946 - RNA, 12 nt, Human
uacuguucuaaa

SEQ ID NO: 1315947 - RNA, 13 nt, Human
uacuguucuaaag

SEQ ID NO: 1315948 - RNA, 14 nt, Human
uacuguucuaaagc

SEQ ID NO: 1315949 - RNA, 15 nt, Human
uacuguucuaaagcu

SEQ ID NO: 1315950 - RNA, 17 nt, Human
uacuguucuaaagcucu

SEQ ID NO: 1315951 - RNA, 18 nt, Human
uacuguucuaaagcucug

SEQ ID NO: 1315952 - RNA, 19 nt, Human
uacuguucuaaagcucuga

SEQ ID NO: 1315953 - RNA, 21 nt, Human
uacuguucuaaagcucugaca

SEQ ID NO: 1315954 - RNA, 14 nt, Human
uacuguucuguguc

SEQ ID NO: 1315955 - RNA, 17 nt, Human
uacuguucugugucuuu

SEQ ID NO: 1315956 - RNA, 16 nt, Human
uacuguucugugucuu

SEQ ID NO: 1315957 - RNA, 13 nt, Human
uacuguugcacgu

SEQ ID NO: 1315958 - RNA, 14 nt, Human
uacuguugcacgug

SEQ ID NO: 1315959 - RNA, 15 nt, Human
uacuguugcacgugu

SEQ ID NO: 1315960 - RNA, 16 nt, Human
uacuguugcacgugug

SEQ ID NO: 1315961 - RNA, 23 nt, Human
uacuguugcacguguguuuuucu

SEQ ID NO: 1315962 - RNA, 17 nt, Human
gguguagcuacagagaa

SEQ ID NO: 1315963 - RNA, 18 nt, Human
gguguagcuacagagaaa

SEQ ID NO: 1315964 - RNA, 22 nt, Human
gguguagcuacagagaaaccag

SEQ ID NO: 1315965 - RNA, 18 nt, Human
ggugucagacccuggagg

SEQ ID NO: 1315966 - RNA, 23 nt, Human
ggugucagacccuggaggcccca

SEQ ID NO: 1315967 - RNA, 13 nt, Human
gguguccccaaca

SEQ ID NO: 1315968 - RNA, 15 nt, Human
gguguccccaacagc

SEQ ID NO: 1315969 - RNA, 19 nt, Human
gguguccccaacagcgccc

SEQ ID NO: 1315970 - RNA, 20 nt, Human
gguguccccaacagcgccca

SEQ ID NO: 1315971 - RNA, 12 nt, Human
gguguccuacag

SEQ ID NO: 1315972 - RNA, 22 nt, Human
gguguagaacacuaauucauaa

SEQ ID NO: 1315973 - RNA, 15 nt, Human
gguguagcuacagag

SEQ ID NO: 1315974 - RNA, 16 nt, Human
gguguagcuacagaga

SEQ ID NO: 1315975 - RNA, 14 nt, Human
ggugggguccugga

SEQ ID NO: 1315976 - RNA, 23 nt, Human
ggugggguccuggagcagaccac

SEQ ID NO: 1315977 - RNA, 14 nt, Human
gguggcugcagccu

SEQ ID NO: 1315978 - RNA, 15 nt, Human
gguggcugcagccuc

SEQ ID NO: 1315979 - RNA, 16 nt, Human
gguggcugcagccuca

SEQ ID NO: 1315980 - RNA, 22 nt, Human
gguggcuacucugugccagagc

SEQ ID NO: 1315981 - RNA, 11 nt, Human
gguggggugga

SEQ ID NO: 1315982 - RNA, 10 nt, Human
ggugggucca

SEQ ID NO: 1315983 - RNA, 14 nt, Human
gguggguccauggg

SEQ ID NO: 1315984 - RNA, 17 nt, Human
gguggguccaugggcag

SEQ ID NO: 1315985 - RNA, 20 nt, Human
gguggguccaugggcagagc

SEQ ID NO: 1315986 - RNA, 19 nt, Human
ggugggugccuaggccugg

SEQ ID NO: 1315987 - RNA, 16 nt, Human
ggugguacccucugga

SEQ ID NO: 1315988 - RNA, 20 nt, Human
ggugguauuuucaauagcca

SEQ ID NO: 1315989 - RNA, 13 nt, Human
ggugguauuuuca

SEQ ID NO: 1315990 - RNA, 14 nt, Human
gguggucccugggu

SEQ ID NO: 1315991 - RNA, 16 nt, Human
gguggucuguuggcag

SEQ ID NO: 1315992 - RNA, 21 nt, Human
gguggucuguuggcaggcugg

SEQ ID NO: 1315993 - RNA, 22 nt, Human
gguggucuguuggcaggcuggc

SEQ ID NO: 1315994 - RNA, 15 nt, Human
ggugguggcucggga

SEQ ID NO: 1315995 - RNA, 14 nt, Human
ggugguggccuggu

SEQ ID NO: 1315996 - RNA, 23 nt, Human
gguggugucagacccuggaggcc

SEQ ID NO: 1315997 - RNA, 16 nt, Human
gguuagggaaaacauu

SEQ ID NO: 1315998 - RNA, 22 nt, Human
gguuaggaggguuucauugucu

SEQ ID NO: 1315999 - RNA, 13 nt, Human
gguuagaccuaca

SEQ ID NO: 1316000 - RNA, 14 nt, Human
gguuagaccuacag

SEQ ID NO: 1316001 - RNA, 15 nt, Human
gguuagaccuacagg

SEQ ID NO: 1316002 - RNA, 20 nt, Human
gguuagaccuacaggggguc

SEQ ID NO: 1316003 - RNA, 22 nt, Human
gguuagaccuacagggggucug

SEQ ID NO: 1316004 - RNA, 23 nt, Human
gguuagaccuacagggggucugg

SEQ ID NO: 1316005 - RNA, 14 nt, Human
gguuaucucugugu

SEQ ID NO: 1316006 - RNA, 21 nt, Human
gguuaguggauggaaggggcu

SEQ ID NO: 1316007 - RNA, 22 nt, Human
gguuaguggauggaaggggcug

SEQ ID NO: 1316008 - RNA, 23 nt, Human
gguuauagacagucguucccagu

SEQ ID NO: 1316009 - RNA, 21 nt, Human
gguguccugcaccggggccug

SEQ ID NO: 1316010 - RNA, 14 nt, Human
gguguccuacagaa

SEQ ID NO: 1316011 - RNA, 15 nt, Human
gguguccuacagaaa

SEQ ID NO: 1316012 - RNA, 16 nt, Human
gguguccuacagaaaa

SEQ ID NO: 1316013 - RNA, 18 nt, Human
gguguccuacagaaaaac

SEQ ID NO: 1316014 - RNA, 21 nt, Human
gguguccuacagaaaaaccuu

SEQ ID NO: 1316015 - RNA, 20 nt, Human
gguguuuuguucaccauuau

SEQ ID NO: 1316016 - RNA, 23 nt, Human
gguuauuuugauguaaagauguu

SEQ ID NO: 1316017 - RNA, 22 nt, Human
gguucacaaacuucauuucaga

SEQ ID NO: 1316018 - RNA, 21 nt, Human
gguugauaaaucauuuuaugu

SEQ ID NO: 1316019 - RNA, 17 nt, Human
gguucuuucuuccucug

SEQ ID NO: 1316020 - RNA, 18 nt, Human
gguucuuucauuugcuuu

SEQ ID NO: 1316021 - RNA, 11 nt, Human
gguugaggaaa

SEQ ID NO: 1316022 - RNA, 14 nt, Human
gguucuuguuggug

SEQ ID NO: 1316023 - RNA, 19 nt, Human
gguucuugaggggaccagg

SEQ ID NO: 1316024 - RNA, 20 nt, Human
gguucuugaggggaccagga

SEQ ID NO: 1316025 - RNA, 14 nt, Human
gguucuuucuuccu

SEQ ID NO: 1316026 - RNA, 16 nt, Human
gguucuuucuuccucu

SEQ ID NO: 1316027 - RNA, 22 nt, Human
gguucuugaggggaccaggagu

SEQ ID NO: 1316028 - RNA, 21 nt, Human
gguucuugaggggaccaggag

SEQ ID NO: 1316029 - RNA, 10 nt, Human
gguucuuguu

SEQ ID NO: 1316030 - RNA, 13 nt, Human
ggugagaaauuua

SEQ ID NO: 1316031 - RNA, 21 nt, Human
ggugagaaccuggguugcaga

SEQ ID NO: 1316032 - RNA, 14 nt, Human
ggugacugucuggg

SEQ ID NO: 1316033 - RNA, 21 nt, Human
ggugacugucuggggagcggg

SEQ ID NO: 1316034 - RNA, 17 nt, Human
ggugacaucggaaaaau

SEQ ID NO: 1316035 - RNA, 13 nt, Human
ggugaccccaggg

SEQ ID NO: 1316036 - RNA, 14 nt, Human
ggugaccccagggc

SEQ ID NO: 1316037 - RNA, 15 nt, Human
ggugaccccagggca

SEQ ID NO: 1316038 - RNA, 16 nt, Human
ggugaccccagggcac

SEQ ID NO: 1316039 - RNA, 17 nt, Human
ggugaccccagggcaca

SEQ ID NO: 1316040 - RNA, 23 nt, Human
ggucugccucuucugggagggca

SEQ ID NO: 1316041 - RNA, 23 nt, Human
ggucugcccucugcauccucugg

SEQ ID NO: 1316042 - RNA, 12 nt, Human
ggucugcuccca

SEQ ID NO: 1316043 - RNA, 14 nt, Human
ggucugcucccaag

SEQ ID NO: 1316044 - RNA, 20 nt, Human
ggucugcucccaaggggccu

SEQ ID NO: 1316045 - RNA, 23 nt, Human
ggucugcucccaaggggccugag

SEQ ID NO: 1316046 - RNA, 22 nt, Human
ggucugcucccaaggggccuga

SEQ ID NO: 1316047 - RNA, 16 nt, Human
ggucugcucuuucucu

SEQ ID NO: 1316048 - RNA, 18 nt, Human
ggucugcucuuucucugc

SEQ ID NO: 1316049 - RNA, 22 nt, Human
ggucugcucuuucucugccagu

SEQ ID NO: 1316050 - RNA, 19 nt, Human
ggucugcucuuucucugcc

SEQ ID NO: 1316051 - RNA, 20 nt, Human
ggucugcucuuucucugcca

SEQ ID NO: 1316052 - RNA, 18 nt, Human
ggugacaucagguuuuuc

SEQ ID NO: 1316053 - RNA, 18 nt, Human
ggugacaucggaaaaaua

SEQ ID NO: 1316054 - RNA, 22 nt, Human
ggucucuucugaauaaagcaau

SEQ ID NO: 1316055 - RNA, 21 nt, Human
ggucucuucugaauaaagcaa

SEQ ID NO: 1316056 - RNA, 20 nt, Human
ggucucuucugaauaaagca

SEQ ID NO: 1316057 - RNA, 19 nt, Human
ggucucucucucucuacaa

SEQ ID NO: 1316058 - RNA, 16 nt, Human
ggucucacccuggagg

SEQ ID NO: 1316059 - RNA, 20 nt, Human
ggucucacccuggaggcacc

SEQ ID NO: 1316060 - RNA, 21 nt, Human
ggucucacccuggaggcaccu

SEQ ID NO: 1316061 - RNA, 19 nt, Human
ggucucaccggcucucacc

SEQ ID NO: 1316062 - RNA, 21 nt, Human
ggucucaccggcucucaccug

SEQ ID NO: 1316063 - RNA, 11 nt, Human
ggucucagccc

SEQ ID NO: 1316064 - RNA, 22 nt, Human
ggucuccagaaagccccaccca

SEQ ID NO: 1316065 - RNA, 17 nt, Human
ggucucaaacuccugac

SEQ ID NO: 1316066 - RNA, 15 nt, Human
ggucucacccuggag

SEQ ID NO: 1316067 - RNA, 15 nt, Human
ggugagaccaccucu

SEQ ID NO: 1316068 - RNA, 15 nt, Human
ggugagaaauuuaaa

SEQ ID NO: 1316069 - RNA, 14 nt, Human
ggugagaccaccuc

SEQ ID NO: 1316070 - RNA, 16 nt, Human
ggugagaauagaaucu

SEQ ID NO: 1316071 - RNA, 13 nt, Human
ggugccuguccca

SEQ ID NO: 1316072 - RNA, 17 nt, Human
ggugccugucccacccc

SEQ ID NO: 1316073 - RNA, 17 nt, Human
ggugccuuuauuuccac

SEQ ID NO: 1316074 - RNA, 22 nt, Human
ggugcuacacccuuuuccagcu

SEQ ID NO: 1316075 - RNA, 23 nt, Human
ggugcuacacccuuuuccagcug

SEQ ID NO: 1316076 - RNA, 18 nt, Human
ggugcgagugcgugaaua

SEQ ID NO: 1316077 - RNA, 14 nt, Human
ggugcuacugggga

SEQ ID NO: 1316078 - RNA, 18 nt, Human
ggugcuacuggggaaacu

SEQ ID NO: 1316079 - RNA, 21 nt, Human
ggugcuacuggggaaacuggc

SEQ ID NO: 1316080 - RNA, 23 nt, Human
gguggccacuccagaccccuggc

SEQ ID NO: 1316081 - RNA, 11 nt, Human
gguggccaggc

SEQ ID NO: 1316082 - RNA, 12 nt, Human
gguggccaggcc

SEQ ID NO: 1316083 - RNA, 16 nt, Human
gguggccaggccggga

SEQ ID NO: 1316084 - RNA, 20 nt, Human
gguggccacuccagaccccu

SEQ ID NO: 1316085 - RNA, 21 nt, Human
gguggccacuccagaccccug

SEQ ID NO: 1316086 - RNA, 22 nt, Human
gguggccacuccagaccccugg

SEQ ID NO: 1316087 - RNA, 13 nt, Human
gguggccaggccg

SEQ ID NO: 1316088 - RNA, 15 nt, Human
gguggccaugcuccu

SEQ ID NO: 1316089 - RNA, 14 nt, Human
gguggcuacucugu

SEQ ID NO: 1316090 - RNA, 16 nt, Human
gguggcuacucugugc

SEQ ID NO: 1316091 - RNA, 18 nt, Human
gguggcuacucugugcca

SEQ ID NO: 1316092 - RNA, 19 nt, Human
gguggcuacucugugccag

SEQ ID NO: 1316093 - RNA, 23 nt, Human
gguggcuacucugugccagagcc

SEQ ID NO: 1316094 - RNA, 14 nt, Human
ggugcuaggaagag

SEQ ID NO: 1316095 - RNA, 15 nt, Human
ggugcugacggccag

SEQ ID NO: 1316096 - RNA, 16 nt, Human
ggugcugacggccagg

SEQ ID NO: 1316097 - RNA, 17 nt, Human
ggugcugacggccaggg

SEQ ID NO: 1316098 - RNA, 20 nt, Human
ggugcugacggccagggaga

SEQ ID NO: 1316099 - RNA, 12 nt, Human
ggugcucugucu

SEQ ID NO: 1316100 - RNA, 19 nt, Human
ggugcugacuggcuucagc

SEQ ID NO: 1316101 - RNA, 21 nt, Human
ggugcugacuucaucucccac

SEQ ID NO: 1316102 - RNA, 20 nt, Human
gggguggggggggugcuggg

SEQ ID NO: 1316103 - RNA, 13 nt, Human
ggggugggcuggu

SEQ ID NO: 1316104 - RNA, 13 nt, Human
gggguggccaggc

SEQ ID NO: 1316105 - RNA, 18 nt, Human
gggguggcugcagccuca

SEQ ID NO: 1316106 - RNA, 18 nt, Human
ggggugcugggccccugc

SEQ ID NO: 1316107 - RNA, 22 nt, Human
gggggagccccuucugcucagc

SEQ ID NO: 1316108 - RNA, 15 nt, Human
ggggcugaggagcag

SEQ ID NO: 1316109 - RNA, 15 nt, Human
gggggagagggcugc

SEQ ID NO: 1316110 - RNA, 21 nt, Human
gggggacuuacaugauucauu

SEQ ID NO: 1316111 - RNA, 17 nt, Human
ggguaaucccugcuuuu

SEQ ID NO: 1316112 - RNA, 19 nt, Human
ggguaacuaacuaaaacaa

SEQ ID NO: 1316113 - RNA, 21 nt, Human
ggguaaacccucacaucagag

SEQ ID NO: 1316114 - RNA, 21 nt, Human
ggguaaaauacuuuuacucug

SEQ ID NO: 1316115 - RNA, 15 nt, Human
ggguaaaauacuuuu

SEQ ID NO: 1316116 - RNA, 11 nt, Human
ggguaaacaau

SEQ ID NO: 1316117 - RNA, 19 nt, Human
gggguguggcuccuuccca

SEQ ID NO: 1316118 - RNA, 14 nt, Human
gggguggugucaga

SEQ ID NO: 1316119 - RNA, 15 nt, Human
gggguuaucucugug

SEQ ID NO: 1316120 - RNA, 16 nt, Human
gggguuauuuucuggu

SEQ ID NO: 1316121 - RNA, 16 nt, Human
gggucugagcuccagc

SEQ ID NO: 1316122 - RNA, 17 nt, Human
gggucugagcuccagcu

SEQ ID NO: 1316123 - RNA, 21 nt, Human
gggucugcucccaaggggccu

SEQ ID NO: 1316124 - RNA, 23 nt, Human
gggucugcucccaaggggccuga

SEQ ID NO: 1316125 - RNA, 19 nt, Human
gggucugcucuuucucugc

SEQ ID NO: 1316126 - RNA, 20 nt, Human
gggucugcucuuucucugcc

SEQ ID NO: 1316127 - RNA, 21 nt, Human
gggucugcucuuucucugcca

SEQ ID NO: 1316128 - RNA, 22 nt, Human
gggucugcucuuucucugccag

SEQ ID NO: 1316129 - RNA, 20 nt, Human
gggucuggaguugaucugga

SEQ ID NO: 1316130 - RNA, 22 nt, Human
gggucuggaguugaucuggaac

SEQ ID NO: 1316131 - RNA, 22 nt, Human
gggucuggcagccucccaucca

SEQ ID NO: 1316132 - RNA, 12 nt, Human
gggucuggcugg

SEQ ID NO: 1316133 - RNA, 13 nt, Human
gggucuggcuggu

SEQ ID NO: 1316134 - RNA, 14 nt, Human
gggucuggcuggug

SEQ ID NO: 1316135 - RNA, 15 nt, Human
gggucuggcuggugu

SEQ ID NO: 1316136 - RNA, 18 nt, Human
gggucuggcugguguuaa

SEQ ID NO: 1316137 - RNA, 21 nt, Human
gggucugggggcacaagacug

SEQ ID NO: 1316138 - RNA, 14 nt, Human
ggggcuaccaggaa

SEQ ID NO: 1316139 - RNA, 11 nt, Human
ggggcucagag

SEQ ID NO: 1316140 - RNA, 15 nt, Human
ggggcuaagacuucc

SEQ ID NO: 1316141 - RNA, 14 nt, Human
ggggcuaauuuaac

SEQ ID NO: 1316142 - RNA, 16 nt, Human
ggggcucccuccgccc

SEQ ID NO: 1316143 - RNA, 19 nt, Human
ggggcucccuccgccccca

SEQ ID NO: 1316144 - RNA, 17 nt, Human
ggggcucuaacgccuga

SEQ ID NO: 1316145 - RNA, 18 nt, Human
ggggcucuaacgccugag

SEQ ID NO: 1316146 - RNA, 20 nt, Human
ggggcucuaacgccugagcc

SEQ ID NO: 1316147 - RNA, 21 nt, Human
ggggcucuaacgccugagccc

SEQ ID NO: 1316148 - RNA, 22 nt, Human
ggggcucuaacgccugagccca

SEQ ID NO: 1316149 - RNA, 23 nt, Human
ggggcucuaacgccugagcccag

SEQ ID NO: 1316150 - RNA, 14 nt, Human
ggggcacaagacug

SEQ ID NO: 1316151 - RNA, 22 nt, Human
ggggcacaagacugacgccagg

SEQ ID NO: 1316152 - RNA, 18 nt, Human
ggggcagucugagagagg

SEQ ID NO: 1316153 - RNA, 15 nt, Human
ggggcagucugagag

SEQ ID NO: 1316154 - RNA, 19 nt, Human
ggggcagucugagagaggc

SEQ ID NO: 1316155 - RNA, 15 nt, Human
ggggcgcggcuggga

SEQ ID NO: 1316156 - RNA, 16 nt, Human
ggggcgcggcugggag

SEQ ID NO: 1316157 - RNA, 17 nt, Human
ggggaggguaggcagga

SEQ ID NO: 1316158 - RNA, 20 nt, Human
ggggauucuuccaucugauu

SEQ ID NO: 1316159 - RNA, 18 nt, Human
ggggaggggcugugggcg

SEQ ID NO: 1316160 - RNA, 15 nt, Human
ggggagggggauccg

SEQ ID NO: 1316161 - RNA, 13 nt, Human
ggggaggguaggc

SEQ ID NO: 1316162 - RNA, 15 nt, Human
ggggagggauucugg

SEQ ID NO: 1316163 - RNA, 20 nt, Human
ggggagggaagggagccaag

SEQ ID NO: 1316164 - RNA, 14 nt, Human
gggcuuuuuucuuu

SEQ ID NO: 1316165 - RNA, 14 nt, Human
ggggagggaaggga

SEQ ID NO: 1316166 - RNA, 17 nt, Human
ggggagggaagggagcc

SEQ ID NO: 1316167 - RNA, 18 nt, Human
ggggagggaagggagcca

SEQ ID NO: 1316168 - RNA, 14 nt, Human
ggggagggauucug

SEQ ID NO: 1316169 - RNA, 22 nt, Human
gggcuuugauguuccuuccagu

SEQ ID NO: 1316170 - RNA, 16 nt, Human
gggccugggcaggagg

SEQ ID NO: 1316171 - RNA, 17 nt, Human
gggccugggcaggaggg

SEQ ID NO: 1316172 - RNA, 11 nt, Human
gggccugggcc

SEQ ID NO: 1316173 - RNA, 12 nt, Human
gggccugggcuc

SEQ ID NO: 1316174 - RNA, 15 nt, Human
gggccugggcuccug

SEQ ID NO: 1316175 - RNA, 16 nt, Human
gggccugggcuccugg

SEQ ID NO: 1316176 - RNA, 18 nt, Human
gggccugggcuccuggac

SEQ ID NO: 1316177 - RNA, 17 nt, Human
gggccugggcuccugga

SEQ ID NO: 1316178 - RNA, 18 nt, Human
gggcuuguggggccuggg

SEQ ID NO: 1316179 - RNA, 16 nt, Human
gggcuuguggggccug

SEQ ID NO: 1316180 - RNA, 18 nt, Human
gggugcugggccccugcc

SEQ ID NO: 1316181 - RNA, 17 nt, Human
gggugcugggccccugc

SEQ ID NO: 1316182 - RNA, 16 nt, Human
ggguuaagaagacuuu

SEQ ID NO: 1316183 - RNA, 13 nt, Human
ggguuaucucugu

SEQ ID NO: 1316184 - RNA, 20 nt, Human
ggguucaccugggcugaggc

SEQ ID NO: 1316185 - RNA, 20 nt, Human
ggguuccuuccucugagccu

SEQ ID NO: 1316186 - RNA, 21 nt, Human
ggguuccuuccucugagccuu

SEQ ID NO: 1316187 - RNA, 19 nt, Human
ggguuccuuccucugagcc

SEQ ID NO: 1316188 - RNA, 13 nt, Human
ggguucauuugug

SEQ ID NO: 1316189 - RNA, 17 nt, Human
ggguucuuucuuccucu

SEQ ID NO: 1316190 - RNA, 19 nt, Human
ggguucuuucuuccucugc

SEQ ID NO: 1316191 - RNA, 22 nt, Human
gguaccagaugcagcucaagag

SEQ ID NO: 1316192 - RNA, 20 nt, Human
gggucuguagguugcacacu

SEQ ID NO: 1316193 - RNA, 20 nt, Human
gggugaacaaagcagccacg

SEQ ID NO: 1316194 - RNA, 21 nt, Human
gggucuguagguugcacacuu

SEQ ID NO: 1316195 - RNA, 20 nt, Human
gggugacccggcacccccug

SEQ ID NO: 1316196 - RNA, 14 nt, Human
gggugaggagcugg

SEQ ID NO: 1316197 - RNA, 15 nt, Human
gggugaggagcuggg

SEQ ID NO: 1316198 - RNA, 17 nt, Human
gggugagggucccaugu

SEQ ID NO: 1316199 - RNA, 23 nt, Human
gggugaguuggcuuaccuggccc

SEQ ID NO: 1316200 - RNA, 14 nt, Human
gggugaugagggca

SEQ ID NO: 1316201 - RNA, 17 nt, Human
gggugaugagggcagca

SEQ ID NO: 1316202 - RNA, 18 nt, Human
gggugaugagggcagcag

SEQ ID NO: 1316203 - RNA, 19 nt, Human
gggugaugagggcagcagc

SEQ ID NO: 1316204 - RNA, 21 nt, Human
gggugaugagggcagcagcca

SEQ ID NO: 1316205 - RNA, 23 nt, Human
gggugaugagggcagcagccagc

SEQ ID NO: 1316206 - RNA, 13 nt, Human
gggugcacaggag

SEQ ID NO: 1316207 - RNA, 14 nt, Human
gggugcacaggagg

SEQ ID NO: 1316208 - RNA, 16 nt, Human
gggugcacaggagggg

SEQ ID NO: 1316209 - RNA, 19 nt, Human
gggugcacaggaggggguc

SEQ ID NO: 1316210 - RNA, 23 nt, Human
gggugcaguaucaugcccugugc

SEQ ID NO: 1316211 - RNA, 24 nt, Human
gggugccuaggccugggcagugga

SEQ ID NO: 1316212 - RNA, 15 nt, Human
gggugcuacugggga

SEQ ID NO: 1316213 - RNA, 16 nt, Human
gggugcuacuggggaa

SEQ ID NO: 1316214 - RNA, 19 nt, Human
gggugcuacuggggaaacu

SEQ ID NO: 1316215 - RNA, 18 nt, Human
gguagcauuuguguugaa

SEQ ID NO: 1316216 - RNA, 13 nt, Human
gguagccagcaca

SEQ ID NO: 1316217 - RNA, 16 nt, Human
gguagccagcacacag

SEQ ID NO: 1316218 - RNA, 21 nt, Human
gguagccagcacacagggcag

SEQ ID NO: 1316219 - RNA, 15 nt, Human
gguagaagggaaagc

SEQ ID NO: 1316220 - RNA, 17 nt, Human
gguagaggaugaggaaa

SEQ ID NO: 1316221 - RNA, 21 nt, Human
gguaccagcagaaagguuagu

SEQ ID NO: 1316222 - RNA, 15 nt, Human
gguacuucuugaagg

SEQ ID NO: 1316223 - RNA, 16 nt, Human
gguacuucuugaaggu

SEQ ID NO: 1316224 - RNA, 19 nt, Human
gguacuucuugaaggugcu

SEQ ID NO: 1316225 - RNA, 16 nt, Human
gguacuugucauuucg

SEQ ID NO: 1316226 - RNA, 20 nt, Human
ggucacguuuggugcuucuc

SEQ ID NO: 1316227 - RNA, 20 nt, Human
ggucaccuaggaagccucag

SEQ ID NO: 1316228 - RNA, 12 nt, Human
ggucacagcugu

SEQ ID NO: 1316229 - RNA, 16 nt, Human
ggucacaggacucugc

SEQ ID NO: 1316230 - RNA, 18 nt, Human
ggucacaggacucugccu

SEQ ID NO: 1316231 - RNA, 22 nt, Human
ggucaacaguuuuccuaugcuu

SEQ ID NO: 1316232 - RNA, 22 nt, Human
ggucaacuugagcauguuacug

SEQ ID NO: 1316233 - RNA, 23 nt, Human
ggucaacuugagcauguuacuga

SEQ ID NO: 1316234 - RNA, 21 nt, Human
ggucacagcggagguguggag

SEQ ID NO: 1316235 - RNA, 12 nt, Human
gguauuuucaau

SEQ ID NO: 1316236 - RNA, 18 nt, Human
ggucaaaauagugccacu

SEQ ID NO: 1316237 - RNA, 16 nt, Human
ggucaacaguuuuccu

SEQ ID NO: 1316238 - RNA, 13 nt, Human
ggucaggcagggu

SEQ ID NO: 1316239 - RNA, 11 nt, Human
ggucaggccuu

SEQ ID NO: 1316240 - RNA, 12 nt, Human
ggucaggccuuu

SEQ ID NO: 1316241 - RNA, 20 nt, Human
ggucaggccuuugagcucag

SEQ ID NO: 1316242 - RNA, 13 nt, Human
ggucaggccuuug

SEQ ID NO: 1316243 - RNA, 21 nt, Human
gggccccugccucucugcagg

SEQ ID NO: 1316244 - RNA, 19 nt, Human
gggccccugccucucugca

SEQ ID NO: 1316245 - RNA, 18 nt, Human
gggccccugccucucugc

SEQ ID NO: 1316246 - RNA, 17 nt, Human
gggccccugccucucug

SEQ ID NO: 1316247 - RNA, 15 nt, Human
gggccccugccucuc

SEQ ID NO: 1316248 - RNA, 13 nt, Human
gggccccugccuc

SEQ ID NO: 1316249 - RNA, 13 nt, Human
gggccccucuccc

SEQ ID NO: 1316250 - RNA, 14 nt, Human
gggccccucucagc

SEQ ID NO: 1316251 - RNA, 15 nt, Human
gggccccucucagcc

SEQ ID NO: 1316252 - RNA, 16 nt, Human
gggccccucucagccc

SEQ ID NO: 1316253 - RNA, 17 nt, Human
gggccccucucagcccu

SEQ ID NO: 1316254 - RNA, 12 nt, Human
gggccccucucc

SEQ ID NO: 1316255 - RNA, 21 nt, Human
gggccccucuccccagggaag

SEQ ID NO: 1316256 - RNA, 14 nt, Human
gggccccagaggcu

SEQ ID NO: 1316257 - RNA, 14 nt, Human
gggcccccaucuca

SEQ ID NO: 1316258 - RNA, 17 nt, Human
gggccccucacccugcc

SEQ ID NO: 1316259 - RNA, 19 nt, Human
gggccccucacccugccuu

SEQ ID NO: 1316260 - RNA, 22 nt, Human
gggccccugccucucugcaggu

SEQ ID NO: 1316261 - RNA, 18 nt, Human
gggccccuuugcugaccc

SEQ ID NO: 1316262 - RNA, 22 nt, Human
gggcccgcgauguggaacugcu

SEQ ID NO: 1316263 - RNA, 17 nt, Human
gggcccugggccugccu

SEQ ID NO: 1316264 - RNA, 13 nt, Human
gggcccugggcug

SEQ ID NO: 1316265 - RNA, 15 nt, Human
gggcccugggcugga

SEQ ID NO: 1316266 - RNA, 14 nt, Human
gggcccugggcugg

SEQ ID NO: 1316267 - RNA, 18 nt, Human
gggcccugggccugccuc

SEQ ID NO: 1316268 - RNA, 13 nt, Human
gggccuggcuggc

SEQ ID NO: 1316269 - RNA, 14 nt, Human
gggccuggcuggcu

SEQ ID NO: 1316270 - RNA, 15 nt, Human
gggccuggcuggcug

SEQ ID NO: 1316271 - RNA, 16 nt, Human
gggccuggcuggcuga

SEQ ID NO: 1316272 - RNA, 17 nt, Human
gggccuggcuggcugag

SEQ ID NO: 1316273 - RNA, 18 nt, Human
gggccuggcuggcugagg

SEQ ID NO: 1316274 - RNA, 20 nt, Human
gggccuggcuggcugagggc

SEQ ID NO: 1316275 - RNA, 12 nt, Human
gggccugggcag

SEQ ID NO: 1316276 - RNA, 21 nt, Human
gggccuggcuggcugagggca

SEQ ID NO: 1316277 - RNA, 22 nt, Human
gggccuggcuggcugagggcag

SEQ ID NO: 1316278 - RNA, 23 nt, Human
gggccuggcuggcugagggcagu

SEQ ID NO: 1316279 - RNA, 12 nt, Human
gggccugggagg

SEQ ID NO: 1316280 - RNA, 13 nt, Human
gggccugggcagg

SEQ ID NO: 1316281 - RNA, 15 nt, Human
gggccugggcaggag

SEQ ID NO: 1316282 - RNA, 13 nt, Human
gggccaaggaccu

SEQ ID NO: 1316283 - RNA, 14 nt, Human
gggccaaggaccug

SEQ ID NO: 1316284 - RNA, 15 nt, Human
gggccaaggaccuga

SEQ ID NO: 1316285 - RNA, 16 nt, Human
gggccaaggaccugag

SEQ ID NO: 1316286 - RNA, 13 nt, Human
gggccaagcccag

SEQ ID NO: 1316287 - RNA, 19 nt, Human
gggccacauagaugcugau

SEQ ID NO: 1316288 - RNA, 19 nt, Human
gggccacaugggaggcuca

SEQ ID NO: 1316289 - RNA, 16 nt, Human
gggccacgcuccagcu

SEQ ID NO: 1316290 - RNA, 17 nt, Human
gggccacgcuccagcug

SEQ ID NO: 1316291 - RNA, 18 nt, Human
gggcccacaccuccuucc

SEQ ID NO: 1316292 - RNA, 13 nt, Human
gggcccacaccuc

SEQ ID NO: 1316293 - RNA, 12 nt, Human
gggccacuccuu

SEQ ID NO: 1316294 - RNA, 16 nt, Human
gggccacuccuuccug

SEQ ID NO: 1316295 - RNA, 17 nt, Human
gggccacuccuuccugc

SEQ ID NO: 1316296 - RNA, 19 nt, Human
gggccacuccuuccugccc

SEQ ID NO: 1316297 - RNA, 21 nt, Human
gggccacuccuuccugcccca

SEQ ID NO: 1316298 - RNA, 20 nt, Human
gggccacuccuuccugcccc

SEQ ID NO: 1316299 - RNA, 11 nt, Human
gggcccagagc

SEQ ID NO: 1316300 - RNA, 12 nt, Human
gggcccagagcc

SEQ ID NO: 1316301 - RNA, 13 nt, Human
gggcccagagccc

SEQ ID NO: 1316302 - RNA, 15 nt, Human
gggcccagagcccag

SEQ ID NO: 1316303 - RNA, 16 nt, Human
gggcccagagcccagc

SEQ ID NO: 1316304 - RNA, 17 nt, Human
gggcccagagcccagcu

SEQ ID NO: 1316305 - RNA, 19 nt, Human
gggcccagagcccagcucc

SEQ ID NO: 1316306 - RNA, 20 nt, Human
gggcccagagcccagcucca

SEQ ID NO: 1316307 - RNA, 15 nt, Human
gggcaucucugggcu

SEQ ID NO: 1316308 - RNA, 16 nt, Human
gggcaucucugggcug

SEQ ID NO: 1316309 - RNA, 22 nt, Human
gggcaucucugggcuggaugag

SEQ ID NO: 1316310 - RNA, 17 nt, Human
gggcaucucugggcugg

SEQ ID NO: 1316311 - RNA, 21 nt, Human
gggcaucuggccuggccagug

SEQ ID NO: 1316312 - RNA, 22 nt, Human
gggcaugagggguuccuccccu

SEQ ID NO: 1316313 - RNA, 15 nt, Human
gggcauggccaggug

SEQ ID NO: 1316314 - RNA, 17 nt, Human
gggcauggccagguggc

SEQ ID NO: 1316315 - RNA, 20 nt, Human
gggcauggccagguggccac

SEQ ID NO: 1316316 - RNA, 21 nt, Human
gggcaugguguucuccugcug

SEQ ID NO: 1316317 - RNA, 19 nt, Human
gggcaugguguucuccugc

SEQ ID NO: 1316318 - RNA, 20 nt, Human
gggcagucugagagaggcca

SEQ ID NO: 1316319 - RNA, 21 nt, Human
gggcagucugagagaggccau

SEQ ID NO: 1316320 - RNA, 17 nt, Human
gggcagucauuauccag

SEQ ID NO: 1316321 - RNA, 17 nt, Human
gggcaguaccugagggu

SEQ ID NO: 1316322 - RNA, 16 nt, Human
gggcaguucgcagcca

SEQ ID NO: 1316323 - RNA, 17 nt, Human
gggcaguucgcagccac

SEQ ID NO: 1316324 - RNA, 19 nt, Human
gggcaguucgcagccaccc

SEQ ID NO: 1316325 - RNA, 20 nt, Human
gggcaguucgcagccacccu

SEQ ID NO: 1316326 - RNA, 21 nt, Human
gggcaguucgcagccacccug

SEQ ID NO: 1316327 - RNA, 22 nt, Human
gggcaguucgcagccacccuga

SEQ ID NO: 1316328 - RNA, 14 nt, Human
gggcauaaauuauu

SEQ ID NO: 1316329 - RNA, 23 nt, Human
gggcaguucgcagccacccugag

SEQ ID NO: 1316330 - RNA, 14 nt, Human
gggcaucucugggc

SEQ ID NO: 1316331 - RNA, 21 nt, Human
gggcaauuaauuccuucagca

SEQ ID NO: 1316332 - RNA, 14 nt, Human
gggcaauugucuga

SEQ ID NO: 1316333 - RNA, 20 nt, Human
gggcaauuaauuccuucagc

SEQ ID NO: 1316334 - RNA, 13 nt, Human
gggcaagaggaau

SEQ ID NO: 1316335 - RNA, 21 nt, Human
gggcaagccuaagggauccug

SEQ ID NO: 1316336 - RNA, 20 nt, Human
gggaucccucccccccaugc

SEQ ID NO: 1316337 - RNA, 17 nt, Human
gggauccgacugcuuug

SEQ ID NO: 1316338 - RNA, 14 nt, Human
gggauccugccugc

SEQ ID NO: 1316339 - RNA, 18 nt, Human
gggaucagggguaggaau

SEQ ID NO: 1316340 - RNA, 15 nt, Human
gggauaggccagccg

SEQ ID NO: 1316341 - RNA, 13 nt, Human
gggacugagaaau

SEQ ID NO: 1316342 - RNA, 19 nt, Human
gggacucaucuuucccucc

SEQ ID NO: 1316343 - RNA, 12 nt, Human
gggacucagccc

SEQ ID NO: 1316344 - RNA, 22 nt, Human
gggacucagccuucagacagag

SEQ ID NO: 1316345 - RNA, 17 nt, Human
gggacuaaaugcccugc

SEQ ID NO: 1316346 - RNA, 19 nt, Human
gggacuacaggcgugagcc

SEQ ID NO: 1316347 - RNA, 20 nt, Human
gggacuacaggcgugagcca

SEQ ID NO: 1316348 - RNA, 18 nt, Human
gggacuagccuggcuugg

SEQ ID NO: 1316349 - RNA, 18 nt, Human
gggaggugagaccaccuc

SEQ ID NO: 1316350 - RNA, 15 nt, Human
gggacugaccagcag

SEQ ID NO: 1316351 - RNA, 23 nt, Human
gggaggugcuucuaguucugcca

SEQ ID NO: 1316352 - RNA, 15 nt, Human
gggacugagaaauuu

SEQ ID NO: 1316353 - RNA, 23 nt, Human
gggagugacucaagaagugaaga

SEQ ID NO: 1316354 - RNA, 13 nt, Human
gggagugugugcc

SEQ ID NO: 1316355 - RNA, 15 nt, Human
gggaguuaagaccug

SEQ ID NO: 1316356 - RNA, 16 nt, Human
gggaguuaagaccugg

SEQ ID NO: 1316357 - RNA, 16 nt, Human
gggaguuuaggguggg

SEQ ID NO: 1316358 - RNA, 17 nt, Human
gggaguuaagaccuggc

SEQ ID NO: 1316359 - RNA, 20 nt, Human
gggaguuaagaccuggcagc

SEQ ID NO: 1316360 - RNA, 23 nt, Human
gggaguuaagaccuggcagcucu

SEQ ID NO: 1316361 - RNA, 12 nt, Human
gggaguguuccc

SEQ ID NO: 1316362 - RNA, 14 nt, Human
gggcaccggggccu

SEQ ID NO: 1316363 - RNA, 14 nt, Human
gggcacccccagcc

SEQ ID NO: 1316364 - RNA, 16 nt, Human
gggcacccccagccug

SEQ ID NO: 1316365 - RNA, 17 nt, Human
gggcacccccagccugg

SEQ ID NO: 1316366 - RNA, 18 nt, Human
gggcacccccagccuggg

SEQ ID NO: 1316367 - RNA, 21 nt, Human
gggcacccccagccugggccu

SEQ ID NO: 1316368 - RNA, 18 nt, Human
gggcaccagggguuucuc

SEQ ID NO: 1316369 - RNA, 20 nt, Human
gggcaccagggguuucucgc

SEQ ID NO: 1316370 - RNA, 23 nt, Human
gggcacaagacugacgccagggu

SEQ ID NO: 1316371 - RNA, 16 nt, Human
gggcacaagacugacg

SEQ ID NO: 1316372 - RNA, 12 nt, Human
gggcacaggagc

SEQ ID NO: 1316373 - RNA, 13 nt, Human
gggcacaggagcu

SEQ ID NO: 1316374 - RNA, 14 nt, Human
gggcacaggagcua

SEQ ID NO: 1316375 - RNA, 15 nt, Human
gggcacaggagcuac

SEQ ID NO: 1316376 - RNA, 17 nt, Human
gggcacaggagcuaccu

SEQ ID NO: 1316377 - RNA, 21 nt, Human
gggcacaggagcuaccugugu

SEQ ID NO: 1316378 - RNA, 18 nt, Human
gggcacaggagcuaccug

SEQ ID NO: 1316379 - RNA, 19 nt, Human
gggcacccccagccugggc

SEQ ID NO: 1316380 - RNA, 13 nt, Human
gggcacugguggc

SEQ ID NO: 1316381 - RNA, 16 nt, Human
gggcacugguggcccg

SEQ ID NO: 1316382 - RNA, 14 nt, Human
gggcagggugaccc

SEQ ID NO: 1316383 - RNA, 17 nt, Human
gggcagucugagagagg

SEQ ID NO: 1316384 - RNA, 15 nt, Human
gggcaguaccugagg

SEQ ID NO: 1316385 - RNA, 20 nt, Human
gggcaguaccugagggucug

SEQ ID NO: 1316386 - RNA, 18 nt, Human
gggcagucugagagaggc

SEQ ID NO: 1316387 - RNA, 19 nt, Human
gggcagucugagagaggcc

SEQ ID NO: 1316388 - RNA, 15 nt, Human
gggaaggaucccaug

SEQ ID NO: 1316389 - RNA, 21 nt, Human
gggaaggauucugcuggccuc

SEQ ID NO: 1316390 - RNA, 22 nt, Human
gggaaggauucugcuggccucu

SEQ ID NO: 1316391 - RNA, 14 nt, Human
gggaaggcaggcag

SEQ ID NO: 1316392 - RNA, 22 nt, Human
gggaaggcagggagggccuggg

SEQ ID NO: 1316393 - RNA, 15 nt, Human
gggaaggcaggcagg

SEQ ID NO: 1316394 - RNA, 21 nt, Human
gggaaggcaggcagggcucuc

SEQ ID NO: 1316395 - RNA, 21 nt, Human
gggaaggcuacuucggggcug

SEQ ID NO: 1316396 - RNA, 22 nt, Human
gggaaggcuacuucggggcugg

SEQ ID NO: 1316397 - RNA, 14 nt, Human
gggaagggacacac

SEQ ID NO: 1316398 - RNA, 14 nt, Human
gggaagggagccaa

SEQ ID NO: 1316399 - RNA, 16 nt, Human
gggaagggagccaagg

SEQ ID NO: 1316400 - RNA, 22 nt, Human
gggaagggagccaagggaugga

SEQ ID NO: 1316401 - RNA, 21 nt, Human
gggaagggagccaagggaugg

SEQ ID NO: 1316402 - RNA, 13 nt, Human
gggaaugaagaua

SEQ ID NO: 1316403 - RNA, 20 nt, Human
gggaaguaguuaucauguua

SEQ ID NO: 1316404 - RNA, 23 nt, Human
gggaagugaagacuggaagcuaa

SEQ ID NO: 1316405 - RNA, 22 nt, Human
gggaaguaguuaucauguuagu

SEQ ID NO: 1316406 - RNA, 18 nt, Human
gggaaguaguuaucaugu

SEQ ID NO: 1316407 - RNA, 21 nt, Human
gggaaggugggguccuggagc

SEQ ID NO: 1316408 - RNA, 16 nt, Human
gggaagggccugccca

SEQ ID NO: 1316409 - RNA, 22 nt, Human
gggacguucgugguccugcgcu

SEQ ID NO: 1316410 - RNA, 22 nt, Human
gggacguggcucagccagcacu

SEQ ID NO: 1316411 - RNA, 20 nt, Human
gggacguggcucagccagca

SEQ ID NO: 1316412 - RNA, 19 nt, Human
gggaccuagggaggcaugg

SEQ ID NO: 1316413 - RNA, 20 nt, Human
gggaccggcggaccccagcc

SEQ ID NO: 1316414 - RNA, 21 nt, Human
gggaccgcuacaccacucugg

SEQ ID NO: 1316415 - RNA, 22 nt, Human
gggaccgcuacaccacucuggc

SEQ ID NO: 1316416 - RNA, 20 nt, Human
gggaccuagggaggcauggu

SEQ ID NO: 1316417 - RNA, 14 nt, Human
gggaccccugagcu

SEQ ID NO: 1316418 - RNA, 19 nt, Human
gggacaacugcucccaccu

SEQ ID NO: 1316419 - RNA, 18 nt, Human
gggacaaguggacucagg

SEQ ID NO: 1316420 - RNA, 19 nt, Human
gggacaaguggacucaggg

SEQ ID NO: 1316421 - RNA, 17 nt, Human
gggaauuucuucaacuc

SEQ ID NO: 1316422 - RNA, 14 nt, Human
gggaauggcagcag

SEQ ID NO: 1316423 - RNA, 23 nt, Human
gggacaaggacuaggguccuggg

SEQ ID NO: 1316424 - RNA, 16 nt, Human
gggacaaaggagccug

SEQ ID NO: 1316425 - RNA, 17 nt, Human
gggacaaaggagccugu

SEQ ID NO: 1316426 - RNA, 18 nt, Human
gggacaaaggagccugug

SEQ ID NO: 1316427 - RNA, 15 nt, Human
gggacaaaggagccu

SEQ ID NO: 1316428 - RNA, 22 nt, Human
ggcuugaguuuaaauuguaaua

SEQ ID NO: 1316429 - RNA, 22 nt, Human
ggcuuggggcucacacaccugu

SEQ ID NO: 1316430 - RNA, 14 nt, Human
ggcuuguggggccu

SEQ ID NO: 1316431 - RNA, 16 nt, Human
ggcuuguggggccugg

SEQ ID NO: 1316432 - RNA, 18 nt, Human
ggcuuguggggccuggga

SEQ ID NO: 1316433 - RNA, 19 nt, Human
ggcuuuucacugcuggcug

SEQ ID NO: 1316434 - RNA, 22 nt, Human
ggcuuuucacugcuggcugccu

SEQ ID NO: 1316435 - RNA, 14 nt, Human
ggcuuuucacugcu

SEQ ID NO: 1316436 - RNA, 15 nt, Human
ggcuuuucacugcug

SEQ ID NO: 1316437 - RNA, 17 nt, Human
ggcuuuucacugcuggc

SEQ ID NO: 1316438 - RNA, 20 nt, Human
ggcuuuaugauaauagauuc

SEQ ID NO: 1316439 - RNA, 22 nt, Human
ggcuuuaugauaauagauucuc

SEQ ID NO: 1316440 - RNA, 19 nt, Human
ggcuuucauuuucucucag

SEQ ID NO: 1316441 - RNA, 20 nt, Human
ggcuuucauuuucucucagg

SEQ ID NO: 1316442 - RNA, 13 nt, Human
ggcuuacacccac

SEQ ID NO: 1316443 - RNA, 20 nt, Human
ggcuuaccuggcccaucagg

SEQ ID NO: 1316444 - RNA, 14 nt, Human
ggcuuaccuggccc

SEQ ID NO: 1316445 - RNA, 12 nt, Human
ggcuucacagau

SEQ ID NO: 1316446 - RNA, 21 nt, Human
ggcuugagaaauauggacacu

SEQ ID NO: 1316447 - RNA, 20 nt, Human
ggcuugagcccccgcgccca

SEQ ID NO: 1316448 - RNA, 22 nt, Human
ggcuuaguuuguguguugucuc

SEQ ID NO: 1316449 - RNA, 16 nt, Human
ggcuuauaauucuuuc

SEQ ID NO: 1316450 - RNA, 17 nt, Human
ggcuuauaauucuuuca

SEQ ID NO: 1316451 - RNA, 18 nt, Human
ggcuuauaucuggccucu

SEQ ID NO: 1316452 - RNA, 17 nt, Human
ggcugggccauguccaa

SEQ ID NO: 1316453 - RNA, 20 nt, Human
ggcugggccauguccaaaga

SEQ ID NO: 1316454 - RNA, 21 nt, Human
ggcugggccauguccaaagag

SEQ ID NO: 1316455 - RNA, 23 nt, Human
ggcuuaaacccauauuguaaaac

SEQ ID NO: 1316456 - RNA, 15 nt, Human
ggcugcugcuacaau

SEQ ID NO: 1316457 - RNA, 11 nt, Human
ggcugcugcug

SEQ ID NO: 1316458 - RNA, 22 nt, Human
ggcugcugcugcucuuggcugg

SEQ ID NO: 1316459 - RNA, 23 nt, Human
ggcugcugcugcucuuggcugga

SEQ ID NO: 1316460 - RNA, 14 nt, Human
ggcugcugcugggc

SEQ ID NO: 1316461 - RNA, 16 nt, Human
ggcugcugcugggcuc

SEQ ID NO: 1316462 - RNA, 21 nt, Human
ggcugcugaucgccuucccca

SEQ ID NO: 1316463 - RNA, 19 nt, Human
ggcugcugaucgccuuccc

SEQ ID NO: 1316464 - RNA, 20 nt, Human
ggcugcugcugggcucagug

SEQ ID NO: 1316465 - RNA, 18 nt, Human
ggcugcugcugggcucag

SEQ ID NO: 1316466 - RNA, 17 nt, Human
ggcugcugugggaaaug

SEQ ID NO: 1316467 - RNA, 15 nt, Human
ggcugcagccucagg

SEQ ID NO: 1316468 - RNA, 16 nt, Human
ggcugcagccucagga

SEQ ID NO: 1316469 - RNA, 17 nt, Human
ggcugcagccucaggac

SEQ ID NO: 1316470 - RNA, 18 nt, Human
ggcugcagccucaggacu

SEQ ID NO: 1316471 - RNA, 22 nt, Human
ggcugcagccucaggacuggga

SEQ ID NO: 1316472 - RNA, 19 nt, Human
ggcugcagccucaggacug

SEQ ID NO: 1316473 - RNA, 20 nt, Human
ggcugcagccucaggacugg

SEQ ID NO: 1316474 - RNA, 21 nt, Human
ggcuggacccagccaggccca

SEQ ID NO: 1316475 - RNA, 11 nt, Human
ggcugggccau

SEQ ID NO: 1316476 - RNA, 12 nt, Human
ggcuggacccag

SEQ ID NO: 1316477 - RNA, 14 nt, Human
ggcuggacccagcc

SEQ ID NO: 1316478 - RNA, 15 nt, Human
ggcuggacccagcca

SEQ ID NO: 1316479 - RNA, 19 nt, Human
ggcuggacccagccaggcc

SEQ ID NO: 1316480 - RNA, 20 nt, Human
ggcuggacccagccaggccc

SEQ ID NO: 1316481 - RNA, 23 nt, Human
ggcuggacccagccaggcccagc

SEQ ID NO: 1316482 - RNA, 18 nt, Human
ggcuggaagauagcugug

SEQ ID NO: 1316483 - RNA, 15 nt, Human
ggcuggaagauccug

SEQ ID NO: 1316484 - RNA, 22 nt, Human
ggcuggaagauccugcgggugg

SEQ ID NO: 1316485 - RNA, 19 nt, Human
ggcuggaagauccugcggg

SEQ ID NO: 1316486 - RNA, 18 nt, Human
ggcugcuucccugaagcu

SEQ ID NO: 1316487 - RNA, 19 nt, Human
ggcugcuucccugaagcuc

SEQ ID NO: 1316488 - RNA, 13 nt, Human
ggcugcuuccucc

SEQ ID NO: 1316489 - RNA, 19 nt, Human
ggcugcuuccuccuggaaa

SEQ ID NO: 1316490 - RNA, 15 nt, Human
ggcugcuuccuccug

SEQ ID NO: 1316491 - RNA, 16 nt, Human
ggcugcuuccuccugg

SEQ ID NO: 1316492 - RNA, 17 nt, Human
ggcugcuuccuccugga

SEQ ID NO: 1316493 - RNA, 18 nt, Human
ggcugcuuccuccuggaa

SEQ ID NO: 1316494 - RNA, 14 nt, Human
ggcucuggagccca

SEQ ID NO: 1316495 - RNA, 13 nt, Human
ggcucuggagccc

SEQ ID NO: 1316496 - RNA, 20 nt, Human
ggccccugccaccuccugcc

SEQ ID NO: 1316497 - RNA, 13 nt, Human
ggccccugccucu

SEQ ID NO: 1316498 - RNA, 15 nt, Human
ggcugagauaugaac

SEQ ID NO: 1316499 - RNA, 15 nt, Human
ggcugagcucucugu

SEQ ID NO: 1316500 - RNA, 20 nt, Human
ggcugagcucucugugggcu

SEQ ID NO: 1316501 - RNA, 16 nt, Human
ggcugagggagccugg

SEQ ID NO: 1316502 - RNA, 13 nt, Human
ggcugagggcagu

SEQ ID NO: 1316503 - RNA, 21 nt, Human
ggcugagggcaguucgcagcc

SEQ ID NO: 1316504 - RNA, 22 nt, Human
ggcugagggcaguucgcagcca

SEQ ID NO: 1316505 - RNA, 18 nt, Human
ggcugaugucaauuucug

SEQ ID NO: 1316506 - RNA, 22 nt, Human
ggcugaugucaauuucuguguu

SEQ ID NO: 1316507 - RNA, 24 nt, Human
ggcugaugucaauuucuguguugc

SEQ ID NO: 1316508 - RNA, 15 nt, Human
ggcugauaauuuuaa

SEQ ID NO: 1316509 - RNA, 15 nt, Human
ggcugauggaguaaa

SEQ ID NO: 1316510 - RNA, 14 nt, Human
ggcugcagccucag

SEQ ID NO: 1316511 - RNA, 19 nt, Human
ggcugcagaggccagaggc

SEQ ID NO: 1316512 - RNA, 14 nt, Human
ggcugauuucuagg

SEQ ID NO: 1316513 - RNA, 13 nt, Human
ggcugcagaggcc

SEQ ID NO: 1316514 - RNA, 16 nt, Human
ggcugcagaggccaga

SEQ ID NO: 1316515 - RNA, 18 nt, Human
ggcugcagaggccagagg

SEQ ID NO: 1316516 - RNA, 20 nt, Human
ggccaggcaggagcccuucu

SEQ ID NO: 1316517 - RNA, 19 nt, Human
ggccaggcauguggcaggg

SEQ ID NO: 1316518 - RNA, 13 nt, Human
ggccaggaggugc

SEQ ID NO: 1316519 - RNA, 22 nt, Human
ggccaggcugggucgcccugga

SEQ ID NO: 1316520 - RNA, 18 nt, Human
ggccaggcugggucgccc

SEQ ID NO: 1316521 - RNA, 11 nt, Human
ggccaggcugg

SEQ ID NO: 1316522 - RNA, 16 nt, Human
ggccaccuggcucuca

SEQ ID NO: 1316523 - RNA, 17 nt, Human
ggccaccuggcucucac

SEQ ID NO: 1316524 - RNA, 22 nt, Human
ggccaccuggcucucaccucua

SEQ ID NO: 1316525 - RNA, 14 nt, Human
ggccacgcuccagc

SEQ ID NO: 1316526 - RNA, 14 nt, Human
ggccaggaggugcc

SEQ ID NO: 1316527 - RNA, 15 nt, Human
ggccaaguuccucua

SEQ ID NO: 1316528 - RNA, 13 nt, Human
ggccaaguuccuc

SEQ ID NO: 1316529 - RNA, 22 nt, Human
ggccaaugcaccuaaagaaaaa

SEQ ID NO: 1316530 - RNA, 12 nt, Human
ggccacacagcu

SEQ ID NO: 1316531 - RNA, 13 nt, Human
ggccacacagcug

SEQ ID NO: 1316532 - RNA, 14 nt, Human
ggccacacagcugc

SEQ ID NO: 1316533 - RNA, 16 nt, Human
ggccacacagcugccg

SEQ ID NO: 1316534 - RNA, 15 nt, Human
ggccacacagcugcc

SEQ ID NO: 1316535 - RNA, 16 nt, Human
ggcagugagggagggc

SEQ ID NO: 1316536 - RNA, 21 nt, Human
ggcagugagggagggcuguca

SEQ ID NO: 1316537 - RNA, 24 nt, Human
ggcauuagcuaaaaccuuccaugu

SEQ ID NO: 1316538 - RNA, 20 nt, Human
ggcauuagaauuauuuaaac

SEQ ID NO: 1316539 - RNA, 17 nt, Human
ggcauuagaauuauuua

SEQ ID NO: 1316540 - RNA, 19 nt, Human
ggcauuagaauuauuuaaa

SEQ ID NO: 1316541 - RNA, 19 nt, Human
ggcagucugaauuuuuaaa

SEQ ID NO: 1316542 - RNA, 20 nt, Human
ggcagucugagagaggccau

SEQ ID NO: 1316543 - RNA, 12 nt, Human
ggccaggcuggu

SEQ ID NO: 1316544 - RNA, 13 nt, Human
ggccauggccugc

SEQ ID NO: 1316545 - RNA, 22 nt, Human
ggccaugggacagggaggacgc

SEQ ID NO: 1316546 - RNA, 21 nt, Human
ggccaugggaggccuuucccu

SEQ ID NO: 1316547 - RNA, 22 nt, Human
ggccaugggaggccuuucccua

SEQ ID NO: 1316548 - RNA, 14 nt, Human
ggccauggccugca

SEQ ID NO: 1316549 - RNA, 15 nt, Human
ggccauggccugcaa

SEQ ID NO: 1316550 - RNA, 13 nt, Human
ggccaugggaggc

SEQ ID NO: 1316551 - RNA, 15 nt, Human
ggccaugggaggccu

SEQ ID NO: 1316552 - RNA, 16 nt, Human
ggcccccaccuggcuc

SEQ ID NO: 1316553 - RNA, 17 nt, Human
ggcccccaccuggcuca

SEQ ID NO: 1316554 - RNA, 15 nt, Human
ggcccccacuugccu

SEQ ID NO: 1316555 - RNA, 16 nt, Human
ggcccccacuugccuc

SEQ ID NO: 1316556 - RNA, 18 nt, Human
ggcccccacuugccucuu

SEQ ID NO: 1316557 - RNA, 14 nt, Human
ggcccccagcccag

SEQ ID NO: 1316558 - RNA, 17 nt, Human
ggcccccagcccagggc

SEQ ID NO: 1316559 - RNA, 18 nt, Human
ggcccccagcccagggcu

SEQ ID NO: 1316560 - RNA, 20 nt, Human
ggcccccagcccagggcucc

SEQ ID NO: 1316561 - RNA, 23 nt, Human
ggcccccagcccagggcuccugc

SEQ ID NO: 1316562 - RNA, 19 nt, Human
ggcccccaucauccucugg

SEQ ID NO: 1316563 - RNA, 14 nt, Human
ggcccccaucucau

SEQ ID NO: 1316564 - RNA, 21 nt, Human
ggcccccaucucaugccccug

SEQ ID NO: 1316565 - RNA, 15 nt, Human
ggcccccaucucaug

SEQ ID NO: 1316566 - RNA, 14 nt, Human
ggcccccccagcug

SEQ ID NO: 1316567 - RNA, 15 nt, Human
ggccccccugguccc

SEQ ID NO: 1316568 - RNA, 21 nt, Human
ggccccccugguccccuccuu

SEQ ID NO: 1316569 - RNA, 19 nt, Human
ggcccccgccuuggccugu

SEQ ID NO: 1316570 - RNA, 23 nt, Human
ggcccccgccuuggccuguguuc

SEQ ID NO: 1316571 - RNA, 13 nt, Human
ggcccccucccug

SEQ ID NO: 1316572 - RNA, 16 nt, Human
ggcccccucccuggau

SEQ ID NO: 1316573 - RNA, 17 nt, Human
ggcccccucccuggaug

SEQ ID NO: 1316574 - RNA, 18 nt, Human
ggccccguuucugguggu

SEQ ID NO: 1316575 - RNA, 19 nt, Human
ggccccucacccugccuua

SEQ ID NO: 1316576 - RNA, 16 nt, Human
ggccccucccccugag

SEQ ID NO: 1316577 - RNA, 14 nt, Human
ggccccuccccucc

SEQ ID NO: 1316578 - RNA, 17 nt, Human
ggccccuccccuccaaa

SEQ ID NO: 1316579 - RNA, 22 nt, Human
ggccccucacccugccuuaucu

SEQ ID NO: 1316580 - RNA, 12 nt, Human
ggccccucucag

SEQ ID NO: 1316581 - RNA, 13 nt, Human
ggccccucucagc

SEQ ID NO: 1316582 - RNA, 14 nt, Human
ggccccucucagcc

SEQ ID NO: 1316583 - RNA, 15 nt, Human
ggccccucucagccc

SEQ ID NO: 1316584 - RNA, 16 nt, Human
ggccccucucagcccu

SEQ ID NO: 1316585 - RNA, 20 nt, Human
ggccccucucagcccucaca

SEQ ID NO: 1316586 - RNA, 12 nt, Human
ggccccucuccc

SEQ ID NO: 1316587 - RNA, 23 nt, Human
ggccccucucccuugggcucuga

SEQ ID NO: 1316588 - RNA, 14 nt, Human
ggccccucugaccu

SEQ ID NO: 1316589 - RNA, 21 nt, Human
ggaucaguuaacuauugcauu

SEQ ID NO: 1316590 - RNA, 18 nt, Human
ggaucagcguggccuugu

SEQ ID NO: 1316591 - RNA, 12 nt, Human
ggaucagaauag

SEQ ID NO: 1316592 - RNA, 19 nt, Human
ggaucagagcgcacaggga

SEQ ID NO: 1316593 - RNA, 13 nt, Human
ggaucagcguggc

SEQ ID NO: 1316594 - RNA, 15 nt, Human
ggaucagcguggccu

SEQ ID NO: 1316595 - RNA, 16 nt, Human
ggaucagcguggccuu

SEQ ID NO: 1316596 - RNA, 17 nt, Human
ggaucagcguggccuug

SEQ ID NO: 1316597 - RNA, 19 nt, Human
ggaucagcguggccuuguu

SEQ ID NO: 1316598 - RNA, 17 nt, Human
ggaucccaugagcuccu

SEQ ID NO: 1316599 - RNA, 13 nt, Human
ggauccagggagg

SEQ ID NO: 1316600 - RNA, 20 nt, Human
ggauccacgacgcuuaaaua

SEQ ID NO: 1316601 - RNA, 18 nt, Human
ggaucagggguaggaaug

SEQ ID NO: 1316602 - RNA, 17 nt, Human
ggauccaaacugaucca

SEQ ID NO: 1316603 - RNA, 18 nt, Human
ggcaacuugggaacuaga

SEQ ID NO: 1316604 - RNA, 23 nt, Human
ggcaacuugggaacuagacuccc

SEQ ID NO: 1316605 - RNA, 20 nt, Human
ggaucccaugagcuccuuaa

SEQ ID NO: 1316606 - RNA, 16 nt, Human
ggcaacgcacaaaaca

SEQ ID NO: 1316607 - RNA, 16 nt, Human
ggcaaggcuguggacc

SEQ ID NO: 1316608 - RNA, 16 nt, Human
ggcacccccugcagcu

SEQ ID NO: 1316609 - RNA, 18 nt, Human
ggcacccccugcagcuug

SEQ ID NO: 1316610 - RNA, 19 nt, Human
ggcacccccugcagcuugu

SEQ ID NO: 1316611 - RNA, 18 nt, Human
ggcaccuaauccaggcag

SEQ ID NO: 1316612 - RNA, 19 nt, Human
ggcaccuaauccaggcaga

SEQ ID NO: 1316613 - RNA, 17 nt, Human
ggcaccugggcccuggg

SEQ ID NO: 1316614 - RNA, 19 nt, Human
ggcaccugggcccuggggc

SEQ ID NO: 1316615 - RNA, 12 nt, Human
ggcagagcuggu

SEQ ID NO: 1316616 - RNA, 13 nt, Human
ggcagagcuggug

SEQ ID NO: 1316617 - RNA, 14 nt, Human
ggcagagcuggugc

SEQ ID NO: 1316618 - RNA, 15 nt, Human
ggcagagcuggugcg

SEQ ID NO: 1316619 - RNA, 22 nt, Human
ggcaccuaauccaggcagaucc

SEQ ID NO: 1316620 - RNA, 21 nt, Human
ggcaccuacacucaccugcac

SEQ ID NO: 1316621 - RNA, 16 nt, Human
ggcaccucacaggccc

SEQ ID NO: 1316622 - RNA, 19 nt, Human
ggcaccucacaggccccag

SEQ ID NO: 1316623 - RNA, 13 nt, Human
ggcaccugggccc

SEQ ID NO: 1316624 - RNA, 16 nt, Human
ggcaccugggcccugg

SEQ ID NO: 1316625 - RNA, 22 nt, Human
ggcaccugggcccuggggccug

SEQ ID NO: 1316626 - RNA, 15 nt, Human
ggcagcaacaauaaa

SEQ ID NO: 1316627 - RNA, 16 nt, Human
ggcagauguaggaggg

SEQ ID NO: 1316628 - RNA, 17 nt, Human
ggcagauguaggaggga

SEQ ID NO: 1316629 - RNA, 20 nt, Human
ggcagauguaggagggacug

SEQ ID NO: 1316630 - RNA, 15 nt, Human
ggcagauggggagac

SEQ ID NO: 1316631 - RNA, 14 nt, Human
ggcagauguaggag

SEQ ID NO: 1316632 - RNA, 14 nt, Human
ggcagauccaggac

SEQ ID NO: 1316633 - RNA, 16 nt, Human
ggcagauccaggacua

SEQ ID NO: 1316634 - RNA, 15 nt, Human
ggcagcaauuuaaau

SEQ ID NO: 1316635 - RNA, 21 nt, Human
ggcagcaaggcccgagcagcu

SEQ ID NO: 1316636 - RNA, 22 nt, Human
ggcagcaaggcccgagcagcug

SEQ ID NO: 1316637 - RNA, 17 nt, Human
ggcagcaaggcccgagc

SEQ ID NO: 1316638 - RNA, 18 nt, Human
ggcagcaaggcccgagca

SEQ ID NO: 1316639 - RNA, 19 nt, Human
ggcagcaaggcccgagcag

SEQ ID NO: 1316640 - RNA, 20 nt, Human
ggcagcaaggcccgagcagc

SEQ ID NO: 1316641 - RNA, 22 nt, Human
ggcagcaacaauaaauagacac

SEQ ID NO: 1316642 - RNA, 17 nt, Human
ggcagcaacaauaaaua

SEQ ID NO: 1316643 - RNA, 12 nt, Human
ggcagcaaggcc

SEQ ID NO: 1316644 - RNA, 13 nt, Human
ggcagcaaggccc

SEQ ID NO: 1316645 - RNA, 16 nt, Human
ggcagcaaggcccgag

SEQ ID NO: 1316646 - RNA, 16 nt, Human
ggcagcaauuuaaaug

SEQ ID NO: 1316647 - RNA, 22 nt, Human
ggcagcacaaguguaaugaaua

SEQ ID NO: 1316648 - RNA, 23 nt, Human
ggcagcaaggcccgagcagcuga

SEQ ID NO: 1316649 - RNA, 18 nt, Human
ggcagagcuggugcggcu

SEQ ID NO: 1316650 - RNA, 20 nt, Human
ggcagaggaccaggcuguag

SEQ ID NO: 1316651 - RNA, 15 nt, Human
ggcagaggcaguacc

SEQ ID NO: 1316652 - RNA, 14 nt, Human
ggcagaggcccagg

SEQ ID NO: 1316653 - RNA, 16 nt, Human
ggcagaggcccaggcu

SEQ ID NO: 1316654 - RNA, 17 nt, Human
ggcagaggcccaggcug

SEQ ID NO: 1316655 - RNA, 19 nt, Human
ggcagaggcccaggcugcc

SEQ ID NO: 1316656 - RNA, 21 nt, Human
ggcagaggcccaggcugccgu

SEQ ID NO: 1316657 - RNA, 22 nt, Human
ggcagaggcccaggcugccguc

SEQ ID NO: 1316658 - RNA, 13 nt, Human
ggcagaggccugg

SEQ ID NO: 1316659 - RNA, 14 nt, Human
ggcagaggccuggg

SEQ ID NO: 1316660 - RNA, 17 nt, Human
ggcagaggccugggcug

SEQ ID NO: 1316661 - RNA, 22 nt, Human
ggcagaggccugggcugggaaa

SEQ ID NO: 1316662 - RNA, 18 nt, Human
ggcagaggccugggcugg

SEQ ID NO: 1316663 - RNA, 13 nt, Human
ggcagcagccagc

SEQ ID NO: 1316664 - RNA, 11 nt, Human
ggcagcagcca

SEQ ID NO: 1316665 - RNA, 14 nt, Human
ggcaggaaggcuga

SEQ ID NO: 1316666 - RNA, 21 nt, Human
ggcagguaugaucggcaggac

SEQ ID NO: 1316667 - RNA, 15 nt, Human
ggcagcuuugcucau

SEQ ID NO: 1316668 - RNA, 13 nt, Human
ggcagcuuuuaaa

SEQ ID NO: 1316669 - RNA, 14 nt, Human
ggcagcuuugcuca

SEQ ID NO: 1316670 - RNA, 12 nt, Human
ggcagcagccag

SEQ ID NO: 1316671 - RNA, 15 nt, Human
ggcagcuuuuaaaag

SEQ ID NO: 1316672 - RNA, 14 nt, Human
ggcagcuuuuaaaa

SEQ ID NO: 1316673 - RNA, 15 nt, Human
ggcaggaacaaacag

SEQ ID NO: 1316674 - RNA, 23 nt, Human
ggcaggaagcccaauugcuggag

SEQ ID NO: 1316675 - RNA, 23 nt, Human
ggcagguaugaucggcaggacac

SEQ ID NO: 1316676 - RNA, 18 nt, Human
ggaggaggcagagaagaa

SEQ ID NO: 1316677 - RNA, 17 nt, Human
ggaggaggcagagaaga

SEQ ID NO: 1316678 - RNA, 21 nt, Human
ggaggagccuguccugccugu

SEQ ID NO: 1316679 - RNA, 13 nt, Human
ggaggaggagggu

SEQ ID NO: 1316680 - RNA, 12 nt, Human
ggaggagcccag

SEQ ID NO: 1316681 - RNA, 13 nt, Human
ggaggagcccagg

SEQ ID NO: 1316682 - RNA, 20 nt, Human
ggaggagcccaggccaggac

SEQ ID NO: 1316683 - RNA, 12 nt, Human
ggaggagccugu

SEQ ID NO: 1316684 - RNA, 13 nt, Human
ggaggagccuguc

SEQ ID NO: 1316685 - RNA, 15 nt, Human
ggaggagccuguccu

SEQ ID NO: 1316686 - RNA, 16 nt, Human
ggaggagccuguccug

SEQ ID NO: 1316687 - RNA, 15 nt, Human
ggaggaggaaauccc

SEQ ID NO: 1316688 - RNA, 14 nt, Human
ggaggagggcaggc

SEQ ID NO: 1316689 - RNA, 15 nt, Human
ggaggagggcaggca

SEQ ID NO: 1316690 - RNA, 20 nt, Human
ggaggagggcaggcaucggg

SEQ ID NO: 1316691 - RNA, 19 nt, Human
ggaggagggucggugccuu

SEQ ID NO: 1316692 - RNA, 16 nt, Human
ggagccgggagccuga

SEQ ID NO: 1316693 - RNA, 21 nt, Human
ggagccgaggccuaccccgca

SEQ ID NO: 1316694 - RNA, 21 nt, Human
ggaggacgcucucuggccuuc

SEQ ID NO: 1316695 - RNA, 20 nt, Human
ggaggacgcucucuggccuu

SEQ ID NO: 1316696 - RNA, 22 nt, Human
ggaggagagacacuggugggga

SEQ ID NO: 1316697 - RNA, 13 nt, Human
ggaggagaaugag

SEQ ID NO: 1316698 - RNA, 13 nt, Human
ggaggaugugaau

SEQ ID NO: 1316699 - RNA, 17 nt, Human
ggagggaagggagccaa

SEQ ID NO: 1316700 - RNA, 18 nt, Human
ggagggaagggagccaag

SEQ ID NO: 1316701 - RNA, 23 nt, Human
ggagggaagggagccaagggaug

SEQ ID NO: 1316702 - RNA, 21 nt, Human
ggagggaagggagccaaggga

SEQ ID NO: 1316703 - RNA, 17 nt, Human
ggagggacaaaggagcc

SEQ ID NO: 1316704 - RNA, 18 nt, Human
ggagggacaaaggagccu

SEQ ID NO: 1316705 - RNA, 19 nt, Human
ggagggacaaaggagccug

SEQ ID NO: 1316706 - RNA, 20 nt, Human
ggagggacaaaggagccugu

SEQ ID NO: 1316707 - RNA, 21 nt, Human
ggagggacaaaggagccugug

SEQ ID NO: 1316708 - RNA, 22 nt, Human
ggagggacaaaggagccuguga

SEQ ID NO: 1316709 - RNA, 22 nt, Human
ggagggacaaguggacucaggg

SEQ ID NO: 1316710 - RNA, 13 nt, Human
ggagggcaggcau

SEQ ID NO: 1316711 - RNA, 14 nt, Human
ggagggcaggcauc

SEQ ID NO: 1316712 - RNA, 13 nt, Human
ggagggcagcagg

SEQ ID NO: 1316713 - RNA, 15 nt, Human
ggagggcagcagggc

SEQ ID NO: 1316714 - RNA, 16 nt, Human
ggagggcagcagggcu

SEQ ID NO: 1316715 - RNA, 17 nt, Human
ggagggcagcagggcua

SEQ ID NO: 1316716 - RNA, 15 nt, Human
ggagggaggcucagg

SEQ ID NO: 1316717 - RNA, 16 nt, Human
ggagggaggcucaggu

SEQ ID NO: 1316718 - RNA, 10 nt, Human
ggagggcaga

SEQ ID NO: 1316719 - RNA, 14 nt, Human
ggagggcagagcug

SEQ ID NO: 1316720 - RNA, 16 nt, Human
ggagggcagagcuggu

SEQ ID NO: 1316721 - RNA, 17 nt, Human
ggagggcagagcuggug

SEQ ID NO: 1316722 - RNA, 19 nt, Human
ggagggcagagcuggugcg

SEQ ID NO: 1316723 - RNA, 12 nt, Human
ggagggcucuga

SEQ ID NO: 1316724 - RNA, 13 nt, Human
ggagggcucugag

SEQ ID NO: 1316725 - RNA, 14 nt, Human
ggagggcucugagg

SEQ ID NO: 1316726 - RNA, 15 nt, Human
ggagggcucugaggc

SEQ ID NO: 1316727 - RNA, 16 nt, Human
ggagggcucugaggcg

SEQ ID NO: 1316728 - RNA, 19 nt, Human
ggaggggagcaugggaagu

SEQ ID NO: 1316729 - RNA, 21 nt, Human
ggagggcucugaggcgcccca

SEQ ID NO: 1316730 - RNA, 18 nt, Human
ggagggcucugaggcgcc

SEQ ID NO: 1316731 - RNA, 22 nt, Human
ggagggcugucaucugugcacu

SEQ ID NO: 1316732 - RNA, 16 nt, Human
ggaggggaagaggccu

SEQ ID NO: 1316733 - RNA, 16 nt, Human
ggaguccacuuuguuu

SEQ ID NO: 1316734 - RNA, 22 nt, Human
ggagucguggggugugcuggga

SEQ ID NO: 1316735 - RNA, 24 nt, Human
ggagucguggggugugcugggagc

SEQ ID NO: 1316736 - RNA, 13 nt, Human
ggagucugagguc

SEQ ID NO: 1316737 - RNA, 16 nt, Human
ggagucugagguccug

SEQ ID NO: 1316738 - RNA, 18 nt, Human
ggagucugagguccugag

SEQ ID NO: 1316739 - RNA, 19 nt, Human
ggagucugagguccugagc

SEQ ID NO: 1316740 - RNA, 20 nt, Human
ggagucugagguccugagca

SEQ ID NO: 1316741 - RNA, 21 nt, Human
ggagucugagguccugagcac

SEQ ID NO: 1316742 - RNA, 23 nt, Human
ggagucugagguccugagcacug

SEQ ID NO: 1316743 - RNA, 17 nt, Human
ggagucugccacccagg

SEQ ID NO: 1316744 - RNA, 20 nt, Human
ggagucugccacccaggauc

SEQ ID NO: 1316745 - RNA, 21 nt, Human
ggagucugccacccaggaucc

SEQ ID NO: 1316746 - RNA, 13 nt, Human
ggagucugccagg

SEQ ID NO: 1316747 - RNA, 14 nt, Human
ggagucugccaggg

SEQ ID NO: 1316748 - RNA, 15 nt, Human
ggagucugccagggc

SEQ ID NO: 1316749 - RNA, 16 nt, Human
ggagucugccagggcc

SEQ ID NO: 1316750 - RNA, 22 nt, Human
ggagucugccagggccccucuc

SEQ ID NO: 1316751 - RNA, 12 nt, Human
ggagucuugcuc

SEQ ID NO: 1316752 - RNA, 20 nt, Human
ggagucugccagggccccuc

SEQ ID NO: 1316753 - RNA, 16 nt, Human
ggaucagaacaggagc

SEQ ID NO: 1316754 - RNA, 15 nt, Human
ggagugaguggcccu

SEQ ID NO: 1316755 - RNA, 19 nt, Human
ggauagaugcuggcccagg

SEQ ID NO: 1316756 - RNA, 20 nt, Human
ggauagaugcuggcccaggg

SEQ ID NO: 1316757 - RNA, 21 nt, Human
ggauagaugcuggcccagggc

SEQ ID NO: 1316758 - RNA, 13 nt, Human
ggacccaggacag

SEQ ID NO: 1316759 - RNA, 10 nt, Human
ggacccagga

SEQ ID NO: 1316760 - RNA, 16 nt, Human
ggacccagccaggccc

SEQ ID NO: 1316761 - RNA, 13 nt, Human
ggacccagcuaau

SEQ ID NO: 1316762 - RNA, 12 nt, Human
ggacccagccag

SEQ ID NO: 1316763 - RNA, 15 nt, Human
ggacccagccaggcc

SEQ ID NO: 1316764 - RNA, 20 nt, Human
ggacccagccaggcccagcc

SEQ ID NO: 1316765 - RNA, 11 nt, Human
ggaccaggagu

SEQ ID NO: 1316766 - RNA, 20 nt, Human
ggaccaggagugggugggga

SEQ ID NO: 1316767 - RNA, 21 nt, Human
ggaccaggaguggguggggag

SEQ ID NO: 1316768 - RNA, 23 nt, Human
ggaccaggaguggguggggagug

SEQ ID NO: 1316769 - RNA, 21 nt, Human
ggacccagaggaaggggccag

SEQ ID NO: 1316770 - RNA, 13 nt, Human
ggacccagggcuc

SEQ ID NO: 1316771 - RNA, 22 nt, Human
ggacccaugaguuggggucugg

SEQ ID NO: 1316772 - RNA, 12 nt, Human
ggaccucugaca

SEQ ID NO: 1316773 - RNA, 13 nt, Human
ggaccucugacag

SEQ ID NO: 1316774 - RNA, 17 nt, Human
ggaccucugacagcagc

SEQ ID NO: 1316775 - RNA, 16 nt, Human
ggaccucugacagcag

SEQ ID NO: 1316776 - RNA, 22 nt, Human
ggaccagcuuuucccaaaagcc

SEQ ID NO: 1316777 - RNA, 17 nt, Human
ggaccagcuuuucccaa

SEQ ID NO: 1316778 - RNA, 15 nt, Human
ggaccagcuuuuccc

SEQ ID NO: 1316779 - RNA, 19 nt, Human
ggaccagcucaggacagau

SEQ ID NO: 1316780 - RNA, 22 nt, Human
ggaccagcucaggacagaugcc

SEQ ID NO: 1316781 - RNA, 17 nt, Human
ggaaggaucccaugagc

SEQ ID NO: 1316782 - RNA, 18 nt, Human
ggaccagcucaggacaga

SEQ ID NO: 1316783 - RNA, 17 nt, Human
ggaaggaggagccuguc

SEQ ID NO: 1316784 - RNA, 16 nt, Human
ggaaggaggagccugu

SEQ ID NO: 1316785 - RNA, 19 nt, Human
ggaaggaggacccaggaca

SEQ ID NO: 1316786 - RNA, 22 nt, Human
ggaaggagcugccuggacccgu

SEQ ID NO: 1316787 - RNA, 13 nt, Human
ggaaggaggagcc

SEQ ID NO: 1316788 - RNA, 16 nt, Human
ggaaggaggacccagg

SEQ ID NO: 1316789 - RNA, 19 nt, Human
ggaaggagcugccuggacc

SEQ ID NO: 1316790 - RNA, 20 nt, Human
ggaaggagcugccuggaccc

SEQ ID NO: 1316791 - RNA, 12 nt, Human
ggaaggagcugc

SEQ ID NO: 1316792 - RNA, 13 nt, Human
ggaaggagcugcc

SEQ ID NO: 1316793 - RNA, 14 nt, Human
ggaaggagcugccu

SEQ ID NO: 1316794 - RNA, 15 nt, Human
ggaaggagcugccug

SEQ ID NO: 1316795 - RNA, 17 nt, Human
ggaaggagcugccugga

SEQ ID NO: 1316796 - RNA, 18 nt, Human
ggaaggagcugccuggac

SEQ ID NO: 1316797 - RNA, 14 nt, Human
ggacuccucugucc

SEQ ID NO: 1316798 - RNA, 17 nt, Human
ggaccuucgggcugugc

SEQ ID NO: 1316799 - RNA, 15 nt, Human
ggacuccucugucca

SEQ ID NO: 1316800 - RNA, 11 nt, Human
ggacuccugaa

SEQ ID NO: 1316801 - RNA, 17 nt, Human
ggaccuggugcugccuc

SEQ ID NO: 1316802 - RNA, 17 nt, Human
ggaccugguacccuccu

SEQ ID NO: 1316803 - RNA, 19 nt, Human
ggaccugaaauuccaaagu

SEQ ID NO: 1316804 - RNA, 12 nt, Human
ggaccugagccu

SEQ ID NO: 1316805 - RNA, 13 nt, Human
ggaccugagccug

SEQ ID NO: 1316806 - RNA, 14 nt, Human
ggaccugagccugc

SEQ ID NO: 1316807 - RNA, 15 nt, Human
ggaccugagccugcc

SEQ ID NO: 1316808 - RNA, 16 nt, Human
ggaccugagccugccg

SEQ ID NO: 1316809 - RNA, 17 nt, Human
ggaccugagccugccga

SEQ ID NO: 1316810 - RNA, 19 nt, Human
ggaccugagccugccgagc

SEQ ID NO: 1316811 - RNA, 23 nt, Human
ggaccugagccugccgagcaacc

SEQ ID NO: 1316812 - RNA, 20 nt, Human
ggaccugagccugccgagca

SEQ ID NO: 1316813 - RNA, 13 nt, Human
ggaccugccugca

SEQ ID NO: 1316814 - RNA, 14 nt, Human
ggaccuggaaggga

SEQ ID NO: 1316815 - RNA, 14 nt, Human
ggaccuggcugcca

SEQ ID NO: 1316816 - RNA, 11 nt, Human
ggacucugccu

SEQ ID NO: 1316817 - RNA, 14 nt, Human
ggacucugcagccu

SEQ ID NO: 1316818 - RNA, 15 nt, Human
ggacucugcagccuc

SEQ ID NO: 1316819 - RNA, 17 nt, Human
ggacucugcagccucag

SEQ ID NO: 1316820 - RNA, 17 nt, Human
ggacucuggugccucca

SEQ ID NO: 1316821 - RNA, 18 nt, Human
ggacucuggugccuccag

SEQ ID NO: 1316822 - RNA, 12 nt, Human
ggacucuguccu

SEQ ID NO: 1316823 - RNA, 14 nt, Human
ggacucuguccuga

SEQ ID NO: 1316824 - RNA, 16 nt, Human
ggacucuguccugaag

SEQ ID NO: 1316825 - RNA, 21 nt, Human
ggacucuguccugaaggccug

SEQ ID NO: 1316826 - RNA, 23 nt, Human
ggacucuguccugaaggccugag

SEQ ID NO: 1316827 - RNA, 22 nt, Human
ggacucuguccugaaggccuga

SEQ ID NO: 1316828 - RNA, 17 nt, Human
ggacugagugggaagcc

SEQ ID NO: 1316829 - RNA, 18 nt, Human
ggacugagugggaagccc

SEQ ID NO: 1316830 - RNA, 15 nt, Human
ggacugaugucuccu

SEQ ID NO: 1316831 - RNA, 16 nt, Human
ggacugaugucuccua

SEQ ID NO: 1316832 - RNA, 16 nt, Human
ggacuccugaaaaaaa

SEQ ID NO: 1316833 - RNA, 13 nt, Human
ggacucuaaaguc

SEQ ID NO: 1316834 - RNA, 17 nt, Human
ggacucucagucucuga

SEQ ID NO: 1316835 - RNA, 18 nt, Human
ggacucucagucucugag

SEQ ID NO: 1316836 - RNA, 20 nt, Human
ggacucucagucucugagca

SEQ ID NO: 1316837 - RNA, 21 nt, Human
ggacucucagucucugagcag

SEQ ID NO: 1316838 - RNA, 13 nt, Human
ggacucugcagcc

SEQ ID NO: 1316839 - RNA, 13 nt, Human
ggagcccugggag

SEQ ID NO: 1316840 - RNA, 12 nt, Human
ggagcccuggga

SEQ ID NO: 1316841 - RNA, 16 nt, Human
ggagcccgucucagug

SEQ ID NO: 1316842 - RNA, 19 nt, Human
ggagcaaacugcaugccca

SEQ ID NO: 1316843 - RNA, 20 nt, Human
ggagcaaacugcaugcccag

SEQ ID NO: 1316844 - RNA, 21 nt, Human
ggagcaaacugcaugcccaga

SEQ ID NO: 1316845 - RNA, 22 nt, Human
ggagcaaacugcaugcccagag

SEQ ID NO: 1316846 - RNA, 23 nt, Human
ggagcaaacugcaugcccagaga

SEQ ID NO: 1316847 - RNA, 13 nt, Human
ggagcaaagccug

SEQ ID NO: 1316848 - RNA, 14 nt, Human
ggagcaaagccugu

SEQ ID NO: 1316849 - RNA, 15 nt, Human
ggagcaaagccuguu

SEQ ID NO: 1316850 - RNA, 22 nt, Human
ggagcaaagccuguucauggca

SEQ ID NO: 1316851 - RNA, 23 nt, Human
ggagcaaagccuguucauggcag

SEQ ID NO: 1316852 - RNA, 24 nt, Human
ggagcaaagccuguucauggcaga

SEQ ID NO: 1316853 - RNA, 18 nt, Human
ggagccccuucugcucag

SEQ ID NO: 1316854 - RNA, 19 nt, Human
ggagccccuucugcucagc

SEQ ID NO: 1316855 - RNA, 21 nt, Human
ggagccccuucugcucagcuc

SEQ ID NO: 1316856 - RNA, 13 nt, Human
ggagagggcgcag

SEQ ID NO: 1316857 - RNA, 14 nt, Human
ggagagggggcugg

SEQ ID NO: 1316858 - RNA, 18 nt, Human
ggagagggggcugguggg

SEQ ID NO: 1316859 - RNA, 21 nt, Human
ggagagggggcuggugggugc

SEQ ID NO: 1316860 - RNA, 15 nt, Human
ggagauugaccugga

SEQ ID NO: 1316861 - RNA, 22 nt, Human
ggagauucucauaacuugagac

SEQ ID NO: 1316862 - RNA, 23 nt, Human
ggagauucucauaacuugagacc

SEQ ID NO: 1316863 - RNA, 13 nt, Human
ggagauucugccu

SEQ ID NO: 1316864 - RNA, 16 nt, Human
ggacugcggaggaagg

SEQ ID NO: 1316865 - RNA, 15 nt, Human
ggacugcggaggaag

SEQ ID NO: 1316866 - RNA, 21 nt, Human
ggacugccagucccccugccc

SEQ ID NO: 1316867 - RNA, 18 nt, Human
ggacugcuaaauaaaauu

SEQ ID NO: 1316868 - RNA, 19 nt, Human
ggacugcuaaauaaaauuu

SEQ ID NO: 1316869 - RNA, 23 nt, Human
ggacugggagcccccagccuguc

SEQ ID NO: 1316870 - RNA, 22 nt, Human
ggacugggagcccccagccugu

SEQ ID NO: 1316871 - RNA, 21 nt, Human
ggacuguaaguugggcuugcu

SEQ ID NO: 1316872 - RNA, 18 nt, Human
ggacuguagggagggcgg

SEQ ID NO: 1316873 - RNA, 20 nt, Human
ggacuguagggagggcggca

SEQ ID NO: 1316874 - RNA, 18 nt, Human
ggacuguaaguugggcuu

SEQ ID NO: 1316875 - RNA, 15 nt, Human
ggacugucauagaaa

SEQ ID NO: 1316876 - RNA, 20 nt, Human
ggacugucgcugcuucgugg

SEQ ID NO: 1316877 - RNA, 14 nt, Human
ggacugucgcugcu

SEQ ID NO: 1316878 - RNA, 17 nt, Human
ggagaccggccugccag

SEQ ID NO: 1316879 - RNA, 22 nt, Human
ggagaccggccugccaggagga

SEQ ID NO: 1316880 - RNA, 19 nt, Human
ggagaccggccugccagga

SEQ ID NO: 1316881 - RNA, 20 nt, Human
ggagaccggccugccaggag

SEQ ID NO: 1316882 - RNA, 21 nt, Human
ggagaccggccugccaggagg

SEQ ID NO: 1316883 - RNA, 17 nt, Human
ggagaccucagaaguaa

SEQ ID NO: 1316884 - RNA, 12 nt, Human
ggagagcuagga

SEQ ID NO: 1316885 - RNA, 13 nt, Human
ggagagcuaggag

SEQ ID NO: 1316886 - RNA, 14 nt, Human
ggagagcuaggagc

SEQ ID NO: 1316887 - RNA, 15 nt, Human
ggagagcuaggagca

SEQ ID NO: 1316888 - RNA, 21 nt, Human
ggagagcuaggagcaaagccu

SEQ ID NO: 1316889 - RNA, 22 nt, Human
ggagagcuaggagcaaagccug

SEQ ID NO: 1316890 - RNA, 19 nt, Human
ggagagggaaugugaaauu

SEQ ID NO: 1316891 - RNA, 14 nt, Human
ggagagggaaugug

SEQ ID NO: 1316892 - RNA, 14 nt, Human
ggaagaucccccag

SEQ ID NO: 1316893 - RNA, 14 nt, Human
ggaagauagcugug

SEQ ID NO: 1316894 - RNA, 23 nt, Human
ggaagaggccuguuuggccucuc

SEQ ID NO: 1316895 - RNA, 17 nt, Human
ggaagagccuuccaccc

SEQ ID NO: 1316896 - RNA, 19 nt, Human
ggaagagccuuccacccag

SEQ ID NO: 1316897 - RNA, 20 nt, Human
ggaagagccuuccacccagg

SEQ ID NO: 1316898 - RNA, 13 nt, Human
ggaagaggccugu

SEQ ID NO: 1316899 - RNA, 15 nt, Human
ggaagagggacagau

SEQ ID NO: 1316900 - RNA, 17 nt, Human
ggaacucgugucuggca

SEQ ID NO: 1316901 - RNA, 17 nt, Human
ggaagagcagcaccucc

SEQ ID NO: 1316902 - RNA, 22 nt, Human
ggaagagcagcaccuccucagc

SEQ ID NO: 1316903 - RNA, 13 nt, Human
ggaagagcaggac

SEQ ID NO: 1316904 - RNA, 23 nt, Human
ggaagagcaggacuccaggccca

SEQ ID NO: 1316905 - RNA, 16 nt, Human
ggaagagcaggacucc

SEQ ID NO: 1316906 - RNA, 22 nt, Human
ggaagaucccccagaaaagaaa

SEQ ID NO: 1316907 - RNA, 18 nt, Human
ggaagaucccccagaaaa

SEQ ID NO: 1316908 - RNA, 12 nt, Human
ggaagauccugc

SEQ ID NO: 1316909 - RNA, 22 nt, Human
ggaagauccugcggguggggcu

SEQ ID NO: 1316910 - RNA, 18 nt, Human
ggaagauggggaccagca

SEQ ID NO: 1316911 - RNA, 22 nt, Human
ggaagauggggaccagcagccc

SEQ ID NO: 1316912 - RNA, 18 nt, Human
ggaagcagaaauccaagc

SEQ ID NO: 1316913 - RNA, 13 nt, Human
ggaagcagcuuuc

SEQ ID NO: 1316914 - RNA, 15 nt, Human
ggaagcagcagccuc

SEQ ID NO: 1316915 - RNA, 18 nt, Human
ggaagcagcagccucgcc

SEQ ID NO: 1316916 - RNA, 12 nt, Human
ggaagcagcagc

SEQ ID NO: 1316917 - RNA, 13 nt, Human
ggaagcagcagcc

SEQ ID NO: 1316918 - RNA, 14 nt, Human
ggaagcagcagccu

SEQ ID NO: 1316919 - RNA, 22 nt, Human
ggaagcauuguaaaauaauucu

SEQ ID NO: 1316920 - RNA, 22 nt, Human
ggaagccaaaauguaggcuuag

SEQ ID NO: 1316921 - RNA, 14 nt, Human
ggaagccaaagagu

SEQ ID NO: 1316922 - RNA, 19 nt, Human
ggaagcauuuguuucuacu

SEQ ID NO: 1316923 - RNA, 22 nt, Human
ggaaccucagccuggccagaca

SEQ ID NO: 1316924 - RNA, 17 nt, Human
ggaacggaucagauguc

SEQ ID NO: 1316925 - RNA, 14 nt, Human
ggaaccucagccug

SEQ ID NO: 1316926 - RNA, 15 nt, Human
ggaaccucagccugg

SEQ ID NO: 1316927 - RNA, 16 nt, Human
ggaaccucagccuggc

SEQ ID NO: 1316928 - RNA, 19 nt, Human
ggaaccucagccuggccag

SEQ ID NO: 1316929 - RNA, 20 nt, Human
ggaaccucagccuggccaga

SEQ ID NO: 1316930 - RNA, 21 nt, Human
ggaaccucagccuggccagac

SEQ ID NO: 1316931 - RNA, 23 nt, Human
ggaaccucagccuggccagacac

SEQ ID NO: 1316932 - RNA, 23 nt, Human
ggaacuagacucccaagcuggac

SEQ ID NO: 1316933 - RNA, 14 nt, Human
ggaacgugauuagu

SEQ ID NO: 1316934 - RNA, 13 nt, Human
ggaacucagaucc

SEQ ID NO: 1316935 - RNA, 15 nt, Human
ggaacucagauccag

SEQ ID NO: 1316936 - RNA, 16 nt, Human
ggaacucagauccagg

SEQ ID NO: 1316937 - RNA, 17 nt, Human
ggaacucagauccaggg

SEQ ID NO: 1316938 - RNA, 19 nt, Human
ggaacucagauccagggac

SEQ ID NO: 1316939 - RNA, 20 nt, Human
ggaacucagauccagggaca

SEQ ID NO: 1316940 - RNA, 17 nt, Human
ggaacucaucugguuga

SEQ ID NO: 1316941 - RNA, 13 nt, Human
ggaaccccuuucc

SEQ ID NO: 1316942 - RNA, 14 nt, Human
ggaaccccuuuccc

SEQ ID NO: 1316943 - RNA, 16 nt, Human
ggaaccccuuucccac

SEQ ID NO: 1316944 - RNA, 17 nt, Human
ggaaccccuuucccacc

SEQ ID NO: 1316945 - RNA, 19 nt, Human
ggaaccccuuucccacccc

SEQ ID NO: 1316946 - RNA, 23 nt, Human
ggaacccugcccacucccaggac

SEQ ID NO: 1316947 - RNA, 15 nt, Human
ggaaccgaggcaggg

SEQ ID NO: 1316948 - RNA, 16 nt, Human
ggaaccgaggcaggga

SEQ ID NO: 1316949 - RNA, 20 nt, Human
ggaaccgaggcagggaagga

SEQ ID NO: 1316950 - RNA, 24 nt, Human
ggaacccuuacaguaggagcccag

SEQ ID NO: 1316951 - RNA, 12 nt, Human
ggaaccucagcc

SEQ ID NO: 1316952 - RNA, 13 nt, Human
ggaaccucagccu

SEQ ID NO: 1316953 - RNA, 12 nt, Human
ggaaauauuuau

SEQ ID NO: 1316954 - RNA, 19 nt, Human
ggaaagugcugucuuaaac

SEQ ID NO: 1316955 - RNA, 23 nt, Human
ggaaaguggccaagaagcagugg

SEQ ID NO: 1316956 - RNA, 13 nt, Human
ggaaauauuuauu

SEQ ID NO: 1316957 - RNA, 15 nt, Human
ggaaauauuuauuuu

SEQ ID NO: 1316958 - RNA, 17 nt, Human
ggaaauauuuauuuuaa

SEQ ID NO: 1316959 - RNA, 18 nt, Human
ggaaauauuuauuuuaau

SEQ ID NO: 1316960 - RNA, 22 nt, Human
ggaaaucaaaagggccaaagaa

SEQ ID NO: 1316961 - RNA, 17 nt, Human
ggaaaagacacauuuuu

SEQ ID NO: 1316962 - RNA, 13 nt, Human
ggaaaagacacau

SEQ ID NO: 1316963 - RNA, 16 nt, Human
ggaaaauaauacugcu

SEQ ID NO: 1316964 - RNA, 19 nt, Human
ggaaaauaggcaggaagcc

SEQ ID NO: 1316965 - RNA, 20 nt, Human
ggaaaggggucggcugacca

SEQ ID NO: 1316966 - RNA, 16 nt, Human
ggaaaggugguguuuc

SEQ ID NO: 1316967 - RNA, 20 nt, Human
ggaaaggugugagacuggga

SEQ ID NO: 1316968 - RNA, 19 nt, Human
ggaaaguacacucugcugu

SEQ ID NO: 1316969 - RNA, 20 nt, Human
ggaaaaaauaacaaugaaag

SEQ ID NO: 1316970 - RNA, 15 nt, Human
gcuuugggcugcccu

SEQ ID NO: 1316971 - RNA, 16 nt, Human
gcuuugggcugcccug

SEQ ID NO: 1316972 - RNA, 18 nt, Human
gcuuugggcugcccuggu

SEQ ID NO: 1316973 - RNA, 14 nt, Human
gcuuuuaaaagauu

SEQ ID NO: 1316974 - RNA, 19 nt, Human
gcuuuuaacagagucugaa

SEQ ID NO: 1316975 - RNA, 22 nt, Human
ggaaaaccaagccguggcuucc

SEQ ID NO: 1316976 - RNA, 12 nt, Human
ggaaaaccagac

SEQ ID NO: 1316977 - RNA, 22 nt, Human
ggaaaaccagacuacuugggag

SEQ ID NO: 1316978 - RNA, 20 nt, Human
ggaaaacuccaccuucccac

SEQ ID NO: 1316979 - RNA, 19 nt, Human
ggaaaaacuuuggaaccag

SEQ ID NO: 1316980 - RNA, 23 nt, Human
ggaaaaagcaaguucgucuguug

SEQ ID NO: 1316981 - RNA, 17 nt, Human
ggaaaaacuuuggaacc

SEQ ID NO: 1316982 - RNA, 19 nt, Human
ggaaaaaguggguuuuuua

SEQ ID NO: 1316983 - RNA, 14 nt, Human
gcuuugggcugccc

SEQ ID NO: 1316984 - RNA, 22 nt, Human
gcuuuggaccuaaauggccuca

SEQ ID NO: 1316985 - RNA, 17 nt, Human
gcuuuggaccuaaucca

SEQ ID NO: 1316986 - RNA, 17 nt, Human
gcuuuggauuugacauu

SEQ ID NO: 1316987 - RNA, 17 nt, Human
gcuuuauuccagaaugc

SEQ ID NO: 1316988 - RNA, 19 nt, Human
gcuuuacuccguaacagau

SEQ ID NO: 1316989 - RNA, 20 nt, Human
gcuuuaugauaauagauucu

SEQ ID NO: 1316990 - RNA, 21 nt, Human
gcuuuaugauaauagauucuc

SEQ ID NO: 1316991 - RNA, 23 nt, Human
gcuugcccuaagcagaaagugcc

SEQ ID NO: 1316992 - RNA, 18 nt, Human
gcuuggagcagaggggcu

SEQ ID NO: 1316993 - RNA, 14 nt, Human
gcuuggagcugagc

SEQ ID NO: 1316994 - RNA, 15 nt, Human
gcuuggagcugagca

SEQ ID NO: 1316995 - RNA, 18 nt, Human
gcuuggccacagccaggg

SEQ ID NO: 1316996 - RNA, 17 nt, Human
gcuuggccacagccagg

SEQ ID NO: 1316997 - RNA, 12 nt, Human
gcuuuaauauaa

SEQ ID NO: 1316998 - RNA, 13 nt, Human
gcuuuaauauaaa

SEQ ID NO: 1316999 - RNA, 14 nt, Human
gcuuuaauauaaau

SEQ ID NO: 1317000 - RNA, 15 nt, Human
gcuuuaauauaaaug

SEQ ID NO: 1317001 - RNA, 16 nt, Human
gcuuuaauauaaaugc

SEQ ID NO: 1317002 - RNA, 21 nt, Human
gcuuuaauauaaaugcaaaua

SEQ ID NO: 1317003 - RNA, 17 nt, Human
gcuuuaauauaaaugca

SEQ ID NO: 1317004 - RNA, 19 nt, Human
gcuuuaauauaaaugcaaa

SEQ ID NO: 1317005 - RNA, 16 nt, Human
gcuugcccuaagcaga

SEQ ID NO: 1317006 - RNA, 19 nt, Human
gcuugcccuaagcagaaag

SEQ ID NO: 1317007 - RNA, 20 nt, Human
gcuugcccuaagcagaaagu

SEQ ID NO: 1317008 - RNA, 21 nt, Human
gcuugcccuaagcagaaagug

SEQ ID NO: 1317009 - RNA, 19 nt, Human
gcuugcccuggugccucac

SEQ ID NO: 1317010 - RNA, 17 nt, Human
gcuugcccuggugccuc

SEQ ID NO: 1317011 - RNA, 18 nt, Human
gcuugccaaggcagaggc

SEQ ID NO: 1317012 - RNA, 16 nt, Human
gcuucuguugcugccu

SEQ ID NO: 1317013 - RNA, 20 nt, Human
gcuugauagaaaugccaagc

SEQ ID NO: 1317014 - RNA, 22 nt, Human
gcuugcagagaugaggccgcca

SEQ ID NO: 1317015 - RNA, 14 nt, Human
gcuugauuuuugcc

SEQ ID NO: 1317016 - RNA, 19 nt, Human
gcuugaugggauucuggac

SEQ ID NO: 1317017 - RNA, 20 nt, Human
gcuugaugggauucuggaca

SEQ ID NO: 1317018 - RNA, 22 nt, Human
gcuugaugggauucuggacagg

SEQ ID NO: 1317019 - RNA, 14 nt, Human
gcuugauucugcag

SEQ ID NO: 1317020 - RNA, 15 nt, Human
gcuugccaaggcaga

SEQ ID NO: 1317021 - RNA, 20 nt, Human
gcuugccaaggcagaggccu

SEQ ID NO: 1317022 - RNA, 18 nt, Human
gcuucuaguucugccagg

SEQ ID NO: 1317023 - RNA, 13 nt, Human
gcuucuccucucc

SEQ ID NO: 1317024 - RNA, 21 nt, Human
gcuucuaguucugccaggaga

SEQ ID NO: 1317025 - RNA, 19 nt, Human
gcuucuaguucugccagga

SEQ ID NO: 1317026 - RNA, 20 nt, Human
gcuucuaguucugccaggag

SEQ ID NO: 1317027 - RNA, 14 nt, Human
gcuucucucugugg

SEQ ID NO: 1317028 - RNA, 16 nt, Human
gcuucucucuguggga

SEQ ID NO: 1317029 - RNA, 13 nt, Human
gcuucucugacuu

SEQ ID NO: 1317030 - RNA, 14 nt, Human
gcuucucugacuuc

SEQ ID NO: 1317031 - RNA, 17 nt, Human
gcuucucugacuucugc

SEQ ID NO: 1317032 - RNA, 18 nt, Human
gcuucucugacuucugcc

SEQ ID NO: 1317033 - RNA, 20 nt, Human
gcuucucugacuucugccug

SEQ ID NO: 1317034 - RNA, 21 nt, Human
gcuucucugacuucugccugg

SEQ ID NO: 1317035 - RNA, 22 nt, Human
gcuucucugacuucugccugga

SEQ ID NO: 1317036 - RNA, 15 nt, Human
gcuucuggccaggaa

SEQ ID NO: 1317037 - RNA, 18 nt, Human
gcuucuggccaggaagcu

SEQ ID NO: 1317038 - RNA, 16 nt, Human
gcuucuggccaggaag

SEQ ID NO: 1317039 - RNA, 17 nt, Human
gcuucuggccaggaagc

SEQ ID NO: 1317040 - RNA, 19 nt, Human
gcuggggccaggcuggguc

SEQ ID NO: 1317041 - RNA, 16 nt, Human
gcuggggccaggcugg

SEQ ID NO: 1317042 - RNA, 21 nt, Human
gcuggggcauggaaggcaaga

SEQ ID NO: 1317043 - RNA, 12 nt, Human
gcuggggccugg

SEQ ID NO: 1317044 - RNA, 13 nt, Human
gcuggggccuggg

SEQ ID NO: 1317045 - RNA, 15 nt, Human
gcuggggccugggac

SEQ ID NO: 1317046 - RNA, 16 nt, Human
gcuggggccugggaca

SEQ ID NO: 1317047 - RNA, 14 nt, Human
gcuggggucccagc

SEQ ID NO: 1317048 - RNA, 16 nt, Human
gcuggggucccagcag

SEQ ID NO: 1317049 - RNA, 17 nt, Human
gcuggggucccagcagc

SEQ ID NO: 1317050 - RNA, 19 nt, Human
gcuggggucccagcagcug

SEQ ID NO: 1317051 - RNA, 12 nt, Human
gcuggggugcag

SEQ ID NO: 1317052 - RNA, 13 nt, Human
gcuggggugcagg

SEQ ID NO: 1317053 - RNA, 15 nt, Human
gcuggggugcaggga

SEQ ID NO: 1317054 - RNA, 20 nt, Human
gcuggggugcagggaugugg

SEQ ID NO: 1317055 - RNA, 14 nt, Human
gcugggagaggcag

SEQ ID NO: 1317056 - RNA, 15 nt, Human
gcugggagaggcagc

SEQ ID NO: 1317057 - RNA, 13 nt, Human
gcugggagcucca

SEQ ID NO: 1317058 - RNA, 14 nt, Human
gcugggagcuccac

SEQ ID NO: 1317059 - RNA, 16 nt, Human
gcugggagcuccacuc

SEQ ID NO: 1317060 - RNA, 18 nt, Human
gcugggagcuccacucug

SEQ ID NO: 1317061 - RNA, 21 nt, Human
gcugggauuacaggcuccugc

SEQ ID NO: 1317062 - RNA, 17 nt, Human
gcugggauuacaggcgu

SEQ ID NO: 1317063 - RNA, 18 nt, Human
gcugggauuacaggcgug

SEQ ID NO: 1317064 - RNA, 19 nt, Human
gcugggauuacaggcuccu

SEQ ID NO: 1317065 - RNA, 20 nt, Human
gcugggauuacaggcuccug

SEQ ID NO: 1317066 - RNA, 17 nt, Human
gcugggaggagggcagg

SEQ ID NO: 1317067 - RNA, 22 nt, Human
gcugggaggaaggacuucccug

SEQ ID NO: 1317068 - RNA, 15 nt, Human
gcugggaggaaggac

SEQ ID NO: 1317069 - RNA, 19 nt, Human
gcugggaggagggcaggca

SEQ ID NO: 1317070 - RNA, 15 nt, Human
gcugggagcucugca

SEQ ID NO: 1317071 - RNA, 20 nt, Human
gcugggagcuccacucugcu

SEQ ID NO: 1317072 - RNA, 21 nt, Human
gcugggagcuccacucugcuu

SEQ ID NO: 1317073 - RNA, 16 nt, Human
gcugggagcucugcag

SEQ ID NO: 1317074 - RNA, 22 nt, Human
gcugggagcuccacucugcuuc

SEQ ID NO: 1317075 - RNA, 23 nt, Human
gcugggagaggcagcccaggaag

SEQ ID NO: 1317076 - RNA, 15 nt, Human
gcuggugcggcuggc

SEQ ID NO: 1317077 - RNA, 18 nt, Human
gcuggugcggcuggccau

SEQ ID NO: 1317078 - RNA, 20 nt, Human
gcuggugcggcuggccaugg

SEQ ID NO: 1317079 - RNA, 18 nt, Human
gcuggugggugccuaggc

SEQ ID NO: 1317080 - RNA, 15 nt, Human
gcuggugugguacag

SEQ ID NO: 1317081 - RNA, 17 nt, Human
gcuggugugguacagag

SEQ ID NO: 1317082 - RNA, 18 nt, Human
gcuggugugguacagaga

SEQ ID NO: 1317083 - RNA, 19 nt, Human
gcuggugugguacagagaa

SEQ ID NO: 1317084 - RNA, 20 nt, Human
gcuggugugguacagagaag

SEQ ID NO: 1317085 - RNA, 21 nt, Human
gcuggugugguacagagaagc

SEQ ID NO: 1317086 - RNA, 22 nt, Human
gcuggugugguacagagaagcc

SEQ ID NO: 1317087 - RNA, 23 nt, Human
gcuggugugguacagagaagcca

SEQ ID NO: 1317088 - RNA, 13 nt, Human
gcugguguuaaca

SEQ ID NO: 1317089 - RNA, 14 nt, Human
gcugguguuaacag

SEQ ID NO: 1317090 - RNA, 16 nt, Human
gcugguguuaacagaa

SEQ ID NO: 1317091 - RNA, 17 nt, Human
gcugguguuaacagaag

SEQ ID NO: 1317092 - RNA, 18 nt, Human
gcugguguuaacagaagg

SEQ ID NO: 1317093 - RNA, 21 nt, Human
gcugguguuaacagaagggag

SEQ ID NO: 1317094 - RNA, 22 nt, Human
gcuguauuuuaaaagaaugauu

SEQ ID NO: 1317095 - RNA, 14 nt, Human
gcugguuagaaaug

SEQ ID NO: 1317096 - RNA, 21 nt, Human
gcugucaagccauuuuuacau

SEQ ID NO: 1317097 - RNA, 14 nt, Human
gcugucaaggcuca

SEQ ID NO: 1317098 - RNA, 22 nt, Human
gcugguguuaacagaagggagg

SEQ ID NO: 1317099 - RNA, 13 nt, Human
gcugucacaggcg

SEQ ID NO: 1317100 - RNA, 17 nt, Human
gcugucacaaccaagaa

SEQ ID NO: 1317101 - RNA, 15 nt, Human
gcugucccucccccu

SEQ ID NO: 1317102 - RNA, 16 nt, Human
gcugucccucccccuu

SEQ ID NO: 1317103 - RNA, 18 nt, Human
gcugucugaggcuaggug

SEQ ID NO: 1317104 - RNA, 17 nt, Human
gcugucugggugcuacu

SEQ ID NO: 1317105 - RNA, 20 nt, Human
gcugucugggugcuacuggg

SEQ ID NO: 1317106 - RNA, 22 nt, Human
gcugucugggugcuacugggga

SEQ ID NO: 1317107 - RNA, 23 nt, Human
gcugucugggugcuacuggggaa

SEQ ID NO: 1317108 - RNA, 23 nt, Human
gcugucuguuguauucauugugg

SEQ ID NO: 1317109 - RNA, 21 nt, Human
gcugucuuaaacuaaaugugc

SEQ ID NO: 1317110 - RNA, 13 nt, Human
gcugugguuuucu

SEQ ID NO: 1317111 - RNA, 14 nt, Human
gcugugguuuucuu

SEQ ID NO: 1317112 - RNA, 15 nt, Human
gcugugguuuucuuu

SEQ ID NO: 1317113 - RNA, 23 nt, Human
gcugugguuuucuuuugccauga

SEQ ID NO: 1317114 - RNA, 22 nt, Human
gcugugguuuucuuuugccaug

SEQ ID NO: 1317115 - RNA, 16 nt, Human
gcuguguaagauuugu

SEQ ID NO: 1317116 - RNA, 23 nt, Human
gcuguguaagauuuguuuuuaaa

SEQ ID NO: 1317117 - RNA, 18 nt, Human
gcuguguaagauuuguuu

SEQ ID NO: 1317118 - RNA, 22 nt, Human
gcuguguccaaaaccgccagcu

SEQ ID NO: 1317119 - RNA, 16 nt, Human
gcuagcaaauaguaau

SEQ ID NO: 1317120 - RNA, 12 nt, Human
gcuagcaaauag

SEQ ID NO: 1317121 - RNA, 18 nt, Human
gcuagauguauguacuuc

SEQ ID NO: 1317122 - RNA, 18 nt, Human
gcuagaggaagcagccaa

SEQ ID NO: 1317123 - RNA, 17 nt, Human
gcuagagcuccucccuc

SEQ ID NO: 1317124 - RNA, 19 nt, Human
gcugcccuggugcugccac

SEQ ID NO: 1317125 - RNA, 20 nt, Human
gcugcccuggugcugccaca

SEQ ID NO: 1317126 - RNA, 22 nt, Human
gcugcccuggugcugccacacu

SEQ ID NO: 1317127 - RNA, 23 nt, Human
gcugcccuggugcugccacacuu

SEQ ID NO: 1317128 - RNA, 18 nt, Human
gcugcccuguaccccagc

SEQ ID NO: 1317129 - RNA, 17 nt, Human
gcugcccuuucugggca

SEQ ID NO: 1317130 - RNA, 15 nt, Human
gcugccuuuggacuu

SEQ ID NO: 1317131 - RNA, 20 nt, Human
gcugccuuuggacuuguccc

SEQ ID NO: 1317132 - RNA, 14 nt, Human
gcugcgcacugugu

SEQ ID NO: 1317133 - RNA, 13 nt, Human
gcugcuagaguga

SEQ ID NO: 1317134 - RNA, 20 nt, Human
gcugcuagagugacucacua

SEQ ID NO: 1317135 - RNA, 20 nt, Human
gcugcuguggccaucaaccu

SEQ ID NO: 1317136 - RNA, 19 nt, Human
gcugcuagagugacucacu

SEQ ID NO: 1317137 - RNA, 21 nt, Human
gcugcugugugcuuuuuuugu

SEQ ID NO: 1317138 - RNA, 22 nt, Human
gcugcugugugcuuuuuuugug

SEQ ID NO: 1317139 - RNA, 17 nt, Human
gcugcuuccuccuggaa

SEQ ID NO: 1317140 - RNA, 19 nt, Human
gcugcuucccugaagcucc

SEQ ID NO: 1317141 - RNA, 18 nt, Human
gcugcuucucccaggcaa

SEQ ID NO: 1317142 - RNA, 19 nt, Human
gcugcuucucccaggcaag

SEQ ID NO: 1317143 - RNA, 21 nt, Human
gcugcuucucccaggcaaggc

SEQ ID NO: 1317144 - RNA, 22 nt, Human
gcugcuucucccaggcaaggcu

SEQ ID NO: 1317145 - RNA, 13 nt, Human
gcugcuuccagug

SEQ ID NO: 1317146 - RNA, 13 nt, Human
gcugcuuccuccu

SEQ ID NO: 1317147 - RNA, 14 nt, Human
gcugcuuccuccug

SEQ ID NO: 1317148 - RNA, 15 nt, Human
gcugcuuccuccugg

SEQ ID NO: 1317149 - RNA, 16 nt, Human
gcugcuuccuccugga

SEQ ID NO: 1317150 - RNA, 23 nt, Human
gcugcuucucccaggcaaggcug

SEQ ID NO: 1317151 - RNA, 20 nt, Human
gcuggaugagaauuugagug

SEQ ID NO: 1317152 - RNA, 13 nt, Human
gcuggaugagcuc

SEQ ID NO: 1317153 - RNA, 14 nt, Human
gcuggaugagcucc

SEQ ID NO: 1317154 - RNA, 23 nt, Human
gcuggaugagcucccacaagccu

SEQ ID NO: 1317155 - RNA, 15 nt, Human
gcuggaugagcuccc

SEQ ID NO: 1317156 - RNA, 14 nt, Human
gcuggcaacacaga

SEQ ID NO: 1317157 - RNA, 19 nt, Human
gcuggcaacacagaggcag

SEQ ID NO: 1317158 - RNA, 21 nt, Human
gcuggcaacacagaggcagcc

SEQ ID NO: 1317159 - RNA, 13 nt, Human
gcuggcccagggc

SEQ ID NO: 1317160 - RNA, 15 nt, Human
gcuggcccagggccc

SEQ ID NO: 1317161 - RNA, 16 nt, Human
gcuggcccagggccca

SEQ ID NO: 1317162 - RNA, 17 nt, Human
gcuggcccagggcccag

SEQ ID NO: 1317163 - RNA, 21 nt, Human
gcuggcccagggcccagagcc

SEQ ID NO: 1317164 - RNA, 18 nt, Human
gcuggcccagggcccaga

SEQ ID NO: 1317165 - RNA, 19 nt, Human
gcuggcccagggcccagag

SEQ ID NO: 1317166 - RNA, 20 nt, Human
gcuggcccagggcccagagc

SEQ ID NO: 1317167 - RNA, 21 nt, Human
gcugggacguggcucagccag

SEQ ID NO: 1317168 - RNA, 22 nt, Human
gcugggacguggcucagccagc

SEQ ID NO: 1317169 - RNA, 14 nt, Human
gcugggacuacagg

SEQ ID NO: 1317170 - RNA, 12 nt, Human
gcugggacucag

SEQ ID NO: 1317171 - RNA, 14 nt, Human
gcugggacucagcc

SEQ ID NO: 1317172 - RNA, 15 nt, Human
gcugggacucagccu

SEQ ID NO: 1317173 - RNA, 16 nt, Human
gcugggacucagccuu

SEQ ID NO: 1317174 - RNA, 19 nt, Human
gcugggacucagccuucag

SEQ ID NO: 1317175 - RNA, 22 nt, Human
gcugggacucagccuucagaca

SEQ ID NO: 1317176 - RNA, 23 nt, Human
gcugggacucagccuucagacag

SEQ ID NO: 1317177 - RNA, 17 nt, Human
gcugggacguggcucag

SEQ ID NO: 1317178 - RNA, 19 nt, Human
gcugggacguggcucagcc

SEQ ID NO: 1317179 - RNA, 20 nt, Human
gcugggacguggcucagcca

SEQ ID NO: 1317180 - RNA, 23 nt, Human
gcugggacaccccgacuuuuguu

SEQ ID NO: 1317181 - RNA, 12 nt, Human
gcuggccucugc

SEQ ID NO: 1317182 - RNA, 13 nt, Human
gcuggccucugcg

SEQ ID NO: 1317183 - RNA, 14 nt, Human
gcuggccucugcga

SEQ ID NO: 1317184 - RNA, 15 nt, Human
gcuggccucugcgag

SEQ ID NO: 1317185 - RNA, 16 nt, Human
gcuggccucugcgagu

SEQ ID NO: 1317186 - RNA, 12 nt, Human
gcuggcccugcc

SEQ ID NO: 1317187 - RNA, 13 nt, Human
gcuggcccugccc

SEQ ID NO: 1317188 - RNA, 17 nt, Human
gcuggccgggagccuga

SEQ ID NO: 1317189 - RNA, 21 nt, Human
gcuggccucacccaccccugc

SEQ ID NO: 1317190 - RNA, 21 nt, Human
gcuggccucccaaaugagcca

SEQ ID NO: 1317191 - RNA, 22 nt, Human
gcuggccucccaaaugagccau

SEQ ID NO: 1317192 - RNA, 22 nt, Human
gcccuucuauacccacccagaa

SEQ ID NO: 1317193 - RNA, 21 nt, Human
gcccuucuauacccacccaga

SEQ ID NO: 1317194 - RNA, 19 nt, Human
gcccuucuuuccacagaag

SEQ ID NO: 1317195 - RNA, 20 nt, Human
gcccuucuauacccacccag

SEQ ID NO: 1317196 - RNA, 23 nt, Human
gcccuuccuggacagcugugccu

SEQ ID NO: 1317197 - RNA, 19 nt, Human
gcccuuccuggacagcugu

SEQ ID NO: 1317198 - RNA, 20 nt, Human
gcccuuccuggacagcugug

SEQ ID NO: 1317199 - RNA, 21 nt, Human
gcccuuccuggacagcugugc

SEQ ID NO: 1317200 - RNA, 22 nt, Human
gcccuuccuggacagcugugcc

SEQ ID NO: 1317201 - RNA, 22 nt, Human
gcccuuccucuccacugccuuc

SEQ ID NO: 1317202 - RNA, 12 nt, Human
gcccuuccugga

SEQ ID NO: 1317203 - RNA, 13 nt, Human
gcccuuccuggac

SEQ ID NO: 1317204 - RNA, 14 nt, Human
gcccuuccuggaca

SEQ ID NO: 1317205 - RNA, 15 nt, Human
gcccuuccuggacag

SEQ ID NO: 1317206 - RNA, 16 nt, Human
gcccuuccuggacagc

SEQ ID NO: 1317207 - RNA, 17 nt, Human
gcccuuccuggacagcu

SEQ ID NO: 1317208 - RNA, 18 nt, Human
gcccuuccuggacagcug

SEQ ID NO: 1317209 - RNA, 11 nt, Human
gcccucugggc

SEQ ID NO: 1317210 - RNA, 12 nt, Human
gcccucugggcu

SEQ ID NO: 1317211 - RNA, 13 nt, Human
gcccucugggcuc

SEQ ID NO: 1317212 - RNA, 14 nt, Human
gcccucugggcucu

SEQ ID NO: 1317213 - RNA, 15 nt, Human
gcccucugggcucug

SEQ ID NO: 1317214 - RNA, 16 nt, Human
gcccucugggcucuga

SEQ ID NO: 1317215 - RNA, 18 nt, Human
gcccucugggcucugagu

SEQ ID NO: 1317216 - RNA, 17 nt, Human
gcccucugggcucugag

SEQ ID NO: 1317217 - RNA, 21 nt, Human
gccgagaguccaucagccucc

SEQ ID NO: 1317218 - RNA, 18 nt, Human
gccgacgcuugcacgacc

SEQ ID NO: 1317219 - RNA, 12 nt, Human
gcccuucuuucu

SEQ ID NO: 1317220 - RNA, 13 nt, Human
gcccuucuuucua

SEQ ID NO: 1317221 - RNA, 16 nt, Human
gcccuucuuucuaccc

SEQ ID NO: 1317222 - RNA, 17 nt, Human
gcccuugaguccccauu

SEQ ID NO: 1317223 - RNA, 14 nt, Human
gccgaguccaagcu

SEQ ID NO: 1317224 - RNA, 15 nt, Human
gccgaguccaagcug

SEQ ID NO: 1317225 - RNA, 18 nt, Human
gccgaguccaagcuggga

SEQ ID NO: 1317226 - RNA, 17 nt, Human
gccgauauacucuagau

SEQ ID NO: 1317227 - RNA, 22 nt, Human
gccgauauacucuagaugaagu

SEQ ID NO: 1317228 - RNA, 14 nt, Human
gccgaugcccagag

SEQ ID NO: 1317229 - RNA, 13 nt, Human
gccgggagccuga

SEQ ID NO: 1317230 - RNA, 14 nt, Human
gccgggagccugac

SEQ ID NO: 1317231 - RNA, 19 nt, Human
gccgggagccugacccuca

SEQ ID NO: 1317232 - RNA, 23 nt, Human
gccggggaacuggccaagcugag

SEQ ID NO: 1317233 - RNA, 15 nt, Human
gccggggcagccccc

SEQ ID NO: 1317234 - RNA, 17 nt, Human
gccggggcgaguggcac

SEQ ID NO: 1317235 - RNA, 19 nt, Human
gccggggugggguggcugc

SEQ ID NO: 1317236 - RNA, 20 nt, Human
gccggggugggguggcugca

SEQ ID NO: 1317237 - RNA, 23 nt, Human
gccggggugggguggcugcagcc

SEQ ID NO: 1317238 - RNA, 14 nt, Human
gccgggucugccuc

SEQ ID NO: 1317239 - RNA, 21 nt, Human
gccgggucugccucuucuggg

SEQ ID NO: 1317240 - RNA, 22 nt, Human
gccggggugggguggcugcagc

SEQ ID NO: 1317241 - RNA, 17 nt, Human
gccuauuuuaauaaaca

SEQ ID NO: 1317242 - RNA, 20 nt, Human
gccuaagaggcugcccuccu

SEQ ID NO: 1317243 - RNA, 17 nt, Human
gccuauugcuagagcuc

SEQ ID NO: 1317244 - RNA, 18 nt, Human
gccuauugcuagagcucc

SEQ ID NO: 1317245 - RNA, 19 nt, Human
gccuauugcuagagcuccu

SEQ ID NO: 1317246 - RNA, 23 nt, Human
gccuauugcuagagcuccucccu

SEQ ID NO: 1317247 - RNA, 20 nt, Human
gccuauugcuagagcuccuc

SEQ ID NO: 1317248 - RNA, 15 nt, Human
gccucaaaggcccgc

SEQ ID NO: 1317249 - RNA, 17 nt, Human
gccucaaaggcccgcuc

SEQ ID NO: 1317250 - RNA, 20 nt, Human
gccucaaauaaaaagugcuu

SEQ ID NO: 1317251 - RNA, 22 nt, Human
gccucaaagcaagcauucagaa

SEQ ID NO: 1317252 - RNA, 22 nt, Human
gccuaaaagugggcuugauucu

SEQ ID NO: 1317253 - RNA, 18 nt, Human
gccuaagaauaaacauuu

SEQ ID NO: 1317254 - RNA, 12 nt, Human
gccuaagaggcu

SEQ ID NO: 1317255 - RNA, 13 nt, Human
gccuaagaggcug

SEQ ID NO: 1317256 - RNA, 21 nt, Human
gccuaagaggcugcccuccug

SEQ ID NO: 1317257 - RNA, 14 nt, Human
gccuaaggcugaac

SEQ ID NO: 1317258 - RNA, 14 nt, Human
gccucaaugccagu

SEQ ID NO: 1317259 - RNA, 22 nt, Human
gccucaauuucugaacaccaua

SEQ ID NO: 1317260 - RNA, 23 nt, Human
gccuaaaagugggcuugauucug

SEQ ID NO: 1317261 - RNA, 11 nt, Human
gccguggcuuc

SEQ ID NO: 1317262 - RNA, 12 nt, Human
gccguggcuucc

SEQ ID NO: 1317263 - RNA, 13 nt, Human
gccguggcuuccc

SEQ ID NO: 1317264 - RNA, 15 nt, Human
gccguggcuucccgc

SEQ ID NO: 1317265 - RNA, 21 nt, Human
gccguggauugcacguggccu

SEQ ID NO: 1317266 - RNA, 22 nt, Human
gccguggauugcacguggccuc

SEQ ID NO: 1317267 - RNA, 23 nt, Human
gccguggauugcacguggccucu

SEQ ID NO: 1317268 - RNA, 16 nt, Human
gccguggcugcugugg

SEQ ID NO: 1317269 - RNA, 20 nt, Human
gccguggcugcugugggaaa

SEQ ID NO: 1317270 - RNA, 23 nt, Human
gccggguguccccaacagcgccc

SEQ ID NO: 1317271 - RNA, 14 nt, Human
gccgucuccagggg

SEQ ID NO: 1317272 - RNA, 16 nt, Human
gccgucuccaggggcu

SEQ ID NO: 1317273 - RNA, 21 nt, Human
gccgucuccaggggcugcuuc

SEQ ID NO: 1317274 - RNA, 23 nt, Human
gccgucuccaggggcugcuuccu

SEQ ID NO: 1317275 - RNA, 16 nt, Human
gccgugaaugggugcc

SEQ ID NO: 1317276 - RNA, 14 nt, Human
gccgugacgucugg

SEQ ID NO: 1317277 - RNA, 18 nt, Human
gccgugacgucugggugg

SEQ ID NO: 1317278 - RNA, 22 nt, Human
gccgugacgucuggguggcccu

SEQ ID NO: 1317279 - RNA, 18 nt, Human
gccucucugcaggucccu

SEQ ID NO: 1317280 - RNA, 17 nt, Human
gccucucugcagguccc

SEQ ID NO: 1317281 - RNA, 16 nt, Human
gccucucugcaggucc

SEQ ID NO: 1317282 - RNA, 14 nt, Human
gccucucugcaggu

SEQ ID NO: 1317283 - RNA, 10 nt, Human
gccucucugc

SEQ ID NO: 1317284 - RNA, 20 nt, Human
gccucuccccagguccagcu

SEQ ID NO: 1317285 - RNA, 22 nt, Human
gccucuccccagguccagcucu

SEQ ID NO: 1317286 - RNA, 23 nt, Human
gccucuccccagguccagcucug

SEQ ID NO: 1317287 - RNA, 20 nt, Human
gccucucccaggcaggggcc

SEQ ID NO: 1317288 - RNA, 16 nt, Human
gccucuccccugccug

SEQ ID NO: 1317289 - RNA, 18 nt, Human
gccucuccccugccugcc

SEQ ID NO: 1317290 - RNA, 17 nt, Human
gccucuccccugccugc

SEQ ID NO: 1317291 - RNA, 14 nt, Human
gccucucccaggca

SEQ ID NO: 1317292 - RNA, 15 nt, Human
gccucucccaggcag

SEQ ID NO: 1317293 - RNA, 17 nt, Human
gccucucccaggcaggg

SEQ ID NO: 1317294 - RNA, 18 nt, Human
gccucuccccagguccag

SEQ ID NO: 1317295 - RNA, 15 nt, Human
gccucccucugcugu

SEQ ID NO: 1317296 - RNA, 13 nt, Human
gccucccugaagc

SEQ ID NO: 1317297 - RNA, 18 nt, Human
gccucccugaagccuuug

SEQ ID NO: 1317298 - RNA, 12 nt, Human
gccucccugagc

SEQ ID NO: 1317299 - RNA, 13 nt, Human
gccucccugagcu

SEQ ID NO: 1317300 - RNA, 13 nt, Human
gccucccccacuu

SEQ ID NO: 1317301 - RNA, 21 nt, Human
gccuccccuuaaaggggagac

SEQ ID NO: 1317302 - RNA, 16 nt, Human
gccucccuccugcccc

SEQ ID NO: 1317303 - RNA, 14 nt, Human
gccucccauguuca

SEQ ID NO: 1317304 - RNA, 15 nt, Human
gccucccauccaggg

SEQ ID NO: 1317305 - RNA, 22 nt, Human
gccucccauccagggcccccau

SEQ ID NO: 1317306 - RNA, 11 nt, Human
gccucccccac

SEQ ID NO: 1317307 - RNA, 20 nt, Human
gccucccccacuuucuuucu

SEQ ID NO: 1317308 - RNA, 12 nt, Human
gccucugcauuc

SEQ ID NO: 1317309 - RNA, 15 nt, Human
gccucugcauucagg

SEQ ID NO: 1317310 - RNA, 23 nt, Human
gccugaaagaggcugaggccugg

SEQ ID NO: 1317311 - RNA, 19 nt, Human
gccugaaccccagggcugu

SEQ ID NO: 1317312 - RNA, 17 nt, Human
gccugaacuccugccau

SEQ ID NO: 1317313 - RNA, 23 nt, Human
gccucucuuguaauuuggaucuc

SEQ ID NO: 1317314 - RNA, 23 nt, Human
gccugcugcugagaaccuggccu

SEQ ID NO: 1317315 - RNA, 13 nt, Human
gccuggaccucug

SEQ ID NO: 1317316 - RNA, 15 nt, Human
gccuggaccucugac

SEQ ID NO: 1317317 - RNA, 18 nt, Human
gccuggaccucugacagc

SEQ ID NO: 1317318 - RNA, 20 nt, Human
gccuggaccucugacagcag

SEQ ID NO: 1317319 - RNA, 16 nt, Human
gccugagcccagggag

SEQ ID NO: 1317320 - RNA, 17 nt, Human
gccugagcccagggagg

SEQ ID NO: 1317321 - RNA, 18 nt, Human
gccugagcccagggaggc

SEQ ID NO: 1317322 - RNA, 19 nt, Human
gccugagcccagggaggcc

SEQ ID NO: 1317323 - RNA, 20 nt, Human
gccugagcccagggaggccg

SEQ ID NO: 1317324 - RNA, 18 nt, Human
gccugagcaacucuugau

SEQ ID NO: 1317325 - RNA, 16 nt, Human
gccugagcaguccuug

SEQ ID NO: 1317326 - RNA, 18 nt, Human
gccugagcaguccuuggc

SEQ ID NO: 1317327 - RNA, 19 nt, Human
gccugagcaguccuuggcc

SEQ ID NO: 1317328 - RNA, 23 nt, Human
gccugagcaguccuuggccugcu

SEQ ID NO: 1317329 - RNA, 12 nt, Human
gccugagcccag

SEQ ID NO: 1317330 - RNA, 13 nt, Human
gccugagcccagg

SEQ ID NO: 1317331 - RNA, 14 nt, Human
gccugagcccaggg

SEQ ID NO: 1317332 - RNA, 15 nt, Human
gccugagcccaggga

SEQ ID NO: 1317333 - RNA, 16 nt, Human
gcuacagaagaaacug

SEQ ID NO: 1317334 - RNA, 22 nt, Human
gcuacaccacucuggcagccac

SEQ ID NO: 1317335 - RNA, 11 nt, Human
gcuacagagaa

SEQ ID NO: 1317336 - RNA, 12 nt, Human
gcuacagagaaa

SEQ ID NO: 1317337 - RNA, 13 nt, Human
gcuacagagaaac

SEQ ID NO: 1317338 - RNA, 15 nt, Human
gcuacagagaaacca

SEQ ID NO: 1317339 - RNA, 16 nt, Human
gcuacagagaaaccag

SEQ ID NO: 1317340 - RNA, 19 nt, Human
gcuacacccuuuuccagcu

SEQ ID NO: 1317341 - RNA, 23 nt, Human
gcuacaccuauuaucccagcugc

SEQ ID NO: 1317342 - RNA, 16 nt, Human
gcuacaccacucuggc

SEQ ID NO: 1317343 - RNA, 17 nt, Human
gcuacaccacucuggca

SEQ ID NO: 1317344 - RNA, 18 nt, Human
gcuacaccacucuggcag

SEQ ID NO: 1317345 - RNA, 19 nt, Human
gcuacaccacucuggcagc

SEQ ID NO: 1317346 - RNA, 20 nt, Human
gcuacaccacucuggcagcc

SEQ ID NO: 1317347 - RNA, 21 nt, Human
gcuacaccacucuggcagcca

SEQ ID NO: 1317348 - RNA, 17 nt, Human
gcuacacccuuuuccag

SEQ ID NO: 1317349 - RNA, 23 nt, Human
gcuaagaaccuggaacuugggga

SEQ ID NO: 1317350 - RNA, 16 nt, Human
gcuaagaaccuggaac

SEQ ID NO: 1317351 - RNA, 17 nt, Human
gcuaagaaccuggaacu

SEQ ID NO: 1317352 - RNA, 16 nt, Human
gcgugagaccugcccc

SEQ ID NO: 1317353 - RNA, 13 nt, Human
gcuaccaggaaag

SEQ ID NO: 1317354 - RNA, 13 nt, Human
gcuaccaguauuu

SEQ ID NO: 1317355 - RNA, 14 nt, Human
gcuaccaguauuua

SEQ ID NO: 1317356 - RNA, 15 nt, Human
gcuaccaguauuuag

SEQ ID NO: 1317357 - RNA, 12 nt, Human
gcuaccaccagc

SEQ ID NO: 1317358 - RNA, 13 nt, Human
gcuaccaccagcu

SEQ ID NO: 1317359 - RNA, 14 nt, Human
gcuaccaccagcug

SEQ ID NO: 1317360 - RNA, 15 nt, Human
gcuaccaccagcugu

SEQ ID NO: 1317361 - RNA, 16 nt, Human
gcuaccaccagcugug

SEQ ID NO: 1317362 - RNA, 20 nt, Human
gcuaccaccagcugugucca

SEQ ID NO: 1317363 - RNA, 21 nt, Human
gcuaccaccagcuguguccaa

SEQ ID NO: 1317364 - RNA, 17 nt, Human
gcuacagagaaaccagc

SEQ ID NO: 1317365 - RNA, 19 nt, Human
gcuacagagaaaccagcuu

SEQ ID NO: 1317366 - RNA, 20 nt, Human
gcuacagagaaaccagcuuc

SEQ ID NO: 1317367 - RNA, 21 nt, Human
gcuacagagaaaccagcuucc

SEQ ID NO: 1317368 - RNA, 22 nt, Human
gcuacagagaaaccagcuuccu

SEQ ID NO: 1317369 - RNA, 12 nt, Human
gcuacagagaag

SEQ ID NO: 1317370 - RNA, 13 nt, Human
gcuacagagaagc

SEQ ID NO: 1317371 - RNA, 19 nt, Human
gcuacauggggcucacuca

SEQ ID NO: 1317372 - RNA, 14 nt, Human
gcuaccaaaacagu

SEQ ID NO: 1317373 - RNA, 20 nt, Human
gcuaccaaagcaccuuagcu

SEQ ID NO: 1317374 - RNA, 18 nt, Human
gcuaccaguauuuagaag

SEQ ID NO: 1317375 - RNA, 19 nt, Human
gcuaccaguauuuagaagc

SEQ ID NO: 1317376 - RNA, 21 nt, Human
gcuaccaguauuuagaagcca

SEQ ID NO: 1317377 - RNA, 22 nt, Human
gcuaccaguauuuagaagccaa

SEQ ID NO: 1317378 - RNA, 12 nt, Human
gcuacccugagc

SEQ ID NO: 1317379 - RNA, 14 nt, Human
gcuacccugagcug

SEQ ID NO: 1317380 - RNA, 16 nt, Human
gcuacccugagcugag

SEQ ID NO: 1317381 - RNA, 20 nt, Human
gcuacccugagcugaggcag

SEQ ID NO: 1317382 - RNA, 19 nt, Human
gcuacccugagcugaggca

SEQ ID NO: 1317383 - RNA, 16 nt, Human
gcuacccuuuuucucc

SEQ ID NO: 1317384 - RNA, 13 nt, Human
gcuagagcuccuc

SEQ ID NO: 1317385 - RNA, 15 nt, Human
gcuagagcuccuccc

SEQ ID NO: 1317386 - RNA, 16 nt, Human
gcuagagcuccucccu

SEQ ID NO: 1317387 - RNA, 19 nt, Human
gcuagagcuccucccucuc

SEQ ID NO: 1317388 - RNA, 18 nt, Human
gcuacccuuuuucuccag

SEQ ID NO: 1317389 - RNA, 19 nt, Human
gcuacccuuuuucuccagc

SEQ ID NO: 1317390 - RNA, 20 nt, Human
gcuacccuuuuucuccagcu

SEQ ID NO: 1317391 - RNA, 21 nt, Human
gcuacccuuuuucuccagcug

SEQ ID NO: 1317392 - RNA, 22 nt, Human
gcuacccuuuuucuccagcugg

SEQ ID NO: 1317393 - RNA, 22 nt, Human
gcuagacacaugaagguaaaua

SEQ ID NO: 1317394 - RNA, 23 nt, Human
gcuagacacaugaagguaaauaa

SEQ ID NO: 1317395 - RNA, 18 nt, Human
gcgccuccaacccuagca

SEQ ID NO: 1317396 - RNA, 19 nt, Human
gcgccuccauccaaggcca

SEQ ID NO: 1317397 - RNA, 18 nt, Human
gcgcuccuggcccagccu

SEQ ID NO: 1317398 - RNA, 19 nt, Human
gcgcuccuggcccagccuu

SEQ ID NO: 1317399 - RNA, 20 nt, Human
gcgcuccuggcccagccuuu

SEQ ID NO: 1317400 - RNA, 23 nt, Human
gcgaccuuccucauccaccccau

SEQ ID NO: 1317401 - RNA, 13 nt, Human
gcgacuaauuuca

SEQ ID NO: 1317402 - RNA, 21 nt, Human
gcgacuaauuucaaaaugcuu

SEQ ID NO: 1317403 - RNA, 23 nt, Human
gcgacuaauuucaaaaugcuuuu

SEQ ID NO: 1317404 - RNA, 18 nt, Human
gcgacuccguuggccacu

SEQ ID NO: 1317405 - RNA, 19 nt, Human
gcgacuccguuggccacuc

SEQ ID NO: 1317406 - RNA, 20 nt, Human
gcgacuccguuggccacucc

SEQ ID NO: 1317407 - RNA, 12 nt, Human
gcgacuuucugc

SEQ ID NO: 1317408 - RNA, 14 nt, Human
gcgacuuucugccu

SEQ ID NO: 1317409 - RNA, 21 nt, Human
gcgccaggauggaacacggcc

SEQ ID NO: 1317410 - RNA, 22 nt, Human
gcgccaggauggaacacggcca

SEQ ID NO: 1317411 - RNA, 15 nt, Human
gcgccaggcugacca

SEQ ID NO: 1317412 - RNA, 20 nt, Human
gcgccaggcugaccacagca

SEQ ID NO: 1317413 - RNA, 22 nt, Human
gcgccaggcugaccacagcaca

SEQ ID NO: 1317414 - RNA, 14 nt, Human
gcgccaggauggcg

SEQ ID NO: 1317415 - RNA, 14 nt, Human
gcgcccagcuccug

SEQ ID NO: 1317416 - RNA, 15 nt, Human
gcgcccagcuccuga

SEQ ID NO: 1317417 - RNA, 13 nt, Human
gcgcccagggcug

SEQ ID NO: 1317418 - RNA, 19 nt, Human
gcgcccagggcugggagga

SEQ ID NO: 1317419 - RNA, 17 nt, Human
gcgcugguccuuucuuc

SEQ ID NO: 1317420 - RNA, 23 nt, Human
gcgcugucaggauugcgagagau

SEQ ID NO: 1317421 - RNA, 20 nt, Human
gcggaacaaggagucagaca

SEQ ID NO: 1317422 - RNA, 14 nt, Human
gcggggaggaggaa

SEQ ID NO: 1317423 - RNA, 23 nt, Human
gcggggaucagagcgcacaggga

SEQ ID NO: 1317424 - RNA, 14 nt, Human
gcguccuccucugu

SEQ ID NO: 1317425 - RNA, 15 nt, Human
gcguccuccucugug

SEQ ID NO: 1317426 - RNA, 16 nt, Human
gcguccuccucuguga

SEQ ID NO: 1317427 - RNA, 18 nt, Human
gcgacauuagcauaaaca

SEQ ID NO: 1317428 - RNA, 13 nt, Human
gcgaccgcccccu

SEQ ID NO: 1317429 - RNA, 14 nt, Human
gcgaccgcccccuc

SEQ ID NO: 1317430 - RNA, 15 nt, Human
gcgaccgcccccucc

SEQ ID NO: 1317431 - RNA, 10 nt, Human
gcgaccuccu

SEQ ID NO: 1317432 - RNA, 15 nt, Human
gcgaccuuccucauc

SEQ ID NO: 1317433 - RNA, 22 nt, Human
gcgaccuuccucauccacccca

SEQ ID NO: 1317434 - RNA, 17 nt, Human
gccuuuuaguuccugug

SEQ ID NO: 1317435 - RNA, 20 nt, Human
gccuuuuaguuccugugcac

SEQ ID NO: 1317436 - RNA, 22 nt, Human
gccuuuuaucccaaaguuguug

SEQ ID NO: 1317437 - RNA, 16 nt, Human
gccuuuuaguuccugu

SEQ ID NO: 1317438 - RNA, 23 nt, Human
gccuuuguuccccacuggagcag

SEQ ID NO: 1317439 - RNA, 21 nt, Human
gccuuuguuccccacuggagc

SEQ ID NO: 1317440 - RNA, 22 nt, Human
gccuuuguuccccacuggagca

SEQ ID NO: 1317441 - RNA, 13 nt, Human
gccuuuucccucu

SEQ ID NO: 1317442 - RNA, 20 nt, Human
gccuuuucccucuuuggcuc

SEQ ID NO: 1317443 - RNA, 18 nt, Human
gccuuuugcaaccaggaa

SEQ ID NO: 1317444 - RNA, 21 nt, Human
gccuuuauuaaaaacugagug

SEQ ID NO: 1317445 - RNA, 19 nt, Human
gccuuuauuuccacugugc

SEQ ID NO: 1317446 - RNA, 20 nt, Human
gccuuuauuuccacugugca

SEQ ID NO: 1317447 - RNA, 23 nt, Human
gccuuuauuuuuggcguggcuga

SEQ ID NO: 1317448 - RNA, 14 nt, Human
gccuuuauuuguua

SEQ ID NO: 1317449 - RNA, 17 nt, Human
gccuuucaggaucuauu

SEQ ID NO: 1317450 - RNA, 14 nt, Human
gccuuucaggaucu

SEQ ID NO: 1317451 - RNA, 18 nt, Human
gccuuuguuccccacugg

SEQ ID NO: 1317452 - RNA, 19 nt, Human
gccuuuguuccccacugga

SEQ ID NO: 1317453 - RNA, 20 nt, Human
gccuuuguuccccacuggag

SEQ ID NO: 1317454 - RNA, 18 nt, Human
gccuuggggcugaugcag

SEQ ID NO: 1317455 - RNA, 19 nt, Human
gccuucggccuccauccug

SEQ ID NO: 1317456 - RNA, 20 nt, Human
gccuucgcuucuugccucug

SEQ ID NO: 1317457 - RNA, 21 nt, Human
gccuucgcuucuugccucugu

SEQ ID NO: 1317458 - RNA, 22 nt, Human
gccuucgcuucuugccucugug

SEQ ID NO: 1317459 - RNA, 20 nt, Human
gccuuggcugacaugaagcu

SEQ ID NO: 1317460 - RNA, 17 nt, Human
gccuugggcuccgugug

SEQ ID NO: 1317461 - RNA, 18 nt, Human
gccuugggcuccgugugg

SEQ ID NO: 1317462 - RNA, 20 nt, Human
gccuugggcuccguguggga

SEQ ID NO: 1317463 - RNA, 22 nt, Human
gccuugggcuccgugugggaga

SEQ ID NO: 1317464 - RNA, 21 nt, Human
gccuugggcuccgugugggag

SEQ ID NO: 1317465 - RNA, 18 nt, Human
gccuucggccuccauccu

SEQ ID NO: 1317466 - RNA, 22 nt, Human
gccuuccccuuauccucccugu

SEQ ID NO: 1317467 - RNA, 20 nt, Human
gccuuccccuuauccucccu

SEQ ID NO: 1317468 - RNA, 17 nt, Human
gccuucgcuucuugccu

SEQ ID NO: 1317469 - RNA, 19 nt, Human
gccuucccaaguugugcuu

SEQ ID NO: 1317470 - RNA, 20 nt, Human
gccuucccaaguugugcuug

SEQ ID NO: 1317471 - RNA, 21 nt, Human
gccuucccaaguugugcuuga

SEQ ID NO: 1317472 - RNA, 22 nt, Human
gccuuccccacccaccaacccu

SEQ ID NO: 1317473 - RNA, 12 nt, Human
gccuuccccacc

SEQ ID NO: 1317474 - RNA, 13 nt, Human
gccuucagcucua

SEQ ID NO: 1317475 - RNA, 19 nt, Human
gccuucaagcucugaggga

SEQ ID NO: 1317476 - RNA, 17 nt, Human
gccuucacaaucuguca

SEQ ID NO: 1317477 - RNA, 22 nt, Human
gccuucacaaucugucaguucu

SEQ ID NO: 1317478 - RNA, 23 nt, Human
gccuucagacagagaggacugua

SEQ ID NO: 1317479 - RNA, 16 nt, Human
gccuucagcucuacag

SEQ ID NO: 1317480 - RNA, 13 nt, Human
gccuucaaaucaa

SEQ ID NO: 1317481 - RNA, 22 nt, Human
gccuuauuggaaagcagucccc

SEQ ID NO: 1317482 - RNA, 19 nt, Human
gccuuauuagagugucuuu

SEQ ID NO: 1317483 - RNA, 16 nt, Human
gccuuauucagggaag

SEQ ID NO: 1317484 - RNA, 18 nt, Human
gccuuauucagggaagga

SEQ ID NO: 1317485 - RNA, 20 nt, Human
gccuucaagaaaacaggcac

SEQ ID NO: 1317486 - RNA, 22 nt, Human
gccuucaagaaaacaggcacug

SEQ ID NO: 1317487 - RNA, 11 nt, Human
gccuucaagcu

SEQ ID NO: 1317488 - RNA, 14 nt, Human
gccuucaagcucug

SEQ ID NO: 1317489 - RNA, 15 nt, Human
gccuucaagcucuga

SEQ ID NO: 1317490 - RNA, 16 nt, Human
gccuucaagcucugag

SEQ ID NO: 1317491 - RNA, 22 nt, Human
gccuucaagcucugagggaaag

SEQ ID NO: 1317492 - RNA, 22 nt, Human
gccuuagucucaguuugugugu

SEQ ID NO: 1317493 - RNA, 18 nt, Human
gccuuagucucaguuugu

SEQ ID NO: 1317494 - RNA, 19 nt, Human
gccuuaggaagagccuucc

SEQ ID NO: 1317495 - RNA, 15 nt, Human
gccuuagucucaguu

SEQ ID NO: 1317496 - RNA, 16 nt, Human
gccuuagaaccuuucu

SEQ ID NO: 1317497 - RNA, 17 nt, Human
gccuuagaaccuuucuu

SEQ ID NO: 1317498 - RNA, 20 nt, Human
gccugucccacccccacccc

SEQ ID NO: 1317499 - RNA, 20 nt, Human
gccuguccacaggcuucuga

SEQ ID NO: 1317500 - RNA, 22 nt, Human
gccuguccuccaacaccaagca

SEQ ID NO: 1317501 - RNA, 15 nt, Human
gccuguccugccugu

SEQ ID NO: 1317502 - RNA, 12 nt, Human
gccuguccugcc

SEQ ID NO: 1317503 - RNA, 13 nt, Human
gccuguccugccu

SEQ ID NO: 1317504 - RNA, 14 nt, Human
gccuguccugccug

SEQ ID NO: 1317505 - RNA, 13 nt, Human
gccuggaggaccu

SEQ ID NO: 1317506 - RNA, 17 nt, Human
gccuggagauccuccug

SEQ ID NO: 1317507 - RNA, 18 nt, Human
gccuggagauccuccugc

SEQ ID NO: 1317508 - RNA, 19 nt, Human
gccuggagauccuccugca

SEQ ID NO: 1317509 - RNA, 20 nt, Human
gccuggagauccuccugcag

SEQ ID NO: 1317510 - RNA, 22 nt, Human
gccuggagauccuccugcagac

SEQ ID NO: 1317511 - RNA, 14 nt, Human
gccuggagaugacu

SEQ ID NO: 1317512 - RNA, 15 nt, Human
gccuggagcacaaag

SEQ ID NO: 1317513 - RNA, 21 nt, Human
gccuggaccucugacagcagc

SEQ ID NO: 1317514 - RNA, 22 nt, Human
gccuggaccucugacagcagca

SEQ ID NO: 1317515 - RNA, 23 nt, Human
gccuggaccucugacagcagcau

SEQ ID NO: 1317516 - RNA, 14 nt, Human
gccuggacuuuccu

SEQ ID NO: 1317517 - RNA, 15 nt, Human
gccuggacuuuccug

SEQ ID NO: 1317518 - RNA, 16 nt, Human
gccuggacuuuccugc

SEQ ID NO: 1317519 - RNA, 17 nt, Human
gccuggacuuuccugca

SEQ ID NO: 1317520 - RNA, 18 nt, Human
gccuggacuuuccugcaa

SEQ ID NO: 1317521 - RNA, 17 nt, Human
gccuggagacuuagggc

SEQ ID NO: 1317522 - RNA, 19 nt, Human
gccuggagacuuagggcac

SEQ ID NO: 1317523 - RNA, 23 nt, Human
gccuggagacuuagggcaccagg

SEQ ID NO: 1317524 - RNA, 16 nt, Human
gccuggagauccuccu

SEQ ID NO: 1317525 - RNA, 18 nt, Human
gccuguaaucacagcuac

SEQ ID NO: 1317526 - RNA, 21 nt, Human
gccuggagaugacuugaggcc

SEQ ID NO: 1317527 - RNA, 14 nt, Human
gccugguuagaggc

SEQ ID NO: 1317528 - RNA, 21 nt, Human
gccugguuaaauaaggcaggg

SEQ ID NO: 1317529 - RNA, 19 nt, Human
gccuguaacaagccagauu

SEQ ID NO: 1317530 - RNA, 13 nt, Human
gccuguaaacuuu

SEQ ID NO: 1317531 - RNA, 18 nt, Human
gccugucagauccaggag

SEQ ID NO: 1317532 - RNA, 19 nt, Human
gccugucagauccaggagc

SEQ ID NO: 1317533 - RNA, 20 nt, Human
gccugucagauccaggagcu

SEQ ID NO: 1317534 - RNA, 22 nt, Human
gccugucagauccaggagcucc

SEQ ID NO: 1317535 - RNA, 21 nt, Human
gccugucagauccaggagcuc

SEQ ID NO: 1317536 - RNA, 15 nt, Human
gccuguccacaggcu

SEQ ID NO: 1317537 - RNA, 18 nt, Human
gccuguccacaggcuucu

SEQ ID NO: 1317538 - RNA, 23 nt, Human
gccuguccacaggcuucugagca

SEQ ID NO: 1317539 - RNA, 22 nt, Human
gcccaucugggggccucuucug

SEQ ID NO: 1317540 - RNA, 14 nt, Human
gcccauccccuuga

SEQ ID NO: 1317541 - RNA, 22 nt, Human
gcccauccccuugaggucucag

SEQ ID NO: 1317542 - RNA, 14 nt, Human
gcccauccugacca

SEQ ID NO: 1317543 - RNA, 15 nt, Human
gcccauccugaccag

SEQ ID NO: 1317544 - RNA, 16 nt, Human
gcccauccugaccagc

SEQ ID NO: 1317545 - RNA, 18 nt, Human
gcccauccugaccagcug

SEQ ID NO: 1317546 - RNA, 19 nt, Human
gcccauccuguggucacug

SEQ ID NO: 1317547 - RNA, 19 nt, Human
gcccauggacaggcuggcu

SEQ ID NO: 1317548 - RNA, 20 nt, Human
gcccauggacaggcuggcuc

SEQ ID NO: 1317549 - RNA, 21 nt, Human
gcccauggacaggcuggcucc

SEQ ID NO: 1317550 - RNA, 23 nt, Human
gcccauggacaggcuggcuccag

SEQ ID NO: 1317551 - RNA, 13 nt, Human
gcccauggagauu

SEQ ID NO: 1317552 - RNA, 21 nt, Human
gcccauggagauugaccugga

SEQ ID NO: 1317553 - RNA, 22 nt, Human
gcccauggagauugaccuggau

SEQ ID NO: 1317554 - RNA, 23 nt, Human
gcccauggagauugaccuggaug

SEQ ID NO: 1317555 - RNA, 23 nt, Human
gccccagcccagccccacuccuc

SEQ ID NO: 1317556 - RNA, 14 nt, Human
gccccagcccagcc

SEQ ID NO: 1317557 - RNA, 19 nt, Human
gccccagcccagccccacu

SEQ ID NO: 1317558 - RNA, 22 nt, Human
gccccagcccagccccacuccu

SEQ ID NO: 1317559 - RNA, 16 nt, Human
gccccagccucccuga

SEQ ID NO: 1317560 - RNA, 18 nt, Human
gccccagccucccugaag

SEQ ID NO: 1317561 - RNA, 21 nt, Human
gccccagccucccugaagccu

SEQ ID NO: 1317562 - RNA, 15 nt, Human
gccccaggaaaggcc

SEQ ID NO: 1317563 - RNA, 22 nt, Human
gccccaggaaaggcccagccac

SEQ ID NO: 1317564 - RNA, 11 nt, Human
gccccaggacc

SEQ ID NO: 1317565 - RNA, 12 nt, Human
gccccaggacca

SEQ ID NO: 1317566 - RNA, 14 nt, Human
gccccaggaccagc

SEQ ID NO: 1317567 - RNA, 15 nt, Human
gccccaggaccagcu

SEQ ID NO: 1317568 - RNA, 16 nt, Human
gccccaggaccagcuc

SEQ ID NO: 1317569 - RNA, 17 nt, Human
gccccaggaccagcuca

SEQ ID NO: 1317570 - RNA, 18 nt, Human
gccccaggaccagcucag

SEQ ID NO: 1317571 - RNA, 19 nt, Human
gccccaggaccagcucagg

SEQ ID NO: 1317572 - RNA, 22 nt, Human
gccccaggaccagcucaggaca

SEQ ID NO: 1317573 - RNA, 23 nt, Human
gccccaggaccagcucaggacag

SEQ ID NO: 1317574 - RNA, 24 nt, Human
gccccaggaccagcucaggacaga

SEQ ID NO: 1317575 - RNA, 20 nt, Human
gccccaggaccuggcugcca

SEQ ID NO: 1317576 - RNA, 21 nt, Human
gccccaggaccuggcugccau

SEQ ID NO: 1317577 - RNA, 22 nt, Human
gccccaggaccuggcugccaua

SEQ ID NO: 1317578 - RNA, 14 nt, Human
gccccaugaccucc

SEQ ID NO: 1317579 - RNA, 15 nt, Human
gccccaugaccucca

SEQ ID NO: 1317580 - RNA, 16 nt, Human
gccccaugaccuccag

SEQ ID NO: 1317581 - RNA, 18 nt, Human
gccccaugaccuccagcu

SEQ ID NO: 1317582 - RNA, 17 nt, Human
gccccaugaccuccagc

SEQ ID NO: 1317583 - RNA, 20 nt, Human
gcccaggcucggccugcccc

SEQ ID NO: 1317584 - RNA, 12 nt, Human
gcccaggcugcc

SEQ ID NO: 1317585 - RNA, 13 nt, Human
gcccaggcugccg

SEQ ID NO: 1317586 - RNA, 16 nt, Human
gcccaggcugccgucc

SEQ ID NO: 1317587 - RNA, 18 nt, Human
gcccaggcugccgucccc

SEQ ID NO: 1317588 - RNA, 17 nt, Human
gcccaggccugccuguu

SEQ ID NO: 1317589 - RNA, 18 nt, Human
gcccaggcucggccugcc

SEQ ID NO: 1317590 - RNA, 19 nt, Human
gcccaggcucggccugccc

SEQ ID NO: 1317591 - RNA, 12 nt, Human
gcccagcuccaa

SEQ ID NO: 1317592 - RNA, 15 nt, Human
gcccagcuccaaggg

SEQ ID NO: 1317593 - RNA, 12 nt, Human
gcccagcuccug

SEQ ID NO: 1317594 - RNA, 14 nt, Human
gcccagcuccugac

SEQ ID NO: 1317595 - RNA, 23 nt, Human
gcccagcuccugacacugcugga

SEQ ID NO: 1317596 - RNA, 13 nt, Human
gcccagcucugaa

SEQ ID NO: 1317597 - RNA, 15 nt, Human
gcccagggcccagag

SEQ ID NO: 1317598 - RNA, 16 nt, Human
gcccagggcccagagc

SEQ ID NO: 1317599 - RNA, 17 nt, Human
gcccagggcccagagcc

SEQ ID NO: 1317600 - RNA, 18 nt, Human
gcccagggcccagagccc

SEQ ID NO: 1317601 - RNA, 19 nt, Human
gcccagggcccagagccca

SEQ ID NO: 1317602 - RNA, 20 nt, Human
gcccagggcccagagcccag

SEQ ID NO: 1317603 - RNA, 21 nt, Human
gcccagggcccagagcccagc

SEQ ID NO: 1317604 - RNA, 23 nt, Human
gcccagggcccagagcccagcuc

SEQ ID NO: 1317605 - RNA, 22 nt, Human
gcccaguaccuagcuggcucug

SEQ ID NO: 1317606 - RNA, 15 nt, Human
gcccaguagaccuug

SEQ ID NO: 1317607 - RNA, 17 nt, Human
gcccaguagaccuuguu

SEQ ID NO: 1317608 - RNA, 19 nt, Human
gcccaguucacccugauuu

SEQ ID NO: 1317609 - RNA, 15 nt, Human
gcccaguuaaucuug

SEQ ID NO: 1317610 - RNA, 21 nt, Human
gcccaguuggagacugucugg

SEQ ID NO: 1317611 - RNA, 18 nt, Human
gcccauccccaggcaccu

SEQ ID NO: 1317612 - RNA, 22 nt, Human
gcccagugcacuugcuggaaga

SEQ ID NO: 1317613 - RNA, 15 nt, Human
gcccagugcacugaa

SEQ ID NO: 1317614 - RNA, 19 nt, Human
gcccagugcacuugcugga

SEQ ID NO: 1317615 - RNA, 14 nt, Human
gcccaguuaaucuu

SEQ ID NO: 1317616 - RNA, 21 nt, Human
gcccggacgcccaggacccca

SEQ ID NO: 1317617 - RNA, 19 nt, Human
gcccggacgcccaggaccc

SEQ ID NO: 1317618 - RNA, 15 nt, Human
gcccucccugccccu

SEQ ID NO: 1317619 - RNA, 21 nt, Human
gcccucccugccccucccuuc

SEQ ID NO: 1317620 - RNA, 14 nt, Human
gcccucccccuccu

SEQ ID NO: 1317621 - RNA, 16 nt, Human
gcccuccucugcacuc

SEQ ID NO: 1317622 - RNA, 12 nt, Human
gcccuccugugc

SEQ ID NO: 1317623 - RNA, 17 nt, Human
gcccuccugugcucagc

SEQ ID NO: 1317624 - RNA, 18 nt, Human
gcccuccugugcucagcc

SEQ ID NO: 1317625 - RNA, 19 nt, Human
gcccuccugugcucagccc

SEQ ID NO: 1317626 - RNA, 20 nt, Human
gcccuccugugcucagcccu

SEQ ID NO: 1317627 - RNA, 21 nt, Human
gcccuccugugcucagcccug

SEQ ID NO: 1317628 - RNA, 22 nt, Human
gcccuccugugcucagcccuga

SEQ ID NO: 1317629 - RNA, 23 nt, Human
gcccuccugugcucagcccugag

SEQ ID NO: 1317630 - RNA, 17 nt, Human
gcccuccuuccuaaauu

SEQ ID NO: 1317631 - RNA, 14 nt, Human
gccccuuccgccac

SEQ ID NO: 1317632 - RNA, 15 nt, Human
gccccuuccgccacu

SEQ ID NO: 1317633 - RNA, 17 nt, Human
gccccuuccgccacugg

SEQ ID NO: 1317634 - RNA, 19 nt, Human
gccccuuccgccacugggg

SEQ ID NO: 1317635 - RNA, 21 nt, Human
gccccuuccgccacuggggcu

SEQ ID NO: 1317636 - RNA, 22 nt, Human
gcccgcucuacaucuucugccu

SEQ ID NO: 1317637 - RNA, 19 nt, Human
gccccugcacuccagccug

SEQ ID NO: 1317638 - RNA, 13 nt, Human
gccccugcacaaa

SEQ ID NO: 1317639 - RNA, 13 nt, Human
gccccuggcccca

SEQ ID NO: 1317640 - RNA, 14 nt, Human
gccccuggccccag

SEQ ID NO: 1317641 - RNA, 12 nt, Human
gccccuggcugg

SEQ ID NO: 1317642 - RNA, 14 nt, Human
gccccuggcuggga

SEQ ID NO: 1317643 - RNA, 16 nt, Human
gccccuggcugggacg

SEQ ID NO: 1317644 - RNA, 23 nt, Human
gccccuggcugggacguggcuca

SEQ ID NO: 1317645 - RNA, 18 nt, Human
gccccuacccuggacuug

SEQ ID NO: 1317646 - RNA, 21 nt, Human
gccccuagcgcuaucucccug

SEQ ID NO: 1317647 - RNA, 21 nt, Human
gccccucaucucucugcccaa

SEQ ID NO: 1317648 - RNA, 13 nt, Human
gccccgcguggaa

SEQ ID NO: 1317649 - RNA, 15 nt, Human
gccccgcccugcccc

SEQ ID NO: 1317650 - RNA, 13 nt, Human
gccccgcccucau

SEQ ID NO: 1317651 - RNA, 17 nt, Human
gccccgugggguuccuc

SEQ ID NO: 1317652 - RNA, 13 nt, Human
gccccgugaggca

SEQ ID NO: 1317653 - RNA, 17 nt, Human
gccccgucccccucugg

SEQ ID NO: 1317654 - RNA, 21 nt, Human
gccccgucccccucuggcucc

SEQ ID NO: 1317655 - RNA, 16 nt, Human
gcccacagcuguauga

SEQ ID NO: 1317656 - RNA, 13 nt, Human
gcccacaccuccu

SEQ ID NO: 1317657 - RNA, 21 nt, Human
gcccacaccuccuucccucuc

SEQ ID NO: 1317658 - RNA, 15 nt, Human
gcccaaaggacgcac

SEQ ID NO: 1317659 - RNA, 16 nt, Human
gcccaaaggacgcacu

SEQ ID NO: 1317660 - RNA, 21 nt, Human
gcccaaaggacgcacugagca

SEQ ID NO: 1317661 - RNA, 19 nt, Human
gcccaaaggacgcacugag

SEQ ID NO: 1317662 - RNA, 16 nt, Human
gcccacccccggcagc

SEQ ID NO: 1317663 - RNA, 20 nt, Human
gcccacccccggcagcagcc

SEQ ID NO: 1317664 - RNA, 22 nt, Human
gccaugggacagggaggacgcu

SEQ ID NO: 1317665 - RNA, 11 nt, Human
gccauuugaga

SEQ ID NO: 1317666 - RNA, 15 nt, Human
gccauuugcuuuuuc

SEQ ID NO: 1317667 - RNA, 14 nt, Human
gccauuuguacuga

SEQ ID NO: 1317668 - RNA, 19 nt, Human
gccaugggacagggaggac

SEQ ID NO: 1317669 - RNA, 14 nt, Human
gccaugggacaggg

SEQ ID NO: 1317670 - RNA, 17 nt, Human
gccauggccugcaaacu

SEQ ID NO: 1317671 - RNA, 18 nt, Human
gccauggccugcaaacug

SEQ ID NO: 1317672 - RNA, 21 nt, Human
gccauggccugcaaacuggga

SEQ ID NO: 1317673 - RNA, 23 nt, Human
gccauggccugcaaacugggaac

SEQ ID NO: 1317674 - RNA, 20 nt, Human
gccauggacucuguccugaa

SEQ ID NO: 1317675 - RNA, 21 nt, Human
gccauggacucuguccugaag

SEQ ID NO: 1317676 - RNA, 22 nt, Human
gccauggacucuguccugaagg

SEQ ID NO: 1317677 - RNA, 14 nt, Human
gccauggagaaagc

SEQ ID NO: 1317678 - RNA, 15 nt, Human
gccauggagaaagcu

SEQ ID NO: 1317679 - RNA, 16 nt, Human
gccauggagaaagcug

SEQ ID NO: 1317680 - RNA, 17 nt, Human
gccauggagaaagcuga

SEQ ID NO: 1317681 - RNA, 20 nt, Human
gccauggagaaagcugacuu

SEQ ID NO: 1317682 - RNA, 22 nt, Human
gccauggagaaagcugacuugg

SEQ ID NO: 1317683 - RNA, 21 nt, Human
gccauggagaaagcugacuug

SEQ ID NO: 1317684 - RNA, 19 nt, Human
gccaggaagaucccccaga

SEQ ID NO: 1317685 - RNA, 16 nt, Human
gccagggccccucucc

SEQ ID NO: 1317686 - RNA, 17 nt, Human
gccagggccccucuccc

SEQ ID NO: 1317687 - RNA, 18 nt, Human
gccagggccccucucccc

SEQ ID NO: 1317688 - RNA, 19 nt, Human
gccagggccccucucccca

SEQ ID NO: 1317689 - RNA, 20 nt, Human
gccagggccccucuccccag

SEQ ID NO: 1317690 - RNA, 22 nt, Human
gccagggccccucuccccaggg

SEQ ID NO: 1317691 - RNA, 23 nt, Human
gccagggccccucuccccaggga

SEQ ID NO: 1317692 - RNA, 20 nt, Human
gccagcuuguuuacaugcuu

SEQ ID NO: 1317693 - RNA, 23 nt, Human
gccagcuuguuuacaugcuuauu

SEQ ID NO: 1317694 - RNA, 15 nt, Human
gccagcuuucccugc

SEQ ID NO: 1317695 - RNA, 14 nt, Human
gccagcuuuucaaa

SEQ ID NO: 1317696 - RNA, 21 nt, Human
gccaggucacccuuugcugug

SEQ ID NO: 1317697 - RNA, 22 nt, Human
gccaggucacccuuugcuguga

SEQ ID NO: 1317698 - RNA, 14 nt, Human
gccaggucccucuc

SEQ ID NO: 1317699 - RNA, 21 nt, Human
gccaggugacugucuggggag

SEQ ID NO: 1317700 - RNA, 12 nt, Human
gccagucugugg

SEQ ID NO: 1317701 - RNA, 13 nt, Human
gccagucugugga

SEQ ID NO: 1317702 - RNA, 20 nt, Human
gccagucuguggaucagaga

SEQ ID NO: 1317703 - RNA, 13 nt, Human
gccagugacagac

SEQ ID NO: 1317704 - RNA, 18 nt, Human
gccagguggccacuccag

SEQ ID NO: 1317705 - RNA, 18 nt, Human
gccaggugaggucagcac

SEQ ID NO: 1317706 - RNA, 13 nt, Human
gccaggucccucu

SEQ ID NO: 1317707 - RNA, 14 nt, Human
gccaguccuguccu

SEQ ID NO: 1317708 - RNA, 17 nt, Human
gccagugaccaaccuuu

SEQ ID NO: 1317709 - RNA, 14 nt, Human
gccagugacagaca

SEQ ID NO: 1317710 - RNA, 17 nt, Human
gccaucccgucuucucc

SEQ ID NO: 1317711 - RNA, 10 nt, Human
gccagccccu

SEQ ID NO: 1317712 - RNA, 18 nt, Human
gccagcccugccuggagg

SEQ ID NO: 1317713 - RNA, 19 nt, Human
gccagcccugccuggagga

SEQ ID NO: 1317714 - RNA, 20 nt, Human
gccagcccugccuggaggac

SEQ ID NO: 1317715 - RNA, 23 nt, Human
gccagcccugccuggaggaccug

SEQ ID NO: 1317716 - RNA, 14 nt, Human
gccagccccuggcc

SEQ ID NO: 1317717 - RNA, 19 nt, Human
gccagccccuggccccagg

SEQ ID NO: 1317718 - RNA, 20 nt, Human
gccagccccuggccccagga

SEQ ID NO: 1317719 - RNA, 14 nt, Human
gccagccccugcca

SEQ ID NO: 1317720 - RNA, 19 nt, Human
gccagccccuuagacagag

SEQ ID NO: 1317721 - RNA, 22 nt, Human
gccagccccuuagacagaggcc

SEQ ID NO: 1317722 - RNA, 20 nt, Human
gccagccccuuagacagagg

SEQ ID NO: 1317723 - RNA, 10 nt, Human
gccagcccug

SEQ ID NO: 1317724 - RNA, 13 nt, Human
gccagcccugccu

SEQ ID NO: 1317725 - RNA, 14 nt, Human
gccagcccugccug

SEQ ID NO: 1317726 - RNA, 15 nt, Human
gccagcccugccugg

SEQ ID NO: 1317727 - RNA, 16 nt, Human
gccagcccugccugga

SEQ ID NO: 1317728 - RNA, 17 nt, Human
gccagcccugccuggag

SEQ ID NO: 1317729 - RNA, 22 nt, Human
gccagcgagcgcccagcuccug

SEQ ID NO: 1317730 - RNA, 20 nt, Human
gccagcgagcgcccagcucc

SEQ ID NO: 1317731 - RNA, 12 nt, Human
gccagcguccuc

SEQ ID NO: 1317732 - RNA, 13 nt, Human
gccagcguccucc

SEQ ID NO: 1317733 - RNA, 19 nt, Human
gccagcguccuccucugug

SEQ ID NO: 1317734 - RNA, 22 nt, Human
gccagcguccuccucugugacc

SEQ ID NO: 1317735 - RNA, 18 nt, Human
gccagcgucggucugugc

SEQ ID NO: 1317736 - RNA, 19 nt, Human
gccagcgucggucugugcc

SEQ ID NO: 1317737 - RNA, 20 nt, Human
gccagcgucggucugugccc

SEQ ID NO: 1317738 - RNA, 21 nt, Human
gccagcgucggucugugcccc

SEQ ID NO: 1317739 - RNA, 22 nt, Human
gccagcgucggucugugccccu

SEQ ID NO: 1317740 - RNA, 15 nt, Human
gccagcuaaggggug

SEQ ID NO: 1317741 - RNA, 16 nt, Human
gccagcuaaggggugg

SEQ ID NO: 1317742 - RNA, 22 nt, Human
gccagcuaagggguggggcugc

SEQ ID NO: 1317743 - RNA, 23 nt, Human
gccagcuacuuccuccuccccac

SEQ ID NO: 1317744 - RNA, 13 nt, Human
gccagcucuguau

SEQ ID NO: 1317745 - RNA, 15 nt, Human
gccagcucuguauca

SEQ ID NO: 1317746 - RNA, 14 nt, Human
gccagcuggaggca

SEQ ID NO: 1317747 - RNA, 17 nt, Human
gccagcuggaggcaggg

SEQ ID NO: 1317748 - RNA, 15 nt, Human
gccagcuggaggcag

SEQ ID NO: 1317749 - RNA, 20 nt, Human
gccagcugugguuuucuuuu

SEQ ID NO: 1317750 - RNA, 14 nt, Human
gccagcuuguuuac

SEQ ID NO: 1317751 - RNA, 15 nt, Human
gccagcuuguuuaca

SEQ ID NO: 1317752 - RNA, 16 nt, Human
gccagcuuguuuacau

SEQ ID NO: 1317753 - RNA, 17 nt, Human
gccagcuuguuuacaug

SEQ ID NO: 1317754 - RNA, 16 nt, Human
gccaaaggaugugaua

SEQ ID NO: 1317755 - RNA, 17 nt, Human
gccaaaggaugugauau

SEQ ID NO: 1317756 - RNA, 18 nt, Human
gccaaaggaugugauaua

SEQ ID NO: 1317757 - RNA, 18 nt, Human
gccaaaggggaccuggaa

SEQ ID NO: 1317758 - RNA, 20 nt, Human
gccaaaggggaccuggaagg

SEQ ID NO: 1317759 - RNA, 15 nt, Human
gccaaauauguccug

SEQ ID NO: 1317760 - RNA, 17 nt, Human
gccaaauauguccuggg

SEQ ID NO: 1317761 - RNA, 19 nt, Human
gccaaaggggaccuggaag

SEQ ID NO: 1317762 - RNA, 12 nt, Human
gccaaauuaaaa

SEQ ID NO: 1317763 - RNA, 14 nt, Human
gccaaauuaaaaaa

SEQ ID NO: 1317764 - RNA, 16 nt, Human
gccaaauuaaaaaaga

SEQ ID NO: 1317765 - RNA, 18 nt, Human
gccaaauuaaaaaagaua

SEQ ID NO: 1317766 - RNA, 21 nt, Human
gccaaauuaaaaaagauaaac

SEQ ID NO: 1317767 - RNA, 22 nt, Human
gccaaauuaaaaaagauaaaca

SEQ ID NO: 1317768 - RNA, 23 nt, Human
gccaaauuaaaaaagauaaacac

SEQ ID NO: 1317769 - RNA, 21 nt, Human
gccacguguuuagaccuagau

SEQ ID NO: 1317770 - RNA, 22 nt, Human
gccacguucuuacuaguuuccc

SEQ ID NO: 1317771 - RNA, 23 nt, Human
gccacguguuugugcuguggugu

SEQ ID NO: 1317772 - RNA, 22 nt, Human
gccacguuggagaagcccgugu

SEQ ID NO: 1317773 - RNA, 19 nt, Human
gccacuaaccuugccuggu

SEQ ID NO: 1317774 - RNA, 22 nt, Human
gccacuaaccuugccugguaca

SEQ ID NO: 1317775 - RNA, 23 nt, Human
gccacuaaccuugccugguacag

SEQ ID NO: 1317776 - RNA, 14 nt, Human
gccacucacuaggc

SEQ ID NO: 1317777 - RNA, 15 nt, Human
gccacucacuaggcc

SEQ ID NO: 1317778 - RNA, 18 nt, Human
gccacucacuaggccccc

SEQ ID NO: 1317779 - RNA, 19 nt, Human
gccacucacuaggccccca

SEQ ID NO: 1317780 - RNA, 23 nt, Human
gccacucacuaggcccccacuug

SEQ ID NO: 1317781 - RNA, 22 nt, Human
gccagagccaaggggcuucagg

SEQ ID NO: 1317782 - RNA, 12 nt, Human
gccagagccagg

SEQ ID NO: 1317783 - RNA, 14 nt, Human
gccagagccagggg

SEQ ID NO: 1317784 - RNA, 15 nt, Human
gccagagcccacucc

SEQ ID NO: 1317785 - RNA, 16 nt, Human
gccagagcccacucca

SEQ ID NO: 1317786 - RNA, 23 nt, Human
gccagagauccaaaagaagcccc

SEQ ID NO: 1317787 - RNA, 20 nt, Human
gccagagcccacuccaucug

SEQ ID NO: 1317788 - RNA, 23 nt, Human
gccagagcccacuccaucuggua

SEQ ID NO: 1317789 - RNA, 24 nt, Human
gccagagcccacuccaucugguag

SEQ ID NO: 1317790 - RNA, 12 nt, Human
gccagagccugg

SEQ ID NO: 1317791 - RNA, 13 nt, Human
gccagagccuggg

SEQ ID NO: 1317792 - RNA, 14 nt, Human
gccagagccugggg

SEQ ID NO: 1317793 - RNA, 15 nt, Human
gccagagccuggggc

SEQ ID NO: 1317794 - RNA, 19 nt, Human
gccagagccuggggcucua

SEQ ID NO: 1317795 - RNA, 16 nt, Human
gccagagccuggggcu

SEQ ID NO: 1317796 - RNA, 17 nt, Human
gccagagccuggggcuc

SEQ ID NO: 1317797 - RNA, 18 nt, Human
gccagagccuggggcucu

SEQ ID NO: 1317798 - RNA, 20 nt, Human
gccacugaggggggauccag

SEQ ID NO: 1317799 - RNA, 18 nt, Human
gccagagaacccagccca

SEQ ID NO: 1317800 - RNA, 17 nt, Human
gccagagaacccagccc

SEQ ID NO: 1317801 - RNA, 16 nt, Human
gccacuccagaccccu

SEQ ID NO: 1317802 - RNA, 18 nt, Human
gccacuccagaccccugg

SEQ ID NO: 1317803 - RNA, 19 nt, Human
gccacuccagaccccuggc

SEQ ID NO: 1317804 - RNA, 21 nt, Human
gcaggaguuucguuuucaaaa

SEQ ID NO: 1317805 - RNA, 20 nt, Human
gcaggaguuucguuuucaaa

SEQ ID NO: 1317806 - RNA, 14 nt, Human
gcaggaggggggag

SEQ ID NO: 1317807 - RNA, 15 nt, Human
gcaggaggggggagg

SEQ ID NO: 1317808 - RNA, 18 nt, Human
gcaggaggggggagggaa

SEQ ID NO: 1317809 - RNA, 14 nt, Human
gcaggaguagcuga

SEQ ID NO: 1317810 - RNA, 15 nt, Human
gcaggaguagcugag

SEQ ID NO: 1317811 - RNA, 16 nt, Human
gcaggaguagcugagc

SEQ ID NO: 1317812 - RNA, 17 nt, Human
gcaggaguagcugagcu

SEQ ID NO: 1317813 - RNA, 18 nt, Human
gcaggaguagcugagcuc

SEQ ID NO: 1317814 - RNA, 19 nt, Human
gcaggaguagcugagcuca

SEQ ID NO: 1317815 - RNA, 21 nt, Human
gcaggaguagcugagcucaca

SEQ ID NO: 1317816 - RNA, 15 nt, Human
gcaggagggaggugc

SEQ ID NO: 1317817 - RNA, 21 nt, Human
gcaggagcggcagauggggag

SEQ ID NO: 1317818 - RNA, 16 nt, Human
gcagcgaccgcccccu

SEQ ID NO: 1317819 - RNA, 17 nt, Human
gcagcgaccgcccccuc

SEQ ID NO: 1317820 - RNA, 18 nt, Human
gcagcgaccgcccccucc

SEQ ID NO: 1317821 - RNA, 22 nt, Human
gcagcgaccgcccccuccucua

SEQ ID NO: 1317822 - RNA, 15 nt, Human
gcagcgagccugcua

SEQ ID NO: 1317823 - RNA, 12 nt, Human
gcagcgagccug

SEQ ID NO: 1317824 - RNA, 13 nt, Human
gcagcgccaggcu

SEQ ID NO: 1317825 - RNA, 14 nt, Human
gcagcgccaggcug

SEQ ID NO: 1317826 - RNA, 20 nt, Human
gcaggaccuucgggcugugc

SEQ ID NO: 1317827 - RNA, 15 nt, Human
gcagccgugccuuca

SEQ ID NO: 1317828 - RNA, 17 nt, Human
gcagccgugccuucagc

SEQ ID NO: 1317829 - RNA, 12 nt, Human
gcagcagggcua

SEQ ID NO: 1317830 - RNA, 17 nt, Human
gcagcagggcuacccug

SEQ ID NO: 1317831 - RNA, 19 nt, Human
gcagcagggcuacccugag

SEQ ID NO: 1317832 - RNA, 20 nt, Human
gcagcagggcuacccugagc

SEQ ID NO: 1317833 - RNA, 13 nt, Human
gcagcagggguug

SEQ ID NO: 1317834 - RNA, 14 nt, Human
gcagcagggguugg

SEQ ID NO: 1317835 - RNA, 18 nt, Human
gcagccgugccuucagcu

SEQ ID NO: 1317836 - RNA, 23 nt, Human
gcagccugcgccaccgcccagag

SEQ ID NO: 1317837 - RNA, 14 nt, Human
gcagcgaccgcccc

SEQ ID NO: 1317838 - RNA, 16 nt, Human
gcagcaacaauaaaua

SEQ ID NO: 1317839 - RNA, 11 nt, Human
gcagcaacaau

SEQ ID NO: 1317840 - RNA, 15 nt, Human
gcagcaacuuguccu

SEQ ID NO: 1317841 - RNA, 16 nt, Human
gcagcaacuuguccua

SEQ ID NO: 1317842 - RNA, 18 nt, Human
gcagcaacuuguccuagc

SEQ ID NO: 1317843 - RNA, 19 nt, Human
gcagcaacuuguccuagca

SEQ ID NO: 1317844 - RNA, 22 nt, Human
gcagcaacuuguccuagcacag

SEQ ID NO: 1317845 - RNA, 16 nt, Human
gcagcaaggcccgagc

SEQ ID NO: 1317846 - RNA, 17 nt, Human
gcagcaaggcccgagca

SEQ ID NO: 1317847 - RNA, 22 nt, Human
gcagcaaggcccgagcagcuga

SEQ ID NO: 1317848 - RNA, 21 nt, Human
gcagcaaggcccgagcagcug

SEQ ID NO: 1317849 - RNA, 15 nt, Human
gcagcacagcugaga

SEQ ID NO: 1317850 - RNA, 15 nt, Human
gcagcacaggagggc

SEQ ID NO: 1317851 - RNA, 17 nt, Human
gcagcaccguucugugc

SEQ ID NO: 1317852 - RNA, 18 nt, Human
gcagcaccguucugugca

SEQ ID NO: 1317853 - RNA, 19 nt, Human
gcagcaccguucugugcac

SEQ ID NO: 1317854 - RNA, 15 nt, Human
gcagcaccuccucag

SEQ ID NO: 1317855 - RNA, 16 nt, Human
gcagcaccuccucagc

SEQ ID NO: 1317856 - RNA, 17 nt, Human
gcagcaccuccucagcc

SEQ ID NO: 1317857 - RNA, 18 nt, Human
gcagcaccuccucagccu

SEQ ID NO: 1317858 - RNA, 19 nt, Human
gcagcaccuccucagccug

SEQ ID NO: 1317859 - RNA, 20 nt, Human
gcagcaccuccucagccuga

SEQ ID NO: 1317860 - RNA, 13 nt, Human
gcagcaccugccc

SEQ ID NO: 1317861 - RNA, 14 nt, Human
gcagcaccugcccu

SEQ ID NO: 1317862 - RNA, 17 nt, Human
gcagcaccugcccuacc

SEQ ID NO: 1317863 - RNA, 21 nt, Human
gcagaguuacaguucuguggu

SEQ ID NO: 1317864 - RNA, 13 nt, Human
gcagaagcagcaa

SEQ ID NO: 1317865 - RNA, 17 nt, Human
gcagaguuacaguucug

SEQ ID NO: 1317866 - RNA, 18 nt, Human
gcagaguuacaguucugu

SEQ ID NO: 1317867 - RNA, 20 nt, Human
gcagaguuacaguucugugg

SEQ ID NO: 1317868 - RNA, 20 nt, Human
gcacagccucuuagaugcag

SEQ ID NO: 1317869 - RNA, 12 nt, Human
gcacagccuggc

SEQ ID NO: 1317870 - RNA, 19 nt, Human
gcacagccuggcuguggcc

SEQ ID NO: 1317871 - RNA, 15 nt, Human
gcacagcuaauucua

SEQ ID NO: 1317872 - RNA, 13 nt, Human
gcacagcuaugaa

SEQ ID NO: 1317873 - RNA, 16 nt, Human
gcacagcuaugaaggc

SEQ ID NO: 1317874 - RNA, 15 nt, Human
gcacagcuuagauuu

SEQ ID NO: 1317875 - RNA, 16 nt, Human
gcacagcuuagauuuc

SEQ ID NO: 1317876 - RNA, 17 nt, Human
gcacagcuuagauuuca

SEQ ID NO: 1317877 - RNA, 21 nt, Human
gcacaggacaugcgguagcca

SEQ ID NO: 1317878 - RNA, 22 nt, Human
gcacaggacaugcgguagccag

SEQ ID NO: 1317879 - RNA, 19 nt, Human
gcacagcuuagauuucaua

SEQ ID NO: 1317880 - RNA, 12 nt, Human
gcacaggagcua

SEQ ID NO: 1317881 - RNA, 15 nt, Human
gcacaggagcuaccu

SEQ ID NO: 1317882 - RNA, 16 nt, Human
gcacaggagcuaccug

SEQ ID NO: 1317883 - RNA, 21 nt, Human
gcacaggagcuaccugugugg

SEQ ID NO: 1317884 - RNA, 20 nt, Human
gcacaggagcuaccugugug

SEQ ID NO: 1317885 - RNA, 12 nt, Human
gcacaggagggg

SEQ ID NO: 1317886 - RNA, 21 nt, Human
gcacaggagggggucguggag

SEQ ID NO: 1317887 - RNA, 22 nt, Human
gcacaggagggggucguggaga

SEQ ID NO: 1317888 - RNA, 20 nt, Human
gcacaggaguguccucuucc

SEQ ID NO: 1317889 - RNA, 23 nt, Human
gcacaggagggggucguggagag

SEQ ID NO: 1317890 - RNA, 14 nt, Human
gcacaggcccccuu

SEQ ID NO: 1317891 - RNA, 16 nt, Human
gcacaggcuaauuuuu

SEQ ID NO: 1317892 - RNA, 15 nt, Human
gcacaggcuaauuuu

SEQ ID NO: 1317893 - RNA, 18 nt, Human
gcaccaccaagccaaggg

SEQ ID NO: 1317894 - RNA, 19 nt, Human
gcaccaccaugccaggcua

SEQ ID NO: 1317895 - RNA, 21 nt, Human
gcacccaucugucugccaacc

SEQ ID NO: 1317896 - RNA, 17 nt, Human
gcaccccaaagcuuucc

SEQ ID NO: 1317897 - RNA, 20 nt, Human
gcaccccaaagcuuuccugc

SEQ ID NO: 1317898 - RNA, 20 nt, Human
gcacuaacguugagccccug

SEQ ID NO: 1317899 - RNA, 17 nt, Human
gcacuacugacaugugg

SEQ ID NO: 1317900 - RNA, 18 nt, Human
gcacuacugacauguggg

SEQ ID NO: 1317901 - RNA, 17 nt, Human
gcacugaggaccagcca

SEQ ID NO: 1317902 - RNA, 13 nt, Human
gcacugaugcugc

SEQ ID NO: 1317903 - RNA, 15 nt, Human
gcacuagccaaaccu

SEQ ID NO: 1317904 - RNA, 17 nt, Human
gcacuagccaaaccuca

SEQ ID NO: 1317905 - RNA, 18 nt, Human
gcacuagccaaaccucac

SEQ ID NO: 1317906 - RNA, 20 nt, Human
gcacuagccaaaccucacca

SEQ ID NO: 1317907 - RNA, 21 nt, Human
gcacuagccaaaccucaccaa

SEQ ID NO: 1317908 - RNA, 15 nt, Human
gcaccugcugucugg

SEQ ID NO: 1317909 - RNA, 19 nt, Human
gcacuaacguugagccccu

SEQ ID NO: 1317910 - RNA, 12 nt, Human
gcaccugcuguc

SEQ ID NO: 1317911 - RNA, 23 nt, Human
gcaccugcugucuggguggcuca

SEQ ID NO: 1317912 - RNA, 21 nt, Human
gcaccugcccuaccugcccca

SEQ ID NO: 1317913 - RNA, 12 nt, Human
gcaccugccuca

SEQ ID NO: 1317914 - RNA, 13 nt, Human
gcaccugccucag

SEQ ID NO: 1317915 - RNA, 14 nt, Human
gcaccugccucagg

SEQ ID NO: 1317916 - RNA, 15 nt, Human
gcaccugccucagga

SEQ ID NO: 1317917 - RNA, 16 nt, Human
gcaccugccucaggac

SEQ ID NO: 1317918 - RNA, 18 nt, Human
gcacugaugcugccccuc

SEQ ID NO: 1317919 - RNA, 19 nt, Human
gcacugaugcugccccuca

SEQ ID NO: 1317920 - RNA, 22 nt, Human
gcacugaugcugccccucaucu

SEQ ID NO: 1317921 - RNA, 17 nt, Human
gcacugauguuguguuu

SEQ ID NO: 1317922 - RNA, 20 nt, Human
gcacugauguuguguuuuua

SEQ ID NO: 1317923 - RNA, 18 nt, Human
gcacugauguuguguuuu

SEQ ID NO: 1317924 - RNA, 13 nt, Human
gcacugccacugg

SEQ ID NO: 1317925 - RNA, 15 nt, Human
gcacuggggagcccg

SEQ ID NO: 1317926 - RNA, 18 nt, Human
gcacuggggagcccgucu

SEQ ID NO: 1317927 - RNA, 19 nt, Human
gcacuggggagcccgucuc

SEQ ID NO: 1317928 - RNA, 22 nt, Human
gcacuggggagcccgucucagu

SEQ ID NO: 1317929 - RNA, 23 nt, Human
gcacuggggagcccgucucagug

SEQ ID NO: 1317930 - RNA, 16 nt, Human
gcacuguaguucuaag

SEQ ID NO: 1317931 - RNA, 17 nt, Human
gcacuguaguucuaaga

SEQ ID NO: 1317932 - RNA, 18 nt, Human
gcacuguaguucuaagac

SEQ ID NO: 1317933 - RNA, 19 nt, Human
gcacuguaguucuaagacu

SEQ ID NO: 1317934 - RNA, 16 nt, Human
gcagaagcagcaacuu

SEQ ID NO: 1317935 - RNA, 14 nt, Human
gcagaagacaguau

SEQ ID NO: 1317936 - RNA, 17 nt, Human
gcacugucccuugccuc

SEQ ID NO: 1317937 - RNA, 18 nt, Human
gcacugucccuugccuca

SEQ ID NO: 1317938 - RNA, 23 nt, Human
gcacugucccuugccucaaugcc

SEQ ID NO: 1317939 - RNA, 11 nt, Human
gcaggucccua

SEQ ID NO: 1317940 - RNA, 10 nt, Human
gcaggucccu

SEQ ID NO: 1317941 - RNA, 22 nt, Human
gcaggggcuuccuggugcugga

SEQ ID NO: 1317942 - RNA, 18 nt, Human
gcaggggcuuccuggugc

SEQ ID NO: 1317943 - RNA, 14 nt, Human
gcagggggcugcug

SEQ ID NO: 1317944 - RNA, 15 nt, Human
gcagggggcugcugc

SEQ ID NO: 1317945 - RNA, 16 nt, Human
gcagggggcugcugcu

SEQ ID NO: 1317946 - RNA, 17 nt, Human
gcagggggcugcugcug

SEQ ID NO: 1317947 - RNA, 22 nt, Human
gcagggggcugcugcugggcuc

SEQ ID NO: 1317948 - RNA, 13 nt, Human
gcaggucccuaau

SEQ ID NO: 1317949 - RNA, 12 nt, Human
gcaggucccuaa

SEQ ID NO: 1317950 - RNA, 17 nt, Human
gcaggugcuggucccgg

SEQ ID NO: 1317951 - RNA, 13 nt, Human
gcagguggaucua

SEQ ID NO: 1317952 - RNA, 19 nt, Human
gcagguggaucuauuucau

SEQ ID NO: 1317953 - RNA, 20 nt, Human
gcagguggaucuauuucaug

SEQ ID NO: 1317954 - RNA, 21 nt, Human
gcagguggaucuauuucaugu

SEQ ID NO: 1317955 - RNA, 21 nt, Human
gcagguggccaaguuccucua

SEQ ID NO: 1317956 - RNA, 17 nt, Human
gcagguggggagacugg

SEQ ID NO: 1317957 - RNA, 21 nt, Human
gcagguggggagacugggcug

SEQ ID NO: 1317958 - RNA, 18 nt, Human
gcagguggccaaguuccu

SEQ ID NO: 1317959 - RNA, 17 nt, Human
gcaggaucucaccaggc

SEQ ID NO: 1317960 - RNA, 18 nt, Human
gcaggaucucaccaggca

SEQ ID NO: 1317961 - RNA, 19 nt, Human
gcaggaucucaccaggcag

SEQ ID NO: 1317962 - RNA, 20 nt, Human
gcaggaucucaccaggcagc

SEQ ID NO: 1317963 - RNA, 22 nt, Human
gcaggaucucaccaggcagccu

SEQ ID NO: 1317964 - RNA, 21 nt, Human
gcaggaucucaccaggcagcc

SEQ ID NO: 1317965 - RNA, 14 nt, Human
gcaggauugaaaau

SEQ ID NO: 1317966 - RNA, 22 nt, Human
gcaggauugaaaauguccagga

SEQ ID NO: 1317967 - RNA, 20 nt, Human
gcaggauuggggaagagagc

SEQ ID NO: 1317968 - RNA, 21 nt, Human
gcaggauuggggaagagagcc

SEQ ID NO: 1317969 - RNA, 14 nt, Human
gcagggagggccug

SEQ ID NO: 1317970 - RNA, 17 nt, Human
gcagggagggccugggc

SEQ ID NO: 1317971 - RNA, 14 nt, Human
gcaggcucccaggg

SEQ ID NO: 1317972 - RNA, 22 nt, Human
gcaggcucccagggacaccugg

SEQ ID NO: 1317973 - RNA, 18 nt, Human
gcagggagggccugggcc

SEQ ID NO: 1317974 - RNA, 22 nt, Human
gcagggagggccugggccccag

SEQ ID NO: 1317975 - RNA, 23 nt, Human
gcaggcucccagggacaccuggg

SEQ ID NO: 1317976 - RNA, 17 nt, Human
gcagggcgggcagaggg

SEQ ID NO: 1317977 - RNA, 18 nt, Human
gcagggcgggcagagggc

SEQ ID NO: 1317978 - RNA, 20 nt, Human
gcagggcgggcagagggcug

SEQ ID NO: 1317979 - RNA, 21 nt, Human
gcagggcgggcagagggcugg

SEQ ID NO: 1317980 - RNA, 17 nt, Human
gcagggcuacccugagc

SEQ ID NO: 1317981 - RNA, 20 nt, Human
gcagggcuacccugagcuga

SEQ ID NO: 1317982 - RNA, 21 nt, Human
gcagggcuacccugagcugag

SEQ ID NO: 1317983 - RNA, 22 nt, Human
gcagggcuacccugagcugagg

SEQ ID NO: 1317984 - RNA, 23 nt, Human
gcagggcuacccugagcugaggc

SEQ ID NO: 1317985 - RNA, 22 nt, Human
gcagggcgggcagagggcugga

SEQ ID NO: 1317986 - RNA, 13 nt, Human
gcaggggcuuccu

SEQ ID NO: 1317987 - RNA, 14 nt, Human
gcaggggcuuccug

SEQ ID NO: 1317988 - RNA, 15 nt, Human
gcaggggcuuccugg

SEQ ID NO: 1317989 - RNA, 13 nt, Human
gcaguucugaaga

SEQ ID NO: 1317990 - RNA, 14 nt, Human
gcaguucugaagaa

SEQ ID NO: 1317991 - RNA, 23 nt, Human
gcaguucgcagccacccugagga

SEQ ID NO: 1317992 - RNA, 22 nt, Human
gcaguucgcagccacccugagg

SEQ ID NO: 1317993 - RNA, 23 nt, Human
gcauauaagggaaguaguuauca

SEQ ID NO: 1317994 - RNA, 16 nt, Human
gcauauagauuguccu

SEQ ID NO: 1317995 - RNA, 19 nt, Human
gcauaggugauccauguaa

SEQ ID NO: 1317996 - RNA, 20 nt, Human
gcauaggugauccauguaac

SEQ ID NO: 1317997 - RNA, 14 nt, Human
gcauagcucugggg

SEQ ID NO: 1317998 - RNA, 15 nt, Human
gcauagcucuggggu

SEQ ID NO: 1317999 - RNA, 19 nt, Human
gcauaggaccuuuccacca

SEQ ID NO: 1318000 - RNA, 22 nt, Human
gcauagcuacuaaaaucaguga

SEQ ID NO: 1318001 - RNA, 18 nt, Human
gcauaggaguuuggagga

SEQ ID NO: 1318002 - RNA, 21 nt, Human
gcauaggaguuuggaggaagu

SEQ ID NO: 1318003 - RNA, 19 nt, Human
gcagugugaggccagggca

SEQ ID NO: 1318004 - RNA, 21 nt, Human
gcagugugaggccagggcaga

SEQ ID NO: 1318005 - RNA, 18 nt, Human
gcagugggaggguaccag

SEQ ID NO: 1318006 - RNA, 13 nt, Human
gcaguguuagcuu

SEQ ID NO: 1318007 - RNA, 14 nt, Human
gcaguguuagcuua

SEQ ID NO: 1318008 - RNA, 14 nt, Human
gcaguuaccauuaa

SEQ ID NO: 1318009 - RNA, 15 nt, Human
gcaguuaccauuaaa

SEQ ID NO: 1318010 - RNA, 19 nt, Human
gcaguuaccauuaaaccau

SEQ ID NO: 1318011 - RNA, 18 nt, Human
gcaguuaccauuaaacca

SEQ ID NO: 1318012 - RNA, 11 nt, Human
gcaguuauauu

SEQ ID NO: 1318013 - RNA, 13 nt, Human
gcaguuauauuuu

SEQ ID NO: 1318014 - RNA, 16 nt, Human
gcaguuauauuuugca

SEQ ID NO: 1318015 - RNA, 17 nt, Human
gcaguucgacucugugc

SEQ ID NO: 1318016 - RNA, 15 nt, Human
gcaguucgcagccac

SEQ ID NO: 1318017 - RNA, 16 nt, Human
gcaguucgcagccacc

SEQ ID NO: 1318018 - RNA, 17 nt, Human
gcaguucgcagccaccc

SEQ ID NO: 1318019 - RNA, 18 nt, Human
gcaguucgcagccacccu

SEQ ID NO: 1318020 - RNA, 19 nt, Human
gcaguucgcagccacccug

SEQ ID NO: 1318021 - RNA, 20 nt, Human
gcaguucgcagccacccuga

SEQ ID NO: 1318022 - RNA, 19 nt, Human
gcauauuuauaaaaauaaa

SEQ ID NO: 1318023 - RNA, 12 nt, Human
gcauauguugaa

SEQ ID NO: 1318024 - RNA, 14 nt, Human
gcauauguugaaua

SEQ ID NO: 1318025 - RNA, 17 nt, Human
gcauauguugaauacuu

SEQ ID NO: 1318026 - RNA, 15 nt, Human
gcauauaagggaagu

SEQ ID NO: 1318027 - RNA, 18 nt, Human
gcauauuauuuuauguug

SEQ ID NO: 1318028 - RNA, 18 nt, Human
gcauauguugaauacuuu

SEQ ID NO: 1318029 - RNA, 19 nt, Human
gcauauguugaauacuuuu

SEQ ID NO: 1318030 - RNA, 20 nt, Human
gcauauguugaauacuuuuu

SEQ ID NO: 1318031 - RNA, 21 nt, Human
gcauauguugaauacuuuuua

SEQ ID NO: 1318032 - RNA, 23 nt, Human
gcauauuauuuuauguugcauag

SEQ ID NO: 1318033 - RNA, 15 nt, Human
gcauuauaaaaagaa

SEQ ID NO: 1318034 - RNA, 15 nt, Human
gcauuagcuaaaacc

SEQ ID NO: 1318035 - RNA, 20 nt, Human
gcauuagauuucucauuugc

SEQ ID NO: 1318036 - RNA, 17 nt, Human
gcauuagaauuauuuaa

SEQ ID NO: 1318037 - RNA, 18 nt, Human
gcauuagaauuauuuaaa

SEQ ID NO: 1318038 - RNA, 18 nt, Human
gcauuagggaugccuccu

SEQ ID NO: 1318039 - RNA, 12 nt, Human
gcauuccagccc

SEQ ID NO: 1318040 - RNA, 15 nt, Human
gcauuccagccccuc

SEQ ID NO: 1318041 - RNA, 16 nt, Human
gcauuccagccccucu

SEQ ID NO: 1318042 - RNA, 19 nt, Human
gcauuccagccccucuggu

SEQ ID NO: 1318043 - RNA, 12 nt, Human
gcauucccaggu

SEQ ID NO: 1318044 - RNA, 13 nt, Human
gcauucccaggua

SEQ ID NO: 1318045 - RNA, 22 nt, Human
gcauguuuagacuuuaacauaa

SEQ ID NO: 1318046 - RNA, 16 nt, Human
gcauguuuagacuuua

SEQ ID NO: 1318047 - RNA, 14 nt, Human
gcauuacugcaugc

SEQ ID NO: 1318048 - RNA, 17 nt, Human
gcauuacugcaugcacu

SEQ ID NO: 1318049 - RNA, 15 nt, Human
gcauuagaauuauuu

SEQ ID NO: 1318050 - RNA, 23 nt, Human
gcauggaaauucccuucaucugg

SEQ ID NO: 1318051 - RNA, 11 nt, Human
gcauggaaauu

SEQ ID NO: 1318052 - RNA, 17 nt, Human
gcauggaaauuuaaagc

SEQ ID NO: 1318053 - RNA, 19 nt, Human
gcauggaaauuuaaagcag

SEQ ID NO: 1318054 - RNA, 23 nt, Human
gcauggaaauuuaaagcagguuc

SEQ ID NO: 1318055 - RNA, 21 nt, Human
gcauggaaggcaagauugugu

SEQ ID NO: 1318056 - RNA, 16 nt, Human
gcauggaacacuucga

SEQ ID NO: 1318057 - RNA, 14 nt, Human
gcauggacaaugga

SEQ ID NO: 1318058 - RNA, 18 nt, Human
gcauggacaauggaccgg

SEQ ID NO: 1318059 - RNA, 21 nt, Human
gcauggacaauggaccggaga

SEQ ID NO: 1318060 - RNA, 17 nt, Human
gcauguugucuaagaaa

SEQ ID NO: 1318061 - RNA, 15 nt, Human
gcaugccuucaaauc

SEQ ID NO: 1318062 - RNA, 20 nt, Human
gcaugcccagagacccagcg

SEQ ID NO: 1318063 - RNA, 17 nt, Human
gcaugcuggugagccaa

SEQ ID NO: 1318064 - RNA, 17 nt, Human
gcaugaauuugugaagg

SEQ ID NO: 1318065 - RNA, 15 nt, Human
gcaugaauuuguaau

SEQ ID NO: 1318066 - RNA, 22 nt, Human
gcaugaauuuguaaugucuuga

SEQ ID NO: 1318067 - RNA, 16 nt, Human
gcaugcacuguucccc

SEQ ID NO: 1318068 - RNA, 17 nt, Human
gcaugcacuguuccccc

SEQ ID NO: 1318069 - RNA, 21 nt, Human
gcaugcacuguucccccugug

SEQ ID NO: 1318070 - RNA, 22 nt, Human
gcaugcacuguucccccugugc

SEQ ID NO: 1318071 - RNA, 23 nt, Human
gcaugcacuguucccccugugca

SEQ ID NO: 1318072 - RNA, 12 nt, Human
gcaugcaguguu

SEQ ID NO: 1318073 - RNA, 12 nt, Human
gcaugcccagag

SEQ ID NO: 1318074 - RNA, 18 nt, Human
gcaugcccagagacccag

SEQ ID NO: 1318075 - RNA, 19 nt, Human
gcaugcccagagacccagc

SEQ ID NO: 1318076 - RNA, 15 nt, Human
gcaugaauuugugaa

SEQ ID NO: 1318077 - RNA, 17 nt, Human
gcauuuuacuguacaga

SEQ ID NO: 1318078 - RNA, 16 nt, Human
gcauuuuacuguacag

SEQ ID NO: 1318079 - RNA, 15 nt, Human
gcauuuggguccagg

SEQ ID NO: 1318080 - RNA, 16 nt, Human
gcauuuggguccagga

SEQ ID NO: 1318081 - RNA, 17 nt, Human
gcauuuggguccaggag

SEQ ID NO: 1318082 - RNA, 18 nt, Human
gcauuuggguccaggagg

SEQ ID NO: 1318083 - RNA, 17 nt, Human
gcauuuguuuuguuuac

SEQ ID NO: 1318084 - RNA, 19 nt, Human
gcauuggaacuggaggcag

SEQ ID NO: 1318085 - RNA, 16 nt, Human
gcauuggaacuggagg

SEQ ID NO: 1318086 - RNA, 12 nt, Human
gcauuggauauu

SEQ ID NO: 1318087 - RNA, 18 nt, Human
gcauuggauauuuuuuac

SEQ ID NO: 1318088 - RNA, 21 nt, Human
gcauucccagguaggccaagg

SEQ ID NO: 1318089 - RNA, 20 nt, Human
gcauucccagguaggccaag

SEQ ID NO: 1318090 - RNA, 13 nt, Human
gcauucucacucc

SEQ ID NO: 1318091 - RNA, 15 nt, Human
gcauucucacuccua

SEQ ID NO: 1318092 - RNA, 13 nt, Human
gcauucuaguacu

SEQ ID NO: 1318093 - RNA, 18 nt, Human
gcauucucacuccuaccu

SEQ ID NO: 1318094 - RNA, 18 nt, Human
gcauucucauuggaaauu

SEQ ID NO: 1318095 - RNA, 20 nt, Human
gcauucucauuggaaauuua

SEQ ID NO: 1318096 - RNA, 14 nt, Human
gcauugccaagggc

SEQ ID NO: 1318097 - RNA, 16 nt, Human
gcauugccaagggcuu

SEQ ID NO: 1318098 - RNA, 22 nt, Human
gcauuuuggagaguuuccugaa

SEQ ID NO: 1318099 - RNA, 23 nt, Human
gcauuuuggagaguuuccugaaa

SEQ ID NO: 1318100 - RNA, 18 nt, Human
gcauuuucugcaucucca

SEQ ID NO: 1318101 - RNA, 17 nt, Human
gcauuuucugcaucucc

SEQ ID NO: 1318102 - RNA, 22 nt, Human
gcauuuuguaaguugaagcaaa

SEQ ID NO: 1318103 - RNA, 12 nt, Human
gcauuuuguaau

SEQ ID NO: 1318104 - RNA, 23 nt, Human
gccaaaacaauguuuaaaccuuu

SEQ ID NO: 1318105 - RNA, 23 nt, Human
gccaaacaaaaagguucucaggu

SEQ ID NO: 1318106 - RNA, 18 nt, Human
gccaaaccaggacccugu

SEQ ID NO: 1318107 - RNA, 21 nt, Human
gccaaaccaggacccugucca

SEQ ID NO: 1318108 - RNA, 21 nt, Human
gccaaagaaccaaagaagaaa

SEQ ID NO: 1318109 - RNA, 19 nt, Human
gaguguuccccuuccacug

SEQ ID NO: 1318110 - RNA, 13 nt, Human
gaguguucccuau

SEQ ID NO: 1318111 - RNA, 21 nt, Human
gaguucagaguccuuaaaaug

SEQ ID NO: 1318112 - RNA, 13 nt, Human
gacuucccugugu

SEQ ID NO: 1318113 - RNA, 18 nt, Human
gacuuccuguccagcucc

SEQ ID NO: 1318114 - RNA, 19 nt, Human
gacuuccuguccagcucca

SEQ ID NO: 1318115 - RNA, 20 nt, Human
gacuuccuguccagcuccaa

SEQ ID NO: 1318116 - RNA, 21 nt, Human
gacuuccuguccagcuccaac

SEQ ID NO: 1318117 - RNA, 22 nt, Human
gacuuccuguccagcuccaacc

SEQ ID NO: 1318118 - RNA, 18 nt, Human
gacuucccacggcuccuc

SEQ ID NO: 1318119 - RNA, 12 nt, Human
gacuucauccca

SEQ ID NO: 1318120 - RNA, 12 nt, Human
gacuucccagcu

SEQ ID NO: 1318121 - RNA, 13 nt, Human
gacuucccagcua

SEQ ID NO: 1318122 - RNA, 18 nt, Human
gacuucccagcuaggaag

SEQ ID NO: 1318123 - RNA, 24 nt, Human
gacuucaucucccaccuagcagca

SEQ ID NO: 1318124 - RNA, 16 nt, Human
gauaaccuugaaaaaa

SEQ ID NO: 1318125 - RNA, 13 nt, Human
gauaaaagauggc

SEQ ID NO: 1318126 - RNA, 16 nt, Human
gaguucucccuguaca

SEQ ID NO: 1318127 - RNA, 22 nt, Human
gaguucucccuguacaguguua

SEQ ID NO: 1318128 - RNA, 13 nt, Human
gauaaacaguagu

SEQ ID NO: 1318129 - RNA, 16 nt, Human
gauaaaagauggccau

SEQ ID NO: 1318130 - RNA, 14 nt, Human
gauaaacacaagau

SEQ ID NO: 1318131 - RNA, 15 nt, Human
gauaaacacaagauu

SEQ ID NO: 1318132 - RNA, 22 nt, Human
gauaaacacaagauugguguuu

SEQ ID NO: 1318133 - RNA, 14 nt, Human
gauaaagagacagu

SEQ ID NO: 1318134 - RNA, 23 nt, Human
gaucaccgacugaaaauauuguu

SEQ ID NO: 1318135 - RNA, 16 nt, Human
gaucacauguggacuu

SEQ ID NO: 1318136 - RNA, 16 nt, Human
gauaucaugcaaauuu

SEQ ID NO: 1318137 - RNA, 20 nt, Human
gauauaucaugagugaauaa

SEQ ID NO: 1318138 - RNA, 23 nt, Human
gauaucgacuuguuuuugcacau

SEQ ID NO: 1318139 - RNA, 13 nt, Human
gauaucucaucuc

SEQ ID NO: 1318140 - RNA, 14 nt, Human
gauaucucaucucu

SEQ ID NO: 1318141 - RNA, 17 nt, Human
gaucaggaagagaagga

SEQ ID NO: 1318142 - RNA, 18 nt, Human
gaucaggaagagaaggag

SEQ ID NO: 1318143 - RNA, 16 nt, Human
gaucaggaagagaagg

SEQ ID NO: 1318144 - RNA, 15 nt, Human
gaucaggaagagaag

SEQ ID NO: 1318145 - RNA, 12 nt, Human
gaucaggaagag

SEQ ID NO: 1318146 - RNA, 23 nt, Human
gaucagcuuauugucuagugaaa

SEQ ID NO: 1318147 - RNA, 13 nt, Human
gaucagcguggcc

SEQ ID NO: 1318148 - RNA, 15 nt, Human
gaucagcguggccuu

SEQ ID NO: 1318149 - RNA, 16 nt, Human
gaucagcguggccuug

SEQ ID NO: 1318150 - RNA, 17 nt, Human
gaucagcguggccuugu

SEQ ID NO: 1318151 - RNA, 17 nt, Human
gauaggucagugcaaau

SEQ ID NO: 1318152 - RNA, 13 nt, Human
gauaggccagccg

SEQ ID NO: 1318153 - RNA, 19 nt, Human
gauaggaagaaagaagaca

SEQ ID NO: 1318154 - RNA, 18 nt, Human
gauaauucuagcuuugag

SEQ ID NO: 1318155 - RNA, 18 nt, Human
gauaauuuuaaauucucu

SEQ ID NO: 1318156 - RNA, 12 nt, Human
gauaauuuuaaa

SEQ ID NO: 1318157 - RNA, 12 nt, Human
gauaauagauuc

SEQ ID NO: 1318158 - RNA, 13 nt, Human
gauaauagauucu

SEQ ID NO: 1318159 - RNA, 14 nt, Human
gauaauagauucuc

SEQ ID NO: 1318160 - RNA, 14 nt, Human
gauaauuauaauau

SEQ ID NO: 1318161 - RNA, 14 nt, Human
gauaguuuucaucc

SEQ ID NO: 1318162 - RNA, 22 nt, Human
gauaguuuucauccauaacuga

SEQ ID NO: 1318163 - RNA, 23 nt, Human
gauaguuuucauccauaacugaa

SEQ ID NO: 1318164 - RNA, 21 nt, Human
gauauaucaugagugaauaaa

SEQ ID NO: 1318165 - RNA, 19 nt, Human
gauauaguuuuacuuuuaa

SEQ ID NO: 1318166 - RNA, 21 nt, Human
gauauaguuuuacuuuuaaac

SEQ ID NO: 1318167 - RNA, 24 nt, Human
gauauaguuuuacuuuuaaacugu

SEQ ID NO: 1318168 - RNA, 15 nt, Human
gauauauaaguguac

SEQ ID NO: 1318169 - RNA, 17 nt, Human
gauauauaaguguacau

SEQ ID NO: 1318170 - RNA, 18 nt, Human
gaugcaguucugaagaag

SEQ ID NO: 1318171 - RNA, 15 nt, Human
gaugcacuucaaauu

SEQ ID NO: 1318172 - RNA, 22 nt, Human
gaugcacuucaaauucaaauaa

SEQ ID NO: 1318173 - RNA, 21 nt, Human
gaugcacuuugcuuuaauaua

SEQ ID NO: 1318174 - RNA, 23 nt, Human
gaugcacuuugcuuuaauauaaa

SEQ ID NO: 1318175 - RNA, 22 nt, Human
gaugcacuuugcuuuaauauaa

SEQ ID NO: 1318176 - RNA, 14 nt, Human
gaugcagcucaaga

SEQ ID NO: 1318177 - RNA, 15 nt, Human
gaugcagcuuauacg

SEQ ID NO: 1318178 - RNA, 14 nt, Human
gaugcagcuuauac

SEQ ID NO: 1318179 - RNA, 14 nt, Human
gaugcagggcaguc

SEQ ID NO: 1318180 - RNA, 15 nt, Human
gaugcagggcaguca

SEQ ID NO: 1318181 - RNA, 15 nt, Human
gaucuguccucagcc

SEQ ID NO: 1318182 - RNA, 16 nt, Human
gaucuguccucagccu

SEQ ID NO: 1318183 - RNA, 17 nt, Human
gaucuguccucagccuu

SEQ ID NO: 1318184 - RNA, 18 nt, Human
gaucuguccucagccuug

SEQ ID NO: 1318185 - RNA, 14 nt, Human
gaucuguccucagc

SEQ ID NO: 1318186 - RNA, 13 nt, Human
gaucugucugugg

SEQ ID NO: 1318187 - RNA, 16 nt, Human
gaugaaauguaaauac

SEQ ID NO: 1318188 - RNA, 17 nt, Human
gaugaaauuccauuugu

SEQ ID NO: 1318189 - RNA, 22 nt, Human
gaugaaguuuuacauuguugag

SEQ ID NO: 1318190 - RNA, 23 nt, Human
gaugaaguuuuacauuguugagc

SEQ ID NO: 1318191 - RNA, 13 nt, Human
gaugaaugagaau

SEQ ID NO: 1318192 - RNA, 15 nt, Human
gaugaaugccgugga

SEQ ID NO: 1318193 - RNA, 16 nt, Human
gaugaaugccguggau

SEQ ID NO: 1318194 - RNA, 14 nt, Human
gaugaccacuuuuu

SEQ ID NO: 1318195 - RNA, 15 nt, Human
gaugacccuuuucau

SEQ ID NO: 1318196 - RNA, 17 nt, Human
gaugacccuuuucauga

SEQ ID NO: 1318197 - RNA, 20 nt, Human
gaucuacuucuguaauugug

SEQ ID NO: 1318198 - RNA, 14 nt, Human
gauccuggaaauca

SEQ ID NO: 1318199 - RNA, 12 nt, Human
gauccuggaggc

SEQ ID NO: 1318200 - RNA, 15 nt, Human
gauccuggaggccca

SEQ ID NO: 1318201 - RNA, 16 nt, Human
gauccuggaggcccag

SEQ ID NO: 1318202 - RNA, 17 nt, Human
gauccuggaggcccagu

SEQ ID NO: 1318203 - RNA, 20 nt, Human
gauccuguauucagacagau

SEQ ID NO: 1318204 - RNA, 19 nt, Human
gauccuguguggagaggga

SEQ ID NO: 1318205 - RNA, 22 nt, Human
gauccuccugcagaccacgccc

SEQ ID NO: 1318206 - RNA, 16 nt, Human
gauccucccaggcuuc

SEQ ID NO: 1318207 - RNA, 12 nt, Human
gauccuccucau

SEQ ID NO: 1318208 - RNA, 15 nt, Human
gauccuccugcagac

SEQ ID NO: 1318209 - RNA, 16 nt, Human
gauccuccugcagacc

SEQ ID NO: 1318210 - RNA, 21 nt, Human
gauccuccugcagaccacgcc

SEQ ID NO: 1318211 - RNA, 23 nt, Human
gauccuaaugaaugcauaaaaug

SEQ ID NO: 1318212 - RNA, 15 nt, Human
gauccuagauccuaa

SEQ ID NO: 1318213 - RNA, 14 nt, Human
gauccgacugcuuu

SEQ ID NO: 1318214 - RNA, 17 nt, Human
gauccgacugcuuugga

SEQ ID NO: 1318215 - RNA, 18 nt, Human
gauccgacugcuuuggac

SEQ ID NO: 1318216 - RNA, 20 nt, Human
gauccgacugcuuuggaccu

SEQ ID NO: 1318217 - RNA, 14 nt, Human
gauccggaaagaag

SEQ ID NO: 1318218 - RNA, 16 nt, Human
gauccuaagcaucuaa

SEQ ID NO: 1318219 - RNA, 19 nt, Human
gauccuaagcaucuaaguu

SEQ ID NO: 1318220 - RNA, 13 nt, Human
gaucauaaggcuu

SEQ ID NO: 1318221 - RNA, 17 nt, Human
gaucauaaggcuucaaa

SEQ ID NO: 1318222 - RNA, 14 nt, Human
gaucccucaucugu

SEQ ID NO: 1318223 - RNA, 18 nt, Human
gaucccucaucugucccu

SEQ ID NO: 1318224 - RNA, 13 nt, Human
gaucccucccccc

SEQ ID NO: 1318225 - RNA, 19 nt, Human
gaucccucccccccaugca

SEQ ID NO: 1318226 - RNA, 21 nt, Human
gaucccucccccccaugcacu

SEQ ID NO: 1318227 - RNA, 23 nt, Human
gaucccucccccccaugcacugu

SEQ ID NO: 1318228 - RNA, 23 nt, Human
gaucccucuacagagcuucccug

SEQ ID NO: 1318229 - RNA, 14 nt, Human
gaucccuguguugu

SEQ ID NO: 1318230 - RNA, 18 nt, Human
gaucccuguguugucucu

SEQ ID NO: 1318231 - RNA, 19 nt, Human
gaucccuguguugucucua

SEQ ID NO: 1318232 - RNA, 20 nt, Human
gaucccuguguugucucuag

SEQ ID NO: 1318233 - RNA, 21 nt, Human
gaucccuguguugucucuaga

SEQ ID NO: 1318234 - RNA, 24 nt, Human
gaucccuguguugucucuagagca

SEQ ID NO: 1318235 - RNA, 16 nt, Human
gauugggaauccgccc

SEQ ID NO: 1318236 - RNA, 16 nt, Human
gauuguuacagaagcu

SEQ ID NO: 1318237 - RNA, 15 nt, Human
gauuguuccugcuuu

SEQ ID NO: 1318238 - RNA, 11 nt, Human
gauuguuugca

SEQ ID NO: 1318239 - RNA, 16 nt, Human
gauuuaaaagccugcu

SEQ ID NO: 1318240 - RNA, 18 nt, Human
gauuuaaaagccugcuca

SEQ ID NO: 1318241 - RNA, 20 nt, Human
gauuucauguacugcauuau

SEQ ID NO: 1318242 - RNA, 19 nt, Human
gauuucauguacugcauua

SEQ ID NO: 1318243 - RNA, 20 nt, Human
gauuucauuucaacuguuug

SEQ ID NO: 1318244 - RNA, 16 nt, Human
gauuucauguacugca

SEQ ID NO: 1318245 - RNA, 13 nt, Human
gauuucauguacu

SEQ ID NO: 1318246 - RNA, 12 nt, Human
gauuucauguac

SEQ ID NO: 1318247 - RNA, 13 nt, Human
gauuucaugauuu

SEQ ID NO: 1318248 - RNA, 16 nt, Human
gauuucaugcuaucuc

SEQ ID NO: 1318249 - RNA, 18 nt, Human
gauuucaugcuaucucug

SEQ ID NO: 1318250 - RNA, 20 nt, Human
gauuucaugcuaucucugug

SEQ ID NO: 1318251 - RNA, 21 nt, Human
gauuucauguacugcauuauu

SEQ ID NO: 1318252 - RNA, 21 nt, Human
gauuucauuucaacuguuugc

SEQ ID NO: 1318253 - RNA, 17 nt, Human
gauuucuuugaaaaaaa

SEQ ID NO: 1318254 - RNA, 14 nt, Human
gauuucuuugaaaa

SEQ ID NO: 1318255 - RNA, 18 nt, Human
gauuugaagaacauguga

SEQ ID NO: 1318256 - RNA, 16 nt, Human
gauuuguuuuuaaacu

SEQ ID NO: 1318257 - RNA, 16 nt, Human
gauugcugccccauca

SEQ ID NO: 1318258 - RNA, 20 nt, Human
gauugcugccccaucagugc

SEQ ID NO: 1318259 - RNA, 11 nt, Human
gauuggccugu

SEQ ID NO: 1318260 - RNA, 16 nt, Human
gauuggccuguagagu

SEQ ID NO: 1318261 - RNA, 23 nt, Human
gauuggccuguagaguugcugag

SEQ ID NO: 1318262 - RNA, 20 nt, Human
gauuggccuguagaguugcu

SEQ ID NO: 1318263 - RNA, 21 nt, Human
gauugcugccccaucagugcu

SEQ ID NO: 1318264 - RNA, 22 nt, Human
gauuaaguaaugauaacuggaa

SEQ ID NO: 1318265 - RNA, 14 nt, Human
gauuaaguaaugau

SEQ ID NO: 1318266 - RNA, 18 nt, Human
gauguucuggauaccauu

SEQ ID NO: 1318267 - RNA, 19 nt, Human
gauguuuauucuucuagag

SEQ ID NO: 1318268 - RNA, 21 nt, Human
gauguuuauucuucuagaguu

SEQ ID NO: 1318269 - RNA, 23 nt, Human
gauguuuauucuucuagaguuca

SEQ ID NO: 1318270 - RNA, 20 nt, Human
gaugccugugaacugaacuc

SEQ ID NO: 1318271 - RNA, 22 nt, Human
gaugcagugccaggaacccuua

SEQ ID NO: 1318272 - RNA, 16 nt, Human
gaugcuagaacucccu

SEQ ID NO: 1318273 - RNA, 22 nt, Human
gauguucuauuuuuuguuuugu

SEQ ID NO: 1318274 - RNA, 13 nt, Human
gauguucuaaggc

SEQ ID NO: 1318275 - RNA, 13 nt, Human
gaugcuaaaaccu

SEQ ID NO: 1318276 - RNA, 14 nt, Human
gaugcuaaaaccug

SEQ ID NO: 1318277 - RNA, 23 nt, Human
gaugcuaagagaaaaaaaagacu

SEQ ID NO: 1318278 - RNA, 14 nt, Human
gauguucuaaggcu

SEQ ID NO: 1318279 - RNA, 16 nt, Human
gauguucuaaggcucu

SEQ ID NO: 1318280 - RNA, 18 nt, Human
gauguucuaaggcucuga

SEQ ID NO: 1318281 - RNA, 19 nt, Human
gauguucuaaggcucugag

SEQ ID NO: 1318282 - RNA, 19 nt, Human
gauguucuaagucuuucca

SEQ ID NO: 1318283 - RNA, 20 nt, Human
gauguucuaaggcucugaga

SEQ ID NO: 1318284 - RNA, 16 nt, Human
gauuacaaaucagaag

SEQ ID NO: 1318285 - RNA, 17 nt, Human
gauuacaaaucagaagu

SEQ ID NO: 1318286 - RNA, 19 nt, Human
gauuacaaaucagaaguca

SEQ ID NO: 1318287 - RNA, 20 nt, Human
gauuacaaaucagaagucau

SEQ ID NO: 1318288 - RNA, 21 nt, Human
gauuacaaaucagaagucauc

SEQ ID NO: 1318289 - RNA, 23 nt, Human
gauuacaaaucagaagucaucuu

SEQ ID NO: 1318290 - RNA, 18 nt, Human
gauuccaaagaguagaau

SEQ ID NO: 1318291 - RNA, 19 nt, Human
gauuccaaagaguagaauu

SEQ ID NO: 1318292 - RNA, 23 nt, Human
gauuccaaagaguagaauugcau

SEQ ID NO: 1318293 - RNA, 21 nt, Human
gauucaugccaauuagcaauu

SEQ ID NO: 1318294 - RNA, 19 nt, Human
gauucauuuuaacaucuga

SEQ ID NO: 1318295 - RNA, 17 nt, Human
gauucaggaaaaggccu

SEQ ID NO: 1318296 - RNA, 18 nt, Human
gauucaggaaaaggccug

SEQ ID NO: 1318297 - RNA, 19 nt, Human
gauucaggaaaaggccugg

SEQ ID NO: 1318298 - RNA, 20 nt, Human
gauucaggaaaaggccuggg

SEQ ID NO: 1318299 - RNA, 21 nt, Human
gauucaggaaaaggccugggg

SEQ ID NO: 1318300 - RNA, 22 nt, Human
gauucaggaaaaggccuggggu

SEQ ID NO: 1318301 - RNA, 23 nt, Human
gauucaggaaaaggccuggggug

SEQ ID NO: 1318302 - RNA, 22 nt, Human
gauucagggaaagugggacagc

SEQ ID NO: 1318303 - RNA, 20 nt, Human
gauucaguguuaaaugugau

SEQ ID NO: 1318304 - RNA, 15 nt, Human
gauucaguuuucauu

SEQ ID NO: 1318305 - RNA, 22 nt, Human
gauucaguuuucauuugguuca

SEQ ID NO: 1318306 - RNA, 16 nt, Human
gauucauaguaacuuc

SEQ ID NO: 1318307 - RNA, 15 nt, Human
gauucagggaaagug

SEQ ID NO: 1318308 - RNA, 23 nt, Human
gcaauccucccacuucagccucc

SEQ ID NO: 1318309 - RNA, 20 nt, Human
gcaauccucccacuucagcc

SEQ ID NO: 1318310 - RNA, 18 nt, Human
gcaagguccggcccaucc

SEQ ID NO: 1318311 - RNA, 22 nt, Human
gcaaucugacccuaugggucua

SEQ ID NO: 1318312 - RNA, 14 nt, Human
gcaaugaacacuua

SEQ ID NO: 1318313 - RNA, 21 nt, Human
gcaagggaauuucuucaacuc

SEQ ID NO: 1318314 - RNA, 17 nt, Human
gcaagcauucagaagaa

SEQ ID NO: 1318315 - RNA, 18 nt, Human
gcaagcauucagaagaaa

SEQ ID NO: 1318316 - RNA, 17 nt, Human
gcaagcugauuaaauga

SEQ ID NO: 1318317 - RNA, 19 nt, Human
gcaagcugauuaaaugaca

SEQ ID NO: 1318318 - RNA, 17 nt, Human
gcaagcuggcggcuggg

SEQ ID NO: 1318319 - RNA, 23 nt, Human
gcaagcuuaauggcugauaauuu

SEQ ID NO: 1318320 - RNA, 16 nt, Human
gcaaggaaaaacaggu

SEQ ID NO: 1318321 - RNA, 23 nt, Human
gcaagauggggagugagaggcug

SEQ ID NO: 1318322 - RNA, 14 nt, Human
gcaagauugugucc

SEQ ID NO: 1318323 - RNA, 22 nt, Human
gcaacuuuguauaaaagggacu

SEQ ID NO: 1318324 - RNA, 21 nt, Human
gcaacuuguccuagcacagau

SEQ ID NO: 1318325 - RNA, 19 nt, Human
gcaacuuguccuagcacag

SEQ ID NO: 1318326 - RNA, 20 nt, Human
gcaacuuguccuagcacaga

SEQ ID NO: 1318327 - RNA, 22 nt, Human
gcaacuuguccuagcacagaug

SEQ ID NO: 1318328 - RNA, 18 nt, Human
gcaagcaagaaacacugg

SEQ ID NO: 1318329 - RNA, 14 nt, Human
gcaagcaagaggcc

SEQ ID NO: 1318330 - RNA, 15 nt, Human
gcaagcaagaggccg

SEQ ID NO: 1318331 - RNA, 15 nt, Human
gcaagcacagcccuu

SEQ ID NO: 1318332 - RNA, 23 nt, Human
gcaagcaagaggccguggcugcu

SEQ ID NO: 1318333 - RNA, 18 nt, Human
gcaaacuuuauuuugugu

SEQ ID NO: 1318334 - RNA, 22 nt, Human
gcaaacugcaugcccagagacc

SEQ ID NO: 1318335 - RNA, 19 nt, Human
gcaaacugcaugcccagag

SEQ ID NO: 1318336 - RNA, 17 nt, Human
gcaaacugggaaccccu

SEQ ID NO: 1318337 - RNA, 23 nt, Human
gcaaacugggaaccccuuuccca

SEQ ID NO: 1318338 - RNA, 10 nt, Human
gcaaacucuu

SEQ ID NO: 1318339 - RNA, 20 nt, Human
gcaaacucuuuggucguuuu

SEQ ID NO: 1318340 - RNA, 22 nt, Human
gcaaacucuuuggucguuuuuu

SEQ ID NO: 1318341 - RNA, 23 nt, Human
gcaaacucuuuggucguuuuuuu

SEQ ID NO: 1318342 - RNA, 13 nt, Human
gcaaacugcaugc

SEQ ID NO: 1318343 - RNA, 14 nt, Human
gcaaacugcaugcc

SEQ ID NO: 1318344 - RNA, 15 nt, Human
gcaaacugcaugccc

SEQ ID NO: 1318345 - RNA, 16 nt, Human
gcaaacugcaugccca

SEQ ID NO: 1318346 - RNA, 19 nt, Human
gcaaacccaucaacaaaaa

SEQ ID NO: 1318347 - RNA, 19 nt, Human
gcaaaccugaccccugcuc

SEQ ID NO: 1318348 - RNA, 21 nt, Human
gcaaaccugaccccugcucag

SEQ ID NO: 1318349 - RNA, 18 nt, Human
gauuuguuuuuaaacugu

SEQ ID NO: 1318350 - RNA, 21 nt, Human
gauuuguuuuuaaacuguaca

SEQ ID NO: 1318351 - RNA, 23 nt, Human
gauuuguuuuuaaacuguacagu

SEQ ID NO: 1318352 - RNA, 22 nt, Human
gauuuguuuuuaaacuguacag

SEQ ID NO: 1318353 - RNA, 20 nt, Human
gcaaacuuuauuuuguguuu

SEQ ID NO: 1318354 - RNA, 20 nt, Human
gcaaacugggaaccccuuuc

SEQ ID NO: 1318355 - RNA, 22 nt, Human
gcaaacugggaaccccuuuccc

SEQ ID NO: 1318356 - RNA, 14 nt, Human
gcaaagaauugacu

SEQ ID NO: 1318357 - RNA, 21 nt, Human
gcaaagacuauucccuucuaa

SEQ ID NO: 1318358 - RNA, 22 nt, Human
gcaaagacuauucccuucuaac

SEQ ID NO: 1318359 - RNA, 14 nt, Human
gcaaagagagauuu

SEQ ID NO: 1318360 - RNA, 23 nt, Human
gcaaaguucccuacuuccuguga

SEQ ID NO: 1318361 - RNA, 12 nt, Human
gcaaauaaaagu

SEQ ID NO: 1318362 - RNA, 19 nt, Human
gcaaauaacaaaugccaaa

SEQ ID NO: 1318363 - RNA, 17 nt, Human
gcaaauaacaaaugcca

SEQ ID NO: 1318364 - RNA, 15 nt, Human
gcaaagugguucccu

SEQ ID NO: 1318365 - RNA, 23 nt, Human
gcaaaugugaaucauuuuaccuu

SEQ ID NO: 1318366 - RNA, 18 nt, Human
gcaaaugucaugcugccu

SEQ ID NO: 1318367 - RNA, 19 nt, Human
gcaaaugucaugcugccuu

SEQ ID NO: 1318368 - RNA, 23 nt, Human
gcaaauguaguauggccuguguc

SEQ ID NO: 1318369 - RNA, 12 nt, Human
gcaaaugugaau

SEQ ID NO: 1318370 - RNA, 12 nt, Human
gcaaaucuugaa

SEQ ID NO: 1318371 - RNA, 14 nt, Human
gcaaauggccucau

SEQ ID NO: 1318372 - RNA, 15 nt, Human
gcaacucuugauuau

SEQ ID NO: 1318373 - RNA, 20 nt, Human
gcaaaugucaugcugccuua

SEQ ID NO: 1318374 - RNA, 16 nt, Human
gaagagaucaggaaga

SEQ ID NO: 1318375 - RNA, 17 nt, Human
gaagagaucaggaagag

SEQ ID NO: 1318376 - RNA, 18 nt, Human
gaagagauuuuucaugau

SEQ ID NO: 1318377 - RNA, 15 nt, Human
gaagagauuuuucau

SEQ ID NO: 1318378 - RNA, 20 nt, Human
gaagagagccugcaggaucu

SEQ ID NO: 1318379 - RNA, 14 nt, Human
gaagagcagcaccu

SEQ ID NO: 1318380 - RNA, 18 nt, Human
gaagagcagcaccuccuc

SEQ ID NO: 1318381 - RNA, 12 nt, Human
gaagagcagccc

SEQ ID NO: 1318382 - RNA, 23 nt, Human
gaagagcagcaccuccucagccu

SEQ ID NO: 1318383 - RNA, 18 nt, Human
gaagagcaggacuccagg

SEQ ID NO: 1318384 - RNA, 22 nt, Human
gaagagcaggacuccaggccca

SEQ ID NO: 1318385 - RNA, 23 nt, Human
gaagagcaggacuccaggcccaa

SEQ ID NO: 1318386 - RNA, 18 nt, Human
gaagaggaggggaagagg

SEQ ID NO: 1318387 - RNA, 20 nt, Human
gaagaggccuguuuggccuc

SEQ ID NO: 1318388 - RNA, 15 nt, Human
gaagagaaggagcag

SEQ ID NO: 1318389 - RNA, 15 nt, Human
gaagagacagcccag

SEQ ID NO: 1318390 - RNA, 14 nt, Human
gaagagaaggagca

SEQ ID NO: 1318391 - RNA, 13 nt, Human
gaagagaaggagc

SEQ ID NO: 1318392 - RNA, 12 nt, Human
gaagagaaggag

SEQ ID NO: 1318393 - RNA, 20 nt, Human
gaagacuuacagcaaauccu

SEQ ID NO: 1318394 - RNA, 21 nt, Human
gaagacuuacagcaaauccuu

SEQ ID NO: 1318395 - RNA, 12 nt, Human
gaagaacugaaa

SEQ ID NO: 1318396 - RNA, 19 nt, Human
gaagacugcauuauauuua

SEQ ID NO: 1318397 - RNA, 13 nt, Human
gaagaacugcagg

SEQ ID NO: 1318398 - RNA, 14 nt, Human
gaagaacugcaggc

SEQ ID NO: 1318399 - RNA, 15 nt, Human
gaagaacugcaggcc

SEQ ID NO: 1318400 - RNA, 19 nt, Human
gaagaacugcaggcccugg

SEQ ID NO: 1318401 - RNA, 15 nt, Human
gaagacuggaagcua

SEQ ID NO: 1318402 - RNA, 16 nt, Human
gaagacuggaagcuaa

SEQ ID NO: 1318403 - RNA, 17 nt, Human
gaagacuggaagcuaau

SEQ ID NO: 1318404 - RNA, 19 nt, Human
gaacuuugcugagccugua

SEQ ID NO: 1318405 - RNA, 22 nt, Human
gaacucaucuagguaaauuaca

SEQ ID NO: 1318406 - RNA, 16 nt, Human
gaacuuuuuauugauu

SEQ ID NO: 1318407 - RNA, 19 nt, Human
gaagaaaaaaaaaaauuca

SEQ ID NO: 1318408 - RNA, 13 nt, Human
gaagaaaaacuca

SEQ ID NO: 1318409 - RNA, 13 nt, Human
gaagaaaaagaag

SEQ ID NO: 1318410 - RNA, 19 nt, Human
gaagaaccaguccccccac

SEQ ID NO: 1318411 - RNA, 22 nt, Human
gaagaaccaguccccccacccu

SEQ ID NO: 1318412 - RNA, 20 nt, Human
gaacucaucuagguaaauua

SEQ ID NO: 1318413 - RNA, 21 nt, Human
gaacucaucuagguaaauuac

SEQ ID NO: 1318414 - RNA, 15 nt, Human
gaagauacugaaaua

SEQ ID NO: 1318415 - RNA, 23 nt, Human
gaagaguaagucaaccugccuga

SEQ ID NO: 1318416 - RNA, 16 nt, Human
gaagauagcugugacu

SEQ ID NO: 1318417 - RNA, 18 nt, Human
gaagauguagaggagaaa

SEQ ID NO: 1318418 - RNA, 20 nt, Human
gaagagguuuuaaagcuucc

SEQ ID NO: 1318419 - RNA, 21 nt, Human
gaagauaaacguggauguuac

SEQ ID NO: 1318420 - RNA, 16 nt, Human
gaagcauucucauugg

SEQ ID NO: 1318421 - RNA, 21 nt, Human
gaagcauucucauuggaaauu

SEQ ID NO: 1318422 - RNA, 18 nt, Human
gaagcauucucauuggaa

SEQ ID NO: 1318423 - RNA, 13 nt, Human
gaagcauuguaaa

SEQ ID NO: 1318424 - RNA, 17 nt, Human
gaagcauuguaaaauaa

SEQ ID NO: 1318425 - RNA, 20 nt, Human
gaagcauuguaaaauaauuc

SEQ ID NO: 1318426 - RNA, 18 nt, Human
gaagccaauucagacagg

SEQ ID NO: 1318427 - RNA, 20 nt, Human
gaagccaauucagacaggca

SEQ ID NO: 1318428 - RNA, 16 nt, Human
gaagcccauccugacc

SEQ ID NO: 1318429 - RNA, 17 nt, Human
gaagcccauccugacca

SEQ ID NO: 1318430 - RNA, 21 nt, Human
gaagcccauccugaccagcug

SEQ ID NO: 1318431 - RNA, 20 nt, Human
gaagcccccaccgugggcag

SEQ ID NO: 1318432 - RNA, 14 nt, Human
gaagcccccagcua

SEQ ID NO: 1318433 - RNA, 17 nt, Human
gaagcccccagcuaaga

SEQ ID NO: 1318434 - RNA, 21 nt, Human
gaagcccccagcuaagaaccu

SEQ ID NO: 1318435 - RNA, 22 nt, Human
gaagcccccagcuaagaaccug

SEQ ID NO: 1318436 - RNA, 19 nt, Human
gaagcccauccugaccagc

SEQ ID NO: 1318437 - RNA, 14 nt, Human
gaagccccugggcc

SEQ ID NO: 1318438 - RNA, 18 nt, Human
gaagccccugggcccagu

SEQ ID NO: 1318439 - RNA, 14 nt, Human
gaagcccggcuccu

SEQ ID NO: 1318440 - RNA, 15 nt, Human
gaagcccggcuccug

SEQ ID NO: 1318441 - RNA, 16 nt, Human
gaagcccggcuccugg

SEQ ID NO: 1318442 - RNA, 17 nt, Human
gaagcccggcuccuggu

SEQ ID NO: 1318443 - RNA, 18 nt, Human
gaagcccggcuccugguc

SEQ ID NO: 1318444 - RNA, 19 nt, Human
gaagcccggcuccugguca

SEQ ID NO: 1318445 - RNA, 21 nt, Human
gaagcccggcuccuggucacc

SEQ ID NO: 1318446 - RNA, 13 nt, Human
gaagcccucccag

SEQ ID NO: 1318447 - RNA, 15 nt, Human
gaagcccucccaggu

SEQ ID NO: 1318448 - RNA, 22 nt, Human
gaacauaaaaaggacaucagca

SEQ ID NO: 1318449 - RNA, 18 nt, Human
gaacauaaaaaggacauc

SEQ ID NO: 1318450 - RNA, 16 nt, Human
gaacauaaaaaggaca

SEQ ID NO: 1318451 - RNA, 14 nt, Human
gaacauaaaaagga

SEQ ID NO: 1318452 - RNA, 24 nt, Human
gaacagugugcaaggcagccgugg

SEQ ID NO: 1318453 - RNA, 17 nt, Human
gaacagugugcaaggca

SEQ ID NO: 1318454 - RNA, 21 nt, Human
gaacagugugcaaggcagccg

SEQ ID NO: 1318455 - RNA, 22 nt, Human
gaacagugugcaaggcagccgu

SEQ ID NO: 1318456 - RNA, 12 nt, Human
gaacagcuggug

SEQ ID NO: 1318457 - RNA, 14 nt, Human
gaacagcuggugua

SEQ ID NO: 1318458 - RNA, 13 nt, Human
gaacagcuggugu

SEQ ID NO: 1318459 - RNA, 22 nt, Human
gaacauaccccuuacaaaugaa

SEQ ID NO: 1318460 - RNA, 16 nt, Human
gaacauagacagaaga

SEQ ID NO: 1318461 - RNA, 12 nt, Human
gaacauauuguu

SEQ ID NO: 1318462 - RNA, 18 nt, Human
gaacauauuguugaaagg

SEQ ID NO: 1318463 - RNA, 17 nt, Human
gaacaucacauuccucu

SEQ ID NO: 1318464 - RNA, 19 nt, Human
gaacauccaaaaucuugau

SEQ ID NO: 1318465 - RNA, 21 nt, Human
gaaauuucagauucccagagc

SEQ ID NO: 1318466 - RNA, 23 nt, Human
gaaauuucagauucccagagcaa

SEQ ID NO: 1318467 - RNA, 16 nt, Human
gaacacucuuuugcuu

SEQ ID NO: 1318468 - RNA, 18 nt, Human
gaacacucuuuugcuuua

SEQ ID NO: 1318469 - RNA, 17 nt, Human
gaacagauaaucccugu

SEQ ID NO: 1318470 - RNA, 18 nt, Human
gaacagauaaucccugua

SEQ ID NO: 1318471 - RNA, 21 nt, Human
gaacagcagacucagcucuga

SEQ ID NO: 1318472 - RNA, 20 nt, Human
gaacagcagacucagcucug

SEQ ID NO: 1318473 - RNA, 20 nt, Human
gaacagugauuaccagggac

SEQ ID NO: 1318474 - RNA, 16 nt, Human
gaacagugauuaccag

SEQ ID NO: 1318475 - RNA, 16 nt, Human
gaaauuguauuacaaa

SEQ ID NO: 1318476 - RNA, 16 nt, Human
gaaaauauaaccagcc

SEQ ID NO: 1318477 - RNA, 12 nt, Human
gaaaauaaagaa

SEQ ID NO: 1318478 - RNA, 13 nt, Human
gaaaauaaagaau

SEQ ID NO: 1318479 - RNA, 16 nt, Human
gaaaauaaagaaugga

SEQ ID NO: 1318480 - RNA, 23 nt, Human
gaaaauaaaucaaugcuauaacu

SEQ ID NO: 1318481 - RNA, 15 nt, Human
gaaaauaaagaaugg

SEQ ID NO: 1318482 - RNA, 17 nt, Human
gaaaauaggcaggaagc

SEQ ID NO: 1318483 - RNA, 19 nt, Human
gaaaauaggcaggaagccc

SEQ ID NO: 1318484 - RNA, 17 nt, Human
gaaauuuauaaacuuuu

SEQ ID NO: 1318485 - RNA, 16 nt, Human
gaaauuuauaaacuuu

SEQ ID NO: 1318486 - RNA, 18 nt, Human
gaaauuguauuacaaauc

SEQ ID NO: 1318487 - RNA, 13 nt, Human
gaaauuguauauu

SEQ ID NO: 1318488 - RNA, 19 nt, Human
gaaauuguauauuguaauu

SEQ ID NO: 1318489 - RNA, 18 nt, Human
gaaauuucacauagccca

SEQ ID NO: 1318490 - RNA, 11 nt, Human
gaaauuucaga

SEQ ID NO: 1318491 - RNA, 14 nt, Human
gaacaucccuccug

SEQ ID NO: 1318492 - RNA, 12 nt, Human
gaacauuggaau

SEQ ID NO: 1318493 - RNA, 21 nt, Human
gaacauuggaauguucucaga

SEQ ID NO: 1318494 - RNA, 22 nt, Human
gaacauuggaauguucucagau

SEQ ID NO: 1318495 - RNA, 15 nt, Human
gaacauugguucuuu

SEQ ID NO: 1318496 - RNA, 12 nt, Human
gaaccucagccu

SEQ ID NO: 1318497 - RNA, 13 nt, Human
gaaccucagccug

SEQ ID NO: 1318498 - RNA, 14 nt, Human
gaaccucagccugg

SEQ ID NO: 1318499 - RNA, 15 nt, Human
gaaccucagccuggc

SEQ ID NO: 1318500 - RNA, 17 nt, Human
gaaccucagccuggcca

SEQ ID NO: 1318501 - RNA, 18 nt, Human
gaaccucagccuggccag

SEQ ID NO: 1318502 - RNA, 19 nt, Human
gaaccucagccuggccaga

SEQ ID NO: 1318503 - RNA, 21 nt, Human
gaaccucagccuggccagaca

SEQ ID NO: 1318504 - RNA, 14 nt, Human
gaacuacugaggau

SEQ ID NO: 1318505 - RNA, 20 nt, Human
gaacuaccuugguuccccca

SEQ ID NO: 1318506 - RNA, 19 nt, Human
gaacuagaauuugauuauu

SEQ ID NO: 1318507 - RNA, 21 nt, Human
gaacuaaagugcugcacucaa

SEQ ID NO: 1318508 - RNA, 19 nt, Human
gaacuaccuugguuccccc

SEQ ID NO: 1318509 - RNA, 21 nt, Human
gaacuagaguuuagcuggaaa

SEQ ID NO: 1318510 - RNA, 13 nt, Human
gaacucagaucca

SEQ ID NO: 1318511 - RNA, 14 nt, Human
gaacucagauccag

SEQ ID NO: 1318512 - RNA, 15 nt, Human
gaacucagauccagg

SEQ ID NO: 1318513 - RNA, 16 nt, Human
gaacucagauccaggg

SEQ ID NO: 1318514 - RNA, 18 nt, Human
gaacucagauccagggac

SEQ ID NO: 1318515 - RNA, 19 nt, Human
gaacucagauccagggaca

SEQ ID NO: 1318516 - RNA, 21 nt, Human
gaacucagauccagggacaga

SEQ ID NO: 1318517 - RNA, 23 nt, Human
gaacguuuagcugacaaaauacu

SEQ ID NO: 1318518 - RNA, 14 nt, Human
gaacguuuucuaau

SEQ ID NO: 1318519 - RNA, 15 nt, Human
gaacguuuucuaauu

SEQ ID NO: 1318520 - RNA, 16 nt, Human
gaacguuuucuaauug

SEQ ID NO: 1318521 - RNA, 20 nt, Human
gaacguuuucuaauugcuua

SEQ ID NO: 1318522 - RNA, 18 nt, Human
gaacguuuucuaauugcu

SEQ ID NO: 1318523 - RNA, 17 nt, Human
gaaccuuugugcccuau

SEQ ID NO: 1318524 - RNA, 19 nt, Human
gaaccuuugugcccuauca

SEQ ID NO: 1318525 - RNA, 20 nt, Human
gaaccuuugugcccuaucac

SEQ ID NO: 1318526 - RNA, 16 nt, Human
gaacgaaaaugaaagc

SEQ ID NO: 1318527 - RNA, 12 nt, Human
gaaguccaagca

SEQ ID NO: 1318528 - RNA, 22 nt, Human
gaaguccaagcauuuagaugua

SEQ ID NO: 1318529 - RNA, 13 nt, Human
gaagucucagcua

SEQ ID NO: 1318530 - RNA, 18 nt, Human
gaagucucaucuggggag

SEQ ID NO: 1318531 - RNA, 24 nt, Human
gaagucucaucuggggagcaggca

SEQ ID NO: 1318532 - RNA, 19 nt, Human
gaagucucaucuggggagc

SEQ ID NO: 1318533 - RNA, 14 nt, Human
gaaguauccuucag

SEQ ID NO: 1318534 - RNA, 21 nt, Human
gaaguaguuaucauguuagua

SEQ ID NO: 1318535 - RNA, 18 nt, Human
gaaguaguuaucauguua

SEQ ID NO: 1318536 - RNA, 17 nt, Human
gaaguaguuaucauguu

SEQ ID NO: 1318537 - RNA, 16 nt, Human
gaaguaguuaucaugu

SEQ ID NO: 1318538 - RNA, 15 nt, Human
gaaguaguuaucaug

SEQ ID NO: 1318539 - RNA, 14 nt, Human
gaaguaguuaucau

SEQ ID NO: 1318540 - RNA, 13 nt, Human
gaaguaguuauca

SEQ ID NO: 1318541 - RNA, 13 nt, Human
gaaguaggaagua

SEQ ID NO: 1318542 - RNA, 16 nt, Human
gaaguauccuucagcc

SEQ ID NO: 1318543 - RNA, 19 nt, Human
gaaguaguuaucauguuag

SEQ ID NO: 1318544 - RNA, 14 nt, Human
gaaguauaccugau

SEQ ID NO: 1318545 - RNA, 14 nt, Human
gaaguauaaagaau

SEQ ID NO: 1318546 - RNA, 15 nt, Human
gaagucaucuugcua

SEQ ID NO: 1318547 - RNA, 18 nt, Human
gaagucaucuugcuacca

SEQ ID NO: 1318548 - RNA, 22 nt, Human
gaagguggauggccccagcaca

SEQ ID NO: 1318549 - RNA, 18 nt, Human
gaaggugcugacggccag

SEQ ID NO: 1318550 - RNA, 19 nt, Human
gaaggugcugacggccagg

SEQ ID NO: 1318551 - RNA, 21 nt, Human
gaaggugcugacggccaggga

SEQ ID NO: 1318552 - RNA, 14 nt, Human
gaaggugggaggau

SEQ ID NO: 1318553 - RNA, 13 nt, Human
gaaguaccagacu

SEQ ID NO: 1318554 - RNA, 14 nt, Human
gaaguaccagacua

SEQ ID NO: 1318555 - RNA, 21 nt, Human
gaaguacccguucacauuuuu

SEQ ID NO: 1318556 - RNA, 20 nt, Human
gaaguagaaacaaaauacaa

SEQ ID NO: 1318557 - RNA, 13 nt, Human
gaagcguuguccu

SEQ ID NO: 1318558 - RNA, 19 nt, Human
gaagcguuguccucagccc

SEQ ID NO: 1318559 - RNA, 20 nt, Human
gaagcguuguccucagcccc

SEQ ID NO: 1318560 - RNA, 14 nt, Human
gaagcuaacaggga

SEQ ID NO: 1318561 - RNA, 15 nt, Human
gaagcuaacagggaa

SEQ ID NO: 1318562 - RNA, 16 nt, Human
gaagcuaacagggaag

SEQ ID NO: 1318563 - RNA, 17 nt, Human
gaagcuaacagggaagg

SEQ ID NO: 1318564 - RNA, 18 nt, Human
gaagcuaacagggaaggc

SEQ ID NO: 1318565 - RNA, 19 nt, Human
gaagcuaacagggaaggca

SEQ ID NO: 1318566 - RNA, 20 nt, Human
gaagcuaacagggaaggcag

SEQ ID NO: 1318567 - RNA, 21 nt, Human
gaagcuaacagggaaggcagg

SEQ ID NO: 1318568 - RNA, 22 nt, Human
gaagcuaacagggaaggcaggc

SEQ ID NO: 1318569 - RNA, 20 nt, Human
gaauacucuuauaucuauau

SEQ ID NO: 1318570 - RNA, 21 nt, Human
gaauaccuuagugcaguuauu

SEQ ID NO: 1318571 - RNA, 20 nt, Human
gaauacuacuuaugaaaugu

SEQ ID NO: 1318572 - RNA, 13 nt, Human
gaauacugaacau

SEQ ID NO: 1318573 - RNA, 22 nt, Human
gaauacugaacaucugaguccu

SEQ ID NO: 1318574 - RNA, 22 nt, Human
gaauagcuuuaaugauaugcuu

SEQ ID NO: 1318575 - RNA, 20 nt, Human
gaauaccuuagugcaguuau

SEQ ID NO: 1318576 - RNA, 17 nt, Human
gaauaccuuagugcagu

SEQ ID NO: 1318577 - RNA, 13 nt, Human
gaauaccugcuca

SEQ ID NO: 1318578 - RNA, 17 nt, Human
gaauaccacucuguaau

SEQ ID NO: 1318579 - RNA, 19 nt, Human
gaauaccacucuguaauug

SEQ ID NO: 1318580 - RNA, 21 nt, Human
gaauaccacucuguaauugca

SEQ ID NO: 1318581 - RNA, 12 nt, Human
gaauacccuuuu

SEQ ID NO: 1318582 - RNA, 15 nt, Human
gaauaccacucugua

SEQ ID NO: 1318583 - RNA, 16 nt, Human
gaauaccacucuguaa

SEQ ID NO: 1318584 - RNA, 23 nt, Human
gaauaccacucuguaauugcaaa

SEQ ID NO: 1318585 - RNA, 22 nt, Human
gaauauuuguuauguagauaac

SEQ ID NO: 1318586 - RNA, 23 nt, Human
gaauauuuuguuuugugcagaga

SEQ ID NO: 1318587 - RNA, 14 nt, Human
gaaucaaacauuuu

SEQ ID NO: 1318588 - RNA, 17 nt, Human
gaaucaacauuucucaa

SEQ ID NO: 1318589 - RNA, 20 nt, Human
gaauaauccuaaacauauga

SEQ ID NO: 1318590 - RNA, 18 nt, Human
gaauaaucacgcuuuccu

SEQ ID NO: 1318591 - RNA, 19 nt, Human
gaauaaucacgcuuuccug

SEQ ID NO: 1318592 - RNA, 20 nt, Human
gaauaaucacgcuuuccuga

SEQ ID NO: 1318593 - RNA, 21 nt, Human
gaauaaucacgcuuuccugaa

SEQ ID NO: 1318594 - RNA, 13 nt, Human
gaaguuuuacauu

SEQ ID NO: 1318595 - RNA, 17 nt, Human
gaaugaagauacugaaa

SEQ ID NO: 1318596 - RNA, 18 nt, Human
gaaugaagauacugaaau

SEQ ID NO: 1318597 - RNA, 21 nt, Human
gaaugaagauacugaaauaaa

SEQ ID NO: 1318598 - RNA, 19 nt, Human
gaaugaagauacugaaaua

SEQ ID NO: 1318599 - RNA, 14 nt, Human
gaaugcauaaaaug

SEQ ID NO: 1318600 - RNA, 22 nt, Human
gaaugccacugccuucgcuucu

SEQ ID NO: 1318601 - RNA, 13 nt, Human
gaaugcuuuagga

SEQ ID NO: 1318602 - RNA, 14 nt, Human
gaaugccguggauu

SEQ ID NO: 1318603 - RNA, 21 nt, Human
gaaugccacugccuucgcuuc

SEQ ID NO: 1318604 - RNA, 16 nt, Human
gaaucaagggucaggc

SEQ ID NO: 1318605 - RNA, 17 nt, Human
gaaucaagggucaggcc

SEQ ID NO: 1318606 - RNA, 11 nt, Human
gaaucaauaau

SEQ ID NO: 1318607 - RNA, 19 nt, Human
gaaucuuuaaaagaugcuu

SEQ ID NO: 1318608 - RNA, 19 nt, Human
gaaucaagggucaggccuu

SEQ ID NO: 1318609 - RNA, 22 nt, Human
gaaucuuuagagaaguauacau

SEQ ID NO: 1318610 - RNA, 23 nt, Human
gaaucuuuagagaaguauacaua

SEQ ID NO: 1318611 - RNA, 21 nt, Human
gaauggugugggagagggaug

SEQ ID NO: 1318612 - RNA, 16 nt, Human
gaaugggugcccacag

SEQ ID NO: 1318613 - RNA, 22 nt, Human
gaauggaggggcagagccagga

SEQ ID NO: 1318614 - RNA, 21 nt, Human
gaauggaggggcagagccagg

SEQ ID NO: 1318615 - RNA, 20 nt, Human
gaauggaggggcagagccag

SEQ ID NO: 1318616 - RNA, 16 nt, Human
gaauggaggggcagag

SEQ ID NO: 1318617 - RNA, 15 nt, Human
gaauggaggggcaga

SEQ ID NO: 1318618 - RNA, 15 nt, Human
gaauggaaagcuuca

SEQ ID NO: 1318619 - RNA, 14 nt, Human
gaauggaucacaag

SEQ ID NO: 1318620 - RNA, 19 nt, Human
gaauggaucacaagaugga

SEQ ID NO: 1318621 - RNA, 17 nt, Human
gaauggaucacaagaug

SEQ ID NO: 1318622 - RNA, 21 nt, Human
gaauggauuuuucuuuaacug

SEQ ID NO: 1318623 - RNA, 13 nt, Human
gaauguaaauguc

SEQ ID NO: 1318624 - RNA, 20 nt, Human
gaauguaaagcuugucugau

SEQ ID NO: 1318625 - RNA, 15 nt, Human
gaauguaaagcuugu

SEQ ID NO: 1318626 - RNA, 16 nt, Human
gaauguaaaugucuca

SEQ ID NO: 1318627 - RNA, 14 nt, Human
gaauguaaaugucu

SEQ ID NO: 1318628 - RNA, 17 nt, Human
gaauguaaauuuguacu

SEQ ID NO: 1318629 - RNA, 14 nt, Human
gaauguaaauuugu

SEQ ID NO: 1318630 - RNA, 23 nt, Human
gaauuguguuuauaauuuuaaau

SEQ ID NO: 1318631 - RNA, 15 nt, Human
gaauuguguuuauaa

SEQ ID NO: 1318632 - RNA, 22 nt, Human
gaauuuaaauagcuuuuuucuc

SEQ ID NO: 1318633 - RNA, 22 nt, Human
gaauugugguuuauauauuuaa

SEQ ID NO: 1318634 - RNA, 16 nt, Human
gaauugugguuuauau

SEQ ID NO: 1318635 - RNA, 15 nt, Human
gaauuguuaguuucu

SEQ ID NO: 1318636 - RNA, 22 nt, Human
gaauuguugagauacuuuacua

SEQ ID NO: 1318637 - RNA, 18 nt, Human
gaauugauuugcauugaa

SEQ ID NO: 1318638 - RNA, 15 nt, Human
gaauugaguguuuaa

SEQ ID NO: 1318639 - RNA, 12 nt, Human
gaauugauuugc

SEQ ID NO: 1318640 - RNA, 13 nt, Human
gaauugauuugca

SEQ ID NO: 1318641 - RNA, 14 nt, Human
gaauugauuugcau

SEQ ID NO: 1318642 - RNA, 15 nt, Human
gaauugauuugcauu

SEQ ID NO: 1318643 - RNA, 17 nt, Human
gaauugauuugcauuga

SEQ ID NO: 1318644 - RNA, 16 nt, Human
gaauuuaauaaucugu

SEQ ID NO: 1318645 - RNA, 19 nt, Human
gaauucuuuaaaauuacaa

SEQ ID NO: 1318646 - RNA, 20 nt, Human
gaauucuugguugaggaaac

SEQ ID NO: 1318647 - RNA, 19 nt, Human
gaauucuugguugaggaaa

SEQ ID NO: 1318648 - RNA, 14 nt, Human
gaauugaguaaugg

SEQ ID NO: 1318649 - RNA, 16 nt, Human
gaauugaguaauggug

SEQ ID NO: 1318650 - RNA, 19 nt, Human
gaauugaguguuuaaaguu

SEQ ID NO: 1318651 - RNA, 18 nt, Human
gaauucaaauuuuaucug

SEQ ID NO: 1318652 - RNA, 13 nt, Human
gaauucagacauc

SEQ ID NO: 1318653 - RNA, 16 nt, Human
gaauucaaauuuuauc

SEQ ID NO: 1318654 - RNA, 14 nt, Human
gaauucauuucacu

SEQ ID NO: 1318655 - RNA, 12 nt, Human
gaauucccucac

SEQ ID NO: 1318656 - RNA, 13 nt, Human
gaauucccucacu

SEQ ID NO: 1318657 - RNA, 14 nt, Human
gaauucccucacuc

SEQ ID NO: 1318658 - RNA, 21 nt, Human
gaauucccucacucgucuccc

SEQ ID NO: 1318659 - RNA, 20 nt, Human
gaauucccucacucgucucc

SEQ ID NO: 1318660 - RNA, 17 nt, Human
gaauucggugugcacca

SEQ ID NO: 1318661 - RNA, 15 nt, Human
gaccccagccaucca

SEQ ID NO: 1318662 - RNA, 12 nt, Human
gaccccagagga

SEQ ID NO: 1318663 - RNA, 13 nt, Human
gacccccagcucc

SEQ ID NO: 1318664 - RNA, 17 nt, Human
gacccccagcuccggcc

SEQ ID NO: 1318665 - RNA, 23 nt, Human
gacccccagcuccggccuguccu

SEQ ID NO: 1318666 - RNA, 15 nt, Human
gaccccccuuucaca

SEQ ID NO: 1318667 - RNA, 19 nt, Human
gaccccccuuucacaggca

SEQ ID NO: 1318668 - RNA, 22 nt, Human
gaccccccuuucacaggcagcc

SEQ ID NO: 1318669 - RNA, 14 nt, Human
gacccauuccuucc

SEQ ID NO: 1318670 - RNA, 16 nt, Human
gacccauuccuuccca

SEQ ID NO: 1318671 - RNA, 15 nt, Human
gacccauuccuuccc

SEQ ID NO: 1318672 - RNA, 22 nt, Human
gacccauuugauauuuuuuaaa

SEQ ID NO: 1318673 - RNA, 23 nt, Human
gaccccaaacaccuuccagcucc

SEQ ID NO: 1318674 - RNA, 20 nt, Human
gaccccccuuucacaggcag

SEQ ID NO: 1318675 - RNA, 17 nt, Human
gacccccucucccugca

SEQ ID NO: 1318676 - RNA, 23 nt, Human
gacccaugaguuggggucuggca

SEQ ID NO: 1318677 - RNA, 17 nt, Human
gacccagccaggcccag

SEQ ID NO: 1318678 - RNA, 19 nt, Human
gacccagccaggcccagcc

SEQ ID NO: 1318679 - RNA, 22 nt, Human
gacccagccaggcccagccgac

SEQ ID NO: 1318680 - RNA, 16 nt, Human
gacccagcccucaucc

SEQ ID NO: 1318681 - RNA, 17 nt, Human
gacccagcccucauccc

SEQ ID NO: 1318682 - RNA, 15 nt, Human
gacccagugccccca

SEQ ID NO: 1318683 - RNA, 16 nt, Human
gacccagugcccccac

SEQ ID NO: 1318684 - RNA, 17 nt, Human
gacccagugcccccacu

SEQ ID NO: 1318685 - RNA, 20 nt, Human
gacccagugcccccacugac

SEQ ID NO: 1318686 - RNA, 19 nt, Human
gacccaaaaggcagaagca

SEQ ID NO: 1318687 - RNA, 18 nt, Human
gacccaaaaggcagaagc

SEQ ID NO: 1318688 - RNA, 16 nt, Human
gaccagcagccccaca

SEQ ID NO: 1318689 - RNA, 12 nt, Human
gaccagcagccc

SEQ ID NO: 1318690 - RNA, 17 nt, Human
gaccagcaggcuggccu

SEQ ID NO: 1318691 - RNA, 20 nt, Human
gacccaaaaggcagaagcaa

SEQ ID NO: 1318692 - RNA, 19 nt, Human
gacccacuggacucaccuc

SEQ ID NO: 1318693 - RNA, 18 nt, Human
gaccagccgugagcaugu

SEQ ID NO: 1318694 - RNA, 22 nt, Human
gaccagccgugagcauguuugg

SEQ ID NO: 1318695 - RNA, 14 nt, Human
gacccagccaggcc

SEQ ID NO: 1318696 - RNA, 15 nt, Human
gacccagccaggccc

SEQ ID NO: 1318697 - RNA, 22 nt, Human
gacauccagcagauuuccagcc

SEQ ID NO: 1318698 - RNA, 13 nt, Human
gacauccaggagg

SEQ ID NO: 1318699 - RNA, 13 nt, Human
gacauccagcaga

SEQ ID NO: 1318700 - RNA, 14 nt, Human
gacaucagcaaaca

SEQ ID NO: 1318701 - RNA, 16 nt, Human
gacaucagguuuuucc

SEQ ID NO: 1318702 - RNA, 16 nt, Human
gacaucacuuguacaa

SEQ ID NO: 1318703 - RNA, 22 nt, Human
gacaucacuuguacaaaauaaa

SEQ ID NO: 1318704 - RNA, 23 nt, Human
gacauccauguuccgagaagaac

SEQ ID NO: 1318705 - RNA, 20 nt, Human
gaccaagcaucuuggggggg

SEQ ID NO: 1318706 - RNA, 15 nt, Human
gaccaagcaucuugg

SEQ ID NO: 1318707 - RNA, 12 nt, Human
gaccaauaaaga

SEQ ID NO: 1318708 - RNA, 14 nt, Human
gaccacaacaugag

SEQ ID NO: 1318709 - RNA, 16 nt, Human
gaccacacccuguacu

SEQ ID NO: 1318710 - RNA, 14 nt, Human
gaccacacuccagc

SEQ ID NO: 1318711 - RNA, 16 nt, Human
gaccacacuccagcug

SEQ ID NO: 1318712 - RNA, 22 nt, Human
gaccacacuccagcugggauca

SEQ ID NO: 1318713 - RNA, 12 nt, Human
gaccacagcaca

SEQ ID NO: 1318714 - RNA, 14 nt, Human
gaccacagcacagc

SEQ ID NO: 1318715 - RNA, 15 nt, Human
gaccacagcacagcc

SEQ ID NO: 1318716 - RNA, 16 nt, Human
gaccacagcacagcca

SEQ ID NO: 1318717 - RNA, 18 nt, Human
gaccacugcagaagacag

SEQ ID NO: 1318718 - RNA, 16 nt, Human
gaccacugcagaagac

SEQ ID NO: 1318719 - RNA, 13 nt, Human
gaccacaggcuca

SEQ ID NO: 1318720 - RNA, 18 nt, Human
gaccacaggcucaggcag

SEQ ID NO: 1318721 - RNA, 16 nt, Human
gaccacaggcucaggc

SEQ ID NO: 1318722 - RNA, 13 nt, Human
gaccacaugcccc

SEQ ID NO: 1318723 - RNA, 12 nt, Human
gaccaccaagcc

SEQ ID NO: 1318724 - RNA, 13 nt, Human
gaccaccaagccu

SEQ ID NO: 1318725 - RNA, 14 nt, Human
gaccaccaagccuu

SEQ ID NO: 1318726 - RNA, 15 nt, Human
gaccaccaagccuug

SEQ ID NO: 1318727 - RNA, 22 nt, Human
gaccaccaagccuugauuggug

SEQ ID NO: 1318728 - RNA, 13 nt, Human
gaccaccagggca

SEQ ID NO: 1318729 - RNA, 19 nt, Human
gaccaccagggcaucucug

SEQ ID NO: 1318730 - RNA, 20 nt, Human
gaccaccagggcaucucugg

SEQ ID NO: 1318731 - RNA, 21 nt, Human
gaccaccagggcaucucuggg

SEQ ID NO: 1318732 - RNA, 22 nt, Human
gaccaccagggcaucucugggc

SEQ ID NO: 1318733 - RNA, 23 nt, Human
gaccaccagggcaucucugggcu

SEQ ID NO: 1318734 - RNA, 13 nt, Human
gaccacucagaga

SEQ ID NO: 1318735 - RNA, 14 nt, Human
gaccacucagagac

SEQ ID NO: 1318736 - RNA, 19 nt, Human
gaccacucagagacaugca

SEQ ID NO: 1318737 - RNA, 21 nt, Human
gaccacucagagacaugcaga

SEQ ID NO: 1318738 - RNA, 15 nt, Human
gaccagcagacagag

SEQ ID NO: 1318739 - RNA, 18 nt, Human
gaccagcagacagagcca

SEQ ID NO: 1318740 - RNA, 19 nt, Human
gaccagcagacagagccag

SEQ ID NO: 1318741 - RNA, 20 nt, Human
gaccagcagacagagccagg

SEQ ID NO: 1318742 - RNA, 23 nt, Human
gaccagcagacagagccaggaga

SEQ ID NO: 1318743 - RNA, 22 nt, Human
gaccagcagacagagccaggag

SEQ ID NO: 1318744 - RNA, 20 nt, Human
gacacuacacccagcaauag

SEQ ID NO: 1318745 - RNA, 19 nt, Human
gacacuacacccagcaaua

SEQ ID NO: 1318746 - RNA, 18 nt, Human
gacacuacacccagcaau

SEQ ID NO: 1318747 - RNA, 17 nt, Human
gacacuacacccagcaa

SEQ ID NO: 1318748 - RNA, 16 nt, Human
gacacuacacccagca

SEQ ID NO: 1318749 - RNA, 15 nt, Human
gacacuacacccagc

SEQ ID NO: 1318750 - RNA, 14 nt, Human
gacacuacacccag

SEQ ID NO: 1318751 - RNA, 15 nt, Human
gacacgggccugucc

SEQ ID NO: 1318752 - RNA, 18 nt, Human
gacacgggccuguccaca

SEQ ID NO: 1318753 - RNA, 19 nt, Human
gacacgggccuguccacag

SEQ ID NO: 1318754 - RNA, 20 nt, Human
gacacgggccuguccacagg

SEQ ID NO: 1318755 - RNA, 21 nt, Human
gacacgggccuguccacaggc

SEQ ID NO: 1318756 - RNA, 22 nt, Human
gacacgggccuguccacaggcu

SEQ ID NO: 1318757 - RNA, 22 nt, Human
gacacgcacggcagccacagcu

SEQ ID NO: 1318758 - RNA, 21 nt, Human
gacacgcacggcagccacagc

SEQ ID NO: 1318759 - RNA, 20 nt, Human
gacacgcacggcagccacag

SEQ ID NO: 1318760 - RNA, 19 nt, Human
gacacgcacggcagccaca

SEQ ID NO: 1318761 - RNA, 14 nt, Human
gacacgcacggcag

SEQ ID NO: 1318762 - RNA, 16 nt, Human
gaauuucacugucuuu

SEQ ID NO: 1318763 - RNA, 22 nt, Human
gaauuucccaggacccugaagg

SEQ ID NO: 1318764 - RNA, 14 nt, Human
gaauuucccaggac

SEQ ID NO: 1318765 - RNA, 15 nt, Human
gaauuucccaggacc

SEQ ID NO: 1318766 - RNA, 16 nt, Human
gaauuucccaggaccc

SEQ ID NO: 1318767 - RNA, 17 nt, Human
gaauuucccaggacccu

SEQ ID NO: 1318768 - RNA, 12 nt, Human
gaauuucaccug

SEQ ID NO: 1318769 - RNA, 17 nt, Human
gaauuucaccuguaaac

SEQ ID NO: 1318770 - RNA, 21 nt, Human
gaauuucaccuguaaaccuga

SEQ ID NO: 1318771 - RNA, 17 nt, Human
gaauuucccacauaccc

SEQ ID NO: 1318772 - RNA, 23 nt, Human
gacagagcgugagcugagcaggc

SEQ ID NO: 1318773 - RNA, 16 nt, Human
gacagagcccugugag

SEQ ID NO: 1318774 - RNA, 17 nt, Human
gacagagcccugugagg

SEQ ID NO: 1318775 - RNA, 16 nt, Human
gacagacagcccucca

SEQ ID NO: 1318776 - RNA, 18 nt, Human
gacacuagcccaaugaaa

SEQ ID NO: 1318777 - RNA, 14 nt, Human
gacagacaggcucu

SEQ ID NO: 1318778 - RNA, 15 nt, Human
gacagacaggcucuu

SEQ ID NO: 1318779 - RNA, 21 nt, Human
gacagacaggcucuuagcagc

SEQ ID NO: 1318780 - RNA, 13 nt, Human
gacagaggcccca

SEQ ID NO: 1318781 - RNA, 18 nt, Human
gacagaggccccagccuc

SEQ ID NO: 1318782 - RNA, 19 nt, Human
gacagaggccccagccucc

SEQ ID NO: 1318783 - RNA, 13 nt, Human
gacagaggcccuc

SEQ ID NO: 1318784 - RNA, 14 nt, Human
gacagaugccuccu

SEQ ID NO: 1318785 - RNA, 14 nt, Human
gacagggcauggcc

SEQ ID NO: 1318786 - RNA, 16 nt, Human
gacaggcaaauaaaag

SEQ ID NO: 1318787 - RNA, 15 nt, Human
gacagggcauggcca

SEQ ID NO: 1318788 - RNA, 20 nt, Human
gacagggcauggccaggugg

SEQ ID NO: 1318789 - RNA, 22 nt, Human
gacagggcauggccagguggcc

SEQ ID NO: 1318790 - RNA, 18 nt, Human
gacagggcggggguggcg

SEQ ID NO: 1318791 - RNA, 16 nt, Human
gacagggcgggggugg

SEQ ID NO: 1318792 - RNA, 17 nt, Human
gacagggcggggguggc

SEQ ID NO: 1318793 - RNA, 14 nt, Human
gacaguucaagaaa

SEQ ID NO: 1318794 - RNA, 15 nt, Human
gacaguucauaugua

SEQ ID NO: 1318795 - RNA, 17 nt, Human
gacaguucauauguacc

SEQ ID NO: 1318796 - RNA, 21 nt, Human
gacaguuccagaagugugacu

SEQ ID NO: 1318797 - RNA, 22 nt, Human
gacauaaaguugauaaagauuu

SEQ ID NO: 1318798 - RNA, 17 nt, Human
gacauaaccacugcuuc

SEQ ID NO: 1318799 - RNA, 15 nt, Human
gacaucacuuguaca

SEQ ID NO: 1318800 - RNA, 23 nt, Human
gacaguuuaccaguugccuuuua

SEQ ID NO: 1318801 - RNA, 19 nt, Human
gacaguuuaccaguugccu

SEQ ID NO: 1318802 - RNA, 16 nt, Human
gacaguuuauuuguug

SEQ ID NO: 1318803 - RNA, 21 nt, Human
gacaguuuaccaguugccuuu

SEQ ID NO: 1318804 - RNA, 14 nt, Human
gacauaaaggaaaa

SEQ ID NO: 1318805 - RNA, 15 nt, Human
gacauaaaggaaaag

SEQ ID NO: 1318806 - RNA, 17 nt, Human
gacauaaaggaaaagac

SEQ ID NO: 1318807 - RNA, 21 nt, Human
gacauaaaggaaaagacacau

SEQ ID NO: 1318808 - RNA, 17 nt, Human
gacauaaaguugauaaa

SEQ ID NO: 1318809 - RNA, 19 nt, Human
gacauaaaguugauaaaga

SEQ ID NO: 1318810 - RNA, 20 nt, Human
gacauaaaguugauaaagau

SEQ ID NO: 1318811 - RNA, 14 nt, Human
gacaggauguguuu

SEQ ID NO: 1318812 - RNA, 18 nt, Human
gacaggauguguuugcuu

SEQ ID NO: 1318813 - RNA, 19 nt, Human
gacagaugccuccuuccuc

SEQ ID NO: 1318814 - RNA, 18 nt, Human
gacagcaaccuguagagu

SEQ ID NO: 1318815 - RNA, 14 nt, Human
gacagcagaacugc

SEQ ID NO: 1318816 - RNA, 20 nt, Human
gacagcagaacugcuauuuu

SEQ ID NO: 1318817 - RNA, 14 nt, Human
gacagcagcaucuc

SEQ ID NO: 1318818 - RNA, 16 nt, Human
gacagcagcaucucua

SEQ ID NO: 1318819 - RNA, 19 nt, Human
gacagcagcaucucuaccu

SEQ ID NO: 1318820 - RNA, 19 nt, Human
gacaggauguguuugcuuu

SEQ ID NO: 1318821 - RNA, 20 nt, Human
gacaggauguguuugcuuuc

SEQ ID NO: 1318822 - RNA, 18 nt, Human
gacaggauguuugcucag

SEQ ID NO: 1318823 - RNA, 23 nt, Human
gacugcggaggaaggaggaccca

SEQ ID NO: 1318824 - RNA, 12 nt, Human
gacugcuaaaua

SEQ ID NO: 1318825 - RNA, 15 nt, Human
gacugcggaggaagg

SEQ ID NO: 1318826 - RNA, 17 nt, Human
gacugccauauuaaauu

SEQ ID NO: 1318827 - RNA, 14 nt, Human
gacugcuaaauaaa

SEQ ID NO: 1318828 - RNA, 17 nt, Human
gacugcuaaauaaaauu

SEQ ID NO: 1318829 - RNA, 18 nt, Human
gacugcuaaauaaaauuu

SEQ ID NO: 1318830 - RNA, 17 nt, Human
gacuggauguaccacca

SEQ ID NO: 1318831 - RNA, 22 nt, Human
gacuggcauacuauguggaugu

SEQ ID NO: 1318832 - RNA, 23 nt, Human
gacuggcauacuauguggaugug

SEQ ID NO: 1318833 - RNA, 24 nt, Human
gacuggcauacuauguggauguga

SEQ ID NO: 1318834 - RNA, 15 nt, Human
gacuggccagggcca

SEQ ID NO: 1318835 - RNA, 12 nt, Human
gacuggccaggg

SEQ ID NO: 1318836 - RNA, 18 nt, Human
gacuggcggggggcccau

SEQ ID NO: 1318837 - RNA, 18 nt, Human
gacuuacagcaaauccuu

SEQ ID NO: 1318838 - RNA, 21 nt, Human
gacugggagcccccagccugu

SEQ ID NO: 1318839 - RNA, 17 nt, Human
gacugggagcccccagc

SEQ ID NO: 1318840 - RNA, 18 nt, Human
gacugggagcccccagcc

SEQ ID NO: 1318841 - RNA, 19 nt, Human
gacugggagcccccagccu

SEQ ID NO: 1318842 - RNA, 20 nt, Human
gacugggagcccccagccug

SEQ ID NO: 1318843 - RNA, 16 nt, Human
gacugggaccaggcac

SEQ ID NO: 1318844 - RNA, 18 nt, Human
gacugggaccaggcacca

SEQ ID NO: 1318845 - RNA, 20 nt, Human
gacugggaccaggcaccagg

SEQ ID NO: 1318846 - RNA, 10 nt, Human
gacuggcuuu

SEQ ID NO: 1318847 - RNA, 20 nt, Human
gacuggcuuuuauuaaugca

SEQ ID NO: 1318848 - RNA, 21 nt, Human
gacuggcuuuuauuaaugcac

SEQ ID NO: 1318849 - RNA, 22 nt, Human
gacuggcuuuuauuaaugcacu

SEQ ID NO: 1318850 - RNA, 23 nt, Human
gacuggcuuuuauuaaugcacuu

SEQ ID NO: 1318851 - RNA, 18 nt, Human
gacuuauaguacaugaua

SEQ ID NO: 1318852 - RNA, 17 nt, Human
gacuuauaguacaugau

SEQ ID NO: 1318853 - RNA, 16 nt, Human
gacuuauaguacauga

SEQ ID NO: 1318854 - RNA, 15 nt, Human
gacuuagcugggaga

SEQ ID NO: 1318855 - RNA, 16 nt, Human
gacuuagggcaccagg

SEQ ID NO: 1318856 - RNA, 17 nt, Human
gacuuagggcaccaggg

SEQ ID NO: 1318857 - RNA, 21 nt, Human
gacuucaagcauggcuauuuu

SEQ ID NO: 1318858 - RNA, 14 nt, Human
gacuucagcucugu

SEQ ID NO: 1318859 - RNA, 14 nt, Human
gacuuacaugauuc

SEQ ID NO: 1318860 - RNA, 15 nt, Human
gacuuacaugauuca

SEQ ID NO: 1318861 - RNA, 16 nt, Human
gacuuacaugauucau

SEQ ID NO: 1318862 - RNA, 18 nt, Human
gacuuacaugauucauuu

SEQ ID NO: 1318863 - RNA, 19 nt, Human
gacuuacaugauucauuuu

SEQ ID NO: 1318864 - RNA, 12 nt, Human
gacuuacucuaa

SEQ ID NO: 1318865 - RNA, 14 nt, Human
gacuuacucuaaga

SEQ ID NO: 1318866 - RNA, 15 nt, Human
gacuuacucuaagau

SEQ ID NO: 1318867 - RNA, 23 nt, Human
gacuuagaaaaccagcucagcac

SEQ ID NO: 1318868 - RNA, 21 nt, Human
gacuuagaaaaccagcucagc

SEQ ID NO: 1318869 - RNA, 11 nt, Human
gacugagaaau

SEQ ID NO: 1318870 - RNA, 21 nt, Human
gacugacaguuuacagacgcu

SEQ ID NO: 1318871 - RNA, 13 nt, Human
gacugaccagcag

SEQ ID NO: 1318872 - RNA, 15 nt, Human
gacugaccagcagcu

SEQ ID NO: 1318873 - RNA, 15 nt, Human
gacucuaaagucugu

SEQ ID NO: 1318874 - RNA, 14 nt, Human
gacucuaagaaaga

SEQ ID NO: 1318875 - RNA, 15 nt, Human
gacucuaagaaagaa

SEQ ID NO: 1318876 - RNA, 16 nt, Human
gacucuaagaaagaac

SEQ ID NO: 1318877 - RNA, 21 nt, Human
gacucuaagguuaucuacuuu

SEQ ID NO: 1318878 - RNA, 20 nt, Human
gacuaauggcaugagaaaua

SEQ ID NO: 1318879 - RNA, 14 nt, Human
gacuaauggcauga

SEQ ID NO: 1318880 - RNA, 16 nt, Human
gacuaauggcaugaga

SEQ ID NO: 1318881 - RNA, 14 nt, Human
gacuacaggcguga

SEQ ID NO: 1318882 - RNA, 17 nt, Human
gacugaugucuccuaag

SEQ ID NO: 1318883 - RNA, 18 nt, Human
gacugaugucuccuaagc

SEQ ID NO: 1318884 - RNA, 14 nt, Human
gacugauuucagag

SEQ ID NO: 1318885 - RNA, 16 nt, Human
gacugauuucagagug

SEQ ID NO: 1318886 - RNA, 22 nt, Human
gacugaugucuccuaagcaccu

SEQ ID NO: 1318887 - RNA, 22 nt, Human
gacugagugggaagcccauccu

SEQ ID NO: 1318888 - RNA, 14 nt, Human
gacugaugucuccu

SEQ ID NO: 1318889 - RNA, 15 nt, Human
gacugaugucuccua

SEQ ID NO: 1318890 - RNA, 16 nt, Human
gacugaugucuccuaa

SEQ ID NO: 1318891 - RNA, 20 nt, Human
gacugccagucccccugccc

SEQ ID NO: 1318892 - RNA, 15 nt, Human
gacugccaagccaug

SEQ ID NO: 1318893 - RNA, 19 nt, Human
gacugccaagacugcugug

SEQ ID NO: 1318894 - RNA, 20 nt, Human
gacugccaagacugcugugg

SEQ ID NO: 1318895 - RNA, 12 nt, Human
gacugccaagcc

SEQ ID NO: 1318896 - RNA, 13 nt, Human
gacugccaagcca

SEQ ID NO: 1318897 - RNA, 14 nt, Human
gacugccaagccau

SEQ ID NO: 1318898 - RNA, 16 nt, Human
gacugccaagccaugg

SEQ ID NO: 1318899 - RNA, 13 nt, Human
gacugagaaauuu

SEQ ID NO: 1318900 - RNA, 14 nt, Human
gacugaccagcagc

SEQ ID NO: 1318901 - RNA, 16 nt, Human
gacugagugggaagcc

SEQ ID NO: 1318902 - RNA, 17 nt, Human
gacugagugggaagccc

SEQ ID NO: 1318903 - RNA, 16 nt, Human
gacugaggggagggga

SEQ ID NO: 1318904 - RNA, 13 nt, Human
gacccugcccuug

SEQ ID NO: 1318905 - RNA, 15 nt, Human
gacccugcccuuguu

SEQ ID NO: 1318906 - RNA, 23 nt, Human
gacccugcccuuguuuggggcag

SEQ ID NO: 1318907 - RNA, 12 nt, Human
gacccugccucu

SEQ ID NO: 1318908 - RNA, 13 nt, Human
gacccugccucuc

SEQ ID NO: 1318909 - RNA, 16 nt, Human
gacccugccucuccca

SEQ ID NO: 1318910 - RNA, 23 nt, Human
gacccugccucucccaggcaggg

SEQ ID NO: 1318911 - RNA, 21 nt, Human
gacccugccucucccaggcag

SEQ ID NO: 1318912 - RNA, 21 nt, Human
gacccuugacaccugcugaga

SEQ ID NO: 1318913 - RNA, 10 nt, Human
gaccuggcag

SEQ ID NO: 1318914 - RNA, 15 nt, Human
gaccuggcagcucug

SEQ ID NO: 1318915 - RNA, 16 nt, Human
gaccuggcagcucugg

SEQ ID NO: 1318916 - RNA, 17 nt, Human
gaccugguacccuccug

SEQ ID NO: 1318917 - RNA, 19 nt, Human
gaccugguacccuccuggc

SEQ ID NO: 1318918 - RNA, 21 nt, Human
gaccugguacccuccuggcuc

SEQ ID NO: 1318919 - RNA, 23 nt, Human
gaccugguacccuccuggcucuu

SEQ ID NO: 1318920 - RNA, 17 nt, Human
gaccuggugcugccucu

SEQ ID NO: 1318921 - RNA, 22 nt, Human
gaccuggugcugccucuaccug

SEQ ID NO: 1318922 - RNA, 12 nt, Human
gaccuguaauca

SEQ ID NO: 1318923 - RNA, 15 nt, Human
gaccugugagcccag

SEQ ID NO: 1318924 - RNA, 16 nt, Human
gaccugugagcccagc

SEQ ID NO: 1318925 - RNA, 19 nt, Human
gaccugugagcccagcugg

SEQ ID NO: 1318926 - RNA, 14 nt, Human
gaccugugcacacc

SEQ ID NO: 1318927 - RNA, 23 nt, Human
gaccugugagcccagcuggguca

SEQ ID NO: 1318928 - RNA, 17 nt, Human
gaccuguuagcagacag

SEQ ID NO: 1318929 - RNA, 18 nt, Human
gaccuguuagcagacagg

SEQ ID NO: 1318930 - RNA, 19 nt, Human
gaccuguuagcagacaggc

SEQ ID NO: 1318931 - RNA, 14 nt, Human
gaccuuaaaugcaa

SEQ ID NO: 1318932 - RNA, 18 nt, Human
gaccuucgggcugugccc

SEQ ID NO: 1318933 - RNA, 19 nt, Human
gaccuucgggcugugcccg

SEQ ID NO: 1318934 - RNA, 12 nt, Human
gaccuuccucau

SEQ ID NO: 1318935 - RNA, 14 nt, Human
gaccuuccucaucc

SEQ ID NO: 1318936 - RNA, 22 nt, Human
gaccuuccucauccaccccauc

SEQ ID NO: 1318937 - RNA, 23 nt, Human
gaccuuccucauccaccccaucc

SEQ ID NO: 1318938 - RNA, 16 nt, Human
gaccuucgggcugugc

SEQ ID NO: 1318939 - RNA, 18 nt, Human
gacggaaggguaaacaau

SEQ ID NO: 1318940 - RNA, 17 nt, Human
gacgucuggguggcccu

SEQ ID NO: 1318941 - RNA, 22 nt, Human
gacgugaccggacuuuucugca

SEQ ID NO: 1318942 - RNA, 12 nt, Human
gacguggcucag

SEQ ID NO: 1318943 - RNA, 14 nt, Human
gacguggcucagcc

SEQ ID NO: 1318944 - RNA, 15 nt, Human
gacguggcucagcca

SEQ ID NO: 1318945 - RNA, 16 nt, Human
gacguggcucagccag

SEQ ID NO: 1318946 - RNA, 18 nt, Human
gacuaaaccauugugcau

SEQ ID NO: 1318947 - RNA, 16 nt, Human
gacguuuuauaagcau

SEQ ID NO: 1318948 - RNA, 22 nt, Human
gacguuuuauaagcaucauuau

SEQ ID NO: 1318949 - RNA, 16 nt, Human
gacuaagagaaguugu

SEQ ID NO: 1318950 - RNA, 23 nt, Human
gacuaagagaaguuguaaaguau

SEQ ID NO: 1318951 - RNA, 18 nt, Human
gacuaagccagcaccgga

SEQ ID NO: 1318952 - RNA, 12 nt, Human
gacuaagccagc

SEQ ID NO: 1318953 - RNA, 22 nt, Human
gacuaauagaaaaguauguucu

SEQ ID NO: 1318954 - RNA, 15 nt, Human
gacuaaucuuauuca

SEQ ID NO: 1318955 - RNA, 22 nt, Human
gacuaaucuuauucauuuucuc

SEQ ID NO: 1318956 - RNA, 23 nt, Human
gacuaacacucagaagccugggg

SEQ ID NO: 1318957 - RNA, 21 nt, Human
gacuaacuagacaccaaaguu

SEQ ID NO: 1318958 - RNA, 23 nt, Human
gacuaacuagacaccaaaguucu

SEQ ID NO: 1318959 - RNA, 14 nt, Human
gacuaacacucaga

SEQ ID NO: 1318960 - RNA, 16 nt, Human
gacuaacacucagaag

SEQ ID NO: 1318961 - RNA, 19 nt, Human
gacuaacacucagaagccu

SEQ ID NO: 1318962 - RNA, 21 nt, Human
gacuaacacucagaagccugg

SEQ ID NO: 1318963 - RNA, 22 nt, Human
gacuaacacucagaagccuggg

SEQ ID NO: 1318964 - RNA, 23 nt, Human
gacuaaccauguguuauguuuuc

SEQ ID NO: 1318965 - RNA, 22 nt, Human
gacuaaaccauugugcauucua

SEQ ID NO: 1318966 - RNA, 19 nt, Human
gacuaaaccauugugcauu

SEQ ID NO: 1318967 - RNA, 18 nt, Human
gacuaaacuuuuuuucug

SEQ ID NO: 1318968 - RNA, 19 nt, Human
gacuaaacuuuuuuucugu

SEQ ID NO: 1318969 - RNA, 20 nt, Human
gacuaaacuuuuuuucugua

SEQ ID NO: 1318970 - RNA, 22 nt, Human
gacuaaacuuuuuuucuguacc

SEQ ID NO: 1318971 - RNA, 16 nt, Human
cuuccuucccugcugu

SEQ ID NO: 1318972 - RNA, 14 nt, Human
cuuccuuccucucc

SEQ ID NO: 1318973 - RNA, 15 nt, Human
cuuccuaccuauccc

SEQ ID NO: 1318974 - RNA, 21 nt, Human
cuuccuugaagaacugcaggc

SEQ ID NO: 1318975 - RNA, 22 nt, Human
cuuccuugaagaacugcaggcc

SEQ ID NO: 1318976 - RNA, 22 nt, Human
cuucgacuguuguuaucuguuu

SEQ ID NO: 1318977 - RNA, 14 nt, Human
cuucgacuguuguu

SEQ ID NO: 1318978 - RNA, 16 nt, Human
cuucgacacuguucuu

SEQ ID NO: 1318979 - RNA, 17 nt, Human
cuucgacacuguucuua

SEQ ID NO: 1318980 - RNA, 22 nt, Human
cuucucagauuucugaggaaau

SEQ ID NO: 1318981 - RNA, 19 nt, Human
cuucucagauuucugagga

SEQ ID NO: 1318982 - RNA, 14 nt, Human
cuucucagauuucu

SEQ ID NO: 1318983 - RNA, 17 nt, Human
cuucucaggacacaggc

SEQ ID NO: 1318984 - RNA, 18 nt, Human
cuucucaggacacaggcc

SEQ ID NO: 1318985 - RNA, 19 nt, Human
cuucucaggacacaggccu

SEQ ID NO: 1318986 - RNA, 20 nt, Human
cuucucaggacacaggccug

SEQ ID NO: 1318987 - RNA, 21 nt, Human
cuucucaggacacaggccugu

SEQ ID NO: 1318988 - RNA, 22 nt, Human
cuucucaggacacaggccugug

SEQ ID NO: 1318989 - RNA, 23 nt, Human
cuucucaggacacaggccugugu

SEQ ID NO: 1318990 - RNA, 15 nt, Human
cuucguuuaaugaau

SEQ ID NO: 1318991 - RNA, 15 nt, Human
cuucguuuauuuuca

SEQ ID NO: 1318992 - RNA, 16 nt, Human
cuucguuuauuuucaa

SEQ ID NO: 1318993 - RNA, 18 nt, Human
cuucguuuauuuucaaga

SEQ ID NO: 1318994 - RNA, 19 nt, Human
cuucuaaacccaauccaaa

SEQ ID NO: 1318995 - RNA, 18 nt, Human
cuucuaaacuuccccauc

SEQ ID NO: 1318996 - RNA, 19 nt, Human
cuucuaaacuuccccaucu

SEQ ID NO: 1318997 - RNA, 22 nt, Human
cuucuaaacuuccccaucuucu

SEQ ID NO: 1318998 - RNA, 16 nt, Human
cuucgauacaccgggc

SEQ ID NO: 1318999 - RNA, 16 nt, Human
cuucgaguucccaggg

SEQ ID NO: 1319000 - RNA, 16 nt, Human
cuucgggcccuuccca

SEQ ID NO: 1319001 - RNA, 17 nt, Human
cuucgggcccuucccac

SEQ ID NO: 1319002 - RNA, 14 nt, Human
cuucgggcugugcc

SEQ ID NO: 1319003 - RNA, 15 nt, Human
cuucgggcugugccc

SEQ ID NO: 1319004 - RNA, 23 nt, Human
cuucgacuguuguuaucuguuug

SEQ ID NO: 1319005 - RNA, 17 nt, Human
cuucggccuccauccug

SEQ ID NO: 1319006 - RNA, 19 nt, Human
cuucggccuccauccugag

SEQ ID NO: 1319007 - RNA, 18 nt, Human
cuucggccuccauccuga

SEQ ID NO: 1319008 - RNA, 19 nt, Human
cuucuccauggcccugcca

SEQ ID NO: 1319009 - RNA, 15 nt, Human
cuucucccaauucau

SEQ ID NO: 1319010 - RNA, 17 nt, Human
cuucuccauggcccugc

SEQ ID NO: 1319011 - RNA, 16 nt, Human
cuucuccauccacaug

SEQ ID NO: 1319012 - RNA, 14 nt, Human
cuucuccauccaca

SEQ ID NO: 1319013 - RNA, 20 nt, Human
cuucucauuuuuuaaaaaag

SEQ ID NO: 1319014 - RNA, 18 nt, Human
cuucucccaggcaaggcu

SEQ ID NO: 1319015 - RNA, 19 nt, Human
cuucucccaggcaaggcug

SEQ ID NO: 1319016 - RNA, 21 nt, Human
cuucucccaggcaaggcugug

SEQ ID NO: 1319017 - RNA, 20 nt, Human
cuucucccaggcaaggcugu

SEQ ID NO: 1319018 - RNA, 12 nt, Human
cuucucccacuc

SEQ ID NO: 1319019 - RNA, 13 nt, Human
cuucucccacucu

SEQ ID NO: 1319020 - RNA, 15 nt, Human
cuucucccacucucc

SEQ ID NO: 1319021 - RNA, 16 nt, Human
cuucucccacucuccu

SEQ ID NO: 1319022 - RNA, 17 nt, Human
cuucucccacucuccua

SEQ ID NO: 1319023 - RNA, 20 nt, Human
cuucucccacucuccuaggc

SEQ ID NO: 1319024 - RNA, 19 nt, Human
cuucucccacucuccuagg

SEQ ID NO: 1319025 - RNA, 14 nt, Human
cuucucccaggcaa

SEQ ID NO: 1319026 - RNA, 15 nt, Human
cuucucccaggcaag

SEQ ID NO: 1319027 - RNA, 17 nt, Human
cuucucccaggcaaggc

SEQ ID NO: 1319028 - RNA, 14 nt, Human
cuucuccuuucaca

SEQ ID NO: 1319029 - RNA, 17 nt, Human
cuucuccuuucacaacc

SEQ ID NO: 1319030 - RNA, 17 nt, Human
cuucuccccagcuccca

SEQ ID NO: 1319031 - RNA, 18 nt, Human
cuucuccccagcucccag

SEQ ID NO: 1319032 - RNA, 20 nt, Human
cuucuccccagcucccagga

SEQ ID NO: 1319033 - RNA, 20 nt, Human
cuucuccuuucacaaccuuc

SEQ ID NO: 1319034 - RNA, 22 nt, Human
cuucuccuuucacaaccuucug

SEQ ID NO: 1319035 - RNA, 19 nt, Human
cuucuccccagcucccagg

SEQ ID NO: 1319036 - RNA, 21 nt, Human
cuucucguccucguuuguguu

SEQ ID NO: 1319037 - RNA, 20 nt, Human
cuucucuaauucuuccuuug

SEQ ID NO: 1319038 - RNA, 23 nt, Human
cuucucuaauucuuccuuuguaa

SEQ ID NO: 1319039 - RNA, 20 nt, Human
cuucugccuuagucucaguu

SEQ ID NO: 1319040 - RNA, 21 nt, Human
cuucugccuuagucucaguuu

SEQ ID NO: 1319041 - RNA, 14 nt, Human
cuucugccuucuca

SEQ ID NO: 1319042 - RNA, 16 nt, Human
cuucugccuucucaug

SEQ ID NO: 1319043 - RNA, 14 nt, Human
cuucugcucagcuc

SEQ ID NO: 1319044 - RNA, 15 nt, Human
cuucugcucagcucu

SEQ ID NO: 1319045 - RNA, 16 nt, Human
cuucugcucagcucug

SEQ ID NO: 1319046 - RNA, 18 nt, Human
cuucugcucagcucuggg

SEQ ID NO: 1319047 - RNA, 15 nt, Human
cuucuggacugguuu

SEQ ID NO: 1319048 - RNA, 18 nt, Human
cuucagcgguuuauauaa

SEQ ID NO: 1319049 - RNA, 17 nt, Human
cuuauuuuugacagugu

SEQ ID NO: 1319050 - RNA, 14 nt, Human
cuucaggcucuucu

SEQ ID NO: 1319051 - RNA, 13 nt, Human
cuucagcucugaa

SEQ ID NO: 1319052 - RNA, 14 nt, Human
cuucagcucugaaa

SEQ ID NO: 1319053 - RNA, 15 nt, Human
cuucaggcucuucuc

SEQ ID NO: 1319054 - RNA, 16 nt, Human
cuucaggcucuucucc

SEQ ID NO: 1319055 - RNA, 17 nt, Human
cuucaggcucuucuccu

SEQ ID NO: 1319056 - RNA, 18 nt, Human
cuucaggcucuucuccuu

SEQ ID NO: 1319057 - RNA, 14 nt, Human
cuucauuuccuccg

SEQ ID NO: 1319058 - RNA, 15 nt, Human
cuuccaaugucugga

SEQ ID NO: 1319059 - RNA, 13 nt, Human
cuuccacaggguc

SEQ ID NO: 1319060 - RNA, 15 nt, Human
cuuccacaggguccc

SEQ ID NO: 1319061 - RNA, 18 nt, Human
cuuccacagggucccaca

SEQ ID NO: 1319062 - RNA, 16 nt, Human
cuuccaaugucuggag

SEQ ID NO: 1319063 - RNA, 19 nt, Human
cuuccaaauccccuaagca

SEQ ID NO: 1319064 - RNA, 20 nt, Human
cuuccaaauccccuaagcag

SEQ ID NO: 1319065 - RNA, 13 nt, Human
cuucauuuggaga

SEQ ID NO: 1319066 - RNA, 14 nt, Human
cuucauuuggagau

SEQ ID NO: 1319067 - RNA, 18 nt, Human
cuucauuugggaugcuac

SEQ ID NO: 1319068 - RNA, 16 nt, Human
cuuccaaauccccuaa

SEQ ID NO: 1319069 - RNA, 14 nt, Human
cuucccuuuucugu

SEQ ID NO: 1319070 - RNA, 16 nt, Human
cuucccucucuggaga

SEQ ID NO: 1319071 - RNA, 16 nt, Human
cuucccuuuucuguuc

SEQ ID NO: 1319072 - RNA, 14 nt, Human
cuuccgccacuggg

SEQ ID NO: 1319073 - RNA, 15 nt, Human
cuuccgccacugggg

SEQ ID NO: 1319074 - RNA, 16 nt, Human
cuuccgccacuggggc

SEQ ID NO: 1319075 - RNA, 22 nt, Human
cuuccgccacuggggcucagag

SEQ ID NO: 1319076 - RNA, 17 nt, Human
cuuccgccacuggggcu

SEQ ID NO: 1319077 - RNA, 22 nt, Human
cuuccgcuuggagcuauuuucc

SEQ ID NO: 1319078 - RNA, 23 nt, Human
cuuccgcuuggagcuauuuucca

SEQ ID NO: 1319079 - RNA, 13 nt, Human
cuuccggccccuc

SEQ ID NO: 1319080 - RNA, 17 nt, Human
cuuccggccccuccccu

SEQ ID NO: 1319081 - RNA, 22 nt, Human
cuuccggggaaggauuuugcag

SEQ ID NO: 1319082 - RNA, 19 nt, Human
cuuccuaccaagucaaacu

SEQ ID NO: 1319083 - RNA, 17 nt, Human
cuuccuaccaagucaaa

SEQ ID NO: 1319084 - RNA, 15 nt, Human
cuucccgcucagccc

SEQ ID NO: 1319085 - RNA, 16 nt, Human
cuucccgcucagcccu

SEQ ID NO: 1319086 - RNA, 17 nt, Human
cuucccgcucagcccuc

SEQ ID NO: 1319087 - RNA, 18 nt, Human
cuucccgcucagcccucc

SEQ ID NO: 1319088 - RNA, 17 nt, Human
cuucccucaccuuggca

SEQ ID NO: 1319089 - RNA, 19 nt, Human
cuucccuccccucuaguuu

SEQ ID NO: 1319090 - RNA, 20 nt, Human
cuucccuccccucuaguuuu

SEQ ID NO: 1319091 - RNA, 14 nt, Human
cuucccucucugga

SEQ ID NO: 1319092 - RNA, 16 nt, Human
cuuccagcuagugacc

SEQ ID NO: 1319093 - RNA, 18 nt, Human
cuuccagcuagugaccca

SEQ ID NO: 1319094 - RNA, 22 nt, Human
cuuccagcuagugacccacaug

SEQ ID NO: 1319095 - RNA, 12 nt, Human
cuuccagcuccu

SEQ ID NO: 1319096 - RNA, 13 nt, Human
cuuccagcuccug

SEQ ID NO: 1319097 - RNA, 15 nt, Human
cuuccagcuccugua

SEQ ID NO: 1319098 - RNA, 19 nt, Human
cuuccacagggucccacag

SEQ ID NO: 1319099 - RNA, 22 nt, Human
cuuccacagggucccacagcca

SEQ ID NO: 1319100 - RNA, 23 nt, Human
cuuccacagggucccacagccac

SEQ ID NO: 1319101 - RNA, 23 nt, Human
cuuccaccaaguuggaacauccu

SEQ ID NO: 1319102 - RNA, 13 nt, Human
cuuccaccacaga

SEQ ID NO: 1319103 - RNA, 20 nt, Human
cuuccagucuuccugacacu

SEQ ID NO: 1319104 - RNA, 21 nt, Human
cuuccagucuuccugacacuu

SEQ ID NO: 1319105 - RNA, 14 nt, Human
cuuccagcuccugu

SEQ ID NO: 1319106 - RNA, 16 nt, Human
cuuccagguguuacug

SEQ ID NO: 1319107 - RNA, 19 nt, Human
cuuccagguguuacuguaa

SEQ ID NO: 1319108 - RNA, 20 nt, Human
cuuccagguguuacuguaau

SEQ ID NO: 1319109 - RNA, 22 nt, Human
cuuccagguguuacuguaauuc

SEQ ID NO: 1319110 - RNA, 22 nt, Human
cuuccagucuuccugacacuuu

SEQ ID NO: 1319111 - RNA, 18 nt, Human
cuucccagaggggccugc

SEQ ID NO: 1319112 - RNA, 19 nt, Human
cuucccagaggggccugcc

SEQ ID NO: 1319113 - RNA, 22 nt, Human
cuucccagaggggccugccacc

SEQ ID NO: 1319114 - RNA, 16 nt, Human
cuucccagcuaggaag

SEQ ID NO: 1319115 - RNA, 21 nt, Human
cuucccagaggggccugccac

SEQ ID NO: 1319116 - RNA, 19 nt, Human
cuguuuuauaauuuuguga

SEQ ID NO: 1319117 - RNA, 16 nt, Human
cuguuuuaaaaaccug

SEQ ID NO: 1319118 - RNA, 12 nt, Human
cuguuuucuucu

SEQ ID NO: 1319119 - RNA, 18 nt, Human
cuguuuucuucuauucca

SEQ ID NO: 1319120 - RNA, 17 nt, Human
cuguuuugaaggcaaaa

SEQ ID NO: 1319121 - RNA, 13 nt, Human
cuguuuuguuaua

SEQ ID NO: 1319122 - RNA, 17 nt, Human
cuguuuuguuauauaau

SEQ ID NO: 1319123 - RNA, 18 nt, Human
cuguuuuguuauauaauu

SEQ ID NO: 1319124 - RNA, 20 nt, Human
cuguuuuguuauauaauuua

SEQ ID NO: 1319125 - RNA, 19 nt, Human
cuguuuuguuauauaauuu

SEQ ID NO: 1319126 - RNA, 13 nt, Human
cuguuuuguugac

SEQ ID NO: 1319127 - RNA, 14 nt, Human
cuguuuuguugaca

SEQ ID NO: 1319128 - RNA, 16 nt, Human
cuguuuuguugacauu

SEQ ID NO: 1319129 - RNA, 17 nt, Human
cuguuuuguugacauuc

SEQ ID NO: 1319130 - RNA, 19 nt, Human
cuguuuuguugacauucug

SEQ ID NO: 1319131 - RNA, 20 nt, Human
cuguuuuguugacauucuga

SEQ ID NO: 1319132 - RNA, 21 nt, Human
cuguuuuguugacauucugaa

SEQ ID NO: 1319133 - RNA, 22 nt, Human
cuguuuuguugacauucugaau

SEQ ID NO: 1319134 - RNA, 16 nt, Human
cuguuuuguuucgcuc

SEQ ID NO: 1319135 - RNA, 23 nt, Human
cuguuuuguuucgcucuuugaga

SEQ ID NO: 1319136 - RNA, 15 nt, Human
cuguuuuucggacag

SEQ ID NO: 1319137 - RNA, 17 nt, Human
cuguuuuucggacaguu

SEQ ID NO: 1319138 - RNA, 20 nt, Human
cuguuuuucggacaguuuau

SEQ ID NO: 1319139 - RNA, 17 nt, Human
cuguuuuucuaacuggg

SEQ ID NO: 1319140 - RNA, 22 nt, Human
cuguuuuucggacaguuuauuu

SEQ ID NO: 1319141 - RNA, 16 nt, Human
cuguuuccuagcugug

SEQ ID NO: 1319142 - RNA, 20 nt, Human
cuguuuauucauaugcauau

SEQ ID NO: 1319143 - RNA, 17 nt, Human
cuguuuauucauaugca

SEQ ID NO: 1319144 - RNA, 16 nt, Human
cuguuuauucauaugc

SEQ ID NO: 1319145 - RNA, 18 nt, Human
cuguuuauuaaucuuagu

SEQ ID NO: 1319146 - RNA, 16 nt, Human
cuguuucccaggccca

SEQ ID NO: 1319147 - RNA, 17 nt, Human
cuguuuccuagcugugu

SEQ ID NO: 1319148 - RNA, 22 nt, Human
cuguuuauuaaaguacaaccau

SEQ ID NO: 1319149 - RNA, 14 nt, Human
cuguuuauuaaucu

SEQ ID NO: 1319150 - RNA, 16 nt, Human
cuguuuauuaaucuua

SEQ ID NO: 1319151 - RNA, 15 nt, Human
cuguuuacugcaagg

SEQ ID NO: 1319152 - RNA, 17 nt, Human
cuguuuacugcaagguu

SEQ ID NO: 1319153 - RNA, 13 nt, Human
cuguuuagaacac

SEQ ID NO: 1319154 - RNA, 14 nt, Human
cuguuuagaacaca

SEQ ID NO: 1319155 - RNA, 20 nt, Human
cuguuuaguagcagugauug

SEQ ID NO: 1319156 - RNA, 17 nt, Human
cugguugggcagccaga

SEQ ID NO: 1319157 - RNA, 13 nt, Human
cugguugggcagc

SEQ ID NO: 1319158 - RNA, 17 nt, Human
cugguugaugccuguga

SEQ ID NO: 1319159 - RNA, 17 nt, Human
cugguucucaauuccaa

SEQ ID NO: 1319160 - RNA, 20 nt, Human
cugguucuuguguuggcugu

SEQ ID NO: 1319161 - RNA, 14 nt, Human
cuguuuuuuuguua

SEQ ID NO: 1319162 - RNA, 22 nt, Human
cuuaaaugcaaccauuugaaac

SEQ ID NO: 1319163 - RNA, 16 nt, Human
cuuaaauguuauuauc

SEQ ID NO: 1319164 - RNA, 16 nt, Human
cuuaacggaccaaagc

SEQ ID NO: 1319165 - RNA, 17 nt, Human
cuuaacggaccaaagca

SEQ ID NO: 1319166 - RNA, 20 nt, Human
cuuaacggaccaaagcaaga

SEQ ID NO: 1319167 - RNA, 16 nt, Human
cuuaacuggucuccuu

SEQ ID NO: 1319168 - RNA, 21 nt, Human
cuuaagaagacugcauuauau

SEQ ID NO: 1319169 - RNA, 14 nt, Human
cuuaacuucuugcu

SEQ ID NO: 1319170 - RNA, 15 nt, Human
cuuaacuucuugcuu

SEQ ID NO: 1319171 - RNA, 18 nt, Human
cuuaacuucuugcuucuu

SEQ ID NO: 1319172 - RNA, 21 nt, Human
cuuaacuucuugcuucuuucu

SEQ ID NO: 1319173 - RNA, 22 nt, Human
cuuaacuucuugcuucuuucua

SEQ ID NO: 1319174 - RNA, 15 nt, Human
cuuaagcaucuggcu

SEQ ID NO: 1319175 - RNA, 17 nt, Human
cuuaagcaucuggcucu

SEQ ID NO: 1319176 - RNA, 18 nt, Human
cuuaagcaucuggcucua

SEQ ID NO: 1319177 - RNA, 23 nt, Human
cuuaagcaucuggcucuaauuca

SEQ ID NO: 1319178 - RNA, 19 nt, Human
cuuaagcccagugcacuga

SEQ ID NO: 1319179 - RNA, 22 nt, Human
cuuaagcccagugcacugaaag

SEQ ID NO: 1319180 - RNA, 18 nt, Human
cuuaagucagaacagcag

SEQ ID NO: 1319181 - RNA, 17 nt, Human
cuuaagucagaacagca

SEQ ID NO: 1319182 - RNA, 16 nt, Human
cuuaagugcugcaauu

SEQ ID NO: 1319183 - RNA, 18 nt, Human
cuuaaugccacuaaauug

SEQ ID NO: 1319184 - RNA, 16 nt, Human
cuuaaguuuauacucu

SEQ ID NO: 1319185 - RNA, 19 nt, Human
cuuaaguuaguuccacuga

SEQ ID NO: 1319186 - RNA, 21 nt, Human
cuuaaguuaguuccacugaga

SEQ ID NO: 1319187 - RNA, 21 nt, Human
cuuaaucagauagauauuccu

SEQ ID NO: 1319188 - RNA, 20 nt, Human
cuuaaucagguccucagaga

SEQ ID NO: 1319189 - RNA, 22 nt, Human
cuuaaucagguccucagagaau

SEQ ID NO: 1319190 - RNA, 19 nt, Human
cuuauaguacaugauaaau

SEQ ID NO: 1319191 - RNA, 21 nt, Human
cuuauacaauuaugaagauuu

SEQ ID NO: 1319192 - RNA, 14 nt, Human
cuuauaguuacugu

SEQ ID NO: 1319193 - RNA, 17 nt, Human
cuuauaguacaugauaa

SEQ ID NO: 1319194 - RNA, 13 nt, Human
cuuauaguacaug

SEQ ID NO: 1319195 - RNA, 14 nt, Human
cuuauaauuguucu

SEQ ID NO: 1319196 - RNA, 21 nt, Human
cuuauaauuguucucagaauc

SEQ ID NO: 1319197 - RNA, 15 nt, Human
cuuauaguuacugug

SEQ ID NO: 1319198 - RNA, 16 nt, Human
cuuauaguuacugugu

SEQ ID NO: 1319199 - RNA, 18 nt, Human
cuuauaguuacuguguaa

SEQ ID NO: 1319200 - RNA, 19 nt, Human
cuuauaguuacuguguaau

SEQ ID NO: 1319201 - RNA, 21 nt, Human
cuuauaguuacuguguaauua

SEQ ID NO: 1319202 - RNA, 14 nt, Human
cuuauaguucuagg

SEQ ID NO: 1319203 - RNA, 15 nt, Human
cuuauaguucuaggc

SEQ ID NO: 1319204 - RNA, 16 nt, Human
cuuauaguucuaggca

SEQ ID NO: 1319205 - RNA, 14 nt, Human
cuuauaauuuaaaa

SEQ ID NO: 1319206 - RNA, 17 nt, Human
cuuauaauaaaggacug

SEQ ID NO: 1319207 - RNA, 22 nt, Human
cuuauaauucuuucaauacaga

SEQ ID NO: 1319208 - RNA, 20 nt, Human
cuuauaauaaaggacuguaa

SEQ ID NO: 1319209 - RNA, 16 nt, Human
cuuauaauaaaggacu

SEQ ID NO: 1319210 - RNA, 14 nt, Human
cuuauaauaaagga

SEQ ID NO: 1319211 - RNA, 13 nt, Human
cuuauaauuuaaa

SEQ ID NO: 1319212 - RNA, 21 nt, Human
cuuaggguuaugauuaaguaa

SEQ ID NO: 1319213 - RNA, 20 nt, Human
cuuaggugauccacucgccu

SEQ ID NO: 1319214 - RNA, 21 nt, Human
cuuagaucuggcauguuagcc

SEQ ID NO: 1319215 - RNA, 12 nt, Human
cuuauuuucaag

SEQ ID NO: 1319216 - RNA, 14 nt, Human
cuuauuuucaagaa

SEQ ID NO: 1319217 - RNA, 15 nt, Human
cuuauuuucaagaaa

SEQ ID NO: 1319218 - RNA, 18 nt, Human
cuuauuuucaagaaacug

SEQ ID NO: 1319219 - RNA, 19 nt, Human
cuuauuuucaagaaacuga

SEQ ID NO: 1319220 - RNA, 18 nt, Human
cuuaugaaaagaauuguu

SEQ ID NO: 1319221 - RNA, 21 nt, Human
cuuaugaaaagaauuguuggg

SEQ ID NO: 1319222 - RNA, 13 nt, Human
cuuaugaaaugug

SEQ ID NO: 1319223 - RNA, 21 nt, Human
cuuaugacaucacuuguacaa

SEQ ID NO: 1319224 - RNA, 22 nt, Human
cuuaugacaucacuuguacaaa

SEQ ID NO: 1319225 - RNA, 23 nt, Human
cuuaugauagcaaauggccucau

SEQ ID NO: 1319226 - RNA, 14 nt, Human
cuuaucaaaggaca

SEQ ID NO: 1319227 - RNA, 14 nt, Human
cuuauauuguucac

SEQ ID NO: 1319228 - RNA, 16 nt, Human
cuuauauuguucacuu

SEQ ID NO: 1319229 - RNA, 16 nt, Human
cuuaucaaaggacacc

SEQ ID NO: 1319230 - RNA, 22 nt, Human
cuuaucugaucagaacaaaugu

SEQ ID NO: 1319231 - RNA, 11 nt, Human
cuuaugaaaag

SEQ ID NO: 1319232 - RNA, 13 nt, Human
cuuaugaaaagaa

SEQ ID NO: 1319233 - RNA, 14 nt, Human
cuuaugaaaagaau

SEQ ID NO: 1319234 - RNA, 19 nt, Human
cuuagaugcaguucugaag

SEQ ID NO: 1319235 - RNA, 20 nt, Human
cuuagaugcaguucugaaga

SEQ ID NO: 1319236 - RNA, 15 nt, Human
cuuagaucuggcaug

SEQ ID NO: 1319237 - RNA, 16 nt, Human
cuuagaucuggcaugu

SEQ ID NO: 1319238 - RNA, 20 nt, Human
cuuagaccaccaagccuuga

SEQ ID NO: 1319239 - RNA, 17 nt, Human
cuuagaguuggccauau

SEQ ID NO: 1319240 - RNA, 15 nt, Human
cuuagaccaccaagc

SEQ ID NO: 1319241 - RNA, 17 nt, Human
cuuagaccaccaagccu

SEQ ID NO: 1319242 - RNA, 19 nt, Human
cuuagaccaccaagccuug

SEQ ID NO: 1319243 - RNA, 17 nt, Human
cuuagaaauugcauuuc

SEQ ID NO: 1319244 - RNA, 16 nt, Human
cuuacuuuuuauauau

SEQ ID NO: 1319245 - RNA, 17 nt, Human
cuuacuuuuuauauaua

SEQ ID NO: 1319246 - RNA, 14 nt, Human
cuuacuuuuuauau

SEQ ID NO: 1319247 - RNA, 15 nt, Human
cuuagaaccuuucuu

SEQ ID NO: 1319248 - RNA, 19 nt, Human
cuuacuaguuucccuugca

SEQ ID NO: 1319249 - RNA, 15 nt, Human
cuuaauguacauagu

SEQ ID NO: 1319250 - RNA, 13 nt, Human
cuuaauguacaua

SEQ ID NO: 1319251 - RNA, 17 nt, Human
cuuaauguauguuacca

SEQ ID NO: 1319252 - RNA, 14 nt, Human
cuuaauguaucaaa

SEQ ID NO: 1319253 - RNA, 16 nt, Human
cuuaauguaucaaacu

SEQ ID NO: 1319254 - RNA, 18 nt, Human
cuuaauguaucaaacugu

SEQ ID NO: 1319255 - RNA, 23 nt, Human
cuuaauguaucaaacuguauaac

SEQ ID NO: 1319256 - RNA, 14 nt, Human
cuuaauguauguua

SEQ ID NO: 1319257 - RNA, 16 nt, Human
cuuaauggcugauaau

SEQ ID NO: 1319258 - RNA, 20 nt, Human
cuuaauggcugauaauuuua

SEQ ID NO: 1319259 - RNA, 22 nt, Human
cuuaauggcugauaauuuuaaa

SEQ ID NO: 1319260 - RNA, 21 nt, Human
cuuaauguauguuaccaaaaa

SEQ ID NO: 1319261 - RNA, 19 nt, Human
cuuaccuuuuuauuugcau

SEQ ID NO: 1319262 - RNA, 23 nt, Human
cuuacgaauacuuuugcccuuug

SEQ ID NO: 1319263 - RNA, 20 nt, Human
cuuaccuuuuuauuugcaug

SEQ ID NO: 1319264 - RNA, 15 nt, Human
cuuacuccuguggga

SEQ ID NO: 1319265 - RNA, 15 nt, Human
cuuacucccaggcac

SEQ ID NO: 1319266 - RNA, 12 nt, Human
cuuacuccugug

SEQ ID NO: 1319267 - RNA, 13 nt, Human
cuuacuccugugg

SEQ ID NO: 1319268 - RNA, 14 nt, Human
cuuacuccuguggg

SEQ ID NO: 1319269 - RNA, 16 nt, Human
cuuacuccugugggag

SEQ ID NO: 1319270 - RNA, 23 nt, Human
cuuacuuaaacccagcucccuuc

SEQ ID NO: 1319271 - RNA, 18 nt, Human
cuuacuuauuaucuucag

SEQ ID NO: 1319272 - RNA, 14 nt, Human
cuuacuucucacua

SEQ ID NO: 1319273 - RNA, 19 nt, Human
cuuacuuggaacugaaggg

SEQ ID NO: 1319274 - RNA, 14 nt, Human
cuuacuuggaacug

SEQ ID NO: 1319275 - RNA, 20 nt, Human
cuugcuugauuguauggugg

SEQ ID NO: 1319276 - RNA, 21 nt, Human
cuugcugcaguaugaaaauaa

SEQ ID NO: 1319277 - RNA, 21 nt, Human
cuugcugaaacgcaucuaguu

SEQ ID NO: 1319278 - RNA, 22 nt, Human
cuugcugaaacgcaucuaguuc

SEQ ID NO: 1319279 - RNA, 20 nt, Human
cuugcugcaagcacagcccu

SEQ ID NO: 1319280 - RNA, 21 nt, Human
cuugcugcaagcacagcccuu

SEQ ID NO: 1319281 - RNA, 13 nt, Human
cuugcuucccuaa

SEQ ID NO: 1319282 - RNA, 17 nt, Human
cuugcuucccuaaucua

SEQ ID NO: 1319283 - RNA, 14 nt, Human
cuugcuucuuucua

SEQ ID NO: 1319284 - RNA, 15 nt, Human
cuugcuucuuucuag

SEQ ID NO: 1319285 - RNA, 18 nt, Human
cuugcuucuuucuagaaa

SEQ ID NO: 1319286 - RNA, 19 nt, Human
cuugcuucuuucuagaaag

SEQ ID NO: 1319287 - RNA, 19 nt, Human
cuugcucuugaugccuggc

SEQ ID NO: 1319288 - RNA, 18 nt, Human
cuugcucuugaugccugg

SEQ ID NO: 1319289 - RNA, 17 nt, Human
cuugcucuugaugccug

SEQ ID NO: 1319290 - RNA, 23 nt, Human
cuugccacaccccccaccccuag

SEQ ID NO: 1319291 - RNA, 19 nt, Human
cuugccacaccccccaccc

SEQ ID NO: 1319292 - RNA, 13 nt, Human
cuugccacacccc

SEQ ID NO: 1319293 - RNA, 20 nt, Human
cuugccaaggcagaggccug

SEQ ID NO: 1319294 - RNA, 19 nt, Human
cuugccaaggcagaggccu

SEQ ID NO: 1319295 - RNA, 13 nt, Human
cuugccacugccu

SEQ ID NO: 1319296 - RNA, 13 nt, Human
cuugccaaauuua

SEQ ID NO: 1319297 - RNA, 14 nt, Human
cuugccaaggcaga

SEQ ID NO: 1319298 - RNA, 17 nt, Human
cuugccaaggcagaggc

SEQ ID NO: 1319299 - RNA, 19 nt, Human
cuugaggggaagcuagucu

SEQ ID NO: 1319300 - RNA, 21 nt, Human
cuugaggggaagcuagucuuu

SEQ ID NO: 1319301 - RNA, 23 nt, Human
cuugaggggaagcuagucuuuug

SEQ ID NO: 1319302 - RNA, 15 nt, Human
cuugaggggaccagg

SEQ ID NO: 1319303 - RNA, 16 nt, Human
cuugaggggaccagga

SEQ ID NO: 1319304 - RNA, 17 nt, Human
cuugaggggaccaggag

SEQ ID NO: 1319305 - RNA, 18 nt, Human
cuugaggggaccaggagu

SEQ ID NO: 1319306 - RNA, 21 nt, Human
cuugaggggaccaggaguggg

SEQ ID NO: 1319307 - RNA, 17 nt, Human
cuucuggcacuuggaga

SEQ ID NO: 1319308 - RNA, 12 nt, Human
cuucuggccagg

SEQ ID NO: 1319309 - RNA, 16 nt, Human
cuucuggauggauuuu

SEQ ID NO: 1319310 - RNA, 18 nt, Human
cuucuggauggauuuuau

SEQ ID NO: 1319311 - RNA, 22 nt, Human
cuucuggccaggaagcuuuggu

SEQ ID NO: 1319312 - RNA, 13 nt, Human
cuucuggccagga

SEQ ID NO: 1319313 - RNA, 15 nt, Human
cuucuggccaggaag

SEQ ID NO: 1319314 - RNA, 13 nt, Human
cuucuggccuugu

SEQ ID NO: 1319315 - RNA, 17 nt, Human
cuucuggccaggaagcu

SEQ ID NO: 1319316 - RNA, 15 nt, Human
cuucugggagggcag

SEQ ID NO: 1319317 - RNA, 19 nt, Human
cuucugggagggcagcagg

SEQ ID NO: 1319318 - RNA, 18 nt, Human
cuugagaaaccccucgau

SEQ ID NO: 1319319 - RNA, 22 nt, Human
cuugagaaauauggacacuuaa

SEQ ID NO: 1319320 - RNA, 19 nt, Human
cuugaggggaccaggagug

SEQ ID NO: 1319321 - RNA, 13 nt, Human
cuugagggggaag

SEQ ID NO: 1319322 - RNA, 20 nt, Human
cuugagggggaaggauucug

SEQ ID NO: 1319323 - RNA, 15 nt, Human
cuugcacagucacug

SEQ ID NO: 1319324 - RNA, 19 nt, Human
cuugcacagucacugcucu

SEQ ID NO: 1319325 - RNA, 23 nt, Human
cuugcacagucacugcucuucag

SEQ ID NO: 1319326 - RNA, 22 nt, Human
cuugcaccccaaagcuuuccug

SEQ ID NO: 1319327 - RNA, 23 nt, Human
cuugcaccccaaagcuuuccugc

SEQ ID NO: 1319328 - RNA, 16 nt, Human
cuuggggcugaugcag

SEQ ID NO: 1319329 - RNA, 16 nt, Human
cuugggcucugaugaa

SEQ ID NO: 1319330 - RNA, 17 nt, Human
cuugggcucugaugaaa

SEQ ID NO: 1319331 - RNA, 18 nt, Human
cuugggcucugaugaaaa

SEQ ID NO: 1319332 - RNA, 17 nt, Human
cuugggccuaggcugca

SEQ ID NO: 1319333 - RNA, 23 nt, Human
cuugggcucagggaccauggcuu

SEQ ID NO: 1319334 - RNA, 13 nt, Human
cuugggcucccug

SEQ ID NO: 1319335 - RNA, 21 nt, Human
cuugggcucccuguaaccucu

SEQ ID NO: 1319336 - RNA, 21 nt, Human
cuugggcuccgugugggagac

SEQ ID NO: 1319337 - RNA, 13 nt, Human
cuugggcucugau

SEQ ID NO: 1319338 - RNA, 18 nt, Human
cuuggggcugaugcaguu

SEQ ID NO: 1319339 - RNA, 18 nt, Human
cuuggggcucacacaccu

SEQ ID NO: 1319340 - RNA, 16 nt, Human
cuuggggcuggagagg

SEQ ID NO: 1319341 - RNA, 19 nt, Human
cuugguugguaggguggga

SEQ ID NO: 1319342 - RNA, 15 nt, Human
cuugguugucuggca

SEQ ID NO: 1319343 - RNA, 15 nt, Human
cuugguuugccuucc

SEQ ID NO: 1319344 - RNA, 10 nt, Human
cuuguaauua

SEQ ID NO: 1319345 - RNA, 11 nt, Human
cuuguaauuau

SEQ ID NO: 1319346 - RNA, 14 nt, Human
cuuguaauuaugga

SEQ ID NO: 1319347 - RNA, 13 nt, Human
cuuguaauucuaa

SEQ ID NO: 1319348 - RNA, 15 nt, Human
cuuguaauucuaaau

SEQ ID NO: 1319349 - RNA, 12 nt, Human
cuuguacaaaau

SEQ ID NO: 1319350 - RNA, 16 nt, Human
cuuguaauucuaaaug

SEQ ID NO: 1319351 - RNA, 23 nt, Human
cuuguaauucuaaaugaauguuu

SEQ ID NO: 1319352 - RNA, 18 nt, Human
cuuguaauuauggaguca

SEQ ID NO: 1319353 - RNA, 22 nt, Human
cuuguaauuuuacacgcuuuug

SEQ ID NO: 1319354 - RNA, 22 nt, Human
cuuguaauuuuuuuaauuuaca

SEQ ID NO: 1319355 - RNA, 13 nt, Human
cuuguacaaaaua

SEQ ID NO: 1319356 - RNA, 17 nt, Human
cuugggauuugcugugu

SEQ ID NO: 1319357 - RNA, 13 nt, Human
cuugggcaccccc

SEQ ID NO: 1319358 - RNA, 17 nt, Human
cuugggcacccccagcc

SEQ ID NO: 1319359 - RNA, 18 nt, Human
cuugggcacccccagccu

SEQ ID NO: 1319360 - RNA, 19 nt, Human
cuugggcacccccagccug

SEQ ID NO: 1319361 - RNA, 20 nt, Human
cuugggcacccccagccugg

SEQ ID NO: 1319362 - RNA, 22 nt, Human
cuugggcacccccagccugggc

SEQ ID NO: 1319363 - RNA, 13 nt, Human
cuugggcagagcu

SEQ ID NO: 1319364 - RNA, 21 nt, Human
cuugggcacccccagccuggg

SEQ ID NO: 1319365 - RNA, 15 nt, Human
cuugggccagaagua

SEQ ID NO: 1319366 - RNA, 23 nt, Human
cuugggccagaaguaccagacua

SEQ ID NO: 1319367 - RNA, 15 nt, Human
cuugggcccacaccu

SEQ ID NO: 1319368 - RNA, 18 nt, Human
cuugggcccacaccuccu

SEQ ID NO: 1319369 - RNA, 16 nt, Human
cuugggcccacaccuc

SEQ ID NO: 1319370 - RNA, 14 nt, Human
cuugggcccuuuga

SEQ ID NO: 1319371 - RNA, 16 nt, Human
cuugggcccuuugagu

SEQ ID NO: 1319372 - RNA, 17 nt, Human
cuugggcccuuugagug

SEQ ID NO: 1319373 - RNA, 19 nt, Human
cuugggcccuuugagugca

SEQ ID NO: 1319374 - RNA, 15 nt, Human
cuuggacacgcucag

SEQ ID NO: 1319375 - RNA, 14 nt, Human
cuuggacaaaucac

SEQ ID NO: 1319376 - RNA, 22 nt, Human
cuuggagccaauggagacuguc

SEQ ID NO: 1319377 - RNA, 19 nt, Human
cuuggagaagucucagcua

SEQ ID NO: 1319378 - RNA, 17 nt, Human
cuuggagaagucucagc

SEQ ID NO: 1319379 - RNA, 18 nt, Human
cuuggagaagucucagcu

SEQ ID NO: 1319380 - RNA, 13 nt, Human
cuuguucugucac

SEQ ID NO: 1319381 - RNA, 14 nt, Human
cuuguuacuucuga

SEQ ID NO: 1319382 - RNA, 15 nt, Human
cuuguuacuucugag

SEQ ID NO: 1319383 - RNA, 17 nt, Human
cuuguuacuucugaggu

SEQ ID NO: 1319384 - RNA, 15 nt, Human
cuuguggggccuggg

SEQ ID NO: 1319385 - RNA, 16 nt, Human
cuuguggggccuggga

SEQ ID NO: 1319386 - RNA, 18 nt, Human
cuuguggggccugggagg

SEQ ID NO: 1319387 - RNA, 17 nt, Human
cuuguggggccugggag

SEQ ID NO: 1319388 - RNA, 22 nt, Human
cuugucgccccucccucccaga

SEQ ID NO: 1319389 - RNA, 20 nt, Human
cuuguccuuagccuggaccu

SEQ ID NO: 1319390 - RNA, 14 nt, Human
cuuguggggccugg

SEQ ID NO: 1319391 - RNA, 20 nt, Human
cuuguccuagcacagauggc

SEQ ID NO: 1319392 - RNA, 17 nt, Human
cuuguccuagcacagau

SEQ ID NO: 1319393 - RNA, 14 nt, Human
cuuguccuuagccu

SEQ ID NO: 1319394 - RNA, 16 nt, Human
cuuguccuuagccugg

SEQ ID NO: 1319395 - RNA, 17 nt, Human
cuuguccuuagccugga

SEQ ID NO: 1319396 - RNA, 18 nt, Human
cuuguccuuagccuggac

SEQ ID NO: 1319397 - RNA, 19 nt, Human
cuuguccuuagccuggacc

SEQ ID NO: 1319398 - RNA, 14 nt, Human
cuuguccuuucccu

SEQ ID NO: 1319399 - RNA, 15 nt, Human
cuuguccuuucccuu

SEQ ID NO: 1319400 - RNA, 13 nt, Human
cuuguagccagcc

SEQ ID NO: 1319401 - RNA, 14 nt, Human
cuuguagccagccg

SEQ ID NO: 1319402 - RNA, 15 nt, Human
cuuguagccagccgg

SEQ ID NO: 1319403 - RNA, 16 nt, Human
cuuguagccagccggg

SEQ ID NO: 1319404 - RNA, 21 nt, Human
cuuguagccagccggggcgag

SEQ ID NO: 1319405 - RNA, 21 nt, Human
cuuguagcccuuuccaagcuu

SEQ ID NO: 1319406 - RNA, 13 nt, Human
cuuguagcuccuc

SEQ ID NO: 1319407 - RNA, 14 nt, Human
cuuguagcuccucc

SEQ ID NO: 1319408 - RNA, 16 nt, Human
cuuguagcuccucccc

SEQ ID NO: 1319409 - RNA, 18 nt, Human
cuuguagcuccuccccug

SEQ ID NO: 1319410 - RNA, 19 nt, Human
cuuguagcuccuccccugg

SEQ ID NO: 1319411 - RNA, 23 nt, Human
cuuguagcuccuccccuggaggg

SEQ ID NO: 1319412 - RNA, 21 nt, Human
cuuguagcuccuccccuggag

SEQ ID NO: 1319413 - RNA, 16 nt, Human
cuuguccuagcacaga

SEQ ID NO: 1319414 - RNA, 13 nt, Human
cuuguuucauauu

SEQ ID NO: 1319415 - RNA, 22 nt, Human
cuuguuucaauuccaccugcaa

SEQ ID NO: 1319416 - RNA, 17 nt, Human
cuuguuuacaugcuuau

SEQ ID NO: 1319417 - RNA, 18 nt, Human
cuuguuuacaugcuuauu

SEQ ID NO: 1319418 - RNA, 21 nt, Human
cuuguuuacaugcuuauucca

SEQ ID NO: 1319419 - RNA, 12 nt, Human
cuuguuucaauu

SEQ ID NO: 1319420 - RNA, 17 nt, Human
cuuguuugcuucaacug

SEQ ID NO: 1319421 - RNA, 14 nt, Human
cuuguuuggggcag

SEQ ID NO: 1319422 - RNA, 19 nt, Human
cuuguugagccgugggcaa

SEQ ID NO: 1319423 - RNA, 13 nt, Human
cuuguugagccgu

SEQ ID NO: 1319424 - RNA, 18 nt, Human
cuuguugagccgugggca

SEQ ID NO: 1319425 - RNA, 14 nt, Human
cuuguuuacaugcu

SEQ ID NO: 1319426 - RNA, 16 nt, Human
cuuguuuacaugcuua

SEQ ID NO: 1319427 - RNA, 22 nt, Human
cuuguuuacaugcuuauuccau

SEQ ID NO: 1319428 - RNA, 22 nt, Human
cuuuaaaaaauuaaucugggcc

SEQ ID NO: 1319429 - RNA, 21 nt, Human
cuuuaaaaagcuccaaaugca

SEQ ID NO: 1319430 - RNA, 16 nt, Human
cuuuaaaaaugucuua

SEQ ID NO: 1319431 - RNA, 18 nt, Human
cuuuaaaaaugucuuauu

SEQ ID NO: 1319432 - RNA, 23 nt, Human
cuuuagaaucccagcccccugac

SEQ ID NO: 1319433 - RNA, 17 nt, Human
cuuugacaaagguaaau

SEQ ID NO: 1319434 - RNA, 15 nt, Human
cuuugaaaaaaaaua

SEQ ID NO: 1319435 - RNA, 13 nt, Human
cuuugaaacagaa

SEQ ID NO: 1319436 - RNA, 19 nt, Human
cuuucuuuuuuuuuuuuga

SEQ ID NO: 1319437 - RNA, 23 nt, Human
cuuucuuuuuuggccaucugcuc

SEQ ID NO: 1319438 - RNA, 17 nt, Human
cuuugaaaaaaaauaaa

SEQ ID NO: 1319439 - RNA, 16 nt, Human
cuuucuuuuuguagcu

SEQ ID NO: 1319440 - RNA, 21 nt, Human
cuuucuuuuuguagcuggggc

SEQ ID NO: 1319441 - RNA, 22 nt, Human
cuuucuuuuuguagcuggggcu

SEQ ID NO: 1319442 - RNA, 15 nt, Human
cuuucuuuuuugaua

SEQ ID NO: 1319443 - RNA, 16 nt, Human
cuuucuuuuuugauau

SEQ ID NO: 1319444 - RNA, 18 nt, Human
cuuucuuuuuuggccauc

SEQ ID NO: 1319445 - RNA, 19 nt, Human
cuuucuuuuuuggccaucu

SEQ ID NO: 1319446 - RNA, 17 nt, Human
cuuucuuuaaaguucuu

SEQ ID NO: 1319447 - RNA, 18 nt, Human
cuuucugucuucuacaga

SEQ ID NO: 1319448 - RNA, 16 nt, Human
cuuucuuccucugcug

SEQ ID NO: 1319449 - RNA, 22 nt, Human
cuuucuguuccaaauucaguuu

SEQ ID NO: 1319450 - RNA, 12 nt, Human
cuuucuguucca

SEQ ID NO: 1319451 - RNA, 13 nt, Human
cuuucuguuccaa

SEQ ID NO: 1319452 - RNA, 14 nt, Human
cuuucuguuccaaa

SEQ ID NO: 1319453 - RNA, 15 nt, Human
cuuucuguuccaaau

SEQ ID NO: 1319454 - RNA, 16 nt, Human
cuuucuguuccaaauu

SEQ ID NO: 1319455 - RNA, 20 nt, Human
cuuucuguuccaaauucagu

SEQ ID NO: 1319456 - RNA, 20 nt, Human
cuuucugaucaaggccuuau

SEQ ID NO: 1319457 - RNA, 11 nt, Human
cuuucugccug

SEQ ID NO: 1319458 - RNA, 12 nt, Human
cuuucugccugg

SEQ ID NO: 1319459 - RNA, 14 nt, Human
cuuucugccuggag

SEQ ID NO: 1319460 - RNA, 15 nt, Human
cuuucugccuggagu

SEQ ID NO: 1319461 - RNA, 19 nt, Human
cuuucuguauauacuuuuu

SEQ ID NO: 1319462 - RNA, 20 nt, Human
cuuucuguauauacuuuuuu

SEQ ID NO: 1319463 - RNA, 22 nt, Human
cuuuccuccucaggcacacagc

SEQ ID NO: 1319464 - RNA, 13 nt, Human
cuuuccucgccug

SEQ ID NO: 1319465 - RNA, 20 nt, Human
cuuucucuuuuccucuacca

SEQ ID NO: 1319466 - RNA, 13 nt, Human
cuuucugaacagc

SEQ ID NO: 1319467 - RNA, 14 nt, Human
cuuucugaacagcu

SEQ ID NO: 1319468 - RNA, 15 nt, Human
cuuucugaacagcug

SEQ ID NO: 1319469 - RNA, 16 nt, Human
cuuucugaacagcugg

SEQ ID NO: 1319470 - RNA, 17 nt, Human
cuuucugaacagcuggu

SEQ ID NO: 1319471 - RNA, 18 nt, Human
cuuucugaacagcuggug

SEQ ID NO: 1319472 - RNA, 19 nt, Human
cuuucugaacagcuggugu

SEQ ID NO: 1319473 - RNA, 20 nt, Human
cuuucugaacagcuggugua

SEQ ID NO: 1319474 - RNA, 21 nt, Human
cuuucugaacagcugguguag

SEQ ID NO: 1319475 - RNA, 23 nt, Human
cuuucugaacagcugguguagcu

SEQ ID NO: 1319476 - RNA, 17 nt, Human
cuuucugaauugcacau

SEQ ID NO: 1319477 - RNA, 14 nt, Human
cuuucugaauugca

SEQ ID NO: 1319478 - RNA, 15 nt, Human
cuuucugaucaaggc

SEQ ID NO: 1319479 - RNA, 16 nt, Human
cuuucugaucaaggcc

SEQ ID NO: 1319480 - RNA, 17 nt, Human
cuuucugaucaaggccu

SEQ ID NO: 1319481 - RNA, 18 nt, Human
cuuucugaucaaggccuu

SEQ ID NO: 1319482 - RNA, 19 nt, Human
cuuuagagaaguauacaua

SEQ ID NO: 1319483 - RNA, 22 nt, Human
cuuuagagaaguauacauaagu

SEQ ID NO: 1319484 - RNA, 15 nt, Human
cuuuaggagcagugg

SEQ ID NO: 1319485 - RNA, 23 nt, Human
cuuuaggcauuaaauuuuagcaa

SEQ ID NO: 1319486 - RNA, 15 nt, Human
cuuuaggcauuaaau

SEQ ID NO: 1319487 - RNA, 24 nt, Human
cuuuggcaggugcagcccccacug

SEQ ID NO: 1319488 - RNA, 13 nt, Human
cuuuggcaggugc

SEQ ID NO: 1319489 - RNA, 13 nt, Human
cuuuggauuugac

SEQ ID NO: 1319490 - RNA, 15 nt, Human
cuuuggauuugacau

SEQ ID NO: 1319491 - RNA, 16 nt, Human
cuuuggauuugacauu

SEQ ID NO: 1319492 - RNA, 17 nt, Human
cuuuggauuugacauug

SEQ ID NO: 1319493 - RNA, 12 nt, Human
cuuugggccaga

SEQ ID NO: 1319494 - RNA, 13 nt, Human
cuuugggccagac

SEQ ID NO: 1319495 - RNA, 21 nt, Human
cuuugggccagacaugccaca

SEQ ID NO: 1319496 - RNA, 19 nt, Human
cuuugugagucaauacaua

SEQ ID NO: 1319497 - RNA, 13 nt, Human
cuuugugagucaa

SEQ ID NO: 1319498 - RNA, 22 nt, Human
cuuugugauucaaucuguaaac

SEQ ID NO: 1319499 - RNA, 23 nt, Human
cuuugugauucaaucuguaaacu

SEQ ID NO: 1319500 - RNA, 16 nt, Human
cuuuguguagcuuugc

SEQ ID NO: 1319501 - RNA, 18 nt, Human
cuuuguguagcuuugcuc

SEQ ID NO: 1319502 - RNA, 23 nt, Human
cuuugcuucauucaagucagcuc

SEQ ID NO: 1319503 - RNA, 12 nt, Human
cuuugcuugcuu

SEQ ID NO: 1319504 - RNA, 13 nt, Human
cuuugcuugcuuu

SEQ ID NO: 1319505 - RNA, 18 nt, Human
cuuugcuugcuuugaagu

SEQ ID NO: 1319506 - RNA, 19 nt, Human
cuuugcuugcuuugaagua

SEQ ID NO: 1319507 - RNA, 16 nt, Human
cuuugcuuuaauauaa

SEQ ID NO: 1319508 - RNA, 17 nt, Human
cuuugcuuuaauauaaa

SEQ ID NO: 1319509 - RNA, 18 nt, Human
cuuugcuuuaauauaaau

SEQ ID NO: 1319510 - RNA, 19 nt, Human
cuuugcuuuaauauaaaug

SEQ ID NO: 1319511 - RNA, 21 nt, Human
cuuugcuuuaauauaaaugca

SEQ ID NO: 1319512 - RNA, 18 nt, Human
cuuugccacccucaugcu

SEQ ID NO: 1319513 - RNA, 12 nt, Human
cuuugcuucauu

SEQ ID NO: 1319514 - RNA, 17 nt, Human
cuuugccacccucaugc

SEQ ID NO: 1319515 - RNA, 16 nt, Human
cuuugccacccucaug

SEQ ID NO: 1319516 - RNA, 14 nt, Human
cuuugcauuuugga

SEQ ID NO: 1319517 - RNA, 22 nt, Human
cuuugcaucucaguaugaauua

SEQ ID NO: 1319518 - RNA, 16 nt, Human
cuuugcaucucaguau

SEQ ID NO: 1319519 - RNA, 15 nt, Human
cuuugcauggauuuc

SEQ ID NO: 1319520 - RNA, 17 nt, Human
cuuugcauggauuucuu

SEQ ID NO: 1319521 - RNA, 22 nt, Human
cuuugcauggauuucuuugaaa

SEQ ID NO: 1319522 - RNA, 19 nt, Human
cuuugacaaagguaaauca

SEQ ID NO: 1319523 - RNA, 20 nt, Human
cuuugaaagguuagagaaua

SEQ ID NO: 1319524 - RNA, 21 nt, Human
cuuugaccuaaauuauuuacu

SEQ ID NO: 1319525 - RNA, 18 nt, Human
cuuugacaauugggagcu

SEQ ID NO: 1319526 - RNA, 21 nt, Human
cuuugacaauugggagcugcc

SEQ ID NO: 1319527 - RNA, 23 nt, Human
cuuugacaauugggagcugccaa

SEQ ID NO: 1319528 - RNA, 22 nt, Human
cuuugacaauugggagcugcca

SEQ ID NO: 1319529 - RNA, 14 nt, Human
gaaaacaaggauga

SEQ ID NO: 1319530 - RNA, 13 nt, Human
gaaaacaaaacug

SEQ ID NO: 1319531 - RNA, 12 nt, Human
gaaaacaaggaa

SEQ ID NO: 1319532 - RNA, 19 nt, Human
gaaaaauauauacuaaaca

SEQ ID NO: 1319533 - RNA, 16 nt, Human
gaaaaauauguaccaa

SEQ ID NO: 1319534 - RNA, 16 nt, Human
gaaaaaucuaagugau

SEQ ID NO: 1319535 - RNA, 16 nt, Human
gaaaaauuccacucaa

SEQ ID NO: 1319536 - RNA, 22 nt, Human
gaaaaauugcugacuguagcuu

SEQ ID NO: 1319537 - RNA, 21 nt, Human
gaaaaauugcugacuguagcu

SEQ ID NO: 1319538 - RNA, 19 nt, Human
gaaaauaacaauaaaagac

SEQ ID NO: 1319539 - RNA, 15 nt, Human
gaaaaguauguucua

SEQ ID NO: 1319540 - RNA, 22 nt, Human
gaaaagucaaggguaggguggg

SEQ ID NO: 1319541 - RNA, 19 nt, Human
gaaaaguauguucuaaccu

SEQ ID NO: 1319542 - RNA, 14 nt, Human
gaaaaguauguuag

SEQ ID NO: 1319543 - RNA, 17 nt, Human
gaaaagguuuaugaaaa

SEQ ID NO: 1319544 - RNA, 22 nt, Human
gaaaagguuuaugaaaaagaag

SEQ ID NO: 1319545 - RNA, 23 nt, Human
gaaaagguuuaugaaaaagaaga

SEQ ID NO: 1319546 - RNA, 20 nt, Human
gaaaaguauguuagugcaaa

SEQ ID NO: 1319547 - RNA, 20 nt, Human
gaaaaguauauugauaaccu

SEQ ID NO: 1319548 - RNA, 13 nt, Human
gaaaaguauguuc

SEQ ID NO: 1319549 - RNA, 17 nt, Human
gaaaacauuccauccuu

SEQ ID NO: 1319550 - RNA, 20 nt, Human
gaaaacccccaaaccagaua

SEQ ID NO: 1319551 - RNA, 17 nt, Human
gaaaacccuugggccag

SEQ ID NO: 1319552 - RNA, 20 nt, Human
gaaaacccuugggccagaag

SEQ ID NO: 1319553 - RNA, 22 nt, Human
gaaaacccuugggccagaagua

SEQ ID NO: 1319554 - RNA, 21 nt, Human
gaaaacccuugggccagaagu

SEQ ID NO: 1319555 - RNA, 13 nt, Human
gaaaacauuccau

SEQ ID NO: 1319556 - RNA, 14 nt, Human
gaaaacaaggaagu

SEQ ID NO: 1319557 - RNA, 11 nt, Human
gaaaaccuuuc

SEQ ID NO: 1319558 - RNA, 15 nt, Human
gaaaaccuuucuuca

SEQ ID NO: 1319559 - RNA, 23 nt, Human
gaaaagguagaggagucacguua

SEQ ID NO: 1319560 - RNA, 20 nt, Human
gaaaagguucuuacugcuug

SEQ ID NO: 1319561 - RNA, 18 nt, Human
cuuuuuuaaaugaagaaa

SEQ ID NO: 1319562 - RNA, 14 nt, Human
cuuuuugcagcuuu

SEQ ID NO: 1319563 - RNA, 13 nt, Human
cuuuuugcagcuu

SEQ ID NO: 1319564 - RNA, 13 nt, Human
cuuuuugcuuucg

SEQ ID NO: 1319565 - RNA, 12 nt, Human
cuuuuugcagcu

SEQ ID NO: 1319566 - RNA, 14 nt, Human
cuuuuugaggcaaa

SEQ ID NO: 1319567 - RNA, 15 nt, Human
cuuuuugaggcaaaa

SEQ ID NO: 1319568 - RNA, 20 nt, Human
cuuuuugaggcaaaagaagg

SEQ ID NO: 1319569 - RNA, 16 nt, Human
cuuuuugaaguauuua

SEQ ID NO: 1319570 - RNA, 17 nt, Human
cuuuugacaaaggcaag

SEQ ID NO: 1319571 - RNA, 16 nt, Human
cuuuuguuuccuuuuu

SEQ ID NO: 1319572 - RNA, 13 nt, Human
cuuuuguuuauuu

SEQ ID NO: 1319573 - RNA, 19 nt, Human
cuuuuuaaaaauagacacu

SEQ ID NO: 1319574 - RNA, 13 nt, Human
cuuuuuauuucug

SEQ ID NO: 1319575 - RNA, 16 nt, Human
cuuuuuauuucugcau

SEQ ID NO: 1319576 - RNA, 13 nt, Human
cuuuuuauuugca

SEQ ID NO: 1319577 - RNA, 14 nt, Human
cuuuuuauuugcau

SEQ ID NO: 1319578 - RNA, 15 nt, Human
cuuuuuauuugcaug

SEQ ID NO: 1319579 - RNA, 20 nt, Human
cuuuuucaaugaauuuuaua

SEQ ID NO: 1319580 - RNA, 18 nt, Human
cuuuucuucuauugccuc

SEQ ID NO: 1319581 - RNA, 19 nt, Human
cuuuucuucuauugccucu

SEQ ID NO: 1319582 - RNA, 23 nt, Human
cuuuucuucuauugccucugaga

SEQ ID NO: 1319583 - RNA, 16 nt, Human
cuuuucuguucuaguu

SEQ ID NO: 1319584 - RNA, 17 nt, Human
cuuuucuguucuaguuu

SEQ ID NO: 1319585 - RNA, 15 nt, Human
cuuuucuuaaaccuu

SEQ ID NO: 1319586 - RNA, 16 nt, Human
cuuuucuuaaaccuuc

SEQ ID NO: 1319587 - RNA, 14 nt, Human
cuuuguuuuguguc

SEQ ID NO: 1319588 - RNA, 17 nt, Human
cuuuguuuugugucucu

SEQ ID NO: 1319589 - RNA, 18 nt, Human
cuuuguuuugugucucuu

SEQ ID NO: 1319590 - RNA, 15 nt, Human
cuuuguuuuauuuuc

SEQ ID NO: 1319591 - RNA, 16 nt, Human
cuuuguuuuauuuuca

SEQ ID NO: 1319592 - RNA, 19 nt, Human
cuuuguuuugcacacuuug

SEQ ID NO: 1319593 - RNA, 23 nt, Human
cuuuguuuugcacacuuugccau

SEQ ID NO: 1319594 - RNA, 17 nt, Human
cuuuguuuuacugucuu

SEQ ID NO: 1319595 - RNA, 17 nt, Human
cuuuguguagcuuugcu

SEQ ID NO: 1319596 - RNA, 15 nt, Human
cuuuguuggagucaa

SEQ ID NO: 1319597 - RNA, 21 nt, Human
cuggauuccccaucucaggcc

SEQ ID NO: 1319598 - RNA, 12 nt, Human
cuggauuuucag

SEQ ID NO: 1319599 - RNA, 15 nt, Human
cuggauuuuuaccag

SEQ ID NO: 1319600 - RNA, 14 nt, Human
cuggauuuuuacca

SEQ ID NO: 1319601 - RNA, 12 nt, Human
cuggcaaugcca

SEQ ID NO: 1319602 - RNA, 15 nt, Human
cuggcaaugccacag

SEQ ID NO: 1319603 - RNA, 19 nt, Human
cuggcaaugccacagcccu

SEQ ID NO: 1319604 - RNA, 20 nt, Human
cuggcaaugccacagcccug

SEQ ID NO: 1319605 - RNA, 21 nt, Human
cuggcaaugccacagcccugu

SEQ ID NO: 1319606 - RNA, 12 nt, Human
cuggcacagagg

SEQ ID NO: 1319607 - RNA, 13 nt, Human
cuggcacagaggu

SEQ ID NO: 1319608 - RNA, 14 nt, Human
cuggcacagccugg

SEQ ID NO: 1319609 - RNA, 17 nt, Human
cuggcacagggcagugg

SEQ ID NO: 1319610 - RNA, 13 nt, Human
cuggauuccagag

SEQ ID NO: 1319611 - RNA, 20 nt, Human
cuggauuccccaucucaggc

SEQ ID NO: 1319612 - RNA, 21 nt, Human
cuggauuccagagcacugcuc

SEQ ID NO: 1319613 - RNA, 16 nt, Human
cuggauuauucugggg

SEQ ID NO: 1319614 - RNA, 17 nt, Human
cuggauuauauuaugaa

SEQ ID NO: 1319615 - RNA, 23 nt, Human
cuggauuauucaaaaugauguau

SEQ ID NO: 1319616 - RNA, 15 nt, Human
cuggauggggcaggc

SEQ ID NO: 1319617 - RNA, 17 nt, Human
cuggauggggcaggcca

SEQ ID NO: 1319618 - RNA, 24 nt, Human
cuggauggggcaggccaccuggcu

SEQ ID NO: 1319619 - RNA, 15 nt, Human
cuggauguaccacca

SEQ ID NO: 1319620 - RNA, 13 nt, Human
cuggauggggcag

SEQ ID NO: 1319621 - RNA, 21 nt, Human
cuggauggaggaaaaccaagc

SEQ ID NO: 1319622 - RNA, 12 nt, Human
cuggaggagccc

SEQ ID NO: 1319623 - RNA, 13 nt, Human
cuggaggagccca
